United States Patent 9,675,668 (MODIFIED POLYNUCLEOTIDES ENCODING HEPATITIS A VIRUS CELLULAR RECEPTOR 2) - sequence listing, part 24

SEQ ID NO: 50940 - DNA, 3534 bp, Artificial Sequence
  Description of Artificial Sequence: Synthetic coding sequence
atggtgtcatcagggtgccggatgaggtctctgtggtttatcattgtgattagcttcctccctaacacagagggcttcagtcgggcagcccttcctttcggattggtgcgccgagaattgagttgcgaagggtatagcattgacctgagatgccctggttcggatgttataatgatcgagtcggccaattatggtaggaccgacgataagatctgtgacgcagatcccttccagatggagaatacagactgctaccttcccgatgcatttaaaatcatgactcagaggtgtaacaatagaacccaatgtatcgtcgtgacagggtctgacgtgttccccgacccttgtccaggtacatataagtacctggaggtccagtatgagtgtgtcccctacatctttgtatgtcctgggaccctgaaggccattgtcgatagcccttgcatctacgaagccgagcagaaagcaggagcatggtgcaaggatccgttgcaggctgccgacaaaatctactttatgccttggacgccataccggaccgacactttgatagagtatgcctcccttgaggacttccaaaattcacgacagacaaccacttacaagctgcccaatcgcgttgacggaactgggttcgtcgtgtacgatggtgccgtattctttaataaggaacgcacaagaaatattgtcaagttcgaccttcggaccagaattaaaagtggtgaagccatcatcaattacgccaactaccatgacacttcaccttatcggtggggcggtaagacggacatagacttggccgttgatgaaaacggcctctgggtcatatacgccacagagcagaacaacggtatgatcgttatatctcaattgaacccatatacgctcagattcgaggcgacgtgggagactgtgtatgataaaagggccgcatccaatgccttcatgatctgcggggtgttatacgtggtgaggtcagtgtaccaggacaacgagtcagagacggggaaaaacagtatcgattatatctacaacacccggttaaaccgcggagaatacgtcgatgtgccattcccgaatcagtatcagtatatcgccgcagtcgattacaaccccagagacaaccagctgtatgtttggaataacaacttcattctgagatattcactggagtttgggcctcctgacccggctcaagtgcctacaacagccgtcaccattactagctccgcagagctgtttaaaactatcatctccaccacatcgaccacaagccagaaaggacccatgagcacaactgtggcaggctcccaggagggcagcaaggggacaaaacccccaccggcagtgtccaccaccaagatcccccctatcactaacatctttcccctgcctgagagattctgcgaggctctagactcgaaaggaatcaaatggccccagacccagcgaggcatgatggtcgagagaccttgtcccaagggtacgcgcggaaccgcctcatacctatgcatgatttcaaccggcacttggaatcctaaagggccagatctgagcaactgcacttctcactgggttaaccagctagcgcagaagattcggtccggagagaacgctgctagtcttgctaatgaactcgcgaaacacacaaaaggacctgtgtttgcaggagatgtgtcgtcatctgtcagacttatggagcaacttgtcgatatcctcgacgcccagttgcaggagctgaaaccaagcgaaaaagactcggcagggcgatcctacaacaaagctatcgttgacactgtggacaacctgctacggccagaagcgctggaatcctggaaacacatgaacagttctgagcaggcccacaccgctacaatgctcctagacactctagaggaaggcgcattcgtccttgctgacaatcttctggagccaacgagggtatccatgcccacggaaaacatagtgcttgaagttgccgtcctcagcactgagggccagattcaggatttcaagtttcccttgggcattaagggagccggaagttcgatacagctgtctgccaacacggtgaaacagaatagccgcaacgggcttgccaagcttgtcttcatcatctatcgaagcctgggtcaattcctgagtaccgagaatgccactatcaagttgggtgccgatttcatagggagaaactcgaccatcgcagtgaattcacacgtgatttcggtctctataaataaagagtcctctagagtgtatctgactgaccccgtgctgttcacactgccccatattgaccccgataactactttaatgctaactgttccttctggaactattccgagcgcacaatgatgggctattggtccactcaaggctgtaaattggtggacacaaacaagaccaggactacatgcgcttgctcccacctaaccaactttgcgattttaatggctcatagggaaatcgcttataaggatggggtgcacgagctcctactgactgtcatcacgtgggtggggatcgtcatcagtttagtttgtctcgcaatttgcatcttcaccttttgttttttcaggggcttacagtccgacaggaacaccatccacaagaacttgtgcatcaacctattcattgccgagttcatcttcctgatcggaatcgacaaaactaagtatgcgattgcctgcccaatatttgccggtctgctccatttttttttcctggccgcttttgcctggatgtgtttggagggagtccagctgtatttgatgctcgtggaggttttcgagtccgagtatagccgcaagaagtactattatgtggccggatatctctttccggcaaccgtggttggcgtgtcagcagcaatcgactataaaagttacggcacagagaaggcctgctggctgcacgttgataactattttatctggtccttcatcggtcctgtgacctttataatcctgcttaatattatcttcctggtcatcactttatgcaaaatggttaagcatagcaatacactgaagcctgattcctctaggctggagaatattaagagctgggtgctgggcgcttttgctttgctgtgtctgttgggtcttacatggtcctttggccttctgtttattaatgaagagactatagtgatggcctatctgttcacaatttttaatgcatttcagggtgtgtttatttttatcttccactgcgctttacagaaaaaggtgcggaaagagtatgggaagtgcttccggcatagctattgctgcggtgggctgccaaccgagagtcctcatagttcagtcaaagcaagcaccacaaggacttccgcccgatacagttcaggcactcagagtcgcattaggcggatgtggaacgatacagtgaggaagcagagtgagagctcgttcatctctggagatatcaattccacctccaccctgaaccaaggactcaccagccacggcctgagagctcacttacaggatctgtatcacctggagctcctcctagggcaaatcgcttag

SEQ ID NO: 50941 - DNA, 4425 bp, Artificial Sequence
  Description of Artificial Sequence: Synthetic coding sequence
atggtgtcctcaggatgcagaatgaggtctctctggttcatcattgtcatctcttttcttccaaacaccgaggggtttagtagagctgccctccctttcgggctcgttaggagagagctttcttgtgagggctacagcatcgacctgagatgccccggttccgacgtcattatgatcgagtccgccaactacggccgtacagacgacaaaatttgcgacgcagatcctttccagatggagaataccgactgctacttgccggatgccttcaaaatcatgacccagcgctgtaacaacaggacccagtgtatcgtggtgacggggagcgacgtatttcccgatccatgtcctggcacgtacaagtacctcgaagtgcagtacgagtgtgtgccgtatatcttcgtttgtccaggcaccctaaaggccattgtggattccccctgcatctatgaagccgagcagaaagctggagcctggtgcaaggacccacttcaagcagcagataagatttatttcatgccgtggaccccctatagaactgatacgctgattgagtacgcctccttagaggattttcagaacagccgccagacaactacatacaagctcccaaatagagtggatggcactggtttcgtggtgtacgacggcgctgtcttcttcaataaagaaaggacgcgaaatatcgtcaagtttgatttgcgcactcgcataaagtcaggggaggcaataattaattatgcaaactatcatgataccagtccatacaggtggggtggtaagaccgatatcgacttggcagttgacgaaaatggactatgggtgatctatgctacggaacagaataacggaatgatagtgatttcacaactgaacccctataccttgcgctttgaagcaacttgggagacggtctacgacaagcgtgctgcgtcaaatgcgtttatgatctgcggggtcctctacgttgtgagaagcgtctatcaagacaacgagtctgaaactgggaaaaattctatcgattatatctacaataccaggctgaatcgaggggaatatgtggacgttcccttccccaatcagtatcagtacatagctgctgttgattataacccccgagacaatcagttatacgtgtggaataacaatttcatcctccgttatagtctagaatttggaccgcctgacccagcccaggttcctaccaccgcagtgacaatcactagctctgccgagctgtttaagactatcatcagcaccacttctactacctctcagaaagggccaatgtcaactacagtagctggctctcaggaaggaagcaaaggcactaaaccccctccagcggtgagtaccacaaaaattccaccaattactaacattttccctctgcccgagcgattttgtgaggctttggactccaaaggaatcaaatggccacagacccagcgcggaatgatggtggaaaggccctgccccaaaggtacgaggggaacagcatcttatttgtgtatgatcagtacaggaacctggaatcctaaaggtcccgatttgtctaactgcacgtcgcactgggttaaccagctggctcagaagattcgatcgggagaaaatgcagcatcgctggccaacgagctggccaagcacacaaagggcccagtcttcgcaggcgatgtgagttcgtcagtgcggctgatggaacagctcgttgatattcttgatgcccaattgcaggagctgaaacccagtgagaaggattctgcaggcagaagctacaataagttacaaaaacgcgagaagacctgccgagcctatctgaaggccatcgtggatacggttgataacctgctacgacccgaggctctcgaatcatggaaacacatgaacagcagtgaacaggcccacacagctacaatgctactcgatactttagaggaaggcgctttcgtccttgctgataacttattggaaccaacgcgggtgtcaatgcccaccgagaacatagtcctggaagtcgccgtgctctccacggagggccagatacaggactttaagttccccttagggattaaaggggcaggaagctctatccagctctcggccaacacggttaagcagaacagcaggaacggtttggcaaaactcgtgttcatcatttaccgatcccttggccagtttctgtccactgagaacgccacgatcaaactgggcgctgacttcattggccgtaacagcacgatcgccgtgaactcacatgtgatcagtgtgtctattaacaaagagagctctcgcgtctacctgactgaccctgtgctattcacacttccccacattgaccctgacaattatttcaatgcgaattgttcattctggaattacagcgagcgcacaatgatgggttactggagcacacagggctgtaagttggtagatacgaacaaaaccaggaccacatgcgcttgttcacacttgactaatttcgcaattctcatggcacacagggaaatcgcgtacaaggacggcgtgcacgaactgcttttgacagtaatcacttgggtgggtattgttatctctctggtttgtttggccatctgtatatttactttttgcttcttcaggggcctccagagtgaccgaaatacaattcacaagaacctgtgcatcaatctgttcatcgccgaattcatcttcctgataggcatcgataaaacgaagtacgccatcgcatgcccaatcttcgctggcctattacacttcttttttttagcggctttcgcgtggatgtgcctggagggtgttcagctctacctgatgctcgtcgaggtgtttgaaagtgagtacagtcgtaaaaagtattattacgtggccggttatttgtttccagctactgtggtcggggtgtctgcagccatcgactataaatcctacggcactgagaaagcctgctggctgcatgtggataactactttatctggagctttatcggacctgtgacatttattatcttattaaatatcatcttcctagtgattactctgtgtaagatggttaagcacagcaataccctgaagccggattcatctagattagagaacatcaacaattatcgggtgtgtgacggctattacaacactgacctgcccggaagttgggtgctcggcgctttcgccctcttatgcctactgggcttgacctggtcctttgggctgctgtttataaacgaagaaacaatcgtcatggcctacctcttcacgatcttcaacgcctttcagggcgtgttcatcttcattttccactgcgccctgcagaagaaagtgcgcaaggagtatggcaagtgtttcagacacagttactgctgcggaggcctgcccactgagagtcctcactcgtcggtgaaggctagtacaaccaggacatcagctagatactcttcaggcactcagagccggatccgcaggatgtggaacgacaccgtgagaaaacagtccgaaagctctttcatctcaggtgatataaatagcacttcaacattaaatcagggcatgacgggtaattacctgctcacaaatccacttctgagaccccacggaaccaacaacccttataatacattgctggcagagacagtggtatgcaatgctccttccgccccagtgtttaatagtcccggacacagcctgaataatgcgagggatacttctgctatggatactttgccgctgaacgggaatttcaacaactcttactctctccacaaaggggactataacgactctgtccaggtagtggattgcggattgtctctgaacgatacggcatttgaaaaaatgattatcagcgaactcgtccataacaatctgcggggatcgagtaaaacccataatcttgagctgacacttcccgttaagccagttataggaggcagcagctccgaggatgacgcgattgtggccgacgcgtcttccctgatgcactcggataatcccggacttgaactccaccataaagagctggaggcccctctgataccccagcggactcattcacttttgtatcaacctcagaaaaaagtcaagtccgaaggtacggatagttacgtatcccagctcaccgcggaggctgaggaccacctgcagagccccaatagagacagcctgtatacctctatgccaaacttgagagacagcccttaccccgagtccagcccagacatggaggaggatctgagtcctagcagacgatcggaaaacgaggacatttattacaagtctatgccaaacctgggtgccggacaccaactccaaatgtgttatcagatctcacggggaaatagcgatggctatatcatccctataaataaggaggggtgcattcctgagggagatgtccgcgagggccagatgcagttagtgaccagcctgtag

SEQ ID NO: 50942 - DNA, 4155 bp, Artificial Sequence
  Description of Artificial Sequence: Synthetic coding sequence
atggtgtctagtggctgccgtatgagatctttatggtttatcatagttatctcctttctacccaatacggaagggtttagccgcgctgcactgcctttcggactggtaagaagggaattaagctgtgaaggatatagcatagatctccggtgtcctggttccgatgtcataatgatcgaatccgctaactatggacgaacggatgacaagatctgtgacgctgacccattccagatggagaacaccgattgctacctacccgacgcatttaagatcatgacccagcgctgcaacaatcggacacagtgtatcgtagtgaccggcagcgacgtattccctgacccctgtcccggaacctataaatacctggaggtccagtacgagtgtgtaccgtatatggaacagaaagtgtttgtttgccctgggacccttaaagcaatcgtggattctccttgtatctatgaagcggaacaaaaagccggagcctggtgcaaagaccctctgcaggcggcagacaagatctactttatgccttggacaccttaccgaaccgacacattgatagaatacgctagtttggaggacttccaaaatagcagacagacaacaacatataaacttcccaatagagtggacggaaccggtttcgtggtgtacgacggggctgtgttttttaacaaggagaggacacgtaatatcgtgaaattcgaccttaggactcggataaagtccggagaagccataattaattacgccaactatcacgatacatccccctaccgctgggggggaaaaaccgacatcgacctagctgtagatgaaaatggcctgtgggttatttacgccacagagcagaacaacggcatgatcgtcatcagtcagctgaatccttatacactaagattcgaggctacctgggaaactgtttatgacaaacgggctgccagcaatgcttttatgatatgtggcgtgctgtatgtggtcagaagcgtataccaggacaacgagagcgagaccggcaagaacagtatcgactacatttataacacccgcctcaatcgcggagaatatgtcgacgtccctttccctaatcaatatcaatatatagcagccgtggactataatccccgagataaccaattgtatgtctggaataataattttattctcagatactccctggagttcgggccaccagatcctgctcaggaaagattctgtgaggcattggactccaagggtattaagtggccacagacacaacgtggaatgatggtggagcggccatgtcccaagggcacgagaggcaccgcctcatatttatgcatgattagcacaggcacgtggaaccccaaaggacctgatctttctaactgcacctctcactgggttaaccagttggcccaaaagatccgctccggcgaaaatgctgcaagccttgccaacgagctggcaaagcatacaaaaggtcccgtgtttgccggagacgtgtccagttccgttagacttatggagcagctggtcgatattctcgacgcgcagttgcaagaactcaagccgagcgaaaaagactcagctgggagatcctataataaagcaattgtggacaccgtagataaccttctgaggccagaggccttggaatcctggaaacatatgaacagttcagaacaggctcacaccgctacaatgttgctcgatacacttgaggaaggagcgtttgtgcttgccgacaatctgctcgaaccaacccgcgtgagtatgcctaccgagaacattgtactggaggtggcagttttatccaccgagggacagattcaagactttaagttccccctaggcattaagggagcgggtagcagcatccagctaagtgccaacacagttaagcagaatagcaggaacggtttggcaaagttggtttttataatctataggtcccttgggcagtttctgtctacagagaatgctactatcaaacttggcgctgacttcatcggccgtaacagtacaattgctgtcaacagccatgtaatctccgtatccattaataaggagagttctcgagtgtacctgacagatccagtgttgtttactctgccacacattgacccagataattatttcaatgcaaactgtagtttttggaactactccgagcggacaatgatgggatattggtccactcagggatgtaagctggtggacacaaataagaccaggactacttgcgcttgctcacaccttacaaatttcgcaattcttatggcacaccgagagatagcctacaaagacggtgtgcacgagctgctcctgaccgttattacttgggtcgggatagtgatttcactggtgtgcttggctatctgcatctttaccttctgtttctttcgagggcttcagtcagatcggaataccattcacaaaaacttgtgcataaatctttttatcgcagaatttatatttctgataggtatcgacaaaaccaaatacgcgatagcctgtcctatttttgccggattgctgcatttcttcttcctcgcagcctttgcatggatgtgcctggaaggagtacaattgtatctgatgctcgtcgaggtgttcgaatcagagtattccagaaagaagtactactatgtcgcaggatacctgttccccgcaaccgtggttggcgtgagtgcggcaatcgattacaagtcgtacggaactgaaaaggcctgttggctgcacgtggataactatttcatctggagcttcatcggacccgtgacatttattatcctgctgaacattatttttctcgtgattacactgtgcaaaatggtgaagcattccaacacattgaagcctgactcttcccgtttagaaaatattaagagttgggtgttaggggcattcgccttactctgcctccttggtctgacgtggagctttggtttgctctttattaacgaggagactatcgtgatggcctacttgtttacaatctttaacgctttccagggggtgttcatctttatctttcactgcgctctgcagaaaaaagtgcggaaagaatatgggaagtgtttcaggcactcttattgttgcgggggtctgcccacagagtcacctcactctagcgtcaaggcatcaacaaccagaaccagtgccaggtatagcagcggcacacagtctagaatacgacggatgtggaatgacaccgtgcggaaacagtccgaaagctccttcattagcggagatatcaacagtaccagtactctcaaccaggggatgactggaaactatctcctcaccaatcctctgcttagaccacatgggacaaataatccctacaataccttgttggccgaaaccgttgtctgcaacgcaccttccgctccggtcttcaatagccctggacatagcttgaacaacgccagggacacctcagcaatggataccctgcctctgaatggcaatttcaacaatagttattcattgcacaagggggactacaatgatagcgtacaggtggttgattgcggcctgtcactgaatgacactgccttcgagaagatgatcattagcgagctcgtccacaataacctcagaggttctagcaaaacgcacaatctggagctgaccctcccagtcaaacctgtaattgggggttccagctccgaggacgatgccatcgttgccgatgcctctagcttaatgcactctgataatcctgggctggaactccaccacaaggagctggaggcgcctctcatccctcagaggactcacagccttctctaccagcctcagaagaaagttaagtcggaggggactgacagctatgtgagccagctgaccgctgaggccgaggaccacctgcagtcccctaacagggattctttgtacacaagcatgccgaatcttcgggatagtccttaccctgaatcctctcccgacatggaagaagatctctcgccctccagacgctccgaaaacgaggacatttattacaagtcgatgcccaatttgggcgcaggccaccagctccaaatgtgctatcagatttcacgcggtaattcagacgggtacattattccaattaataaagaaggatgcattcctgagggggacgtgagggaaggacagatgcaactcgtcacatcactgtag

SEQ ID NO: 50943 - DNA, 4386 bp, Artificial Sequence
  Description of Artificial Sequence: Synthetic coding sequence
atggtttcatcaggttgccggatgaggagcctgtggtttattattgtgatatcgttcctgccgaatacagaggggttctcacgggcagctctgccctttggtttggtgcgcagggagctgtcctgcgaggggtacagcatcgaccttcggtgtccagggtctgatgtcattatgattgaaagcgctaactacggtaggaccgacgataagatctgtgacgctgatccttttcagatggagaatacagactgttacttacctgacgccttcaagattatgactcaacgctgcaataatcggacccagtgcatagtggttacggggtccgacgtgttccccgatccttgtcctgggacgtataaataccttgaagttcagtacgagtgcgtaccatacatcttcgtgtgtcccggtactttaaaggccatcgtggattctccttgtatttatgaggctgagcagaaggccggtgcctggtgtaaagacccactccaggctgcggacaagatttacttcatgccctggaccccttacagaacagatacacttattgagtacgccagcctggaagacttccagaatagtcggcagacaaccacttataagctccctaatcgggtagatggcaccggatttgtggtgtatgacggcgcagtcttctttaacaaagaacgcactcgcaatatcgtgaagttcgatctgcgcacacgcattaaaagcggcgaggccatcataaattacgcaaactatcatgatacttctccgtacaggtggggtggcaagacagatatcgacctcgcggtggatgaaaacggcttgtgggtgatttacgctaccgagcaaaataacgggatgatagtgatctcccaactcaacccatacacgctacggttcgaagctacatgggagaccgtctacgataagagggctgcctctaacgcctttatgatatgcggagtgttgtatgtggttagaagcgtgtaccaggataatgagtccgagacgggcaaaaatagcattgactatatctacaacacacgccttaaccggggtgagtatgtagacgtaccctttcctaaccaataccagtacattgccgcagtcgattataaccccagggataaccagctgtacgtgtggaataacaattttatccttcgctattctctggaattcggcccacctgaccctgctcaggttccaacaacagccgtcacaattacaagttccgcagagctgtttaagactattatttcaactacctcgactactagtcagaaaggcccaatgagcacaacagtggcaggctcccaggaagggtctaaggggactaagccgcctccagctgtctctacaacaaagattccccctatcactaacattttcccgctgccggagcgcttttgtgaggctttggattcaaaaggaattaagtggccgcagacccagcgcggaatgatggtggaacgcccttgccccaaaggaaccagaggcacagctagctatctatgcatgatcagcaccggcacatggaaccctaagggtccagatctgtccaactgcacctcccactgggtgaatcaattggctcagaaaatcaggtctggggaaaatgccgcttctctggctaatgaactcgcaaaacatacaaaaggaccggtctttgccggagacgtgtcaagttctgttcgcctgatggaacagctcgttgacatactcgatgcgcaactgcaggagttaaaaccatccgagaaggattcagccggtaggagctataacaaagcaatcgttgatacagtggataacctgctcagacccgaggcactcgaatcgtggaagcacatgaattcatctgaacaagcccacacagctactatgctgcttgatacactcgaagaaggcgcattcgtgctcgctgacaatcttctcgaacctaccagagtgtccatgcctacagaaaacatcgtcctggaggtagctgtgctaagcacagagggccagatccaggactttaaatttccacttggaattaagggcgctggcagcagtattcagctcagtgcaaacaccgtgaagcagaactcacgaaacggcctggcaaagctcgtcttcataatctatcgcagtctgggccaattcctgtccactgaaaacgctacaataaagcttggtgcagatttcattgggcgtaattcgactatcgccgttaactcacacgtcatctctgtgagtatcaataaagaatcttcacgggtgtaccttaccgatccagtcctcttcacgctaccacatatcgatcccgacaactatttcaacgccaattgtagcttctggaactactccgaacggacaatgatgggttattggtccacacaggggtgtaaactggtcgacactaacaaaacacggactacctgcgcgtgctctcatctcacgaacttcgccattctcatggcgcatcgtgaaatagcatataaagacggagtgcacgagcttttactgaccgtgattacgtgggtggggatagtaatttcgctcgtgtgccttgctatctgtatttttaccttttgtttcttccgcggtctgcagagcgacaggaatacaatccataagaacctgtgcatcaacctgttcatcgccgagttcatctttcttattggaattgacaagaccaagtatgcaattgcttgtcccatctttgccggactgcttcactttttttttctcgcagccttcgcttggatgtgcttagagggcgtgcagctttatctcatgttagttgaggttttcgagtctgaatacagcaggaagaagtactactacgtggccggatatctgttccccgctacagtggttggagtttctgcggcaattgattacaaatcctacggcactgagaaagcgtgctggctgcacgtcgacaactacttcatttggtcttttatcggacctgtgacctttattattctgctgaacatcatttttcttgtgatcacgctgtgtaagatggtgaagcattcaaacactctgaagcctgatagcagtcgtcttgaaaacatcaacaactatcgagtttgtgacgggtactataacactgacctcccgggatcctgggtcctaggtgccttcgctctcctctgcctcctgggtttaacttggagtttcggcttgctattcattaacgaggaaaccatcgtgatggcctatctgttcacaatcttcaatgcttttcagggagtgtttatatttatatttcactgcgcgctgcagaagaaggttcggaaggagtacggaaaatgttttcgccactcttactgctgtggcggattacccacagaaagcccccatagtagcgtgaaggcctctaccactcgcaccagtgcccgttactcaagcggcacacagtctaggattcgacggatgtggaacgacacggtccgcaaacagtcagagtccagtttcatcagcggcgatatcaattcaacaagtacactcaaccagggaatgacaggcaactatcttctaaccaatccgctccttcgaccacacggcacgaacaacccctacaataccctgttggctgagaccgtagtgtgtaacgccccttccgcacctgtattcaactctccagggcacagtctcaacaatgccagagacacctcggcgatggacaccctgccacttaacgggaatttcaacaattcctactctctccataagggagattacaatgattccgtgcaagttgtcgattgcggacttagcctaaatgatacggcctttgaaaagatgattattagcgaattagttcacaataaccttcgcggttcatccaagacccataatttagaactcactcttcccgtcaaacctgttatcggcggatcgagctccgaggacgatgccatcgttgcggatgcaagctcgctcatgcatagtgacaacccaggactggagttgcatcacaaagaactggaggccccactgatcccacaacgtactcactcgttgctgtaccagcctcagaagaaagtgaaatcagaaggaactgacagctatgtcagtcagttgacagccgaggcggaggaccatctgcagtccccaaacagggactctctgtacacttcaatgccaaatctccgcgactcaccctacccagaaagctccccagacatggaggaggatctgtcgccctcccggcgaagtgaaaacgaagacatctattataagagcatgcccaacttgggcgcaggccaccagctccaaatgtgttatcaaatctctagaggcaattccgacgggtatatcatcccaataaacaaagagggttgtatcccggagggcgatgtccgcgaggggcagatgcagcttgtcaccagtctttag

SEQ ID NO: 50944 - DNA, 4425 bp, Artificial Sequence
  Description of Artificial Sequence: Synthetic coding sequence
atggtgtcgagcggctgccgaatgagatctctgtggttcattattgtaatatccttccttcccaacacagagggcttttcccgcgcagcactaccattcggactcgtgcgcagggaactcagttgcgaaggatatagtatcgacttgcggtgtcccggttccgacgtgataatgatagagtccgccaactatgggaggacagacgataaaatctgtgacgccgaccctttccaaatggaaaacaccgactgctacctgcctgatgctttcaaaattatgacacagcggtgcaataaccggactcagtgcattgtggtgacaggaagcgacgtgtttccggacccctgtcccggtacatacaagtacctggaggtccaatacgagtgcgtcccttacattttcgtgtgtccagggaccctcaaagcgatcgtggattccccatgcatttacgaggctgagcaaaaagctggcgcttggtgtaaagacccactgcaagccgctgacaagatttacttcatgccctggacaccttaccgtaccgacacactgattgagtacgcatcactcgaggactttcaaaactcacggcagacaaccacgtacaagctgccaaatagggtggacggaacaggcttcgtcgtttacgatggcgcagtgttctttaataaggagcgcactaggaatatagtgaaattcgatttgcggacaaggatcaagtccggggaggccatcattaattacgccaactatcatgacactagtccctaccgctggggcggtaaaaccgatatagacctggccgtggacgagaacggattgtgggtcatttacgccaccgaacagaacaacggtatgatcgtgatcagccagctcaacccctatactctgcgttttgaggccacgtgggagaccgtgtatgataaaagggctgcatctaacgcattcatgatttgtggagttctctacgtggtccggagtgtctaccaggacaacgaaagcgagacgggcaaaaacagcatcgactacatctacaataccaggctgaacagaggggaatacgtagacgtccctttccctaaccaatatcagtatatcgcggcagtggactacaatccacgcgacaatcagttatacgtgtggaacaacaattttatcctgcgctactctctcgaattcggccctcccgatccagcacaagtccccacaactgctgtgacgattacctcttctgccgaactcttcaagacaattatttccacaacctctactacttctcagaagggacccatgagcaccacagtggctggatcccaggaaggcagtaaagggacgaagcccccacctgccgtcagcactaccaagatcccaccaataacaaacatctttccgctacctgagcgtttctgcgaggctttggacagcaagggcatcaagtggccccaaacacagagaggaatgatggtggaacggccttgccctaaaggtaccaggggaactgcttcatacttgtgtatgatttccaccggaacctggaatcccaaggggccagacctctccaactgtacgtcccattgggtaaatcaactagctcaaaaaatacggagcggcgagaacgccgcatccttggctaatgagctggcgaagcatactaaggggcctgtttttgcgggagacgtaagcagctccgtgcgcctcatggagcagttggtagacatcctagatgcccagttacaggagctgaagcctagcgaaaaagactcagctggtagaagctataataagttgcaaaaacgggagaaaacatgcagggcgtacttgaaggccatcgtcgataccgtcgataacctcttacggccagaggcactagaaagctggaagcacatgaatagtagtgaacaggcgcacactgccacaatgctgctggacaccctggaagagggggcatttgtgctggcggacaatctgttggaacccacacgcgtatcaatgccaacagagaacatcgtgctcgaagtggccgtcctgtccacagaaggacaaatccaagactttaagttcccactggggattaaaggagcgggatcctccattcagttgagcgctaacacagtcaaacagaatagccgaaatgggttggctaaactggtgttcatcatttacaggtccctcggccagtttctgagcacagagaacgctaccatcaagctgggtgcagatttcattggtagaaattctacaatcgctgtaaactcccatgtgatcagcgtctccattaacaaggaatctagccgggtatatcttaccgaccccgtcttgttcaccctcccccacattgacccagacaactacttcaacgcgaattgcagtttttggaactattctgagaggacgatgatgggttactggtctactcaaggatgtaaacttgtcgacaccaacaagaccagaacaacctgcgcctgttcacatttaaccaattttgcgatcctcatggctcaccgggaaattgcctataaggacggcgtgcacgagttactgctgactgtaatcacctgggtcggcattgttatctcactcgtctgcctcgctatatgcatttttacattctgtttctttagaggcctccagagcgaccgcaatacaatccacaaaaatctttgtataaatctgttcatcgccgaatttattttcctgataggtatagacaaaactaaatacgccattgcctgtccgatctttgctggccttcttcactttttcttcctggccgctttcgcttggatgtgtctggagggagttcagttgtacctgatgctagtcgaagtattcgaaagcgagtactctcgcaaaaagtattattatgttgccggttacctattccccgctacagttgtcggtgtcagcgccgcaattgactataaatcttatggcaccgagaaagcctgttggctgcacgtggataactacttcatctggtcctttatcggtcccgtaacattcataatccttctgaacatcatcttcctggtcatcaccctttgcaaaatggttaaacactccaacacactgaaaccagatagctcgaggcttgagaacatcaacaactacagagtatgcgatggatattacaacaccgacctccccggatcctgggtgttaggtgcctttgctcttctttgtctcctcggactgacttggtcatttggcctgctttttattaacgaggagaccatcgtgatggcttacctcttcacaatcttcaatgcctttcagggtgtcttcatctttatttttcactgcgcccttcagaagaaagtgaggaaggaatatggcaaatgctttcggcactcctattgctgtggcggactgccaaccgagtcaccacactcctccgtaaaggcatcgactacccggacttccgccagatactctagtggcacacagtcaaggatccgccgaatgtggaatgacacagtacgtaaacaatctgagtctagctttatttccggggatattaattctacgagcaccctgaaccaaggcatgacaggaaactacctgctgactaaccccctgctcaggccccatggcaccaataatccctacaatacactgctcgctgaaacagtagtctgtaacgcccctagtgcccctgtatttaatagccccggtcattcactgaacaatgccagagatacctccgccatggacacattgcccctaaatggcaactttaataactcctatagtttgcataaaggcgactataacgacagtgtgcaggttgtggactgcggcctgagcctgaacgatactgcgtttgaaaagatgatcattagtgagcttgtccacaataatctgagaggaagtagcaagactcacaacctggagctcacactgcccgtaaaacctgtcataggagggtcctcgtcagaggacgacgccatcgtggccgacgcatcctccctcatgcatagtgacaacccaggtttagagctgcaccataaggaactcgaagctcctctcatcccccaaaggacccattctctcctgtaccagccacaaaagaaagtcaaatcagaaggtactgactcatatgtcagccagttgacagccgaagcagaagaccatcttcaatcaccaaaccgcgattccctgtatacctcgatgccgaatctgcgggatagtccatatcctgagtcgtctcctgatatggaggaagacctgtctccctcccgcagatccgaaaacgaagatatttattacaagagcatgccaaacttgggagccggtcaccaactccaaatgtgctatcagattagtcgcggaaactcagacgggtatatcatccccattaacaaggaagggtgtatcccagaaggagacgtcagagagggacaaatgcagctggttaccagcctgtag

SEQ ID NO: 50945 - DNA, 4296 bp, Artificial Sequence
  Description of Artificial Sequence: Synthetic coding sequence
atggtgtcttctggctgtcgtatgagatcactctggtttattatcgtgatctctttcttacccaacactgagggcttctcccgtgctgcactgcccttcggattggtgcggagagagttgagctgtgagggctactcgatcgatttacggtgtcccggatcggatgtcattatgatcgagtctgccaattatggcagaactgacgacaaaatctgtgatgcggacccattccaaatggaaaacaccgattgctatctgcccgatgctttcaaaatcatgacccagcgatgtaacaacaggacccagtgcatagtggtcactggtagcgacgttttccccgacccttgtccgggaacctacaaatatcttgaagtgcagtacgaatgtgttccatatatttttgtctgcccgggaacacttaaagctatagtcgatagcccttgcatttatgaggcagagcagaaagcaggggcttggtgcaaagaccccctgcaagctgctgataaaatctacttcatgccttggactccataccggactgacaccctaatcgagtacgcctccctcgaggattttcagaactcaaggcaaactacaacttataagctgcctaatagggtggacgggacgggcttcgttgtttatgatggcgcagttttcttcaataaggaacggaccagaaacatcgttaagtttgacctccgcaccagaatcaagtctggggaggccattatcaactatgccaattatcatgatacgtcaccctaccggtggggagggaagacggatatagacctggccgttgacgaaaacggtctgtgggtcatctatgcaaccgaacagaacaatggtatgatcgtcattagccaactgaatccttatactttgcggtttgaagcgacctgggaaacggtgtatgataagcgggctgccagcaatgcatttatgatttgcggagtgctgtatgtcgtgaggagcgtgtaccaggacaacgagtcagaaacggggaaaaattcaatcgactacatatacaatacacggctgaaccgcggagaatatgtggacgtacctttccccaatcaatatcaatatatagccgcagttgattataatcccagagacaaccagctatacgtgtggaacaataacttcattctcagatattccctagagtttgggccacccgatccagcccaggtgcctacaaccgcagtgacaataacctcaagcgcggagttatttaaaaccatcatctcaacaactagcacaaccagccagaaaggcccaatgagtacaaccgtcgccggatctcaggaaggctcaaagggcaccaagcctcctcccgcagtctctaccactaaaattccacccattacgaatattttccctctgcctgaaagattctgtgaagccctggactctaagggaattaaatggcctcagacgcagcggggaatgatggttgagagaccctgtcctaaagggactcgcggaactgcatcatacctgtgcatgataagtactggaacgtggaaccctaaggggcctgatctctcaaactgcacgtcacattgggttaatcagctcgcccagaagatccggagcggcgagaacgcagcctccttggccaacgagctggcgaagcacacaaaaggccctgtcttcgctggcgacgtctcatcctcagttaggttgatggagcagctggttgacatactcgatgcccagcttcaggagctgaaaccatcggaaaaagattccgccggacggtcatataacaaactacagaagcgagagaagacatgtcgggcatacctgaaggcgatcgtggatactgtagacaacctccttagacctgaggccctcgagagttggaaacacatgaactcctccgaacaggctcacactgccaccatgttgctagacacacttgaggagggcgcatttgtcctagccgataacctgctggagcctactcgcgtaagcatgcctactgagaacatcgtgcttgaggtggcagtgctgtcaactgagggacagatccaagacttcaaatttcccctgggaatcaagggcgctggatcttccattcaactcagcgccaatactgtaaagcagaactctaggaacggcctggccaagttagtattcattatttacagatctctaggccagttcttgtccaccgaaaatgccactatcaagcttggcgcagactttatcggacggaatagcacaatagcggtcaactcgcacgtgatttcagtgtccatcaacaaggaaagttctcgcgtctaccttacagatcctgtgctatttaccctgccccacatcgacccagacaactattttaacgcaaattgttcattttggaattattcagaacggacgatgatggggtattggtctacgcagggctgtaagctggtcgacactaataagaccaggacgacatgtgcttgcagtcatctgacaaactttgccatacttatggcgcatagagaaatcgcatacaaggacggcgtccacgagctgctgttaactgtcatcacatgggtcgggatcgttattagtctggtgtgtctcgccatatgcattttcactttctgcttcttccgaggcctgcagagcgacagaaataccattcacaagaacctgtgtatcaacttattcattgctgaatttattttcctgattggaatcgataaaactaagtatgctatagcgtgtccaattttcgccggtctgctgcatttttttttcctggctgcctttgcatggatgtgtttggagggagtgcagctgtatctcatgttggtggaggtctttgaatccgaatattcaagaaagaagtattattatgtggccggatatttgtttcctgccacagtggtcggcgttagcgccgctattgactataagtcctatggtacggaaaaggcttgttggctgcacgtggataattatttcatatggagctttattggcccagtgacttttatcatcctgcttaacattatctttctagtgatcacactttgtaaaatggttaagcactccaacactttgaagcccgacagttctagactagaaaatatcaataactatagagtttgcgacggatactacaacacagacctgcccggatcatgggtcttgggagcctttgctctcctctgtctgctggggttgacctggagcttcggactgctatttattaatgaggagaccatcgttatggcataccttttcaccatcttcaacgccttccagggcgtcttcatatttatttttcactgtgccttgcagaagaaagtccgaaaagagtacggtaaatgttttcggcacagctactgttgtgggggactgcccaccgagtctcctcactcttcagtcaaggccagtacaacaaggactagcgctagatattcaagcggaactcagtctcgaatacgcaggatgtggaacgatacggtccgcaagcagagcgagagctcttttatttcaggtgacatcaatagcactagcaccttgaatcaagggcattccctcaataacgccagagatacatccgctatggacacactaccgctgaacggaaacttcaataactcctattctctccataagggagactacaatgactcggtgcaggtggtggattgcggtttaagcttaaatgatactgcttttgagaagatgataatctcagaattagtgcataataatcttcgcggtagcagcaagactcataatttagaactgaccttgcctgtcaaaccagtgatcggcggttcctcctcagaggacgatgccattgtagcagatgcttcatcccttatgcactccgacaatcctggcctagaactgcaccacaaagaattggaggcgcctcttatcccccagaggacacattctttactttaccagccacaaaagaaagtcaagtctgaaggcactgactcatacgtgtcacagttaacagctgaagctgaggaccatcttcagagtcccaacagagatagcttatataccagcatgcccaacctccgcgatagcccctaccccgaatcctcaccggatatggaggaggacctctcccccagccggagatctgagaatgaagatatttactataagagcatgccaaatcttggggctgggcaccagttacagatgtgctaccagatcagtcgcggtaattcggatggatacattatacccattaataaggaagggtgtattcctgaaggagacgtgagagagggtcagatgcaattggtcacctccctgtag

SEQ ID NO: 50946 - DNA, 4380 bp, Artificial Sequence
  Description of Artificial Sequence: Synthetic coding sequence
atggtaagttccggatgccgaatgcgcagcctgtggttcatcatagtcatcagttttctgcctaacacagaaggcttcagccgggctgctctgccttttggtctggtacggagagaactttcctgcgaggggtatagtattgacctaagatgtccgggaagtgatgtcattatgatagagagtgccaactatgggagaactgacgacaagatctgtgatgcagatcccttccagatggagaacacagattgctatcttccagacgcgtttaaaatcatgacccaaaggtgtaataatcgcactcagtgcatagttgtgacaggatctgacgtctttcccgacccttgcccgggaacttacaagtacttagaggtccaatatgagtgcgtaccttatatatttgtctgcccagggaccctgaaagccatagtagattctccgtgcatatacgaggctgaacaaaaggccggagcatggtgtaaagacccactccaggccgctgacaagatctatttcatgccctggacaccttaccgtaccgataccctcatcgaatacgcatctctcgaggatttccagaacagtcgccagacaaccacctacaagctcccgaaccgggtggacggtactggatttgtcgtttacgacggggctgtgttctttaataaggagaggacgcgcaatatagtgaagtttgatttgcgcactcgcattaagagtggggaggcaattattaattacgcaaactatcacgatactagcccttacagatggggcggtaagaccgatatcgatctcgcagtcgacgagaacggtctctgggtcatttacgctaccgagcagaataacggaatgattgttatctctcagctgaacccttatacgcttcgcttcgaagccacctgggaaacagtgtacgataagcgagctgcctctaacgctttcatgatatgcggtgtgctgtacgtggtgcgcagtgtgtaccaagacaatgaaagtgaaacgggcaagaattccatcgattatatctacaacacacggctgaatcgaggggagtacgtggatgtgccattccctaatcaatatcagtacatcgccgctgtcgactacaatcctcgggataaccaactgtacgtctggaataataactttattctgcgctactctcttgaatttggcccacctgacccagcacaggtgcctaccaccgccgtgaccattacttcaagtgctgagctatttaagactatcattagtaccaccagtactaccagccaaaagggaccgatgagtacaactgtggcaggctcccaggagggctctaaaggtactaaaccccctccagcagtttctaccacaaagataccacctataacaaatatcttcccactgcctgagcggttctgtgaggcactggactccaagggcatcaaatggcctcagacacaaagaggcatgatggtcgagagaccttgtcctaaaggcactcggggtactgcgagttacctgtgcatgatttctactggcacatggaatcccaaaggtcctgacctgtcaaattgtacttctcattgggttaaccagctggctcagaaaatcagaagcggcgagaatgccgctagtttggcaaatgagcttgccaagcataccaaggggcctgtgttcgctggggatgtgtcctcttccgtgcgtctgatggaacaacttgtggacattcttgatgctcagcttcaagagctgaagccatctgagaaagacagtgctggtcgatcgtataacaagctgcagaaacgggagaagacatgtagagcatatctgaaggccatcgtggacactgtagataatctgcttcggcctgaggcactggaaagctggaagcatatgaatagtagcgagcaggcccacaccgcaactatgttattggataccctggaggagggcgcttttgtgttggccgacaatttactggagcccacacgagtgagcatgccaaccgagaacatcgtattagaggttgctgtgctgtccacggagggacagattcaggattttaagttccctctgggtataaaaggagccggatccagtatccagctgagcgccaataccgtgaaacagaatagccggaacggtttagcaaagcttgtctttattatatatagaagcttgggacagttcttgagcaccgagaatgcgactataaaattgggcgcagactttatcggaaggaattcaaccatagccgtgaactcccatgttattagtgtcagcatcaacaaggaatcaagtagagtctacctcactgacccagttctgtttaccctgccccacatcgatccagataattatttcaatgcaaactgctccttctggaattattccgaacgtaccatgatgggttactggtccacccagggttgcaagctggtcgacactaataaaactcggacaacttgtgcctgctcccacctgaccaacttcgccattcttatggcgcatcgggagatcgcttacaaagacggcgtgcacgagctgttactgaccgtgattacatgggtggggattgtgatatcactcgtatgtctcgcaatctgcatctttaccttttgcttttttcgaggcctgcagtctgatagaaatacaatacataaaaacctctgtattaacctgtttatcgccgaattcatatttttaatcggcatagacaagacaaagtatgcaatcgcctgcccaatcttcgccggactccttcacttcttttttctggccgcttttgcttggatgtgcctcgagggggtgcagctgtatctgatgctcgtggaagtcttcgagagcgagtactccaggaagaagtattactacgtggccggttatctgttccccgcaacagtagtgggcgtgtcagcggctatagactataagtcttatgggacggagaaagcttgttggctccacgtggataattacttcatttggtcctttatcggccctgtgacattcatcattctccttaacatcatctttttagtcatcacgttatgcaagatggtcaaacacagtaatacgctgaaacccgacagcagtcgtctcgagaatatcaaatcctgggttttaggggcatttgcactattatgcctgctggggctcacatggtcatttggcctgctcttcattaacgaggaaactatcgttatggcctacctgttcaccatttttaatgctttccagggagtgttcatctttatctttcattgtgctctgcagaaaaaggttcgcaaggaatacggaaagtgcttccgccatagttattgctgcgggggactcccaaccgaaagcccacactccagcgtaaaagctagcaccacacggacctctgccagatattcaagtggcacacagtcaagaattcgtcggatgtggaacgatacagttcggaaacagagcgagtctagtttcataagtggagatatcaatagtacatccaccctaaatcagggcatgacgggcaattacctcctgactaacccacttctgcggccacacggcaccaataacccatataataccctcctcgctgagaccgtggtttgcaatgccccatccgcacccgtgttcaactctcctggtcattctctgaacaatgctagggacacgagcgctatggacacccttcccctgaatggtaacttcaataatagctacagcttgcataaaggtgactacaacgactcagtccaggtcgtagattgtggcctgagtctgaatgataccgctttcgaaaagatgatcatcagcgaacttgtgcataataatctacgtggttcttctaagacccataacctggaactcaccctcccggttaaacccgttatcggtgggagttcttctgaagatgacgccatcgttgcagacgcaagctccttaatgcatagtgacaacccgggactggagctgcaccacaaagagctggaggcgccactgatcccccagcgtacccattcgctactttaccagccacagaagaaggtaaagtcagagggaaccgactcatatgtgtcccagctgacagctgaagccgaggaccacctgcagagccccaatagggattctttgtacacttcaatgcccaatctccgggatagcccttatccagaatcttcgccagatatggaggaggatttgagccctagtagacgcagcgaaaacgaggacatttattacaagtccatgccaaatctaggcgcagggcatcagctacagatgtgttaccaaatcagccggggaaattctgacggctatattatccctatcaacaaggaggggtgtattccagagggggatgtccgggaaggccagatgcagctagtgacatcactctag

SEQ ID NO: 50947 - DNA, 4251 bp, Artificial Sequence
  Description of Artificial Sequence: Synthetic coding sequence
atggtgtctagtggatgccggatgcgatcgctgtggtttatcatcgttatctctttcctacccaacaccgaggggttcagcagggctgcattacctttcgggctggtccgcagagaattgtcctgtgagggctacagcattgaccttagatgccccggttccgacgtgatcatgattgagagcgccaactacggcaggacggacgataagatctgtgatgcagatccttttcagatggaaaataccgattgttacctgcccgatgcttttaagataatgacccaaagatgtaataatcgtacccagtgcattgtggtaacaggcagtgatgtttttccagacccctgtcccggaacatataagtatcttgaagtccagtacgaatgtgtcccctacatttttgtctgtcctggaacattgaaggccattgtggatagcccctgtatctatgaagctgagcagaaagcaggcgcatggtgtaaggaccccctgcaggctgctgacaagatttactttatgccctggacaccctacagaactgacactctgattgagtatgcctcacttgaggatttccagaatagccgccagacgacaacgtataaattgcccaacagggtggacgggaccgggtttgtggtatacgatggcgctgtgttttttaacaaggaacgaacccgcaatatcgtgaaattcgacttacgcacaagaatcaaatccggggaggcaatcattaactacgctaattatcacgatacttctccctaccgatggggcggtaagactgatattgatttggcagtggatgaaaacggattatgggtcatctatgccactgagcagaacaacggcatgattgtaattagccagctcaatccttacactctccggtttgaggccacgtgggaaacagtgtatgataaacgggcagcctcaaatgcttttatgatctgtggagtcttgtatgtggtgcgatccgtttatcaagataatgagagtgaaacaggaaaaaatagcatcgactatatctataacactagactgaaccgcggagagtacgtcgacgtgccctttccaaatcaatatcagtacatcgctgccgtggattacaatccaagggacaatcagttatatgtttggaataacaatttcatactgcgctatagcctggagttcgggcctccagatcctgcgcaggtgccaaccaccgcagtgacaatcacttcgtctgctgagctgttcaagaccatcatatcgaccaccagtaccacaagccagaagggcccaatgtccactacagtcgcaggcagccaggaagggtctaaaggcacaaaaccaccacctgccgtgtccactaccaagatcccacctattaccaatatttttcctctgcctgagaggttctgcgaggcgctagactctaagggcataaagtggcctcagacacagcgagggatgatggtagagagaccttgcccaaaagggacgagaggtactgcctcttatctctgtatgataagcacaggcacatggaaccccaaagggcctgacttatcaaattgtacctctcactgggtgaatcagctcgctcagaaaatcagatccggagagaacgctgcctcacttgccaatgaactcgctaagcacaccaaaggaccggtatttgcaggagatgtgagctcttctgttaggcttatggaacagctagtggacatcctcgatgcccagctgcaggagctgaaacccagcgagaaggattctgctggccgaagttataataagcttcagaaaagggagaaaacatgtagagcgtaccttaaagcgatcgttgacacagtcgataacctcctccgaccagaagctctggaatcctggaaacatatgaacagcagcgagcaggctcatacagctaccatgctgctcgataccttggaggaaggggctttcgtgttggcggataacctgcttgagcccacccgagtttcgatgcccactgagaacatcgttctggaggtcgccgtattgtctaccgaaggccagattcaggactttaaatttcctctgggaattaaaggcgcaggctcttccatacagctgtcggccaacaccgtcaagcagaatagtaggaacggcttggcaaaacttgttttcataatttacaggtccctagggcagtttctgtctaccgagaacgccaccattaaactcggagcagatttcattgggaggaactctacgattgccgtgaactcccacgtcatttccgtgtctattaataaagagagttcccgggtgtacctgaccgatcccgtcctgtttaccttaccacatatagatcccgataactacttcaacgcaaattgctcattttggaactacagtgagcgtaccatgatgggatattggagcacccaaggttgcaagcttgtagacacgaataaaacaagaaccacttgcgcatgctcgcacctaactaactttgcaatcctgatggcacaccgagagattgcctacaaggacggtgtgcatgagctactcctgacggtgataacctgggtcgggatcgtgattagcctcgtgtgccttgcgatttgcatttttacattctgtttctttaggggcctccagtcagatagaaacacaatccacaagaatctctgcattaatctcttcatcgcagaatttatattcctaatagggattgataaaaccaaatacgctatcgcctgtcccattttcgccggtttgctgcacttctttttcctagctgcattcgcctggatgtgcctggagggggtccaactgtacctgatgctggtggaagtctttgagagcgaatattcccggaaaaaatattactatgtcgctggctacctctttccagcaaccgtggttggtgtgtccgctgctatcgattacaaatcttatggcaccgagaaggcttgctggctccacgtggacaattacttcatttggtcgttcattgggccagtgacattcataattctgctcaacattattttcctagttatcacactgtgtaagatggtcaagcattctaataccctcaaacccgactcgtcacgcttggagaatataaagagctgggtcctcggagctttcgcactcttgtgtcttctcggtttgacctggtcatttggactactcttcataaacgaagaaacgattgtgatggcctatctgtttacgatattcaacgcttttcagggcgtgttcatttttatattccattgtgccttacaaaagaaggtgcgcaaggagtacggcaagtgcttccgtcactcctactgctgtggaggactgcctaccgaaagccctcattcatccgttaaagcgtccaccacccgcacctcagcacggtatagcagcggtactcagtcgaggatcaggagaatgtggaatgataccgtccgcaagcagagcgaatccagtttcatatcgggcgacattaactccacatccacactgaatcagggccactcgcttaacaacgctcgggatacatctgccatggacaccctccctttgaatggaaactttaacaactcttactctcttcacaaaggcgactataatgactcagtccaagtggtggattgtggtctgtctctgaatgacactgcttttgagaagatgatcataagcgagcttgtacacaataatttacggggttcaagtaagacacataacttggaactgaccctgccagttaaacctgtcattggcggttcatcttctgaggatgatgctatcgtcgccgatgcttcgagcctgatgcactctgataaccccggtttggaacttcatcataaggagctggaagctccactcattcctcaacggactcacagcttgttgtatcagccgcagaaaaaggttaagtctgagggcaccgattcctacgtgagccagctgacggccgaggccgaagaccatcttcagtcccccaaccgcgacagcctgtatacctccatgccaaatcttagagattccccctacccggagtcctcccccgacatggaggaagacctcagtccttccaggaggagcgaaaacgaggacatctactacaagtctatgcccaacctgggggcaggtcaccaactccaaatgtgctaccagatctctaggggaaattctgacggctacattatccccatcaataaagaaggatgcatacctgaaggggatgttcgcgaagggcagatgcagctggtgacaagtctctag

SEQ ID NO: 50948 - DNA, 4386 bp, Artificial Sequence
  Description of Artificial Sequence: Synthetic coding sequence
atggttagtagcggctgtaggatgcgaagcttgtggttcatcatagtcatatctttcctgcctaataccgagggattttcacgggcagccttgccttttggattagtgcgaagggagttaagttgcgagggctactcgatcgacttgaggtgtcctggctccgatgtgatcatgatcgagagcgccaattacgggcgaactgacgacaagatatgcgacgctgatcctttccagatggaaaatactgactgttacctgcctgatgccttcaaaatcatgacccagcggtgtaacaatcggacccagtgtatcgttgtgaccggctccgacgttttcccagacccatgccccggaacgtacaaatatctggaggtccagtacgaatgcgtgccttacatctttgtctgtccgggaaccctaaaggcgattgttgattctccttgcatttatgaggctgaacagaaggcaggggcatggtgcaaagaccccctgcaggccgcagataagatttacttcatgccctggaccccttaccggaccgacacgctgatcgaatacgcgagtctggaagactttcagaattctagacagacaaccacttacaagttgcctaatcgggtcgacggcactgggttcgtggtgtacgatggcgcagtgtttttcaacaaggaacggacacggaatatagtcaagtttgatttgagaactcggattaagagtggagaggcaataattaactatgcgaactatcacgatacgtcaccctaccgatggggaggtaagacagatattgatctggctgttgatgagaacggtctttgggttatatacgcaaccgagcagaataacggcatgattgttatctctcaactcaacccgtacactctcaggtttgaagccacgtgggagaccgtgtatgacaaaagagctgcgagcaatgcctttatgatttgtggagttctctatgttgtcaggtctgtgtaccaggacaacgagtccgagaccggaaagaatagcatcgactacatctataatacgcgcctcaatcgaggtgaatacgtcgacgtcccctttcctaaccagtaccagtacatcgccgcagtcgactacaacccgagagataaccagttgtacgtgtggaacaataattttatactgcggtactcactggaattcggacctcccgatcccgcacaggttccaactacagcagtgaccataacttcctctgcagaactttttaaaactattatctctaccacgtccactaccagccagaagggccctatgtccacaacagtggccggatctcaggagggtagtaagggtactaaaccacctcccgcagtgtccacaaccaagatccccccaatcaccaatatcttccctttgccagagaggttctgtgaagcactggatagtaagggcattaagtggccccagacccagcgcggaatgatggttgagaggccatgtccaaaaggcacacggggtaccgcctcttatctgtgtatgatcagtaccggtacttggaaccctaaggggcctgatctgtctaattgtaccagtcactgggttaaccaattagcacagaaaattaggtcaggcgaaaatgcagctagccttgccaacgaacttgccaagcacacaaaaggaccagtcttcgctggagacgtgagctccagcgtgagactgatggaacaactcgtcgatattctagatgcccagctgcaagaactaaaaccctcagagaaagacagcgccggaagatcttacaacaaggccatcgttgacacagttgacaacttgctgaggccagaagccttggagtcctggaaacacatgaacagcagcgaacaggcacatacggccacaatgctattggacacacttgaagaaggtgcctttgtcttggccgataacctattggagcccacacgcgtttcaatgcctacagagaacattgtgcttgaggtggctgtactgtcaaccgaaggccaaattcaagatttcaagttccccttagggatcaaaggggctggatccagcatccaattaagcgcaaataccgttaaacagaatagccgcaacggactggccaagctggtgtttattatatatagatctctgggccagttcctaagcaccgagaacgcaaccattaaactgggtgctgactttatcgggagaaactcgactattgcagtcaactcccacgtgatctcagtctcaattaacaaagagagtagccgggtatacctcaccgaccctgttctgtttacacttccccatattgacccggacaattactttaatgccaattgctcgttctggaactactcagaaagaacgatgatgggttactggtccacacaggggtgtaagttggttgacacaaataaaacccgcaccacatgcgcgtgctctcatctgaccaatttcgcaattctcatggcccaccgggagatagcatacaaggacggggtccacgaattgctgctgactgtgatcacctgggtgggcatcgtaatctctctggtctgcctggccatctgcatctttaccttctgcttcttccgtggattacagtccgaccgcaacacaatccacaagaatctctgcattaatctctttatcgcggaattcatttttttgatcggcattgacaaaacaaagtacgcgattgcttgtcccattttcgctggactgcttcacttcttctttctagcagccttcgcttggatgtgcctcgaaggggtccaactataccttatgctggttgaagtattcgaaagcgaatatagccgtaaaaagtattactatgtcgctggctacctgttcccggcaactgtggtcggggtgtccgccgctatagattacaagtcatacggaaccgagaaggcatgctggctgcacgtcgataactattttatctggtcattcattgggccagtcacttttattatactccttaatatcatatttctggttatcacattatgtaagatggtcaaacattctaatacattaaagccggatagctcaagactggaaaatattaacaactatcgcgtttgcgatggctactataatacagatctgccgggatcttgggtgctgggtgcgtttgccctcctatgtctcctggggctgacttggtcattcggcctcctattcattaatgaggagactatcgtaatggcttatctttttaccatcttcaacgcttttcagggggtcttcatctttattttccattgcgccctgcagaaaaaggtccggaaagaatatgggaaatgtttcagacactcctactgttgcggtgggctgcctactgaatctcctcactccagcgtgaaggccagcactacccgaacctcggctagatattctagtgggacgcagtctcgcattagaagaatgtggaacgacactgtgagaaagcagtctgaatcgagttttatatcaggcgacatcaattccacctctactctgaaccagggaatgactggcaactatctgcttaccaatcccctgctgcggcctcatggaaccaataacccatataacactctgctggctgagactgtagtctgcaatgctccctcagcacccgtttttaactctcccggacatagcctcaacaacgcacgcgacactagcgccatggacacgctgccgcttaacggcaattttaacaattcttattcgctgcataagggcgattataacgatagcgtgcaggttgtcgattgcggcctttccctgaatgataccgcgttcgagaagatgatcataagcgagctagtacataataatctgagggggtcgtccaagacccataacctggaactaacccttcctgtgaagccagtaattggtgggtccagcagtgaagacgacgccatcgtggccgatgcaagcagcctgatgcattccgataatccaggtcttgagcttcaccataaagagttggaagctcctcttattccacaaagaacacattccctactataccagccacagaagaaggtgaagtccgaagggaccgactcttacgtgagtcagctaaccgccgaagccgaagaccacctgcagtcgcctaatcgggactccctgtacacctccatgccaaacttaagggactccccataccctgaaagctccccagatatggaagaagatctgagtccatcaagacgctctgaaaatgaggatatctattataagagcatgccaaatctcggcgcagggcaccagctccagatgtgctaccagatcagtagaggcaattccgacgggtacataataccaatcaacaaagagggctgcattcctgagggcgatgtgagggaggggcagatgcagctggtcacctctctgtag

SEQ ID NO: 50949 - DNA, 1416 bp, Artificial Sequence
  Description of Artificial Sequence: Synthetic coding sequence
tgaataactctctgcaagatggtgaagcactccaacacactgaaacctgactccagcagattggaaaacatcaacaattatcgcgtctgtgatggatattataacacggatcttcctgggtcttgggtgctgggagccttcgctctgctgtgtctgttaggacttacctggagctttggtctgttgttcattaacgaagaaacaattgtgatggcctatttgttcactatattcaacgcatttcagggtgtgtttattttcattttccactgcgctctgcagaagaaagtgcgaaaagagtatggcaaatgctttcggcactcatactgttgcggtggcctgcctacagagtcccctcatagctccgtaaaggccagtacaacacgcacatccgcaagatactctagtggcacacagtcgaggatccgccgaatgtggaatgataccgtgcggaagcagtccgagtcttccttcatcagtggtgacatcaactctacatctaccctcaatcagggcatgaccggtaactacttgctgacaaatcctctgttgcgcccacatggcactaataatccttacaataccctgctcgcggagaccgttgtatgcaatgcccctagtgctccagtcttcaactcgccagccacctatcgggagacaaggcacagcctcaacaacgcccgagacaccagtgccatggacaccctccccctcaacggcaatttcaataacagttacagtctgcacaaaggggattacaacgattctgttcaggtcgtggattgcgggctcagtttgaacgacactgcttttgaaaagatgatcatctcggagctggtacataataatctgagagggtcctccaagacacataacctcgagttgactcttcctgtgaagccggtgattggcggtagctcttctgaagacgacgccatagtcgccgacgcctcttccctcatgcattccgacaacccaggcttagagctgcaccataaagagctggaagcaccgctgattccccagagaacacattcgcttctgtaccagccccaaaaaaaggtgaaatcggaggggactgattcttacgtgtcccaactaaccgctgaagccgaggatcacctccagtcgccaaacagagattctctctatacaagtatgcccaatctgagggatagcccttatcctgaatctagccctgacatggaggaggatctcagcccgtctcggaggagtgagaacgaagacatttattataagtccatgcctaatttgggcgctggtcaccaactacaaatgtgttaccagatttcacggggtaactctgacggctatattatccccattaacaaggaggggtgtatccctgagggcgatgtgcgcgagggtcaaatgcagctggtcacaagcctgtag

SEQ ID NO: 50950 - DNA, 4056 bp, Artificial Sequence
  Description of Artificial Sequence: Synthetic coding sequence
tgattcgtttgccctggcactctgaaggccattgtagacagtccatgtatctatgaagcagaacagaaagccggagcatggtgtaaggatcctctacaggccgcagacaaaatttattttatgccttggacaccttaccgcaccgatacactgattgagtacgccagtcttgaagatttccagaactcccgacagactactacctataaacttcctaatagagtcgatggcacaggattcgttgtctatgacggtgctgtgttctttaataaggagaggacccgcaatatagtaaaattcgatttgcggaccaggatcaagtcaggcgaggctattatcaactacgccaattaccatgatacgtctccataccgctggggaggtaaaaccgatatagacctggccgtggatgaaaatggactgtgggtcatatatgctactgagcagaataatggcatgatagtgatttcacagctaaatccgtacactctccgcttcgaagccacgtgggagaccgtgtatgataagcgggctgcttccaacgccttcatgatttgcggcgtcctttacgtcgttcggtctgtgtatcaagacaatgagagcgagacgggtaagaactccatagattacatctacaacacgcggctgaacagaggggagtatgttgacgtgccatttccaaaccagtaccaatacattgccgcagttgattataaccctagggacaaccagctctatgtgtggaacaataacttcatcctgcggtattccctggagtttggccctcctgatccagcccaagttcccactactgccgtgactattacttccagtgccgaacttttcaagactattatctcaactacctctaccactagccagaagggacctatgtcgaccacagtcgccggttcccaagaagggtccaaaggaacaaagcccccacccgcagtgtcaacgacgaagataccacccatcacaaatatcttcccgttacccgagaggttctgtgaggcgctagatagcaaagggattaagtggcctcaaacacagagagggatgatggtagaacgcccatgccccaaaggcactcgcggtactgccagctatctgtgtatgatttccacagggacatggaaccctaagggcccagatctctccaactgcacttcccactgggtaaatcaattggcacagaaaatccggagcggcgaaaacgcagctagcctcgctaacgagctggcaaaacatactaaagggccagtatttgcaggggatgtgagcagctcagtccgtctcatggagcagttggtcgacattctggacgctcagttacaagaactgaaaccgagtgaaaaggacagtgcaggcagatcttataataaactgcagaaaagggagaaaacctgcagggcctacctgaaagctatcgttgataccgtcgataacctcctcagaccggaggcgcttgagagctggaagcacatgaattctagcgagcaggcacacacagccactatgctgctcgacaccctcgaagaaggggcttttgtgttagccgacaacctgctggaacctacccgggtatcaatgcccaccgagaacatcgtgctggaagttgccgtgttgagtaccgaggggcagattcaagactttaaatttcccctagggatcaagggggcaggttcctcaatccaacttagcgcaaatacagtcaagcaaaactccaggaatgggctggccaaactcgtgttcattatttatcggagtctggggcagttcctctcaacagaaaacgcaactatcaagttgggcgctgattttatcggcagaaacagtactattgccgtgaacagccacgtgattagtgtgtctattaacaaagaaagcagccgagtctacttgaccgacccggtgctctttacacttccccacattgacccagacaactatttcaatgcaaattgtagcttctggaactattctgagcggacaatgatgggttattggtctacacaggggtgcaaactggtggataccaataagactcgcacgacctgtgcctgctcccatttaactaattttgccatcttaatggcacacagagagatcgcttataaggatggtgtgcacgagcttcttctgactgtcattacttgggtggggattgtgatctccttggtttgtcttgccatatgtatcttcaccttctgcttttttcggggactccaatccgacagaaataccattcacaaaaacctgtgcattaacctgtttatcgccgaatttatctttttgattggtattgataagacaaaatatgctatcgcatgtcccatttttgctggtttattgcatttcttctttttggccgcatttgcttggatgtgcctggaaggagtgcagctttatctgatgctcgtggaggtgtttgagtcagagtactccagaaaaaaatattactacgtcgctggatacctcttccccgctacagtcgtcggggtgtctgccgctatagattacaagtcatacggtaccgaaaaggcatgctggctacacgtggacaattatttcatctggtcgttcataggtcccgttacctttattatcctgctcaatatcatcttccttgtcataactctctgtaagatggttaagcattcaaataccctgaagccagactccagccggctcgaaaatatcaacaactaccgagtttgtgatggatattataacactgacctccctgggtacgaggataataagcccttcatcaagtcttgggtgttgggtgctttcgctcttttgtgtctgttgggcctcacatggtcattcggactgctttttattaatgaagaaactatcgtcatggcctacctcttcaccatctttaacgctttccaaggcgtgttcatatttatctttcactgtgccctgcagaagaaggtgcgcaaggaatacggtaagtgcttcaggcacagctactgttgtggaggtctcccaaccgagagcccacacagcagcgtgaaagcatcaaccaccagaacaagtgccaggtattcctccggaactcagtctcgaatccgcagaatgtggaacgacacggtgcgtaagcagagtgaaagttctttcattagtggggacatcaactctacatccacacttaaccagggaatgacagggaactatctcctgaccaaccctctgctgcgccctcatggaactaacaatccatacaacacactcctggcagaaaccgttgtctgtaacgccccatcagctcccgtcttcaattctcctgggcacagccttaataatgctcgggacacgtcggctatggacacactgccgctgaatggcaattttaacaactcttacagtctgcataaaggtgattataatgattccgtacaggtcgtggattgtgggctttccctgaacgacacggcattcgagaagatgatcatcagtgaactcgtgcataacaacctaagaggttcaagtaagactcacaacctagaattaaccttgccagtaaagccggtgattggaggcagcagcagcgaggacgacgctatcgttgctgatgcctcatcattaatgcacagcgacaatcccggactggagctgcaccataaagagctggaagccccactcataccacagagaactcactccctgttgtaccagcctcagaagaaagttaaaagtgaggggaccgacagttacgtgagccagttgaccgccgaggcggaagaccacctgcagagtccaaatcgcgactccctatatacgtccatgccaaacttgcgagactctccatacccagagagcagcccagatatggaggaggacttgagcccctcccgcagatctgaaaacgaagacatttactacaagtccatgcctaaccttggcgctgggcaccagctccagatgtgctatcagattagtagaggcaatagcgatggatacattattcccatcaacaaggagggttgcatacctgaaggagacgtccgagaaggtcagatgcagcttgtcacgagcttgtag

SEQ ID NO: 50951 - DNA, 3723 bp, Artificial Sequence
  Description of Artificial Sequence: Synthetic coding sequence
atgtggccaagtcagctgcttatcttcatgatgctgctggccccaatcattcatgctttcagtagggcacccatcccgatggcagtagtcagacgcgaattaagttgtgagtcctatccaatcgagctgcgttgcccagggactgatgttattatgattgaaagcgccaactatggcaggacagacgacaagatctgcgactcggaccccgctcagatggaaaacatccggtgctaccttcctgatgcttacaagatcatgtctcaacgatgtaacaataggactcagtgtgccgtcgtcgctggaccggatgtgttcccagatccctgccccggaacttataaatatttggaagtacagtacgagtgtgtaccctatcgggttgaccagaaggtgtttctctgccctggtcttctgaaaggggtgtaccaatcagagcatctgtttgagagcgatcaccagagtggggcatggtgtaaagaccccctgcaggcaagtgacaaaatatactatatgccatggactccttatcggaccgatacactgaccgagtattcttccaaggatgatttcatcgcgggaaggccaaccacgacatacaaactgcctcaccgcgtcgacggaacagggttcgttgtatatgacggggcattgtttttcaataaggagcggacaagaaatatcgtaaaattcgacttacgtacaaggattaagtcaggggaggctattatcgctaatgccaattaccacgacacgagcccttatcgatggggcggaaaaagcgacatcgacctcgccgtggatgagaacggcctgtgggtgatctacgccacagagcagaacaatgggaagatcgttataagccaactcaatccttataccctcagaattgaaggaacctgggataccgcctatgataagcggtccgcatcaaacgccttcatgatctgcgggattctttatgtcgtgaaaagcgtatatgaggatgatgataacgaggccacaggaaataaaattgattacatatacaacacagaccagagcaaagactctcttgtggacgtgccttttccaaattcttaccagtacatagccgcagtcgactataaccctcgcgataatctgttgtacgtttggaacaattaccatgttgtcaaatatagtctagactttgggccactcgactcaaggagcggacaagcccatcatggtcaggtgtcctacatatccccccctattcatcttgactccgagctcgaacgccctagcgtgaaagatatttcaaccacaggacctcttggaatgggctccactacgacatccacgactctccgcactaccactctctcccctggcaggtcaaccactccatcggtctctggacggcgaaaccggtcaaccagcactcctagtcccgctgtggaggtcctggatgacatgacaacgcacttgccatccgcatccagccagatacccgcactcgaggagagttgcgaggccgtagaggctagagaaatcatgtggttcaagacacggcagggacaaatcgcaaaacagccctgtcccgctggaactattggagtgtcaacctacctgtgtctcgccccagacggcatatgggatccacagggacccgatttgtcaaattgtagcagtccttgggtgaaccacatcacccaaaaactcaagtccggcgaaacagcggctaacatcgcacgtgaattggccgaacagacccgtaatcacttgaatgctggagatattacttacagcgtgcgcgctatggatcagctcgtgggccttctggacgtccaactgcgaaacctgacaccagggggaaaagacagtgcagcacgaagtttgaataagctgcaaaagagggagaggagctgccgagcctacgtccaggcgatggtcgagacagttaacaatctgctgcaaccccaggctcttaatgcttggagagatctcaccacttccgaccagttgcgggctgccacaatgctgctgcacacagtcgaagaaagtgccttcgtactggcagataatctgctcaagactgacatcgtcagagagaacaccgataatatcaagcttgaggttgcccgtctgagcactgaagggaacctagaggacttaaagtttccggagaatatgggccacggctccactatccaactgagtgctaacactctgaaacagaatggacggaatggcgagattcgggtcgcttttgttttatacaacaacttaggaccctatctgagtaccgaaaatgccagcatgaaactcggaaccgaagccctgtccaccaatcactccgtaatcgtgaacagtcccgtgattacagctgctattaacaaagagttcagtaataaggtgtatcttgcagatcccgtggtgtttaccgtgaagcacataaagcagtccgaggaaaatttcaatccaaattgctctttctggagctacagcaaaagaactatgactggttactggagtacacagggctgtagactccttacaactaataagacacatactacgtgttcatgcaaccatcttacaaatttcgctgtgctaatggcacatgtcgaggttaaacactccgatgcagttcacgaccttttactggatgtgataacctgggtaggtattttattgagcctggtctgtctgctgatctgtatttttactttctgcttctttcggggtttgcagagcgacaggaacaccatacataagaatctctgtatttccctgtttgtggccgagcttctctttctaatcggaattaaccggaccgaccaacccatagcctgcgccgtgtttgcggcacttctccatttcttttttcttgcagccttcacgtggatgtttctggagggcgtgcagttatacattatgttagtggaagtctttgaatctgaacacagccggcgaaagtacttctacctggttggctatggcatgcctgcactcatcgtggcagtttccgcagctgtggattacaggtcatatggtacagataaggtgtgttggttacgcttagacacatattttatctggtcgttcattggacctgcgactctgattatcatgctcaacgttatcttcctaggaatcgcactctacaagatgtttcatcacaccgcaatcctcaaacctgaatctggctgcttggataacatcaactatgaggataaccggcctttcattaagagctgggttattggtgccattgcccttctgtgtctgctcggacttacttgggctttcggcctaatgtacattaacgagagcaccgtgattatggcttacctgttcactatttttaattcactgcaagggatgttcatctttattttccattgtgtgctgcagaagaaggtgagaaaggaatatgggaagtgtctgcggacccattgttgtagcggaaagagcacagagagctctataggtagtggcaaaaccagcggcagtaggacgccaggcaggtacagtacaggcagccagtctcgcattcggcgaatgtggaacgatactgtgcgcaaacagtctgaatcatcttttattacgggtgacataaatagctccgcgagtctgaacagggaaccatacagagaaaccagtatgggagtgaaactgaatatcgcctaccagattggggcatccgagcaatgccaaggctataagtgccacggttatagtacaaccgaatggtag

SEQ ID NO: 50952 - DNA, 4344 bp, Artificial Sequence
  Description of Artificial Sequence: Synthetic coding sequence
atgtggccctcccaactgctgattttcatgatgctgctggcgcctattattcacgcattttcccgcgcaccaatcccaatggccgtcgtccgcagagaactcagctgcgagagctatcctatcgagctccgctgtcccggaaccgacgttatcatgatagagtccgccaattatggccgaaccgacgacaagatttgcgacagcgacccagcacaaatggagaacatcaggtgttacctacccgatgcatacaaaataatgtcacagcggtgtaataacagaacacagtgtgccgtggtcgccggtccagatgtgttccctgatccttgtccaggtacgtacaagtacttagaagtgcagtatgagtgcgttccctatcgcgtggaccagaaagtgttcctgtgtcccggactcttaaaaggggtatatcagagcgagcacctgtttgagtctgatcatcagagcggagcatggtgtaaagaccccctacaagcaagtgacaaaatctattacatgccatggaccccctaccgtacggatacccttaccgagtacagttcaaaggacgactttatcgccggacgaccaactaccacatacaagctcccgcaccgcgtagacggaacagggtttgtggtgtacgatggcgctctgtttttcaataaggagcgtactcggaacatagtgaaattcgatttgcggacacgcatcaagtctggtgaagcaatcattgctaacgccaattaccacgacacctccccttatagatgggggggaaagagcgacatagacctggcagtggacgagaacggtctttgggttatctacgctactgaacagaacaacggaaagatcgttatttctcagctgaacccttacacccttaggatagagggcacttgggatacggcgtacgacaagaggagcgcctctaatgcctttatgatttgcgggatcctctatgtggttaagtccgtgtacgaggacgacgataatgaggctaccggaaataaaattgactatatctataacactgatcaatcaaaggacagtttggtcgacgtgcccttcccaaattcctaccaatacatcgccgcagtcgattataatccaagagacaatcttttatatgtatggaataattaccatgtagtgaagtactcgctggacttcgggccactagattcccgctccggtcaagcccaccacggacaggtctcttatatctctccccctatccatctggattcggaactagagcggccatcggtcaaggatatctcaactaccggcccactcgggatgggttccacaaccacctcaaccaccctaagaacaacaaccctttctccaggaaggagtactacgccttctgtcagcggccgacggaacaggtccacttccacaccctcaccggctgtggaggtcttggatgacatgacaacacacttgccttccgcatccagccagataccggctcttgaggaatcatgtgaagccgtggaggcgcgtgagattatgtggtttaagacacggcagggccaaatagctaagcagccctgtcccgcagggactatcggggtgagcacatacctttgtctggcgcctgacggcatttgggaccctcaaggcccagacttgagcaattgtagcagtccctgggtgaaccacattactcagaagctgaagtctggcgaaactgccgcaaatatcgcacgggagttagcagaacaaaccagaaaccacctgaatgccggtgacatcacttacagcgtcagggctatggaccagctcgtggggctgctagatgtccagctccgaaaccttaccccagggggtaaggattcagctgcccgaagcctcaataaggccatggtagagaccgtcaataaccttctccaaccacaggccctgaatgcatggagagacctgaccacgtccgatcaattgagagcagccacaatgctcctgcacacagtggaggagtctgctttcgtgttagccgacaacctcctgaagacagacattgtgcgtgagaacactgataacatcaagctcgaagtagctagattgagtacggaggggaatctggaagacttaaagttccccgagaatatgggccatggcagcaccatacagttaagtgccaacacccttaagcagaatgggagaaatggggagattcgagtagccttcgtcctttacaataatctgggaccttatctttctacagagaacgcaagtatgaaactcggaaccgaagctctgtccaccaaccactctgtgattgtcaactcaccagtgatcaccgccgcaatcaacaaagaatttagtaacaaagtgtatctagcggatccagtagtgttcaccgttaaacacattaagcagtccgaagagaattttaaccctaactgcagcttctggagttatagtaagcgaacaatgacgggctactggtctacccagggctgtagattactgacgacaaataaaacgcatactacctgttcctgtaatcacctgaccaacttcgcggtgctcatggcgcatgtcgaagtgaagcatagcgatgcagttcacgacctgctgctcgacgtcattacctgggtgggcatcctattgtccctcgtgtgtcttctgatttgtattttcacgttttgttttttcagaggcctgcaatcggaccgcaatacaatccacaaaaatctgtgcatctccctctttgtggccgaattgctgttcctgatcgggatcaaccggacagaccagcctatcgcctgcgccgtgtttgcagctctgctccacttcttcttcctggccgctttcacttggatgttccttgaaggcgtacagctctatattatgctggtggaggtgttcgagtctgaacacagtcgcagaaaatatttctatctggtcggttatggcatgccagccctgattgtcgccgtctcagctgcggttgattatcggagttatgggacagacaaggtctgttggctgcggctagatacttacttcatttggtcctttatcggacccgctacattgattatcatgctgaatgtgatcttcctgggaatcgccctgtataagatgtttcatcataccgccatcctaaaacctgaaagtggctgccttgataatatcaagtcctgggtcattggcgcaattgccctactgtgcctgttgggtttaacatgggccttcggcctcatgtatatcaatgaatctaccgttatcatggcatacctgttcacgatcttcaattcgctccagggcatgttcatttttattttccactgtgtcttgcagaagaaggtcaggaaagagtatggcaagtgtctccggacgcactgctgctccgggaaatctacagagagctcgatcggttcaggcaaaacctccggatccagaacacccggacgttactctaccggcagccagtctagaatacgcaggatgtggaacgacacagtgcggaaacagtctgagtcctccttcatcacaggtgatatcaactcctcagcatctttaaatagggaagggctgctcaataacgcacgagataccagcgtgatggacactctgccactgaacggaaaccacgggaattcatactctattgcgtctggagagtacctttcgaactgcgtgcagataattgaccgcggttacaatcacaacgaaacagcacttgagaagaaaattctgaaggagcttacatctaactatattcccagttacttgaataaccacgagagatcctcagaacagaatagaaatttgatgaataagttagtgaataatctggggagtggaagggaagatgacgctatcgtccttgatgatgctacctcatttaaccacgaggagtcactgggactggagttgatccatgaggaatcagacgccccattgttaccccctcgggtctattctaccgagaatcatcagccccatcactacacacggcgtaggattccacaagaccactcggaatccttttttccactgctgacaaatgaacatacggaggatttacagagtccgcacagggactcactctacactagcatgccaaccctcgccggagtggccgctacggaaagcgtgactacaagcacacagacggagcctccccctgctaaatgcggtgatgccgaggacgtctactacaagagtatgcccaatctaggatcaaggaatcatgttcatcagctccatacctactatcaactcggtcgcggaagctctgatggatttattgtccccccaaataaagacggaactccacctgaaggtagctccaagggcccagcacatctggtgacttcattgtag

SEQ ID NO: 50953 - DNA, 2757 bp, Artificial Sequence
  Description of Artificial Sequence: Synthetic coding sequence
tagtatttgtgtttagcgccagacggaatttgggaccctcaggggcctgacttaagtaactgttcttcaccatgggtcaaccacatcactcaaaaacttaagtcaggcgaaaccgccgcaaacatcgctagagagctcgccgagcagacgcgcaatcacttgaatgcaggcgacataacatactctgtgcgcgctatggatcaattggtgggcctgctggacgtccaattacgaaacttgactcccggaggaaaggacagtgccgcaagaagcttgaataaagcaatggttgaaacagttaacaatcttctgcagcctcaggcactgaacgcatggcgggatctaacaacaagcgaccagctgagagctgccacaatgttgttgcataccgtggaggaaagtgcctttgtccttgcggacaaccttttaaagaccgacatcgtgcgggaaaacaccgacaatatcaagttggaagtggctcgcctgtccaccgaaggcaatcttgaggacctgaaattccctgagaacatgggtcacggctcaacgattcagctgagtgccaacacactgaaacagaacggaagaaacggggaaatccgagtagctttcgtgttatacaacaatttaggtccctatctctccacagagaacgcatccatgaagttggggacagaggccctgagtaccaaccactctgtgattgttaacagtcccgtcattacggcagctattaacaaagaatttagcaataaggtgtatctggccgatcccgtggtgttcaccgtcaagcacatcaagcagtcagaggaaaattttaatcccaactgttccttttggtcatattctaagcgtacaatgactgggtattggtctactcaggggtgcaggttgctaacgactaacaaaacacacactacatgctcctgcaatcatctgactaactttgctgtcctgatggcccacgtggaggttaaacactcagacgccgtccacgacctccttctggatgtgataacctgggtggggatcctgctgagtcttgtttgcctgttgatttgtattttcacattctgcttctttcggggactgcagagcgaccgtaacactattcacaagaacctctgcatctccctctttgtggcagagctcctgttcctgatcgggatcaatcgcacagatcagcccatcgcctgtgccgtctttgcagccctcctccacttctttttcctggccgcattcacttggatgttcctcgagggggtccaactttatattatgctagtagaggtattcgagtctgaacattcccgtcgtaaatacttttatctcgtgggctacggcatgccagctttaatagtagctgtgtcagcggctgtggactaccgaagttacggaactgataaggtgtgttggctgcgccttgatacctatttcatttggtcgtttattgggcctgctacactaatcatcatgctgaacgttatttttctgggaatcgccctctacaaaatgttccatcacacggccatcctgaagcctgagtcaggatgtctggacaacattaagagctgggtgatcggggctatcgcactgctatgcctgctgggattgacttgggcctttggcctcatgtatataaatgagtccacggtcattatggcctaccttttcacaatctttaattcactgcaaggtatgttcatttttatttttcactgcgtcctgcaaaagaaagtgcggaaagaatatggtaaatgtcttcgtacccattgttgcagtggaaagagcacagagtccagtattggaagtggaaagaccagtggatctagaaccccagggagatactccaccggatcccagtctaggatacgcaggatgtggaatgacacagtaaggaagcagtcagagtcctcatttatcaccggcgatatcaatagctcggcatccctcaatcgcgagggattgttaaacaatgcaagagacactagtgtcatggacactctgcccctaaatggcaatcacgggaattcctactccattgcttccggggaatatttaagtaattgtgtgcagattatcgaccgagggtacaatcacaatgagacggctctggagaagaagatactgaaagagctgaccagcaactatataccgtcctacctgaacaatcatgagcgttcatcagagcagaatcgaaatctcatgaacaaactggtcaacaacctgggatcaggacgcgaagacgatgcgattgttttggatgatgcgaccagcttcaatcatgaggagtcactgggtctggagctgattcacgaggaaagtgatgccccattgctgcctcccagggtatactccactgagaatcaccagccacatcactacacccgcaggaggatcccccaagatcactccgaaagcttttttccgctgctgaccaacgaacacaccgaggacctgcagtctccacatagggactccctgtacacttctatgcccaccctggccggtgttgctgctacggagtccgtcaccacgtccacgcaaacagaacctccgccagccaaatgtggtgacgcagaagatgtatactacaagtcaatgccgaacctgggaagccgtaaccacgtacatcaacttcatacttactatcagctcgggcgtggttcgagtgatggtttcatcgtccctcccaataaggacggtacaccgcctgagggatcctctaagggaccagcgcaccttgtcacatccctgtag

SEQ ID NO: 50954 - DNA, 3852 bp, Artificial Sequence
  Description of Artificial Sequence: Synthetic coding sequence
atgtggccaagccaattgctaatctttatgatgttgttggcacctatcattcatgccttttcccgggctccaattccaatggcagtggttcgcagggagctctcatgtgaatcttatccaatcgaactgagatgccccggaacagatgttataatgattgagtcagctaactacggcagaacggatgataaaatatgcgattccgatcctgcccagatggagaatataaggtgctatctgccagacgcttataagattatgtcccagcgatgcaataacaggactcaatgtgcagtggtcgcagggcctgacgtgtttccagacccatgcccaggaacttacaaatacctcgaagtgcagtatgagtgcgtcccttacaaggtagaacagaaagtgtttctttgtcccggactcctgaagggcgtttaccagtccgagcacctcttcgaatctgatcaccaatcgggagcctggtgtaaagacccattgcaggctagcgacaaaatatattacatgccgtggaccccataccgcacagacaccctgactgagtattccagtaaagacgacttcattgcgggaaggcctactactacgtataaattgcctcacagagtggatggaactggcttcgtcgtgtacgatggggctcttttttttaataaagagagaacacgcaatattgttaagtttgaccttcgtacacggataaaatctggagaagcaatcatcgctaatgccaactaccatgatacaagtccttacagatggggaggaaagagtgatatcgacctggctgtggatgagaacggcctgtgggtaatttatgctaccgaacagaataacggcaagatagtgatctctcagcttaacccatacaccctgcgcattgaaggaacctgggacacggcctatgataaacggtctgccagtaatgcattcatgatatgcggaatcttatacgtggtcaagagtgtctatgaagatgacgacaacgaggccacgggcaataaaatcgattacatttataatactgaccagtcaaaagacagtctggtggatgtcccgttccccaattcttaccagtatattgccgcagtagattacaacccacgggataacctgctttacgtgtggaacaattaccacgtggttaaatattcactggatttcggtccccttgattcaaggtccggacaagcccaccacggccaggtgagctatatcagtcccccaatccacctggacagtgagctggaaaggccaagtgttaaggatataagtacaacgggcccattaggcatggggagcaccactacaagcactaccctgaggaccaccaccctgagccctgggcgtagcaccacccctagcgtctccggccgaaggaataggtccacatcaaccccttcgcccgctgtggaagtgctcgacgacatgactacccacttgcccagcgcaagctcccagatccccgctttagaggagagctgtgaggccgtggaggccagagaaataatgtggttcaagacacgtcaaggacagatagcgaaacagccatgtcccgctgggaccattggcgtaagcacttatctgtgtttggccccagatggcatatgggaccctcaggggcctgacttgtcaaattgctcctccccatgggttaatcatattacccagaaactgaagtccggtgagacagccgctaacattgcccgagagctagcggaacagactagaaatcacctgaatgccggagatattacatattccgtgcgggctatggaccagcttgttgggttactcgatgtacaactccgcaacctgactcctgggggtaaggattccgccgctagaagcctgaacaaactgcagaaaagggagcggtcttgtcgtgcctacgtccaagccatggttgaaactgtcaataacctcctccagccacaggccttgaatgcttggcgcgatttgaccacaagtgatcagctgcgagctgccacaatgctgctccacaccgtagaggaatctgcctttgtgctagccgacaacttgttgaaaactgatatcgtaagagagaataccgacaacattaagttggaggtggctcgactgagcacagagggaaacctggaggatctgaagttcccggaaaacatgggacacggatcaacgatccagctgtccgccaacacattaaagcagaacggacgtaatggagagattagagtcgctttcgtgctttataataacctaggaccatacctgagtaccgagaacgcaagcatgaaactcggcactgaggctctgagtaccaatcatagcgttatcgtcaatagccccgtgatcacggccgcaatcaacaaggaattctccaataaggtatacctagccgaccctgttgtgttcaccgttaagcatatcaaacaatccgaagagaactttaatccaaattgctcattctggtcatattctaaacggacaatgacaggctattggtccacacaaggatgtagactgctgacaaccaacaaaacacataccacatgttcatgcaaccatctcactaactttgctgtgctgatggctcacgtagaagtgaagcattccgacgcagtgcacgatttgcttctggacgtgatcacatgggtcgggattctgctttccctggtttgtctacttatatgcatatttacgttttgctttttccgcggactgcagtctgatagaaacactatccacaagaatctttgtatatcccttttcgtggccgaactcctcttcctcatcggcattaaccgcacagaccaaccaatagcttgtgctgtgttcgcagcactgctacattttttttttctcgccgcattcacttggatgttcctggaaggcgtgcagctgtatattatgcttgtggaggtctttgagagcgaacatagtcgccgtaaatacttctatctcgtggggtacggcatgcctgccttaattgtggccgtgtcggctgcagtggattaccggtcctatggtaccgacaaggtctgctggctgaggctggacacatattttatttggtcatttattggtccagcaactctgataataatgctcaatgtgatcttcttaggcatcgcactctataaaatgttccatcacactgctattttgaaacctgaaagcggctgccttgacaacatcaactacgaggataacaggccattcatcaagagctgggtgattggcgctatcgctcttctgtgtctgctcgggctgacatgggcctttggcttgatgtatataaacgaatccaccgtgatcatggcctacctgtttactatctttaactcactccaggggatgttcatttttatttttcattgcgttctccagaagaaagtccgcaaagagtatgggaaatgtttacgcacacattgttgttcggggaagtctacagagagctctattggcagcggcaagacatcaggcagcagaactccagggcgttactccactgggtcacaatctaggatcaggcgcatgtggaacgatacagtcaggaagcagagcgaaagtagctttataacgggggatataaatagttcggcctcacttaatcgaggggcaatggctaaccacctcataagcaatgccctcctccgtccccacggtactaacaacccatacaatactctgctaggggagccagccgtgtgcaataatcccagcgtgagtatgtacaacgcacaagagccctatagggaaacttccatgggtgtaaaacttaatattgcttatcagatcggcgcttcggagcagtgccagggatataaatgtcacgggtactccactactgaatggtag

SEQ ID NO: 50955 - DNA, 3696 bp, Artificial Sequence
  Description of Artificial Sequence: Synthetic coding sequence
atgtggccctcacagttgcttattttcatgatgctgcttgcccctatcatacacgccttctctagagctcccattcccatggccgtcgtaaggagggagcttagctgcgagtcgtaccccatagaattaaggtgccctggcacagatgtcatcatgatcgagtctgccaattatggtcggacagacgacaagatttgtgactccgatcctgctcagatggaaaatatccgctgctatctgcctgacgcctataagatcatgagtcagcggtgtaataaccgaacgcagtgtgctgtggtcgccggtccagacgtgtttccagatccgtgtcctggaacctacaaataccttgaggtacagtacgaatgtgtgccctataaggtcgaacagaaagtgttcctatgcccgggactccttaagggcgtttaccagtcagaacaccttttcgaatcagatcaccagagtggtgcttggtgtaaagaccctttacaagcctcagataagatttactacatgccctggaccccatataggacagataccttgactgagtattcttccaaggatgatttcatagcgggacgtcctacaactacctacaaactgccccatagggtcgacggtactggttttgtggtgtacgatggcgcactcttcttcaataaggagcgcaccaggaatattgtgaaatttgacctgcgcacccggattaaatctggggaagccattatcgccaatgcaaattaccacgatacaagtccatacagatggggcggaaagtccgacatcgatctggctgtcgacgaaaatgggctgtgggtgatatatgccaccgagcagaacaatgggaaaatagtgatatcgcaactcaatccttacacattgcgaatagaggggacgtgggacacggcgtatgacaagcggtccgcctccaacgcattcatgatttgtggaatcctatacgttgtgaaatctgtctatgaggacgacgataatgaagcaacgggaaacaagattgactatatatacaacactgaccaaagcaaagatagcttagttgatgtcccatttcccaattcttatcagtacattgctgccgtggattacaaccccagagacaatctgttatatgtgtggaataactaccatgtggtgaagtacagcctggatttcggccctctagattcccgtagcgggcaggcacaccacggccaggtgtcatatatctcccccccaattcatctggactccgaattggagaggccatccgtcaaagacatcagcaccacggggccactcggaatgggatctacgactacgtccaccacactcaggacaaccacactgtcccccggaagatctaccacgccctcagtatctggtcggagaaatagatcaaccagcacaccttcgccagctgtggaggtgctggatgatatgacaactcacctgccatccgccagctcccaaatccccgcattggaggaaagctgcgaagctgtggaggcccgtgaaatcatgtggttcaaaactcgacagggacagatcgcaaagcagccttgcccagctggaacaataggagtcagtacttacctctgtctggcacccgacggcatctgggatcctcagggcccagacttatccaactgcagtagcccatgggtgaatcacattacacagaagttgaagtctggggagacggctgctaacatcgccagggagctggccgagcagacaaggaaccacctaaacgcaggcgacatcacatacagcgtcagggctatggatcagctggttggactcctcgacgtgcagctcagaaatctgactccgggaggcaaggactcagcggctagatccctaaataagctacagaagcgggagagatcctgccgagcatacgtgcaggctatggtcgagacggtgaacaatctgctgcagccccaggcactgaacgcttggcgggacctgacaacaagtgaccagttgcgcgcagccacaatgctgttacacactgtggaggagagtgccttcgtcctagccgataatttgctgaagaccgacatcgtgcgagagaatacagacaatatcaagctggaggtcgctagactgtctacagagggaaaccttgaagatctgaaattccccgagaacatgggtcatggtagcactattcaattgtccgcaaatacactgaaacagaacgggaggaatggtgagatccgggtcgccttcgtactgtacaacaaccttgggccttatctgtcaacggagaatgcatccatgaaacttgggactgaggctctgtcaaccaaccattctgtgattgtcaattcacctgtgattaccgcggctataaacaaagagttcagtaacaaggtctacttggctgacccagtagtgtttacagtaaaacacattaaacagtctgaggaaaactttaacccaaactgcagtttttggtcttacagtaaacgtaccatgactggctactggtccacgcaggggtgtcggctgctcactactaataaaacccacacaacctgttcgtgtaatcacctgacgaatttcgcggtcctgatggcgcacgtagaggtgaaacattctgatgctgttcacgacctgctgctagacgtaattacatgggttggtatcctcctgagcctggtttgtttgttgatttgcatctttactttttgcttttttcgcggactacagagtgaccggaatacgatccacaaaaacctgtgtatctcactattcgttgctgagctcctgttccttataggaatcaaccgcactgatcagcctatcgcttgcgccgtgtttgcagccctgctgcacttctttttccttgccgcatttacctggatgttcctcgagggcgtgcaactgtacattatgcttgtggaagtgttcgagtccgaacactcccgcaggaagtacttttacctggtagggtatggcatgccggctcttatcgtcgccgtttcagccgctgtggactatcgttcttatggaaccgacaaagtttgctggctacgcctggatacctactttatctggtcgtttatcggcccagccactctcatcattatgttaaacgtgatctttttgggtattgccctgtataaaatgttccaccatacagctatcctcaaacccgaatctggatgtctggacaatatcaagtcttgggtgatcggcgcaatagccctgctctgtctcctgggcctgacctgggccttcggcctgatgtatattaacgagagcacagtgattatggcatatctcttcacaatcttcaatagtctgcaaggtatgtttatcttcatttttcactgtgtgttgcagaagaaggtgcgcaaggagtatggaaagtgcttacgaactcactgctgttctggcaagtccacagaatcgagcataggttctggtaaaacatcaggttccaggactcctgggaggtatagcaccggaagccagtcccgcattagaagaatgtggaatgataccgtaaggaaacagagtgaaagctctttcattaccggggatatcaacagcagcgcatcgttaaaccgtgaaccatatcgcgagacatccatgggagttaagctaaatatcgcctatcagattggggcatccgaacaatgccagggctacaaatgtcatggatactccacaaccgagtggtag

SEQ ID NO: 50956 - DNA, 4743 bp, Artificial Sequence
  Description of Artificial Sequence: Synthetic coding sequence
atgtggcccagccagttactgatttttatgatgctcctggctcctatcatccacgggggtaagcattctgaacggcacccagctttggcagcacctctgaggcatgccgaaagatcacccggaggagcactgcctcccagacatcttctccagcaacccgcagccgagcgtacagcggcacacagaggtcagggacccagaggcgctactcgtggggtgaggggacctggagctcagggcgctcagattgccgctcaggcattctctcgcgcaccgatcccaatggctgtggtgagaagggagctctcttgtgaatcttatcccatagaactgcgatgtcctggaacggacgtcatcatgatcgagagtgctaactacggtcgtactgacgataaaatatgcgactctgacccagcacagatggaaaacataaggtgctatctgcccgatgcctacaagattatgagtcaaaggtgtaataatcgcacgcagtgtgctgtggtggcgggacctgatgtgttccccgatccgtgccccggaacatacaaataccttgaggttcaatacgaatgtgttccatataaggtggagcagaaggtcttcctgtgccctggcctgctgaaaggtgtttaccaatctgagcacctgtttgagtccgaccatcaaagcggcgcatggtgcaaagacccactgcaggccagtgacaaaatctattacatgccgtggacaccataccgaacagacaccctgaccgagtattcatccaaagacgatttcatagctggcagaccaactactacatacaagctgcctcatcgtgtagatggcactggattcgtggtgtacgatggagccctgttctttaacaaggagcggactcgcaatattgtaaaattcgacctacgcacacgaattaagtcaggagaggctatcattgctaacgcaaattaccacgacaccagtccctaccggtgggggggaaaatctgacatcgatcttgctgtggacgagaatgggctctgggtgatatatgccaccgaacagaacaatggcaagatcgtcatttcacaacttaatccatacacactgcggatcgaaggcacctgggacaccgcatacgataaaagatctgcaagcaatgccttcatgatttgtggaattctgtacgttgtgaaatcagtgtacgaagacgatgacaatgaagctaccggaaataaaatcgactatatttacaatacagaccaatccaaggactccctcgtcgacgtcccttttcccaacagctatcagtatatcgcggctgttgattacaatcccagagacaatctgctgtacgtctggaacaactaccacgttgtcaagtatagcctggatttcggtcccttggactcacggagtgggcaggcccatcacggacaggtctcatatatatcccctcccattcacctggactcagaattggagcggccatctgtaaaggacatttctactaccggcccattaggtatgggctccaccaccacctccacaacccttcgcactacaaccctctctccaggtcgctctaccaccccatccgtatctgggaggcggaacaggtccacctccacgcccagtcccgcagtggaggtgttggatgatatgacaacccacctaccaagcgccagcagtcagatacctgcactagaagagagctgtgaagcagtggaggccagggagattatgtggttcaagacgagacagggtcagatagcgaagcagccatgccccgcaggaacaattggggtcagcacttatctgtgtttagcccctgacgggatctgggaccctcaggggcctgatttgtcgaactgtagttcaccttgggtgaaccacattacccaaaagctcaagtccggggaaaccgcggcaaacattgcacgagaattggctgagcagaccagaaatcacttgaacgctggtgacatcacctatagcgttcgcgctatggaccagcttgtagggttactggatgttcagttgcgtaacctgactcccggaggaaaagacagcgccgcacgtagcctgaataagctccagaagcgcgaacggtcctgtagagcttacgtgcaagcgatggtcgaaactgtcaacaatctcctgcaaccacaggcactcaacgcctggagagatctcacaacctctgaccagttacgcgcagccacaatgttgctgcatacagtggaggagtctgcgttcgtgctggccgataacctgctgaagaccgacatcgtgcgtgaaaacacagacaacattaaactagaggtggcacggctgtcgacagaaggcaacctggaggatctcaagtttcctgagaacatgggacacggatcaactatccagttatctgctaatacactgaaacaaaacggtaggaacggggaaattagggtggccttcgtcctctataacaatctcggtccgtacctgagcactgagaatgcatcaatgaagctgggtactgaggctcttagcacgaaccatagcgtaattgtgaattctcccgtgatcactgccgctatcaataaggagttttcaaacaaagtttacttggccgaccccgtggtattcaccgtgaaacacatcaagcagagcgaagagaattttaaccctaattgctccttctggagctactcgaaaagaactatgacaggctattggagcacccaggggtgccggctgctgaccaccaataagacacacacaacttgttcgtgcaatcatctcactaatttcgctgtgctgatggcccacgtggaggtaaagcactccgatgctgttcatgaccttctcctagacgtcatcacttgggttgggattctattatcgcttgtgtgcctcctgatttgtatatttaccttctgcttcttcaggggcctgcagtccgaccgaaatacaatccataagaacctgtgtataagtctttttgtggccgagctcctgtttctgattggaatcaacagaactgatcagccaatcgcctgcgctgtctttgctgcattgctacatttttttttcctggccgcatttacgtggatgttcctggagggcgtgcagctgtatatcatgctcgttgaggtgtttgaatctgagcacagccgaaggaagtacttttacctggtcgggtatgggatgccggctttgatcgtggcagttagtgcagctgttgattaccggagctacggaactgacaaggtgtgttggcttagattggacacttatttcatttggagctttattggtcctgcaacgctcatcattatgctgaatgtcatattcctcggcatcgccctctacaagatgtttcatcatacagccatcttaaaacctgagagcggctgtctggataacataaattatgaggacaatcggccttttataaaatcttgggtgatcggggcaattgcactgctgtgtttgctgggcttaacctgggctttcggtctgatgtatataaacgagagcacagtaattatggcctatctctttacgatcttcaacagtctgcaaggtatgtttatctttatcttccactgcgtcctccaaaagaaagtgcgcaaggagtatggcaaatgcctaagaacgcactgctgctcgggtaagtctaccgagagcagcataggatcaggtaaaacctcaggatctaggacccctgggagatatagtacaggatcccagtcgcggattcgccgaatgtggaacgacaccgtccgtaagcagtcagagagcagctttatcacaggcgatataaactcttccgcatctctcaaccgcggtgctatggccaaccacttgatatcaaatgcactgctcagaccccacggaacgaataatccttataacaccctccttggggagcctgctgtgtgcaataacccaagcgtctcaatgtacaacgcccaggaaggactactcaataacgctagggacaccagtgtgatggatacgctacctttgaatggcaaccacggaaattcttatagcattgcatccggcgagtacctttctaactgcgtccaaatcatagacaggggctataatcataatgagactgccttggagaagaaaattctcaaggagctgacaagcaattacattccctcatatctgaacaaccatgagaggtctagtgagcaaaacagaaatcttatgaacaagctcgttaacaacctcggttctggccgtgaggacgatgcaatcgtgctcgacgacgctacgtcatttaaccacgaggagtcactgggtctggaactgatccatgaagaatcagatgcgcctttactgccaccgcgagtgtacagtaccgagaaccatcagcctcatcactatacccgcagaaggattcctcaggaccactcagagtctttctttcctttgctgacaaacgagcatacagaggatcttcaatcgccacaccgggactccttgtatacaagcatgcccacactagccggagtcgcggcaacagagtctgtgaccacctctacccagactgaacccccacccgctaaatgtggggatgccgaagacgtgtactacaaatccatgcccaacttgggcagtaggaaccatgtccatcagctgcatacttattatcagttaggcagaggctcgtcagacgggttcatcgtgccacctaataaagacggaaccccgccagagggtagctcaaagggacccgctcacttggtgacctcactttag

SEQ ID NO: 50957 - DNA, 4716 bp, Artificial Sequence
  Description of Artificial Sequence: Synthetic coding sequence
atgtggcccagccagctgctgatcttcatgatgctcctcgcacccattattcacggcggaaagcattcagaaaggcaccctgcattagcggctccgcttagacacgcagagcggtcacctggcggagccctgcccccaagacaccttctgcaacagccagccgcagagcgaacagccgcacaccggggacaggggcctagaggagctacccggggagtccgaggcccaggggcacagggagcacagatcgccgctcaggcatttagcagggcccctatcccaatggctgttgttcggagggagctgtcctgtgagtcgtaccccattgagctcagatgccccggaacagatgtgattatgattgaaagcgctaactatggcagaacagacgacaaaatctgtgacagtgacccagcacagatggaaaacataaggtgctatctcccggacgcttacaagatcatgtcccagcgctgcaataaccgtacgcagtgtgccgtggtcgccggtcccgacgtgttcccagacccttgtcccggtacttacaagtatctagaagtgcagtacgagtgcgtgccttacaaggtcgagcagaaagttttcctgtgccccggactcctaaaaggagtgtaccagtctgagcatcttttcgaaagtgaccatcagagtggggcatggtgcaaagaccccctacaggcatcagacaaaatatactatatgccgtggactccttaccggaccgacactctgactgagtatagtagtaaggacgacttcatcgccggacgccctactaccacatacaaactcccgcaccgagtggacggcacagggttcgtggtttacgacggagccttattcttcaataaggaacggacccggaatatcgtgaagtttgatttgaggacaaggattaagagcggagaggctattatagcgaatgctaattatcacgatacctcaccttatcggtggggcggtaaatctgacattgatctagctgtggatgagaatggcctctgggttatctacgcgaccgagcaaaataacggcaaaatcgtcatctcccagctgaatccctataccctcaggatcgagggaacttgggacacagcgtacgataagcgtagcgcttcaaatgcgttcatgatctgcggtattctttacgtggtgaagagcgtctacgaggacgacgacaatgaggctactggcaataagatcgattatatctacaacactgatcagtcaaaggattctctggtggacgtgccattccctaattcttaccagtacatagcagcagtggactacaacccacgtgataaccttttgtatgtgtggaacaattatcacgtcgtaaaatactcacttgattttggaccactagacagccgctcgggccaagcccatcacggtcaagtatcctatatatccccacctattcacctcgatagcgagctcgaacggccaagcgtaaaggacataagtacaacgggtcctctcgggatggggtcaactactacatctacgacactgcgaactaccaccttgtcaccgggaaggagtactacaccctccgtatcaggacgcaggaaccgcagtacaagcacgcctagtccggctgtggaagtcctagacgatatgactacccatctgccttctgcgtcctctcagatccccgctctcgaagagagctgtgaggccgtagaggcccgagaaattatgtggtttaaaaccaggcaagggcagattgccaaacagccttgccctgcgggaactatcggcgtgagcacctacttgtgcttggctccagacggtatttgggacccacaaggcccagatctctcgaattgttcttcaccatgggtcaatcacattacgcagaagctgaaaagtggcgaaacggccgcaaacattgccagggagctagctgagcagacccggaaccacctcaacgccggagacattacatatagcgtgcgggctatggatcaactggtcggactgcttgatgtccagctcagaaatttaacacctgggggtaaggacagcgctgctagatctttgaacaaattgcagaagcgtgaaaggtcttgtcgagcttacgtgcaggcaatggtagagactgttaataatttactgcagcctcaagccctgaacgcctggagggatcttacgacgagtgatcagctccgggcagccacaatgcttttacacacagtggaggaaagtgcatttgtgcttgccgacaacttactgaaaactgacatcgtgcgcgaaaataccgacaatatcaagctggaggtcgcacgcctgtccacagaggggaacctggaggatcttaagttcccggagaacatgggacatggatcaactatacagctgtcagccaacaccctcaagcagaacgggaggaatggagagatcagagtcgcattcgtcctctacaataatctcggaccttatctatccactgaaaatgcaagcatgaagttaggcacagaagccctgtccaccaaccacagcgtgatcgtgaacagcccggttataaccgcagctatcaacaaagagttctccaataaagtgtacttggctgatcccgtggtgtttacggttaagcatattaagcagtctgaagagaatttcaatcctaattgcagtttttggtcatactctaaacggacgatgactggctattggtcaacccagggatgtagactgctcactaccaataagacacacaccacgtgctcctgtaaccatctcacgaacttcgccgtgctcatggcccatgtcgaagtcaaacactctgacgcagttcacgacctgcttttagacgtgattacctgggtgggcatcctgctgtccttggtctgcctcctgatttgtatttttacgttttgcttctttagagggttgcagagtgaccggaacaccatccacaagaacctgtgtattagcttgttcgttgctgagctgctttttctaataggcatcaacaggacagatcagccaatagcctgtgcagtgttcgcggctttactgcattttttctttctggccgcttttacatggatgtttttagagggtgtgcaactgtacatcatgctggtggaggtttttgaaagcgagcattctcggaggaagtacttctacctggttggttatggaatgcccgctctcattgttgccgtttcagcagccgtagactacaggagttatggtaccgataaagtatgctggctgcgcctcgatacatactttatttggtcgttcatcggcccagccactctgattattatgttgaatgtgatttttttgggaatcgcattatataagatgtttcatcacaccgcaatcctgaaaccagaaagcggttgtctggataatattaaatcctgggttattggagcaatcgccctgttatgcttgctcggacttacctgggcttttgggttgatgtacatcaacgaatcaaccgtgatcatggcttacttgttcactattttcaacagtcttcaaggcatgtttatctttatcttccactgcgtgctccaaaagaaagtgcgcaaggaatatgggaagtgccttcgcacacattgttgtagtggcaagtccacagaaagttcgatcggctccggcaagacctcagggtcacgaacacctgggaggtatagtaccggttcccagtccaggattcgacgcatgtggaatgacacggtccggaagcaatctgagagctccttcattactggggatatcaactcaagtgcctccctcaaccggggagctatggccaatcatctcatcagcaacgccctgttgaggccacacggtaccaataatccctataatactctgcttggggagcctgccgtctgcaacaacccgtcagtgagcatgtacaatgctcaggaagggttgctaaataatgcacgggataccagcgttatggacacgctccccttaaacggaaaccatggtaattcgtattccatcgcctcaggggagtacctctctaactgcgtgcagatcattgatagaggctacaatcacaatgagacagcacttgagaaaaaaatactgaaagagctaactagcaactacatcccaagttacttgaataaccacgaaagatcttcagaacagaacaggaatctgatgaataaactggtgaataatctgggtagtggacgcgaggatgacgcaatagtgttagatgacgccacaagcttcaatcacgaagagtcactggggctggaactgattcacgaggaatcagatgcgccactgctcccacccagggtctactccacagaaaaccaccagccacatcactacaccaggaggcgtatcccacaggaccatagcgagagcttcttcccactgctgactaacgagcacacagaggacctgcagtccccacaccgcgacagtctctatacctcaatgcccacgctcgccggtgtggcggcaaccgaatctgtgacaacaagcactcagactgagccaccgcctgccaagtgcggggatgcagaggacgtgtactataaatccatgccaaacctgggaagccgtaaccatgtgcatcagcttcacacatactaccaactcgggagaggttcttcggatggcttcatagtgcctcctaataaagatggcactccacctgagggaagcagcaaaggaccggctcatctggttacctcgctctag

SEQ ID NO: 50958 - DNA, 4029 bp, Artificial Sequence
  Description of Artificial Sequence: Synthetic coding sequence
atgtggccatcccagcttctgatattcatgatgctgctggcccctatcattcacggtggcaagcattccgagaggcacccagcacttgccgcacccctgaggcatgccgaacggagcccaggcggtgccctgccgccacgccacttattgcagcagccagcagctgagcgcactgccgcacatcggggacagggcccacggggtgctactcgcggagtccggggtcccggagcgcagggcgctcaaatcgctgctcaggctttttcaagggccccaatccctatggctgtagtgcgtagggagctctcttgcgagtcatatccgatagaactcaggtgccccggtaccgacgtcataatgatcgagtccgccaattacggcaggaccgatgacaaaatttgcgactcagatcctgcacagatggagaacatccgttgctacctgcccgacgcctacaagattatgagccagaggtgtaacaaccgaacacagtgtgccgtcgtcgctgggccagacgtatttcccgacccctgccccggtacctacaagtacctggaggtgcaatatgaatgcgtgccttataaggtggagcagaaggtgttcctgtgtccaggactacttaagggtgtgtaccagagtgagcatctttttgaaagtgatcaccaatcaggagcgtggtgcaaagatcctctgcaggctagcgacaagatctattacatgccctggaccccttatcgaactgacacattgaccgagtatagctccaaagacgactttatcgcagggaggccaacaaccacttacaaactgcctcaccgtgtggatggtaccgggtttgttgtctacgatggtgcactgtttttcaataaggaacgcacccggaatattgtgaagttcgatctgcgaacacggatcaagtcaggagaggcgatcattgccaacgccaattatcacgacacctccccatatagatgggggggaaaaagtgacatagacctcgctgtggacgagaacggactctgggtaatttacgctactgagcagaacaacggtaagatagtgatttcccagctgaatccgtatacactgcgaatcgagggcacttgggacacagcctacgacaagagaagcgcctccaacgctttcatgatttgtggaatcctgtatgtagtgaagagcgtatatgaggacgatgacaacgaggcgaccggcaataaaatcgactatatttacaatacagaccagtccaaagatagcttagtggatgtgccctttcccaattcctaccagtacatcgcagccgtggattacaatcctcgagataacctcttgtatgtgtggaataactaccacgtagtgaaatattccctcgacttcggcccactcgatagtcgatcaggacaggctcatcacggtcaggtctcttacatctcacctccaattcatctcgattctgaactcgagagaccatcagtgaaagatatttccacgaccggaccacttggcatgggttccacgacaaccagtaccacactgagaactacgacactgagtccaggacggagcaccacaccctctgtttctggtaggcgaaaccgctccaccagcaccccgtcccctgccgtggaagtgctcgatgacatgacaacccacttgccatccgctagcagtcaaatccccgctctggaggagtcatgcgaagcagtggaggctcgcgagatcatgtggtttaagactcgccagggccagatcgctaagcagccgtgccctgccggaaccattggagtgtccacctatctgtgtctggcgcctgacggcatttgggatccccaaggacccgacttgagtaactgcagctccccttgggtaaaccacattactcagaaactgaagagcggtgaaaccgccgcaaatattgctagggagctggccgaacagactagaaatcatcttaacgccggtgacatcacttactcggtgcgggcaatggaccagttggtgggcctgctcgacgtgcagcttaggaacctgaccccgggtggcaaagactcagccgctcggtccctgaataagttgcagaaacgggaaagatcctgccgtgcctacgtgcaagccatggtcgagaccgttaataatcttctgcagccccaagccctgaatgcgtggagggacttgaccactagcgatcagttaagagcagccactatgctcttgcatacagtggaggagagcgctttcgttctagcagataacttgctaaagaccgatatagtgcgggagaatactgacaacatcaagcttgaagttgcgaggctgtctaccgagggtaacttggaggacctgaaattccctgaaaacatgggtcatgggagcacgatccaacttagcgcaaacacacttaagcaaaacggcagaaacggggagattagagtggcctttgtcctttacaacaatttaggtccctatttgagtaccgaaaacgcctctatgaaactggggacagaagctcttagtacaaaccatagcgtgatcgtaaatagcccggtgattacggccgctataaataaggagtttagtaacaaggtctatctcgccgatccagtagtctttactgtaaaacacatcaagcaatcagaagaaaattttaatccaaactgctcgttttggagctacagcaagcggacaatgactggctactggtctactcagggctgtcgacttctgacaactaataagacccacactacctgctcctgtaaccacctgacaaatttcgctgtcctgatggcccacgtggaggtgaagcattcagatgcagtccatgatttattgctggacgtgatcacctgggttgggattttgctctccctggtgtgtcttctgatttgtatcttcaccttctgcttcttcagaggtctgcaatcagataggaatactatccacaagaacctgtgcatcagcctgtttgtagccgagttgcttttcttaattggcatcaacaggacggaccaaccaatcgcttgtgccgtgttcgctgcactcctgcacttcttctttctcgctgctttcacctggatgtttcttgagggcgttcagctgtacatcatgctcgttgaagttttcgaatccgagcacagccgacgcaagtacttttacctggtaggatatggcatgccagccctcatcgtggctgtgtctgcagctgtcgattataggagctacggaactgataaggtttgctggttgcgcttagacacatatttcatttggtcgttcataggccctgctaccctgatcatcatgctgaacgtgattttcctgggaatagccctctataaaatgtttcatcatactgcaattctgaaaccagaatccgggtgtctcgataacatcaaatcatgggtcattggcgctattgcacttctctgtctcctgggtctcacatgggccttcgggctcatgtatattaacgagagtactgtcatcatggcatatctgttcacaatttttaattccctacaggggatgtttatcttcattttccattgtgtgttgcagaaaaaagtgaggaaggagtatggtaagtgtctgagaacgcattgttgttccggcaagtcgacggaatcttcaattggatccggaaagacttctggaagtcgtacccccggaagatatagcacaggaagccagagtcgaattcggagaatgtggaacgacaccgtgcggaagcagtccgaatcctcctttataacaggtgacataaatagttccgcctctttgaaccgtggcgcaatggccaatcacctaatctccaatgcccttctacgtcctcatgggacaaataacccttataacaccctgctgggtgaaccagcagtttgcaacaacccatccgtctctatgtataatgcgcaagaaccttaccgggagacctccatgggcgtgaagcttaacatcgcgtaccagattggagcgagtgaacagtgtcaaggctataagtgccatggctacagcactaccgaatggtag

SEQ ID NO: 50959 - DNA, 4587 bp, Artificial Sequence
  Description of Artificial Sequence: Synthetic coding sequence
atgtggccatctcaactcctcatcttcatgatgctgcttgcccctataattcatggcggaaagcattccgagaggcatccagctttggcggcacctctgcggcacgcggagagaagccccggaggagccctccctcctagacaccttcttcagcagcccgctgccgagcggaccgccgcacaccgcggacagggcccaagaggggctaccagaggtgtccgcggaccaggagcacagggggcacagatcgccgctcaagctttttcccgtgccccaatcccgatggctgtggtcagacgtgaactgtcctgcgagtcctacccaattgagctccgctgccccggaaccgacgttatcatgatagagagcgctaattacgggagaacagatgacaagatctgtgactcagatcccgctcagatggaaaatatccggtgctatctccccgacgcctacaagattatgagccagagatgtaataatcgaacccaatgcgcagtggtggcaggtcctgacgtattccccgatccgtgtcctgggacctacaagtatttggaagttcagtatgagtgtgttccatataaggtggaacagaaagtctttctatgtccaggactgctgaaaggtgtgtaccagtcagaacatctgtttgaaagtgaccatcaatccggggcttggtgtaaagatcctttacaggcctctgacaagatttactacatgccatggactccttatcgcacagatacactcaccgaatacagctccaaagacgactttattgcagggcgacctactactacctacaagctgccgcaccgcgtcgacggaaccgggttcgtggtgtacgacggcgcactattttttaacaaggagcgaacccgcaacatcgtaaagtttgacctccgcacgagaataaagtcgggcgaggctattattgccaacgccaattatcacgacacatccccctatcggtggggtggcaagtcagacattgatctggcagttgacgagaatggcttgtgggtgatctatgctacagaacaaaataacggaaagatcgtaatttctcagctcaacccctacacactgcggatcgaaggtacctgggatacggcgtacgacaagagatctgcatcaaacgcttttatgatttgcggtattctttacgttgttaaatcagtctatgaagacgatgataatgaagctaccggcaataagattgattatatttacaacacagatcagagtaaggatagcctggtagatgtgcccttcccaaattcatatcagtacatcgccgctgtcgattacaatccaagggacaacctgctatacgtgtggaacaactatcacgtggtgaagtacagtctggacttcggcccacttgattccaggtcaggccaggcccaccacggacaggttagttacatcagcccccctatacaccttgattcggaactggagagaccgtcagtgaaggacattagcactaccggccctctcggcatgggatcaactaccacatctaccaccctacgcacaaccactcttagcccaggcaggtccaccacccctagtgtgtcaggtcgtcggaaccggtccacttctactcccagccccgcagtcgaagtcctggatgatatgactacacatttgccaagtgcgtcctctcagattccagccctggaggagtcgtgtgaggcagtggaggcgagagagattatgtggtttaagactcgccagggacagattgcgaagcagccgtgtcccgcaggcacgattggggtgagtacatatctttgcttggccccagacggcatctgggatccccagggcccagaccttagcaactgctcttcaccgtgggtgaaccacattacccaaaagctgaagagcggcgagacggcagctaacatcgccagggaacttgccgagcagacacggaatcatctgaacgcgggagacatcacatactctgtgagggcaatggaccagctggttggactcttagacgtacagcttagaaacctgactcctggagggaaggactcagccgctcgcagtctgaacaagttgcagaagagagagaggtcctgtagggcatacgtgcaggccatggtagagaccgtgaacaatctacttcaaccacaagctcttaatgcctggcgggatctcaccacttcagatcagctgagggccgcaacaatgttgttgcatacggtggaagaaagcgcatttgtactggcagacaatctgctgaaaacagatattgtgcgcgaaaacaccgacaatattaagctggaggtcgccagactctcgacagagggaaacctagaggacttgaagttccccgagaatatgggacatggatctactatacagctctccgccaatacactaaagcagaacggacggaatggcgagatccgggtggccttcgtcctgtataacaatttaggtccatatctgagcactgagaatgcttcgatgaagctgggcaccgaggctttgagtacaaaccatagcgtgattgtcaactctcccgtgattacagcagccatcaataaagaattcagtaacaaagtctacctggctgatcccgtcgtgttcaccgtcaagcacattaagcaatctgaagaaaactttaatcctaattgttcgttctggtcttacagtaagcgtaccatgacagggtattggagcactcagggatgtaggctgctgactaccaacaagacccacactacatgctcttgtaaccacctcactaattttgcagtgctgatggcccacgtggaagttaagcactccgatgctgtgcatgatttgctgctggacgtaatcacatgggttggtattctgctatccctcgtttgtttactcatctgtatctttaccttttgtttcttccgcggtctccagagcgacaggaatacgatacacaaaaacctgtgtatctcattattcgttgcagaacttttatttctaatcgggatcaaccgcaccgatcagccaatagcttgtgctgtgtttgcagccctgctgcactttttctttttggccgcttttacgtggatgttcctagagggggtacaactttacatcatgctcgtcgaggtcttcgagagcgagcactccagacgtaaatatttctatctcgtgggatacgggatgccagccttaatcgtcgcagtctcagctgcggtagattaccgtagttacgggactgataaggtctgttggcttcggctggacacgtatttcatttggtccttcattggcccagccaccctgatcattatgctgaatgttatatttttaggaatcgcactgtataaaatgttccaccatactgctatactgaagccagaatctggttgtctggacaacattaaatcatgggtaataggtgccattgcgctgctgtgtttgctgggccttacatgggccttcggactgatgtacatcaacgaatccacggtcataatggcttacctttttacaattttcaacagtctgcagggaatgtttatttttattttccactgtgtactgcaaaagaaggtgcgtaaggagtatggaaaatgtctgagaactcactgctgctcaggtaaatccactgagtcgtccatcggatccgggaagacttctgggagcagaactcccggtcgatacagcaccgggtcacaatcccgcatacgccgaatgtggaacgataccgtccgcaagcagtccgaaagcagtttcatcaccggcgatatcaactccagcgccagccttaatagggaagggttactgaacaatgccagggataccagcgtgatggacacactgcctcttaacggcaaccatggtaactcctacagtattgctagcggggagtatctttccaattgcgtgcaaataatcgatagaggctacaaccacaatgaaacagccctggaaaagaagatactcaaggagcttacatctaattacattccaagctatctcaataatcacgagagatcaagtgaacaaaacagaaatctgatgaacaaattggtaaataacttgggcagcgggcgtgaagacgacgctatcgtgcttgacgacgcaacctcatttaatcatgaggagagtctgggcttggagctgatccatgaggagtccgacgcccctctgcttcctcccagagtgtactcaaccgagaaccaccagcctcaccactatactcggagaaggattcctcaggaccattccgagtccttttttcctctgttgacaaacgagcacacagaagacctccagtctccccatcgggactccttgtacacttctatgcctaccctggctggcgtagccgcaactgagagtgtcactactagcacacagacggagcccccacctgcaaagtgcggagacgcggaagatgtgtactacaaaagcatgcccaacttgggcagccgcaatcatgtgcatcaactccacacttactaccaacttggcagaggttccagcgatggttttatcgtgccaccgaataaggacggcaccccccctgagggatcatcgaaaggcccagctcacctggttacatctctgtag

SEQ ID NO: 50960 - DNA, 4056 bp, Artificial Sequence
  Description of Artificial Sequence: Synthetic coding sequence
atgtggcccagccaactgctcattttcatgatgttgctggcaccaattatacacggcggaaagcattctgaacgccaccctgcccttgcagcgccactcagacacgccgaacgctcccctgggggagctttgcctccacgccacctgcttcagcagccggctgccgaaaggaccgcagcacacagaggccaagggcctaggggggcaacacgcggagtcagggggcctggcgcacaaggagctcagattgcggctcaggcattttctcgggctccgattcctatggccgtagtcaggcgtgaactctcttgcgagtcataccctattgaactgaggtgccccggaactgacgtgataatgattgagtctgccaattacggacgcaccgatgacaaaatatgcgattccgacccagcccaaatggagaatatccgatgttatctgcctgatgcatataaaatcatgagtcagaggtgcaacaaccgaacacagtgcgcggtggtggccggtccagacgtgttccctgacccctgcccaggcacctacaagtacctggaggtacagtatgaatgcgtcccctacaaagttgaacagaaggttttcctgtgtccaggtctacttaaaggggtataccagtctgagcatctgtttgaaagtgatcatcaatccggagcctggtgtaaggatccattacaggccagtgacaagatctactacatgccctggactccttataggaccgacaccctgacagagtactcttcgaaggacgacttcatcgccggtcgccctactacaacatataaattaccacatcgggtggacgggacaggctttgtggtgtacgacggcgctctgttcttcaacaaggaacgaacgcggaacatcgtaaaatttgatctgagaacaagaatcaaatctggagaagcaattattgccaatgcaaattatcatgacacaagcccctatcgctggggaggaaagtctgacattgatctcgctgttgatgagaacggattatgggtaatatacgcaaccgaacaaaataacggcaagattgtgatctcacagttgaatccttatacacttcgtatagaaggtacttgggacacagcatacgacaagcgctccgcctccaacgcatttatgatctgtggaatcctttacgtggtgaagtccgtgtacgaggacgacgataacgaggcgacgggcaacaaaatagactacatctacaatacggaccagtcaaaggactccctcgtggacgttccattcccaaatagctaccagtatattgcagcggtcgattacaatcccagagacaatttgctctacgtgtggaataactaccatgtggtgaaatattctctcgatttcgggccactagattcccggtccggccaggcgcatcatgggcaagtgtcatatatttcccccccaatccatttggattctgagctggagagaccatcggtgaaggatatctccaccaccggccctctgggcatgggatcaactactacgagcacaaccctccggacaaccacgctgagtcctgggaggtctacaactcctagcgtcagcggcagaaggaataggtcaacctcgacgccttccccagccgtcgaggtgctcgacgacatgactacgcatttgccatccgcctcgagccagatacccgctctcgaagaatcatgtgaggccgtggaagctagggaaatcatgtggtttaaaacacggcaaggacagattgccaagcagccatgtcctgctggaaccattggcgtatctacttatctttgtctagcaccagatggaatatgggatccacaaggacccgacctgtccaactgctcttccccttgggtgaatcatataacccagaagctcaagtcaggcgagacagccgcaaatatagccagggagctggctgaacagactagaaatcacctcaacgctggggatattacatattccgtgagagccatggaccaactagtggggttgcttgacgtgcagctgaggaatttgactcccggaggcaaagactctgctgccaggagccttaataagttgcagaagcgggagcgctcgtgcagagcttatgtgcaggctatggtcgagactgtgaacaacctactacagccccaggccctgaatgcctggcgtgacctcacaacctccgaccaattgagagctgctaccatgttacttcacacggtggaggagtcagcctttgtgctggccgataacctgctcaagacagatatcgttagagaaaatacagacaatattaagcttgaggtggccagattgtccaccgaagggaacctcgaggatttgaagttcccagaaaatatgggccatgggtcaacaatccagttatccgctaatactcttaagcaaaacggcagaaatggcgagattcgagtggccttcgtcctctataataaccttggcccatatcttagtaccgagaacgccagcatgaaactcggaacagaggctctctcaaccaatcatagcgtgatcgtcaatagtcctgtgataacagccgcaatcaataaggaattttccaataaagtgtacctcgctgatcctgtggtgtttaccgtgaaacacattaaacagagtgaggagaatttcaaccccaattgttccttttggtcttactccaagcggaccatgacgggatattggtctacacagggctgcaggctcctcacaacaaacaagacacacactacttgctcatgtaaccatctcaccaactttgcggtgctcatggcacacgtagaagtcaaacacagtgacgctgtccacgacctgttgttggacgtgatcacatgggtggggatcttgctctcactcgtatgtctgctgatctgtatatttaccttctgttttttcagggggctacaatccgataggaacaccatccataagaacttatgcataagtttgttcgtcgctgagctgctttttctaattggcatcaatcgcacagaccagcctatcgcttgcgcagtgttcgctgccctactgcacttctttttcctagccgcattcacttggatgtttctcgaaggagtgcagttgtacatcatgttggtagaggtgttcgaatccgaacacagcagacgcaagtatttctacctggtgggatatggcatgcctgccctgatagtcgcggtgtctgctgcagtagactacaggagttacggcaccgataaggtctgctggctccggcttgacacctactttatttggagctttattggccctgccacactaattattatgttgaacgtgatttttctcggtatcgccctatataaaatgtttcatcatactgctatcctgaaaccagaatccgggtgcctcgataacatcaactacgaggataatcgtccttttattaagtcttgggtaatcggggcaatagccctgctgtgtttgttaggcctcacttgggcatttggccttatgtacattaacgagagcactgtgatcatggcctacctgttcaccatctttaattcgctccaaggtatgtttatctttatatttcattgcgtcctacagaagaaggtaaggaaggaatacggaaaatgcctacggacccactgctgtagcggtaaaagtactgagtcatctattggcagcgggaagacctctggaagtaggactcctggtcgctactccacaggatcccaatcacgcatcagaaggatgtggaatgacactgttcggaaacagtccgagagttcgttcatcacgggagacatcaatagctccgcttcacttaaccgaggagccatggccaatcatttgatttcaaacgccctgctgcgtccacatggaactaataatccttacaacactcttctcggagagcctgctgtctgcaacaatccatctgtctctatgtacaatgcacaggagccatatagggaaacatctatgggagtcaaactgaatattgcctaccagataggcgcaagtgagcagtgtcagggctataagtgtcacggttattccacaactgaatggtag

SEQ ID NO: 50961 - DNA, 4539 bp, Artificial Sequence
  Description of Artificial Sequence: Synthetic coding sequence
atgtggccctctcagctgttgatcttcatgatgttactcgctcccattattcatgcatttagccgggcacctatccctatggcagttgtgagacgagaacttagttgcgagtcgtaccccattgagttgaggtgtcctggcactgacgtaatcatgatagaaagcgcaaactacggccgtacagatgataaaatatgcgattcagatcccgcacagatggagaacattcgatgctatctccccgacgcatacaagataatgagccagcgatgtaataatcggacgcagtgtgccgtggttgctggacccgacgtcttcccagatccgtgtcctgggacctataagtatctagaggtgcaatacgaatgcgtaccctacaaagttgagcagaaagtgtttttgtgccctggactacttaaaggagtgtaccagtccgagcacctctttgaaagtgaccatcagagcggggcttggtgcaaagatcctctgcaggcaagcgacaaaatttactacatgccatggacaccttatcgcaccgacacccttactgaatactccagcaaagatgattttatcgcgggtaggcctactactacgtataagcttccccatcgagtggatggcacaggattcgttgtgtatgatggtgcattgtttttcaacaaggaaaggaccaggaatatagtgaaatttgacctacgaactagaataaagtctggcgaagccattatagctaacgcaaactaccatgacacaagcccataccgctgggggggaaagagtgatatagatcttgccgttgacgaaaacggcttgtgggtgatctacgccactgagcaaaataatggcaaaatcgtgatcagtcagttaaatccatacacactgcggatcgagggtacctgggacactgcatacgataagagatcagccagcaacgcctttatgatttgcggaatactgtatgtcgtgaagtccgtttatgaggatgacgataatgaggccaccggtaataagattgactacatttacaataccgatcagagtaaggatagtctagtggatgtacctttccctaattcttaccaatacatcgccgcagttgactacaatccacgtgacaatttgctctatgtctggaataattatcatgtggtcaaatacagtcttgattttggaccgcttgacagtaggagtgggcaggcccaccacggtcaggtgagctacatatctccgccaattcacttggacagcgaactggagaggccatcggtcaaggacatctccacaacaggccctctggggatgggctccactacaaccagcactacgttgaggaccacgacgttgtcaccgggaagatctaccaccccaagtgtcagtggacggagaaacaggagtacaagtacgccatcccctgctgtggaagtccttgacgacatgacgacacaccttccttccgctagtagtcaaattccagctttggaagagtcctgcgaggctgtagaggcgagggaaattatgtggtttaaaacccgtcaggggcaaattgccaaacagccatgcccggctggaaccattggcgtcagcacctacctatgcctcgcccctgacgggatctgggatccccagggtccggatttgtccaactgcagctctccatgggtgaatcacataacccagaaactgaaatccggggagacagccgcaaacatcgcacgagaattggctgagcagactaggaaccatctcaatgccggtgacataacttattctgtgcgtgcaatggatcagctggtgggtctgctggatgtccagcttcggaacttaacacctggtggtaaagacagtgccgcacggagcctgaacaagctccagaaacgcgagcgcagctgtcgtgcttacgttcaagcgatggtggaaactgtgaacaacttactgcagcctcaggctttgaacgcttggagagatcttacaacatcagatcagctgcgggcagcaaccatgctgctgcacacagttgaggaaagtgctttcgtgttggcagacaacctgctgaaaaccgatatcgtgcgagaaaacactgataacattaaactggaggttgctaggctgagtacagaaggtaatcttgaagacttgaagtttccagaaaacatgggtcacgggtcaacgatccagttgagtgctaatacactgaagcagaatggcagaaacggggagatccgtgtcgcgtttgtcctgtacaacaacttgggtccctacctcagtacggagaatgccagtatgaaactcggcactgaagcattgagcaccaaccatagtgtgattgtgaactctcccgtcatcactgcagctatcaataaggagtttagcaataaggtctatttagcagaccctgtcgtgttcacagtcaaacatataaaacagtcagaggaaaactttaaccccaattgctcgttctggagctattcaaaacgcacgatgaccggctactggagcacccagggttgtaggctgttaacaacaaataagacgcacactacatgctcgtgcaaccacctcactaacttcgccgtgctaatggcacatgtggaggtgaagcacagtgatgccgtgcatgatctgctattggacgtgattacctgggttggtattttactgtccttagtgtgcctgctgatctgcatattcacattctgcttcttccgaggactccagtctgatagaaataccatccacaagaacctatgcatctccctgttcgtcgccgaattactgttcctgatcggcataaaccgaaccgaccaacccatagcatgcgcagtattcgccgctttgcttcattttttctttctggccgcattcacttggatgtttctggaaggagtccagctgtatatcatgttggtggaagtgtttgaatctgagcatagccgacgtaagtacttctatctggtcggatatggcatgcctgccctcatcgtggcagttagtgccgcagtagactacagatcatacgggaccgataaggtgtgctggctgaggttggatacctacttcatctggtcatttatcggtcctgctaccctcattattatgctgaatgtaatttttctaggcatcgctttgtataaaatgttccaccatacagccatccttaagccagagtccggctgtctggacaatatcaattatgaagataatcgaccattcatcaagagctgggtgatcggcgctatagccctgctgtgtctgctgggccttacctgggcctttggcctgatgtacatcaacgagtctacagtgattatggcatatttattcacgatttttaattctctccagggaatgttcattttcatcttccactgcgtcctgcagaagaaggtccgtaaagagtatggtaaatgtcttagaacacactgttgctcgggtaagtcaacagaatccagtatcggatcagggaagacttccgggtctcggacccccggacgctactccacaggcagccagtctaggatacgcagaatgtggaacgacacagtcaggaaacagtccgaatcgagcttcattacgggcgatatcaactcttccgccagccttaacagaggagcaatggcaaatcacttgatcagcaatgccctgttgcggccacacggtacaaacaacccatacaatacgctcttgggcgaaccagccgtgtgtaataacccgtccgtgagtatgtataatgcacaggagggccttcttaacaatgcacgtgacacttccgtcatggacactctgccactgaacgggaatcacggcaactcatactctatcgcgagcggtgagtacctctccaactgcgtgcagatcatcgatagaggatacaaccacaacgaaacggcactagagaagaaaattctaaaggagctgacttctaactatattcccagctatcttaataatcatgagcgtagctccgagcaaaatcgcaatctgatgaataaactggtcaacaacctggggtcaggcagggaggacgacgccatcgtcctcgacgatgcgacctccttcaaccacgaagagtccttaggtttggaactgattcatgaggagagtgacgcgccactcctcccccctcgcgtctacagtactgagaatcaccaacctcatcattacacaaggcgcaggataccccaggaccactcggagtcattctttccattgctcactaacgagcacactgaagatcttcagtccccccatcgcgacagcctctatacatccatgccaactctcgccggagtcgccgcaacagaatctgttacgacctcaactcagacggagcctcccccagcaaagtgcggggacgcggaggacgtctattacaaatctatgcctaatctgggaagtaggaatcatgtgcatcagctccatacgtactatcagctggggcgagggtcctccgacggatttatcgtgccgccaaacaaagacgggacccctcctgagggaagttccaaaggaccagcccatcttgtgactagcctgtag

SEQ ID NO: 50962 - DNA, 3927 bp, Artificial Sequence
  Description of Artificial Sequence: Synthetic coding sequence
atgtggccgagtcagttgctgatctttatgatgctgctagcgcctatcattcacggtggcaaacactccgagcggcaccctgcgctggccgctccgcttcgtcacgccgaacgctcaccaggaggcgcactccctcccaggcacctcctgcagcagcccgctgccgagcgcactgcggcacacaggggacaaggcccacgaggggcaaccagaggtgtgcggggtccgggtgcccagggtgcacagattgccgctcaggcattttctagagcaccgatccctatggccgtcgtgcggagggaactgagttgtgaaagctaccccatcgaacttcgatgtcctggcactgatgtgattatgattgaatcagcaaattatggccgaactgacgataaaatttgcgattccgaccctgcacagatggagaatattaggtgctacttaccagacgcttataagatcatgagtcagaggtgcaacaatagaacccagtgtgcagtcgtggctggaccggatgtctttccagatccatgtcctggtacctacaaatacctggaagtgcaatacgaatgtgttccatacaaggtggaacagaaggtgtttctgtgtcctggacttcttaagggggtttaccaaagcgagcacctgtttgagtcagaccatcagagcggagcctggtgcaaggatcctcttcaggccagcgacaagatctactacatgccttggacaccctacaggactgatactcttacagaatattcttcaaaggatgactttatcgcgggacgcccaactacgacgtataaactaccgcatcgcgtcgacggtactggcttcgtcgtatatgacggagccctgttttttaataaagagcgaacgagaaatatcgtgaaatttgacttgcgcacaagaattaagtcgggcgaagctattattgctaacgccaattatcatgatacctccccttacaggtggggcggtaagagtgacatcgatctggcagtggacgaaaatgggctctgggtgatatacgccactgaacagaataacggtaaaatcgttatcagccagttaaacccctatacccttagaatcgaaggcacctgggacacggcctacgataaaagatcagcctccaatgcttttatgatctgtggcattctctatgtcgtgaaatctgtatacgaggacgatgataatgaagcaactggaaataaaatagactacatctataatacagaccaaagtaaggacagtcttgtcgacgtaccgtttccaaactcctaccaatatatagcagcagtggactataatcctcgcgataaccttttgtatgtgtggaataactatcacgtcgttaagtattctctggactttgggccattagattctcgctctggccaggcgcatcatggacaggttagctacatctctccaccgatacacctggactcagaattggagcggccttccgtgaaagatatctctaccactggaccattaggtatggggagcacaaccacgagcacaaccttgcgcactactactttgtccccaggcaggagcacaaccccatcagtgagtggaagaaggaatcggtctaccagcaccccctctcccgctgtggaagtgctggacgatatgacgactcatttaccttccgcctcatcgcagattcccgctttggaggagagttgtgaagccgtcgaggctagggagattatgtggttcaagaccaggcaaggccaaatagcaaagcagccatgtcctgcagggaccatcggtgtgtcgacttatctctgcctggctcccgacggtatctgggacccccagggcccagacctgagtaattgcagctctccctgggtcaaccacattactcagaagctgaagtccggggagaccgcggcaaatatagcccgtgagctggcagaacagactagaaatcatctcaatgccggtgacatcacctattccgtgagagccatggatcaacttgtaggcctgctggatgtccaattaagaaatctcacccctggagggaaggattccgctgcgcgttctctcaataagttgcagaagcgtgagcggtcctgtagagcgtacgtccaagctatggtcgagactgtgaacaatctgttgcaaccacaggccctaaacgcatggagagatctgactacttctgatcagcttcgggctgccaccatgctactgcataccgtcgaggagtccgcctttgtgctggcggataatctcctcaaaaccgacatcgtgagagaaaataccgacaacattaaactagaggttgcaaggctgtctacagagggaaacctggaggacctaaagtttcctgagaatatgggccacgggagcaccattcagctaagcgccaatactctgaagcagaacggcaggaacggcgagatccgcgtggctttcgtcctttacaataatctcggcccttacctgtccacagaaaatgcaagtatgaagttaggcaccgaagcgctatcaaccaatcattcagttattgtaaattcacctgttataaccgcagcgataaacaaagaattcagcaataaggtttatctggcagaccctgtggttttcaccgtaaaacatatcaagcagagcgaggaaaactttaatccaaactgttctttttggtcctactccaagagaactatgacggggtactggtctacgcagggttgtagactgctgaccacaaacaaaactcatacaacgtgctcctgcaatcatttgacgaatttcgccgttctgatggcgcacgtcgaagtcaagcactcggacgccgttcatgacctgctccttgatgtcattacatgggtagggattctcctctcattagtctgtctactcatatgcattttcactttttgtttctttagagggctgcagtccgaccgtaacacgatccacaagaatctgtgcataagtctgttcgtagcggagttattgttcctcatcgggatcaaccgaacagaccagcctatcgcctgcgccgtgttcgcagctctgctccacttctttttcttggccgcttttacttggatgtttctcgaaggagtacagctgtacatcatgttagtcgaagtcttcgagagcgaacattctaggcgcaagtacttttatctggtcggctatggcatgcccgctctaatagttgccgtgagtgctgctgtcgattaccgcagctacggaacagataaggtgtgttggctccgcctggacacttatttcatctggagcttcatcggtcccgctacactgattatcatgctgaacgtgatcttcttggggatcgcgctgtacaagatgttccatcacactgccattcttaagcccgagtctggctgtctcgacaatattaactacgaggataaccgcccttttataaagagctgggtgataggcgcaattgccctcctctgccttctagggctcacctgggccttcggcctgatgtatattaacgaaagtaccgtgattatggcgtatctctttaccatctttaactcacttcagggcatgttcatctttatcttccattgcgtcttgcagaagaaggtacgcaaggaatacgggaaatgcctgagaacacactgctgtagtggaaagtctactgaatcttcaattgggagtgggaagacctccgggagtcgcactccaggccgatactcgacaggatcacagtctcggatccggagaatgtggaacgacactgtacgcaagcaatctgagagcagcttcattactggagacattaattcatccgctagccttaaccgggagccgtacagagaaacgagcatgggggtgaaactgaatattgcataccagattggcgcttccgaacaatgccaggggtataaatgccacggctatagtaccacagaatggtag

SEQ ID NO: 50963 - DNA, 3900 bp, Artificial Sequence
  Description of Artificial Sequence: Synthetic coding sequence
atgtggccttctcagttactgatcttcatgatgcttcttgcccctatcatccacggaggaaaacactctgagagacatccagctctggctgccccactaaggcacgctgagaggtctcccggaggagccctgccacccagacacctcctccaacagcccgctgcagaacgtactgccgcacacagagggcaaggtcctcggggagcaacacgcggagtgcgcggaccaggggctcagggagctcaaatcgccgctcaggcattctctcgagcccctattcccatggccgtggttcgcagggagctttcttgtgagtcataccctatcgagcttaggtgtcctggaacggacgtgattatgatcgagagcgcaaattatggacgcaccgacgataagatatgcgactcagatcctgctcaaatggagaacattcgatgctacttaccagacgcctataagatcatgtcccaacgctgcaataacaggacccagtgcgctgttgtggcgggacccgatgtctttccagacccctgtcctggtacatataagtatctcgaagtgcagtacgaatgtgtgccgtataaagttgagcagaaagtgtttctttgcccgggactcctgaagggcgtttaccagtctgagcatcttttcgaatccgatcatcaatctggtgcttggtgtaaagatcccttacaagccagcgataagatatactatatgccatggaccccctaccgcacagacacactgacagaatactccagcaaggacgacttcattgccggacgcccaaccaccacttataaactgcctcaccgtgttgacgggacgggcttcgtggtgtacgatggggcactgttcttcaataaagagcgtaccaggaacattgtcaagttcgatctgagaactcgaataaagagcggcgaggcaattattgcgaatgccaactatcacgatacctcgccctaccggtgggggggtaagtcagatatagatttagctgtagacgagaacggcctgtgggtgatctacgctacagaacagaataacggaaagattgtcattagtcagctcaatccttacactctccgtatagaaggcacctgggacaccgcctacgataagcgcagtgcttccaacgctttcatgatttgcggcatcctgtacgtagtgaagagtgtttatgaagatgatgacaatgaggccactggtaataagatcgactacatttacaatactgatcagagtaaggattccttggtggatgtgccgtttccaaatagctaccagtacatagccgcagttgactataaccccagggataaccttctatacgtgtggaataattatcacgtcgttaagtattcgctggactttggcccactggatagtaggtccggacaggcccatcatggccaggtgtcgtatatctccccaccgatccacctcgattccgaacttgaacgtccatccgtgaaggacatctccactaccggcccactgggtatgggcagcaccactacgtctaccaccctgcgtaccactaccctatctcccggacggtccaccactccatccgtgagtggcaggcgcaatcgcagcacgtcaacacccagtcccgcagtggaggtcctggatgatatgaccactcacctccctagcgcttccagccagattccggctctggaagagtcatgcgaggcagttgaggcccgagaaattatgtggttcaagacacgacaaggacaaatcgctaaacaaccctgccctgcgggaacaatcggcgtctctacatacctgtgtctagccccagacggcatttgggatccccaggggcctgatctgagcaactgtagttcaccatgggtgaaccacataactcagaaacttaaaagtggagagacggctgccaacatcgcccgagaattggcagagcagaccagaaatcatttgaacgcaggcgacatcacatactccgtgagagcaatggaccaattagtgggcctgctggatgtgcagctgcgaaacctcactccgggtggaaaagacagtgctgccagatcactcaacaagctgcaaaaacgcgagcgtagctgtagagcgtacgtgcaggccatggtggaaacggttaacaatctgctccagccacaggcactgaacgcctggagggacctaacaaccagcgatcagctgagagctgccacaatgctactgcacacagtggaagagtctgcgtttgtcttggcagataacttgctaaaaacggatatcgttcgggaaaatacagataacatcaagctcgaggtggccagactttcgaccgagggaaaccttgaagacctgaaattcccagagaacatgggacacggtagtaccattcagctaagtgcgaacaccctgaaacagaatggaagaaatggtgagatccgggtggcctttgtgctctataataacctcggcccatatctcagtactgaaaacgcaagtatgaaactcggcactgaggcgctgtcgacaaatcattctgtgatcgtgaattcgccagtgatcacagcggcaatcaataaagagttttcaaacaaggtgtatctggccgacccggtcgtcttcactgtgaagcatattaagcagtctgaggaaaattttaatccaaattgctcattctggagttactcaaaaagaactatgacaggatattggagtacacaggggtgcagacttttaaccaccaacaaaacacatacaacatgttcctgtaaccacctgaccaatttcgcggttctaatggctcatgtggaggttaaacactcagatgccgttcacgatctccttctggatgtgattacttgggtaggtatacttctttctttggtttgcctgctcatctgcatttttaccttttgtttttttagggggctgcaaagcgatcgaaataccatccacaagaacctgtgcatatccctgttcgtagcagagttgctctttctcatcggaattaacaggaccgatcagcctattgcatgtgccgtgttcgctgctctgcttcatttctttttcctcgccgctttcacatggatgttcctagagggcgtgcaattgtatataatgctggtcgaggttttcgaatcagaacactccaggagaaagtacttctacctggtaggatacggcatgccggcactgattgtggccgtttctgccgctgtggactacaggtcctatggaactgacaaggtctgctggttgcgtctcgacacatacttcatctggagtttcattggaccagccacactcatcataatgttgaatgtcatttttctcgggatcgctctgtacaaaatgttccaccacacggccatcttaaagcccgagtctggctgcctggataacatcaaaagctgggttataggggctatcgcgctgttatgccttcttggactcacctgggcctttggcctgatgtatattaacgagtcaactgtcattatggcttatctgttcacaattttcaatagcttgcagggcatgttcatctttatatttcattgcgtgctgcaaaagaaagtgaggaaggagtacggcaagtgcttacgaacacactgctgctctgggaagtcaacagaatctagtatcggtagtggcaagaccagcggctcacggactccagggagatatagcaccggttctcagtccaggattcgtcgcatgtggaacgatactgtgagaaagcagagcgaatctagtttcataaccggggatatcaacagcagtgccagtctcaatcgagagccatatagagagacgtctatgggggtgaagctgaacattgcctaccagataggtgcctccgagcagtgccagggatataaatgtcacgggtattccaccacagaatggtag

SEQ ID NO: 50964 - DNA, 3723 bp, Artificial Sequence
  Description of Artificial Sequence: Synthetic coding sequence
atgtggcctagtcagctcctgatctttatgatgctcctggccccaatcatccatgccttcagcagagcgcctatccccatggccgttgtcagaagggaactttcctgcgagtcttaccccattgagcttcggtgccctgggacagatgttatcatgattgagtcagccaactacggcagaacagacgacaagatttgcgatagcgacccggctcaaatggagaacatccggtgctatttacctgatgcatacaagataatgtctcagcgctgcaacaacaggacccagtgtgcagtggtggccggacccgatgtattcccagacccctgccccggtacatacaagtatttggaggtccaatacgagtgtgtgccctacaaagttgagcagaaggtgtttctttgtcctggcttgctgaaaggggtataccaaagcgaacatctcttcgagagtgaccatcaaagcggggcatggtgtaaggatccactgcaggcatcggataaaatctactatatgccatggacaccttatagaactgacaccctcacagagtatagtagcaaagatgattttatcgcgggaagacccactacaacttataaactgcctcacagggtggacggcactggttttgttgtttacgacggagccctgttttttaacaaagaaaggaccagaaatatcgttaagttcgatctgaggacccgcattaagtcaggcgaagccattatcgctaacgcgaactaccacgataccagtccatatcggtgggggggtaaaagtgacatcgacctcgctgtggatgagaacggtctctgggttatttacgctactgagcagaataacggcaagatagtgatctctcagctgaacccctacacgctgcggattgagggaacttgggacacagcatatgacaaacgcagcgcttccaacgctttcatgatttgcggaatcttgtatgtggtcaaaagtgtctatgaggatgatgataacgaggccacaggtaacaaaatagactatatttataacacggaccagagcaaagactctttggtcgatgtgccttttcccaactcgtatcaatacatcgcagctgtggactataaccctagggacaacctcctttacgtgtggaataactaccacgtggtcaaatatagtctcgactttgggcctctggacagtagaagcggccaagcccaccacggccaggtcagttatatctctccaccaatacatttggattccgagcttgagagaccctcagtaaaggacattagcactaccgggcctttaggtatgggtagtacaaccacttccaccacacttcggacaacaacactttcccctggacggagcaccacaccatccgtgtctggaagacgcaatcgtagtacatcaactccaagccccgctgtagaggtcctagacgacatgacaactcatctgcccagcgccagctcccaaatcccagcattggaggagtcatgtgaagcagtcgaagccagggagattatgtggttcaaaacccgtcaagggcagatagctaagcagccttgtcctgctggtactattggcgtctccacttacctttgtttagcgcctgatgggatttgggacccacaggggcctgatctgagcaattgttcttccccatgggtaaaccatattacgcagaaactcaagagtggggaaactgccgctaacatcgcgagagagctggctgagcagacgaggaatcatctgaatgcaggagacatcacatactctgtgcgggctatggatcaactagtcgggcttctggacgtccagctcaggaatctgactcctgggggtaaggattcggcagccagatcactcaacaagctgcagaaacgggaaagatcttgtcgcgcatatgtccaggcgatggttgagacagtgaacaatctccttcagccacaggcattgaatgcttggagagacctcacgactagcgatcagcttcgtgccgctactatgctactacacaccgtggaagagagtgcttttgtactggcagacaacttattgaaaacagatatcgttcgagaaaataccgataatatcaagctcgaagtggctagactctccactgaagggaatcttgaagacctcaaatttccagagaatatgggacatggttctaccattcagttgtcagcaaacactttgaagcagaacggtcggaatggtgagatccgagtggccttcgtattgtacaacaacctgggcccatatctgagcacagaaaacgcatctatgaagctgggcactgaggcactgagcaccaaccactctgtcatcgtcaacagccccgtgatcacagcagccatcaacaaagaattctctaataaggtctacctggccgaccccgtcgtgttcaccgtcaaacacatcaagcagagtgaagaaaatttcaatccaaactgctctttttggtcctattccaagcgtactatgacagggtattggagtacccagggttgcaggctgctcactaccaataaaactcacacaacctgttcctgtaatcatttgaccaatttcgctgtgcttatggcccacgtggaggttaaacattctgatgcagtgcatgacttacttctggacgtgattacctgggtgggtattttgctatctcttgtgtgtttactgatttgcatttttactttctgttttttccggggattgcaaagcgataggaacacaattcacaaaaacctttgcatcagtctgttcgtcgcggaactcttgttcctgatcggcataaaccggacagaccagcccatagcttgcgccgtgtttgccgctttgctgcacttcttctttctggctgctttcacttggatgttcctggagggtgttcagttgtatatcatgctggtggaggtgtttgagtccgaacacagccgtaggaagtacttttacctggtgggctacgggatgccggctctgatcgtggctgtgtccgctgccgtagattacagatcctacgggacggataaggtttgttggctccgtctcgatacttatttcatctggtcgttcattggacccgctacattgattatcatgctcaatgttatttttctcggtattgcactttataaaatgtttcatcatacagctattctgaaacccgagagtggctgtcttgacaacatcaattacgaagataacaggccattcatcaagtcgtgggtcatcggggctattgctctactttgtcttcttggcttaacttgggccttcgggttgatgtacattaatgagagcaccgtgatcatggcctacctcttcactatatttaattccctccagggaatgttcatctttatatttcattgcgtgctccagaagaaggtgagaaaagagtacggcaagtgccttcgtacccactgctgctccggtaaaagcaccgagtcaagtatcggcagcggtaagacctccgggtcaaggacccccggtaggtactcaactggaagccaatctaggattcgcagaatgtggaatgataccgtacggaagcagtccgagagttccttcataaccggcgacatcaactcctctgccagtcttaatcgggagccttaccgagaaacatccatgggagtgaaattgaacatcgcataccagatcggcgcaagcgagcagtgccaaggctataagtgtcatggatacagtacaactgaatggtag

SEQ ID NO: 50965 - DNA, 3825 bp, Artificial Sequence
  Description of Artificial Sequence: Synthetic coding sequence
atgtggccgtcccagcttcttatctttatgatgctcctggccccaatcatccacgcgtttagcagggctccgattccaatggctgtagtgaggagagagctctcctgcgaaagttatccgatcgaactccgctgtcccggaaccgatgtgatcatgatcgaatctgccaattatggtagaaccgacgataagatttgtgatagcgacccagcccaaatggaaaatatccggtgctatctccccgatgcctataaaatcatgagtcagcgctgcaacaacaggacacaatgcgccgtggtggcagggcctgatgtatttcccgacccctgtccaggaacttacaagtatctcgaggttcagtatgaatgtgtcccttacaaagtggagcagaaagtcttcttgtgtcctgggctcttaaagggagtctaccagtccgagcacttgttcgaatccgatcaccagagcggtgcctggtgtaaagacccgctgcaagcatccgacaaaatttactatatgccctggactccatatcggacagataccctgacggagtatagttcaaaagatgattttatcgccggacgacctaccactacctacaagctgccccatcgggtggacggtacaggcttcgttgtgtacgacggtgccctcttttttaacaaagagcgtacccgaaatatagttaagttcgatttgaggactaggattaagtctggggaagccataatcgccaacgcaaactaccacgatacaagtccctatcgttggggtggaaagtccgatatcgacctggcagtagacgagaatggactctgggtgatctacgccaccgagcaaaacaatggcaaaattgtcatctcacagttaaatccctacactctgcgtattgaaggtacgtgggacaccgcttatgataagaggtctgctagcaacgcattcatgatttgtggcatattgtatgtcgttaagagtgtctatgaagatgatgataacgaggcaactggtaacaagatagattatatctacaacactgatcagtccaaggattccctggtggacgtgccattcccgaacagttatcagtatatcgcagcggtggactacaacccaagagacaatcttttatatgtgtggaataactaccatgtcgtgaaatatagcctggacttcggtccgctcgacagtcgcagtgggcaagcacaccatggacaagttagctatattagtcctccaatccatttagacagtgaactggagagaccatctgttaaggacatatctaccactgggcctttgggtatgggctctaccacaaccagcaccacactgagaacaacgacgctcagccccggtaggagcacgactccttccgtcagcggcaggagaaaccgtagcacatcgaccccttccccagccgtggaggttttagacgacatgaccactcaccttcccagcgcttccagccagatccctgccttggaagaaagctgtgaggccgtggaagcgagggagatcatgtggtttaagacccgccagggccagatcgcaaaacagccctgtccggctggtactattggcgtcagtacctatctctgtctcgcacccgacgggatctgggatccccagggtcctgacctgagcaactgctcatccccatgggtaaaccatattactcaaaaactgaagtccggtgaaacggctgccaacattgctcgcgaattggctgagcagactcggaatcatctcaatgcaggcgatatcacatactcagttagggccatggaccaattagtgggcctactcgatgtccagctgaggaacttgacgcccggtggcaaggacagtgccgcaaggagcctgaacaaattacagaaacgggagcggtcctgcagagcctatgtccaggcaatggtggaaaccgtgaacaatctgctgcagccacaggctctaaatgcttggagggatctcaccacctccgatcagcttagggccgcaacaatgctcttgcacaccgtggaagaatccgcatttgtgctggctgataacctccttaaaacagacatcgtgcgcgaaaataccgataatataaagctggaagtcgctaggctctctacagagggcaatctggaagacctaaagtttcctgaaaatatgggccacggaagtactatacagctcagcgcaaataccttaaagcagaatggcagaaatggcgagatacgtgtcgcattcgtgctgtacaataatctaggcccttacctctccaccgagaatgcatccatgaagctgggcactgaagctctcagtaccaaccactcggtgattgtcaattccccagtgattaccgccgctattaataaggagttcagcaataaagtgtacctcgctgaccctgtggtcttcaccgtgaagcatattaaacagagcgaggagaattttaacccaaactgtagtttttggtcctacagcaaacggacgatgaccgggtattggagcacacagggctgtcgactgctcacaacaaacaagacacatacaacttgcagttgtaaccacctcaccaactttgcagttttaatggcccacgtggaggtcaaacatagtgacgccgtgcacgacctgctacttgacgtgattacgtgggtgggcatcctgctttccctcgtctgtctgctgatatgcattttcacattttgcttttttcgaggtctccagagcgatcggaacaccattcacaagaacctgtgtatctcgctgtttgtggccgagctgttgtttctgattggtataaataggacggatcaaccaatcgcatgtgccgtgtttgctgctttacttcatttcttcttcctcgcggcttttacctggatgtttctggagggcgtacaactgtacattatgttggtggaagtgtttgaatcagaacactctcgcagaaaatacttctacttagttggctatgggatgccggctctgattgtggccgtcagcgccgctgtagactacaggtcatacggtactgacaaggtatgttggctgcgactggatacgtactttatatggagcttcattggtccggctactcttatcatcatgttgaatgtcatatttctggggatagctttatacaagatgttccaccacacggctatacttaaacccgaatccggatgtctggacaacatcaagtcctgggtaatcggcgctattgccctgctttgtctgctgggcttgacatgggctttcgggctgatgtatatcaacgagtcgaccgtgatcatggcatacctgttcaccattttcaactctttgcaaggtatgttcattttcatttttcactgcgttttgcagaagaaagtgaggaaggagtacggcaagtgcctgcgcacccattgctgtagtggtaagagtactgaatcctctatcgggtctggaaagacctccggttctaggaccccaggtaggtactccaccgggagtcagtcgcggatcaggagaatgtggaacgacacagtgcggaaacagtctgagagttcttttattaccggagacattaacagttctgcgtctctaaatagaggagccatggcaaaccacttaatcagcaatgctctgttaagaccccatggcacaaacaacccttataacacacttctcggggaacccgctgtgtgcaataatccttctgtcagtatgtacaatgctcaggagccttacagggaaacctctatgggcgtgaagcttaacattgcgtatcagatcggagcctcagagcagtgccaggggtacaaatgtcacgggtactctaccaccgaatggtag

SEQ ID NO: 50966 - DNA, 4410 bp, Artificial Sequence
  Description of Artificial Sequence: Synthetic coding sequence
atgtggcctagccaactgctcatctttatgatgctcctggccccaatcatccacgccttctctagagcacccatccccatggcagtggtcagacgcgagttatcttgtgagtcttaccccatagaattgcgctgtcccggaactgacgtgataatgattgaaagtgccaattatggccgaaccgacgacaagatctgcgatagtgatcccgcacaaatggagaacattcggtgttacttaccggacgcctataagataatgagtcaaagatgtaacaataggacacagtgtgcggtggttgcgggacctgacgtgttccccgatccatgccctgggacttacaagtatctcgaggtgcagtatgaatgcgtgccttacaaggttgagcagaaggtgttcctctgtcctggattactgaaaggtgtgtaccagagtgagcacttgtttgagtcagatcatcagtctggcgcatggtgtaaggacccccttcaagcttcagataagatttattatatgccttggactccctatcggaccgacactctgaccgagtatagcagcaaagatgatttcattgctggtcgacctacaacgacatacaaactaccacacagggtcgatggcaccggcttcgtagtgtatgacggcgcactctttttcaataaggagagaaccagaaatatagtgaagtttgacctgcgcacacgcataaagtctggcgaggcaattatcgccaatgccaattatcacgacaccagcccctatcgctggggcggtaaatctgacatcgaccttgctgttgatgagaacggtctatgggtgatctacgctaccgaacagaacaatgggaagatcgtaatttcacaattaaacccatacactctcaggattgagggcacctgggacacggcatatgacaagcgcagtgcgagcaacgcttttatgatctgcgggatcttgtacgtagtgaagagcgtctatgaagacgacgataacgaggccactggtaataagatcgattatatatataacacagaccagtccaaagatagcctcgtggacgtgccctttcccaattcttaccagtatattgctgcagtggattacaatcctcgggacaacttgttgtacgtgtggaataattatcacgtggtgaaatactccctcgacttcggtcccctggactctcggagtggtcaggcccatcacggccaggtgtcctacattagcccccctattcacctggattcagagcttgaacgcccttcggttaaagacatctcaaccaccggaccgttaggcatgggatcaaccacaacctctaccactttacgcactacaacattgagccccggacgttccaccactccctcagtctcgggccgaaggaatagatcaacttccaccccgtcccccgctgttgaagtcctggacgatatgactacacacctgccgagcgcctcaagccagatccctgcactcgaggagagttgcgaagcagtggaggctcgcgagatcatgtggtttaagactaggcaaggtcagatcgctaagcagccctgccctgccggaaccattggtgtcagcacatatctttgcctggctccggacgggatctgggacccacagggccctgatctcagcaactgttcttctccctgggtcaatcatataactcaaaaattgaaatctggcgaaacggcagccaacattgccagagaacttgcagagcagactaggaaccacctaaacgcgggagacattacttattctgtgagggctatggatcaattggtgggactgctggacgtacagctgaggaaccttacccccggtggaaaagatagcgctgcacgctccttaaacaaattgcaaaagagggagcgctcttgccgcgcttatgttcaagcaatggtggagactgtcaataatcttctgcagccacaggcccttaacgcgtggcgggaccttaccacttccgaccagctgcgcgcagcaactatgctcttacacaccgtagaagagtctgcctttgtgctggctgacaatctgctgaagaccgacatagtgagagaaaacactgataacattaagctggaggttgccagactctcaaccgaaggcaatctggaagatcttaagttcccagagaacatgggccacggttctaccatccaactcagcgcaaatacattaaaacaaaacgggcgaaatggagagattagggtcgcgttcgtcctgtacaataacctgggtccttatctctccaccgagaatgcttccatgaagctgggaaccgaggcgctttcaacaaatcactctgttatcgttaacagtcccgtcattacagcggcaattaacaaggagttctcaaataaggtctacttagcagacccggtcgtttttaccgttaaacacatcaaacaatctgaagagaatttcaatccaaattgtagcttctggtcatatagtaaacgtactatgactggatactggagcacccagggctgcaggctgcttacgacgaacaagacgcatactacctgttcttgtaatcatctgacaaactttgcagtgttgatggctcacgtggaggtgaagcactccgatgccgttcatgacctcttgctagacgtcatcacgtgggtgggcatcctgcttagcctcgtgtgcttgctgatctgtatttttactttctgtttctttcggggtttgcagtctgataggaacacaatacacaaaaatctttgcattagcctcttcgtcgctgaactcctgtttctgatcggtatcaacagaactgaccaaccaattgcatgtgcggtgttcgccgctctgttgcattttttctttttggctgctttcacctggatgttcctggagggtgtccagctctatattatgcttgttgaggtcttcgagtctgaacacagtagacgcaagtatttctatttggttggctatgggatgccagcgctgattgttgctgtctccgcagccgtcgactatagatcctacggcaccgataaagtctgttggcttagactggatacctatttcatttggagtttcattggtccagcgactctcatcattatgctcaacgtgatatttctggggatcgcgctgtataagatgttccaccataccgccattcttaagccagagtctgggtgcttagataatatcaactatgaagacaatcgcccattcatcaagagttgggtaattggagctatcgctctcctgtgtctgcttggcctgacttgggccttcggcctcatgtatataaacgaaagcacagttataatggcttacctatttacgatcttcaatagtctccaggggatgttcatctttatcttccattgcgtccttcaaaaaaaagtacggaaggagtacggaaaatgcctacggacacactgctgctcaggaaagtccactgagtccagtatcggaagcggtaagacgtccgggtcaaggactcccggacgatacagcaccggcagccagtcccgcattagacgtatgtggaacgacacggtgcgcaaacagtccgagtccagcttcataactggcgatatcaactccagtgcctcactgaaccgcgaaggtttgctcaacaacgctagggatacgagtgtcatggacaccctgcctcttaatggaaaccacggcaactcatattctatcgccagcggcgagtacctgtcaaactgcgtgcagataattgacaggggatataaccacaatgaaaccgcgcttgagaaaaaaattctcaaggagcttacctcaaactatattcccagctacctgaataatcacgagcgcagtagtgagcaaaatcgcaatctgatgaacaagctggtgaacaacctgggcagtggcagagaggatgatgctatcgtgctcgatgatgccaccagtttcaaccacgaagaatccttggggctggagttgatccacgaagaatccgacgcccctctgttacctccaagggtttacagtacagagaaccaccagccccatcattatacccgccgtaggataccacaggatcattccgagtcatttttccccctgctcacaaacgagcacacagaagacctgcagagcccacatagggatagcctgtacaccagcatgcctaccctggcgggtgtggctgcgaccgagtccgtgaccaccagcactcagacagaaccccctcccgcaaagtgtggagacgccgaggacgtttactacaagtcaatgcctaacttgggttcgaggaaccacgtccatcaactccatacttattatcagctgggaaggggcagtagtgacggttttatcgtccccccaaacaaggacggaaccccaccagaggggtctagtaagggacctgctcacctcgtgacttccctttag

SEQ ID NO: 50967 - DNA, 4512 bp, Artificial Sequence
  Description of Artificial Sequence: Synthetic coding sequence
atgtggccatcccagctgctaatttttatgatgctgctcgcccctatcattcacgccttcagtagggcgcctattcccatggccgtcgtacgcagagagctgtcctgtgagtcttaccctatagagctgcgatgccccggaacagatgtgatcatgattgaatctgccaactatggaagaacggatgacaaaatttgtgattcagatccagcacagatggaaaatattagatgctacctccctgacgcatacaagatcatgagccagcgctgcaacaatcggacccagtgcgctgtggttgctggcccagacgtatttccggatccctgtcctggcacctacaagtacctagaggtgcaatacgaatgtgtcccttataaagttgagcaaaaggttttcttatgcccaggcctgctgaagggagtttaccagtcggagcacctcttcgagtcagatcaccagtcaggggcttggtgcaaggatcccctgcaggcctccgataagatctactatatgccgtggacaccttatagaaccgacaccctgactgaatattcgtccaaagatgatttcatcgccggacgacctaccaccacttataagcttccgcaccgtgttgatggcaccggctttgtcgtatacgatggggctctgtttttcaataaggagcggacccgtaacattgtgaaattcgatctccgtactcgtattaagagtggcgaggctattatcgccaacgcaaactaccatgacacaagtccatatcgctggggtggaaagagtgacatcgatcttgctgttgacgaaaatgggctgtgggttatatacgcaactgaacagaataacggcaaaatcgtgatatctcagcttaacccctacaccctgcgaattgaagggacatgggacaccgcttatgataaacgctccgcctcaaacgccttcatgatatgtggtattctctacgttgttaaaagcgtgtacgaggatgacgataacgaggcaacggggaacaaaatcgactatatttataataccgatcagagcaaggactcgttggtcgacgtccctttccccaactcataccagtatattgcagccgtcgactataatccgcgagacaatctgctgtatgtgtggaataactatcacgttgttaagtacagcctagattttggccctctcgatagtagaagtggccaggcgcaccatggtcaggtttcctacattagccccccaattcatctagacagcgagctcgaacggccatccgttaaggatatttcaacaactggaccactgggaatgggatccactacaacaagcactaccctgagaaccactaccctcagtcccggacggtccaccactccctctgtgagcggcaggagaaatagatctacaagtactcccagcccggctgttgaagtcctggatgacatgaccacccatctgccctcggcatcttcgcagattcccgctctggaagaaagctgcgaggcggtagaagcccgagagataatgtggttcaaaacacgccaaggacagatagctaaacagccgtgtccagccggaacgattggggtatcaacctacttgtgcttggcccctgatggcatttgggaccctcaggggcctgacttgagtaattgctcctccccttgggtcaatcacatcacgcagaagctcaagtcaggcgaaaccgcagccaatatcgcacgggaactcgcggagcaaacacgcaatcacctgaatgccggtgatatcacttactctgtgagggccatggaccaattggttggcttacttgacgttcagctcagaaatctgactcctggaggaaaggactcagcagccagaagcctgaacaaactgcaaaaacgggagcgttcgtgccgggcatatgttcaggccatggtagaaacagtaaataaccttctgcagcctcaggccttgaacgcttggagagacctcaccactagtgaccagcttagggcagctactatgcttctccacactgtcgaggaaagcgcatttgttctggccgacaacctgctcaagacggacattgtgcgggagaataccgataacatcaagctggaggtggctcgcctgagtacagagggtaatttggaagaccttaagttccccgaaaatatgggacatggctccaccatacagttgagcgccaataccctgaaacagaacggcaggaatggagaaattcgcgtggctttcgtcttgtacaacaatctgggtccttacctgagtacggagaacgcctctatgaagcttggtaccgaagcactgtccactaatcattcagtgattgtgaactcgcctgttattactgcagccattaataaagaattttctaataaggtctacctggcagacccagtagtctttaccgttaagcacatcaagcagagtgaagagaacttcaatccaaactgctcgttctggagttattcaaagcggacaatgacgggctactggagtacccagggctgtaggcttttgaccactaataaaacgcatacaacttgcagttgcaaccacctaacaaacttcgcggtgctgatggcccacgtggaggtcaaacacagtgatgctgtgcacgacctgctgctcgacgtgatcacatgggttgggatccttctctctctggtgtgcctgcttatttgcattttcacgttttgtttctttaggggcttgcagtctgaccggaatacaatccacaagaatttgtgcatctccctgttcgtggccgaactgctgtttctcattggcatcaaccgaaccgaccagcccatcgcttgcgcggtgtttgccgctttactgcattttttttttctggccgcattcacctggatgtttctggagggcgtgcagctttatatcatgctggttgaggtgttcgaaagcgagcacagccgccgaaaatatttttacttggtcggctatgggatgcccgcactcattgtcgcagtgagcgccgctgtggattaccgaagctacggcactgataaagtgtgttggttgcgactggatacatactttatttggagttttatcggcccagcgacactcattattatgctgaacgtcattttcctgggcatcgctctctacaagatgtttcatcacactgcaatcttgaagccagagtccggctgcctggacaatattaagtcgtgggtgatcggcgcaatcgccctgctctgtttactcggactgacttgggcattcggtctgatgtacattaacgagagcacagtaattatggcttaccttttcactatattcaactcattgcaaggcatgtttattttcatatttcactgtgttctgcaaaaaaaagttagaaaggagtacggcaagtgccttcgcacccactgctgtagtggaaaatccacagagagctctataggctctggcaagactagtgggagccgcacccccggacgatactccaccggcagccagagcagaattagacggatgtggaatgataccgtgcgaaagcagtcagaatcctctttcataaccggcgatattaactcttccgcaagtctgaacaggggcgctatggccaaccacctcatatccaacgcgttacttcgaccacatggaactaataacccctacaataccctgctgggagaacccgctgtatgcaacaacccgtcagtatccatgtataacgctcaagaaggacttcttaacaacgcccgtgacacttcggtaatggacacattgcctctcaacgggaatcatgggaactcttactctatcgctagtggggagtacttgtccaattgtgtccagattattgatcgtggctacaaccataatgaaaccgccctcgagaaaaagatcctgaaggagctcacttccaactatattcctagctatctgaacaatcatgaaagaagctccgagcagaaccgcaaccttatgaataagttggtcaataacctggggagtgggcgagaggacgatgctatagttctcgacgacgctacgtcttttaaccacgaagagagcttgggcctggaattgattcacgaagagagtgacgcaccacttctgcctccacgggtgtactccactgaaaaccaccagcctcatcactataccaggagacgcattcctcaggatcattccgagtcttttttcccgctactgactaatgagcacaccgaggatctccagtctcctcacagggattctctgtatacatcgatgcccaccctcgcaggggtggctgccacagagtcagtgaccacatcaacacagaccgagcccccacccgcaaagtgtggggacgcagaggacgtatattacaagagcatgcccaatctcggaagtcgaaaccacgttcaccagctgcacacctattatcagctgggcaggggatcaagcgatgggttcatcgtgcctcctaacaaggatggaacaccccctgagggatccagtaaagggcctgcacacctggtcacttctttatag

SEQ ID NO: 50968 - DNA, 2124 bp, Artificial Sequence
  Description of Artificial Sequence: Synthetic coding sequence
atgtggcccagtcagttgctgatctttatgatgctgctcgccccaatcatccacgcgttttctagggctcctataccgatggccgtcgttcgcagagagttgagttgtgaatcttatcccattgagctccggtgtcccggaaccgatgtgattatgatcgagagcgccaattatgggaggacggacgataagatctgtgattccgacccagcccagatggaaaacatccgatgctatctgcccgatgcctataagataatgagccagcgctgtaacaacagaactcaatgcgctgttgtggccggacccgacgtcttccccgacccatgcccgggtacttataagtatctcgaagttcagtatgagtgtgtcccttatagagtggaccaaaaggtctttctatgccctgggttgttgaagggagtgtaccagtccgagcacctgttcgaatcagaccaccagtcaggggcatggtgcaaagacccactacaggcttctgacaaaatctattatatgccatggacgccttatcgcactgataccttgaccgaatactccagcaaagatgactttatcgctggcaggccaaccacgacctacaagttgccacacagagttgatggcactggattcgtggtatatgatggtgccctgttcttcaacaaagaaagaacacgcaacattgttaaatttgacctgcgcacccgtataaagagcggtgaggccatcatcgctaacgctaattaccacgatacaagtccttacagatggggaggcaagagcgatatcgatctggctgtggatgaaaatgggctttgggtgatttacgctaccgaacagaacaacggcaagattgtgatctcacagcttaatccctacaccctgaggatcgaggggacatgggatactgcttatgacaagagaagcgcttccaatgcattcatgatttgcggcattctctatgtcgtaaaatctgtgtatgaggacgacgataatgaagctactggaaataagatagattatatttacaacactgaccagtctaaagacagtctggtggatgtcccgtttcctaactcctatcagtacatcgccgcagtcgattacaaccctcgggataacttactatacgtctggaacaactatcatgttgtgaagtattcgctcgattttggccctctggatagccgcagtggccaagcccatcacggtcaagtttcttacatcagccctcccatccacctcgactccgagttggagcgcccttccgttaaggacatctcgaccaccggtcctcttggtatgggatcaacaactacctcaactaccctccggaccacgacactgtcccccggaaggagtaccacacccagcgtatccggcagacgcaacaggagcacctccactccctcccctgctgtggaagttttagatgatatgaccacccatctgcccagtgccagttcgcaaattccagctttagaagaaagctgcgaagcagtggaggcgagggaaattatgtggtttaaaaccaggcaaggacagattgccaagcaaccctgtcctgctggaaccattggggtttccacctatctttgcttggcgccagacgggatctgggacccacagggcccagatcttagtaattgcagctctccatgggtaaaccacattacccagaagctgaagagtggggagaccgcagccaacatagcacgagagttagctgagcagaccaggaatcatctcaatgcaggcgatatcacttattccgtgcgcgctatggatcagttggttggcctgcttgacgtccagttgagaaacttgacacccggaggcaaggattcagctgctagaagtctgaataaggcaatggtggaaaccgttaataacctgcttcagccgcaggccctgaatgcatggcgcgaccttactactagtgatcagctgagagccgctaccatgctgcttcataccgttgaggagagtgcctttgtcttggtgctgcaggtctgccttcccgtgcgagagcagtcattcctccccttcttcagctttttcattttctttttttccttcctgcccttcattcccctgaaatttaggctagctaaaaacaaatag

SEQ ID NO: 50969 - DNA, 4410 bp, Artificial Sequence
  Description of Artificial Sequence: Synthetic coding sequence
atgtggcccagccagctcctgatattcatgatgctgcttgccccaattattcacgctttctccagagctccgatccctatggcggtcgtgcgtagagagctttcctgtgagtcctatcccattgagttgcgctgcccaggcactgacgttattatgatcgaatccgccaactacggcagaacggacgataagatctgcgattccgaccccgcacagatggaaaacattagatgctatctgcccgatgcctacaagatcatgagccagaggtgcaacaatcgaacgcagtgtgcagtggtggcagggcctgacgttttcccggacccctgcccaggtacctacaagtaccttgaggtccagtacgagtgtgtgccgtacaaggtggagcagaaggtattcctgtgccccggactcttgaagggagtgtaccagtcagagcatctctttgagagcgaccatcagtccggagcttggtgtaaggatccattgcaggcctctgataaaatttactacatgccatggactccctatagaactgataccctgacggagtactcctcgaaagatgacttcatagccggtcgccctactaccacttacaaacttccacatcgcgttgacggcactggcttcgtagtctatgacggcgcattgttcttcaataaagaacggacacgaaatatagtgaaatttgacctcagaacgaggataaagtcaggggaggcgataatcgccaatgccaattaccacgatacttctccatataggtggggagggaaatccgatattgacctcgccgtggacgaaaacggactgtgggtgatctacgccactgaacagaacaatggaaaaatagtcattagccaattgaacccatatacgctacggatcgagggcacttgggacactgcttatgacaaaagatcggcgtccaacgccttcatgatttgtggcatactgtatgtcgtcaagagtgtgtatgaagatgatgacaacgaggctaccggtaataagatcgactacatttacaatacagatcaatccaaggattctctcgtagatgttccgttccccaattcataccagtatatagcagcggtcgactacaaccccagggacaatctgctgtacgtatggaataattaccatgtggtgaagtactcgcttgacttcggaccgctggattctcggtccggtcaggcccatcacggccaggtgagttacatctcaccgccaattcatctggatagcgaacttgagaggccgtcagtgaaggacatcagtacaacgggaccacttggaatgggatccaccacgacatccaccaccctccgcacaaccacattgtctccgggacgatccactactccaagtgtgagtggtagaagaaacaggagtacatctactccttctccagccgttgaggtactggatgatatgaccactcacctcccttctgctagctcacagatccccgcactcgaggagagctgtgaggctgttgaagctagggaaattatgtggttcaagacccgacagggccaaatcgcgaaacagccatgccctgccggtacaatcggtgtctctacatacttgtgcctggcacccgatggtatttgggacccccaggggccagacttgtctaactgtagctctccctgggtaaatcacattactcaaaagcttaaatctggggaaacagcagccaacatagcacgcgagctggctgagcagacacgcaatcacctgaacgccggtgacatcacatatagcgtccgcgctatggatcagctggtgggccttctggacgtacaactgcggaacttgacacccggaggaaaggactctgctgccaggagcttgaataagctgcaaaagagggagaggtcctgtcgcgcttatgtgcaggccatggtggagacagttaataacctgctccagccccaggccctaaatgcttggagagacttgacaacgagtgatcagctgcgagctgcgacgatgctgctgcatacagtggaggaaagtgccttcgtcttggccgacaatttgctcaagaccgatatcgttagggagaatacggataacatcaagttggaggtggccaggctgtctacagaggggaatctggaggatcttaagtttccagagaacatgggtcacggctccaccatccaactctctgctaacaccttgaaacagaatggtcgaaacggggagatcagggtggcattcgtgctgtacaataatcttggaccatatctctcgactgagaacgctagcatgaaactgggtacagaagcactatctacaaaccactccgtgatcgtcaacagtcccgtaatcactgctgccatcaataaagagtttagtaataaggtatatttggccgatccagtcgtgttcacggtgaagcacataaagcagtctgaggagaatttcaaccctaactgtagcttctggagctatagtaaaaggacaatgacgggctattggtccacacagggttgccgactccttactaccaataaaacccatacgacgtgcagctgtaatcatcttacaaatttcgcagtcctcatggctcatgtggaggtgaagcactccgacgctgtgcatgaccttctgctcgacgtcatcacttgggtggggatcttgctctctctggtgtgtttgctgatttgtatttttacgttttgctttttccgcggactccagtccgataggaacactattcacaagaacctgtgcatcagcctatttgttgcggaattgctctttctgataggaataaataggaccgaccagccgattgcttgcgctgttttcgcagcactgctccatttcttcttccttgccgcttttacctggatgtttttggagggggtgcagctgtacatcatgctggttgaggtgttcgagtctgagcactcacgtcgtaagtatttctacctggttgggtacggtatgccagccttaattgtcgcagtgagcgccgcagtggactatagaagctacggtactgacaaggtgtgttggctgcggctggacacatacttcatctggagttttataggccctgccactttgatcattatgttaaatgttatctttctagggatagccctttacaagatgtttcaccatacggccatcttgaagcccgagtccggctgcctggacaacatcaattacgaggacaacagaccttttatcaagagctgggtcatcggggcaatagccctcctgtgtctcctcggtttaacttgggccttcggtctaatgtacattaacgaatcaacagtgatcatggcctatctgtttacaatctttaactccttgcaggggatgttcatctttatttttcactgcgtgctccaaaaaaaagtgagaaaggagtacggtaaatgcctgagaacccactgctgttccggaaaatcaaccgaatcttccatcgggtcaggcaaaaccagcggctcccgcactccaggacgctactctactggatcgcagagccgaattcggagaatgtggaacgacacagtgaggaaacagagcgagtcctccttcatcactggcgatattaacagcagcgcctctctgaaccgtgaaggcctgctcaacaacgcaagagacacgagcgtgatggatacactgcctctcaacggcaaccatggcaactcgtattccatcgccagtggggaatacctttctaactgtgtgcagattatcgaccggggatataatcataatgagaccgcacttgaaaaaaaaatactgaaggaactgacatcgaattacattccctcttacctcaataaccatgagcggtcctccgaacaaaatcgtaatctaatgaacaagcttgttaataacctggggagcggccgtgaagatgacgccatcgtgctcgacgacgccacctctttcaatcatgaagaatcactcggactggaactcattcacgaagaaagcgacgcaccactgctcccacctagagtgtactcgacggaaaaccaccagccgcaccactacactaggcgcagaatcccccaggaccactcagagtccttcttccctcttttaaccaacgaacacactgaagatctgcagtccccacaccgggattccctgtatacatccatgcccaccctcgccggagttgccgcaaccgaatctgtgacaacttctacccagacggaacctccgcctgccaaatgtggagacgccgaagatgtctactataagtccatgcccaacttaggctctcggaaccacgtacatcagctgcacacctattaccagcttggacggggaagctccgatggatttatagtcccccctaacaaggacggaactccacccgagggcagctcgaagggaccagcacatctcgtgacctcactttag

SEQ ID NO: 50970 - DNA, 1125 bp, Artificial Sequence
  Description of Artificial Sequence: Synthetic coding sequence
atgcggcctgggaccgcgctccaggccgttctgctcgccgtgctgctggttggtctccgagccgctactggccgtctattgagcgggcagcccgtgtgccgcggagggacccaacgcccttgttataaagtcatctacttccatgacacatctagacgcctgaatttcgaagaagcaaaggaggcatgccgcagagatggcggacagctagtgagcatcgaaagtgaggacgagcagaagctcattgagaaattcatcgaaaatctgttgcctagcgacggcgacttctggataggtctgcgccgacgagaagaaaagcagtccaactcaaccgcctgtcaggatttatatgcctggaccgatgggtctatttcccaattccgaaactggtatgtggatgagccaagttgcggaagcgaggtatgtgtagttatgtatcatcagcccagcgctcctgcgggtattggcggaccttacatgtttcagtggaatgacgatagatgtaatatgaagaataattttatctgcaagtactccgatgaaaagccagcagtgccctcccgggaagctgagggggaagagaccgagctgaccacacctgtgttgcctgaggaaacccaggaagaagacgcaaagaagacttttaaggagtcccgcgaggctgctctcaatctggcctacatcttgatcccttccatccccctcctcctcctgctagtggtgactaccgtggtttgttgggtgtggatctgcagaaaacgtaagcgggagcagcccgatccttctacaaagaaacagcatactatctggccttctccccaccagggcaattctccagatttggaggtctacaatgtgatccgaaagcaatctgaggctgatctggccgagaccagacccgacctgaaaaatatcagcttcagagtgtgcagcggggaggccactcctgacgatatgtcctgtgactatgacaacatggcagtgaacccgagcgaaagcggcttcgtgaccctggtgagcgtggaatccggcttcgtgacaaacgacatatatgagtttagcccagatcaaatggggagatccaaggaaagcggctgggtcgagaacgagatctacggctactag

SEQ ID NO: 50971 - DNA, 1149 bp, Artificial Sequence
  Description of Artificial Sequence: Synthetic coding sequence
atgcgacccggaacagctctgcaagccgttctgctcgcagtgcttctggtggggctccgggctgcgacaggacgcctgctgagcgcatcagatcttgacctgagaggaggccaacctgtctgtagaggcggtacccaaaggccctgctacaaagtcatctacttccatgatacctcaaggaggctcaacttcgaagaagctaaggaggcctgtcgtcgggacggcggacagcttgtctctattgaaagtgaggatgaacaaaaactcattgagaaatttattgagaacctcctgcccagcgatggtgacttctggataggcctgcgccgaagggaggagaagcagagtaacagtaccgcctgtcaagacttatatgcttggacggacggttccattagtcaatttcggaattggtacgtggacgaaccttcatgtggaagtgaagtctgtgttgtcatgtatcatcaaccctccgctcccgcaggtattggtggcccttatatgttccagtggaacgacgatcggtgcaatatgaagaataacttcatatgcaagtacagcgatgaaaaaccagcagttcccagtcgtgaagcagaaggtgaagagacagagctgaccactcccgtgctccctgaggaaacccaggaggaggacgccaagaagacctttaaagaatctagggaggctgctctcaacctggcgtacatactcataccatccatacccctcctgctgcttctggtggtgaccaccgttgtgtgctgggtgtggatatgcagaaagagaaaaagggaacagcccgatccatcaactaagaagcagcacactatctggccctcccctcaccagggaaactcacccgatctcgaggtgtacaacgttattcgaaagcagagtgaagccgatctagccgaaacaaggcccgacctcaaaaacatttcctttagggtttgttccggggaagctactccagatgacatgagttgtgattacgataacatggcggtgaacccctccgagagcgggttcgtgaccttggttagtgtggaaagcggattcgtgaccaacgacatctatgagttctctcccgatcaaatgggcaggtctaaggagagcggctgggtcgaaaatgaaatttacggctactag

SEQ ID NO: 50972 - DNA, 690 bp, Artificial Sequence
  Description of Artificial Sequence: Synthetic coding sequence
atggtgacttccgggctaggttcaggaggcgtccgccgaaataaggcaatagcgcagcctgctcgaacattcatgctgggcctgatggcagcgtatcacaacctggagaagccggctgtgccgagccgagaggcggagggcgaagaaacagaacttaccacccctgtccttcctgaggaaacacaagaggaggacgcaaagaagactttcaaagaaagccgtgaggcggctttgaacttagcttacatattaattccgtcgatacccctactgctactgctagtggttaccacagtggtctgctgggtgtggatctgtcgtaagcgcaagagggaacaacctgacccctctacaaagaaacagcacaccatctggccctcaccacatcagggtaatagccctgacttggaagtctacaacgtcatccgtaagcagtccgaagccgatctggcagaaactcgacccgacctgaagaatatctcatttagggtgtgttctggagaagctacccctgacgatatgtcctgcgactatgacaacatggcagtcaacccatcggagagcggcttcgtgacccttgtgtctgttgaatctgggtttgtgacgaacgacatttatgagtttagtcctgaccagatgggacggtctaaggaaagtggctgggtggagaacgaaatttatggctattag

SEQ ID NO: 50973 - DNA, 1014 bp, Artificial Sequence
  Description of Artificial Sequence: Synthetic coding sequence
atgcgaccaggaacggccctgcaggcagtgctgctggcagtactcttggttggcctgcgcgcagccacaggcagactgctgtccggacagccggtgtgccgcggaggcacccagcggccatgctacaaggtcatttattttcatgacaccagtcggcgactaaatttcgaggaagcaaaggaagcctgtaggagaagggaagaaaagcagtcaaatagtaccgcctgccaggatttatatgcgtggacggacgggtctatcagccaattccggaattggtatgtcgacgagccttcctgtggtagcgaagtctgtgtcgtgatgtatcaccagccctccgcccctgccggaatcggtggcccatacatgtttcagtggaatgacgacaggtgtaatatgaagaataacttcatctgtaaatatagcgatgagaaacccgcagttccctctagggaggcagaaggcgaggagaccgaacttactacaccagtcttgcctgaggagacgcaggaggaagatgcgaagaaaaccttcaaagaatcccgtgaggcagctctgaatctcgcctatattttgatacctagcattcccctgctgctactcctagtggttacaacagttgtgtgttgggtctggatttgtaggaagcgaaagagggagcagccagatccatcaacaaaaaagcagcacacaatttggccctccccacaccagggaaacagtcccgatctcgaggtgtataacgtgattaggaagcaaagcgaggctgatctggccgagacacgccctgatttgaagaatatctcattccgggtgtgcagcggagaggcaaccccagatgatatgtcctgtgactatgataatatggccgttaaccccagcgaatccggattcgtgacactggtctccgtggaaagtggttttgtaactaatgacatctacgaatttagccccgatcagatggggaggagtaaggaatcaggctgggtggagaacgaaatttacggatattag

SEQ ID NO: 50974 - DNA, 405 bp, Artificial Sequence
  Description of Artificial Sequence: Synthetic coding sequence
atgagaccaggcacagcgttgcaggccgtattgctcgccgtccttctcgtgggcctgagagcagcaactgggagactgttgtcgggacaacccgtatgccggggagggacccaaagaccatgctataaagtaatatatttccacgacacgtcgagacgccttaacttcgaggaggccaaagaagcctgtagacgggatggcggacagctggtttccatagaatctgaagacgaacagaagttgattgaaaagtttatcgagaaccttctgcccagcgacggggatttctggattgggctgagacggagggaggagaagcaatcaaactcgaccgcctgccaagacctgtatgcctggaccgatgggagtatttcacagttccgcgagaccagtagtagtttctag

SEQ ID NO: 50975 - DNA, 1071 bp, Artificial Sequence
  Description of Artificial Sequence: Synthetic coding sequence
atggctgccgagggatggatttggcggtggggatgggggaggaggtgcttaggtcggccaggactgctcgggcctggtcccggacctaccacacccttattcctgctccttctcctaggatctgttactgccgacatcacggacggcaactctgaacatttaaaaagagaacacagcctgataaagccatatcagggcgtaggttccagttctatgccgctgtgggattttcagggtagcactatgctcacttcacagtacgttcgcttgacacctgacgaacgcagcaaagaaggatcaatttggaatcatcagccttgctttcttaaggactgggagatgcacgtgcattttaaggtacatggcactgggaagaagaatcttcacggcgacggaattgccctttggtatacacgggatcgtctcgttccaggccctgttttcggcagtaaagataattttcatgggctggcaattttcctggatacctatcctaatgatgagaccactgagcgggtgttcccatatatctccgttatggtaaacaacggctctctttcttatgaccattccaaagatggcagatggactgaattagcgggatgtactgcagacttccgcaaccgcgatcatgacaccttcctggccgtaagatattcccggggacggctcacagtgatgacagatctggaagataagaacgagtggaagaattgcattgacatcacgggagtgcggctgcccactggctactacttcggggcttcagcagggacaggggaccttagcgacaaccacgatatcatctcaatgaagttattccagctgatggtcgaacatactcccgatgaagagtccatcgattggacaaaaatcgaacctagcgtgaattttctaaaaagccccaaggacaacgtggacgacccgactgggaattttcgtagcggacctctcaccggatggcgagtctttcttctcctactatgcgccctgttgggtattgtggtctgcgcagttgttggcgcagttgtctttcaaaagcgtcaggagcgaaataagcgcttctattag

SEQ ID NO: 50976 - DNA, 858 bp, Artificial Sequence
  Description of Artificial Sequence: Synthetic coding sequence
atgccactctgggattttcagggatcaaccatgttgactagccagtacgttagactgactccggatgaacgttccaaggaagggtctatctggaaccatcaaccttgcttcctcaaagattgggagatgcatgttcatttcaaggtgcacgggaccggaaagaagaatctgcacggagacggaatcgcactgtggtacacacgggatcgccttgtcccaggtcccgtttttggctccaaggataactttcacgggttggctatctttcttgatacctaccctaatgatgagacaaccgagcgggtcttcccctacatctccgtcatggtaaacaatggctccctctcttacgatcatagcaaagatgggaggtggaccgaactggccggttgcactgccgacttcagaaaccgcgaccatgatacatttctcgcggtgaggtatagcaggggtagactcaccgtgatgaccgacctggaagataagaacgaatggaagaattgtattgatattacgggcgtgaggctgcctaccggctactattttggggcatccgccggaaccggcgacttgtccgataaccatgacattatttctatgaagctgtttcagctcatggtggaacatactccggacgaggagtcaatcgactggaccaaaatcgagccttccgtgaattttctgaagtcccctaaagataacgtggatgaccctactggcaattttcgatccggaccacttaccgggtggcgcgtatttctgctgttactgtgtgcgctgcttggaattgtcgtctgcgcggtcgttggcgctgtggtgtttcagaagagacaagaacgcaacaagcgcttctactag

SEQ ID NO: 50977 - DNA, 1047 bp, Artificial Sequence
  Description of Artificial Sequence: Synthetic coding sequence
atggcggcaacgctcggccctcttggcagctggcagcagtggagacggtgcctgagtgcgagggacggcagtcgtatgctacttcttctgttgcttctgggcagcgggcagggaccccaacaggtgggagcagggcagacttttgaatatttaaaaagggaacactcactttctaagccctatcagggggtagggaccggcagcagcagcctctggaacttaatggggaatgcaatggtgatgacgcagtacatcaggctgacaccggacatgcagagcaaacaaggcgctctttggaatagggtcccgtgtttccttagggactgggagctgcaggttcacttcaaaattcacggccaagggaaaaaaaaccttcacggcgacggccttgctatatggtacacaaaggaccgcatgcagcctgggccagtcttcgggaatatggacaaattcgttggacttggcgtgtttgtggatacataccccaacgaggaaaaacagcaggagcgcgtttttccctacatttccgctatggtgaacaacggtagtctctcttacgatcacgagagagatgggcgtcctaccgagctgggcggttgcaccgccatcgtaagaaatttgcactacgacaccttccttgtgatcagatacgttaagcgccatttgaccataatgatggacatcgacggaaagcacgagtggcgcgactgcatcgaggtccccggtgtgcgcctcccacgtgggtactactttgggacaagttctattactggtgacctgtcagacaaccacgacgtgatctctctcaaactttttgaactgacggtagaaagaacacctgaagaggagaaacttcacagagatgtgtttctgccatctgttgataatatgaagttgcctgagatgactgctccacttcccccactgagtggcttggcgctctttctgatagtttttttttctctcgtattttctgtattcgcaattgtgataggcattatcctgtataacaagtggcaggaacaatctaggaagcggttctactag

SEQ ID NO: 50978 - DNA, 1080 bp, Artificial Sequence
  Description of Artificial Sequence: Synthetic coding sequence
atggctgctactcttgggcctctggggtcttggcagcaatggagaagatgtctttcagccagagatggctcccgcatgctgctcctgctgctgctgcttggtagtgggcaggggccacagcaggtgggcgctggccagaccttcgagtatctgaaacgggagcacagcttgtctaagccctatcaaggcgtggggactggtagcagcagcttgtggaatctgatgggcaatgccatggtaatgacacagtacatcaggttaacccctgacatgcagtcgaaacagggcgcactatggaacagggtgccttgctttttgcgggattgggagctgcaggtccactttaagatccatggccagggaaagaagaacctgcacggtgacgggttagctatctggtatacaaaagataggatgcaacccggtccggttttcggcaatatggataagttcgtaggcctgggcgtctttgtggatacttatccaaacgaagaaaaacaacaggaggcccagaagcggagatatagcccgggtgttcagagagtctttccatatattagtgcaatggtcaacaacggatcactttcctatgatcatgagcgggacggacgccctacggaactcggcggatgcacagcgattgtgagaaatctgcattacgacaccttcctcgtcatcaggtatgttaagcgtcatctcaccattatgatggacatcgacgggaagcatgagtggcgggattgcatcgaggtgcccggtgtgagactccctcgcggttactacttcgggacttctagcatcacgggcgatctgtctgataatcacgacgttatctcactaaagctcttcgaactcaccgtcgagcggaccccggaggaagagaaactacaccgagatgtttttcttccaagcgtagacaacatgaagctccccgagatgacggcccctttgccaccactcagtggactggcactcttcctgattgtcttcttctctctcgtcttttcagtgttcgctattgtaatcggtatcatcctgtacaacaagtggcaagagcagtctcggaaacgcttttactag

SEQ ID NO: 50979 - DNA, 645 bp, Artificial Sequence
  Description of Artificial Sequence: Synthetic coding sequence
atggataaggagaggaggatttgcatggggatggcttggcagtcagggacacagagaatagggtgcagccaggcacagaagcgacgttatagcccgggtgtacaacgggtgttcccgtatatctcagcaatggtcaacaacggttctctgtcatacgatcatgagagggacgggaggccaactgaacttggaggctgcaccgccatcgttcggaatctccactatgatacatttctggtaatcaggtacgttaagcggcacctgactattatgatggacatcgatggcaagcacgagtggagagattgtatcgaagtgcctggcgtaagactgcctagaggctactatttcggaacctcctccattacaggagacttaagtgataatcatgatgtcatatctctgaagttgttcgagctcacagttgagaggacacctgaagaagagaagctgcaccgggacgtgttcttgccctccgttgataatatgaaattaccagaaatgacggccccacttccacccctttccgggcttgcactgttcctcatcgttttcttctccctcgtattcagtgtcttcgccatagtgatcggaatcatactctataacaagtggcaggaacaatctcgcaaacgtttctattag

SEQ ID NO: 50980 - DNA, 612 bp, Artificial Sequence
  Description of Artificial Sequence: Synthetic coding sequence
atggacaaggagcggcgaatttgcatgggcatggcatggcagagcggtactcagcggataggctgctctcaacgagtctttccttatatctctgccatggtcaacaatggtagtttgtcttacgatcacgagcgggacggcagaccaactgaactcggagggtgtactgctattgtgcgaaatctgcattacgacaccttcctggtcatccggtacgtgaagagacacctgactattatgatggatatcgatggcaagcacgagtggcgggattgcatcgaggtgcctggggtacggctgcccagagggtattatttcggtaccagtagcataacaggcgacctgagcgataatcacgatgtaatcagcttgaagctgtttgagctcacagtggaacgcacacctgaagaggagaaactgcatcgggatgtatttctgcccagcgtcgacaacatgaagctccccgagatgactgcgcctctgcccccattaagcggcctggccctgttcctcattgtcttcttcagtcttgtgttcagtgtgtttgctattgtgattggaataattttatataacaaatggcaggaacaatctcgtaaaaggttctactag

SEQ ID NO: 50981 - DNA, 633 bp, Artificial Sequence
  Description of Artificial Sequence: Synthetic coding sequence
atgcaacctggcccagtgtttggtaatatggataaatttgtaggtctgggggttttcgttgatacataccctaacgaggaaaaacagcaagagagagtttttccttacatctctgccatggtcaacaacggaagcttatcttacgaccacgagagggatggaaggcccaccgagctcggaggctgtacagcaatcgtgagaaaccttcactacgataccttcctggttatacgctacgtaaagcgccacttaacaattatgatggacattgatggtaaacatgagtggcgggactgtattgaggtgccaggagtaagacttccacgcggttattattttggcacaagtagcatcacaggggacctctccgataaccacgatgttatcagcctgaagctgtttgaactcactgtcgaacgcacacctgaggaggaaaaactccatagggatgtgtttcttcccagtgtcgacaatatgaagctacccgagatgacagccccactgcccccactgagcggtctcgctctgtttcttatcgtcttcttcagtttggttttttcagtcttcgcaattgttattggaattattctttacaataagtggcaggaacagagcagaaagaggttctattag

SEQ ID NO: 50982 - DNA, 1581 bp, Artificial Sequence
  Description of Artificial Sequence: Synthetic coding sequence
atgcctgccgtgtccgggccaggtccattattttgccttctgctcctgctgctggacccacatagcccagagaccggttgcccacctctgagacgatttgagtataagctgagctttaaggggccacgcctggccttgcccggagctggaatcccgttctggagccatcacggcgatgcaatcctcggcctggaggaagttcggctcactcctagcatgcgcaatcgcagcggcgcagtgtggtcacgggcaagcgtaccgttttctgcctgggaggtggaagtccaaatgcgggttacgggactaggccgtcggggtgctcaaggcatggctgtatggtacacccgaggcagaggtcatgtaggttccgtcctcgggggattagctagttgggatggcattggaattttttttgactcaccagctgaagacacccaggattctcccgcaatccgcgtcctggcctcagatggtcacatccctagtgaacagccaggcgacggggcaagccagggcctgggatcttgccactgggattttcgcaaccgccctcacccttttcgcgcaagaatcacatactggggccaacggctgcgcatgtcgctgaatagtgggttaacaccctcggatccaggcgagttttgtgtggatgttggtccactcctgcttgtccctggagggttcttcggtgttagtgctgctacagggacccttgctgatgatcacgacgtcctgtcattcttaacattctctctgtctgagccttctcccgaagtccctcctcaaccatttttagagatgcagcagctgaggcttgcacgccagctcgaggggctgtgggctaggctggggctgggcacccgggaggacgtcaccccaaagagcgatagcgaggctcagggggaaggggaacggctgtttgatctggaggagacccttggcaggcaccggagaattctgcaggcactccgcggactgtctaaacaactggcccaagcagaacggcaatggaagaaacagctggggcctcccggacaggcaaggccggacggcggatgggcccttgacgccagctgtcagattccctcaacaccagggaggggaggccacttatccatgagtctcaataaagactcagccaaagtgggcgctctcttacatggacaatggacactgctgcaagcacttcaggagatgcgggatgcggctgttcggatggccgcagaggcacaggtgtcttaccttcccgtggggatcgagcatcacttcttagaattggatcacattctagggcttctccaagaagagctgagaggaccagctaaagcagccgctaaggcaccccgaccacctggacagcctccacgagcctcttcttgtctacagcctggcatttttctcttttatcttctgatccaaaccgtagggttttttggatatgtccactttcgacaggaattaaacaagagcctgcaggagtgcctttcgaccggttctcttcccctgggaccagccccacacaccccgcgtgctctcggaattcttcgtcgccaaccactgcccgcaagtatgcccgcttag

SEQ ID NO: 50983 - DNA, 1545 bp, Artificial Sequence
  Description of Artificial Sequence: Synthetic coding sequence
atgcccgctgtgagcgggccaggcccactgttttgtttattactgctattgctggatcctcatagccccgaaaccggctgcccaccactgaggaggttcgagtacaagctgagcttcaaggggcctcggctggccttaccaggcgctggaatcccattttggagccatcacggggatgcaatactcggtctggaagaggtgagactgacaccctcaatgcgaaaccgatccggggcagtgtggagccgggcatctgtgcccttcagcgcttgggaggtggaggtgcagatgcgcgtaacaggtctggggaggcgaggggctcaaggtatggcagtgtggtacacccggggtcggggacacgtgggttccgtccttggcggtctggcttcatgggacggcattggaatcttttttgattccccagcggaggacactcaggattcccccgctattcgggttctcgcttccgatggccatatccccagcgagcagcccggtgacggggctagtcaggggctgggctcgtgccattgggattttagaaaccgtccacatccatttagagctagaatcacatattggggtcagagacttagaatgtctcttaactctgggctgacaccgagtgatcccggagagttctgcgtagatgtggggcctctcttgttggtgccaggcggttttttcggtgtatctgccgctaccggcactctggcaggagaagacccaaccgggcaagtccccccacagccctttctggaaatgcaacagctgcggctcgccaggcaactggaagggttatgggctcgtttgggactcggcacccgcgaggatgtgactcctaagtctgactcagaggctcagggcgaaggggaaaggctgttcgatctcgaagagaccctcggcagacatcggaggatcctccaagcacttaggggcctttccaaacagctcgcccaagccgaaagacaatggaagaaacaactgggccctcctggccaggccagaccagacgggggatgggccctggatgcgtcttgccagatccccagcacgccaggccgaggcggacacctgtcgatgagcttaaacaaagacagcgctaaggtgggtgcgctgctgcatggtcagtggacgcttctgcaagcattgcaggaaatgcgggacgctgccgtcagaatggccgcagaggcccaagtgagctacttacccgtgggcatcgagcatcacttcctggagctcgaccatattcttggtctgcttcaggaggaactgaggggcccagctaaagccgcagcgaaggcccctcgccctccaggacagcctccaagagccagctcttgcctgcagcccggtatcttcctattctatctgttaatccaaaccgttggttttttcgggtacgtgcatttccgacaagaactgaacaagagtctgcaggaatgcttaagcactggcagtttgcccttagggccagccccacacaccccacgcgcattgggcatcttgcgacggcagccattacctgcgagtatgcctgcctag

SEQ ID NO: 50984 - DNA, 435 bp, Artificial Sequence
  Description of Artificial Sequence: Synthetic coding sequence
atgcgtaaccggagtggcgcagtgtggtccagagccagcgtgcccttttcagcctgggaggtggaggttcagatgagggtcactggactgggaaggagaggtgcccaggggatggactctcccgctatcagagttcttgcctctgacggccacataccgagtgaacagcccggagacggagcaagtcagggccttggctcatgtcactgggacttccgcaacaggccgcaccccttcagagctagaatcacctactgggggcagaggctgcgcatgagcctcaacagcgggctaaccccttctgacccgggagagttctgtgtggacgttggaccactgttactcgtgccaggcggattttttggcgtcagcgccgctactggaactttggctggggaagaccccacaggccaagttcgggcagagggccagtag

SEQ ID NO: 50985 - DNA, 204 bp, Artificial Sequence
  Description of Artificial Sequence: Synthetic coding sequence
atggtggacgtcaaatgcctatctgactgcaaactgcaaaaccaactggaaaagttgggcttctcgcctggcccaattctgcggggtctccaggagcatcaggccccagaaagtcatatgggcctcagccccaaacgggagaccacagcgaggaaaactcgactgtcacgagccggtgaaaagaaagtttcccagtgggcctag

SEQ ID NO: 50986 - DNA, 423 bp, Artificial Sequence
  Description of Artificial Sequence: Synthetic coding sequence
atggtagatgtgaagtgtcttagcgactgtaaactgcagaatcagctggagaagttggggttcagcccgggtcctattctgcagctgaacattatattgcagggaaatatcatcctgagcacagaaaagagtaagaagctcaaaaaatggccggaagccagcacaaccaaaagaaaggcagtggacacctattgcctagactacaagccgtctaagggcagacgttgggccgctcgagccccaagtaccagaattacctatggcaccattacaaaagagagggattattgcgctgaggaccagaccattgagagctggagggaggagggctttcccgtcgggcttaagcttgctgtactaggaattttcatcatagtggtatttgtgtatttaacggtggagaacaaatcactgtttggatag

SEQ ID NO: 50987 - DNA, 423 bp, Artificial Sequence
  Description of Artificial Sequence: Synthetic coding sequence
atggttgacgtgaaatgtctgtctgactgtaagcttcagaaccagttggagaaactggggttcagccctggtcctatcctgcagctgaatatcattctccagggcaacattatcctctcaaccgaaaagtcgaagaagctgaagaaatggcccgaggccagtacgaccaaacgcaaagcagttgacacgtactgcctggactataagccatctaagggccgacgttgggccgctcgagcaccctctaccagaattacatatggaacaattacgaaggaaagagattactgcgcagaagaccagacaattgagtcctggagagaggaggggtttcccgtcggtcttaaactggccgtccttgggatatttattatagtcgtgtttgtgtatttaactgttgagaacaagtcgcttttcgggtag

SEQ ID NO: 50988 - DNA, 546 bp, Artificial Sequence
  Description of Artificial Sequence: Synthetic coding sequence
atggtggacgttaaatgcttgtccgactgcaaactgcagaaccagctcgagaaactaggtttttctccaggcccaatactgccgtctacgcgaaagctctacgaaaagaagttggtccaattactggtatccccgccttgtgcaccaccggtcatgaacggccctagggagctggatggcgctcaggatagtgacgattcagaggagttgaatattattctgcaggggaacatcatcctgtctactgagaaaagcaaaaagcttaagaaatggccggaggcaagcaccacaaagaggaaagccgtggatacctattgcctggattacaagccttctaagggtcgtaggtgggccgctcgggctccgtcaacgagaattacctacggcactatcacaaaggaaagagattattgtgccgaggaccagacaattgagtcctggcgggaagagggcttccccgtgggactgaagctcgccgtcctggggatcttcatcatcgtcgtgttcgtgtacttaaccgtcgagaataaaagcctttttggatag

SEQ ID NO: 50989 - DNA, 327 bp, Artificial Sequence
  Description of Artificial Sequence: Synthetic coding sequence
atggtcgacgtgaagtgccttagcgactgcaagctccagaaccagctcgagaagctcggattttcaccagggccaattctgccctcgacccgcaaactttacgagaagaaactcgtgcagctcctggtcagtcccccatgtgcacctcccgttatgaatggcccaagggaattggacggcgctcaagattcggacgattccgaaggtggcttgcaggagcaccaggcaccagaaagtcacatgggactgtctccgaagcgtgaaaccactgcaagaaagacgcggttgtccagagcgggagagaagaaggtcagtcagtgggcctag

SEQ ID NO: 50990 - DNA, 327 bp, Artificial Sequence
  Description of Artificial Sequence: Synthetic coding sequence
atggtcgatgtgaaatgcctatctgattgtaaactgcagaatcagttagagaagctggggttctccccaggtcctatcttgcctagtaccagaaagctctatgaaaagaagctcgtccagctgctggtgagtccaccttgtgcgcctcctgtgatgaacggcccaagggaactcgacggagcacaggattccgatgactctgaggggggtctccaggagcatcaggcccctgagtcccatatgggtctctcacctaaaagggagacaacagcccgaaaaacacgtctgagtagggctggcgaaaagaaggtgtcgcaatgggcgtag

SEQ ID NO: 50991 - DNA, 1512 bp, Artificial Sequence
  Description of Artificial Sequence: Synthetic coding sequence
atggctggcttgagtgacctggaactgcgcagggagctacaagcattaggtttccaacccggacctattacagacaccacgagagacgtctaccgcaacaaacttcgcaggcttcgaggggaggctagactgagagatgaggagaggctgagggaagaagctcgaccaagaggtgaggaaagattgcgtgaagaggctagactgagagaagatgccccactccgagccaggcccgcagcagcgtcaccaagagctgagccttggctgtcccagccagcatccgggtcggcgtatgctacacctggggcatatggcgacattagaccctcggcagcatcctgggtggggagtcgtggtctggcttaccccgcacgtccggctcagctgcgaagacgggcttccgtgagaggatcttccgaggaggatgaagatgccagaacccccgacagagcgactcaaggccctggcctggccgcacgacgttggtgggcagcatcaccggctccggctagattgccttcaagcttgcttggaccagatccgcgaccaggcctgagagccacgcgggcaggcccagccggtgccgctcgcgctcggcctgaggtcggcaggcgactggaacgctggcttagcaggcttctcctgtgggctagccttgggttactgttggtgttcctcggcattctctgggtcaaaatggggaagccatcggctccacaagaagccgaagacaatatgaaactgctcccggtggattgtgagcgcaaaacagacgaattttgccaggccaagcagaaagcagctctcctggaacttttgcacgagctgtacaatttcctcgccattcaggctggaaacttcgagtgcggcaacccagagaatctgaaaagtaaatgtatcccagtgatggaggcccaagagtacatcgcaaatgtcactagtagttcctccgccaagtttgaggccgctctgacatggatcctttcctctaacaaggacgtcggaatctggctcaaaggcgaggaccagagtgagctggtcactacagtcgacaaggtcgtttgcctcgagagtgcccatcctcgcatgggggtcgggtgtcgattgtctagagctttgttgacggccgtgactaatgtcttgatctttttctggtgcctcgccttcttgtggggattgctaatcctgctgaagtacagatggcggaaattagaggaagaggagcaagccatgtatgagatggtcaaaaagatcattgatgttgtgcaagatcactacgtggactgggaacaggacatggagcggtacccttatgttggtatcctgcatgttcgcgacagcctcatccccccacagagtcgccgtaggatgaagagggtctgggatagagcagtggagttcctggcctccaacgaaagtcggatccagacagagtcgcaccgcgtagcgggtgaggacatgcttgtgtggcgctggacaaagccatcctcattcagtgacagcgagaggtag

SEQ ID NO: 50992 - DNA, 606 bp, Artificial Sequence
  Description of Artificial Sequence: Synthetic coding sequence
atggaagcgcaagaatatatcgccaacgtgacaagctcttcaagcgccaaatttgaagctgcactgacttggatcctatcatctaacaaggatgtaggtatctggttgaagggcgaggaccagtctgaactggttacaacagttgataaagtcgtgtgtctggagtctgcccaccctaggatgggtgtggggtgcagactttctagggccttgttgacagcggtgaccaatgtcctcatctttttctggtgtctggcctttttgtggggactgttgatcctgctcaagtataggtggcgcaaactcgaggaagaagagcaggccatgtacgagatggtcaagaagataattgatgtagtacaggatcactacgtggactgggagcaagacatggaaagatacccttacgtgggtatactccacgttagagactccctcatccccccacagtcccgacgccgtatgaagagggtgtgggatcgcgcagtggaattcttggccagtaacgagtcacgcatacagactgagtctcaccgtgttgccggagaggacatgctggtgtggagatggactaagccctcttcttttagcgactctgaaaggtag

SEQ ID NO: 50993 - DNA, 165 bp, Artificial Sequence
  Description of Artificial Sequence: Synthetic coding sequence
atggaagctcaggaatatatcgcaaatgtcacatccagttcgagcgccaagtttgaggctgcactcacctggatactgagctctaataaggatgtcggaatctggctcaaaggcgaagatcagagtgagcttgtgaccacggttgataaggtagtgtgcctctag

SEQ ID NO: 50994 - DNA, 4470 bp, Artificial Sequence
  Description of Artificial Sequence: Synthetic coding sequence
atgcggcaggtgctgtggttgtgcaatgtgtgtgtcactgcacgcgagactaggcaccatctgcaccttcccgcaatcctcgacaagatgcccgcacctggagcactgatcttactggccgcagtgtccgcttctggctgcctggcctctcccgcacacccagacggattcgctttaggccgtgctccgttggcgccaccatacgcagtagtgttgatcagctgcagcggcctactggcctttatcttcctgctactgacctgcctgtgttgcaaacgaggggacgtgggatttaaagaatttgagaacccagagggcgaagattgttctggagagtatactccaccagctgaagaaacatcttcaagtcagtcactgcctgacgtgtatatcctacccctggcagaggtttctctgccaatgcccgctccgcagccctctcattctgatatgactacccccctggggttgagcaggcaacacctctcatatcttcaggagataggttccggatggtttgggaaggtcattctgggcgagatctttagcgactacacacccgctcaggtcgtggttaaggaactgcgcgcttccgccggacccttggaacagcgtaagttcatctcggaggcacaaccctaccgatccctgcagcacccaaatgttcttcagtgcctagggttgtgcgttgaaacgcttccatttctccttatcatggaattttgtcagctgggggatctgaagaggtatttgagggcccagagacctcccgagggcctgtcgcctgagttacctcctcgagacttaagaaccctccagaggatgggcctagagattgcgcgaggcctggcccatctccactcgcacaattatgttcatagcgatttagcactcaggaattgccttctgacttcagacctgactgtgagaatcggcgattatgggttggcccactccaactacaaggaggactattatctcaccccagaacggttgtggatccctctccgatgggcagcgccagagctcctcggcgaattacatggaacttttatggtcgtggatcagtcacgagagtcgaatatctggtcattaggcgtgaccctatgggagctgttcgaattcggggctcagccttacagacacctgtctgacgaagaggtgctcgccttcgttgtgagacaacaacacgttaaactcgcccgacctagactgaaactgccatatgccgattattggtatgacattctgcaatcctgctggcgccctccagctcagaggccctccgcgtccgatttgcaactgcagctgacttacctcctctcagagcgccctccaagacctcctccgcctccccctcccccaagagacggacctttcccttggccctggcctcctgcacacagtgccccacgccctggcaccctgtccagcccatttcccctcctggatggttttcccggtgcagatcccgacgacgttttaactgtaactgagagcagcagaggcttaaatttagagtgtctctgggagaaggctaggagaggggctgggaggggtggtggcgcaccagcttggcagcctgcttccgcacctccggcacctcacgcaaacccttctaatccattttatgaagcactcagcacgcctagcgtcttgcccgtgatcagcgctaggtccccgtctgtttcgtccgagtattacatcagattggaggaacacggaagccctccagaacctcttttccccaatgattgggaccctttggacccaggggtgcccgctccgcaggcccctcaggctcccagcgaagtgccacagctcgttagcgaaacgtgggcatcacctctctttccagctcctcggccttttcctgcccaatcctccgccagcgggtctttcctgctgtctggatgggatccagagggacgcggagccggtgagacccttgctggggatcccgctgaagtgctgggcgaacgcggaactgccccatgggttgaggaggaggaagaggaggaggaaggcagcagccccggagaggattcctcttccctaggcggtggtccaagtcgcaggggacccctcccatgcccactgtgcagccgggagggagcttgtagttgcctgcccctcgaaagaggcgacgccgtagccggatggggcggacatcccgcactaggctgcccccaccctccagaggacgactcgtccctccgggctgaacgcggttccctggccgacctccctatggcgccaccagcttcggccccacccgagtttttggacccactcatgggagccgcagctccacagtaccctgggaggggcccacctcctgccccacctccccctcctccccctcccagggctccagcagacccagctgcatctcccgatccgccatccgccgtggcctcaccgggatctggtttgagttccccaggaccaaagccgggagactctggctatgaaactgaaactccattctcacctgagggggcattccccggtggaggcgctgcggaggaggaaggagtgcctcggccacgcgcacctcccgagccgccagacccgggagcacccagaccaccccctgaccccggtccgctgccattgcccggtcccagagagaaaccaacctttgtcgtgcaggttagtacagagcaactcctgatgtcgctgcgagaggatgttacacgtaacctcctcggagaaaagggcgctacggccagggaaacgggacccagaaaggccggtcggggtccaggcaatcgagaaaaggttcccggtcttaatcgtgatcccactgtgctggggaatggtaaacaggctccaagtctatcactccctgtgaatggcgttactgtacttgagaatggcgatcagagagcaccaggcatcgaggagaaggccgcagagaatggcgctctgggcagccccgaacgagaggagaaggttctcgagaatggggaactcacgccaccgagacgcgaggagaaagctctggagaacggtgaactgcgatcccctgaggctggagaaaaagtgctcgtcaatggcggactgacacccccaaaaagcgaggacaaagttagcgagaacgggggtcttcgtttccctagaaacactgaacggcctccggagaccgggccttggcgagctccgggaccctgggaaaaaacacccgagagttggggccctgcccctactatcggtgagcccgctccagagacgtcgctcgagagggcccctgcgccttctgcggtagtgagctctagaaacggcggtgagactgcgcctggtccattggggccagctcccaagaacggcacactggagcctggtactgagcggagggctcccgaaacaggaggagctccacgggctcctggagcaggtcggttggaccttggtagcggcggacgcgctcccgttggcaccggcaccgcacctggcggagggccagggtccggtgtagatgccaaagctggatgggtcgataatactagaccgcagccaccacctccgccacttccccctccccctgaagcccaaccaaggcgtcttgaaccggctccacccagagccaggcccgaagtcgccccagagggcgaaccaggagcgcctgatagtcgggcaggtggagacactgctctctcaggcgacggcgatccaccaaagccggagcgcaagggtccagagatgcctcgactgtttctcgacctgggacccccacagggcaacagcgaacagatcaaagcgaggctgtctaggctcagcctggcgttgcctccgttgacactgacgcctttccccggaccaggccctcgcaggccaccctgggaaggggcagatgcaggagccgctggaggagaggccggaggcgcaggagctccaggcccagcggaagaggacggcgaagacgaagacgaggatgaagaagaggacgaagaggccgctgcgccaggagctgctgcgggtccaaggggaccgggaagagcgcgagcggcacctgtccctgttgtggtgagcagcgctgacgcagacgccgcacggccactgagaggtttgttgaaatcccctcgcggagctgacgagcccgaggatagcgagctcgagcggaagcgaaaaatggtttcttttcacggtgacgttaccgtgtatctgtttgatcaggaaacaccaacaaatgagcttagtgtccaggcacctcctgagggcgacaccgaccctagcacaccacctgccccaccaacgcctccacaccctgcaacacctggagacggctttcccagcaacgattccgggtttggtggctctttcgagtgggcagaggactttccactgctcccccctccagggcctcctctctgtttttccagattttccgtatccccagctctggaaacccctggacccccagcgcgagcccctgacgctaggcccgcaggacctgtggaaaattag

SEQ ID NO: 50995 - DNA, 1656 bp, Artificial Sequence
  Description of Artificial Sequence: Synthetic coding sequence
atgcatttacagatgcgagaggacatggccaaatatcggcgaatgagcggggtgcgtcctcagtcttttagggacctagaaacaccacctcactgggccgcttacgatacggggctcgaattgctgggtcggcaggaggcaggccttgcactacctcggctggaagaggccctgcagggatccttggcacagatggaatcgtgtcgtgccgactgcgaaggtccagaggaacagcagggggctgaggaggaagaggatggagctgcatctcaggggggtctctacgaggccatcgcagggcactggatccaggtgctgcaatgtaggcagcgatgtgtgggggagacagctacacgccctggcaggagttttcccgtgcccgattttctcccgaatcagctgcgccgactgcatgaggcccacgcacaggtcggcaacctctctcaggctattgaaaacgtactttctgtactgctgttttacccggaagatgaggccgcaaaacgtgctctgaatcagtatcaggcccaattgggcgagccaaggcctggtctagggccaagagaggacatccagcgctttattctccgatctcttggtgaaaagaggcagttatattacgccatggagcacctaggtacctcattcaaggatccggacccgtggactccggctgccttaatccccgaggctctgcgagaaaaattaagagaggaccaggagaagcggccatgggatcatgagccagttaaaccaaaaccactgacgtactggaaagatgtgctgctcctggagggcgttacattgacccaagattccaggcagctgaacggcagtgaacgagccgtccttgatggccttctgaccccagccgagtgcggagttctcctccagcttgctaaggatgctgccggagccggagcgcgttcaggctacagagggcgtcggagcccccacacgccgcatgaaaggtttgaaggcctgactgtcctcaaagccgctcagctcgcgagggctggcacagtcgggtctcagggagccaagctgctgttggaggtgagtgagcgggtgcgcacactgactcaggcctacttttctcctgaacgcccactgcatttgtcttttactcatctggtatgccggagtgccatcgaaggggaacaggaacagcggatggatctcagccaccctgttcatgctgacaactgtgtgctagaccccgataccggtgagtgctggcgggaacctcctgcttatacctaccgcgattattcgggactgctttacctcaatgatgatttccagggtggcgatctgttttttaccgaacctaatgctctgacagtcacggcccgtgtccgacctcggtgcgggagactcgtggctttttcgtccggcgttgaaaatccccatggagtttgggctgtaaccagagggagacggtgcgccctcgcactgtggcacacctgggctcccgagcacagggagcaggagtggatcgaggccaaggagctgctccaagagtctcaggaagaggaggaagaggaagaggaagagatgcctagcaaagacccaagccccgagccacccagcagaagacaccaaagggtgcaagataagacgggcagagccccaagagtcagggaggagttgtag

SEQ ID NO: 50996 - DNA, 2208 bp, Artificial Sequence
  Description of Artificial Sequence: Synthetic coding sequence
atgctgaggctgttgcggcctctcctactgctgttattactgccaccccctggatcacctgagccgcctggcttgacccaactcagtccgggtgcgccaccacaggccccagacctgctgtatgcagacggtttgcgggcatacgcagcaggcgcatgggccccagcagtggcactcctaagagaagcactgcgcagtcaagcggcactcgggagagttagactcgactgtggtgcttcctgtgcagccgaccccggagcggcattgcccgctgtgctgctcggcgctcctgaacccgactcagggcctgggccaacccagggttcatgggaacgtcagctgctgagagcagccctgaggcgtgccgattgcttgacgcagtgtgctgccagacgtcttggcccaggaggcgctgcacgccgagttggaagcgcactgagagacgcatttcgcaggcgggagccatataactacctccagagagcctactaccagctgaagaagctggacctggctgctgccgcagcacatactttcttcgtggcaaatccaatgcatctgcagatgcgtgaagacatggctaagtatcgcagaatgagtggtgtccggcctcagtcctttcgggaccttgagacccccccacactgggccgcttacgacaccgggctagagctgctgggacgccaggaggccggtctggcactgccccgattggaggaagcactccaaggaagtcttgctcagatggaaagttgtcgcgctgactgcgagggacccgaggaacaacagggggcagaggaggaagaggacggtgccgcttcacagggcggactctatgaggcaattgctggccattggatacaggtgctgcaatgtcgccaacgttgtgtcggcgagactgctacaagaccgggtcgatccttcccagtcccggatttcttgccgaaccagctccgcagactgcatgaagcccacgcgcaggtgggtaatttgtctcaagctatagagaacgtgctctccgtgctgctcttttaccctgaggatgaggcagccaaaagagcccttaaccagtaccaggcacagttaggcgaaccgagaccaggcttagggccaagagaagacattcagcgcttcattctgcggtccctgggggagaaacgacaattgtattatgccatggagcacctggggacctcctttaaggatcctgatccatggacacctgccgctctgatacccgaggcattacgcgaaaaacttagggaggatcaagaaaagagaccatgggatcatgaaccagtgaaaccaaaacccttgacatattggaaggacgtcctgctgctggaaggagtgaccctcacccaggactcacggcagctcaacggcagcgaaagagcggtgctggatggtctcttgaccccagcagaatgcggagttctgttacagctcgcaaaagacgcggcaggagctggcgctcggagcggatatagaggcagacgtagcccccatactcctcatgaacgctttgaaggactgactgtcttgaaagcggcacagctcgcccgagccggaacagtcggttctcagggagctaagctcttacttgaagtgtctgagcgtgtgcggacacttacacaggcttatttcagtccagagcggccacttcaccttagcttcacccacttagtatgtcgcagtgctatagagggagaacaggagcagcggatggacctgtcccaccccgtgcacgctgataactgtgtgctcgacccggatactggcgagtgttggcgagaacccccagcctatacctatcgcgactactctggtcttctgtacctcaacgacgatttccagggcggtgacctctttttcacagaacccaacgccttgacagttactgctagagtgaggccccgatgcggacgcctggtcgcgttctcatccggcgtggaaaatccgcatggggtgtgggccgtaacccgcggaagacgatgcgctctggctctgtggcacacatgggcaccagagcacagagagcaggaatggattgaggccaaggaattactccaggagagccaggaggaagaggaggaagaggaagaggaaatgccatccaaggacccctcacccgagccaccctctagaagacatcaacgtgttcaggataagaccggaagggcccctcgggtgagagaggagttatag

SEQ ID NO: 50997 - DNA, 492 bp, Artificial Sequence
  Description of Artificial Sequence: Synthetic coding sequence
atgttaagactcttgcgacctctgctcctgctcttattgctccccccaccagggtctccagaacctcctggtctaacacagcttagccccggtgccccaccacaggcaccggaccttttgtatctcaacgacgactttcaaggtggagatctcttcttcaccgagccaaacgcactcaccgtaacagcaagagtgcgcccacgatgtggaaggctggttgcattttcctctggagtagagaatccccacggcgtctgggccgtgacaaggggtagacggtgtgccctggcattgtggcacacttgggcccctgagcatagggagcaggaatggatcgaggcaaaggaacttttgcaggaaagccaggaagaggaagaggaagaagaggaagaaatgcccagtaaggaccctagcccggagccgccatctcgcaggcaccaaagggttcaagataaaactggcagagccccacgagtacgggaggaactgtag

SEQ ID NO: 50998 - DNA, 1083 bp, Artificial Sequence
  Description of Artificial Sequence: Synthetic coding sequence
atggccctttccagggtctgttgggctagatcggctgtctggggatctgccgtcacacccggtcatttcgtaactcgaagacttcagctcgggagatccgggctggcttggggcgctcctcgcagtagcaagcttcacttgagtcccaaggcagacgtaaagaacctgatgtcgtacgtagtaacaaagaccaaagccattaacggcaagtatcatagattcctcggcagacatttccccagattctacgttctgtataccattttcatgaaaggtctccagatgttatgggccgacgctaagaaagctcggagaatcaaaacaaatatgtggaagcataacatcaaattccatcagctcccgtatagggagatggagcacctaagacaattcaggcaggacgtgactaaatgcctgttcctgggcatcatctctattccgccatttgctaattatctagtgttcctcctaatgtatctgttccctcggcaactcctcattcgccatttttggacgcctaaacagcaaacagacttccttgatatctatcatgcatttcggaagcagagccatcccgaaatcatcagctacctcgagaaagtgataccattgatcagcgatgctggactgcggtggcgtttaactgatttgtgtaccaagatccaacggggaactcatccagccattcacgacatacttgccctccgggaatgcttcagcaatcaccctttggggatgaatcaactgcaggctcttcacgtcaaggcactgagtagggcaatgttgttgacctcttacctgcctcccccactcctgagacacaggcttaaaacacatactaccgtcattcatcagcttgacaaggctctagccaaattgggcatcgggcagcttacagcacaggaggttaagtcagcctgttacctccgcggtttgaatagcactcacatcggggaggatcggtgccgaacatggctgggagagtggctgcagatctcatgttctctcaaggaggccgagctgagcttattactgcacaacgtggtgctgctctctaccaactatttaggaactcgtcgttag

SEQ ID NO: 50999 - DNA, 300 bp, Artificial Sequence
  Description of Artificial Sequence: Synthetic coding sequence
atggctctgtctcgagtctgttgggcccgatcagctgtttggggaagcgcagtcactcccggtcacttcgtgactaggcgtctgcagctcggacggagtggattggcatggggcgctcctcggtcctcaaaactgcatctgagccctaaggctgacgttaagaacttaatgagctatgtggtgacaaagaccaaagccattaacggaaaataccatcggttcctgggcaggcacttccctaggttttacgtcctgtatacgatttttatgaaaggaacgtgtttccctgggaattattag

SEQ ID NO: 51000 - DNA, 822 bp, Artificial Sequence
  Description of Artificial Sequence: Synthetic coding sequence
atggctctttcacgggtctgctgggctcggtctgccgtgtggggttccgctgtcactcctggacactttgtaacccgccgacttcagctcggcaggtccggcttggcctggggtgcccctaggtcgtctaagttacacctttctcctaaagccgacgttaaaaatctgatgtcctacgtggtgacaaagacaaaggccatcaatggcaagtaccatagattcttgggcagacattttccaaggttctacgtgttgtatacaattttcatgaaaggaattatatccatccccccattcgccaactacctggtgtttctcttaatgtatctcttcccgaggcagcttttgattcgacacttctggacacccaaacagcagaccgacttcctggatatctaccacgcctttaggaagcaatcccatccagaaatcatttcctacttggaaaaagttattcccttgataagtgacgcaggccttagatggcggctgaccgacctatgtactaagatccaacgcggaacacaccctgccattcatgacatactcgctctgcgtgagtgtttctcaaaccacccactgggtatgaaccagctgcaggccctccatgtgaaggcactcagtcgggcaatgctcttgacttcatacctccctcccccactcctgaggcatcgcctcaaaactcacaccaccgtcattcatcagctcgacaaggctctcgctaagcttgggatcggccagctcacagcattgcatcagcttccatgggataaagctcttaacgaaccttggagcggctggcattgcccggctgtggtctag

SEQ ID NO: 51001 - DNA, 915 bp, Artificial Sequence
  Description of Artificial Sequence: Synthetic coding sequence
atgagctacgtggtgacaaaaacgaaggcaattaatggcaagtaccataggttcctgggtcggcactttccgcgtttctacgttctgtatacaatttttatgaagggcttacaaatgctatgggctgatgctaagaaagctcggaggatcaaaacaaacatgtggaaacataatattaagttccatcagctgccctatagagaaatggaacacctccgccagtttcggcaggacgtaacaaaatgcctgttcctgggcatcatctctataccgccatttgcgaactacctggtgttcctcttgatgtatttgtttcctcgacagcttctcatacgccatttctggactcctaaacagcagaccgacttcctcgacatctatcacgccttccgcaaacagagtcatcccgagatcatctcatatttggagaaggtcatccccctcattagtgatgccggacttcgttggcggctgaccgacctctgtacaaagatccagagagggacccaccccgcaatacatgatattttagccttgagggagtgcttctctaaccatcctctgggtatgaatcagctgcaggccctccacgtgaaggccctctctagagcaatgctgctgacttcttacctgcctccccctctgctaagacatcgcctgaagacccacacaacagtgattcaccagctggataaggccttagctaagttgggaattgggcagcttaccgcccaggaagtcaagagcgcctgctacctgagaggcctgaactctacccacatcggcgaggacagatgtcggacctggctgggcgaatggctgcagataagctgcagcttgaaggaggcagagttgtctctgttactacacaacgttgttttgctctcaactaattatctcgggactcgacgttag

SEQ ID NO: 51002 - DNA, 1122 bp, Artificial Sequence
  Description of Artificial Sequence: Synthetic coding sequence
atggccctgtcccgggtctgctgggccagatctgctgtgtggggcagcgctgtgacacccggacactttgtcacacgtagactgcagttagggcgaagcggtctggcttggggtgcccctaggtctagcaagcttcacctgagtcctaaggcagacgtgaagaatctgatgtcatatgtggtgacaaaaacaaaagcaataaacggaaagtaccatcgctttttaggccgacattttccacggttctacgtactctatacaatatttatgaaaggtctgcaaatgctttgggcagacgcaaagaaggcgagacggatcaagactaatatgtggaaacacaacattaagttccaccaactgccttatagagagatggaacatttgcgccaagtctgggctagagggaggtatcccgaggtccatggtgagtttcgccaggatgtgactaagtgcctttttcttggtataatcagcattcctcccttcgcaaactatcttgttttcctgctcatgtatctgttcccaagacagttgctcatacgccacttctggacccctaaacaacagaccgactttctcgacatctatcatgctttcagaaagcaatcacaccctgaaatcatttcttatctcgaaaaggtgatccctctaatatcagacgccggtctgcgatggagacttaccgacttatgtaccaagatccagagagggacccatcctgcaattcacgacatcctggctctgcgcgagtgcttctcaaatcatcccctgggcatgaatcagttacaggctttgcacgtcaaagcactttccagggcaatgctgctcacctcttacctccctccccctctcctgcgtcacaggctgaaaacacacaccacggttatacatcagctcgacaaggctctagctaagttagggatcggccagttgaccgctcaggaagttaagagtgcatgctacctgcgcggtctgaactccacacatattggggaggatcggtgtaggacatggctgggggagtggctgcagatttcctgttctcttaaggaggccgagctatccctgttgttgcataacgtcgtattgttgagcactaattacctgggcactcgcaggtag

SEQ ID NO: 51003 - DNA, 1782 bp, Artificial Sequence
  Description of Artificial Sequence: Synthetic coding sequence
atggacgcagcaacggctccaaaacaagcctggcccccatggccacccctcctttttctgctcctcctcccgggtggatccgggggtagctgcccggctgtatgtgattgcacctcccaaccccaggcagtgctctgtggccacagacagttggaggctgtgcccggaggactcccgctggacacagaattgctcgacctgagtggcaatagactgtggggccttcaacaaggaatgctctcccgcctgtctctgctccaggaactagatctgtcttataaccagctaagtactttagagccgggagcattccacggcctgcagagtctgctgactctgagactccagggcaacagattgaggataatgggccctggcgtgttttccgggctctcggctctcactcttctggacttgcggttgaaccaaatcgtgctgtttctcgacggggctttcggggagctcggttctctgcagaagctggaagtcggcgataaccacctggtcttcgtggcgccaggggcattcgcagggctggctaaactctcgacgctgacgttggagcgatgtaatttgagcactgtcccaggccttgctttggcaagactgcctgctctcgtggcgctgcgcctgcgggagctggacattgggcgattacccgctggcgctttaaggggcttggggcagctgaaggaattagagatccatttgtggcccagcctggaagcattggatccaggtagccttgtcggtctgaacctgtcgtcattagccatcacccgatgcaatttaagcagtgttcctttccaggctctctaccatcttagctttctgagggtcctggatctcagccagaatcccatctcagctattccggctcgccgactctcacctctggttcgcctccaggagctcagactttctggcgcttgcttgacgagcattgctgctcacgctttccacggactcactgccttccacctgctagacgttgctgataacgcactccagaccctcgaagagacagcgttcccttcacctgataagctcgtgaccctgcggctttcaggtaacccactgacgtgtgattgtcggctgctgtggctgctgcggctaaggcggcacctagacttcgggatgtctccacctgcatgcgcagggcctcaccacgtgcagggcaagtccctgaaagagtttagtgacatcctccctcccggacacttcacctgcaagcccgcactgattagaaaatccggacccaggtgggtgatagctgaagagggtggccacgccgtgttctcctgttccggggacggagaccctgccccaacagtctcatggatgcgcccacacggcgcatggctcggtcgggctggacgtgttagagtccttgaagatggcactctagaaataaggtccgtgcagctcagggataggggcgcttatgtatgcgttgtttcaaacgtcgctgggaacgacagtctgcgcacttggctggaagtgatccaggtagaacctcctaatggcacattatccgacccgaacataacagtccctggcatccccggacccttctttctggattcacggggagtggctatggtgttggcagttggttttttgccatttttaacctccgtaactctgtgtttcgggctgattgcattatggagcaaaggcaagggcagggtcaagcaccatatgacattcgattttgtggctcctcgacccagcggagataaaaacagcgggggaaacagagtgacagcaaaactgttctag

SEQ ID NO: 51004 - DNA, 1746 bp, Artificial Sequence
  Description of Artificial Sequence: Synthetic coding sequence
atgccactcaagcactatttgctgcttctggtggggtgccaggcttggggggctggcttggcttatcatgggtgtccatcagagtgtacgtgcagccgtgcttcacaggtagaatgtaccggcgcacgaattgtagcggtaccgacgcctctgccttggaatgctatgtcactgcaaatcctgaacactcatattacggaactgaacgaaagcccttttctgaacatctctgctctcatagctctgaggatcgaaaagaacgaattgtcccggatcactccgggagcgttcaggaaccttggaagtttacgctatctgtctctggctaacaataaattgcaggtgctgccaataggcctgtttcaaggacttgattctctggagtcactactgctatcaagcaatcaactgttgcagattcaacctgctcactttagccagtgttcaaacctgaaggagctccagctccacggaaaccatttagaatatattcccgacggggcattcgaccacctggtcggtcttaccaagctgaacctgggcaaaaattcactcacacatatcagtcctcgagtttttcaacatctgggcaacctacaggtgctaaggctgtatgaaaacaggttgacagatattcccatggggacgttcgacggtctggtgaatttgcaagaactggcactccaacagaatcagataggactgttgtcacccggtctttttcataataaccacaacctccaacgactgtacctgagcaacaaccatatcagtcagttgccgccaagcgtctttatgcagctccctcaacttaaccgactgacactctttggcaattcactgaaagagctctccccaggtatcttcggacccatgccaaacctgagggaactgtggctctacgacaatcatatctctagcctgcccgataatgtgttttcaaatctgagacagctgcaggtgctgattctgtctagaaaccagatcagctttataagcccaggcgcatttaacgggctaacagagttacgagaactgtctctgcacacgaatgcgctacaggacctcgacggaaacgtttttaggatgctggctaacctgcagaatatctccctacagaacaatagactcaggcagctcccagggaatattttcgcgaatgtgaacggattgatggcaattcaactgcaaaacaatcaacttgagaatttgcccctcggcatctttgatcacttgggaaagttgtgcgagcttagactgtacgacaatccctggcgatgcgactccgacattctgcctctgagaaactggctgttactaaaccagcccagattaggcaccgatacagtccccgtctgtttcagtcccgctaatgtaaggggccagtcattgatcatcatcaacgtaaatgtcgccgtcccctcagtgcacgtgcctgaagtaccttcctatcctgaaaccccctggtatcccgatactcccagctatccggacaccacatcggtgagcagcaccaccgaactaacatctcctgtggaagattacacggacttaactaccattcaggtaacagacgaccgcagcgtgtggggtatgacacaggcgcagagtgggctggccatcgccgctatcgtgatcggcattgttgctttagcatgcagtctggccgcatgcgttggatgctgttgctgcaaaaaaagatcacaggcagtactaatgcagatgaaggcgcctaatgaatgctag

SEQ ID NO: 51005 - DNA, 1764 bp, Artificial Sequence
  Description of Artificial Sequence: Synthetic coding sequence
atgcctcttgataaggctatgccccttaaacactaccttctgctgctggtcggatgccaggcctggggcgctggtttagcctatcatgggtgcccgtcagaatgtacctgttcaagggccagtcaggtcgagtgtactggtgcgagaatagttgccgtgcccacaccactgccttggaacgctatgtccctgcagatactgaacactcatatcaccgagctgaatgaatccccttttctgaacatatctgcgctgatcgcactaaggatagaaaagaatgaactttcccggattactcctggagcattcagaaatctgggaagtttacgatacctatccctggctaacaacaaattgcaagtgctccctatcggtctgtttcaggggctggactcactggagagcctgctgttgtcctcaaatcaacttttgcagatccaacccgctcacttttcacagtgtagtaatctgaaggagcttcagttacacggcaaccatcttgagtacattcccgatggggcttttgaccatctggttgggctgacgaagctgaatctcggtaagaactccctcactcatataagtccaagagtttttcagcatctaggaaatctacaggttctgaggctctacgagaatcggctgacagacattccaatgggaacctttgacggactggtgaatctacaggagctcgcacttcagcagaatcaaatcgggcttctcagccccggtctcttccacaataaccataatctgcagcgtttgtacttgagtaacaatcacataagccagttaccacctagcgtgttcatgcagctgccccaactgaaccgactgacgctcttcgggaattcccttaaggaactgagtccaggtattttcggtcccatgccaaatctccgggagctctggctgtatgacaaccacatctctagcctgcctgacaacgtgttcagcaacttgcgccagctccaggtcctgattttaagccgcaaccagatatctttcatttccccgggagccttcaacggcctcacagaactccgagagctgagcctccacaccaatgctctgcaggacctcgatggcaacgtgtttaggatgctagccaatttacaaaacatttcactgcagaacaatcgactgcgccagctgccagggaatatcttcgccaatgttaacggactgatggccattcaactgcagaataatcagctcgagaacctgccactgggtattttcgaccatctgggcaaactctgcgaactcaggctatacgataacccctggcgctgtgatagcgacattctgcccctccgcaattggctattattgaatcagcctagacttggaacagacacagtgcccgtgtgtttcagcccagcaaacgttcgcggacagagtttaatcatcatcaacgtcaatgttgccgtgccgagtgttcatgtgccagaggtgcccagttaccctgagactccttggtatcccgacactccctcttatccggacacaacaagcgtgtcttccaccacagagttgacttctccagtggaggactataccgacttaactactattcaagtgacggatgatcggtcagtctggggaatgacccaagcacagagtgggttagccatcgccgctattgtcatcggtattgtggccctcgcatgtagccttgccgcatgtgtgggttgctgctgttgcaaaaagagatcacaggccgttcttatgcagatgaaggcacctaacgagtgttag

SEQ ID NO: 51006 - DNA, 1764 bp, Artificial Sequence
  Description of Artificial Sequence: Synthetic coding sequence
atgccacttgataaagccatgcctttaaaacactatctcctgctgctcgtggggtgtcaggcttggggtgctggtctggcttatcacgggtgtccctccgagtgtacgtgtagcagagccagccaggtggagtgtactggcgcacgtattgtggccgtgcccactcctcttccatggaacgccatgtccctgcagattcttaatacccacattactgagctgaacgagtcgccatttttgaatatcagtgccctgatcgccctgaggatcgagaaaaatgaactgtctaggataacacccggtgcattccggaaccttggttcactccggtatctcagcttagcaaataacaaattgcaggtgctccctattggcctgtttcagggccttgactcgctcgagagcctgttgctttcaagtaatcagctactgcagatccagccagcccatttttctcaatgttctaatttgaaagagctccagctgcacggcaatcatttagaatacattccagacggagcatttgatcacttggtgggcctcaccaagctgaacctggggaagaactccttgacccatatcagtccgagggtttttcagcatctaggcaacttgcaggtgctgcgcctttacgagaaccgcctgacagacattcctatgggcaccttcgacggcttggtcaacctgcaggaactcgctctgcagcagaatcagattgggttattgtccccgggtctcttccataataatcataacctccagaggctatacttatctaacaatcacattagccagctgccaccgtccgtttttatgcaactgccacaactcaatcgcctgacccttttcggcaactccctcaaggaactgtcaccaggcatctttggacccatgcccaacctgagggagctgtggttgtacgacaatcacattagctcactaccggataatgttttctcaaatcttcgccagctccaggtcctgatactgagccgaaatcaaattagctttatttcacccggtgccttcaatggactgactgagcttagagagctgagtctgcatacaaacgcactgcaggatctggacggaaacgtctttaggatgctcgccaacctccaaaacatttcgttgcagaataatagacttagacaactgccagggaatattttcgctaacgtcaatgggctgatggcaattcagctgcagaacaatcaattggagaatctgccccttggcatcttcgatcatcttggaaagctctgtgagctgagactgtacgataacccctggcgatgtgattctgatatcctgccactgcggaactggctgcttctgaaccagcctagactgggaacagacaccgtgcccgtctgtttctctccggcaaatgtgagaggacagagtctgatcattatcaacgtcaacgtcgccgttccttcagtccacgtgcccgaagtgccaagctacccagaaacgccatggtacccagacactccctcttatcctgacactaccagtgtgagctcgaccaccgagttgactagtcccgtagaggattacaccgacttaacgacaatccaggtgacggacgatcggagtgtgtggggcatgacccaagcacaatctgggctggccattgctgcaattgtgattggcatcgtcgccctggcatgcagtttggctgcttgcgtgggatgttgctgctgtaagaagagaagccaggcagtgttaatgcagatgaaggcacccaatgagtgctag

SEQ ID NO: 51007 - DNA, 1113 bp, Artificial Sequence
  Description of Artificial Sequence: Synthetic coding sequence
atgaaggtgacaggtataacgatcctcttctggcctctgagcatgattttgctctctgacaagattcagtcctcaaagagggaagttcagtgtaacttcactgaaaaaaattacactcttatccccgctgatatcaagaaagacgtcacaatcctcgacctgtcttacaaccagatcactctgaatggcaccgatactcgagtgctacagacctacttcctactcactgagttgtatctgatcgaaaataaggtgactatcctgcataataacggcttcggaaatctgagcagcctcgagatccttaacatctgcaggaatagtatctatgtcatacaacagggagcctttctggggttgaacaagttaaagcaactctacctttgtcagaacaaaattgagcaactgaacgccgacgtgttcgtcccactcaggagcctcaagctgttgaacctgcaggggaacctgatctcctacttggacgtcccacctctgtttcatttagaactgatcacactgtatggcaatttatggaattgtagctgttcccttttcaacttgcagaactggctaaatactagtaacgttaccttggagaacgagaacattacaatgtgtagttatcctaactccctccaatcatacaatataaagacagtcccacataaagccgagtgccactccaaattcccctcgagtgtaaccgaggatctgtacattcacttccagcccatctcaaatagcatctttaacagttcctccaataaccttaccagaaattccgagcacgaacccctggggaagtcttgggctttcctcgttggggttgtcgtaactgtgctgaccacaagtttactcattttcatcgcaattaagtgtccaatctggtataatatactgctctcatataaccaccaccgactggaagagcatgaggccgaaacctacgaagatggctttacggggaatcccagctccctgtcccaaatacctgagaccaactctgaagagacgaccgtcatcttcgaacagctgcactcttttgtcgtggatgacgatgggtttatcgaagataagtatatcgatattcacgaactgtgtgaggagaactag

SEQ ID NO: 51008 - DNA, 1542 bp, Artificial Sequence
  Description of Artificial Sequence: Synthetic coding sequence
atggcgttgagggcaccggcactgcttcctctcctattgctcctgctgccccttcgggcagccggatgtccggcagcctgcagatgctacagcgccactgtggagtgcggtgcactcagactccgcgtggtccccctaggcatcccaccgggaacgcaaacactctttctgcaggacaacaacatcgccagactggagccaggggctctggcccctctggccgcactgcgccgactctatctgcataacaactccttgcgcgctctggaggcaggggcatttcgcgctcagcctcgcctgctcgaactcgccctgacgagtaatagactgagaggtctgcgatctggtgctttcgttgggctagcccagctgagggtactctacctcgcaggtaaccaactcgctagactgctggactttacatttcttcatcttccccgactacaggagctgcatctacaggagaattctatcgagcttctcgaagatcaggccttggccggactatcaagtctcgccctcctggatctcagcagaaatcagctggggacaatcagtcgcgaagccctccagccccttgcatcactccaggttttgagactcaccgaaaatccatggaggtgcgactgcgccctgcattggctgggcgcttggatcaaggagggtggacagaggttgctgacttctagggataggaagattatgtgcgccgagcccccaaggttggctctacagtcgttgctggatgtgtcccacagttccctaatttgcattccgccaagcgtgcacgtccaaccactggagctcaccgccaacctgggggaagaccttcgcgtcgcctgccaggcttcaggttatccccagcccctggtaacctggcgtaaggtgccacagccaagggagggacggccaagggcgcaggcacaattggaaggcggactgctgggcctcggcggtcactcagcctccgataccggaagcgggatgctgttcttatcaaacattaccctggcccatgcgggaaagtatgaatgcgaggcaagcaatgcgggaggtgctgctcgagtgccctttcggctcctggtcaacgcatccagacagcagcctcaacagccggcacagccacccccaccagcagctcgacccgcaggctccgagcctagacctgaagctggtagtatggcctttcgggcactgggcgtggcgacacaaactgctattgcagctgcaattgcactcttggcactaactgccctgctcctggtcgccatgatatgccggaggcggaggcggagaaagaaagctcgcggaccgccaggggaaggagccttatttgtcaacgactatctggatggtccttgtacattcgcacaactggaggagcttagagatgaacggggacacgagatgtttgtgatcaatcgctccaaaccactttttgccgaggggcctgccgaagcccctgccgactgcggtcctgaacagggcgctggtccaggcctgcgtgtcccccctcccgtcgcttacgagatacattgctag

SEQ ID NO: 51009 - DNA, 774 bp, Artificial Sequence
  Description of Artificial Sequence: Synthetic coding sequence
atgggcaccgtgaggccaccacgcccttccttactactggtctccaccagggagtcctgtctcttcttgctgttttgtctgcacctgggagctgcgtgcccccagccctgtagatgcccggatcatgctggagccgtcgctgtgttttgttcactcagagggctacaggaggtgcctgaagacattcctgctaacacagtgttgctgaagctggacgccaacaagatctcacacctcccagacggggcattccagcatttgcatcggctccgagagttagatctctcacataacgccattgaagctatcggatctgcaacgttcgccggactggctgggggtctgcgactgttagatctctcttacaatagaatacaacggatccccaaggatgctttggggaagctgagcgctaagatccgtctctcacacaatcctctgcactgcgaatgcgcccttcaggaagctctctgggaactaaaactcgatcccgattcagttgatgaaattgcatgccacaccagcgtgcaggaggagttcgtgggaaaacctctggtgcaggcgctggatgccggtgccagcctgtgttccgtcccacacaggaccaccgacgtcgccatgctagtcacaatgtttgggtggtttgctatggtgattgcatacgtggtctactacgttaggcataaccaggaagacgcgagaagacatttagaatatctgaaaagtctcccctccgccccagcttccaaggacccaatcgggcctggaccctag

SEQ ID NO: 51010 - DNA, 414 bp, Artificial Sequence
  Description of Artificial Sequence: Synthetic coding sequence
atgggaactgtaagaccaccccgtccctcgctgctgctggtatccactcgggaatcctgtctctttcttttgttttgtctgcatcttggcgcagcctgcccacagccttgccgctgtcctgatcatgcgggagcagtcgcggtgttttgttccctgcgcggactccaggaggtccccgaagacatcccagcgaacacggtgctgctgaaactcgacgctaataaaattagccatcttccggatggagcctttcagcacctgcacaggctccgggagcttgacttatcccacaacgccatagaggccatcggatccgccacattcgccggtctcgccggagggctgcggcttttagatctgagctacaacaggatccagaggatacctaaagaccccattggacccggtccctag

SEQ ID NO: 51011 - DNA, 1989 bp, Artificial Sequence
  Description of Artificial Sequence: Synthetic coding sequence
atgcgcccacaaatcttgctgttactcgccttgctaactctgggactggcagctcaacaccaggacaaagtgccctgcaaaatggtggacaaaaaggtgtcgtgccaagtgttaggcttgctacaggtgccgagcgtcttgccaccagacactgagacgctagatctcagtggcaaccagctccgctcaatactcgcttcgccactgggattctacacagctcttagacacctggacctgagcaccaatgaaatttcattcctccaaccaggggcattccaggccctcactcatctcgagcacctgagcctggctcacaacaggctggctatggcaactgccttgtccgccggaggcctaggccctctgccccgtgtaacctccctcgacctctccgggaacagcctgtacagtgggctcctcgagaggctcctgggggaagccccttccctacacactttgagtcttgccgaaaactcgctgacccgcctgacacgccacacctttagagatatgccggctctggagcagttggacctgcactctaacgtgctcatggatattgaagacggggcttttgaaggattgccgaggctgacccatctgaacttgtctcgaaatagcctcacctgtatctccgactttagtctccagcagctgcgagtgttggacctgtcttgcaacagtatcgaggcttttcaaaccgcctcccagccacaggctgagtttcaactcacctggctggacttaagagaaaataagttacttcactttcctgatctggcggctctgcctaggttgatctatctgaacttgtccaacaatctgatacgattgccaacaggacctcctcaggactctaagggtattcacgcaccatccgaaggctggtcagctctgcctctcagtgcaccaagtggcaacgccagcggtcgccctctatctcagcttcttaatttagacctgagctataacgaaatagagctgattcctgactcatttctcgagcacttaacatccctgtgctttttgaacctgtcccggaattgcctgagaacctttgaggccagaagactggggtcactaccctgtttaatgctgctggatctgtcccacaacgccctggaaactcttgagctgggtgcaagggctctgggttctctacggacgttgctcctgcagggaaacgcccttagagacttgccaccctacaccttcgcgaacctggccagtctgcagcgcctgaacctgcagggcaatagggttagcccctgtggaggccctgacgagcccggacctagcggatgcgtggctttctcaggaattacttctctgcggtccctttccctggttgacaacgaaattgagcttttaagggccggagcctttctgcacaccccattgactgagcttgatctgagttctaatcccggacttgaagttgctacgggcgctctgggcggactcgaagcgagtctggaagtcctggcactccagggaaatggcctaatggtactgcaggttgatttaccgtgtttcatctgcctcaagcgcctcaaccttgccgagaaccgcctctctcacctccccgcatggacacaggctgtttcattggaggtccttgatctgagaaacaactcctttagccttctaccgggtagcgccatgggcggacttgaaaccagcttgaggaggctctacctgcaggggaaccctctctcgtgctgtggcaatggttggctggcagcgcagctgcaccaaggtagagtcgatgtggacgccacccaagaccttatttgccggtttagttcccaagaagaggtcagtctgtcacacgtgagaccagaggattgtgaaaagggtggccttaaaaatatcaatcttatcatcatacttaccttcatattagtctcagcaatactgctaacgacactggcagcctgttgctgcgtcagacgtcagaagttcaatcagcaatataaggcttag

SEQ ID NO: 51012 - DNA, 1989 bp, Artificial Sequence
  Description of Artificial Sequence: Synthetic coding sequence
atgcgcccacagattctgctgttactggccctccttaccctgggcctggccgctcagcaccaagataaagtgccatgtaagatggttgacaaaaaggtgagttgccaagtgctcggactgcttcaggtaccctccgtgctgcctcctgatactgagaccctcgatctgtccggcaatcagctgaggtcaatcctagcctcacctctgggcttctacactgccctgaggcaccttgatttgtcaacaaacgagatctctttcctccaaccgggtgcctttcaggccctgacacacctcgaacacctgtcattggcccataatagactcgccatggctaccgccctgagcgctggaggacttgggccactcccccgtgtaacatctctcgacttatccgggaacagtctgtacagtggcttactggaaaggctcctgggtgaagccccatccctgcacaccctctctttggctgagaattcgctcacacggctcactagacacactttccgggatatgcccgcactggagcaactagatctccattcgaatgtactgatggacatagaagacggagccttcgaggggcttcccagactcacacatctgaacctcagccggaatagcctgacctgtattagtgatttttctttgcaacaacttagagttttggatctgagttgtaactctatcgaggctttccagacagcaagccagccccaggctgagttccaactcacctggctagatctacgggagaataaactactgcattttcccgacctggctgcactcccgagattaatttacttgaatctgtcaaacaatctcatcagattgcccacgggaccaccacaggacagtaaggggatccacgcaccttctgaaggctggtctgctctccccctgagtgcgccaagcggaaacgcctctgggaggcctctgtcccaactgctgaatctggatcttagctataacgaaatcgaacttatccctgatagcttcttggagcacctaacctccttgtgttttctaaatctctcccggaactgcctaaggacatttgaggctcgacggctgggatcactaccgtgtttaatgctcctggatctgtcccacaatgcccttgaaactttagagctcggcgctcgcgcattggggagcctaagaaccctcctcctccagggaaatgcccttcgcgatctcccaccatatactttcgccaatttggccagcctacagaggctgaacctgcagggcaaccgggtgagcccctgcgggggtcctgacgaaccaggaccaagtgggtgtgtggcctttagtggaatcactagtctcaggtctctgtcactggttgataatgagatagagttactgagagcaggcgctttcctgcacactccactgacagaactggatttgtcctccaatccgggactggaggtcgcaacaggagctcttggagggcttgaggcttcactggaagttctggcccttcagggaaatggcttaatggtgttgcaagtggacttaccgtgcttcatctgtctgaagagactgaacctggccgagaatagactgagccacctccctgcgtggactcaagctgttagcctcgaggtgctagacttgaggaataactctttctctctgttgcccggatccgcaatgggaggtctggaaacgtctttaagaagactctatctccagggcaacccactttcctgctgtggcaatgggtggctggccgctcagctacaccagggcagggttgacgtcgacgccactcaagatttgatctgtcgcttctcgagtcaagaggaagtctcccttagtcacgtccggcctgaagattgtgagaagggtggcctgaaaaacatcaatctgatcattatcctgacgttcatattagtgtctgctatccttttgaccacattggctgcttgttgttgcgtgagaaggcaaaagttcaatcagcaatacaaagcctag

SEQ ID NO: 51013 - DNA, 1989 bp, Artificial Sequence
  Description of Artificial Sequence: Synthetic coding sequence
atgcgccctcaaattctccttctcttggctctgctaactctcggcctagctgctcagcaccaggataaggtaccttgtaagatggtggataagaaagtgagctgtcaagtgctggggctgctgcaggtcccttccgtgctccctcccgacaccgagacgctggatctatcagggaatcagctgagatcaatcctagcatccccactgggattctacacggcactccggcacctggatctcagtacaaacgaaatctccttccttcagccaggggcttttcaagcactcacacacctggaacatctgagcctggcacataaccggctggctatggctacggctctttcagctggcggactcggcccactaccgcgagttacttctttagacttgtctggaaactccctatactctgggctgctcgaaagactcctcggagaagccccatctcttcacacactgtctcttgcagagaacagcctcacgcgtttgactaggcacacttttcgtgacatgccagcgctggaacagctggacttgcatagcaatgtactcatggatatcgaagatggggcattcgaggggctacctcggcttacccatctgaatctgagcaggaattctcttacctgtattagtgatttttctctgcagcagcttagggtgctcgatttatcctgtaactcaatcgaggccttccagactgctagtcagccacaggcagaatttcagttgacatggctcgaccttcgtgagaacaaacttctacattttcctgacctggccgcactgccaagattaatttatctcaatcttagcaataatctcatcaggctcccaactggaccccctcaagatagcaagggaatccacgcacccagtgaaggttggagcgctctgcccctcagcgccccatctggtaatgcctcaggacggcctctgagccaattgctcaatctggatctctcatacaatgagattgagctgatccccgattcttttctggaacatcttactagcctgtgttttctcaatttgtctaggaattgccttaggactttcgaggccagaagactcggttcacttccctgcctcatgctgttagacctttcacacaatgctctggagactctagaactgggggcacgggctctgggctcacttagaactctgttgctccagggtaacgccttgcgcgatctccccccatacaccttcgccaaccttgcctccctgcaaaggctgaatttgcaaggaaatagagtgtctccttgcgggggaccggacgaaccgggtcccagtggatgcgtggcatttagcgggattacgtcgctacgcagtctatctctggtggataacgagattgagctacttagggctggagcgttcctccacaccccattgactgagctggatttgagttcgaaccccggtctcgaggtggccaccggcgctctgggcggactagaagcatccctggaagtgctcgctcttcaaggaaatggactgatggttttgcaggtggacctgccttgttttatctgcctgaagcgactgaatttagccgagaacaggctgtctcacctgccagcttggacacaggcagtgagcctcgaggtcttagatctcaggaataactccttttccctgctgccagggtccgcaatggggggtttagaaactagcttacgcaggctgtatcttcaagggaatccacttagctgttgcggtaacggatggttagcagcccagctgcaccagggccgagttgacgttgatgctacacaggatttaatatgtcggttctcttctcaggaggaagtcagcttgagtcacgtccgccctgaagactgtgagaaagggggattgaagaatatcaacctaatcatcatccttactttcatcctagtgtctgccatactccttacgaccctggctgcgtgctgttgcgtgagaagacaaaaatttaatcagcagtataaggcctag

SEQ ID NO: 51014 - DNA, 561 bp, Artificial Sequence
  Description of Artificial Sequence: Synthetic coding sequence
atgcgcccacagattctactgttattggcattactgacattgggcctggctgcacagcaccaggacaaggtcccgtgcaagatggtcgataagaaagtgagttgccaggtactgggcttgcttcaagttccctcagtcctaccccctgacacggagactttagacctttccgggaaccagctccgcagtatccttgccagccctcttggcttctacaccgctcttaggcacctggacttgtctactaacgaaatcagctttttgcagcctggggctttccaggcgttgacccatctagaacatctgagtctagcccataacagactcgccatggctacagctctaagcgccggagggctggggcctctccctcgggtgacgtcgttggatctgagcggcaacagcctctactcagggctgctggagcgcttgttgggtgaagcaccatccctgcatacactttccctcgccgagaattccttgacaaggcttacgaggcatacatttagagatatgcccgctctagaacagctcgatctccatagcaacgttcttatgtag

SEQ ID NO: 51015 - DNA, 2079 bp, Artificial Sequence
  Description of Artificial Sequence: Synthetic coding sequence
atggaattgttgcccctgtggttatgcctaggctttcattttctcacagtgggctggagaaaccgtagcgggactgcaactgctgcatcccagggagtttgtaagctggtggggggagcagccgactgtcgaggccagagcctcgccagcgtaccctccagcttgcctccacatgccaggatgctcaccctagatgccaatccccttaaaaccctgtggaaccattcactgcagccttacccattgttggagtccctgtctttgcacagttgccaccttgaaaggatctctagaggggctttccaagagcagggtcacctccgctcgctcgtactaggagataactgccttagtgaaaactacgaagagaccgcggcagcactccacgcccttcccggattgaggcggcttgacctgtccggaaacgcacttaccgaagacatggccgcactgatgctgcagaatctttcttcattaagatctgtttctcttgcaggcaataccataatgcgtctggatgatagcgtgtttgagggtcttgaacggctccgtgagctggatctgcagagaaattacatctttgagatcgaaggcggtgccttcgatggcttggcagaactgcgacacctcaacctagcattcaacaacctgccgtgtatcgtcgacttcggccttacccgattgcgggtgctgaatgtaagttacaatgtgctggaatggttccttgcaactgggggagaagctgcattcgaactggagaccttggatctgagccataatcagctgctgttcttccctttgcttccccagtactctaagctccgaacactcctgctgcgagataacaatatgggtttttaccgcgatctgtataatacatcaagtcctcgtgagatggttgctcagttcctgttggtcgacgggaacgtcacaaacatcacaacagtgtccttgtgggaggagtttagtagcagcgacctggccgatctgcgctttttggacatgagtcagaaccaattccaatatctgccggatggcttccttcgaaaaatgccaagtctgtctcacctgaatttgcaccagaactgcctaatgactttgcacataagggaacatgagcctccaggggcacttacagaactagacttatctcataatcaactttctgagctgcacctggcgcctggcctggccagctgtttgggaagccttcggttatttaacttatcgagcaatcagctcctgggggtcccccctgggctcttcgcaaacgcacgtaacattaccaccctggacatgtcccataaccagatttccctgtgtcctctacctgccgctagcgatagggtgggtccgccaagttgtgtggactttcggaatatggctagccttcgtagtctgagcctggaaggctgtggcctgggcgcactcccggactgcccttttcagggcacgtccctgacatacctggacctttcctcaaactggggggtactcaatggcagcctggcacccctgcaagatgtagccccaatgctgcaagtgctatcacttagaaatatgggtctgcactcttcattcatggcacttgatttcagtgggttcggtaatctccgcgacttagacctgtctgggaactgtctcactacttttccccgatttggcggatctctcgcactcgaaaccctcgatctgagacggaactccctgaccgcgctccctcagaaggctgtttctgaacagctgtctcggggactgagaacgatctatttgtctcagaacccgtatgactgttgcggggtggacggatggggagccttacagcatggccagaccgttgctgactgggctatggttacctgcaacttgagcagtaaaataatcagagttacagaacttcctggaggcgtgccccgtgattgtaagtgggaacgcttggatctggggcttctctatctggtgctcatattacccagctgcctcacactgcttgtcgcttgcactgtcattgtccttacatttaagaaaccactgctccaggttatcaaaagcaggtgccactggtcaagtgtatactag

SEQ ID NO: 51016 - DNA, 4905 bp, Artificial Sequence
  Description of Artificial Sequence: Synthetic coding sequence
atgacaagtgctcagtgccctgcacttgcatgtgtgatgtctccactcaggttctgggggccatggccattgctaatgtggcagctgctgtggctgctcgttaaggaagcgcagccgcttgagtgggtgaaagaccctcttcagctcacaagcaatcctctaggccctcccgaaccgtggtcctcccattcaagccactttccccgagagagcccccacgccccaacgctgccagcagacccctgggatttcgatcatttgggaccgtccgccagctctgaaatgcccgcacccccacaggagagcaccgagaatctcgtgccctttttagatacatgggacagcgccggagaactcccccttgagcccgagcagtttctagccagccagcaggacctgaaggataaactttctccacaagagcgtctccccgtgagtccgaaaaaacttaaaaaggatccagcacagagatggtctctggccgagattatcggcataatccaccagttgtcaaccccccagagccaaaagcaaaccctgcagaatgagtatagcagtaccgacacgccctatccgggttcactccccccagaactgagagtgaagtcagatgagccccctggcccttcagagcaggtgggcccttcgcagttccacttagagccagaaactcagaaccccgagacgcttgaggacatccagagtagttcgttgcagcaggaggcacctgcacagctgccacagctgctggaggaagaaccctcatctatgcaacaggaagctcctgctctaccccctgagtctagcatggagtccttaacgctgcccaatcatgaggtcagtgttcagcctcccggtgaagaccaagcttattatcatttgccaaacattaccgtgaagccagccgacgttgaggtcaccatcacttccgaacctaccaatgagacagagtcctcccaggcccagcaggagacaccgatccaattcccagaggaggtggagccgtccgctactcagcaggaggccccaatcgagccccctgtcccacctatggagcacgagttgtccatttctgagcagcaacagcccgtccagcctagcgagtcaagccgcgaggtcgaaagctcaccaacccaacaggagaccccaggccagccaccagaacatcacgaagttacagtctcacctcccggacaccaccagacccaccatctggcttctccctccgttagtgtgaagccacctgatgttcagctgactatagctgctgagccctccgccgaggtggggacttctctggtgcatcaggaggccacaacccggttgtctggaagtggaaacgacgtcgaacctcctgccatccagcatggcggacctccactgctgcccgagagttcagaggaggctggtccattggcggtgcaacaagagacttccttccagagccctgaacccattaacaacgagaatcccagccccacccaacaggaggctgcagcagagcatccgcagacagccgaagagggcgaatcatccctgactcatcaggaggccccagcgcagactcctgagttccctaatgtggtggtggctcaacctcccgaacatagccacctgacccaagctacagtgcaacctctcgacctcggctttaccattacccccgagtcaatgacagaggtcgaactgagcccaaccatgaaagagactcctactcaacctccaaagaaggtggtcccccagctccgcgtgtatcagggcgtgactaaccccacccccggacaggaccaggctcaacacccggtgagtccatccgtaacagtccagcttcttgacctgggcctcactatcacacctgagccaaccactgaggtggggcactcaactcctccaaagcgcacaatcgtcagtcctaagcaccctgaagtgacactgcctcatccggaccaggtccaaactcagcacagtcatctcaccagggccactgttcagccactcgacctgggcttcacgattacccctaaatcgatgacagaagtggaaccctccaccgctctgatgacgacagccccaccccctgggcaccctgaagttacactcccaccttctgacaagggccaagcccaacatagtcatcttacacaagctactgtacagcccctcgatctggagctgacaatcacaaccaaaccgacaacagaggtgaagcccagcccgaccactgaagagaccagcacccagctgcccgatttaggactggccatcatcccggaaccaacaacagaaactggacacagcaccgcgctggagaaaacaactgcgcctcgaccagacagagtacagacgctacacagatctctcacagaagtgactggcccacccacagaactggaacccgctcaggatagtttagtacagagtgagagctatacacagaacaaggctttgacggccccagaggaacataaggcctcaacctccacgaatatctgcgaactctgtacatgcggcgacgaaatgctctcttgcatcgacttgaatcctgaacagaggctgcgccaagtacctgtccccgaacccaacacccataacggcaccttcaccatattgaacttccagggaaattacatatcatacatagatggaaacgtttggaaggcctacagctggaccgagaagcttatcttacgcgagaacaatctgacggaactccataaggactcattcgagggcctgctatcactccagtacttggacctgagttgtaacaaaattcaatctatcgagagacatactttcgagcctcttccctttctcaaattcatcaacctcagttgcaacgtgatcaccgaactcagttttggtaccttccaagcttggcatggcatgcagtttcttcataaattgatactgaaccacaatccattaacaacagtggaagatccttatcttttcaagctgcctgctctcaagtacctcgacatgggcacaacactggtgccactgacaactttgaaaaatattctcatgatgaccgtggagctcgagaaacttattgttccctcgcacatggcctgctgcctatgccagtttaaaaactctatcgaggcggtgtgtaagacagttaagcttcactgtaactctgcctgcctgactaacaccacgcactgccctgaggaagcatcagtcggaaaccccgagggcgctttcatgaaagtcctgcaggcacggaagaactatacatctaccgagctaatcatcgaaccagaggagcccagcgacagtagcggcatcaatctgtcaggatttggtagcgaacagctagatacaaacgatgagagtgacgtgacgtcaacgttgtcttatatcctgccatacttctctgccgtgaatttggacgtcaagagcttactcttaccattcatcaaactgcctaccactggaaacagccttgcaaagattcagacggttgggaaaaatcgccagcgtctgaatcgcgttcttatgggaccgaggtctattcagaagcgccatttcaaggaggtaggtcggcaaagcataaggagggagcaaggcgcacaggcatctgtggagaacactgccgaagagaagcggttgggaagcccagcacctagagagcttaagcaaccccatacacagcagggtcctgagaagctcgctgggaatgccgtttacacaaagccctccttcactcaagaacataaggctgccgtgagtgttctgaagcccttctccaaaggcgctccttccaccagctcacctgcaaaagcactaccccaagtgagagataggtggaaagatcttacacacgccatctctattctggagtccgcaaaggctagggttaccaatatgaagaccagcaaacctattgtgcatagtaggaaaaagtataggttccacaagacaaggtcccgcatgacacaccgcacccccaaggtgaagaaaagtcctaaggtgcgtaagaagagctacctgtctcgactgatgctgtcaaaccgtctgccattctccgccgcaaagtccttaatcaattcgcctagccagggcgcttttagctcgctacgcgacttatcgccccaggagaatccgtttctagaagttagcgcccctagcgaacactttatagagaataacaatacaaaggacaccactgcccgtaacgcttttgaggaaaatgttttcatggagaatacgaatatgcctgaagggaccatttctgagaacaccaactacaaccaccctccggaagccgacagtgccggaactgcattcaatctggggcctacagtaaaacagacagaaacgaagtgggagtataacaacgtgggaacagacttgtccccggagccaaagtctttcaattatccccttctgagctctcccggagatcagttcgaaatacagcttacgcagcagctccagtctgtcatacccaacaacaatgtgcgaaggctgatagcacacgttatcaggacgctgaaaatggattgctctggggcacacgtgcaggtgacctgtgctaaactggtgtcacgaactggtcacttgatgaagctcctcagcgggcaacaggaggtcaaagcctctaaaatagaatgggataccgatcagtggaagacagagaattacatcaacgagtccacagaggcccagtctgaacagaaagaaaaatccctcgagttcacaaaggagttgcctggttatggctacaccaagaagctgattctggcactgatagtcacgggaattctgacaattctcataattctgctgtgcctgattgagatctgttgccataggcgcagcctgcaggaagacgaggaagggttttccagggatagcgaagcaccgacagaagaggagtctgaagcattaccctag

SEQ ID NO: 51017 - DNA, 4905 bp, Artificial Sequence
  Description of Artificial Sequence: Synthetic coding sequence
atgactagcgcccagtgtcctgcgctggcgtgcgtgatgtctccgttgcggttctggggtccttggccactcctaatgtggcagctactgtggttgctcgtgaaagaggctcaaccgttggagtgggttaaagaccccctgcagctgaccagcaaccctctgggccctccagagccctggagctcacattcgtctcattttcctagggagtcaccacatgctccaactttgcctgccgacccctgggattttgaccacctgggaccttctgcctccagcgagatgccagctccccctcaggaatccacagagaatcttgtacccttccttgacacctgggactcagcaggagaacttccgctggaacccgagcaattcctggcctctcagcaagatctcaaggataagctgagtccccaggagcggctgccagtcagtccaaagaaactaaagaaggatcccgctcagcgatggtccctagcagagattatcggaataatccatcaactgtctactcctcagtcccaaaagcaaacgctgcagaatgagtattcctctactgatacgccataccctgggagcctgccccctgagcttagagtgaagtccgatgaaccacccggacctagcgagcaggttggtccaagccaatttcatcttgagcctgaaacccaaaaccctgagacccttgaggatatacagagcagctcacttcagcaggaggcacctgctcagttgcctcagctgcttgaagaggagcccagttcgatgcagcaggaagctcctgcactacctcccgaatcatcgatggagtccttaactttacccaatcatgaggtgagtgtccagccacctggcgaggatcaggcgtactaccacctgcccaacatcacagtcaaacctgctgacgtggaggtgaccataactagtgagccaaccaacgagaccgagagcagccaggctcagcaggagaccccaattcagttcccagaagaggttgagccaagcgcgacccaacaagaggcccctatcgagcccccagtgcccccaatggaacacgagctgagcatttccgagcaacagcagccggtccagccatctgagtctagcagagaggtggagtctagccctacccagcaggagactccaggtcagcctcctgagcatcacgaagtaacagtctcacctccagggcatcatcaaacacaccatctcgccagccctagtgttagtgttaagcctccggatgtacagcttacaatcgctgccgagccttctgcggaggtaggcaccagtttggtacaccaggaggccacaacgagactgagtggctctggtaacgacgttgagccgccagctatacaacacggcggacctcctctgctccccgaatcttcagaggaggccggacccttagccgtgcagcaggagacgtcctttcagtcccccgaaccaataaacaatgaaaacccctcgcccactcagcaagaagccgctgccgaacaccctcagaccgccgaggaaggtgaatccagtctgacgcatcaagaggcgccagcgcaaacacctgagttccccaacgtggttgttgcccaacccccagagcatagtcatcttactcaggcaacagtccagcctctggacctcggctttacgataaccccagagagcatgacagaagtagagctgtcccccacgatgaaggaaacccctacacagcctcctaaaaaggtggtcccacagcttcgtgtttaccagggggttactaacccgacacccggtcaggaccaagcgcaacaccctgttagtccatccgtgacagtccaacttctagatcttggccttacaatcacacccgagcccacaacagaagtcggtcactccacaccacctaagcgcactatcgtgtctcctaagcaccctgaagtgaccttgccgcatcccgatcaagtgcagacccagcactcccatctgacgcgcgcaacggtgcagccactggacctaggtttcacgataactccgaagagcatgaccgaagttgagccatctaccgcccttatgacgacggctcctcctccgggacaccccgaggtcactctacctccgtccgataaaggacaagcccagcattcccacctgacacaggctactgttcaaccactggacctggaactcaccattaccaccaagcccacgacagaagtcaagcccagccccacaacagaggaaacttcaactcaactcccggatctcggacttgccattatcccggaacccactaccgaaacgggccactctacagcgcttgaaaagactactgcacccagacccgatcgggtgcagaccctccaccgttcactcactgaagtaaccgggccaccaacagaattagaaccggctcaggactcgttggtgcagagcgagtcttatacacagaataaagcactaaccgccccagaggagcacaaggctagcacgtccacgaacatctgcgaattgtgcacatgtggagacgaaatgttatcctgcattgacctgaacccagaacagcgcttaaggcaagtccctgtccctgagcctaatacacacaacggaacattcacaatcctgaattttcagggcaattatataagctatatcgacggcaacgtttggaaggcctactcatggactgagaagctaattctccgcgagaacaacttaacagagctccataaagacagttttgaaggtttattatccctgcagtacctcgatctgagttgtaataaaatccagtccatcgaaaggcatacttttgagccactcccctttttaaaatttattaacttaagttgtaacgtaattaccgagttaagcttcggaacattccaggcatggcacggaatgcagttcctccacaagctaatccttaaccacaatccactaacgaccgtagaggacccttatctgttcaagttgcctgcgcttaagtatcttgatatgggtactacccttgtgccactaactacactaaagaatattcttatgatgaccgttgagttagagaagctcattgtgccgtcacacatggcatgttgcctgtgtcaatttaagaatagcatcgaagcagtgtgcaaaactgtcaaactgcactgcaactccgcatgcctgactaataccactcattgcccagaggaagcctccgtggggaatcctgagggggctttcatgaaagtcttgcaagcccgaaaaaactacacctcaaccgagttaatcatcgagccagaggaaccctccgactctagtgggataaatctctcgggcttcggctctgagcagctcgacaccaatgacgaatctgatgtgacaagcactttatcatacatactgccatatttcagcgcagtcaatctggacgtcaagtccctgctgctccccttcatcaagttacctactacgggcaacagccttgctaagattcaaactgtaggaaagaacagacagcgccttaatcgtgtgctcatgggtccaagatcaatccagaagcggcatttcaaagaggtaggaaggcagtccatcagacgggaacaaggcgctcaggcctcagtggagaatacagccgaggaaaagcgactgggctccccagcaccaagagaattgaagcaacctcatacacaacagggtccagagaagctagccggaaacgccgtctacaccaagccgagctttacacaagaacacaaggctgccgtctccgttttaaagccattctccaaaggcgcaccctccactagctcacctgccaaggccctgcctcaagtgcgggacagatggaaggacctcacccacgccatctccattttggaatcagccaaagcgagggtaactaatatgaagacctcaaagcccatcgtgcattccaggaaaaagtacaggtttcacaagacacggagccgaatgacgcaccgcaccccgaaggtcaaaaaatctcctaaggtgaggaaaaagtcgtatttgagcagattgatgctgtctaatagattgccattttccgccgcaaagtctctgatcaactccccaagccaaggagcctttagctccttgcgtgacttgagcccacaggagaacccgttcctggaagttagtgccccaagcgaacactttatcgagaacaacaatactaaggatactactgctcggaacgcgttcgaggaaaatgtgtttatggagaacacaaacatgcctgagggcacaattagtgaaaacaccaactacaaccacccgccagaagccgacagcgcaggcacagcattcaatctgggccctactgtcaagcaaacagaaaccaaatgggagtacaataacgtaggcaccgacctttctcctgaacccaagtctttcaattaccctctgttgagctccccaggtgatcaattcgaaatacagctgacccagcaactgcaatctgtcatccccaataacaacgtgcggcgactgattgcacacgtgatacggacattgaagatggattgctccggcgcacacgtgcaggtcacttgcgccaaactggtgtcaagaacaggccacttaatgaagctcctttctggccaacaagaggtcaaagcttcgaagatcgagtgggacacggatcaatggaaaacagaaaactacatcaatgaatccaccgaggcacagtcagagcagaaggagaagtccctggagtttacaaaggaactgccaggatatggatacacaaaaaagttgatcctcgcgttgatcgtgactggtatccttactatcctcattattctgctttgtctgatagagatctgctgccataggagaagtctgcaagaagacgaggaaggattcagccgggacagcgaagccccaacggaggaggaatcagaggccctgccatag

SEQ ID NO: 51018 - DNA, 1836 bp, Artificial Sequence
  Description of Artificial Sequence: Synthetic coding sequence
atggcctgctgcctttgtcagttcaagaactccatcgaggcagtctgtaagacggtgaaactgcactgtaacagcgcttgccttacgaacaccacacactgcccagaggaggcaagcgttggcaacccggagggtgcgtttatgaaggtgcttcaggcacgcaaaaattacacatccaccgagctgattatagaacccgaggagccaagcgactcctctgggatcaacctatctggtttcggaagcgagcaactagatacgaacgacgagtccgacgttacttctacactttcatatatcttaccctatttcagtgccgtcaaccttgacgtcaaaagtctactccttccatttatcaagctgccgacaacaggcaactccttggcaaaaattcagactgtcggtaagaacaggcagaggctaaacagggtcctcatgggcccacggagtatccagaagcgccatttcaaggaagtgggcaggcagagcattcgtcgtgaacaaggcgctcaggcatccgtagaaaatactgccgaggagaagagattagggtcacctgcgccacgggagttaaaacagccacacacacagcagggtcccgagaaacttgctggcaatgctgtgtataccaagccaagcttcacccaggaacacaaggccgcagtgagcgtacttaaaccattttctaaaggtgcaccatccacaagtagcccagccaaggccctccctcaggtgcgcgacaggtggaaggacctgacacacgcaatctctattttagaaagcgcaaaggcgagggtgacaaatatgaaaactagcaagcctatcgtacacagtaggaagaagtaccgcttccacaagactcggtctagaatgacccatcggaccccgaaggtgaaaaagagtccaaaggtgcgcaagaaaagctatctgtcaagactgatgctctccaatcgcctgccattttccgccgctaaatcacttatcaactccccaagtcagggggcttttagcagtttgcgcgacctttcccctcaggaaaaccccttcctggaagtatcagctccttccgagcactttattgagaacaacaacacaaaagacacgacagcacgcaacgcatttgaggagaatgtttttatggaaaacaccaacatgccagaaggcaccatcagcgagaacacgaattacaaccaccctcccgaagctgactctgctgggaccgcattcaatctcggaccaaccgtaaagcagaccgaaactaagtgggagtacaacaacgtggggacagacctcagcccagaaccaaagtcattcaactatccactcctgtcctcccccggagatcagttcgagatccagttgacacaacagctgcaaagtgttattccaaataacaacgtaaggcgcctgattgcacacgtcatcagaactctgaaaatggactgctcgggtgcccacgttcaggttacttgtgctaagctggtgtccaggactggccatctcatgaagctgttgtccggacagcaggaggtgaaggcaagcaagattgagtgggacaccgatcagtggaagaccgaaaactacatcaatgaaagcactgaagcccagagcgaacagaaagagaagagtctggaattcacgaaggagctccctggttacggttatacaaaaaagctcatactggcacttatcgtaactgggattctgacaatactcattatccttctgtgcctcatcgaaatctgctgtcatcggcgatcccttcaggaggacgaggaggggttttctcgggattccgaagcgcctaccgaggaggaaagtgaagctttaccatag

SEQ ID NO: 51019 - DNA, 2148 bp, Artificial Sequence
  Description of Artificial Sequence: Synthetic coding sequence
catcgaaactttcaggggaactatatatcatatatcgacggcaacgtctggaaggcttactcttggacagaaaagctcatcttacgagagaataatttgactgagttgcataaggattccttcgaaggcctcctttccctccagtatcttattctgaatcacaacccgctgactacagtggaggacccttacctcttcaagctcccggcactgaaatacctggacatgggcactacactcgtgccgctaacgacacttaagaacattctaatgatgacagttgagctagaaaaactgatcgtgccgagccacatggcatgttgcctgtgccagtttaaaaactcaattgaggccgtgtgcaaaacggtcaaactgcattgcaactccgcctgtttaacaaataccacccattgtccagaagaggccagtgttggcaatccggaaggggcttttatgaaagttctgcaggcccgaaagaattatacctctactgaactcatcattgagccggaggaacccagtgattcatcaggaatcaacctgtccgggtttgggtccgagcagctggacacaaacgatgagagtgatgtgacatctaccctgagctacatcttgccttactttagcgctgtaaacttggacgtgaagagcttgctgctgccctttatcaagctcccaaccactggtaattcactggctaaaattcagacggtgggtaagaacagacagcgactgaaccgggtgctgatggggcctcgcagcattcagaaaagacatttcaaggaagtggggaggcagtccatcaggcgggagcaaggggctcaagctagtgtggaaaacaccgccgaggaaaaaagactgggatctccagcccctagggagctcaagcaaccgcatacacaacaagggcctgagaagctcgcaggaaatgccgtctacactaagcctagctttacccaagagcataaagccgctgtgtccgtgctaaagcccttttccaaaggcgcaccgtccacttcctccccagccaaggctctgccacaggtgcgggaccgatggaaggacctaacacatgctatttccatcctggagagtgctaaggctagggtcactaatatgaagacatcaaagcctatcgtgcattctcgcaagaaatacagattccacaagacaaggtccaggatgacgcatcgtacgccaaaggttaaaaaatcccccaaggtgagaaaaaagagctacctgagtcggctgatgttgagtaatagactccctttctctgccgcaaaaagtctgattaactctcctagccagggcgctttctcaagcctacgggacctctctccccaggagaacccctttttagaagtttctgccccaagcgagcacttcatcgagaataacaacaccaaggacacaaccgccagaaatgctttcgaggagaacgtcttcatggaaaataccaatatgccagaaggaacaattagcgagaacaccaactataaccatcccccagaggctgattcagctggcaccgcgttcaacctcggacctacggtcaaacagaccgagaccaagtgggagtacaacaacgtggggactgacctgtcccctgaacccaagagctttaactatcccctgttgtcttcacccggagatcagttcgagatacagctcacacagcaactgcagtctgtgattccaaacaataatgtccggagactgatcgcccacgtcattcggacgctcaaaatggactgcagtggagcccatgtgcaggtgacatgtgccaagctcgtaagtcgtacaggccacctcatgaagttactgtcaggacagcaggaagtgaaggccagtaagatagagtgggacacagaccagtggaaaacggagaactatataaatgaatcaacagaggcgcagtccgaacagaaggaaaaatctctcgaattcacaaaggagctgcctggctacgggtatacaaagaagttgatactggctttgatagtgacgggaatcctgacaatcttgattatactgttatgcctgatagaaatttgttgccatcgacgtagtctccaggaagacgaagagggcttttctcgcgactccgaagctcctactgaggaggagagcgaggcgctgccctag

SEQ ID NO: 51020 - DNA, 2019 bp, Artificial Sequence
  Description of Artificial Sequence: Synthetic coding sequence
atgcagttcctgcacaagctgattctgaaccataacccactgaccactgtggaggacccttacctgttcaagttgcccgcactgaaatacctggatatgggtacaacactggttcccttgaccactctcaagaacatcttaatgatgacagtcgagctggagaagcttatcgtgccatcgcatatggcctgttgcctctgtcaatttaaaaactccattgaggccgtctgcaaaacagtcaagctgcattgcaatagtgcctgcttaacaaacacaactcattgccctgaagaggccagcgtgggaaatcctgaaggcgcttttatgaaagtgctccaagctcggaaaaattatacttccaccgagctcattatcgagcctgaagagccaagtgattcaagcggcattaacctgtctgggttcggaagtgagcagctggacaccaacgacgagtcggacgttacatcaaccctgtcatacattctaccttatttctctgccgtgaacttggatgtcaaatcactcctcctgccttttataaagctgcccacgaccgggaatagcctggccaagatccagactgtaggaaagaacagacagcgactcaaccgtgtacttatgggcccacggtccatccagaaaaggcactttaaagaggtcggcaggcagtcaatccgtcgggagcagggcgctcaggcctccgttgagaatacagccgaagaaaagagactgggctctcccgcaccccgtgagctgaagcaacctcacacgcagcaagggcctgaaaaactggccggaaatgctgtgtacaccaagccctcctttactcaggaacacaaagcggcagttagcgttctaaaacccttttcaaagggagcaccctccacttctagtcctgccaaggctctgcctcaggttagagaccgttggaaggaccttacgcatgccatctctatcctggaaagcgccaaagccagagtcaccaatatgaagacctccaagccaatcgtccattccagaaagaagtacagatttcataaaactagaagtcgaatgacccaccgcaccccaaaggtgaagaagtctcccaaggtgcggaagaagagttacttgagtcggttaatgttaagcaaccgcctccccttttccgccgctaagagcctgatcaactccccgtctcagggggctttctcatctcttcgcgatctcagccctcaagagaatccttttctcgaggtctcagccccttccgagcactttatagaaaacaacaacacaaaagatacaacagccaggaacgcctttgaggagaacgtattcatggagaatacaaacatgcccgaggggactatcagcgagaatacgaattacaaccatccgcctgaggcggacagtgcgggtacggcctttaatcttggccctaccgtgaaacaaacagagaccaaatgggaatacaacaacgtcgggactgatctcagcccagagccgaagtctttcaactatccactgctaagctccccaggcgatcaattcgagatccagttgacacaacagcttcaatcagttatccccaataacaacgtaagacgcctgatcgcccacgtcatccgaaccttgaagatggactgttctggggcacatgtccaggtcacctgtgcaaagctcgtgtccagaacgggccacttgatgaaactactgtcaggacagcaggaggtcaaagcatctaaaatcgaatgggatacagatcaatggaagacagagaactacatcaatgagagtacggaagctcagtcggaacagaaagaaaagtcactggaatttaccaaggaactgcccggttacgggtataccaaaaagcttatactcgcattgatcgtcactgggatcttgacaattttgatcattctgctttgccttattgagatttgctgtcacaggcgcagcctgcaggaagatgaggaaggctttagcagggacagcgaggccccaaccgaggaggaaagcgaggcgcttccgtag

SEQ ID NO: 51021 - DNA, 5103 bp, Artificial Sequence
  Description of Artificial Sequence: Synthetic coding sequence
atgtcaagtgcccagtgccccgctttggtttgcgtcatgtcccgcttgagattctggggcccatggcctctgctgatgtggcagcttctctggttactggtgaaggaggcacaaccccttgagtgggtcaaggaccctttacaactgaccagcaatcctctcggtccacctgaatcttggtcaagtcactcctctcattttcccagagagtctcctcatgcccctaccttgcctgccgacccgtgggattttgaccacttaggacctagcgcctcatcagagatgcctgccccacctcaggagtccacagagaatctcgtgcctttcctggacacctgggatagcgctggcgagcagccactcgagcccgagcagttcctcgcctctcagcaggacctaaaggacaagttaagccctcaagagaggcttcctgttagccctaagaagctcaagaaagaccctgcacaaaggtggtcgctggctgagattatcgggataactcggcagttgtctaccccgcagtctcaaaagcagaccctgcagaatgagtacagcagtaccgatactccttaccccggaagtttacctcccgagttgagagtgaagtctgacgaaccacctggaccgtccgagcaagttggaccttctcagtttcatttggagccagaaacacagaaccccgaaaccttagaggacattcagagctcgtctctgcagcaggaagcaccggcacagttaccacagctcctcgaggaagagccttcatctatgcagcaggaagcccctgcactccctcccgaatcttctatggagtccttaacccttcctaatcatgaggtgtccgttcagccacccggagaagaccaggcttattatcaccttcccaatataactgtaaagccagccgatgtggaggtcacgattaccagtgaaccaacaaacgaaacggagtcttctcaagcgcagcaagaaacccctattcaattccctgaagaggtggagccctccgcaacccagcaagaggctcccatcgagcctcccgtgcctcctatggagcacgaactcagcattagcgaacaacagcagccggtacaaccaagtgagtctcctcgagaggtagagagttcacccacccagcaggagaccccagggcagccaccagaacaccacgaggtgactgtctccccgcctggccatcatcagacacatcacttggcctctcccagcgttagcgtaaagccgccagacgttcagctaactattgccgcagaaccatccgccgaagtcggaactagtctcgtacaccaggaagccaccactcggctgtcaggctcaggaaacgacgtcgagccccctgccatacagcatgggggacccccactcctgccggaaagttcagaggaagccggacccctagccgtgcagcaggagacctcttttcagagtcctgagcccatcaacaatgagaacccttcacctacccagcaggaggctgccgcagaacaccctcagacagctgaagagggcgaaagctcactgacccatcaagaagcccctgcccagacccccgagttcccaaacgtggtcgtggcacagcctccagagcattcccatctgacacaggccacagtccagcctctagacctgggattcactattactcccgagagcaaaacagaggtggagctgagcccaaccatgaaggagacccctacacaaccaccaaaaaaagtggtaccgcagctgcgggtgtatcaaggggttaccaatcctaccccaggacaggaccaggcccagcaccccgtgtctccaagcgtcaccgtgcaactcctggacttgggtctaactattacccctgaacctacaacagaagtgggtcactccacaccccctaagcgtaccattgtgagtccgaagcaccccgaggtgaccctgccgcacccagaccaagtgcagactcaacacagtcacttgacaagggcaacggtgcagccactcgacctcggatttaccatcactcccaagtctatgaccgaagtcgaaccatcgacagccctcatgactaccgcccctccaccaggacatcctgaggtaactctaccccctagcgacaaaggtcaggcgcagcactcccaccttacgcaggcaacggtgcaaccgctagatttagaattgacgatcacgactaagccaacgacggaggtgaagccgagtccgaccaccgaggaaacgtccacgcagcctcctgacctgggcttggcaatcatacctgagccgaccaccgagacaggccatagtactgccctggagaaaaccacggccccaaggcccgacagagttcaaaccctgcataggagcctgacagaggtgactgggccacccacagagctcgagccggcacaggactccctggtgcagagcgagtcgtatacgcagaacaaggcactaacagctccagaagagcataaagcatccactagtacaaatatatgtgagctttgtacatgtggcgatgagatgctgtcgtgcatagacttgaatcccgagcagagactgcgccaggtacccgttcccgaaccgaatacacacaatggcacctttacaatactgaactttcagggaaactacatctcttatattgacggaaatgtctggaaagcatactcttggactgagaagttaatactccgcgaaaacaaccttactgagctccacaaggactcttttgaggggttactcagcctacagtacctggacctgagttgcaataagatccaatccatcgaacggcacaccttcgagcccttgcccttcctgaagttcattaacttaagctgtaatgttatcacagagctgtcctttggcacttttcaagcatggcacgggatgcaattccttcacaaattgatcctgaaccataacccacttaccaccgttgaagatccctatctcttcaaacttccagctctcaaatacctggatatgggaaccactctagttcctctgaccacgctaaaaaacattctcatgatgaccgtcgaactggaaaagcttatcctgcctagtcacatggcatgttgcctatgtcaattcaaaaacagtattgaggccgtgtgtaagactgtcaaactgcactgcaatagcgcatgtctgaccaatactactcattgccctgaagaagcttccgttggaaaccctgaaggcgctttcatgaaggtgttgcaggcccgaaagaattacacttctactgaattgatcgtcgagcccgaagagcctagcgattctagcgggatcaacctgtctggtttcggaagtgaacagcttgacaccaacgacgagagcgacttcatttcaactctgagctacattctgccctattttagcgcggttaacctagacgtgaaatctctgctgcttccctttatcaagctgccaaccaccgggaattctctcgccaagatccagaccgtgggtcagaaccggcagcgcgtaaaacgcgtgctgatgggtcctagatctattcagaagcgccatttcaaagaggtgggcaggcaatccatcagaagggagcagggcgctcaggcatccgtcgaaaatgccgctgaagaaaagcgtctaacaagccccgctcctagggaagtcgagcagccccatacgcagcaaggaccggagaaactggccggaaacgcagtctacaccaaaccaagcttcacccaggagcataaggctgcagtgagtgttctcaagcctttttctaaggggaccccctcaacttctagccccgcaaaggccctgccgcaggtaagggacagatcaaaagacctgacccacgcgatctccattctggagtcggccaaggcaagagttaccaacaccaaaacaagcaagccaatcgtgcatgccagaaagaaataccgatttcacaagaccagatcgcatgttacccacagaacaacaaaggtgaaaaaatcgcctaaggtgcgcaagaaatcctacctgtcgagactcatgctggccaatagactgcccttctccgcagcaaagtcattgattaactctccgtcccagggtgcgttcagttcccttggtgacctctccccacaggagaatccttttttggaagtgagcgcgctcagtgaacacttcattgagaagaacaataccaagcacactaccgcccgtaacgcctttgaagagaacgattttatggagaatacaaacatgccggagggcactattagcgaaaacacgaactacaaccacccaccagaggcagacagtgccggaacagcttttaacctgggacccaccgtgaaacagaccgagacgaagtgggaatacaacaatgtcggcacagatttgtcacccgaacctaagagtttcaactatccattgctgtcatctccaggggaccagtttgaaatccagctcacacagcagctgcagtctcttatccccaataataacgtacgcagactcattgcacatgtgatccgaacactgaagatggactgtagtggagcccacgttcaggtgacctgtgcaaaactaattagcaggactgggcatctaatgaagttgttgagtggccagcaagaagtgaaggcgagcaagatcgagtgggacactgatcagtggaagatcgagaactacatcaacgaaagtaccgaagctcaatcggagcaaaaggaaaagtcacttgaactcaagaaagaagttcctggttacggctataccgataagctcattctggctctgattgtgactggcatcctgactatcttgattatcctgttttgtctgatagtgatttgttgccaccgcaggtctctgcaggaggacgaagagggtttctcacggggaatttttcggtttttgccttggcgagggtgtagtagtcggcgagagtctcaggacggtctctccagcttcggccagcctctgtggttcaaagacctgtacaagcccctttcagctacaaggataaacaatcacgcgtggaagctgcacaagaagagctctaatgaagacaagatacttaaccgggacccgggagactctgaggcgccaacagaggaagaagagtcagaagctcttccttag

SEQ ID NO: 51022 - DNA, 5102 bp, Artificial Sequence
  Description of Artificial Sequence: Synthetic coding sequence
atgtcttccgcccagtgccctgctctggtgtgcgtgatgtctcgactgagattttggggaccatggccgttgctgatgtggcaactgctgtggctgctagtcaaggaggcgcagcccctggagtgggtgaaagatccactacagctcacaagcaaccctctgggcccacccgaaagttggtcatcccacagttctcacttccccagggagtctccccatgctccaacccttcccgcagacccctgggactttgatcacctcgggccttccgcctcaagcgaaatgcccgcaccccctcaagagagtaccgaaaacctggtgcccttcctggacacctgggacagcgcaggggagcaacccctggagccagagcagtttctggcgtctcagcaggacctgaaggataaactctcgccccaggagcgcctacctgtgagccccaaaaaattaaagaaagaccccgcacagcggtggtcattagccgaaatcataggtattacacgccagttgtccaccccccagtcccagaaacagacactgcagaatgagtactcaagcaccgacactccttaccccggatcacttcccccagaactgcgagtgaaatctgatgaacccccaggcccatcagagcaggtcgggccatcccagtttcatctcgaacccgaaacacaaaatccagaaacactggaggatattcagtccagttctctgcagcaggaggcacccgcacagctgccacagctgctggaagaggaaccttcttccatgcaacaggaggcacctgctctgcccccagagagtagtatggagagtctgacccttccgaaccacgaggtttccgtgcagcctccaggcgaggaccaggcgtactatcatctgccaaatatcacggtgaaaccagccgacgttgaggtgaccattacttctgaacccactaatgaaacagagagcagccaggcgcaacaggagactcccatacagttcccggaagaggtggaaccgtctgctacacagcaggaagcccctatagaaccccctgttccccctatggagcatgaattaagcatatccgaacagcagcagcctgtgcagccttctgaatctcctagagaagtggagtcatcgcccacccagcaggagacccctggccagcctcctgagcatcacgaagtcaccgtttcacctcccggacaccaccagacacaccatctcgcatccccgtctgtctccgtgaagcctccagacgttcagctaaccatagcagctgaaccttcggcagaggtgggaacaagcctcgtccatcaggaggctactaccaggttaagcggctctgggaacgacgtggagccaccggcaatacagcacggcggaccacccctactacctgagtctagcgaggaggctggccctctggctgtgcaacaagaaacaagcttccagagccccgagcccataaacaatgagaatcctagtccaacacagcaagaagccgctgcagaacatccacaaactgccgaagaaggtgagtctagcttaactcaccaagaagctccagcccagacacctgaatttccaaacgtagttgtcgcgcagccccctgagcacagtcacctgactcaggccacagtccagccactcgatttagggttcacaatcactcctgaatcaaaaacagaagtggaactctcgcccaccatgaaggagacgcccacccagccgccaaaaaaagtggtccctcagttgcgtgtttaccagggggttaccaaccctacgcccggacaagaccaggcgcagcatccagtgagcccttctgtaaccgtgcagttactcgatctgggactcaccataactcccgagcccacaactgaggtcggccactccaccccccctaagagaacgatcgtgagcccaaagcaccccgaggtaaccctgccacaccccgaccaggttcagacacagcactcccacctgacacgggctactgtgcagcccctagatcttgggtttaccatcacccctaaatcaatgaccgaagtggaacctagcacggcactgatgactactgcgccacccccaggtcaccctgaggtgacactaccgccatcagataagggacaggcccaacactctcacctcacccaggctacagtgcagccactcgatctggaactcacgattaccacgaaaccaacaactgaggtcaaaccttctcccaccacggaagaaaccagtacccaacctccggatctgggccttgccattatccctgaaccaaccactgaaacaggacattctaccgcgctcgagaagacaaccgccccaaggccggatagagtgcagactctccacagatctctgaccgaagttaccggtcctcccacagagctggagccagcccaggacagcctcgtgcagagtgagtcatacacacagaacaaggcacttacagccccagaggagcacaaagccagcacttctacaaacatttgtgaactatgcacctgtggcgatgagatgctgtcttgcatcgatctaaatccagaacagagactcaggcaagttccagtgcccgaacctaatacacataatgggaccttcacaatattgaactttcagggaaactacatcagctacatcgatggaaatgtgtggaaggcttattcctggaccgaaaagttgattctcagagagaataacctgaccgaattgcacaaggattcatttgagggtttactgagccttcagtatttagacctatcgtgcaacaagatccagtccattgaacgccatacctttgagccacttcctttcctaaaattcattaacctctcatgcaacgtcatcaccgagctgtccttcggaacctttcaggcttggcacggcatgcagtttctccataagctgattctgaaccacaacccactgacaaccgtcgaggacccatatctgttcaaattgcctgccctaaaataccttgacatgggaaccactctggtaccccttacgaccttgaaaaatatcttaatgatgacagtagaattagagaaactgatcttgccatcgcatatggcctgttgcttgtgccagtttaaaaactccatcgaggcagtgtgtaaaaccgttaagctgcattgcaacagcgcctgcctgacgaacaccacccattgccctgaggaagcctcagttggcaaccccgagggtgcctttatgaaagttttgcaggcaaggaagaactatacatcaaccgagcttatagtagaaccggaggagccgtcagactccagcggcattaatctcagtggctttgggtctgagcagttggatacaaacgacgagtccgattttatttcaacactctcctacatcctgccctacttcagcgctgttaatctggatgtgaagagtctcttgttaccctttattaaattgcccactacggggaacagcctcgccaaaattcaaaccgtgggtcagaaccggcagagagtgaagagggtcctaatgggtcctcggtcaatccaaaagcgacatttcaaagaggtcggacggcaaagcattagacgcgagcaaggtgcgcaagcctcagtagaaaacgcggcagaagaaaagcgactgacctcaccggctcccagggaggttgagcagccacacacccagcaaggccctgaaaagttggccggtaatgctgtgtacacaaaaccgagctttacgcaggagcacaaggcagcagtatccgttcttaagcctttcagtaagggaacaccttccacatcttcacccgctaaggctcttccccaggttagggacaggagcaaggatttaacccatgcaatctccatccttgagagcgccaaagcccgagtcacaaataccaaaacttctaaacccattgtgcacgctaggaaaaagtaccgattccataaaacaagatcccatgtcacccatcgaacaacaaaggtgaagaagagccctaaagtgcggaaaaaatcctatttgtcacggttaatgctggccaatcgcctgcctttttcggcagcaaaatccctgatcaattcaccttcacaaggagctttttcaagcctcggtgatctgtcgccacaggagaacccattcctggaagtctcagccctgtctgagcacttcatcgaaaagaacaataccaagcacacaacagcacgaaacgcgttcgaagagaacgactttatggaaaacacaaacatgccagagggaacgatcagcgagaacaccaattacaatcacccacccgaagctgacagcgcagggacagcctttaacctcgggccaacagtgaagcagactgagactaaatgggagtataataacgtaggcaccgatctaagcccagaacctaaatcatttaattacccactcctgagcagccccggagatcaatttgagatacaactcacgcagcaactgcagagtttaataccaaacaataacgtgcgcaggcttatcgcacacgttatcagaacattgaagatggactgcagtggggctcatgtgcaggtgacatgtgcgaagcttatcagcagaacaggacaccttatgaaacttctttccgggcagcaggaggtaaaagcgagcaagattgaatgggacaccgaccagtggaagatcgagaattacattaatgaatctacggaggcacagagcgaacagaaggaaaagtctcttgaacttaaaaaggaagtgcctggatatgggtatactgacaagctgatcctggccctgatagtcaccggcattctgaccatcttgataattcttttttgtctgatagtcatatgctgtcacaggaggtccctacaggaggacgaggagggttttagccgtggcatcttccgtttcctgccctggagaggttgcagcagccgtagagagtctcaagatggcctctcatcctttggtcagcctctttggtttaaagacctgtacaagcccttgtcagctactcggattaacaaccatgcatggaagctccataagaaatcctctaatgaagataagattctaaaccgagatcccggagacagcgaagctcccacagaggaggaagagagcgaggctctgccata

SEQ ID NO: 51023 - DNA, 2925 bp, Artificial Sequence
  Description of Artificial Sequence: Synthetic coding sequence
atggcccacgcctacaaaggacacgagcatctgcgtgcggcacgtatggcctttgccgaatgtatcgccccagcttgcgtcatgtcttggcttcgcttttggggcccatggcctcttttgacgtggcaacttctgtctttgctcgtcaaagaagctcagcctctggtttgggttaaggatcctcttcagcttacctctaatccattgggacctccagagccctggtcctccaggagttcgcaccttccttgggagtcccctcacgcccctgccccaccggctgctcccggtgactttgactacttaggaccaagcgcgtctagccagatgtccgccctgcctcaagaaccaacagagaacctcgccccattcctgaaagagctagacagtgccggtgagctgcctctcgggcctgagccctttctcgcagcgcatcaggatctcaacgacaaacggacacccgaggaacgcctgcccgaggtggtgccgctgcttaatagagaccagaaccaggctttggtccagctcccaaggctaaagtgggtccagaccactgacttggatagggccgctggccatcaggctgatgaaatccttgtgccattggacagtaaagttagtcgccctactaaatttgtggtgagtccgaaaaatctcaaaaaggatttggcagagaggtggagcctgcccgaaatcgtggggatcccacatcagctgtcgaagcctcaaagacagaaacagaccttgcccgacgactatctgtctatggataccctgtaccctggaagtctgcctcctgagctgcgcgtgaacgctgatgagccaccaggtccgccagaacaagtcggactgagtcagttccacctcgagcctaaatcccagaatccggaaactctggaggacattcagagttcaagcctgcaggaggaagcgcctgcacagctacttcagctgccgcaagaagtcgagccaagtacccaacaggaggctccagcgcttccacccgaaagcagtatggagagcctggcacagacacctctgaatcacgaggtcacagtgcagcctcctggtgaggatcaggctcactataacctgcctaaattcacagtaaagcccgcagacgtcgaggtgactatgacatctgagccaaaaaatgaaaccgaatccacacaggctcaacaggaagccccaatacagccccctgaggaggccgagcccagtagcaccgcattgcggacaacagatcctcctcccgagcacccagaggtgaccctgcccccatccgataaagggcaggcccagcactcacatctgacagaggctaccgtccagccattggatttggaactgtccattaccactgagcccaccacagaggtcaagccatctcccacaactgaagagacctccgcacagcctcccgatccaggactggctatcacccccgaacctacaactgaaataggccactccaccgcactcgagaaaaccagggccccacatcccgaccaggtacagaccttgcatcggagccttacggaggtgactggacctcccaccaaactcgagagctcccaagactctctcgtacaatctgagacagctccagaggagcaaaaggccagtacctctactaatatttgcgagctgtgcacgtgtggggatgagactctgagctgtgttggcctttcccctaagcagaggctcagacaggtgccagtacctgaacccgacacctataacggcatttttaccaccctgaacttccaggggaattatatttcctatcttgatggaaacgtctggaaagcctacagttggacggagaagcttatactgagcgagaactatttgacagaactaccaaaagactcttttgaaggactactctacttgcaatatttggacctgagctgtaataagattcggtatatagaaagacagacatttgaatccctcccctttttacagtatataaaccttggatgcaacctaatcaccaaactcagtctcggcacatttcaggcctggcatggaatgcaattcttgcataatctcatcctcaatcgaaatccattaacaaccgtggaggacccatatctttttgagttgcctgccctgaaatacctcgacatgggcacaacacacattaccctcactacattgaaaaacatcctgaccatgaccgtcgaacttgagaagttgattctccctagccatatggcttgttgcctgtgccagttcaaaaactcaatagaagccgtttgtaagactgtcaaactgcactgtaatactgcatgcctaactaatagcatccattgtcctgaggaagcttctgtgggaaacccagaaggcgctttcatgaagatgttacaggcccgtaaacagcatatgtctacccagctcactattgaatcagaggcaccttctgactcaagtggcatcaacctgagcggcttcggaggagaccaactcgagatccaattgacagaacaactccggtctttaatacccaatgaagatgtgcgcaagttcatgtcacatgtcataaggacgctgaaaatggagtgcagcgaaacccatgtccagggcagctgtgctaaactgatgcttaggaccggcctgctaatgaagctcttgagcgagcagcaagaggccaaggcattaaacgttgaatgggatacagaccagcagaaaaccaactacatcaacgagaatatggagcaaaacgagcagaaggagcaaaagtcttcagaattgatgaaggaggtgccaggcgacgactacaagaataaactcattttcgctatctccgtcacggtaatcttgattattcttatcattatcttttgcctgatcgaggttaactcccacaagcgagcatctgagaaatataaggacaaccccagcatttctggtgcatag

SEQ ID NO: 51024 - DNA, 2844 bp, Artificial Sequence
  Description of Artificial Sequence: Synthetic coding sequence
atgtcatggctgcggttctggggaccgtggccattgctcacgtggcagttactaagcttactggtgaaggaggctcagccgctcgtatgggtcaaggacccacttcaactgacgtctaacccactggggcctcccgagccatggagtagccggtcctcacatctgccctgggaaagcccccacgcccctgccccacccgcagcccctggtgacttcgactaccttggccctagcgctagctctcagatgtccgccctgccccaggagccaacagagaacctggcgccatttctcaaggagctggactcagccggtgaactccctctcggaccggagcctttcttggctgcccatcaggacttgaatgataaacggacccctgaggagagattgccagaggttgtgccacttctgaacagggaccaaaatcaggcgcttgtgcagttacctcggctcaagtgggtacagacgaccgacctcgaccgagctgctgggcaccaagcggacgagatattggtacctctagattcaaaagtttctcggccaacaaaattcgtagtgtctccaaagaatctgaaaaaggacttggctgaacgctggagtcttcccgagattgtcggcatccctcaccagctcagtaagccacagcgacagaagcaaacccttcctgatgactacctctcaatggataccctgtatcccggaagcttacctcccgagctgagggtaaacgcggacgagcccccaggacctcccgaacaggttggcttgtctcagttccatcttgaacccaaatcacagaatccggagactctggaagatatccagagttcgagccttcaagaggaggcaccagctcagctgctacagcttccacaagaggtggagccgtctacgcagcaggaggctccagcactgcctcctgagtcgtccatggagtcactcgctcagacaccgctgaatcatgaggtaacagtccagcccccaggggaggaccaagcccattacaatctacctaagttcaccgttaaaccggcagacgtggaagttacaatgacatccgaaccgaagaatgaaactgaatcgacccaggctcagcaagaggcccctattcaaccccctgaagaagcggagccctcttccaccgccctccgcaccactgatccaccgcctgagcaccccgaggtcacactgcctcctagtgacaagggccaggcccaacattcacaccttacagaggctaccgttcaacctctggaccttgagctctccattacaaccgaacccactacagaagtgaaaccttcacctacgaccgaagagacatccgctcagccccctgacccaggcctcgccatcacaccggaacctacaaccgagattggacactctacggccttggagaaaacccgtgctccacatcccgaccaggtgcagaccctgcatagaagcttaaccgaggttactgggccacccactaagctcgaatctagccaagacagcctggtgcagtctgaaactgctcccgaagaacaaaaggcatccacctcgacaaacatatgcgaactctgcacctgcggagacgagaccctgtcttgtgtcggactctcacctaagcagcgcctacggcaggtacccgtccccgagcctgacacatataatggaattttcaccacactgaacttccagggcaactacataagctacttagatggaaatgtgtggaaggcttattcctggactgagaagctgatcctcagcgagaactacctgaccgaactgcccaaggattctttcgagggacttctgtacctgcagtatctggacctgagctgtaacaagattcgatacatcgaaaggcaaacgttcgagtccctgccattcctgcagtacatcaacttgggatgtaacctcattactaaactgagtcttggcactttccaagcttggcacggaatgcagtttttgcacaatctcatacttaatagaaatccattgaccaccgtggaggacccatacctctttgaactgcccgctttgaaatatctggatatggggacgactcacatcactctcaccaccctcaaaaacatcctcaccatgaccgtggagctcgagaagctgattctgccttctcacatggcatgctgcctgtgtcagtttaagaactcaatagaagctgtgtgtaaaactgtgaaactgcactgtaatactgcttgcctcaccaactctattcactgccccgaagaggccagcgtcgggaatccagagggggctttcatgaaaatgctgcaggctagaaagcaacatatgagcacccagctgacaattgagagcgaggccccaagtgattcctcgggaatcaacctgagtggcttcgggggtgaccagctagagatccagctgactgaacagctgcgctccctgatccccaatgaggacgtgagaaaatttatgagccatgttattagaaccctcaaaatggagtgtagcgaaacccacgtccaaggaagttgtgctaaattaatgctgagaacaggtttgttgatgaaactcttgtccgaacagcaagaggcaaaggccctcaatgtggagtgggacacagatcaacagaagacgaattatatcaacgaaaacatggagcagaacgagcagaaggaacagaagtctagcgagctgatgaaggaagttcccggtgacgactataagaataaactcatctttgcgatttctgtaactgtaattctcattatcctgattattatcttttgtcttattgaggtgaacagccacaagagagcgtctgagaaatacaaagataaccctagcattagcggagcctag

SEQ ID NO: 51025 - DNA, 2691 bp, Artificial Sequence
  Description of Artificial Sequence: Synthetic coding sequence
atgtcgtggttgcgcttctgggggccttggcccttgctgacctggcagctgttaagtctgctggtaaaggaggcacagccattggtgtgggtaaaagatccactgcagctcacgagcaatcctctcggccctcccgaaccatggagctcccggagtagccatttgccctgggagagtccgcatgctcccgctccccctgctgcccctggtgatttcgattatctcggcccttccgccagttcacagatgtctgccttgcctcaggagccaacagagaatctggccccttttttaaaagaactggattctgctggtgaactgccgcttggtcccgagccattcctggccgcacatcaggatctcaatgacaaaagaacccccgaggaaaggctgccagaggtggtgccattacttaacagagaccagaaccaggccctggtgcagctgccgaggctgaaatgggtacagactacggatctggaccgcgcagctggccaccaagcagatgagattcttgtgccactggattcaaaagtgagccggcctacgaaatttgtggtatcacctaagaacctaaaaaaggacctggccgagcggtggtccctgcccgagatcgtagggatcccgcatcaactgagcaaacctcagaggcagaaacagactctccctgacgattacttgagtatggacaccctgtatcctggaagcctgccccctgagttgcgtgtgaatgctgacgaaccacctggaccaccagagcaggtcggcctaagtcagttccacctggaacctaagagccaaaaccccgagaccttggaagacatccagtccagttctctccaggaggaagcacccgctcaactgttgcaattgccacaggaagtcgagccctccacccagcaggaggccccagctctgccacccgaatcatctatggagtcactagcccaaacacccctcaaccatgaggtgactgtccagcccccaggagaagatcaggcccactacaacctgccaaagtttactgtaaagccagcggacgttgaggtgactatgacaagtgagccgaaaaacgaaacagagtctacacaagcacaacaggaggctcctatccaaccacctgaggaagccgaaccatccagcaccgcactgagaacaacagaccctccacctgagcacccagaagtcacactccccccttcggataaggggcaggcccagcactctcacctgaccgaggccaccgttcagcccctggacttagagctatcaatcactaccgagcctacaactgaggtgaagccgagccccactaccgaggagactagcgcacaacctccggatcctggactagctattactcccgaacccaccaccgagatcggccattccactgccctagaaaagactagggcacctcatcccgatcaggttcagactcttcatagaagtcttacagaggtgacgggcccacctactaaactggagagcagccaggactctttggtacagtcggaaacagcccctgaagaacagaaagcctcaacctccacaaacatctgcgagctgtgcacctgcggtgatgaaacactgagctgcgtcggcctgtctcccaagcaacggctgcggcaagtccccgtgccagaacccgatacctacaatggaatttttaccaccctcaacttccaggggaactatatctcctatctcgacggaaacgtctggaaagcttacagctggactgaaaagctaattctgtccgagaactatctgacagagcttcctaaagatagcttcgaggggctgctgtatctgcagtatctcatcttaaatcgaaaccccctgaccaccgtggaggacccctacctttttgaattgccagctctgaaatacctggacatgggtacaacacatattacactgaccacactgaagaacattctaaccatgactgttgagctggaaaagttaattctgccctctcatatggcctgctgtctttgtcagtttaaaaattccatcgaggccgtttgcaaaaccgtgaagctgcattgtaacactgcctgccttacgaattcgattcactgccctgaggaggcgagcgtcggtaacccagaaggggcattcatgaagatgctgcaggcccgaaagcagcacatgtctacccaattgactattgaaagtgaggctccttcggactccagcgggatcaacctcagtggcttcgggggtgatcagcttgagatccagctcactgaacagttgcggtccctcatcccaaacgaggacgtgcgcaagtttatgtcccacgtcatacggaccctgaaaatggagtgctccgagacacatgtccaaggttcttgcgcaaaacttatgttgcgcaccggactcttaatgaaactcctctcagagcagcaagaagccaaagcgctgaacgtcgaatgggacacagaccagcagaaaacaaattatataaatgaaaacatggagcagaacgagcagaaagagcagaagagctcagagctaatgaaagaagtgcctggggacgactataagaacaaactaatatttgccattagcgttaccgtgatcctgataattctgattatcattttctgtctcattgaggtgaattctcacaagcgggctagcgaaaagtataaggataatccctcgatctctggcgcttag

SEQ ID NO: 51026 - DNA, 2598 bp, Artificial Sequence
  Description of Artificial Sequence: Synthetic coding sequence
atgtcagccctaccgcaggagcctactgagaacctggccccttttcttaaagaactcgactcagcgggagaactgccactggggccagagccattcctagccgctcaccaggacctgaacgataagaggacacccgaggaaagactgcccgaagtggtacccctgctgaaccgggaccagaaccaggcgctagttcagctgccgagactgaaatgggtacagacgacggacctcgatagagccgcaggacaccaggcagacgaaattctggttcccctcgattcgaaggtctctaggcccactaagtttgttgtctcgccaaaaaatcttaaaaaggacttggctgagaggtggtctctgcccgaaattgtcggtatcccacatcagttaagtaaaccccagaggcagaagcaaacactcccagacgattatctgagtatggataccctgtatccaggatccctgcccccagagttgcgcgtcaatgccgacgaaccacctggtccacctgaacaggtgggcctgtctcaatttcacttggaaccaaagtcacagaaccctgagacattagaggacatccaatcctcatccctgcaggaggaagctcctgcccagttgttacagctgccacaagaggttgagccgtcaacgcagcaagaagcgccagccttgccaccggagagctccatggaatcgctggcacaaactccgttgaatcacgaggtgacagtccaacccccaggcgaggaccaggcccactacaatctccccaaatttactgtcaagcccgcagacgttgaggttactatgactagtgagcctaagaacgaaacagaaagcacacaggctcagcaggaggcgccaatacagccgccagaagaagccgagcctagtagtactgcactgcgaacaaccgatcccccacccgagcatcccgaggtaacattaccaccttcagataaggggcaggcccagcactcccacttaacagaggccacagtgcaaccattagacctggaactatctataaccacagaaccaactaccgaggtcaagccttcccctaccacagaggaaacatccgcccagccaccagaccctggcctggcaatcacaccggaaccaacaaccgagatcggccacagcaccgccctggaaaagaccagagctccgcatcctgatcaggtgcagaccctccatagatcactgaccgaagtgaccggtccacccactaagctggagtcctctcaggattctctcgttcagtcagaaacagctcccgaggagcagaaggcaagcacctctaccaatatatgtgagctgtgcacctgtggggatgaaactttaagttgcgtaggcctgtctcctaagcagaggctgcgccaggtaccagttcctgagccagacacttataacggcatattcaccacactgaattttcagggtaactatattagctatctagatggcaatgtttggaaggcatacagctggacagagaagcttatcctatccgagaattaccttaccgagctgcccaaggattcatttgaggggctcctttatctccagtacctcgatttgtcttgtaataagattcggtacatcgaaagacagacctttgagtcacttcccttcctgcagtacattaatcttgggtgcaatctcattaccaagttatccttgggcactttccaggcttggcacggtatgcaattccttcacaatctcattttgaacaggaatcccttgaccaccgtcgaggacccgtacctgttcgagctgcctgctctaaagtatctcgatatgggcaccacgcatatcacacttacgacattgaaaaatattctgacaatgacagtggagcttgaaaagctcatcctccctagccacatggcctgctgcctgtgtcagtttaaaaattccattgaagcagtttgtaaaacagttaaattgcattgcaatacagcatgtttaacgaactctattcattgccccgaggaagcatccgtaggtaatcccgagggagcttttatgaaaatgctgcaggcaagaaaacaacatatgtccacacagctcaccatcgagtctgaggcccctagtgacagtagcgggatcaatttgtctggcttcgggggtgaccaactggagattcaactaacagagcaactgcgaagcttaattccgaacgaagatgtgcggaaattcatgagccatgtcataagaaccctcaagatggagtgctctgagacacacgttcagggttcctgcgccaaactgatgctgagaactgggctcttaatgaagttactgtctgagcagcaagaagctaaagccctgaacgtggagtgggataccgaccagcagaagacaaactatatcaatgagaacatggagcagaacgagcagaaggaacaaaagagcagcgaactaatgaaagaggtacccggagacgactacaagaataagttgatcttcgctatcagtgtgaccgtcattcttatcatcttgattatcatcttttgcctgatagaggtcaactctcacaaaagagcctcagagaagtataaggacaatcccagcattagcggcgcttag

SEQ ID NO: 51027 - DNA, 885 bp, Artificial Sequence
  Description of Artificial Sequence: Synthetic coding sequence
atgcggccacgggctcccgcatgcgccgctgccgctctggggctgtgctcgctactactgctcttagctcccggacatgcctgcccagcagggtgcgcctgcactgacccccacacggtagattgccgagaccgcggactcccaagtgtccccgacccctttcctctcgatgtccggaaacttctggtggccggtaatcgcatccaaaggatccctgaagacttttttatcttctatggcgatctcgtctaccttgatttcagaaataacagcctccggagtctagaagaaggcaccttttccggcagcgctaagctcgtgttcctggacctcagctacaataaccttactcaactcggagccggagccttccggagcgcagggaggttagtcaagctgtcgttggctaacaataacctggtgggcgtgcacgaagatgctttcgagactctggaatcacttcaagtcctagaactcaatgacaataatctgagatcactgtctgtcgcagccctggccgctctgcccgctttgcggagtctgcggttggatgggaacccatggctgtgtgactgcgattttgcacatctcttttcttggatacaggagaacgcttcaaaactgcctaaaggtcttgatgagatacagtgcagcctaccgatggaatcaaggaggatttcattgcgcgagctatcagaagcctctttttcagagtgtagattttcactgagtcttactgatttgtgtattatcatattttccggggtcgctgtgtctattgcagccattatttcatccttctttctggctaccgtggtccagtgccttcagaggtgcgcgcctaacaaagatgctgaggacgaagacgaggacaaagatgattag

SEQ ID NO: 51028 - DNA, 780 bp, Artificial Sequence
  Description of Artificial Sequence: Synthetic coding sequence
atgaatcttgtggatctgtggcttactaggtcactcagcatgtgtttactgttacaatcatttgtgctgatgatattgtgctttcactccgcatctatgtgcccaaagggatgtctttgcagctcctcagggggtctgaatgtgacatgttccaacgctaacttaaaagaaataccgagagaccttcctcctgaaaccgttctgctgtacctggacagcaatcaaattacctcaatccctaatgagatttttaaggacttacatcagctgagagtcttgaacctctccaaaaacggcatagagttcatcgatgagcacgcatttaaaggcgtggccgaaaccctccagaccctggacttgtcagacaacaggatccagagcgttcacaagaatgcctttaacaatttaaaggcgagggcgagaattgccaacaatccctggcattgcgattgcactctgcagcaggttctgaggagcatggccagcaaccatgagacggctcacaacgtaatctgcaagacctctgtgctggacgagcacgccggaaggccctttttaaatgctgccaacgatgccgacctgtgtaatttgcctaagaagacaactgattatgctatgttggtgacaatgtttggttggttcaccatggttatttcttacgtggtgtactatgtgaggcagaatcaggaggatgccaggaggcatcttgaatacctgaaatcgctgccttccaggcagaaaaaggccgatgagcccgacgacattagcactgtggtgtag

SEQ ID NO: 51029 - DNA, 168 bp, Artificial Sequence
  Description of Artificial Sequence: Synthetic coding sequence
atgaatctggtcgatctgtggctaacccgttctctgagtatgtgcctcttgctccagtcatttgtgctgatgatactctgttttcattctgcaagtatgtgccctaagggatgtctttgcagctcttctggagggctgaacgtcacctgctcgaatgccaacctatag

SEQ ID NO: 51030 - DNA, 780 bp, Artificial Sequence
  Description of Artificial Sequence: Synthetic coding sequence
atgaatcttgtggacctgtggctgacgcggtcacttagcatgtgcctcttgcttcagtctttcgtattgatgatactgtgtttccatagcgcgagtatgtgtcctaaaggctgtctttgttctagcagtgggggacttaatgtgacttgttccaatgcaaatctgaaagaaatccctcgagatttgcctcctgagacagttctactttacctcgactctaaccagattacatccatacctaacgagatcttcaaagatctgcatcagctgagagttctgaatctctctaaaaacggtatcgaatttattgacgagcatgcttttaagggagtggctgagacgttacaaactctcgatctcagcgacaaccgcattcaaagtgtgcacaaaaatgctttcaacaatcttaaagccagggcaaggatagccaacaatccgtggcactgcgactgcacactgcagcaggtgctgagatccatggcttcaaaccatgagactgcccataacgtcatctgtaaaacctctgtgctggatgagcacgctgggaggccgtttttaaatgcagctaacgatgccgatctgtgtaatctaccaaagaagacaacagattatgcaatgctggtaaccatgtttggatggttcaccatggtgatatcatacgtcgtgtattatgtgcgtcagaatcaggaggacgccaggagacacctcgaatatctgaaatcccttccgtcgcggcagaagaaggccgacgaacctgacgatatctccacggtggtttag

SEQ ID NO: 51031 - DNA, 492 bp, Artificial Sequence
  Description of Artificial Sequence: Synthetic coding sequence
atgaatttagttgatttgtggttaacaaggtcactgtccatgtgtctcctgctgcagtccttcgtgctgatgatcctttgctttcattcagctagtatgtgcccaaagggatgcctttgttcaagtagtggtggtttaaatgttacctgctctaacgctaacctgaaggaaattcccagggatttgccgcctgagaccgtactgttgtaccttgacagcaatcagattacctccatccccaacgaaatctttaaagatctgcatcaactgagggttcttaacttgtccaaaaatgggattgaattcatcgacgaacatgctttcaagggagtggcggaaactcttcagaccctggatctgagcgataacaggattcagtcagttcataagaacgccttcaataacctgaaggccagagcccgtatcgcaaacaatccgtggcactgcgattgcaccctgcagcaagtgctgaggagtatggcaagcaactag

SEQ ID NO: 51032 - DNA, 780 bp, Artificial Sequence
  Description of Artificial Sequence: Synthetic coding sequence
atgaatctagtcgacttgtggcttacgcgctcactgtctatgtgcttgctccttcagtcctttgtgctgatgatcctgtgttttcactctgcatcaatgtgccccaaaggttgcttgtgctcttcgtcaggtggactgaacgtgacttgcagcaatgccaacctaaaggagatccccagggacctcccacctgaaaccgtgctgctttatctggactccaaccagataacctcaatcccaaatgagatcttcaaggacctgcaccagctaagagtgctgaacttatctaagaacggcatcgaattcatagatgagcacgcctttaaaggagtggccgaaaccctccagacgctggacctctcagataacagaatccagtccgtacataagaacgcattcaacaacctgaaggctagagccagaatcgcgaacaacccctggcactgcgactgtactctccagcaggtattgagaagcatggcttccaatcatgagacggcacacaatgttatttgcaagacttcagttttagatgagcacgcaggcagaccttttctgaatgccgctaatgacgccgacctctgtaatctgccaaaaaaaaccacagattacgcaatgctagtaacaatgtttggttggtttacaatggtcatctcctacgtcgtgtactatgtgagacaaaatcaggaggacgcgagacgccatctggagtatcttaagagcctcccatcacgccagaagaaagcagacgaacctgacgatattagcacagtggtgtag

SEQ ID NO: 51033 - DNA, 828 bp, Artificial Sequence
  Description of Artificial Sequence: Synthetic coding sequence
atgcgtatgacgagcagcagctttgtctcctactgcacccctggactgtgccagttcatggctatgcttccaacagctggccacttgctccctcttttactggtgatcggaactggcggaacggttccttcaccgcaggtgccaccgagagggtgttacgtggcaaaagaagctggcgagcggacgttcagatgttctcaggcgggactgagcgccgtgccctccggcattccgaacgacacacggaaactttacctcgatgctaaccaactggcttctgtcccagcgggagcctttcagcatttacccgtgcttgaggagctggacctgtcccacaacgcattggctcatttgagcggggctgcttttcagggactggaggggacccttcggcacctcgacctttccgcaaatcagctcgctagtgtgcccgttgaagcttttgttggactgcaaattcaggtgaacctaagcgctaacccttggcactgcgattgtgcccttcaggaagttctacggcaagtccggctggtgcctggcaccggaaccgggattgtctgcggttccggggctcgtccggatctcgtgggccaagagttcctgttgcttgctggtgaggaggaactgtgcggatcaggctggggcggagcaagacgttcaacggatgtggcattattggttaccatgggcggatggcttacactgatggtggcatacctcgttcattatgtgtggcagaacagggacgagacacgacgcagcttgaagcgcgctcccgtgctgcccgtgcgctccgaagacagtagtatactgagcaccgtcgtctag

SEQ ID NO: 51034 - DNA, 1962 bp, Artificial Sequence
  Description of Artificial Sequence: Synthetic coding sequence
atgaagctgctctggcaggtgactgtacaccaccatacctggaacgctatattactgcccttcgtctatttgaccgcgcaggtgtggatattgtgcgctgccatcgcagcagctgcttctgctggacctcaaaattgcccatcagtctgctcttgttccaatcaattcagcaaagtagtgtgcacgcgcagaggcctgtcggaggtgccccagggcattccctctaacaccagatacctgaacctgatggagaataatatccaaatgatacaggcagacacattccggcacctgcatcacctggaggtcctccagttgggtcggaattcaatccgacagatcgaagtcggagcctttaatggactagcatccctgaacaccctggaactattcgataattggctgaccgtgatcccgtcaggcgctttcgagtacctcagcaaactgcgcgaactgtggttgaggaacaacccaatcgagtctataccttcctacgcgtttaacagagtgccctctttaatgcgcctagatcttggcgaattgaagaagctagagtatataagcgagggcgcttttgagggcctgtttaatctgaaatacctgaatctaggaatgtgtaatatcaaggatatgccaaacctgactcctctcgtgggcttggaagagttagagatgagcgggaatcattttcctgaaattcggcctggttcctttcatggattgtccagcctgaagaagttatgggtgatgaatagtcaagtatctctgattgaacgtaatgcattcgacggactggcctctctggtcgaattgaacctagcccataacaacctgtcttctttaccgcacgacctctttacccccctgcggtatttggtagaactgcacctccaccacaacccgtggaactgtgactgtgatatcctgtggcttgcatggtggctgcgggaatacatccctaccaatagtacgtgctgtggaaggtgccacgcaccaatgcacatgaggggcaggtatctggtggaggtggatcaagcgagttttcaatgtagtgcaccgttcatcatggatgcccctagggaccttaatattagcgagggtagaatggccgaactcaaatgtcgtaccccaccaatgagttcggtgaaatggctcctaccaaatggtaccgtgctatcgcacgccagccgccacccaagaatatctgtgctgaatgacggtaccctaaatttctcacacgtcctcctgagcgacactggcgtgtacacatgtatggtcacgaacgttgccggtaatagcaatgcaagcgcctatcttaacgtttcaaccgccgaacttaacacatcaaactacagctttttcactacggtcaccgtcgaaacaacagagatatcccccgaggatacaacaaggaagtacaagcctgtccctacgacgtcaaccggctaccagcccgcatacacaacatctaccacagtgttgattcagacgactagggttccaaagcaggttgcggtccccgctaccgatactactgacaagatgcaaactagtctggatgaggtgatgaagactaccaaaatcattattggctgctttgtggctgttacactcctggccgctgctatgttgatagtgttctacaaacttaggaagaggcaccaacaaagaagtacagtgacagcggcacgtacggtggaaattattcaggtcgatgaggacataccagcggcaacaagcgccgcagccactgctgctccctcaggcgtgtctggagagggagccgtggttctgcccacaatacatgaccatattaattacaatacatataagcctgcccatggtgcccattggaccgagaacagtctggggaattccctgcaccctactgtcactacgatctccgagccttacatcattcagacccacacaaaggacaaggtgcaagaaactcaaatatag

SEQ ID NO: 51035 - DNA, 285 bp, Artificial Sequence
  Description of Artificial Sequence: Synthetic coding sequence
atgaaactcttgtggcaggttacagtgcatcatcatacctggaacgctattctcttgccttttgtgtacctcactgcccaggtgtggatcctctgcgcagccatcgctgccgctgcatctgccggtccacagaattgcccatccgtgtgttcttgcagcaaccagttttctaaggtggtctgtacccggagggggttatccgaggtcccacagggaattccatcaaatactagatacctaaatctaatggaaaataatatacagatgattcaggccgacacctag

SEQ ID NO: 51036 - DNA, 156 bp, Artificial Sequence
  Description of Artificial Sequence: Synthetic coding sequence
atgaaactgctgtggcaggtcacagttcatcaccacacatggaacgccatcctcctccccttcgtctaccttactgcccaggtctggattctgtgtgcagccattgccgctgccgcatctgctgggccacagaattgcccttcagtgtgctcgtag

SEQ ID NO: 51037 - DNA, 2142 bp, Artificial Sequence
  Description of Artificial Sequence: Synthetic coding sequence
atggcaagggcaagagggtccccctgtccacctctcccaccaggtcgaatgagttggccccacggggcactgctcttcttgtggctgttttcccccccactcggcgcaggcggaggaggcgtggctgtgaccagcgctgctgggggagggtcgccacccgctacatcctgcccagtcgcttgcagctgttcgaatcaggcgtcccgcgtcatctgcactagacgcgacctggcagaggtgccagcgtccatccccgtgaatactcgctacctaaacttgcaggaaaatggtatccaagttatccggacggacaccttcaagcacttgcggcacttggagattctacaactctcgaagaacttggtccgcaagatagaggtgggagcttttaatggactgcccagtcttaacactttggagctctttgacaatcgcctgacaacagtgcccacgcaagcatttgaatatttgagtaaactccgggaactgtggttacgcaataaccccatcgaatctattcccagttatgccttcaaccgcgtacccagcttacgcagattggaccttggggagctgaagaggctggagtacattagtgaggctgcctttgaagggctggtgaatctgcggtatctcaatctgggcatgtgtaatttgaaagacatccccaatcttacggcgctggtacggctggaagagctcgagctgtccggtaaccggctcgatttgatacgacctggctcttttcagggcctcacaagcctgagaaagttgtggctgatgcatgcacaagtggccacaatcgaacgaaatgccttcgacgatctcaagagtctcgaggaactgaacttgtcccacaataatctgatgtccctcccccacgatctgttcacccctctgcatcggctggaacgcgtgcacctcaaccacaacccctggcactgtaattgcgatgtgctgtggctgtcgtggtggttgaaagagactgtgccctccaacaccacttgttgcgcgagatgccatgcccctgcaggcctcaaagggcgatatattggagagctggatcagtcccacttcacttgttacgcacctgtgattgttgaaccccctaccgatctgaatgtgacagaagggatggctgctgagctcaaatgccgaacaggcacctctatgacatcggtcaactggctgacacccaacggcaccctaatgacccatgggtcctatagggtcagaataagcgtgctgcatgacggcactctgaacttcacgaatgtcacagttcaggacacgggccagtatacatgtatggtcaccaatagcgctggtaataccactgcatccgcaacgttaaatgtctcagccgtggacccagtggcagccggagggacaggttccggtggtggcggtcccggaggatccggaggcgtaggaggcggttccgggggttacacctacttcaccacagtaacggtggaaacgctggagacgcagccaggagaggaggctctgcagcccaggggaacggaaaaagagccccctgggcctactaccgacggagtgtggggaggcggtagacctggggatgccgcaggcccagcctctagcagcaccactgcccctgcaccacgtagctcccgcccaacggagaaagccttcaccgtacctatcactgacgtgaccgaaaatgcccttaaggatctggacgatgttatgaagacaaccaaaatcatcattgggtgttttgttgccataactttcatggctgccgtgatgctcgtggccttttataagctcaggaagcagcaccaactccacaagcaccatgggcctacgcgcaccgtggaaattataaatgtagaggatgaactgcccgcagcgtccgccgttagtgttgctgccgctgcagccgtggccagcggagggggagtagggggagattctcatctagcattacctgctctggaacgggaccatctgaaccaccaccattacgttgccgctgccttcaaggcccactattcaagcaatccctctggcggaggctgtgggggaaagggtccaccaggcctcaattccattcacgaacctctcctgttcaagagcggcagcaaggagaacgtgcaagagacacaaatctag

SEQ ID NO: 51038 - DNA, 1266 bp, Artificial Sequence
  Description of Artificial Sequence: Synthetic coding sequence
atggcacgggctcggggatccccttgtccccctttgcctccgggtcgaatgtcttggccgcacggagccctgttatttctgtggcttttcagtccgcctttgggagccggaggcggaggcgtggccgtcacttctgctgcgggaggaggtagccccccagctacaagctgtcccgtcgcctgcagctgttcgaaccaggcttccagggtgatctgtacaagacgtgacctggccgaagttcctgccagcattccggtcaacacacgatatttgaatcttcaggagaatggcatccaagtgatccgcaccgacacattcaagcatctgagacacctggaaatcctacagttgtccaagaatctagtgcgcaagattgaggttggtgcgtttaacggtctgcccagtctgaacactctggagctgttcgacaaccgcctcacaactgtacccacacaagcatttgaatatctgagcaagctaagagagttgtggctacgcaacaatcccatcgagtcaattccaagctatgctttcaacagggtgccaagcctgcgccgtctggacctcggggaactgaagcggctggaatacatcagcgaagccgcttttgagggactcgtgaacctgcggtatctgaatttagggatgtgcaatctaaaggacattccgaatctgaccgctctggtgcgtctcgaagaactggaactgtctggcaaccgactggatttgattcggcctggatctttccagggcctcaccagcctcagaaagctctggctgatgcatgcccaagtggctactattgaacggaacgcttttgacgatttgaaatctctggaggaattgaatttatcgcacaataatctcatgtcgcttccacatgacctgttcaccccgctgcaccgcctcgagcgagtacacctcaaccacaatccttggcactgcaattgtgatgtgctgtggctcagctggtggctgaaggaaaccgtgcccagcaatactacgtgctgcgctcgctgtcacgctcccgctgggcttaaaggaaggtacataggcgagctagaccagtctcacttcacatgctatgctccggtgatcgtagagccaccaaccgaccttaacgtaactgaaggaatggccgcagaactcaaatgcagaacaggcacttccatgacttcagtgaactggtggccacaactacacccccgtaccagcgcactgcaggagagactccaaggagagagagcgagagacgctgacctgtag

SEQ ID NO: 51039 - DNA, 942 bp, Artificial Sequence
  Description of Artificial Sequence: Synthetic coding sequence
atgagtctggcatccggtccgggaccaggttggctactgttcagcttcgggatgggtctggtctccggcagcaaatgtccgaataattgtctgtgccaggcgcaggaggtgatttgtaccggtaagcagctaaccgagtaccccctggatatcccactgaacactcgccgtctgttcctgaatgagaaccgtatcactagtcttcccgctatgcacctcggtctgctgagtgacttagtctacttggactgccagaacaaccgtatcagagaggtgatggactacaccttcatcggagtttttaagctgatctacctggatctcagttccaataacctgacttccatctccccattcacattctccgtgctgtcaaacctagtacagctcaacatcgctaataatccccatctactctccctgcataaatttaccttcgccaataccacttctcttcggtacctggacctgcgcaatacgggtctgcaaaccctcgatagcgccgcactctatcatcttaccacactggagaccctgtttctgtccggcaatccatggaagtgcaactgtagcttcctagacttcgccatcttcctgatagtctttcacatggatcccagcgacgacctcaatgcaacctgcgttgagccaacagaactgactggatggccaatcactcgcgtgggaaatccactgagatacatgtgtattacccatttagaccataaggactacattttcctcctcttgatcggattttgtattttcgcggctggtaccgtggcagcgtggctgacgggtgtgtgtgccgtactgtatcaaaataccagacacaagagttcagaggaagatgaagatgaagcgggtacaagggtggaagtcagcaggcgaatattccagacacagacatcctctgtgcaggaatttccacaactgatttag

SEQ ID NO: 51040 - DNA, 1026 bp, Artificial Sequence
  Description of Artificial Sequence: Synthetic coding sequence
atgttgcgctcacccaccttcactgatgcaggacccaggtgtagttgcctccccgtttcacaaacactggatagtatggatacggtactcatgggaagtctgcaacattgctgctgccttttacccaagatgggtgacacatgggcccagcttccttggccaggaccaccacaccccgcaatgctcctgataagcctgttgctggccgctggattgatgcacagcgatgcaggaacatcgtgcccagtgctgtgtacctgccgtaaccaggttgtggactgctcctcacagcgcctgttcagcgtcccacccgacctgccaatggacacccggaacctcagtctcgctcataatcgcattacggccgttcccccaggatacctcacttgttacatggagcttcaggtgctggacctgcataacaacagcttaatggagttgcccaggggactctttctgcacgctaagcggctagcacacctagacctttcgtataacaacttctcccatgtgcctgccgatatgttccaggaggcccacgggctggttcacattgatctcagtcacaacccctggctcaggcgggttcacccccaggcctttcagggcctgatgcaactgcgggatctggatttaagctatggcggactggcctttttgtccttagaagcccttgaaggactgcctggcctggtcacattgcagatcggtgggaacccttgggtttgtgggtgtaccatggaacccctgcttaagtggctccggaatagaattcagcgatgcacggctgactcccagctggctgagtgcagaggcccacccgaggttgaaggcgctcctctttttagcctgacagaagaatcctttaaagcttgccacctgacgctgacattggatgactacctgttcattgcatttgtgggcttcgtcgtgtcaattgcctccgtagcaaccaactttctgttagggatcacggccaactgctgccatcgctggagcaaagcatctgaggaggaagagatttag

SEQ ID NO: 51041 - DNA, 447 bp, Artificial Sequence
  Description of Artificial Sequence: Synthetic coding sequence
atggcaagtgtcgtgctggctctgaggacccggacagcagtaactagtcttctcagcccaacgccagcaaccgctctagcagtgagatatgcctcaaaaaaatcagggggaagctcgaagaatctggggggaaagagctctgggaggcgtcagggcatcaaaaaaatggaggggcattacgtgcatgccggaaacatcatcgccacccagcgacacttccgctggcatccaggcgcacacgtgggggtgggcaaaaataaatgcctctatgcactcgaggaagggattgtccggtacacaaaagaagtttatgtgccacacccccgtaatacggaggccgtggatctcatcacccgactgcccaaaggcgctgtgctctacaaaaccttcgtccacgtcgtgcccgctaagcccgaaggcacatttaagctggtggccatgttatag

SEQ ID NO: 51042 - DNA, 2643 bp, Artificial Sequence
  Description of Artificial Sequence: Synthetic coding sequence
atgaaaaacttgtattttagagtgatcacgatcgtcatcgggctctacttcacaggaataatgactaacgcgtccagaaaatctaatattctcttcaacagcgaatgccagtggaatgaatacatattgacaaattgctcattcactggtaaatgcgatatccctgtcgacatttctcagacagctgcgaccgttgatgtgtccttcaactttttcagagtgctcctgcagtcacacactaaaaaagaagaatggaaaatcaaacacctggatctgagcaataacttgatcagcaagattacactgtccccctttgcctaccttcacgcattggaggtcctgaatctgtctaacaatgcgatccacagtctgtcccttgatctgctgtcacctaagagttcatgggtcaagaggcaccggtcatcttttaggaacagattcccactcctcaaggtgctgattctgcagcgaaacaagctctcagacacaccaaaagggctctggaaactaaaatccctacaaagtctggatctctccttcaacggcattctccagataggctggtctgacttccataactgtctacagctggagaacctctgccttaagtcaaacaaaatatttaagatccctcctcaagcattcaaggacttaaagaaattgcaggtgatcgatttatcaaacaacgcccttattacaatcctgccgatgatgatcattgcgctcgaatttccccaccttgtggtagacctcgctgacaacaattggcagtgtgacgattccgtcgccgtattccagaacttcatctccgagagttggaggaaaaaatggaacgttatctgtaatcggtcaataggctctgaggaagccaacggtggtaccccgcagtctaggataagccgggaaacgcgattgcctccgattcatctgcaccgcatgaaaagcctgatcaggtccaaggcagaacgacctcagggtggacggcacacgggcatctccaccctgggcaagaaagccaaggccggttctgggctgcgaaagaaacagaggcgcttgccccgttccgttagatcaacacgcgatgtgcaggcagctggtaagaaggaagatgcaccacaagaccttgccctagccgtctgtctctccgtgttcataacctttctcgtagcctttagcctgggcgcttttacaagaccttatgtagaccgactttggcaaaagaagtgccagtcaaaaagccccggtcttgacaacgcttacagcaatgaaggcttctacgacgacatggaggccgctggccatacaccacacccagaaacacatctgcgccaggtcttccctcacctgtcactgtacgagaatcagacaccgttttgggtcacacagccccatccgcatgctactgtaatcccggacagaacactgggcaggtccaggaaggatccaggcagctctcaatcacctggtcagtgcggcgacaacaccggcgcaggtagcggcaatgacggagccgtgtatagcattttacagcgtcaccctcatgctggaaatcgtgagctgatgagcgccgcacaggatcatatccacagaaacgatatcttaggtgaatggacttacgagaccgtggctcaggaggaaccgttgtcagcccattccgtgggcgtttcctctgtagcagggacctcccatgctgtatctgggagttcgcgatacgattctaacgagctcgatccctcactttcaggcgagattactgcttccctgtgcaaaatgctgacccacgccgaagcccaaagaaccggtgactccaaggagagaggtggcacggagcagtctctctgggattcccaaatggagttttccaaagagcggcaggtttcctcttccattgatcttttaagtattcaacaaccaaggttatccggcgcaagggcagaggaggctctcagcgcccattatagtgaggtcccctatggcgaccctcgggatacaggtccgagtgtctttccccctcgatgggacagcggcttggatgtgacacctgccaacaaggagcctgtccagaaatccacaccgtcagatacatgttgtgaacttgagtccgactgcgattccgatgaggggtcactttttactttgagctcgatctcttccgagtcagcaagatccaaaaccgaagaggcagttcccgacgaggaaagcctgcaagacgagtcctccggggcatcaaaagacaatgtgaccgcggtcgactctctcgaggagaatgtgactttccagacgattcccggaaaatgcaaaaaccaggaggatccatttgagaagcccttgatcagcgctcctgattcgggtatgtacaaaacccatctggaaaatgcctcagataccgacagatctgagggactgagcccatggccacggtcgccaggaaactccccacttggcgacgagttccctggaatgttcacctacgactatgataccgccctgcagagtaaagccgctgaatggcactgcagtctgcgtgatcttgaattctccaatgtggacgtgctccaacagacccccccttgttctgcggaagtgccctctgaccctgataaggccgcatttcacgaaagggacagtgatattcttaaatag

SEQ ID NO: 51043 - DNA, 1869 bp, Artificial Sequence
  Description of Artificial Sequence: Synthetic coding sequence
atgtgcggtttgcagtttagtttgccatgtctacggctgtttttggtggtcacatgctatctcttactgctgctacacaaggaaatacttgggtgctcctccgtgtgtcagctgtgtaccggacggcagatcaactgccggaaccttggactctcctctattcctaagaattttcccgaatccacggtgtttctgtacctgaccggcaacaatatttcatacatcaatgaatcagaactcacaggcctccatagtctggtggcattgtacttagataactctaacatcctatatgtataccctaaggcttttgtgcagctacggcatctctattttctctttctgaataacaattttataaagcggctggaccctggaatatttaaaggtctactgaatctccgtaacctgtacctgcagtataatcaggtgtcttttgtgcctcggggtgtgtttaacgatctggtgtccgtgcaatacctgaatcttcagagaaatcggctcacagttctcgggagcggtacattcgtgggaatggtcgctctgaggatactggatctctctaataataatatcctcagaattagcgagtccggcttccaacacctcgagaacctcgcttgtttgtatctaggatcaaataacctcactaaggtgccttctaatgccttcgaggtcctgaagagcctgcggaggctgtccctaagccataaccccatcgaagccattcagccatttgcgtttaaaggcctagccaatcttgaatatttacttctgaaaaattcccgcataagaaacgtcaccagagacggttttagcgggattaacaacttgaagcacttgatcttgtcccataacgacctcgaaaacctgaattcggataccttcagcttgctgaagaaccttatctatttgaagttggatcgcaatcgcattataagcattgataacgacacattcgagaacatgggagcctctttgaaaattctgaatctgtcattcaacaacctgacagcactgcatccaagagtgctgaaaccactgtcatctctaatccaccttcaggcaaattcgaatccgtgggaatgtaattgcaagctcttggggctccgcgactggctcgcctcaagtgcaatcacactgaacatatactgccaaaaccctccatctatgcgaggcagggctttgagatatatcaatattaccaattgtgtaacctctagtatcaacgtgagcagggcgtgggcagtagtaaaatcacctcatatacaccataagaccacagctctcatgatggcatggcacaaggtcacaaccaacggctccccactggagaatacagagacagaaaatattacattttgggagcggattcccactagcccagctggacggttcttccaagaaaatgcattcggcaatcctctagaaaccactgccgttctccctgtgcaaatccagcttacaacctcggtcactttgaacttggagaaaaactcagctcttccaaacgatgccgcttctatgtcaggtaagacaagcctaatctgcacgcaggaagtcgaaaagctgaatgaggcctttgacattctgctggcctttttcatcctagcatgcgtactcattatctttctcatctacaaagttgttcaatttaagcaaaaactgaaggccagtgagaactcccgcgagaatcgtctcgaatattactctttttaccagagcgcacgctataacgtgaccgcctcaatctgtaatactagcccaaattcgctggaatcccccggactggaacagattcgcctgcataaacagatagtccccgaaaatgaagcccaggtgattcttttcgaacactcggctctctag

SEQ ID NO: 51044 - DNA, 2151 bp, Artificial Sequence
  Description of Artificial Sequence: Synthetic coding sequence
atggcccgtatgagttttgtgatagctgcatgccaactagtgctgggcctgttgatgacgtcactcacagagagctccattcaaaatagcgaatgtcctcaactgtgtgtttgtgagatccgcccttggttcaccccccaaagcacctacagggaagcgacaacggttgattgtaacgacttaaggctgacaaggatcccttctaatctgagcagcgatacgcaagtgctgctgctgcagagtaacaatattgccaagactgttgatgagctgcagcagctctttaacctcaccgagctcgatttttcccaaaacaactttacgaacattaaagaagtgggcttggccaacctgacccagcttactaccctgcatctggaagagaatcagatcactgaaatgaccgactactgcctgcaggatctcagcaacctgcaggagctgtatattaaccataatcagatttccacgatttcagcccatgcatttgcgggacttaagaaccttttgcggctgcaccttaactcaaacaagctgaaggttattgacagccgttggttcgacagcacccctaatctggaaatcctgatgatcggcgaaaaccccgtcattggcattttggacatgaacttcaagccattagccaaccttagaagcctagttctggcaggcatgtacctaacagatatccctggaaatgccctcgtgggcctcgactccctggagtctttgtccttctatgataataaactggtaaaggtgccacagctggccctacagaaggtgcccaatctgaagttccttgacttaaacaagaaccccatccacaagatacaggagggagactttaaaaatatgctgcgcttaaaagaactgggaatcaacaacatgggggaactcgtgtccgttgatcgctatgccttggacaatctgcccgagttgaccaagctcgaggcgacaaataaccccaagctttcctacatccaccggctggcttttaggagcgtccctgccctggaatctctcatgctcaataataacgccttaaacgccatctaccagaagaccgtcgagagcctgcctaacttgagagaaatcagcatacactctaatcccctgagatgcgactgcgtcattcattggatcaactccaacaaaaccaatattcggttcatggagcctttgagcatgttctgtgccatgccacctgagtacaagggccatcaggtcaaggaggtgctgatccaggactcgtcggaacagtgtttgcccatgatcagtcatgattcattccccaaccgcttgaacgtcgacatcggcacaacagtgttcctggattgccgggcaatggcggaaccagagcccgagatttactgggtgacacctatcggtaataagattactgttgaaacgctgagtgacaaatataaattgagttctgaggggacactggagatctccaatatccaaattgaggatagcgggcgatacacctgcgtcgcacagaatgtgcaaggcgctgacacccgggtggcaaccattaaagtcaacggcactctcctcgatggaacccaggtcttaaaaatctatgttaaacagacagagagtcattcgatcctcgtctcctggaaggtcaactctaatgtgatgaccagcaaccttaaatggtcatccgccaccatgaagatcgacaatccgcacattacctacacggcccgagtccccgttgatgtccatgagtacaacctgacacacctccagccttccactgactatgaggtatgcctgaccgtgagtaatattcatcagcagacgcagaaatcttgcgttaacgtgacaacaaagaacgccgcatttgctgtggacatctccgatcaggagacctctaccgcccttgccgcagtgatgggaagtatgttcgccgtcattagtcttgcatcgatcgctgtgtactttgccaagcggttcaagaggaaaaactatcaccactcactcaaaaagtacatgcagaaaacttcctctataccgctcaatgagctctatccccctctgattaacctgtgggagggcgattccgagaaggataaagacggctcagccgatacaaaaccgactcaggtagacacttccaggagctattacatgtggtag

SEQ ID NO: 51045 - DNA, 2142 bp, Artificial Sequence
  Description of Artificial Sequence: Synthetic coding sequence
atgaggttacttgtggcgccacttctccttgcctgggtggctggggctacagcagctgtgcccgttgtaccgtggcacgtaccctgcccgccacaatgcgcttgccagatacggccttggtatactccacggagcagctaccgagaggcaaccacagtggattgtaacgacctgtttctgaccgccgtaccaccagctttgccagccggaacacagacgttgcttctgcagagcaactcaatcgtcagggtggatcagtccgaactcggatacctggccaacttaactgagctggacttgagtcagaatagcttcagcgacgccagggattgtgatttccacgctctgcctcagctgttgagcttgcacttggaggagaaccagctgacacggctcgaggatcactctttcgctggactggcttctctgcaagaactgtacctcaaccacaatcagctatatcgtatagcacccagggcattttctggactgtctaatctgcttcgtcttcaccttaatagcaacctcctgcgcgctattgatagtcgatggtttgagatgctacccaatcttgagatactcatgattggcggaaacaaagtagatgcaattctggatatgaacttccgtcccttagccaacctgcggtcgcttgtgctagccggaatgaacctcagggagatttccgattacgctctcgaagggcttcaatcgctggagtcgttatcattctacgataaccagcttgcacgggtccccagacgcgcactcgagcaagttccagggctgaagttcttagatctgaataagaaccccctacaaagggtgggccctggagactttgccaacatgctccatctaaaagaactaggcctaaacaatatggaagagctggtcagcatcgataagttcgcactggtcaacctgcccgaactcactaagctggatatcaccaataatcccagacttagtttcatccaccctcgcgcattccaccaccttccccagatggaaacactcatgctcaacaataacgctctgtccgcgttgcaccaacagaccgtcgaaagcttacctaatctgcaggaggtgggcctgcatggaaatcccatccgatgcgactgtgtgatcagatgggccaacgccactggaactagagtccgattcatcgagccgcaatctacgctgtgtgctgagcctcctgatctgcagcggctgccagtgcgtgaggtcccatttagagaaatgacagaccattgcctgcctctcatttcaccacgatcctttccgcctagcttacaggtggccagtggggagagtatggtcctacactgtagggctctcgccgagccagaacctgaaatatattgggtgaccccagctgggctccggctgaccccagcccatgcagggcgtaggtatcgggtgtatcctgagggcactctggaactgaggagggtcacagcggaggaggccggattgtatacttgcgtcgctcagaatctggtgggtgctgatacgaaaaccgttagtgttgtggttggtagggcccttctacaacccggaagagatgaaggccaaggactcgaactgagagtgcaggagacacacccgtatcatatactgttgagctgggtgacaccgccaaacactgtgagtactaacttgacgtggtcctccgccagctctttacggggtcagggagcgactgcactggctcgactcccccgtggcacacacagctacaacataacccggcttctgcaggcgacagagtattgggcttgtctgcaggtagctttcgcagacgcccacacccagctggcctgcgtatgggcccgaacaaaagaggccacatcatgccaccgtgctctcggcgataggccaggccttatcgctatcttggctctcgctgtcttgctgttggcggctggcctggccgctcatctgggaaccgggcagcctaggaaaggtgtggggggtcggagacccttgcctcctgcttgggcattctggggctggtccgccccatcagttagagtcgttagtgctcccctggtcctgccatggaatccgggtcggaaactgcctcgctcaagcgagggagagacgctgctgcccccactgtcacagaatagctag

SEQ ID NO: 51046 - DNA, 2142 bp, Artificial Sequence
  Description of Artificial Sequence: Synthetic coding sequence
atgcgccttttggtcgcaccccttttactggcatgggtcgcaggggcaactgccgcagttccggtggtgccctggcacgtgccttgcccacctcagtgcgcttgtcagatcagaccttggtatactcctcgcagcagttaccgcgaagccaccacggtggattgcaatgacctcttcctaacagcggtgccacccgcactgcctgcagggacacagactctgctgctgcaaagcaacagtatagtgcgcgtggatcagtccgaactggggtatttagcaaatttgaccgagttagatctctcacaaaactccttcagtgacgcacgggactgtgatttccacgccctcccccagttgcttagcttacatctggaggagaatcaacttacccgtctcgaagaccacagtttcgccggactggccagcttacaagagctgtatctcaaccacaaccagctgtacagaattgcacctcgagctttctccggcctctcaaatcttctccgtctgcatctaaatagcaaccttcttcgggctatcgactcccgctggtttgaaatgcttcctaacctcgagatcttaatgatcgggggaaacaaagtggatgcaatcctggatatgaattttcgccctctggccaatcttagatccctcgtcctggcaggaatgaacctgcgggaaatttccgattacgcattggaagggttgcagtctctcgagtctctgagtttttacgacaaccagctagccagggtacccagaagggcactagagcaggtcccgggactgaaattcctggatttaaacaagaaccccctccagagggttgggcctggcgactttgcaaatatgctgcacctaaaagagcttggcctgaacaatatggaggagttagtgtccatagacaaattcgctctggtcaatcttccagaactgacgaaactggatattaccaacaaccctcgcctgagctttatccatccaagagcttttcaccacctccctcagatggagacactgatgttaaacaacaatgccctttccgctctgcatcagcaaactgtggagtcgctgccaaaccttcaagaagtgggcctacatgggaatcccattcgatgtgactgcgtgatcaggtgggctaacgccactggaactcgtgtgcgcttcattgagccccaaagtactctctgtgcggagccccctgacctccagcggctgcctgtccgcgaggtgccctttcgcgagatgactgatcattgtttgccgttgatctcccccaggtcctttccgccttctcttcaggttgcttcaggcgagtctatggtgcttcattgtcgggcactggcagagcccgaacctgagatctactgggtaacaccggcaggcttacggttgactcccgctcacgcaggacgcaggtaccgcgtgtacccggaaggcacactcgagctaaggcgcgtcacagcggaagaagcaggattatatacctgcgtagcacagaatctggtcggagcggacacgaagaccgtgagcgtagtggtaggccgagcccttcttcagcctggaagggacgagggccaggggttggaactgcgcgtacaggaaactcacccgtaccacattctcttatcttgggtgacgcctcctaacaccgtttcgactaacctgacttggtcatcagcatccagcctgcgcggacaaggggctacggccctcgcgagactgccacgtggaacccacagttataatataactagattgcttcaagccactgagtactgggcatgtctgcaggttgccttcgccgatgcacacactcaactggcctgtgtctgggcacgcactaaggaagccacctcttgtcatagagccctgggggatcgcccaggtttgatcgctatacttgctcttgcagttcttctcctggccgcagggctggcggctcatctgggtaccggtcagccacgcaagggcgtgggaggacggaggcccctgcctccagcctgggcgttttggggatggagcgcccctagcgttcgggtcgtcagcgcaccactagttctgccctggaatccaggacgtaagttgcctcgttcatctgaaggggagacccttttaccacccctgtcccaaaactcctag

SEQ ID NO: 51047 - DNA, 2142 bp, Artificial Sequence
  Description of Artificial Sequence: Synthetic coding sequence
atgcgcctgctcgtagctccactgctgcttgcctgggttgcaggtgccacagctgccgtgcccgtggtgccctggcacgtgccctgtccaccgcagtgcgcatgccagatccggccatggtacaccccgcgatcttcttatcgcgaagctacaactgtcgactgcaatgacctattcctcaccgctgtgccgcctgccctgcccgcagggactcagaccctgctcctccagagcaacagtatcgttcgagtcgaccagagcgagcttgggtacctcgccaatcttaccgagttagacctctcgcaaaactcttttagcgacgctcgggattgtgatttccacgcactgccccaactgctcagcctgcatctagaggaaaaccagctgacaaggcttgaggatcactcattcgcgggactggcctctcttcaggaactctacctaaatcataaccagctctataggattgcccctagggcatttagcggactttcaaatctcctgaggctccatttgaactcaaacctgctgcgtgccatagacagtaggtggttcgagatgctgccaaatctcgagatcctcatgattggcggaaataaggtcgacgcaattttagacatgaacttccggcctctagcgaacctcaggtcattggtgctcgcagggatgaacctgcgagaaatctcggattatgccctagaaggcctccagtcactggaaagcttatcattttacgacaaccagctcgccagagtgccacgaagggctctggaacaggtgccaggcctgaagttcctcgacctgaataaaaacccgctccaacgtgtcggaccaggtgacttcgccaacatgctacacctcaaggaactcggcctaaataacatggaggaactggtaagcatcgacaagttcgcgctggtaaacctccccgaattgaccaagctggatatcactaacaatcccaggctctccttcatacacccccgagctttccatcatctccctcagatggaaactctcatgctgaacaacaacgcactaagcgctttgcatcagcaaactgtggaaagtctgccaaacctgcaggaggtgggcttacatggtaaccccatcagatgtgactgtgttatcagatgggcaaatgccactgggactagagtgcggtttatagagccgcagtctacgttatgtgccgagcccccagatctgcagcgcctgcccgtaagggaggtaccttttagagaaatgacagatcattgtctaccgctgatttcaccaagatccttcccaccctcattgcaggtggctagtggggagtccatggtgctccactgtcgggcattagcggagcccgaaccggagatttactgggtgactcctgcagggttacggctgacccctgcccatgccggacgcaggtatagagtgtaccctgagggcacgctggagctcaggcgcgtaaccgccgaagaagccggtttgtacacctgtgtggcacaaaacctggttggagccgacaccaagacagtatcggtggttgtgggcagagcacttctacagcctggtcgggacgaggggcagggcctggagttgagagtgcaggagacccacccatatcatatactgttgagctgggtgacgccacctaatacagtcagtaccaacctgacttggtcctcggccagctccttgagagggcaaggcgcaaccgctctggccagattgccaaggggaacccacagttataatatcactcggttgttacaggctacggagtactgggcatgtttgcaggtggccttcgccgatgcgcatacccaattggcgtgtgtctgggcaagaaccaaagaggccacttcttgtcatagagcactcggagacagacccggactcatcgccatcttggctttggcagtgctgctactggctgcagggctggccgctcacctggggaccgggcagcccaggaagggagtcggtggaagaagaccactgccgccagcctgggccttctgggggtggtcggccccaagcgtgcgcgtagtgagtgctccactggtgcttccttggaatcctggtaggaaactgcctagaagcagcgaaggggagacccttctcccccctttaagccaaaattcttag

SEQ ID NO: 51048 - DNA, 2127 bp, Artificial Sequence
  Description of Artificial Sequence: Synthetic coding sequence
atgaaggatatgcccctccggatccatgtgttactcggacttgcgatcaccacactggtccaagctgtggacaagaaggtggactgccccaggctgtgtacttgtgaaatccggccttggtttactccccgtagtatttatatggaagcctcaactgtcgattgtaacgacctgggactgctgacatttccagcaagacttcccgcaaacactcagattttgctcctgcaaactaacaacattgccaaaatagagtacagtacagatttccccgttaatctcacgggactcgacttgtcacaaaataatttaagcagcgttaccaacatcaacgtgaagaaaatgcctcagctgctgtctgtctatttggaggagaacaagctcaccgaactccccgagaaatgcttaagcgagctgagcaacctacaggaattgtatatcaaccacaatctgctgtcaacaataagccctggtgcgttcattggactgcataacctactgaggctgcacctcaatagtaacaggctccagatgatcaactctaaatggtttgatgccttacccaatctggagatcctcatgattggcgaaaacccaattatcagaatcaaggacatgaacttcaaaccactcatcaatcttagatccctcgtgattgccggaatcaaccttacagagatccctgataatgctctcgtgggcctggaaaatcttgaatccatctccttttacgacaaccgcctaattaaagtgccgcacgtggctttacagaaagtcgtgaacctgaagtttctggatctgaacaaaaaccccatcaatcgaatcaggcgcggagatttctcgaacatgctgcacttgaaggagttgggaattaacaacatgccagagctgatttccattgattcacttgccgtggataacctgcccgacctacggaagatcgaggccaccaataatcctcggctgtcatatatccaccctaacgctttctttcgccttccgaaactggaatcactgatgctgaacagtaatgccttgagtgccttgtaccacggaactatcgaatccctgccaaatctcaaggaaatcagtattcattctaaccctatacgatgcgactgcgtgattaggtggatgaacatgaataaaactaacattcgattcatggaacctgacagcctgttctgtgtggatcctcctgagtttcaaggccagaacgtgcgacaggtccactttcgcgatatgatggagatttgtctgcctctcattgccccagaaagctttccatctaacctgaatgtggaagccggaagctatgtgtcatttcactgccgcgcaaccgctgaaccacagcccgaaatctattggatcactcctagtggccaaaagctgctgccaaataccctgaccgacaagttctacgtccacagtgaggggaccctggacatcaacggtgtcaccccaaaggaaggtgggctgtatacttgtatcgcaacaaatctagtgggcgcagacctcaagagcgttatgattaaggttgacggctccttcccccaggacaacaacgggtcactgaacatcaaaatacgcgacatccaggccaattccgttctcgtttcttggaaggcctcctccaagatcctgaaatcctccgtgaagtggactgctttcgtgaagacagaaaattctcatgccgctcagagcgctcgtatcccatccgatgtgaaggtctacaatctgactcacctcaatccttccactgaatataagatatgcatcgatattccgacaatctaccagaaaaatcgtaagaagtgcgtaaacgtgacaacaaagggtcttcacccagaccaaaaggagtacgaaaagaataacacaactacccttatggcttgtctggggggtctactgggcatcatcggtgtgatctgcctcatttcctgtctatctccagaaatgaattgtgacggcggacatagttatgtacgcaactacctccaaaagcccacatttgcgctgggagaactctatccgccattgatcaacctctgggaggcaggcaaagagaaaagcacttccctcaaggtaaaagccacagtgattggattgccaacgaacatgtcatag

SEQ ID NO: 51049 - DNA, 2127 bp, Artificial Sequence
  Description of Artificial Sequence: Synthetic coding sequence
atgaaagacatgcctctccggattcacgtgctgctggggcttgcgattacaacactggtccaggcagtcgataaaaaggtcgactgtcctaggctgtgtacatgtgagatccgcccatggtttaccccacggagcatttatatggaggccagcactgtggactgtaatgatctcggtcttctgacgtttcctgcgaggttacccgcaaatactcagatcctattgctgcagacgaacaatatcgcgaaaatagaatattctaccgacttcccggtgaatctgacagggctagatctgtcccagaacaatctgagtagtgtgaccaatatcaacgttaagaaaatgccacaactgctgagtgtgtacctagaggaaaataaactgacagaattgcccgagaagtgcctttccgagctgagtaatctgcaggagctgtatatcaaccacaatctcctgtcaacaatcagtcctggggcattcattggtctccataatctcctgcgtctgcatttgaactcaaacaggttgcagatgattaactcaaagtggttcgatgccctgcctaatctcgagatcttgatgatcggcgagaacccaatcattagaattaaggatatgaacttcaagcctcttatcaacttgcgcagccttgtgatcgccggtatcaacttgaccgagatccctgataacgccctcgtggggctcgagaacctggagtcgatttcattttacgacaatcgactgatcaaggtcccccacgtagcccttcagaaggtggtcaacctaaaattcctggatctaaataagaatcccatcaaccgcatcaggcggggagatttcagtaacatgttacatttgaaagaattggggattaataatatgcctgaattaatctccatcgattccctcgctgtcgacaacctgcccgacttacgcaagatcgaggcaaccaacaacccgagactgagttacattcaccctaatgctttcttccgacttcccaaattagagagtttgatgctcaactctaatgccctctctgcattgtaccatggaactattgaatctctccccaacctgaaggagatatcaatccacagcaacccgatccgttgtgactgtgtcatcaggtggatgaatatgaataaaaccaatatcaggtttatggagcctgattccttgttctgtgtggaccctcctgaattccagggccagaacgttcggcaggtgcacttcagagatatgatggaaatttgtctgccgctaatagcgcctgagagctttccttcaaatttaaacgttgaggcgggttcttacgtgtctttccactgtcgggctacagcagagccgcagccggaaatctactggatcacccccagtggccagaagctcctgccaaacacgctcactgacaagttttacgtccacagcgagggtacactggacattaacggggtgacaccgaaggaagggggactctatacgtgcattgcaacaaacctggtcggggctgatcttaagagtgtcatgatcaaggtggatggcagcttcccacaagataacaacggaagcctcaatatcaagattcgggacatacaggctaattcggtcttagtgtcctggaaagcctcttcaaaaattctgaaatcatccgtcaaatggacagcctttgttaagaccgagaattcgcacgcagctcagagcgcgaggattccatccgacgtgaaagtttataacttgacccatctgaaccccagtaccgagtacaagatctgcatagatatccccaccatctatcaaaaaaaccggaagaagtgtgtcaatgttactactaaggggctccaccccgaccagaaggaatatgagaaaaacaatacaaccacattaatggcatgcttaggaggtttgcttggcatcattggtgtaatttgcctgatttcctgccttagccccgaaatgaattgtgatggcggtcattcatatgtgcgaaactatttgcaaaagcctaccttcgccctgggggaattataccctcccctgatcaatctgtgggaagctggcaaggagaagagcacgagtcttaaggtgaaggctacagtcatcggactgcccaccaacatgagttag

SEQ ID NO: 51050 - DNA, 2127 bp, Artificial Sequence
  Description of Artificial Sequence: Synthetic coding sequence
atgaaagatatgcctttacggatccacgtgctgctgggactggccattaccacgctcgtccaggcggtggacaaaaaagtagactgtcctaggctgtgtacctgcgaaattcgaccttggtttactcctcgctctatctacatggaagcttccaccgtggactgcaatgatcttgggctactgacgttcccggctcgcttgcccgctaatacccagattctgctgttacaaactaataacattgctaagatagaatactcaaccgactttcccgtcaatctcaccggactcgatctaagccagaataacctttcaagtgtgaccaatatcaacgttaaaaagatgccccaattattaagtgtctatttagaagaaaataagttaaccgaattgccagagaagtgcctgtcagagctgtctaacctccaggagctgtacatcaatcataatctgttgagcactataagccctggcgcattcattgggctgcacaacctcctcagattgcaccttaatagcaataggctgcaaatgataaacagcaaatggttcgacgccctgcccaaccttgagatcctgatgatcggtgagaatcctattatacgcatcaaggatatgaacttcaagcctcttatcaacctccggagcctggttatcgctggaatcaaccttactgaaatcccagacaacgcactcgtgggtctcgagaacctggagagtatatctttttatgacaaccggctgatcaaggtgccccacgtggcactgcagaaggtggttaacctgaagttcctggacttaaataaaaatccaatcaaccgtatccgtcggggtgacttctcaaacatgctgcatttgaaggagctgggaatcaacaatatgccagagctcatttcaatagactcgctcgccgtggataacctccccgacctccgcaaaattgaagccacgaataacccccgactgtcatatatacatcctaatgcattttttaggctgcctaaactggagtcgctgatgctgaacagcaacgccctgtctgccctgtaccacgggaccatcgagtctcttcccaatctgaaggaaataagcatccacagcaatccaatccgatgtgattgcgttattaggtggatgaatatgaataaaactaacatcaggttcatggagcccgactccctgttctgcgtggaccccccagagtttcagggccagaacgtgcgacaggtacactttagggacatgatggagatttgtctgcccctcatcgctcctgaaagctttcctagtaatttaaatgtcgaggctggctcctacgtgtcattccattgccgcgctaccgcggagccccagcctgagatttactggattaccccttcggggcagaagctgctgcctaacacccttacagacaaattttatgtgcattccgaggggactctcgacattaacggggtcacacctaaggaagggggattgtacacctgcattgcgactaatttggttggcgctgatttgaagtcagtcatgattaaggtggatggttcatttccccaggacaataacggatcactgaacatcaaaataagggatatccaagccaacagcgtgctggtctcctggaaggctagctctaaaatcctgaagagctcagtcaagtggacagctttcgtgaagaccgagaattcccatgcagcccagtccgcccgaatcccaagcgacgtgaaagtgtacaacctgacccaccttaatcccagtacggagtacaagatatgcattgacatccccacgatttatcagaagaataggaagaagtgcgtgaacgtgactacaaaaggccttcatcctgatcagaaggagtatgaaaagaataacaccaccaccctgatggcatgtttagggggtctgttgggaatcatcggagtaatttgtctgatctcctgcctcagtcccgaaatgaactgcgacgggggacactcttatgtgagaaattatcttcaaaagccaacatttgctttgggggagttgtatcctccactaattaatctctgggaagctggaaaggagaagtcaacctccctaaaagttaaggcaaccgtgataggactccccacaaacatgagctag

SEQ ID NO: 51051 - DNA, 2223 bp, Artificial Sequence
  Description of Artificial Sequence: Synthetic coding sequence
atgcgacagacattacctttgctgctgctcacggtgctccgcccatcctgggccgacccaccacaagaaaaggtacccctgtttcgagttacacagcaagggccatggggatcatccggatcaaacgcaacagattccccctgcgagggcctgcccgctgctgatgccactgcactaacattggcgaaccgtaatctggagcgactgcctggctgcctcccccgaaccctgcgtagcttggacgcctcccacaatctgcttcgtgctttgtcaacatctgagctcggtcatcttgaacagcttcaggtcctcaccttaaggcacaacagaatcgcagcactgagatgggggcctggcggaccagctggcttgcatacattggatctgagttacaaccaactcgctgccttgcccccatgcacagggccagctctctcatctttgcgagccttggcgctggcaggaaatccactccgggctctccagccccgagctttcgcctgtttcccagccctccaactgctgaacttaagctgcacagctctcggaaggggagctcaaggagggatagccgaagccgcatttgcaggcgaggacggcgcaccactggttacactggaggtgctggatctgagcggcacattcttggaacgagtcgaatcaggttggattagagacctacccaagttgaccagcctatatctgcggaagatgccgaggctgactacactggagggcgacatttttaaaatgacacctaacctccagcagctggattgtcaagacagtcctgctctggcatctgtggcaactcatattttccaggatactccacacttgcaggtgcttctgtttcaaaattgtaacctctcatccttccctccttggacactagactcctcccaggtcctctctatcaacttgtttggcaacccgttgacctgcagttgtgatctgtcctggttgctaaccgatgccaaacggacagtcttgtcacgcgcagcggacactatgtgcgcgccagctgccggaagtagcggcccattctctgcttctctatctctatcccagctaccaggggtctgtcagagcgaccagagtacgactttgggtgctagtcaccctccttgtttcaacagatctacatacgcccagggaacaactgtggcaccttctgccgctcccgctactcggccagcgggagatcaacagtcagtctccaaagcaccaaacgtgggttctagaactatagcagcgtggccacacagcgacgccagggagggaacagcaccatcgacgactaactctgtcgcgggacactccaatagtagcgtttttcccagagcagcatctaccacccggacccaacacaggggggagcatgcccctgaactggtattggagccagatatctctgccgcttcaacccctttggcatccaaactgctgggaccctttccaacaagctgggataggtcaatcagctccccccagcctggccagcgcacccatgccacacctcaagcgccaaatccttcactgtccgaaggagaaatacccgtgctgctgctggatgactacagcgaggaggaggaaggtaggaaggaggaagtagggacaccacatcaggacgtgccttgcgactatcacccctgtaagcatttgcagacaccatgcgcagagctgcaacggcgttggcgctgtaggtgccccggattgtcaggggaggacacaattccggaccctccccgattgcaaggggttacggagactacggatacgtcagcactggtccactggtgtgctccaaatagcgtagtgcatgggtatcagattcgatacagtgcagaggggtgggctgggaatcagtccgtcgttggagtcatctatgccaccgcccgacagcatcccctatacggcctgagccccggtactacctatcgagtgtgtgtcctcgctgccaatagagctgggctaagccagccccgttcttccgggtggcgcagcccctgcgctgcatttacaaccaaaccatcattcgcactcctgttatcaggcttatgtgcagcatctgggctgctcttggcaagtaccgtggttcttagcgcctgtctctgtcggcgaggtcagacactcgggttgcagcgatgcgatacccacttggtcgcttataagaaccccgcattcgatgactatccgctgggattgcagacagtctcgtag

SEQ ID NO: 51052 - DNA, 1191 bp, Artificial Sequence
  Description of Artificial Sequence: Synthetic coding sequence
atgaaaaattacgagtccaagaagtatagcgacccaagccaacctggcaacactgtgctgcaccccggtacccggcttattcaaaagctgcataccagcacatgttggctgcaggaggtcccgggtaaaccacagctggagcaggctacaaaacaccctcaggtaaccagcccccaggctaccaaagagactggaatggagatcaaggaaggcaagcagagttaccgccagaaaataatggatgagctgaagtattactacaacggattttacttattatggatagacgccaaagtggctgcgagaatggtgtggcgtctgctgcatggacaagtactcaccaggcgcgagagacggagggaagagaagcaaaaaaaaaaaatggccgtaaagctggagctggcgaagttcctgcaggagacgatgacggagatggcaaggagaaatcgggcaaaaatgggagacgccagcactcagctcagtagctatgtaaagcaagtgcagaccggacataaacctagcactaaagaaatagtgcggtttagcaaactatttgaggatcagctggcccttgagcatctcgaccggcctcaactggtagccctttgtaaactgctggagttacagacctttgggaccaacaacttgctgcggtttcagttgctgatgaagctaaagtccatcaaggcagacgacgagattatcgcgaaggaaggagtcactgcgctaagtgtgtctgaacttcaggctgcttgcagagccagagggatgcgctccttgggactcaccgaagagcagctcagacagcagctcaccgagtggcaggacctgcatctgaaggaaaatgttcctccctctcttctgttactgtcccgcacattttaccttatagatgtgaaaccaaagccaattgaaattccccttagcggtgaagcacccaagactgacattctggtggaactgcctactttcactgagagtaaggagaatatggtcgacttggcccctcagctaaaaggtacaaaggacgaggactttattcagccacctccagtcacctctagccccatcacaccaagcacccccatctccctgccaaaaggaccaataacttcctcagaagagcccaccctgcaggccaaaagtcagatgactgctcaaaacagtaaagcctcatctaagggggcatag

SEQ ID NO: 51053 - DNA, 1476 bp, Artificial Sequence
  Description of Artificial Sequence: Synthetic coding sequence
atggctttttattcctataatagtgtcctggcgatcgcccgaaccaggttcccaagccactttgtgcatcctacttgttcctcatactctcccagctgtgcatttcttcaccttcctgatagccacctgaacaagacctgcatgaaaaattacgagagcaagaagtactctgatccttcccagcccggtaatacagtcctgcacccaggaacacgcctgattcagaaactccacacaagtacatgttggctgcaggaggtgccaggtaagcctcaactggaacaggccacaaagcacccccaggtaacatcaccccaggcgaccaaggagactgggatggagatcaaggaaggtaagcaaagctacaggcagaaaatcatggacgagttaaagtactactacaatgggttctacttgctgtggatcgacgccaaagtggccgctcgtatggtctggcggctgctccatggccaggtactgacaagacgtgagaggaggagactgttacggacctgcgtcgatttcttccggctggtgccatttatggtgtttctcatcgtgccttttatggagttcctgctccctgtctttttgaagcttttcccggagatgctcccttctaccttcgagtcggagtccaagaaggaggagaagcaaaaaaagaaaatggccgttaaactggagcttgccaaattcctgcaggaaacgatgactgaaatggcaagacgcaaccgagcaaagatgggggacgctagcacacaactttccagttacgtcaagcaggtgcaaaccggccacaagccctccacaaaggagatcgttagattcagtaagttgttcgaggaccagcttgccctggagcatttagataggccgcagctggttgccctgtgcaagctcctggagctccagacatttggcaccaataatctcctgcgctttcagctgctaatgaaactaaagagtatcaaggcagatgacgagattatagcgaaggaaggcgtgacggccctttcagtgagcgagcttcaggccgcttgtagagcgagagggatgaggagtctggggctcactgaggagcagttaaggcagcaacttacggaatggcaggacctccatctgaaagaaaacgtgcccccttcacttttgctgttgagtcgcacattctacctcattgacgtaaagcctaagccaattgagatacccttgtctggcgaggccccaaaaacggacattcttgtggagctaccaacattcactgaaagcaaagaaaatatggtggacttagcaccccaactgaagggcaccaaggatgaagacttcatccagccacccccagtgacatcttccccaattactcccagcacgccaattagcctgccgaagggaccgattacctcaagcgaagagccaactctgcaggccaaaagtcagatgactgctcagaattctaaggcgagttcgaagggggcatag

SEQ ID NO: 51054 - DNA, 1332 bp, Artificial Sequence
  Description of Artificial Sequence: Synthetic coding sequence
atggccttctacagctataatagcgtgttggccatcgctcggacgaggttccccagccatttcgtgcaccccacctgttccagctacagcccgtcatgtgcctttttacacttacctgactcccatctgaataaaacttgtatgaaaaactacgaatccaagaagtattccgacccttcccagcctggtaacaccgtgctgcatcccggtacccgcctcatacaaaaactgcatacctcaacctgctggttgcaggaggtgcctgggaaaccccagctggagcaggccacaaagcaccctcaggtcacatcgccccaagccacaaaggagaccgggatggagatcaaggaaggaaagcaatcgtacagacagaagattatggatgagcttaaatactactacaatggattttatctgctgtggatagatgcgaaggtggccgctaggatggtatggcgactactgcacggccaagttctgacaaggagggagaggcggagggaagagaaacagaaaaagaaaatggcagtcaaattggaattagctaaatttttgcaagagaccatgaccgagatggctagacggaacagagccaagatgggcgacgcctccactcagttgagctcctatgtcaaacaggtgcagaccggacacaagcccagcactaaagagatcgtgagattcagcaaattattcgaagaccagctggccctcgagcaccttgatcgcccacagttggtggccctgtgcaaactgctggagctacagaccttcggaacaaacaatttgcttagatttcagctcttgatgaaacttaagagcatcaaggccgatgatgagattattgctaaggagggagtgacggcactgtcagtcagcgagttgcaggctgcctgccgggctagaggcatgagatccctgggcctcaccgaggagcagttacggcagcaactcactgagtggcaggacctgcacctgaaggagaacgtgcccccttccctgctgcttctgagtcgcactttctacttaatcgatgtgaagccaaagccgattgagattcctctatcgggcgaagcccctaaaacagacattttggttgaacttcctacctttaccgagtccaaagagaatatggtggacctagcgccacagctgaaggggacaaaagacgaagatttcatccagccccctcccgttacctcatctcccattacacccagcactcctatcagtctacctaaggggcctatcactagttcagaggagcctactctgcaggccaaatcgcagatgactgcccagaattccaaggctagcagtaagggcgcttag

SEQ ID NO: 51055 - DNA, 429 bp, Artificial Sequence
  Description of Artificial Sequence: Synthetic coding sequence
atggccttctatagctacaactctgttctggctatcgccagaacacggtttccatcacactttgttcaccccacctgctctagctattccccttcatgcgcctttctgcaccttcctgattctcatctaaacaagacctgtatgaaaaattatgagagcaagaaatacagcgaccccagccagccgggaaataccgtgctgcaccccggtaccagattgatccagaagttgcacacgtctacttgctggcttcaggaagtacccggtaagccccagctggaacaggctacaaagcatcctcaggtaaccagccctcaggccaccaaggagacagggatggaaattaaagaagggaaacagagctaccggcagaaaattatggacgaactgaagtactactataatgggttctatctgctctggatttag

SEQ ID NO: 51056 - DNA, 351 bp, Artificial Sequence
  Description of Artificial Sequence: Synthetic coding sequence
atggcattttacagttacaactccgtactggccatagcacgaacccgcttcccctcccattttgttcatcccacgtgctcgtcatattcgccatcctgcgcttttttacacctgcccgactcacacctgaataagacgtgcatgaaaaactacgagtctaagaagtactctgatccatctcagcctgggaatacagttctgcaccccggaacaagactgatccaaaaattgcacacaagtacctgttggctgcaggaggttccagggaagccacagctcgaacaggccacaaagcacccccaggtaacctcccctcaagcaactaaggagaccggaatggaaattaagtag

SEQ ID NO: 51057 - DNA, 834 bp, Artificial Sequence
  Description of Artificial Sequence: Synthetic coding sequence
atggaggagaagcagaagaagaagatggctgtgaaacttgagctggctaagttcctccaggaaaccatgacagaaatggcacggagaaatcgggctaagatgggagatgcctcgacacagctcagcagctacgtaaagcaagtgcagacagggcacaagccgtcaactaaagagatagtccgattttccaaactgtttgaggatcaacttgccctggagcacctcgatcggcctcagctggtagctctctgtaagctcctcgagctgcagacctttggaacaaacaacttactgaggtttcagctgcttatgaaacttaaaagcataaaggcggacgacgaaattattgctaaggaaggcgttaccgccttgagtgtgtctgaactgcaagctgcatgccgagcgcgagggatgagatctctggggttaacggaagagcagctgagacaacagctgacagagtggcaagacctccatctcaaggaaaatgtgcctccatcgctgttgcttctgagccggaccttctatctgattgatgtgaagcccaaacccatagagatccccctgtctggcgaagctcctaaaaccgacatcctagtggaactgcccacattcactgagagtaaggagaacatggtggacctcgcccctcagctaaagggcactaaggatgaggacttcatacaaccgccaccagtcacctcgagccctattaccccttccactcccattagcctgccaaagggtccaatcacctcttccgaggagcctacgctgcaggccaagtcccaaatgactgcccagaactcgaaagcttcaagtaaaggggcatag

SEQ ID NO: 51058 - DNA, 369 bp, Artificial Sequence
  Description of Artificial Sequence: Synthetic coding sequence
atgaaaaactatgaatccaaaaagtacagcgatccttcccagcctggaaacacagtgctacatccaggaacccgcctcatccagaagctccatactagtacctgttggttgcaggaggttccaggtaaaccacaactcgagcaggcaaccaagcatccccaggtgacttcacctcaagcaaccaaagaaactggaatggagattaaggaggggaagcaatcttatcgccagaaaattatggatgagctcaaatattattacaatgggttttacctgttatggatcgacgctaaggtggcagccagaatggtctggcggctcctgcacggacaggttctcacccgccgtgaacgcagacggtgcttctag

SEQ ID NO: 51059 - DNA, 1335 bp, Artificial Sequence
  Description of Artificial Sequence: Synthetic coding sequence
atgaaaaattacgagtccaaaaaatatagcgacccctcccagcccggtaacaccgtgctgcacccaggtaccaggctcatccaaaagctccatacatcgacctgctggttgcaggaggtcccagggaaaccgcagctggagcaggccactaaacatccgcaggttacatcccctcaggcaacaaaagagacaggtatggagatcaaggaaggcaagcagagttataggcagaagatcatggatgagttaaagtactattacaatgggttctacctgttgtggatagatgcgaaagttgccgctcgaatggtctggagactcctgcacggtcaggtgctgacccgcagggagcggcgtcgcctgttgcggacatgtgtggatttctttcgattagttccgttcatggtgtttttgatcgtgccttttatggaattccttctgcctgtctttctgaaattgtttcctgagatgttgccttctactttcgagagcgagagtaagaaggaggagaagcaaaagaagaaaatggccgtgaaattggagcttgctaagttcctacaggaaacaatgaccgagatggcccgacggaaccgcgcaaagatgggtgatgcaagcactcaactcagttcatacgttaagcaggtccagactggccacaagccaagcaccaaggagatcgtgcggtttagcaagctgtttgaggatcaactggcattggaacatttagaccgtccacaactagttgctctgtgtaaactgctcgagctccaaacctttggcaccaacaatctgctgcggttccagttgctgatgaaactgaagtccataaaagctgatgatgagatcatcgccaaagaaggcgtaacggccctgtcggtgagtgagttacaggctgcctgcagggcccgtgggatgagaagtctaggtctgaccgaagagcaactgcgccagcagctgaccgagtggcaggacctgcacttgaaggagaacgtgccgccttccctgctgcttttatccagaactttttacctgattgacgttaagcctaaacctattgaaatacccctgtcaggcgaggccccaaagacagacattctagtcgagctgcccacatttactgaatcaaaagagaacatggtggacctggcccctcaactgaaaggcaccaaggatgaagacttcatccaaccacctccggtaacatcatccccaatcacacccagcacgcccatttctttgccaaaaggaccaatcacttcctcggaggaaccaaccctgcaagctaagtcccagatgacggcccagaactcaaaagcctcttctaaaggcgcttag

SEQ ID NO: 51060 - DNA, 1872 bp, Artificial Sequence
  Description of Artificial Sequence: Synthetic coding sequence
atgagagtcgccttgggaatgttatggctgctagcgttagcttggccacctcaggcaagagggttctgccctagccaatgttcttgcagtctgcatatcatgggcgatggatctaaagctaggacggttgtgtgtaatgatcctgacatgactctgcctccggcatctattccacctgacacaagccggttgcgattggagcgcacagccatccggagagtgcctggggaggcttttcgcccactgggcagactcgaacagctatggctgccttacaatgctctttccgaactaaatgccctcatgcttcggggactgcgacgtctgcgggagctgcgcctgcctggtaaccgtttagcggcattcccgtgggcagccttaagggatgcacccaagctacggctccttgacctccaggctaaccggctgagcgccgttcctgcagaggctgccaggtttctcgagaatcttacttttctcgacctttcatctaaccaactaatgaggctgccacaggagcttatcgtttcctgggctcatctcgaaacagggatatttcccccaggccaccacccccgacgcgtcctgggattgcaggacaatccctgggcctgcgattgccgactgtatgacttggtgcacctgttggacggctgggctccaaaccttgcattcattgagactgagctccgatgcgcctccccgagatccctggctggagtggccttttcacagctcgagctccgtaaatgccagggtcccgaattgcaccctggggtcgcttctattcgtagcttactgggtggaaccgctctgctccggtgtggtgccactggcgtgcctgggccagagatgagctggagacgcgctaacggccgtcccctgaacggcaccgtgcatcaagaggtgtcaagcgacggcacgtcatggaccctcctggggctccccgcagtttctcacttagattctggcgactacatctgccaggcaaaaaatttccttggcgcaagcgagacggtgatttccctgatagtgactgagccgcctacctccaccgagcactccggctcacccggagccctctgggccagaactggaggaggcggagaggcagcagcatacaacaacaagctcgtggctcggcatgttccccagatccccaagccagcagttctcgccaccggccctagcgtacccagcaccaaagaggaattgaccttagagcacttccagatggatgcgttgggggaactgtccgatggcagggccggaccatccgaggctaggatggtcagaagcgtgaaagtggtgggggatacttatcatagcgtgagtttggtctggaaagctcctcaggccaaaaacaccaccgctttcagcgtgctctatgcagtgttcggacagcacagcatgcgcagggttattgttcagccgggaaaaactcgggttacaatcactggcttgctgcccaagacaaagtacgtcgcctgcgtctgtgtacaggggctggttccgagaaaagagcaatgcgtcatatttagcaccaacgaagtcgttgatgccgagaacacgcagcaactgatcaatgtggtggtgataagtgtggccatcgttatcgcccttccactcacactgctcgtctgttgttctgcactgcagaagcgttgcagaaaatgttttaacaaagacagtactgaggctaccgtgacgtatgttaatctggagagactgggatatagcgaggatggcttagaggaacttagcagacacagtgtgtccgaggccgaccgactgctcagtgcacgctcctctgtcgatttccaagccttcggcgtgaaaggcggtcggagaatcaacgagtacttttgctag

SEQ ID NO: 51061 - DNA, 1491 bp, Artificial Sequence
  Description of Artificial Sequence: Synthetic coding sequence
atggtcgagccgcaccaggagcctcgtcactctaaggttggactgcaggacaacccatggttttgcgattgccatatttctaagatgatagagctgtcaaaggtcgttgacccggcaattgtccttttggatccactgatgacctgtagcgaacccgagcggctcactgggattttattccaacgggcagaattggagcattgcttaaagccgagtgtcatgacttcggccactaagattatgtcagccctcggatctaacgtgctgttgcggtgcgacgccaccggcttccccaccccccagattacgtggacgcggagtgactcaagccccgtgaattacacagtcatccaagaatctccagaggaaggcgttcgatggtctatcatgtctctcaccggcatcagttctaaggatgccggagactacaaatgcaaagcaaagaatcttgccggaatgtccgaggctgtcgtcaccgtgaccgtcctcgggatcaccaccaccccgattcctcccgatacatcagaacggaccggagatcacccagagtgggacgtccaaccaggctcaggcagaagcacatccgtgtcatctgcaagttcgtacctgtggagcagtagcttttcccctacatctagtttttccgcctcgaccctgtctccgcctagcaccgccagtttcagcttatcgcccttctcatcttccacggtgtcatcaacaaccacacttagtactagtatcagcgcatccacaaccatggcgaacaagagaagctttcaactgcaccaaggaggtaaacggaatctgaaagttgctaagaatggcagcaagctgccacccgctagtacatccaagaaggaagagctggccctgctagaccagaccatgctcactgaaaccaacgcggctatcgagaatctccgggtagtatcagaaactaaggaaagtgtaacacttacctggaatatgattaacactactcacaactcagcagttacagtactttatagcaagtacggaggaaaggatctgctcctgctcaatgcggatagcagcaagaatcaggtcactatagacggcctggaaccaggtggccagtacatggcctgcgtctgtcccaagggcgtcccaccccaaaaggatcaatgtatcacattttccacagaaagagtcgagggcgatgatagccagtggagtctgttactggtcgtgacctctactgcatgcgtggtgatcctgcccctcatatgcttccttctatataaggtttgcaagctgcaatgtaaatcggaaccattttgggaagatgacctagccaaggaaacctacatccagttcgagacactgttccccagatcacagagcgtcggggagttgtggacccgttcacatcgagatgacagcgaaaagctgctgttgtgttccagaagttcagtggaatctcaggtcaccttcaagtccgaagggtcccggcctgaatactactgctag

SEQ ID NO: 51062 - DNA, 1905 bp, Artificial Sequence
  Description of Artificial Sequence: Synthetic coding sequence
atggacatgaacgaactgcctacaaatctacctgtggatacagtgaagctacggattgagaagaccgtcattcggaggatctccgccgaggcattttactatttagttgagctccagtatttgtgggtcacttataatagtgttgcaagcatcgatccctcaagtttctacaacctgaaacagttgcacgagttgcgacttgacgggaacagtctagctgcctttccatgggcaagtcttctagatatgccgctattgaggacgctggacctgcacaataacaagataacatctgtgccaaacgaagctttaagatatttgaaaaatctggcgtaccttgacttatccagcaaccggctaacaactttgccccctgatttcttggagtcttggacccacctagtctccactccttccggggtgttggatttgtcaccaagtagaataattctgggcctccaggacaatccatggttttgtgattgtcacatttccaagatgatcgagctctcaaaggtcgtggatcccgcaatcgtgctgctggacccgctgatgacctgctctgaaccagaaaggctaaccggaattttgttccagagggccgaactcgaacactgcctgaagccatccgtcatgacctcagccaccaagatcatgtcggcactcgggagcaatgtacttctaagatgtgatgccacaggatttcctacgccgcagattacttggactcggtccgattctagcccagtcaattacacagtcatacaggaatcaccggaggaaggagtccgctggagtataatgtcactgacgggcataagctctaaggacgctggcgactacaagtgcaaagccaaaaacctggccggaatgagtgaagcggtggtgacggttactgtcctagggatcacaacaacacccattccacccgacacttctgagagaacaggggaccacccagagtgggatgtgcagccaggttctgggcgatctacaagcgtctcctcagcttcatcctatctgtggtcgtcctccttcagccccacctcaagtttcagcgcctcaacactgagccccccttctaccgcctctttttccctttccccttttagcagcagcactgtgagttctacaactaccctttccacttcaatatcggcgtccaccacaatggctaataagaggtcttttcagctgcaccaagggggaaagcgcaaccttaaggttgctaagaacggtagcaaattgccacctgcctcaaccagtaaaaaggaggaattggccctgcttgaccagaccatgctaacggaaacaaatgccgctattgagaatttgcgcgtggttagtgaaactaaggagagcgtcactttgacgtggaatatgatcaataccactcataacagcgctgtgactgttctgtattcaaagtacggcggaaaagacttgctgctgctcaatgctgacagctcgaaaaatcaagtgactattgacggtttagaacctggtggacaatatatggcatgtgtgtgccctaagggggtgcctccccagaaggaccagtgtatcacatttagtacagagagagtagagggcgatgactctcagtggagcttgctccttgtggtgacttccacagcttgtgtcgtgattctacctctgatttgctttctcttatacaaagtctgcaaactgcagtgcaaatccgaacccttctgggaggacgacctcgctaaagaaacctacattcagtttgaaaccctttttcccagatcgcagagtgtgggagaactatggacacgaagccatagggacgactccgagaaactactcctgtgttcgcgctctagcgttgagtctcaggttacatttaaatccgagggatcaaggccggagtattactgttag

SEQ ID NO: 51063 - DNA, 1491 bp, Artificial Sequence
  Description of Artificial Sequence: Synthetic coding sequence
atggttgaaccccatcaggaaccccgacactctaaagttggcctgcaagataatccgtggttctgtgactgtcacatatcaaagatgatcgaactttctaaagtggtcgacccagcaatcgtgctcctcgatccactgatgacctgctcagaaccagaaaggttgactggcatcctattccaacgcgctgagttagagcactgcctcaagcccagcgtgatgacatctgctaccaagatcatgtcagcactggggagcaacgtgctgttacggtgcgatgccacgggctttccaaccccacagatcacctggacacggagcgacagttcgcctgtgaactacactgtaatccaagagtccccagaagaaggagtgaggtggagcatcatgtctctgaccggtatcagcagcaaggatgctggagattataagtgcaaggctaagaatctggccggtatgagtgaagctgttgtgacagtaactgtcctgggaatcacgactactccaattcctcctgacaccagtgagagaaccggagatcaccctgaatgggacgtgcagccgggatctgggaggagcacttcagtatcatcagcttccagctacctttggtcatcctcttttagccctacaagttcattctcagcctccactctcagcccgccaagcaccgcttcattctcccttagcccgttcagttcttcaaccgtttcctctaccacgaccttatcaaccagcatcagcgccagtaccacaatggcaaataagcgcagtttccagctgcatcagggtggaaagcgcaatctgaaggtagctaagaacggatccaagctcccaccagcttcaacatctaaaaaggaggagctggccctgttggaccagaccatgcttacggaaaccaacgccgcaattgagaacttgcgtgttgtgtccgaaacaaaagaaagtgttaccctgacttggaacatgattaacactacccataacagtgcagtcacagtcctgtactccaaatatggaggaaaggacctgctgctgctgaatgcagacagttctaaaaatcaggtcaccatagatggcctggaacccggtggacagtacatggcctgtgtgtgtccaaagggtgtgcctccccagaaagatcagtgtataactttctccacggaaagggttgaaggggatgatagtcagtggtctctgctgctggtggttacctctaccgcttgcgtcgtgattttaccgttaatatgcttcctcctgtacaaggtgtgtaaacttcaatgtaaatctgagccattctgggaagatgacctcgctaaagagacctatatccagttcgagacccttttcccaagatctcagagcgttggcgaattatggacgagaagtcatcgggacgactccgaaaagttactcctgtgttcacgatcctccgtggagagccaggtaaccttcaagagcgaggggagcaggcctgaatattattgctag

SEQ ID NO: 51064 - DNA, 3360 bp, Artificial Sequence
  Description of Artificial Sequence: Synthetic coding sequence
atgtcggccccttccctcagggcccgtgcggctggtctgggactgttgctttgcgcagtactgggccgtgccggacgcagtgattccggtggaaggggcgagttagggcagcccagtggagtggctgctgaacgcccttgtcctacgacatgtagatgtctgggagatcttctggattgtagccgaaagcggctggcccgactgcctgagccacttccttcttgggtggctcgccttgacctttcacacaaccgactctctttcataaaagctagctccatgtcacaccttcagtcactgcgggaggtgaagcttaataacaacgaattggagaccatacctaacctcgggcctgttagtgctaacattaccctgctgagtctcgctggaaatcgcattgtggagattttacccgagcaccttaaagagtttcagtctctcgaaaccctggatctcagttctaataatatctctgagcttcaaaccgccttccctgcccttcaactcaagtatctgtacctcaattctaaccgtgtcacctccatggagcccggatatttcgataacctggctaataccctgctcgtcctcaaactgaatcgaaatagaatctcagccattcccccaaagatgtttaaactgcctcagttgcaacacctggaattgaaccggaacaaaataaagaatgttgacggactgaccttccagggattaggtgcattgaagtccctgaagatgcagaggaatggcgtgactaaacttatggatggcgctttctggggtctgtctaatatggagattctgcagttggatcacaacaacctgaccgagataacaaaggggtggctgtacggccttctgatgctccaggagttacatctgagtcagaatgcaattaataggatctccccagatgcctgggagttttgccagaagctatccgaactggaccttacgtttaatcacttgagccgccttgatgatagctcctttttggggctttcgctcctgaacacattgcacattggtaataaccgggtaagctatattgctgactgcgcctttcgaggtctgtcgtccttgaagactctggatcttaagaataatgagatcagctggactatagaggacatgaacggagcgttctctggcttggataagttgcgccgactgatcctgcaggggaataggattaggagcatcaccaagaaagccttcaccggtctggacgcccttgagcatttggacctaagtgacaatgccattatgtcgctccagggaaacgccttctcacagatgaagaagctccagcagttacacctgaacaccagtagtctcctgtgtgattgccaactcaaatggttgccccagtgggtggctgagaataacttccagtcattcgtgaacgcatcttgtgcgcacccccaacttctcaaggggcgatctatctttgctgtgtctcctgacggctttgtatgcgatgattttccgaagcctcaaataactgtccagccagaaacacaaagcgccattaaaggatccaacctgtcctttatttgttccgcagccagcagcagcgattcgcctatgacttttgcatggaaaaaagataatgaactccttcacgatgcagagatggaaaattatgcccacttacgagcccagggtggggaagtgatggaatacacaaccatactgcggctgcgcgaagtggagttcgccagtgagggaaagtatcaatgtgtgattagcaatcactttggtagttcctatagcgttaaggctaagctcaccgtgaatatgctaccctcttttactaaaactccaatggatttaaccattcgggcaggggcaatggcgaggttggagtgcgctgctgtaggtcacccagccccacagatagcctggcaaaaggatggtggaacagatttcccggctgccagggaacgacggatgcacgtaatgcctgaggatgacgtcttcttcatcgtcgacgtgaagatcgaggacataggggtctatagctgtaccgcacaaaatagcgcaggcagcatcagtgccaatgcgacactgactgtcctggaaaccccatctttcttgagaccactcctcgaccgcacggtaacaaaaggagaaacggccgtccttcagtgtatagccggaggctcaccacctccaaagctgaattggaccaaggatgattcacccctggtcgtcacggaaaggcacttcttcgccgcaggcaaccagctcctcatcatagtcgactcagatgtgagcgacgccggaaagtacacgtgcgagatgagcaacactctcggaaccgaacgtgggaatgtccggctcagcgtgattccaacccctacttgtgatagcccccaaatgacagcgcctagtttggatgacgatgggtgggcaaccgtgggggtagtaataattgctgtggtgtgctgtgtcgttggtacaagtctggtgtgggttgtgatcatctaccatacgaggcgccgtaatgaggactgctcaatcaccaacacagatgagactaacctgccagctgatattccttcatatctctcttctcagggcacacttgccgaccgccaggacggatacgtgagctctgagtccgggtcccaccaccagttcgtgaccagctctggagctggcttcttcctaccccagcatgactcctccgggacgtgccatatagacaacagcagtgaggcagacgtggaagcggcaacagatctttttctatgcccttttttgggttctacaggaccgatgtacctcaagggcaatgtctacggttccgaccctttcgaaacctaccacactggctgtagtcccgaccccaggacagtactcatggatcattacgagccctcctatatcaagaagaaggagtgctacccctgttcacaccctagtgaggaaagttgtgaaagaagtttttcaaatattagctggccttctcacgtcagaaaactcctcaacacatcgtattctcacaacgaaggacccggaatgaagaatttgtgtctcaataaatctagccttgactttagcgcaaacccagagcctgcaagtgttgctagttctaactcattcatgggaacctttgggaaagctcttagacggcctcatcttgacgcttactcaagttttgggcagccctcagattgccagcctcgggcattctatctgaaggctcattctagtcctgatctggactcagggagcgaagaggacggcaaagagagaaccgacttccaagaggaaaaccatatttgcactttcaaacagaccctggaaaactatcgcacccccaattttcagtcatatgatttagatacctag

SEQ ID NO: 51065 - DNA, 3180 bp, Artificial Sequence
  Description of Artificial Sequence: Synthetic coding sequence
atggtggacgtgttgctgctcttcagcctttgtctgctgtttcacatttcacgcccagacctgtcccacaatcgcctctcatttattaaagctagctcaatgtcccacttacagagccttcgggaggtgaagttgaacaacaatgagctggagaccatacccaatctcggtccagtgtctgctaatatcacccttttgtccctcgctggaaaccggatcgtcgagattcttcccgagcaccttaaagagttccagagtcttgagactttagacctgtcttcaaacaatatttccgaattacagaccgcattccccgctctccagctcaaatacttgtacctgaacagtaaccgggtgacaagcatggagccgggttacttcgataatctggccaacactctgctggtgttgaagttgaataggaatcgtatcagcgccattccccctaagatgttcaagctgccacagctgcaacacctcgaactgaataggaataagatcaaaaatgtcgatggacttacatttcagggactgggcgctctgaaatcactaaaaatgcagaggaacggagtgaccaaattgatggatggcgctttctggggtctgtctaatatggagattctccaactggaccataacaacctcaccgagatcaccaaaggttggctgtatgggctgctcatgctccaggagcttcacctcagccaaaacgcgataaacaggatatcccccgatgcctgggaattctgtcagaagctgtcagaactagatctgaccttcaaccatttgagtcgattggatgacagctcattcctgggtctgagcctactcaatactctgcacattggcaataatcgggtgtcatacatcgcggactgcgccttccggggactgtccagcctaaagacccttgatctgaagaataatgagatctcttggaccatcgaagacatgaacggcgcttttagtggcctcgacaaactcagaagactgatactgcagggaaataggatccgctccataacgaagaaggcctttactggcttggacgccctggaacacttggatttgtcagacaatgctatcatgtcccttcagggcaatgcctttagccagatgaaaaagctgcagcagctccacctcaatacatcgagcctgctatgcgattgtcaactgaaatggctacctcagtgggtcgcagagaacaacttccagagcttcgtgaacgcttcttgtgctcaccctcaacttctgaaaggccgaagcatcttcgccgtgtcaccagacgggtttgtgtgcgacgactttccgaagcctcaaattaccgtgcagcccgagacccagagcgctatcaagggcagtaacctttccttcatttgtagcgccgctagcagcagcgattcaccaatgacctttgcttggaagaaggataacgaactgctgcatgacgcagagatggaaaattatgcccacctgcgcgcacagggcggagaagtgatggagtacacaacaattctgcgcctaagagaagtggagtttgcatccgaaggaaagtaccagtgtgtgataagcaaccacttcggatcctcatacagcgtcaaggccaaactgactgtcaacatgctaccctcgttcaccaagaccccaatggatctcactatccgggctggtgcaatggccagactggaatgcgcggctgtgggccaccctgccccacagatcgcttggcagaaggacgggggaaccgattttccagcggcaagggagcggagaatgcatgttatgcccgaagacgacgtgttcttcattgtggacgttaaaattgaggacatcggagtgtatagctgtaccgctcagaattctgctggaagtatctccgccaacgctacactaaccgttctcgaaactccatctttcctgcgacctctgttggaccgtaccgtgaccaaaggcgaaacggctgtgctgcagtgcatcgcgggaggcagcccacctcctaagcttaactggactaaggacgactcaccacttgtcgttacagagagacacttcttcgccgcagggaaccagttactgattatcgttgactccgacgtgagcgatgccggaaagtacacttgtgaaatgtcaaatacactgggaacggagagaggaaatgtgcggctgagtgtgatccctaccccaacgtgtgattccccacaaatgacagctccctccttggatgacgacgggtgggctaccgttggcgttgtgataatcgcagtggtgtgttgcgtggtgggtactagcttggtctgggtggtcatcatctaccacactcggaggcgcaatgaggattgttctattacgaataccgacgagactaaccttcctgcggacattccgagctatctatccagtcagggcacgctggctgaccgccaggacggatacgtgagttctgagagcggcagccatcatcaattcgtgacctctagcggagctggtttcttcctcccccagcacgacagctcgggtacatgccatatcgacaactcctcagaagccgatgtggaggccgctacagacctcttcctgtgtcccttccttggttcgaccggtcccatgtacttaaaagggaatgtctacggtagcgacccctttgagacctatcataccggctgctcgcccgaccccaggaccgtgttgatggaccattacgaaccctcttatatcaagaaaaaggagtgctatccctgttctcatcctagtgaagagtcgtgtgagagaagtttctcaaatatctcctggcccagccatgtacgaaagttactcaatacctcctacagtcacaacgaagggccaggaatgaaaaacctgtgcctgaacaagtcctccctggattttagtgccaacccagagcccgcatcagtggcatcttctaattcctttatgggaacttttggaaaagcactccggagaccccacttggatgcttattcgtcctttggccagccatccgattgtcagcctcgcgctttctatctgaaggcgcattcctcccccgatcttgactcgggctccgaagaggatggaaaggagaggacagatttccaagaggagaatcacatctgtacattcaagcagaccctcgagaattatagaacccccaactttcagtcctacgacctcgacacatag

SEQ ID NO: 51066 - DNA, 1038 bp, Artificial Sequence
  Description of Artificial Sequence: Synthetic coding sequence
atgaagggtgagcttcttctcttctcctctgtcatagtgcttctgcaggtggtgtgctcgtgtccagacaagtgctattgccagagcagtactaattttgttgattgttcccagcagggactcgccgagattccgtctcatctgcccccacaaacccgcacgctgcatctccaagataaccaaatccatcatctcccggcttttgctttccggagtgtgccatggctaatgacactgaacctgtccaacaattctttgtcgaacctggcacccggagctttccacggactgcaacacctacaggtgttgaacctgacacaaaattccctgctgtctctggaatcacggctcttccatagcctaccgcaactccgggaactggacctgtcttccaataatatttcacatctccccacaagccttggtgaaacatgggagaaccttactattctggcagtgcagcaaaatcagttgcaacagctcgacagagccctgttggagtctatgccttcagtgcgattacttctgctgaaagataacctttggaaatgtaattgtcatctgctggggttgaagctttggttggagaaattcgtttacaagggagggctgactgatggaatcatttgcgagtccccagacacttggaaggggaaagatctgctgcgcatccctcacgaattgtaccagccttgtcccctacccgctccggaccccgtgtcatcgcaggcccagtggccaggcagcgcgcacggagtggtcctaagaccccctgagaaccataacgctggagagcgcgaactgcttgaatgcgagctgaagcccaaaccgaggcccgctaacctgcggcatgctattgcaactgtcataatcaccggagtggtgtgcggcattgtatgcctaatgatgcttgccgctgccatctacggctgcacctacgctgcaattaccgcgcagtatcatggcggacccctggcgcagacaaacgatcctggcaaggtggaggaaaaggaacgctttgacagctctcctgcctag

SEQ ID NO: 51067 - DNA, 810 bp, Artificial Sequence
  Description of Artificial Sequence: Synthetic coding sequence
atgaccttgaatctgtcaaacaactcattatccaaccttgcacccggtgcctttcatgggctgcagcacctccaagtactgaacctcactcaaaattccctcctcagcctggagtcccgcctgtttcattcattgccccagctgcgagagcttgacctcagttctaacaatatttcacacctcccaacctcattgggcgaaacctgggaaaatctaaccatcctagcagtgcagcaaaaccagcttcagcagcttgaccgggcacttctggagagtatgccaagtgttagactcctcttgcttaaggataatctgtggaaatgcaactgtcatctcctcgggttaaaactgtggctcgagaagtttgtctataagggaggcttgacggatggaatcatatgtgaatcccccgatacctggaaggggaaggatctgctgcgtattccccatgaactgtatcagccgtgcccattgcctgcacccgaccccgtttctagtcaggcccagtggcctggctcggcacacggtgttgtactgaggccccctgaaaaccataacgccggtgaacgcgagttgctcgagtgcgagctcaagcctaaacccagacccgctaatctgagacatgctatagcgactgtcatcatcaccggcgtggtgtgtggaatcgtgtgtttgatgatgctcgcagcagcaatctacgggtgtacttatgccgcaataactgcacagtaccatggtggccctctggcacaaactaatgatccgggaaaggttgaggagaaagaacgattcgactcttcgcccgcttag

SEQ ID NO: 51068 - DNA, 1113 bp, Artificial Sequence
  Description of Artificial Sequence: Synthetic coding sequence
atgcttgctccgggatcatcacccggacagcggggacgtctcgccctgcaatggaggcaggtatcctggattacctgttggattgcactatatgctgtggaggccttgcctacatgtcctttttcttgtaaatgtgattcacgcagcctcgaagtcgattgttctgggctgggcttgacgaccgttccgccagatgttcctgccgcaacacgaacgctgctcctgctgaacaacaaactgtctgctctgcccagttgggctttcgctaacctgagttctctgcagcggctggatctgtctaataatttccttgatcggctacctagatcaatcttcggggacctgactaatctcacagagttacagctgaggaacaactctatcagaaccctggacagagaccttctgagacacagccctctgctcagacatttggacctgagcatcaatgggctcgcacagttgcctccgggtctctttgacggcttgcttgcacttcggagtctgtctctccggtccaatagactccagaatttggatcggttaactttcgaacccctagctaatctgcagctacttcaggttggcgataatccttgggaatgtgactgtaacttacgggaattcaagcactggatggaatggttctcttacaggggagggcgtctggaccaactggcctgtacactgccgaaggagctcaggggcaaagatatgcggatggtgccgatggaaatgttcaactactgttcacagctggaggacgagaattccagcgctggactagacatcccagggccaccgtgcacaaaggcctccccagagcccgctaaacccaagcctggtgccgaaccggagccagaacccagcaccgcctgtccccagaagcaaaggcacagacctgcaagtgtgcgaagagccatgggtaccgtgatcatcgccggagtggtttgtggggtggtgtgtatcatgatggtagttgccgctgcatacgggtgtatttacgcaagcttgatggccaagtaccatcgggaattgaagaagcgccaaccccttatgggggatccagaaggggagcacgaagaccaaaaacagatatcctcggtggcttag

SEQ ID NO: 51069 - DNA, 408 bp, Artificial Sequence
  Description of Artificial Sequence: Synthetic coding sequence
atgcgcatggttcccatggaaatgttcaactactgctcccagctggaagatgagaattcaagcgcaggcctcgatatccccggaccaccatgcacgaaggcgtccccagagccagccaagcctaagccgggtgcccagcactccctccccaccgaagccgaggctcccgctggcgagagggaggctagtcatggacatggagaccactgtcggggaagagtcagaaggagactccaccacgacggtggaggtcggtgtctgtggctacacttgagactgccacacgggcaggtgcccccaggggcacaaaaggctcccgctccagacggcggtcccaggggtcgcgctcgcggacccgaggcagacctgttttgtggtctttcagcgcaccctcaccctgctcggtag

SEQ ID NO: 51070 - DNA, 1113 bp, Artificial Sequence
  Description of Artificial Sequence: Synthetic coding sequence
atgctggccccaggctcctcacccggacaaagaggccgactggccctccagtggaggcaggtgtcttggattacttgctggatagcattgtacgcagtagaggccctccctacatgtccattttcttgtaagtgcgacagtcgcagtctggaggttgactgtagtggcctgggtctgaccaccgtgccacccgacgtgccggctgcaacacggaccctgctcctgctgaataataaacttagcgcactgccaagctgggcttttgcgaatctcagcagcctccagcgcctcgacctgtctaacaattttctggacaggctcccacgtagtatttttggcgacctcactaatctcacagaactccagctgcggaataattctattagaacgctggacagggacttgctgcgccattccccacttctgagacacctggacctgagtattaatggtctggctcagctgccccctgggctgttcgatggactgctggcactccgaagcctgtctcttagatctaatcgtctgcagaacctagatcgcttgacattcgagccactggctaatctccagctcctccaggtgggagataatccctgggagtgcgattgcaacctgcgcgagtttaagcactggatggagtggttctcttatagaggagggcgtctagaccagcttgcttgtaccttgccaaaggagttgcggggaaaggatatgaggatggtgcccatggagatgtttaattattgttctcagctggaggacgagaattcatctgcagggctggatattccaggaccaccatgtactaaggccagcccggagcctgccaagcccaagccaggggcagagcccgagccagaacccagtactgcttgccctcagaaacagaggcataggcccgctagcgtgaggcgtgcaatgggaacagtaatcattgccggagttgtgtgcggcgttgtctgcattatgatggtagtcgccgcagcctatggatgtatatatgcctccctcatggctaaataccatcgcgaactgaaaaaacgacaaccgctcatgggggaccctgaaggagaacacgaggaccaaaaacagatcagttcagtcgcatag

SEQ ID NO: 51071 - DNA, 1113 bp, Artificial Sequence
  Description of Artificial Sequence: Synthetic coding sequence
atgcttgcccctggttccagtccaggccagcgcggtcgcttagctctgcagtggcggcaggtttcatggatcacctgctggatcgcactttacgcggtggaagccttacccacatgcccctttagttgcaagtgtgacagcagatccctagaggtagactgttcaggcctggggctgacgactgttcctcccgatgtccctgcggcaacccggacactgctgctgcttaataacaaacttagcgcccttcctagctgggcatttgccaatctttccagccttcaaaggcttgacctgagcaataacttcttggatcggcttccgcgaagtatcttcggcgatttgaccaaccttaccgagttacagctgcggaacaacagcatccgcacactggacagagacctgctccgtcactctcccctcttgcggcacctggatttgagcatcaacggtcttgcccagctacctcccggattgtttgacggcctgctggctcttcggtctttgagtctccggtctaatagactgcaaaatttggaccgtctaacattcgagcccctggccaatctgcagctcctgcaggttggcgacaacccctgggaatgcgattgcaacctgcgggaatttaaacattggatggagtggttttcttatagggggggaagactcgatcagctggcatgcaccttgcccaaagaactgcgcggaaaagacatgcgcatggtgccgatggaaatgttcaactactgttcacaactggaagatgaaaattccagtgccggactcgacattccgggacctccatgtactaaagcctcacccgaaccggctaagccgaagccaggagctgaacccgagcctgagccttcaacagcttgcccccaaaaacagcggcaccgccctgcatctgtcagacgggcaatgggtaccgtgattatcgcaggcgttgtgtgtggcgtggtatgcatcatgatggtcgtcgctgcagcctacgggtgcatttatgcgtcactaatggcgaagtatcatagagagctaaagaaacgccagcccttaatgggagatcctgagggcgagcacgaggaccagaaacaaatcagctccgtggcatag

SEQ ID NO: 51072 - DNA, 1500 bp, Artificial Sequence
  Description of Artificial Sequence: Synthetic coding sequence
atgacgctcatattgacatcgctgttgttttttggcctgtcactaggcccacgaacacgggtgcaagccgagaatcttcctaagccgattctatgggccgagcctggccctgtgattacctggcataaccctgtcactatttggtgccagggaaccctggaggctcaaggatatcgcctcgataaagaggggaactcgatgtccagacatatcctgaaaacccttgagtccgaaaataaagtcaaactcagcatcccttctatgatgtgggagcatgccggacgataccattgctattaccagtcccctgccggatggtctgaaccctctgacccgctggaacttgtcgttactgcttactcccgccctacattaagcgctctcccttccccggtcgtgactagtggtgtcaacgtgaccttacgctgtgccagccgccttggactcggtagattcactctgatcgaagagggggaccatcggctctcttggaccctgaattcacatcagcacaaccatggaaaattccaggctcttttccctatggggccacttacatttagcaatcggggtacatttcgttgctacggttatgagaacaataccccctacgtttggagcgagccttcagacccactgcaattgctcgtgtctggcgtgtccagaaaaccgtctctccttacacttcaaggacccgtcgtaacacccggagaaaatttaactctacagtgcggctctgacgttggttacattagatatactttgtacaaggaaggcgcagatggcttgccccaacgccctggcagacagccccaggcgggtctctcacaagctaacttcacactatcaccagttagccgatcctatggaggccaatacaggtgctatggagctcacaacgtgagcagcgaatggagcgctccttcagatcctttggacattctgatcgccggacagatctccgatcgtccatccctctctgtccagccagggcctaccgtgacaagtggcgagaaggtgacattgctctgtcagtcctgggacccgatgttcacgtttctgcttacaaaggagggtgctgcacatcccccactgcggctacgatcaatgtacggggcacacaagtatcaggcagagttccctatgtcaccagttactagtgcacacgctggtacatatcgctgctacggcagcagatcttctaacccttatctcctgtctcacccctccgaaccactggagttagtggttagcggggcaaccgaaacgctgaaccctgcacagaaaaagtcagactcgaaaacagctccccacttgcaggactataccgtcgagaatctcattaggatgggggtagcaggtctagttctgctcttcctcgggatcctactatttgaggctcagcactctcagcgaagcccccctcggtgcagccaagaggcgaacagtcgcaaggataatgcacccttccgtgttgtggaaccttgggagcagatttag

SEQ ID NO: 51073 - DNA, 978 bp, Artificial Sequence
  Description of Artificial Sequence: Synthetic coding sequence
atggcgaatgcactggcgagtgccacatgcgaacggtgcaaaggaggattcgctcctgcagagaaaatcgtcaactctaatggggaactctaccatgagcagtgctttgtctgcgcacaatgttttcagcagttcccagaagggctcttttatgagtttgagggaaggaaatattgcgagcatgattttcagatgttattcgccccatgctgccaccaatgcggtgaattcatcatcgggagagttatcaaggctatgaacaattcctggcaccccgagtgctttaggtgtgatctatgtcaggaggtgctggctgatatcgggttcgttaagaacgcgggaaggcacctgtgtcgcccttgccataatagggaaaaagcccgagggctgggcaaatacatttgccagaagtgtcatgccattatagacgagcaacccctaatattcaagaacgacccctatcatccggaccatttcaattgcgccaattgtgggaaggaattgaccgccgacgctagggagctgaagggagaattatattgtctgccatgccatgacaagatgggtgtgccaatatgcggggcatgccgcagaccaattgagggcagggtggtgaatgccatgggcaagcagtggcatgtagagcattttgtgtgtgctaaatgcgaaaaacccttcctagggcatcgccactatgagagaaaaggcctggcctactgtgagacccactataatcaactctttggtgatgtttgcttccattgtaacagagtgatcgagggtgacgtcgtttcagctctcaacaaggcgtggtgtgtgaactgctttgcttgctccacatgtaacaccaaactcacactaaaaaataagttcgttgaatttgatatgaagccggtatgtaaaaaatgctatgagaagtttccgctagaactgaagaagagactcaagaagctggctgaaaccctgggtcgcaagtag

SEQ ID NO: 51074 - DNA, 978 bp, Artificial Sequence
  Description of Artificial Sequence: Synthetic coding sequence
atggccaacgcgctggccagcgccacatgtgagagatgtaagggaggtttcgccccagctgaaaaaattgtgaattccaatggagaactgtaccacgaacagtgcttcgtctgtgcccagtgtttccagcagttcccagaggggctgttctatgaattcgagggcaggaagtactgcgaacatgatttccaaatgctttttgctccgtgctgccatcagtgtggggagttcatcatcgggagggttatcaaggccatgaacaattcctggcaccccgagtgcttcagatgtgacctttgtcaggaggtgcttgctgatataggtttcgtgaagaacgcaggtaggcacctgtgtcggccatgccacaacagggaaaaggctcggggattgggtaaatacatctgccagaagtgccatgcaatcatagatgagcagcctctcatcttcaagaacgacccctatcatccggatcactttaactgtgccaattgtggaaaggagctgacggccgatgctcgagagctaaaaggcgagttgtattgtctgccatgccacgacaagatgggagttccaatttgtggcgcttgcagacgcccaatcgaagggagagttgtgaacgcaatgggcaaacaatggcacgtggaacactttgtatgcgccaaatgtgaaaagccatttttggggcatcggcactacgaaaggaaagggctagcttactgtgaaactcattataaccagcttttcggcgatgtgtgttttcactgtaatcgcgtcatcgaaggggatgtcgtatccgcccttaacaaggcgtggtgcgtgaactgcttcgcgtgctctacctgcaatacgaagctaacgctcaagaacaagtttgtggaattcgacatgaagcctgtctgtaaaaagtgctacgagaaatttccccttgagcttaagaagagattaaagaaacttgccgaaaccctcggcagaaaatag

SEQ ID NO: 51075 - DNA, 978 bp, Artificial Sequence
  Description of Artificial Sequence: Synthetic coding sequence
atggccaacgcactagcttctgccacttgtgagcggtgtaagggaggattcgcaccggctgagaaaattgtgaatagcaacggcgaactctatcacgagcagtgcttcgtttgtgcacagtgtttccagcaattccccgaggggcttttctacgaattcgaagggaggaaatattgtgagcacgactttcagatgctgtttgctccctgctgccaccaatgcggagagtttataattggcagagtgattaaagccatgaataattcttggcatccagagtgcttcaggtgcgatctctgccaggaggtcctggctgatattggattcgtgaagaacgccggacgccatctgtgtcgcccttgtcacaatcgggaaaaggcgagaggattggggaaatacatttgccagaagtgccacgccattattgacgagcagcctctcattttcaaaaatgacccctaccatcctgatcacttcaattgcgccaactgcgggaaggaattgactgcagacgcccgagagctaaagggagagctgtattgtctcccttgccatgataagatgggagtgcctatttgtggtgcctgtcgcagaccaatcgagggcagggtggtaaacgcaatgggaaaacagtggcacgtcgagcacttcgtgtgtgctaagtgcgaaaaacccttcctgggacaccgtcattatgagcgcaagggtctagcgtactgcgaaacacactacaaccagctattcggggacgtatgtttccactgcaacagagtgattgagggagacgtggtatccgcgctcaacaaagcctggtgtgttaactgcttcgcttgctctacctgtaacaccaagctgaccttaaagaataaattcgtcgagttcgatatgaagcccgtctgcaaaaagtgctatgagaaattccccttggagctcaaaaagcggctgaaaaagctagctgagaccttaggaagaaagtag

SEQ ID NO: 51076 - DNA, 354 bp, Artificial Sequence
  Description of Artificial Sequence: Synthetic coding sequence
atggcattcagcggaagggccaggccctgtatcattcccgagaatgaggagattccccgtgcggctctcaacactgtacatgaggccaacggcaccgaagatgaaagggccgtgtccaagctccagagacgacactcagacgtgaaagtctataaagaattctgcgacttctatgccaaattcaacatggctaatgccttggcatctgcaacgtgtgaaaggtgcaagggcggttttgcccctgccgaaaaaattgtgaatagcaacggcgagttataccacgagcagtgcttcgtgtgcgcacaatgctttcagcagttccccgaggggctgttttatgaggagcgcacctag

SEQ ID NO: 51077 - DNA, 1089 bp, Artificial Sequence
  Description of Artificial Sequence: Synthetic coding sequence
atgacagccctgcaactgaaagaactgtcgcattctggattatatcgcaggcggagggaccgacctgacagcctaagggtgaatgggttgccagaggaggaactgagcaacatggctaatgcactcgccagcgctacttgcgaacgctgtaagggaggcttcgctcccgcagagaagatcgtgaactctaacggcgagctttaccacgaacagtgctttgtgtgtgctcagtgcttccagcaattccccgaaggcctgttttacgaatttgaagggaggaagtactgcgagcatgactttcagatgctctttgctccttgttgccatcaatgcggagaatttattattggcagagtcatcaaggccatgaataactcctggcaccctgagtgttttagatgcgacctctgccaagaagtccttgcagacatcgggttcgtcaagaatgctggacgccatttatgtagaccgtgtcataacagggagaaggccaggggtctgggtaaatacatatgccagaaatgccacgccattatcgatgagcagcccctcatttttaaaaatgatccatatcacccggatcattttaattgcgccaattgcggtaaagagctgaccgccgatgctagagagctgaaaggagaactatattgtctgccttgccacgacaaaatgggagtccctatttgtggggcatgtcggagacccatcgaggggagggtggtcaatgctatgggaaagcagtggcacgtggaacactttgtctgcgccaagtgcgagaaaccttttctgggacaccggcactacgagcggaaaggcctagcatactgcgagacacactacaatcagttatttggggacgtatgttttcactgcaacagagtgatcgagggggacgtggtgtctgccctcaacaaggcttggtgcgtgaattgctttgcctgtagtacctgtaacaccaagctcacattaaagaacaagttcgtcgagtttgatatgaagccagtctgcaaaaaatgctatgagaaattcccgctggaacttaagaagagactcaagaagcttgccgaaaccctcggcaggaaatag

SEQ ID NO: 51078 - DNA, 990 bp, Artificial Sequence
  Description of Artificial Sequence: Synthetic coding sequence
atgacttgtaatatggccaacgcgttggcatccgccacgtgtgagaggtgcaaagggggatttgctcctgcagaaaagatcgtgaacagcaacggagagctataccatgaacagtgctttgtgtgcgcacaatgttttcagcaatttccagagggcctgttttacgagtttgagggccgtaaatattgtgagcacgactttcagatgctgttcgctccctgctgtcatcaatgcggggaattcatcatcggcagggtgatcaaagccatgaacaattcgtggcatccagagtgctttcgctgcgatttgtgccaggaagttctggcggatattggcttcgtgaaaaacgccggaaggcacttgtgccgaccctgccataatcgagagaaggccagaggcctgggcaaatacatatgtcagaagtgtcatgccataattgatgaacagccacttatattcaaaaacgatccgtaccaccctgatcacttcaactgcgcaaattgtggcaaggagctgaccgcagatgctcgtgagttgaagggcgagttatactgtctcccctgccatgacaaaatgggagtgcccatttgcggagcttgccggcgacccattgaaggcagagttgtgaacgccatgggcaaacagtggcatgtcgagcattttgtgtgcgctaaatgcgaaaaacctttcctcggtcacaggcattatgagcgcaagggactggcatattgtgagacccactacaatcagctgtttggagacgtatgctttcattgcaacagggtaatcgaaggcgacgtggtgtcagccctgaacaaggcttggtgcgtcaattgtttcgcctgttccacctgcaatacaaaactgaccttgaaaaataaatttgtggaatttgacatgaaacccgtatgtaaaaaatgctacgagaagttccctttggaactaaaaaagaggttgaagaaattggctgagaccctcggcagaaaatag

SEQ ID NO: 51079 - DNA, 1164 bp, Artificial Sequence
  Description of Artificial Sequence: Synthetic coding sequence
atggcctttagtggcagagcgagaccttgtattattcctgaaaacgaggagatacctcgtgctgccttgaatactgtgcatgaggcaaatggaacggaggacgagcgggctgttagtaaactgcagcgtagacactctgacgtcaaagtttataaggagttctgcgacttctacgccaaattcaacatggctaatgcactggcatcggcaacgtgcgagcgatgtaaaggcggtttcgcacctgccgaaaaaatcgttaactcgaacggggagctgtatcatgaacaatgctttgtgtgcgcccagtgctttcagcagttcccagaagggttattttacgagtttgaggggcgaaagtactgtgaacacgactttcaaatgttgttcgccccttgctgccaccagtgcggcgagtttattataggacgcgtgattaaggctatgaataacagctggcacccggagtgttttcggtgcgatctttgtcaggaggtgctagctgatataggcttcgttaaaaatgctgggaggcacctgtgcagaccttgccacaacagagagaaagcccgaggactgggtaaatacatctgccagaagtgccatgccattatcgacgagcagccactcattttcaagaacgacccctatcacccagaccatttcaattgcgctaactgcggcaaagaactcacggccgacgccagggagcttaaaggcgagctatattgtctgccttgccatgataagatgggggtgcccatttgcggtgcctgtaggcgtccaatagaaggcagagtcgtgaacgctatgggaaaacaatggcacgtggaacactttgtgtgcgccaagtgcgaaaaaccttttctgggccacaggcactacgaaagaaagggtttagcttactgcgaaacacactacaatcagctttttggtgatgtgtgctttcactgtaaccgcgtcatcgagggggatgtcgtgtcagcactgaacaaggcttggtgtgtgaactgttttgcttgttctacttgtaatacaaaactgaccctcaaaaacaagttcgtagagtttgatatgaagcctgtgtgtaagaaatgttatgagaagtttccactcgagctgaagaagagacttaaaaagctggccgagactcttggaagaaaatag

SEQ ID NO: 51080 - DNA, 1014 bp, Artificial Sequence
  Description of Artificial Sequence: Synthetic coding sequence
atgttaggagtagctgccggaatgacccactccaatatggcaaacgccctcgcaagcgccacatgcgagcggtgcaaggggggatttgccccagcagagaagattgttaatagtaatggtgagctgtaccacgagcagtgctttgtctgcgcccagtgctttcagcaattcccggagggactcttctatgaatttgagggccgtaagtactgtgaacatgacttccaaatgctgtttgccccttgctgtcaccagtgcggggagtttattattgggagagtaatcaaggcgatgaacaacagttggcatcctgagtgttttcgatgcgacctgtgtcaggaggttttggctgacattggatttgtgaagaacgccggacgccatttgtgccggccttgtcacaatagagaaaaagcgaggggtttgggtaagtatatttgccagaagtgccacgctataattgacgaacaaccactcattttcaagaatgatccgtaccatccagaccactttaattgtgccaattgtgggaaagagttgaccgccgacgcgcgagagctgaagggagagctgtactgcctcccgtgccacgacaagatgggggtacccatttgtggtgcctgcaggagacctatcgagggcagagtagtcaatgctatgggcaagcaatggcacgtggagcactttgtatgtgccaagtgcgaaaagcctttcttaggccacagacattacgagaggaagggactcgcgtactgcgaaacccattataaccagttgtttggagacgtctgcttccactgcaaccgcgtcattgagggagacgtggtctccgccctgaacaaggcatggtgtgtgaactgcttcgcttgctcgacctgcaacactaagttgaccctgaaaaacaaattcgtggagttcgatatgaaaccagtgtgcaagaagtgctacgagaagttcccactggagctgaagaaaagattgaaaaaacttgccgagaccttggggaggaaatag

SEQ ID NO: 51081 - DNA, 1098 bp, Artificial Sequence
  Description of Artificial Sequence: Synthetic coding sequence
atggccgctagactgggagcgctagctgccagcggactgtatcggagaagacagcaccgacagagtcctccgcctgccactggaaatatgtcagacgcgctagccaatgcggtttgtcagcgatgccaggctagattcagccctgcagaacgtatcgtgaattcaaacggtgagctctatcacgagcactgctttgtctgcgcacaatgttttcgtcccttccctgaaggtttattctacgagttcgagggcagaaagtactgtgagcatgactttcagatgttgttcgccccttgctgcgggtcctgcggggagttcattataggtcgggtcattaaagccatgaacaataattggcatcccggatgctttcgctgcgagctgtgtgatgtcgagctcgcagatctcgggtttgtgaagaacgcagggagacatctgtgtcgcccatgtcataacagagagaaggcaaagggtctggggaagtacatctgccagaggtgtcacctggtgattgacgagcaacctttaatgttcagatccgatgcatatcatccagaccacttcaactgtacccactgcgggaaagaactgacagcagaggcacgggagctaaagggagaactctattgccttccttgccacgacaagatgggtgtaccaatctgtggcgcatgcaggcgacccatagaggggagggttgttaacgccctgggaaagcaatggcacgtggagcacttcgtctgcgcaaaatgtgaaaagcccttcctcggccataggcactacgagaagaaaggtctggcatactgcgagacccactataaccagctgtttggtgatgtttgttacaattgcagccacgtgatagaaggggacgtcgtcagtgctctgaataaggcttggtgtgtgagctgtttctcatgcagcacctgtaatagcaagttaaccctcaaaaataaattcgtggagtttgatatgaaaccagtttgcaagcgctgctacgagaaatttccacttgagctgaaaaagcgcctgaagaagctttccgaactgacatctcggaaggctcagccaaaagccaccgacctgaattctgcctag

SEQ ID NO: 51082 - DNA, 750 bp, Artificial Sequence
  Description of Artificial Sequence: Synthetic coding sequence
atggagtctaggcatcccgcagtggccgagattgcgtgcacatgttgggcactgctgcacttagccaatccagaaggaagaggccatctctgcaggccatgccataatcgggagaaagctaaaggtcttggaaaatacatatgccaacggtgtcacctggtcattgatgagcagccattaatgttcagatcagacgcataccacccagaccatttcaactgtactcactgcggcaaggaattaacagctgaggcaagggaactgaagggggaactgtactgcctcccctgccatgacaagatgggggtgcctatctgcggcgcatgtcggcgacccatcgaaggacgggtggtcaacgcactggggaagcagtggcacgtggagcactttgtgtgtgcaaaatgtgagaagccctttctgggacacaggcactatgagaagaaaggtctcgcgtactgcgaaacacattataatcagctattcggggacgtgtgctacaactgctctcatgtgatcgagggcgacgtggtgagcgcgctgaataaggcttggtgcgtatcatgttttagctgttccacttgtaatagcaaactaacactcaagaataagttcgtggagtttgacatgaaacccgtttgcaagaggtgctatgagaaatttcctttagagctcaaaaaaagactcaaaaaactgtctgaactcacttctcgcaaagcgcaacccaaggccacagaccttaactccgcctag

SEQ ID NO: 51083 - DNA, 1026 bp, Artificial Sequence
  Description of Artificial Sequence: Synthetic coding sequence
atgaccggtagcaatatgtcagatgcacttgccaacgccgtttgtcagaggtgccaggcgcgattcagtccagcagagaggattgtgaatagcaatggcgagctgtaccatgagcactgctttgtgtgcgcccagtgctttcgccctttccccgagggtctgttttacgagttcgagggacgcaaatactgcgaacatgatttccagatgctgtttgcaccatgttgcgggagctgcggagagtttatcattggacgtgtgatcaaagctatgaacaacaactggcatccgggatgtttccgctgtgagctgtgcgacgtagaattagccgatttgggattcgtaaagaacgccggtcgtcatctctgtcggccatgtcataaccgggaaaaggccaaaggtctcgggaaatatatctgtcagaggtgtcatctagttattgatgagcaacccttgatgtttagaagtgatgcctatcatcccgaccactttaattgcactcactgcggtaaagagttaacagccgaggccagagaactcaaaggcgagctatactgcctgccttgtcatgacaagatgggggtcccaatctgcggcgcttgccgacgacctattgaaggacgtgtggttaacgcattggggaaacagtggcacgttgaacattttgtgtgcgcaaagtgcgagaagccgttcctagggcacaggcattatgaaaaaaagggattggcatactgtgaaacgcactataatcagttgtttggcgacgtgtgctacaattgttcgcacgtgatcgagggtgatgttgtttcagcactcaacaaggcatggtgtgtttcgtgtttttcttgttcaacctgtaattccaaactgacactgaaaaacaagtttgtggagttcgatatgaagccagtgtgtaagcggtgttacgagaaattccctctcgaactgaaaaagaggttgaagaagctctctgagcttacctctagaaaagctcagccaaaggctaccgacctgaatagcgcctag

SEQ ID NO: 51084 - DNA, 570 bp, Artificial Sequence
  Description of Artificial Sequence: Synthetic coding sequence
atgtttaggagtgacgcttatcacccggatcatttcaattgcacacactgcggcaaagagcttactgccgaagcgagggagctcaagggcgagctttactgcctgccatgtcatgacaaaatgggagtgcccatttgtggcgcatgtcgtagaccaattgaggggagggtcgtgaacgcactgggtaagcagtggcacgtagagcatttcgtgtgcgcgaaatgcgagaagccctttttggggcatcggcactatgaaaaaaaagggctggcatactgcgaaactcactacaaccagctgttcggagacgtgtgctacaattgctcccacgtgattgaaggcgatgtagtgtcagcccttaataaggcctggtgcgtgagctgtttcagctgttctacctgtaatagtaagctgactttgaagaataaattcgtggagtttgacatgaaacccgtctgcaaacggtgttacgaaaaatttccattagaactgaaaaaacgattgaaaaagctgagcgaacttacctcccggaaagcacagcctaaggcgaccgacttgaattccgcgtag

SEQ ID NO: 51085 - DNA, 570 bp, Artificial Sequence
  Description of Artificial Sequence: Synthetic coding sequence
atgtttcggagcgatgcgtatcatcctgaccattttaactgtacccactgtggcaaggaactaacagccgaggcccgagaattgaagggcgagttgtactgccttccatgccacgataagatgggagttcctatttgtggcgcttgtcgtagaccaattgagggccgagtggttaatgccctgggcaagcagtggcacgtcgagcattttgtctgtgcaaagtgcgaaaagccgtttcttggtcaccgccactacgagaagaaggggcttgcttactgcgagacccattacaaccagctgttcggcgacgtttgttacaattgctctcatgtgatcgaaggggacgtggtctcggctctgaataaggcctggtgtgtttcatgtttcagttgcagcacttgcaattccaaattgactttgaagaacaagtttgtggaattcgatatgaagccagtgtgcaaaaggtgctacgagaaattccctctcgaactcaagaaacggcttaagaaactctccgaattaacctccaggaaagctcagcccaaagcaacagacttgaatagtgcctag

SEQ ID NO: 51086 - DNA, 1011 bp, Artificial Sequence
  Description of Artificial Sequence: Synthetic coding sequence
atgagcgatgccttggccaacgcggtctgtcagaggtgccaggcaagattcagcccagccgagagaatcgtgaattctaacggtgagctctaccacgagcactgttttgtttgcgcacagtgtttccgaccttttcccgaaggcctcttttacgagttcgagggaaggaaatattgtgagcacgattttcagatgctattcgctccatgttgtggcagctgtggggagtttataattgggcgagtaattaaagctatgaataataactggcaccccggatgtttcagatgcgagctgtgcgatgtcgagctagccgacctcggattcgtaaagaacgctggcaggcatctgtgccgaccctgtcacaaccgggaaaaagcgaagggcttaggaaaatatatttgtcagagatgccacttagttattgatgaacaaccactgatgttccgctctgacgcatatcatcccgatcatttcaactgcacccattgtggcaaggaactgacggcggaagcaagggagctgaagggggagctttattgtttaccttgccatgacaagatgggtgttccgatctgcggagcatgccgacggcctattgaaggcagagtggtgaatgctctgggaaagcagtggcatgtggagcacttcgtatgtgccaaatgcgaaaaacctttcttagggcacagacactatgagaagaagggcctggcctactgcgagacccattacaatcaactgtttggggatgtgtgctataattgttcacatgtgatcgagggcgacgtggtgtctgcccttaataaagcatggtgcgtctcgtgtttctcatgttccacctgcaactctaagcttacactgaagaataaatttgtcgagttcgatatgaaacctgtatgcaaacgttgctatgagaaattcccgctcgagctcaagaaaagactgaagaaactctcagaactgaccagtcgcaaggcacagcctaaagctacggaccttaattctgcatag

SEQ ID NO: 51087 - DNA, 570 bp, Artificial Sequence
  Description of Artificial Sequence: Synthetic coding sequence
atgtttaggagcgacgcgtatcaccctgatcactttaattgtacacattgcggcaaagaacttaccgccgaggccagagagctgaagggcgaactgtactgtttaccctgccatgataaaatgggggtgcctatctgcggagcttgcagacgaccaattgaaggtagagtggtcaacgcactgggtaagcagtggcatgtggagcattttgtctgcgccaagtgcgaaaagcctttcctggggcaccgacattatgaaaaaaaggggttggcttactgcgagacacattacaatcagttgtttggcgatgtttgctacaattgttcacacgtcattgagggtgacgttgtcagcgctcttaacaaagcatggtgtgtgagttgtttttcatgtagtacctgtaactccaaactgaccctgaagaacaagttcgtggagttcgacatgaagcccgtgtgcaaacgctgttacgagaagttcccattggagctcaaaaagagactgaagaagctgtcagagctcacctccaggaaggcacagcccaaagcaaccgacttaaactctgcatag

SEQ ID NO: 51088 - DNA, 1011 bp, Artificial Sequence
  Description of Artificial Sequence: Synthetic coding sequence
atgagcgacgccctcgcgaatgccgtgtgccaaagatgccaggcgagattctcccctgcggagcggatcgtaaattcaaacggagaactgtatcatgaacactgctttgtgtgcgctcagtgtttccggccatttccagagggcctcttctacgagtttgaaggcagaaaatattgcgagcatgacttccaaatgctgtttgctccctgttgcgggtcctgcggggagtttatcattggcagggttatcaaggccatgaataacaactggcatcctggatgtttccggtgtgagctttgcgatgttgagctcgccgacttagggttcgtaaagaatgccggtagacacctgtgtagaccatgccacaatagggagaaggccaaaggactgggtaagtatatttgccagcgctgccatcttgttatagatgaacagccgctcatgttccgttcggacgcctaccaccccgatcacttcaactgtacccactgcggtaaggaacttacagcggaagcaagggagctgaaaggggaactctattgtttaccctgtcatgacaagatgggcgtcccaatatgcggggcttgtaggcgcccaatcgaaggaagagtcgtgaatgccctggggaagcagtggcacgtcgaacatttcgtgtgcgcgaaatgtgaaaagccattcctggggcatcggcactacgaaaaaaagggcctcgcttactgcgaaacccactataaccagctctttggcgatgtgtgctacaattgttcccacgtgatcgagggtgacgtggtgtcggccctgaataaggcatggtgcgtttcctgtttctcttgttccacttgcaactcaaaactgactctgaaaaataaattcgtggagttcgacatgaaaccagtttgcaagcgctgttatgaaaagttccctctcgagctgaaaaagcggctgaaaaaactctcggagctgactagccgcaaagcacaaccaaaagcgacagacctgaattctgcctag

SEQ ID NO: 51089 - DNA, 1011 bp, Artificial Sequence
  Description of Artificial Sequence: Synthetic coding sequence
atgagcgacgcattggccaacgcagtctgtcagcggtgccaggcaagattttccccagctgagcgaatcgtgaatagcaacggcgagctttaccatgaacattgctttgtctgcgcacaatgctttaggcccttccccgaaggcctgttctatgaatttgagggacggaagtactgcgaacatgactttcagatgctgtttgcgccttgttgtggctcctgtggtgaattcatcataggcagagtaatcaaagcaatgaacaacaactggcaccctggatgtttcagatgcgagttgtgtgatgtggagctggcagatcttgggtttgtcaaaaatgccggacggcacctctgccgaccttgtcataacagggagaaggctaaaggcctgggcaaatacatctgtcaacgctgtcatctagtgattgacgaacagcccctgatgtttcgatctgacgcctatcaccccgaccattttaattgcacccactgcgggaaagagctaacagctgaagcacgtgaactgaagggagaactgtattgcctcccatgccacgataagatgggggtcccgatatgcggtgcatgccgccgtcccatcgagggtcgcgttgtcaatgctctcgggaagcagtggcacgtggagcactttgtgtgtgcgaagtgtgagaagcccttcctcggccaccgacattacgagaaaaagggactagcatactgcgagactcactataaccagcttttcggcgacgtgtgctacaattgcagccacgttatcgaaggcgatgttgttagcgccctgaataaagcttggtgcgttagttgttttagttgctctacatgcaactcaaagctcaccctgaagaataaattcgtagaatttgatatgaaaccagtctgtaagcgttgctatgagaagtttcccctggagctgaagaagagactgaaaaaacttagtgaactgacatcacggaaagctcaacctaaagccactgacctgaactctgcttag

SEQ ID NO: 51090 - DNA, 570 bp, Artificial Sequence
  Description of Artificial Sequence: Synthetic coding sequence
atgtttcgctccgatgcctaccatcccgatcactttaactgcacccactgcggaaaggagctgacagcagaggccagggagctcaagggtgaactgtattgcttaccgtgccatgacaaaatgggagtgccaatatgcggtgcctgtcggaggccaattgagggacgcgtcgttaacgcactcggcaaacagtggcacgtggaacactttgtgtgtgcaaaatgcgagaagccatttttgggccatagacattacgaaaaaaagggcttggcgtactgtgaaacccactacaatcagttgttcggcgacgtctgttacaactgtagccacgtcatcgaaggtgacgtggtctcggcactgaacaaagcctggtgtgtgagttgcttttcttgtagcacctgtaacagcaagctgacacttaagaacaagtttgtggagttcgatatgaaaccagtttgcaaaagatgctacgagaagttccctctagaactaaagaagcgactcaaaaaactgtctgagttgaccagccgtaaagcccagcctaaggctacagacttaaactctgcctag

SEQ ID NO: 51091 - DNA, 1011 bp, Artificial Sequence
  Description of Artificial Sequence: Synthetic coding sequence
atgagcgacgccctcgcgaatgcagtctgccagagatgtcaggcaagattttcacccgcagagcgcattgtaaacagtaatggtgagctctaccacgagcattgcttcgtgtgtgctcaatgcttccggccattcccagagggactcttctacgagtttgaaggaagaaagtactgcgaacacgactttcagatgctgttcgccccatgttgtgggagttgcggtgaatttattatcggacgcgttatcaaggccatgaacaacaactggcatcctggctgtttccggtgcgaactgtgtgacgtggagttggcagatctggggttcgtcaaaaatgctggtcggcacttgtgccgcccatgtcacaatcgcgagaaggccaaaggcctgggaaaatatatctgccagcgatgtcatctggtgatcgacgaacagccactaatgtttcggagcgatgcctaccatccagatcactttaactgcacgcactgtgggaaagagctgaccgctgaggcaagggaattgaaaggtgaactatattgccttccctgtcacgacaagatgggagtgccaatctgcggtgcctgtagacgtcctattgagggtagagtcgtaaacgctctgggcaaacagtggcatgtggagcactttgtctgtgcaaaatgcgagaagccttttttggggcaccgacactatgagaagaaggggctcgcttattgcgagacacattacaaccagctatttggtgacgtgtgttacaactgtagtcatgtcatagagggagatgttgtctctgctttgaacaaagcatggtgtgtcagttgcttttcatgctcaacatgtaactctaagctgacacttaaaaacaaattcgtcgaattcgatatgaagcccgtgtgtaagcggtgctatgagaagtttcctctggagctgaagaagcggttaaagaaattatccgagttgacctcccggaaagcgcagccaaaggctactgatttgaatagcgcttag

SEQ ID NO: 51092 - DNA, 441 bp, Artificial Sequence
  Description of Artificial Sequence: Synthetic coding sequence
atgtccgatgctcttgcgaacgccgtctgccagcgctgccaagccagattctctcctgcggagcgaatcgtgaattcgaatggggagctgtatcatgaacactgcttcgtgtgcgcccagtgctttaggcctttccctgagggactgttctacgaatttgaagggaggaagtattgtgaacatgactttcagatgctgttcgctccctgctgcggctcctgtggcgaatttattatcggcagggttataaaggccatgaacaacaactggcaccccggttgttttagatgtgagttatgtgacgtcgagttggccgacctaggcttcgttaaaaacgccggtcgtcacctgtgccggccatgtcacaaccgtgagaaagccaagggcctcggaaaatacatatgtcagagatgtcacctcgtcattgacgaacagccttag

SEQ ID NO: 51093 - DNA, 570 bp, Artificial Sequence
  Description of Artificial Sequence: Synthetic coding sequence
atgtttcgctctgatgcatatcatcccgatcatttcaattgtactcactgtggcaaggagttgaccgctgaggctcgcgaactgaagggtgagctttattgtctgccctgccatgacaagatgggtgtgccaatatgcggagcctgccgccgtccaatcgagggacgagtcgtgaacgcattagggaagcagtggcacgtagagcattttgtgtgtgctaaatgcgagaagccttttctgggccatcgtcactatgagaaaaaaggcctggcatattgcgagacccattataatcagctcttcggagacgtgtgctataattgctcccatgtgattgagggtgatgtcgtgtctgcattgaataaagcttggtgcgtgagttgtttctcttgcagcacatgtaactccaagctgaccctgaagaacaagtttgtggagttcgacatgaagcccgtgtgtaaaagatgctatgagaagttcccactggagctgaagaagagacttaagaaactgagcgagttgacttccaggaaagcacagcccaaggccacagacctgaattccgcttag

SEQ ID NO: 51094 - DNA, 1092 bp, Artificial Sequence
  Description of Artificial Sequence: Synthetic coding sequence
atgactggtcggaagagaaaatggggtgaaactggcacgggatctggggcagctcctgcggctgcgttgcgctggtcaaatatgagcgacgcgctcgctaacgctgtctgccagagatgtcaagctagattcagtcccgcagaacgcattgttaacagcaatggcgagctgtatcacgagcactgtttcgtgtgcgcgcagtgctttaggccttttcccgaaggtctgttttacgagttcgaggggaggaaatactgcgagcatgatttccagatgctgtttgccccttgttgcggttcttgtggcgagttcattattgggagagttatcaaagccatgaacaataactggcatcccggttgcttccgatgcgaactctgtgacgttgagttggccgacttaggattcgtgaagaatgccggaaggcacttatgtagaccttgtcacaatcgtgaaaaagccaaaggattaggcaagtacatttgccagcgatgccacctggtgatcgacgagcagccgttgatgttcagatctgatgcctatcaccctgatcactttaactgtacacactgtggcaaggagctgaccgctgaagccagggaactgaagggtgagctctactgtctgccatgtcatgataaaatgggtgtgccaatttgcggtgcgtgtcggaggccaatagagggacgcgtggttaatgctctcgggaaacagtggcatgtggaacacttcgtgtgcgcgaagtgcgagaagccattcctgggacaccgccattacgaaaaaaaaggtctggcttactgcgagactcactacaaccagctcttcggggacgtttgctataactgcagccacgttatagagggggacgtggtgtccgcactgaataaggcttggtgcgtcagctgcttttcctgctccacatgtaactcaaaactaacactgaagaataagtttgttgagtttgatatgaagcccgtgtgtaagagatgctacgagaaatttccactggagcttaagaaaaggctgaaaaagctcagcgaattaacatctaggaaagcgcaacctaaagctactgatctcaatagcgcctag

SEQ ID NO: 51095 - DNA, 1092 bp, Artificial Sequence
  Description of Artificial Sequence: Synthetic coding sequence
atgacagggcgaaaaagaaagtggggagaaacaggcactggatccggcgcagcccctgccgctgctctaaggtggagcaacatgagtgatgccctggctaacgcagtgtgccagaggtgccaagccaggttctctccggctgaacgaatagtcaatagtaatggtgaactgtatcacgagcattgcttcgtgtgtgcccagtgcttccgaccgtttcctgagggcctgttttacgagttcgaaggtcgcaaatactgcgagcacgacttccagatgctgttcgcgccatgctgtggctcgtgtggagagtttatcatcgggagagtaatcaaggccatgaataacaactggcaccccggatgtttccggtgcgagctctgcgacgtggagctggccgacctcggatttgtgaaaaatgcaggtcggcatctgtgccgaccatgccacaatcgcgaaaaagcaaaaggcctcggaaaatatatatgccagcggtgtcacctagtcatagatgagcagcctctcatgttcaggtctgatgcctaccatcccgaccacttcaactgcactcactgtggaaaagaattgaccgccgaggctagggaactcaagggcgagctctactgcttgccctgtcacgacaagatgggtgtgcctatttgcggtgcctgcagaagacccattgagggtcgggtggttaacgcgctcggcaaacagtggcacgttgagcacttcgtgtgcgcgaaatgcgagaagccctttctgggacacagacattacgagaagaagggccttgcctactgtgaaacccactataaccaactattcggcgacgtatgttataattgcagtcatgtgattgagggggacgttgtgtctgcactgaacaaggcctggtgcgttagttgcttctcctgctctacatgcaactccaagctaacactgaaaaataagtttgtggagttcgatatgaagcccgtctgtaagcggtgctacgagaagtttccattggagttaaagaaacggctgaagaagctgagtgagctcacttctaggaaagcccagcccaaggccacagacttgaatagtgcttag

SEQ ID NO: 51096 - DNA, 702 bp, Artificial Sequence
  Description of Artificial Sequence: Synthetic coding sequence
atgcttaaaccaagcgttacaagcgctccaacggcagacatggccacactaacggtggtccagccgctgaccctcgatcgggacgtggccagagctatcgaactgttagagaaactgcaggagtccggggaagtcccggttcacaagcttcagtctcttaaaaaagtcctgcagtcagaattttgcaccgctatccgagaggtatatcagtatatgcacgagactatcaccgttaatggttgccctgagtttagggccagggcgactgcaaaagctacagtagctgccttcgccgctagtgaagggcactcacatcccagagtggtcgagttaccaaaaacagatgagggcttgggattcaatgtaatgggaggtaaagaacagaacagtccgatctatatctcccggatcattcccggaggtgtggccgaacgacatggtgggcttaaaaggggcgaccagctgctctcagtgaacggggtgagcgtggagggcgagcaccatgaaaaggccgttgaactgttgaaagcagcaaaggattctgtcaagctggtggttcgctacaccccaaaggtgctggaggagatggaagctcggttcgaaaagctccgtacagctagaaggcgccagcagcagcagcttctgatccagcagcagcagcagcaacaacagcaacagacacagcagaatcacatgtcatag

SEQ ID NO: 51097 - DNA, 858 bp, Artificial Sequence
  Description of Artificial Sequence: Synthetic coding sequence
atgaaggtgaccgtaggacccgatccctccctggtctaccgtccagatgtggatccagaagtcgctaaggacaaggcctcgttcaggaactataccagcgggcctttgcttgatagggtgtttaccacatacaagcttatgcatacacaccaaaccgtcgacttcgtccggtcaaagcacgcacagttcggcggtttttcctacaaaaagatgacagtcatggaggccgtagatctcttggacggattagtggacgagtccgatcccgacgtcgacttcccaaatagcttccacgccttccagactgccgaaggaattcggaaagctcaccccgataaggattggtttcacctagtcgggctgctccatgacctgggcaaagtcctggcactgttcggcgagccccaatgggcagttgttggggacacctttccggtaggctgcaggccacaggcttcagttgtgttttgcgactccactttccaggataatcccgacttacaggatcctaggtatagcacagaactggggatgtaccaaccacactgcggactagatcgagtccttatgtcttggggccatgacgagtacatgtatcaggtgatgaagttcaacaaattttctttgcccccagaggccttttatatgatccgatttcattctttctatccatggcatactggcagagactatcagcaactttgctcacagcaggatttagcaatgcttccttgggtgcgggagtttaacaaatttgacctttacaccaagtgtccagacctgccggatgtcgataaactgagaccatactaccaggggctgatcgataagtactgccctggtatcctgtcttggtag

SEQ ID NO: 51098 - DNA, 1785 bp, Artificial Sequence
  Description of Artificial Sequence: Synthetic coding sequence
atggccggtagcaggctccctcgccagcttttccttcagggcgtggccgcagtgtttatgttcgctttcgcaagtctctacacacagattcctgggctctatggcccagaaggcatcctccccgcacgcagaactctgcggccacaggggaaggggagatggcagcagctgtgggaaacccctactctgctatgggaggctccgcgacttgggctcgatacagcacagggtctggagttgttatccctgcttggtgctcttgtggctctaggcgcactgctgctgtcacccctgcgacatcctgtcatataccttctcttatgggcagcctatctgtctgcctgccaagtgggccaggtgttcctgtacttccagtgggactctctgcttctggagaccgggttcctggctgtgctggtcgccccactccgcccagctagccaccggaaggaggccccacagggcaggcaagcaggggcattaccacatgaggacctgcccttttggctcgtaagatggctactctttcgcctgatgttcgcttcaggggtcgtgaagctgactagccgatgtcctgcttggtgggggctgactgctctaacctaccactatgagacccagtgcctgcccacaccagccgcttggtttgcacatcatctgcccgtttggctgcataagctttccgtggtcgctacattcctgatagagatcgccgtgccaccgctgttcttcgcccctattagacgcctccgcctggcggcattttactcccaggtgctgctccaagtgctgatcattatcactgggaactacaacttttttaatcttatgacacttgtgttgaccaccgcactgctggacgaccaacatttggcagcagaacctggccacggctccaggaaaaaaacagcaacatcgtggcccaaggccttgttggccacgctctcgctactgctggagctcgccgtgtatggcctcctcgcttacggcacagtgcattatttcggattggaagtcgattggcagcaaagaacaattcacagcagaacgacattcacttttcaccaattttcacaatggctcaagaccctgactctgcccacagtgtggcttggtgtggctagcttagtttgggaattactgagcgccctgtggcgctggacccaagtgcgcgattggcagatgtggttcgctgctctgggcccacacactcacagtccatggtttacatcactcgtgcttagactgctacagggtaaagaacctgtgattagacttgtgcaaagccaggttgctaggtacccatttcacaaacagccccctacttatgttcgcgcacaacgctacaagtactggttttctcagcctggcgaacagggccagtggtggcgtcggcaatgggtggaggagttttttccttctgtgtcattgggtgacccaaccctggagacgctcctgaggcagttcgggctgcaagagaaatcacccccacggacacggtctgccaacagcacgcttgctcaggcccttcattggactcggtcccagctcagtccattagaagccccagccctcttgtggggtctcctgatggctgtgggcgctgtaagattcgtgcaagctctgctggctccatgttccctcagatctagcccactagcgcctgtctccggcgagaaaaggcgtcccgcttctcagaaggatagcggagctgcatctgaacaagctactgccgctccaaacccctgctcttcatctagtaggaccacccgcagaaaaaaatag

SEQ ID NO: 51099 - DNA, 2124 bp, Artificial Sequence
  Description of Artificial Sequence: Synthetic coding sequence
atggctggtagcaggctgcctaggcagttgttcctgcagggcgtcgctgcagtttttatgttcgccttcgcatctctgtacacacagatcccaggcctctatggcccagaagggattcttcccgctagacgcacgctgcggcctcaagggaagggacgctggcaacagttgtgggaaactcctacactgctttgggaggcaccaagactgggccttgataccgcccagggtctggaacttctgagccttctgggagcacttgtcgccctgggcgctctgcttctctcccccctgagacacccggttatctacctgttactctgggctgcttatctcagcgcatgtcaggtgggacaggtcttcctctactttcagtgggactctttattattggaaaccgggttcctggctgtgctagtagccccattgcggcctgcgtcgcaccggaaagaagcgcctcaggggaggcaagcaggcgcacttccccacgaggacctgccattctggctggtacggtggttgctctttcgcctcatgttcgccagtggcgtggtaaaactcactagccgatgtcctgcatggtggggcctgaccgcactcacttaccactatgaaactcaatgtcttcctactcccgctgcttggttcgcccaccacttgccagtgtggttacataaactctccgtggtggccacctttctcatcgagatcgccgtccctccattgttctttgcaccaattcggagactccggctggccgcattttattctcaggtgttgctacaggtgctgattatcatcactggaaactacaactttttcaacctcatgaccctcgttctgacgaccgccctccttgacgatcagcacttggctgctgaacctggtcacgggagccgcaaaaagacggccacctcatggcccaaggcgctactggccaccctttctctactgctggaactcgccgtgtacggccttctggcctatggcacggtgcactattttggcctggaagttgattggcagcagcgaactatccactccaggacaacatttactttccatcagttttcacaatggctgaagacactgacgctgccgacagtgtggttgggtgtggctagtctggtctgggagctgctatctgccctatggaggtggacacaggtccgcggatggctaaggaagctgtccgccgtggtgcagctctctctggtcggaaccgctaccgtcgccctcttcctaattagtctggttccatacagttacgtcgagccagggactcatggtcgcctgtggaccggcgctcataggttattcggagccgtggagcatctacagcttgccaacagttacggtctgtttagacggatgacgggtctgggcggaaggcctgaggtcgtgctcgaagggagttatgacggccaccactggaccgaaatcgaatttatgtacaaacctggaaacctgagcagacctccgcctgtggttgtccctcatcagcccaggctggactggcaaatgtggttcgcagctctgggccctcacacccacagcccgtggttcacctcccttgtgctccgcttgcttcaggggaaagagcctgttatccggctagtgcagtcccaggtggccagatatccttttcacaaacaacccccaacatatgtgcgggctcagagatacaaatactggttctcgcaacccggagagcagggccaatggtggagacgacagtgggttgaagagtttttcccctcagttagcctgggcgatccaacactggagaccttgctccgtcagttcggcctgcaagaaaaatcaccacctaggacccggagcgccaactcaaccttggcccaggctttgcactggacgagatcccaactgagtccgctagaggccccagcactcttatgggggctccttatggctgtgggtgccgtgagattcgtacaggcgcttctcgccccatgctcattacgctcctcccccctggctcctgtatctggagagaaaaggcgcccagctagccagaaggatagcggtgccgctagcgaacaggccactgctgcgccaaacccttgcagttcttcctcccgcaccacacgtagaaagaaatag

SEQ ID NO: 51100 - DNA, 978 bp, Artificial Sequence
  Description of Artificial Sequence: Synthetic coding sequence
atggcggtcgggaacaacacccagcggagttacagcatcattccttgtttcatcttcgtggaacttgtgatcatggctggcaccgttctgttagcgtactattttgagtgtacagacacttttcaagtacatattcagggcttcttctgccaggacggcgacctgatgaaaccatacccaggaactgaggaagaaagttttataactcctctagttttgtactgcgttctggctgcgacccctactgccataatattcataggcgaaatctccatgtattttattaagtcaacccgggaaagtctgatcgctcaggaaaagactatcctaactggtgagtgttgttacttaaaccctttgttgcgcagaataattcggtttacaggagtgttcgcatttggtttgttcgccacagacattttcgttaacgccggtcaggtagtcactggccatctcactccttattttctgactgtgtgcaaacctaattacacctctgcagattgtcaggctcaccatcaatttatcaacaacggcaatatttgcaccggggacctggaggtgatcgagaaggccaggcgctcattcccttccaaacatgcagccctgtcaatttacagcgctctctacgcaaccatgtatattacttctacgattaagacaaagagcagccgcctggccaaacccgtcctctgcctgggaaccctgtgtaccgcttttctcaccggtctgaatagggtttccgagtacagaaaccattgttccgacgtgatcgccggatttattttgggaactgcagtggcgctttttttggggatgtgtgtcgttcataatttcaagggaacgcagggctcgcccagtaaacctaagcctgaggaccccagaggtgtacccctcatggcatttccaagaattgagagcccccttgaaaccttgtcggctcagaatcattccgcctctatgaccgaagtgacttag

SEQ ID NO: 51101 - DNA, 978 bp, Artificial Sequence
  Description of Artificial Sequence: Synthetic coding sequence
atggccgttggcaacaacactcagcgctcatatagcatcatcccatgctttatttttgtcgaactcgtgattatggcaggcaccgtacttctagcctattatttcgagtgtactgacacctttcaggtgcacattcagggttttttttgccaggacggagatctgatgaagccataccccggaacagaggaggaatcctttattactccacttgttctgtattgcgtcttggccgctactccaaccgcaataatattcataggcgaaattagcatgtacttcatcaagtccacaagggagtccctgatcgcccaagagaaaaccattcttacaggcgagtgttgctatctcaacccactgctacgacggatcatcaggttcactggagtgttcgcgtttggcctttttgctacagatatctttgtgaatgcaggccaggttgtaacagggcatctgaccccatactttctgaccgtttgcaagcctaactacacgtccgcagactgtcaagcacatcatcaatttataaacaatggcaacatctgtaccggcgacctcgaggtcattgagaaggccaggcgatctttcccatctaagcatgccgctctctccatctactctgccctctacgcaacgatgtacataacatcgaccatcaagaccaagagtagtaggctcgccaagcccgtgctttgcctgggaactttgtgcacagcattcctaaccggactgaaccgtgtgtctgagtatcgcaaccactgctctgacgtgatagccggatttatcctcgggacagctgtggccctgtttctaggtatgtgcgtcgtgcataactttaaaggtactcaggggtctccatccaaaccgaaaccagaggaccctcgaggagttcccctcatggcttttccacggattgagtctccacttgaaacgctctcagcccagaaccactctgctagtatgactgaggtgacatag

SEQ ID NO: 51102 - DNA, 978 bp, Artificial Sequence
  Description of Artificial Sequence: Synthetic coding sequence
atggcagtgggcaacaacactcaaagatcctactccatcatcccatgttttattttcgtagagttggtaattatggcaggaaccgtgcttctggcctactacttcgaatgtacagacacgttccaggtgcacatacagggctttttctgtcaggatggggacctgatgaagccctatcccggaactgaggaggaatctttcatcactcccctagtgttatattgcgtcctggccgcaacccccaccgcaatcatttttatcggcgaaatcagtatgtactttattaaatccacccgcgaatctttgattgctcaggagaaaactattttgaccggcgaatgctgctacctaaatcctctcctgcgcagaattatccgctttactggggtattcgccttcggcttgtttgccactgatatattcgtcaatgcgggacaagttgttacgggccacttgactccatactttttgaccgtctgcaaacctaattacaccagcgccgactgccaggcacatcaccagttcattaataacggtaatatctgcaccggtgacctggaagtgattgagaaggctagacggtcctttccgagcaagcacgcggctttgtccatctactccgccttgtatgcgacgatgtacatcacttcgacaattaagaccaaatctagcagactcgccaagcccgtgctgtgtttggggacactgtgcactgcttttttgacagggcttaacagggtgtcagagtatcggaatcattgcagtgacgttattgcaggctttatcctggggactgccgttgcattgttcttggggatgtgcgtagttcacaactttaagggcacccagggctccccaagcaagccaaagccagaagatcctcgtggtgtccccttgatggctttccccagaattgaatcgccactggaaacgctgagtgcccagaatcactcagcgagtatgacagaggttacatag

SEQ ID NO: 51103 - DNA, 312 bp, Artificial Sequence
  Description of Artificial Sequence: Synthetic coding sequence
atggcagtgggcaataatacccagcggagctatagcatcataccttgtttcatatttgtggaactggtcatcatggccggtacggtgctgctcgcctactattttgagtgcacagacacatttcaagttcatatccagggcttcttctgtcaggacggagacttaatgaagccttaccctggaacggaagaggagtcctttattactcccctcgttctgtactgtgtgctagccgcaacaccgacagccataatcttcattggcgagatcagcatgtatttcataaaaagtacaagagagtcactgatctag

SEQ ID NO: 51104 - DNA, 1032 bp, Artificial Sequence
  Description of Artificial Sequence: Synthetic coding sequence
atggctggcggtcgccctcatcttaagcggtctttctccattatcccctgctttgtgttcgtggaatcagtcctcctgggaattgtgatcctcttggcctatagactcgagtttacagacaccttccccgtgcacacccagggctttttctgttatgattccacttatgctaaaccataccccggacctgaggccgcttcacgcgtgccacccgctctcgtgtacgccctggtcacagcaggaccgacattaaccatcttactgggtgaactggccagggccttttttccggcacccccatctgctgtccccgtcatcggcgagagcactatagtatctggagcctgctgtcggttctcgcccccagtgaggcggttagtccggttcctgggggtctactcctttggtctatttaccaccaccattttcgccaacgcgggtcaggtagttacgggcaaccccactccacacttcttaagcgtttgccgccctaattatacagcgctgggttgtctgccacctagcccagatagacccggaccagaccggtttgtcaccgatcagggagcttgcgctggctctcctagcttagtagctgctgccaggagagccttcccatgcaaggacgcagccttgtgtgcctacgccgtaacttacactgccatgtacgtcactttggtgttcagggtcaagggatcccgtctggttaagccctccttgtgtctggcactgctatgcccagctttcctggtgggcgttgtccgagtagccgagtaccgcaatcactggagtgacgttctcgccggattcctcaccggagctgcaatcgccacattcttggtgacttgcgtggtccacaattttcagtcaaggcctcccagtgggcgacgtcttagcccgtgggaagatctgggccaggcgccaaccatggatagcccactagagaagaatccaagaagcgccggacggattagacaccgacatggttcgccacacccctcgcggcgtaccgcacccgcagtcgccacctag

SEQ ID NO: 51105 - DNA, 1284 bp, Artificial Sequence
  Description of Artificial Sequence: Synthetic coding sequence
atggctggaggcagaccccacttgaagaggagctttagcatcatcccttgtttcgtttttgttgagggctttttctgttacgactcaacctacgccaaaccctatccgggacctgaggccgcatccagggtgccacctgccctggtgtacgcattggtgaccgcaggacccactctgacaatcctgttgggggagctggccagagccttcttccctgcccctccttccgcggttcctgtgattggcgaaagtacaattgtatcgggagcttgctgtagattttccccacccgtgagacggcttgttagatttctgggagtctactcattcgggctctttaccaccacaatctttgcaaatgcgggacaggtcgtcaccggaaaccccaccccccatttcctgagtgtgtgccgccctaattatactgccttagggtgtctgccccctagtccggatcggcctgggccagatcgcttcgtcacagatcaaggggcttgcgctggcagcccctcccttgtagctgccgcacgtagagcgttcccctgcaaagatgctgccctctgcgcttatgctgtgacttatacggccatgtacgtaacactggtctttcgcgtaaagggaagccgcctggtgaagccaagtctctgtctagcccttctgtgtccagctttcctggttggggtcgtccgcgtcgctgagtatagaaatcactggtcggacgtcctggcagggtttctcacaggagctgcaatcgcgacgtttctcgttacttgtgtggtccacaatttccagagtaggcccccaagcggacggaggttgagcccttgggaggatctggggcaagctccaactatggattctccattggaaaaactgagtgtcgcacaagagcctgaggtgtgcaggccccactccacacctgccaggctgacgccctccaaaagccagaactgtgccagaagaggccatttgatccccagctgcgtaagctcccgtgctccagcgatgtgcagctctccaagagtgccccgacctcgccttagaagtgaacctacccctctccctctccctttgccccttcctgccccaacccccagtcagggaccttcaccttcctctcccggacctgggggacccggtggtggtgggggtagaggccgaaaactcctgctaccaacacccctccttcgggatctgtacacactcagcggcttgtatccaagtccatttcatcgggacaatttttccccatacttgttcgcatctcgagatcaccttttatag

SEQ ID NO: 51106 - DNA, 2160 bp, Artificial Sequence
  Description of Artificial Sequence: Synthetic coding sequence
atgatctcaacaaaggaaaagaacaagattcccaaggattcaatgacgctccttccatgtttctacttcgtggaactccccatcgttgcatcctccattgtctccctgtatttcctggagctcacagacctcttcaagccagccaaagttgggtttcaatgctacgatcgcacgctgagtatgccctatgttgagacaaatgaggagctcatcccactgctcatgctcctgtctctggccttcgcagcccctgctgcctccatcatggtggcagagggtatgctctattgcttgcagtcccgcctttgggggagagctggaggcccagccggagccgaggggtccatcaatgctggtggttgcaactttaactctttcctaaggcggaccgtccgctttgtggccggagttcatgtcttcggactctgcgccaccgcgctcgtgacagatgtcatacagctggctaccgggtaccacactcccttttttcttactgtctgcaagcctaattatacattattgggaacatcttgtgaagtaaacccctacataacacaggacatctgctcgggacacgatattcacgccatcctaagtgcacggaagacattcccctcccaacacgcgaccttaagtgccttcgcagcagtttacgtatccatgtactttaatagcgtcatatccgacaccacgaagctactgaaacctatattggtgttcgccttcgctatcgccgctggggtatgtggcttgacccagatcacacagtacaggtctcaccctgtggacgtatatgccggtttcctaatcggcgcaggtatcgctgcctacctggcttgccatgccgttggcaattttcaagctccaccagctgagaaaccagcagcaccagcccctgccaaagacgccttgcgagcattgacccaacgcggacacgactcagtctatcagcaaaataaatcagttagtaccgatgaactgggacctcctggcagacttgagggcgcaccacgcccagtggctcgtgagaaaaccagccttggctcattgaaacgcgcttctgtggacgtcgatcttctggcacctaggtcacctatggccaaagagaatatggtcaccttttctcacacccttcctcgggcatccgcaccgtccctggacgacccagctaggagacacatgactattcacgtcccactggacgccagccgatcaaaacaactaatctccgagtggaagcagaagagcctggaaggtagaggtttgggactccccgatgatgcatctcctggacacctccgcgcacccgcagagcccatggccgaagaagaggaagaggaggaagatgaggaagaagaagaggaagaggaggaagaagaggacgaagggccagcaccaccttccctgtacccaacagtccaggctagacccggtctgggccctcgcgtgattctgccaccacgcgcaggacctcctcccctggtgcatatcccagaagagggcgctcagaccggcgcaggactgtcgcctaaaagcggtgcaggtgtgcgcgctaagtggttaatgatggccgaaaagagtggagccgctgtggctaaccccccaagactgctccaagtgattgccatgtcaaaggcccctggagcccctggccctaaagccgctgagacagcatcatcaagctctgcctcctctgattctagccagtaccgcagtccgtcagatagggactctgcttctattgtgacaatcgacgcgcacgccccacatcatcccgtcgtgcacttgagcgccggaggagccccttgggaatggaaagcagctggagggggagccaaagcagaggccgacgggggttatgagctcggcgatctcgcaagaggatttcgcggaggggctaagccacccggagtttcccccggttcctccgtgagtgacgtggaccaggaagagcctcgatttggcgctgtagcgaccgtgaatctggcaaccggcgaagggctgccccctcttggagccgcagatggagctttgggaccgggttctcgggaatctactctccgcaggcatgccggagggctgggcctggccgagcgcgaggcagaagccgaagcagaaggttattttcgcaaaatgcaggcgcgacggtttcctgactag

SEQ ID NO: 51107 - DNA, 2241 bp, Artificial Sequence
  Description of Artificial Sequence: Synthetic coding sequence
atgatttctaccaaggagaaaaataagatccctaaggacagtatgaccctgcttccttgcttttatttcgtggagctcccgatagtggcctcaagcatcgtaagcctttactttctggagcttactgatctgttcaagcctgctaaagtagggttccagtgctacgaccgtacattgtccatgccttatgtggagacaaacgaagagctgatccctcttctgatgctcctgagtttagccttcgcagcccctgccgcaagcatcatggtggcggagggcatgctgtattgtctgcagtctcgcctgtgggggcgagccggagggccagctggggcagaaggcagcatcaatgccggtgggtgtaacttcaactcattcctgcggagaacggtgcgctttgtcggagttcatgtcttcggactctgtgcgacagccctggttacggacgttatccagttggcgaccggctatcatacaccattcttcctcaccgtctgcaaacctaactacaccctgttgggtacctcatgtgaggtgaatccctatatcacacaagatatttgcagcggccacgacatccatgctatattgtccgcccgaaaaacctttccaagccagcacgctaccctctcggctttcgccgctgtgtatgtctcagtttcgcctgcaccccactgcccatcccaggcattgctgctgacccgtggcgagccgtctctaactccaactcccatgccccagatgtatttcaattctgtgatttccgataccacaaaattgttgaaacctatcctggtatttgcttttgccatcgctgccggtgtgtgtggactcacccagattactcagtaccggtctcaccccgtggatgtgtacgccggattcttaattggcgcaggaatcgccgcatatctggcctgtcatgccgtgggaaactttcaggcaccccctgccgagaagcccgcagccccagcgcctgcaaaagacgcactgagggccctaactcaacgaggacacgacagcgtgtatcagcaaaacaaatccgtcagcacagacgaacttgggccacccggacgtctcgaaggcgcaccacgacctgtggctcgcgagaaaacctcgctcggcagccttaaacgcgcttcagtcgatgtggacctacttgctcctaggtccccgatggcaaaagagaatatggtgaccttctcccacacactgcctcgagcttctgcccctagcctagatgatcccgctcgacgccacatgaccatccacgtgcctctcgatgcttctcgcagcaaacagcttatcagtgaatggaagcaaaagagtcttgagggtagggggttgggactacctgatgacgcgagccccggtcatcttagggccccagccgagccgatggcagaagaggaggaagaggaggaggacgaggaggaggaggaagaggaagaagaggaggaagacgagggccctgctccgccaagtctatatccaactgtacaggcccgacccggactgggtccgagagtcatcctgccccctcgggcaggtcctcccccacttgtccatatcccggaggagggagcccaaacaggtgctggtctgtccccaaaaagcggagccggagtgcgggcaaagtggctaatgatggctgagaagtccggggctgccgtggcaaatccgcctagactgctgcaagttatagctatgtcaaaagctcccggtgccccagggcctaaagctgcggagaccgctagtagcagttctgccagcagcgattccagccagtatcgatccccttctgatcgagattcggcatcaattgtaaccatcgatgctcacgccccacatcatcccgtggtgcacctatccgcaggcggagcaccctgggaatggaaagccgctggtggaggtgcaaaagccgaggccgacggtgggtacgagctcggggacctggcacgcggatttagaggcggagccaaacctcccggagtgtctcctggcagtagcgtgtcagacgtcgatcaagaggagccccgtttcggagcagttgccacagtgaacttagcaactggtgagggactcccccctctgggcgcagctgatggggcactgggcccaggaagccgagaaagcactctgaggaggcacgccggaggcctgggcttagcagagcgggaagcagaggcagaggccgagggatacttcagaaagatgcaggccaggaggttccccgactag

SEQ ID NO: 51108 - DNA, 2157 bp, Artificial Sequence
  Description of Artificial Sequence: Synthetic coding sequence
atgatctctacgaaggaaaagaacaaaattcctaaagatagcatgacgttgttaccatgcttttacttcgtcgaacttcccattgtagcatctagcatagtgtccctctatttcctggagttaaccgatttgtttaagccagcaaaggtcgggttccagtgttatgaccgcaccctgagtatgccttatgtagaaaccaatgaggagctcatacctctgctaatgctgttatcactggctttcgcagcacctgctgccagcatcatggtggctgagggcatgctgtattgcctccaatctaggttatggggcagggcgggagggcctgccggagcagaagggagcatcaacgcaggaggctgcaatttcaattcctttttgagacggactgtccggtttgtgggcgtgcacgtatttgggctctgcgccactgccctcgtcaccgatgtgatccagctcgccaccggctaccacacacctttctttctgactgtttgcaagccgaattacacactactgggaacttcttgtgaagtcaacccctacattacccaggacatctgctcaggccacgatattcacgccatcctgagtgccagaaaaacatttccttcacagcacgccactctctccgccttcgccgctgtttatgtgagcatgtacttcaacagtgtcatctccgatactaccaagctgcttaagccaatccttgtattcgctttcgccatcgccgctggcgtttgtggcctcacacagattacccagtatcgcagtcatcctgtggacgtgtacgccggatttttgataggcgctggcattgccgcatacctcgcctgccacgcggtagggaattttcaggctccacctgcagaaaaaccagccgctcccgctccggcaaaagacgccctgagagccctgactcagcgcggacatgattccgtttaccaacagaataaatctgttagcactgacgagcttggaccacccggacggctagagggtgcacccaggcctgtggccagagagaaaaccagcctcggaagtttgaagcgggcatctgtggacgtagatctgctcgcgccacggtcacctatggccaaggagaacatggtaaccttttcacacactctgcccagagcttctgcacctagtctggacgatcccgcacgtcgacatatgacgattcacgtgccccttgatgctagcagatcaaagcagttgatctcagaatggaagcagaagagcttggagggccgaggcttgggcttacctgacgatgcgtcccccggacatttgcgggctcccgctgagccaatggcggaagaagaggaggaagaggaggacgaggaagaggaggaggaggaggaggaggaggaggatgaggggcctgccccaccaagtttgtaccctactgtgcaggcacgacctggactcggacctagggtgatcctgcctcctcgggctggaccacctccgctggtgcacattccagaggaaggcgctcagactggcgctggcttgtcgccgaaatccggggcaggggtccgcgcaaagtggttaatgatggcagagaaaagtggcgcagcagtcgctaatccccctcgtctgcttcaggtcatcgccatgtcaaaagcccctggggcaccagggccaaaggcagccgagacagcctcttccagttccgcttctagcgactcatcacagtatcgtagcccatcagacagggattccgcatccattgtgaccatcgacgcccacgcacctcaccaccctgtcgtgcatctgagcgctggcggagccccttgggagtggaaggccgcaggaggcggagctaaggctgaggcggacgggggatacgagctcggcgaccttgctcggggttttcgcggtggtgctaagcctcctggcgtttcacctggcagctctgtctctgatgttgatcaggaagaacccagattcggcgctgttgctactgtgaatctggcaaccggtgagggactcccacctctgggcgctgcagatggagcactgggaccgggtagtcgcgaatcaacgctgcgcagacacgccggagggctgggcttggctgaaagggaggctgaagctgaagccgaagggtactttcgaaaaatgcaggcacgcagattcccagattag

SEQ ID NO: 51109 - DNA, 1734 bp, Artificial Sequence
  Description of Artificial Sequence: Synthetic coding sequence
atgcagcgggctggttcctccggaggacgcggtgagtgtgacatctcaggggcagggcgtcttggtctggaagaggccgctcgtctcagctgcgcggtgcatacatctccagggggtggtcggcgtccagggcaagctgctggcatgagtgcgaaggagcgtccaaaagggaaagtcattaaggattcggtcaccctgttgccctgcttctactttgtcgagctgcccatactggcaagcagtgttgtttccctatacttcttagagctcacagacgttttcaagcctgtgcattcgggcttttcctgctatgacaggtctttgtctatgccttacatcgagccgacacaagaggctatcccattcctgatgttgctgtccctggcattcgcaggccctgctatcaccattatggtgggtgagggaatactgtattgctgtctaagcaagcgtcgaaatggcgtgggacttgagccgaacattaatgcgggaggctgtaattttaatagcttcctcagaagagctgtgcgattcgttggggtgcacgtcttcggcctctgcagtacggccctgatcactgacatcattcagctgtccacagggtaccaggctccatattttctgacagtgtgtaagcccaattatacctcactgaacgtctcgtgcaaggagaactcctatatcgttgaagacatatgctccggtagcgatttaaccgtcatcaatagcggccgtaagagtttcccaagccagcacgcaacactggccgcattcgcagccgtctacgtgtcaatgtactttaacagtacactgacagactccagcaaactcctaaagcctctgttggtgtttacattcattatttgcggcataatctgtggccttacacggattactcagtataagaatcacccagtcgatgtctactgtggatttctaattggcggtggcattgccctctacttgggtctttacgctgtgggcaacttcttaccttcggacgaatccatgttccaacaccgggatgccttaagatcccttactgacctcaaccaggatcccaacagactgctttctgccaaaaatggtagcagcagcgacggaatcgcacacactgaggggattctgaatagaaaccatcgggatgcttcttcactgacaaatctgaaacgggctaacgcagacgttgagatcatcacccccaggtcaccgatggggaaggagaacatggtgaccttttcgaatacgctgccgcgagccaacacgcccagcgtagaagaccctgtccgcaggaacgcaagcatccacgccagcatggattcagccagatctaagcagttactaactcagtggaagaataaaaatgagtcacgtaaactcagcctccaggtgatagagcccgaacccggacaatctcctcctagaagcatcgagatgcggagcagtagtgagcccagtcgcgtcggggtcaacggcgatcatcacgggccaggaaatcaatatcttaagatccaacctggagccgtcccaggctgcaataattctatgccaggaggacctagggtgtctatccagagcagaccaggcagcagtcagttggtacacattcccgaagagacgcaggagaatatctcaacctcaccgaaatcgagcagggtatcctccaaggctgctcctcggacgttaaaggccgcaagaagcccggcactagcgccttcagctatcaagccctag

SEQ ID NO: 51110 - DNA, 1818 bp, Artificial Sequence
  Description of Artificial Sequence: Synthetic coding sequence
atgaatatgttcgatgctgatacaaccactaaccttgttaccatcagcttcattttacctataggcgtccatgtgttcgggctctgttctacagcgcttattacggacatcatccagctgtctactggttatcaggctccctacttcctgacagtgtgtaagcccaattatacatcccttaatgtgagctgtaaggagaactcctacattgtggaagatatttgctctggtagtgatcttaccgtgattaacagcggccgaaagagctttcccagccagcatgcaacccttgccgctttcgcagccgtgtacgtgtcgatgtacttcaattccaccctgacggactcttcaaagctgctgaagcctctcctcgtcttcaccttcatcatctgcggaatcatttgcggcttaacccgtatcactcagtataaaaatcacccggttgacgtctactgcggtttcttaatcgggggtggcatcgctctatatctgggactttatgcagtgggaaattttcttcccagtgatgaatccatgtttcagcatagagacgccctgcgcagcctgactgatctgaaccaggatcctaacaggctacttagcgccaaaaacggctcctcatcagacggcatagctcacaccgaaggaattctgaacaggaatcatcgggatgcaagttcactgactaacctcaagcgcgctaacgctgacgtggaaataataaccccacggtcaccaatgggtaaagaaaatatggtcaccttctctaacaccctgcctcgggctaatacacctagcgtggaggatcccgtgagacggaatgcctctattcatgctagcatggactcggcacggtccaagcagctgttgactcaatggaaaaataagaacgagagcagaaagctttcacttcaggtgatcgaacctgagccaggacagtcaccacccagaagcatcgagatgcgtagctcaagcgagcccagtagggtcggcgtgaatggagatcatcatggccctgggaaccagtatctgaaaatacagcccggagctgtcccaggatgcaacaattctatgccaggcggacccagggtatcgatacaaagtcggcctggttctagtcagctggtgcatatcccagaggagacccaggagaacattagtacttcaccaaagtcaagtagcgcccgagcaaagtggcttaaagcagcagaaaagaccgtcgcctgtaatagaagcaattcccaaccgagaatcatgcaagttattgctatgtctaagcagcagggagtgctgcagtccagtcctaaaaacacggagggctcgaccgtgtcctgtaccggttcaatccgatataaaactctgacagaccatgagccgagtggcattgtgcgcgtggaggcacatcccgagaataatcgaccgatcatccagatcccaagtacagagggggaggggtccggatcatggaagtggaaggctcctgagaagggaagtcttcgccagacgtacgagttaaatgatctgaacagagatagcgagtcctgcgaatctctaaaggattcttttggttcaggtgataggaaaagatccaatattgattcaaatgagcatcatcatcatggcatcacgactatacgggtaaccccagtcgagggcagcgaaattggttctgagactttgagcataagctcctcaagagactctacactcaggcgaaagggcaacatcattttgattcccgaacgcagcaattccccagaaaatactcgtaacatcttctacaaaggcacctcgcccacccgcgcatacaaggattag

SEQ ID NO: 51111 - DNA, 2292 bp, Artificial Sequence
  Description of Artificial Sequence: Synthetic coding sequence
atgcagagggccggatcttccggaggcaggggggagtgcgacatatcaggggcaggccgactcggacttgaagaggccgcaagactgtcttgtgctgtgcacacgagcccaggcggaggaaggagacccggacaggcagccggaatgagtgctaaggagcgacctaaaggtaaggtcatcaaggatagtgtgacactgctgccctgcttctattttgtggaacttcccatcttagcctccagtgtcgtgagcctatactttctggaactgacagacgtgtttaagcctgttcactctggtttttcctgttacgaccggtctctgagtatgccctacatcgaaccaacgcaggaggccattccgtttctgatgcttctgtccctagcgttcgcaggacctgccattacaatcatggtgggagagggcattctgtactgttgtctatccaaacgacggaacggggtcggactggaacccaacattaatgcaggaggatgtaattttaactcttttctgcgccgagctgtgagattcgtgggtgtccacgtgtttggactctgcagtaccgccctgatcaccgacatcatccagttgagtacaggctatcaagctccctactttctgaccgtttgcaaaccgaattataccagcttgaatgtctcatgtaaggagaattcttatatcgttgaggatatctgctccggatccgacctgaccgtaattaactctggacggaagagtttccccagtcagcacgccactcttgcggcattcgccgcagtttatgtgtctatgtacttcaatagcaccctgactgactcttctaagttgctcaagcccctgctcgtttttactttcattatctgcgggatcatctgtgggctcacccgcataacacagtacaagaaccaccccgtggacgtgtactgcggcttccttattggcggagggatcgccctgtacctgggtctctacgcggttggcaactttctgccaagcgacgagagcatgtttcagcatcgtgacgctctaaggtctcttacagacctgaaccaagatcccaataggctcttgagtgccaaaaacggaagtagttcggacggcattgcccatactgaaggtatcctcaatagaaaccaccgggacgcatccagcctcaccaacctaaagcgagctaatgccgatgtggagattataacacccagatctccaatgggaaaggagaacatggtgactttctctaacacccttcctcgagctaacacccccagcgtcgaagacccagtgcgacgcaatgcctccatccatgcctctatggactctgcgcgtagtaagcagttattgactcagtggaagaataaaaacgagtccagaaaactgtcactgcaggtgatcgagccagaacccggacagtcccctcccaggtctatcgaaatgcgtagctcctccgagcctagcagagtgggcgttaatggagaccatcacggcccaggtaaccagtatctcaagatacagccaggtgccgtgccaggctgcaataattctatgcccggaggcccacgcgtaagtattcagtcacgcccagggtcatcacagctggtgcacatcccagaggagacccaagaaaatataagcaccagtcccaagagttctagcgcacgtgcgaagtggctaaaagccgcagagaagactgtggcttgtaaccgttctaactctcagcctaggataatgcaggttattgccatgagtaagcagcagggggtcctccagagctcccccaaaaacaccgaaggctcgactgtgagttgtaccggatccatcagatacaaaacattgaccgatcacgaacctagtgggatcgtcagggtggaggctcatccggaaaataatcgcccaatcattcagattccttctacggagggcgagggatcaggctcctggaagtggaaggcacccgagaaaggttccctacggcagacctacgaactcaatgatctcaaccgcgactcggagagttgcgaatctctgaaagattcattcggcagcggcgatcggaagcgtagcaacatcgattccaatgagcaccaccaccacgggattaccactatcagagtgaccccagtcgagggcagcgaaatcgggtcagagactctctccatatcaagttcacgtgattctacgctacggaggaaaggaaacattatcttgattccagagcgatcaaacagccccgagaatactcgcaacatcttttacaagggcacctctcccacacgggcttacaaagattag

SEQ ID NO: 51112 - DNA, 2118 bp, Artificial Sequence
  Description of Artificial Sequence: Synthetic coding sequence
atgcaacgggctggctcaagtggaggacgcggagaatgtgatatcagcggagccggaaggctggggttggaggaggccgctcgcctgtcttgcgcagttcatacaagccctggcggtggccgaaggcctggtcaggcagctgggatgtctgcaaaagagcgtcctaaagggaaagtcataaaggactccgtgaccttgctcccatgcttctatttcgtggaacttccaatcctggcgtccagtgtggtgtctctgtacttcttagaactgacagatgtttttaagccggtgcatagtgggttttcgtgctatgataggtctctgtctatgccctatattgagccgactcaggaggccattccttttctaatgctacttagtttggcatttgctgggcctgcaattacgataatggtgggagaaggcattctttattgttgcttgtctaagaggagaaacggcgtggggctagaaccaaatataaatgccggagggtgcaatttcaattcctttctgaggagagcagtgcgatttgtcggcgtgcacgtattcggcctctgctccacggctttaatcaccgacattatccagttgtctactggatatcaggccccatacttcctgactgtatgcaagcccaactacaccagtttaaacgtgagttgtaaggagaattcttatattgtggaggacatatgctctggtagcgacctgaccgtgattaactccgggaggaagagttttccttctcagcatgctaccctagctgcatttgcagccgtgtacgtttcgggactctacgcagttggcaacttccttcctagtgacgagtccatgttccagcatcgggacgccttgcgctcgttaacggatcttaaccaggatcccaacagactactgagcgctaagaacggtagcagctctgacgggatagcgcacactgaaggcatcctgaacagaaatcacagagacgccagcagcctaacgaatctcaaacgggctaacgccgatgtggaaataatcacaccacgctcaccaatggggaaagagaacatggtgacttttagcaataccctgccaagggctaatacgccctccgtcgaagatccagtgagaagaaacgcttctatacatgccagcatggactcagcaaggtcaaaacagctgctgactcaatggaagaacaaaaacgaaagccgcaagctcagcttacaggtaattgaacctgagcctgggcaatcccctcctcgtagtattgagatgagaagctcctcagaaccttctcgagtgggggtgaacggcgaccatcacgggcctggcaaccagtacctgaagatccaacccggtgcggtccccggatgtaataacagcatgccgggtggaccgagggtcagtatccagtcacgtcctgggagtagccagctcgtccacatacccgaggaaacacaagaaaatattagtacctctcctaagtccagttctgctcgcgcaaaatggctgaaagcagccgagaaaacggtcgcatgtaatcgttccaattcacagccaagaatcatgcaagtcatagccatgagtaaacaacagggggtcctgcagtcttcccctaaaaacactgaaggaagcacagtttcttgtaccggcagtattaggtataaaacgctgaccgatcatgaacctagcggaatagtgagggtggaggcacatccagaaaacaatagaccaattatccagattccatcgactgagggggaagggtccggatcctggaagtggaaagccccagaaaagggaagccttaggcaaacttacgagctgaatgacctgaatagagattccgaatcctgtgagtcgttgaaagactctttcgggtctggtgatcggaagagatccaacatcgactccaatgagcaccaccaccatgggatcaccacgatcagagtgacccccgtggaggggtcggagatcggttcggaaactctgtccattagctccagccgggactctaccctgcggagaaaagggaatatcatacttatccctgagaggtcgaactctcctgagaatacgagaaatatattttacaaaggaacaagccccactcgcgcttacaaggactag

SEQ ID NO: 51113 - DNA, 966 bp, Artificial Sequence
  Description of Artificial Sequence: Synthetic coding sequence
atgccactcctgcctgccgcactgactagtagtatgctctatttccaaatggtgataatggcaggcaccgtgatgctagcttattactttgagtacacagacacgtttacggtgaatgtgcagggatttttctgccatgacagtgcatacagaaagccttatcctgggccagaggatagttcggctgtgccaccagttctgctctacagtttggccgctggcgtgcctgtgctggtgattatcgtgggtgaaaccgctgtgttctgcctgcaattagctaccagagacttcgagaatcaagaaaaaactattctcaccggagactgctgctatattaaccccctggtgcgtcgtacagttagattcctgggaatttacacatttggcctgttcgcaactgacatcttcgttaatgcaggccaggtggttaccggcaatcttgcaccacatttcctggcattgtgtaagcccaattacacggctctcggctgtcagcagtacacacaatttatatccggcgaggaggcgtgcaccggcaaccccgacttgatcatgagggcacgtaaaacttttccatctaaagaagccgctctgtcagtgtacgccgcaatgtacctcaccatgtacatcacaaacaccattaaagcgaagggaaccagacttgccaagccagtgttgtgcttagggcttatgtgtctggcattcctcacaggtttgaaccgggtggctgagtatcgaaaccattggagtgacgtcatcgcaggattcttggttggcatctccatcgccgtctttctggttgtttgtgtggtcaacaattttaaggggaggcaagctgagaatgaacacattcacatggacaatctcgcccagatgccaatgatttccattccacgcgttgaaagccctttagaaaaagtgaccagcgtgcagaatcatatcacggcgttcgctgaggttacatag

SEQ ID NO: 51114 - DNA, 951 bp, Artificial Sequence
  Description of Artificial Sequence: Synthetic coding sequence
atgccgcttctgcccgctgctctgacctcatctatgctctacttccagatggtgattatggctggtaccgtaatgctggcctactatttcgagtacacagatacgttcacagttaacgtacaggggtttttctgccacgactctgcataccgaaagccctatcctggtcccgaagacagctctgccgttcctccggtgctgctgtacagcttggccgctggggtgcctgtcctcgtaattatcgtcggcgagactgccgtcttttgtctgcaattggccacacgagatttcgagaatcaggaaaagacaatcctaacgggcgactgctgctatatcaacccattggtgcggaggaccgttcgatttctcggcatatacaccttcggactgttcgcgaccgatattttcgtgaatgccggtcaggtggtcaccggaaacctcgctccacactttctggcactgtgtaagcctaactacactgctctcgggtgccagcagtacacccagttcatatctggtgaggaagcttgcaccggaaatcctgacttgattatgagagcaagaaaaaccttcccttccaaagaagctgctctatctgtgtacgctgcaatgtatttaactatgtatatcacaaatactataaaagccaaaggaacgcgtttggccaaacctgtattatgtcttggactgatgtgcctagcattcctcactgggctcaacagagtcgccgaataccggaatcactggtctgatgtgattgccggtttcctagtggggatatccatcgctgtattccttgtagtgtgcgtagttaataactttaaggggagacaggccgaaaatgagcacatccatatggataacctggcgcagatgcctatgattagcattcctagggtcgagagcccgttggagaagaatcatatcaccgccttcgctgaagtgacgtag

SEQ ID NO: 51115 - DNA, 744 bp, Artificial Sequence
  Description of Artificial Sequence: Synthetic coding sequence
atgctcccgtctcaagaagcctctaaactgtatcatgaacactacatgcgcaatagccgcgctatcggggtgttgtgggctatattcaccatctgcttcgccatcatcaacgttgtcgtgtttatccaaccatactgggtgggagactccgtatctacccccaaaccagggtattttggactctttcattactgcgtgggatccggactggcgggacgagagttgacctgccggggttccttcaccgacttttcaacaatccctagttctgccttcaaggccgctgcattctttgtgctactgtccatggtcttgattctgggttgtattacatgcttctccctgttcttcttctgtaacaccgctacagtgtataagatttgtgcctggatgcagttgctggctgccctgtgtcttgtgttaggttgcatgatcttcccggatggatgggacgctgagacaatccgcgacatgtgcggagcaaaaacagggaagtatagcctgggcgactgctctgtgcgatgggcgtacatcctcgccatcatcgggattcttaatgctctcatactttccttcctcgccttcgtactgggcaatagacagacagatctgttgcaggaagagttgaagcccgagaataaagactttgtgggatcgactgtgtcatccgtgctgaggcctggaggcgatgtaagcggatggggcgtacttccatgtcccgtcgcgcattcccaggggccttag

SEQ ID NO: 51116 - DNA, 2088 bp, Artificial Sequence
  Description of Artificial Sequence: Synthetic coding sequence
atgtccggcgctgccctgggtttagaaattgtatttgtgttttttttggctttatttcttctgcaccggtatggtgattttaagaaacagcatcggctggtgataattggcacactcctcgcctggtacttgtgcttcctgattgtcttcatccttccactggacgtgtcgactacaatctacaaccgatgtaagcacgctgcagcgaattcttccccccctgagaattccaatattacggggctctacgcgactgcaaacccggtgccatcccagcacccttgctttaagccttggagctatatccccgacggtatcatgccgatcttttggcgtgttgtctattggacatcacagttcctgacgtggatcctcctgcccttcatgcagagctacgcgagatcggggggtttttccattacaggcaagatcaagactgcgctcatagagaatgcgatttattatggaacttacttgcttatcttcggggcattcctgatttacgtggccgtcaatcctcaccttcatcttgaatggaaccagttacagactattggcattgccgctgctaacacctggggtctattcttgcttgttctccttctaggctatggtctcgtcgagataccacggtcttactggaacggcgctaagcgcggttatctgctaatgaagacatatttcaaggctgcaaagctaatgacagagaaggcagacgctgaagagaaccttgaggatgcgatggaagaagtgcgaaaagtcaacgagagcattaaatacaatcatcctctgaggaaatgtgttgatacaattctcaaaaagtgtcccactgagtatcaggaaaaaatgggacggaacatggacgactatgaggacttcgacgaaaagcattcaatctatccctctgagaaatctctggttaagctccataaacaggtgatctattctgtccagagacatagaagaacacaagttcagtggcaaattttgctggaacaagctttttatctcgaagacgtcgctaagaatgaaacctccgccacccaccagttcgtgcacaccttccagtctccagagcctgaaaacaggtttattcagtacttctacaatcctacgttcgaatggtattgggagtgcctgctgcgcccttggttttacaaaatcttagcggtagtccttagcatcttttctgttattgtcgtctggagtgaatgtacgttcttctcaacaacccccgtacttagcttgttcgccgtgttcatccagctagccgagaagacctacaactacatttatatagaaatagcttgttttctgagcatcttcttcctctctatttgcgtctatagcaccgtgttcaggatccgggtgttcaattactactacctggccagccatcaccagacagacgcctatagtctcctgttttcgggaatgcttttctgcagactgacccctcctttgtgtctcaatttccttggtctgacgcatatggactcaagcatctcccacaagaacacccagccaactgcatacacatcaatcatgggctccatgaaggtgttgagctttattgccgacggattttatatttactatccaatgctcgtcgtaattttatgcattgctacctacttctcactagggacaaggtgcctgaatctccttggatttcagcaatttatgggcgacgatgatatgacatcagacctggtcaatgagggaaaagaactgattagaaaggaaaagagaaaaagacaacgtcaagaagagggcgaaaaccgcaggcgtgagtggaaagagcggtatggacacaatagagaagacagcacacggaaccggaacattcatacggatccaaaggagagtaactttagtgacgttaacaccaataggtccgcttttaagtacaccagagctaataacaggaccgagagggaccggatcgagctcctgcaagatgccgagccactggactttaacgcagagactttcaccgacgacccacttgagtctgagtccggacgatatcaaccgggaggacgttacctgagcatgtccaggtccgacatcttcaatgatgtctag

SEQ ID NO: 51117 - DNA, 1770 bp, Artificial Sequence
  Description of Artificial Sequence: Synthetic coding sequence
atgcctatcttctggcgagtggtgtattggacgagccaatttctaacctggatcttattgcctttcatgcagagctatgctaggagcggcggattttccataaccggtaagataaagactgcgcttatcgaaaacgctatctattatggcacctacctcctaatatttggggcatttctgatttatgtagccgtaaatcctcacctccatctagagtggaaccagctgcaaaccatcggaatagccgctgcaaacacttggggcctgtttttgctggtactgctgctgggatacggtctggtcgaaatacccagatcttactggaacggagcaaagagaggctatctcctgatgaagacttacttcaaggcagctaaactgatgaccgaaaaagctgatgctgaggaaaacttagaagatgccatggaggaagtcaggaaggtgaacgaaagtattaagtacaaccaccctctgcggaagtgcgtggatacgatcctcaagaagtgccccactgagtatcaggagaagatgggcaggaacatggacgattatgaggattttgatgagaagcactccatttatccatctgaaaagtccttggtcaagctgcacaagcaggtgatatattccgtacaacggcaccgccgaacacaggttcagtggcagatactcttagaacaggccttttatttggaagacgtcgctaagaacgaaaccagcgcaacacaccaatttgtccacacatttcagtctccagagccagagaatcgcttcatccaatacttttacaaccccacctttgagtggtactgggagtgcctcctccgtccctggttttacaagatcctcgctgtggttctctcaatctttagtgtcattgttgtatggagtgagtgtacatttttcagtacaacccctgttctcagcctattcgcagtttttatccagctggcggaaaagacatataactacatatatatcgagattgcatgcttccttagcatatttttcctcagcatctgtgtctactccacagtttttcgaatccgtgtatttaattattactacctggcatcacatcatcagacagatgcttacagcctcctgtttagtggcatgctgttttgccgcttgacgcctcctctttgcctgaattttcttggacttactcatatggactctagtatctcacataagaacacacaacccaccgcctatacctctatcatgggatctatgaaggttctgagctttatcgcagatgggttctatatttattatcccatgcttgtggtgatcctttgcatcgccacctacttctcactcgggacgcggtgcctgaatctgcttgggttccagcagttcatgggagatgatgacatgacatcggatctcgttaatgaaggaaaggagctgatcaggaaggagaagcggaaaaggcagcggcaggaggaaggagagaatagacggagagaatggaaggagcggtacggtcataacagagaagatagtactagaaaccggaatattcacactgatcctaaggaatctaacttcagcgatgtcaacacaaataggagcgcattcaagtacacccgggctaacaaccgcactgagcgcgatagaatcgaattgttacaagatgctgagcctcttgactttaatgccgagacctttacggacgatcctctcgagtcagagtccgggcgatatcagccaggcggacggtacttaagcatgtcacggagcgatatcttcaacgatgtatag

SEQ ID NO: 51118 - DNA, 618 bp, Artificial Sequence
  Description of Artificial Sequence: Synthetic coding sequence
atgaataaggtgttccctcagggcgaaaacggctacactgccgcagagtcaaaagcccatccagggggagaggccggaggcggacatttgtgttgtagccggcgtggcgcatgcctgtcggcaagccttctgctgcttctagcgactgtagcagctttgatcgcactcgtgaccattcttggcctacccagttgcactcccggagcccaggcctgtattacgttaactaatagaacaggttttctgtgccacgaccagagatcctgcatcccagcaagcggcgtgtgcgatggggttcgaacatgcacccacggtgaagacgaggatgagagtctgtgcagggacgtgcctcaatccctccctcactttctggtcgcacattgtggggaccccgcatcctggatatactcggaccagaagtgtgacggaaccaataattgcggggattgcagtgacgagctgtccccggtcacagtatgcccaccatgtggacccggatggtggaggtgcccgagtacattttttaagtattgtgactgtatccccagacatctgtgtagagaccacgtgcaacattgttctgactggtccgatgaatatgcatgtccgggtccatag

SEQ ID NO: 51119 - DNA, 351 bp, Artificial Sequence
  Description of Artificial Sequence: Synthetic coding sequence
atgaacaaagtattcccgcagggggaaaacggttatactgctgccgaatctaaagcgcatcccggtggcgaaggagacgtgccccagtccctgccacacttcttagtagcccattgtggtgacccggcatcctggatttattcagaccagaaatgtgacggaactaataattgcggcgactgcagtgatgaactctccccagtgaccgtctgtcccccatgcgggcctggttggtggagatgtccctctaccttcttcaaatactgtgactgtatcccacgccatctgtgtcgggaccatgtacagcattgttcagattggtcagatgaatatgcatgtcctgggccttag

SEQ ID NO: 51120 - DNA, 819 bp, Artificial Sequence
  Description of Artificial Sequence: Synthetic coding sequence
atggaagcatgctgtctactgcaactgccacagaggctattattgctcggtgccgcagctctgaccgctacagcccttgaaaccgctgatctggccgagctgtgcggtcagacctggcaaggcgacggcctgctcctcaggagtcacgcggcatccaggcgcttttatttcgtcgcccctgatactgattgcggactttgggtccaggctgctgcacctggggaccgaatacggttccagtttcggttcttccttgtgtacagccttaccccagcacctcctgctctcaatacttcaagtccggctcccgctgatccttgtgctcctggatcataccttcagttctacgaaggacccccaggggcaccacggcctctgggaagtcccctgtgcgggctgaacatacctgtgccagtggcctctagtggaccctttctcggactgcggctggtcacaagaggccgacagcccagagtggactttgtgggggaagtgacatccttccggctggggccttgcggagcttattttcgatgtcaaaatggacgctgcatcccatcaagcctcgtctgtgatccttggggaatggacaactgcggcgatggaagcgatcaaggctcttggagtcccgctgactgccgcggtccatccccagtgccctcccaaacagggagtacggacgcccacacatccaggtccttaaccccctcccccgcactaggcagtgccggatctctatggatcgctgccgagaggtccagccctgcaggtagagaccctacccgtcaggatgctgcgttagagggcagcacagagtag

SEQ ID NO: 51121 - DNA, 819 bp, Artificial Sequence
  Description of Artificial Sequence: Synthetic coding sequence
atggaagcatgctgtctgctgcaactgccacagcgcctgctcctcctcggcgcagccgctctgacagccacggccctggagaccgctgatctagcagaactctgcggtcaaacgtggcagggggacggtctgcttctgcgtagccacgcagcatctcgaagattttattttgtggccccagatacagactgtggtttatgggttcaggccgctgcccctggcgacagaattcggtttcagttcaggttctttctggtctattcactcactcccgctcccccagccctcaatacctcatcacccgctcctgcagatccgtgcgcccctgggagctatctccaattttatgagggccctcctggagccccaagacctcttggctcacctctgtgcggattgaacatccccgtgccagttgcaagctcaggcccatttctggggctgagactggtcactcgcggacgccagcccagagtggattttgtcggggaggtgacctcttttcgcctgggcccatgcggagcctattttcgctgccagaatggaagatgtattccttcttccttggtctgcgacccatgggggatggacaactgcggagatggatcagatcagggaagttggagcccagccgactgccggggaccctctccggttccttcccagaccggcagcactgatgcacacacctcgagaagcctgactcccagtcccgctctgggtagcgctggctctttgtggattgctgcggagcgaagttcgcccgctgggagagatccgacccggcaggacgcagctcttgaggggtcaacagagtag

SEQ ID NO: 51122 - DNA, 1038 bp, Artificial Sequence
  Description of Artificial Sequence: Synthetic coding sequence
atgtggctgctgggccctctgtgcttgcttctctccagcgccgctgagagccagctccttccagggaacaactttaccaacgaatgcaacatacctgggaacttcatgtgttcaaacggccgttgcatccctggagcttggcagtgcgacgggctgcccgattgttttgataaaagtgacgaaaaagaatgccccaaggcaaagtccaagtgtggccctaccttttttccttgcgcatctggaatccactgcatcattggcaggttcaggtgcaatggatttgaggattgtcccgacggaagtgatgaggagaactgtaccgctaacccgctgctgtgctcaaccgccaggtatcattgcaagaacggcctgtgcattgataagagctttatctgtgacggtcaaaataactgtcaagacaatagcgatgaggaaagctgcgaaagcagccaggagcccggtagtgggcaagtgttcgtaacttccgagaaccagctagtttattatccttccatcacatacgcaattattggttcctccgtcattttcgtgttagtggtggctctccttgcattagtactccatcatcagcgcaagcggaacaacttgatgacactccccgttcaccgcctccagcatccagtcctgctctcccggctggttgtcctggaccatccccatcactgtaatgtgacttacaacgtgaataacggaatccagtacgtggcctcccaggcagaacagaacgcaagtgaggtggggtctccaccatcttatagcgaagctctgttggatcaacggcctgcttggtatgacttgccccctcccccttactccagcgatacagaaagtctaaatcaggctgacctgcccccatatcgatcaaggtctggcagcgctaatagcgccagctctcaggctgcctcttctctgctgagcgtagaggacaccagccatagtccgggacagcctggcccacaggagggtaccgccgagcccagagacagcgagccttctcaagggacggaggaagtatag

SEQ ID NO: 51123 - DNA, 468 bp, Artificial Sequence
  Description of Artificial Sequence: Synthetic coding sequence
atgtggctgctgggacctttatgtctactattgtcaagcgccgcagagagccagctcctgcccggaaacaattttactaatgagtgtaatattcctggcaattttatgtgtagtaacggccgatgcatcccaggagcttggcagtgtgacggcttacctgattgcttcgataagtccgacgagaaggagtgccccaaggctaaatccaagtgcggacctaccttttttccctgtgcgtccggaatccactgcatcatcggtcgatttcgatgcaacggctttgaggactgccctgacggctctgatgaggaaaactgcaagaacggactgtgtatcgacaagagcttcatctgtgacggccagaacaactgtcaagacaatagcgacgaagaatcttgtgagagtagccaagggctgcgcggaatgacgtttctgcaccgaccaaccctacttaccagaaacctctag

SEQ ID NO: 51124 - DNA, 1503 bp, Artificial Sequence
  Description of Artificial Sequence: Synthetic coding sequence
atggcttccgttgctcaggagtccgcagggagtcaacgaaggttacctccaaggcacggcgcactgaggggcttgctgctcttgtgcctgtggctgccaagcggtagagctgctcttcccccagcagctcccctgtctgaactacacgcacaactgtctggcgtggaacagctccttgaggaattcagacgccaactccagcaggagagaccacaggaagagctggagttggagttacgggcaggcggaggcccacaagaggactgcccaggacctggaagtggaggctattctgctatgccagatgctatcatcaggacaaaggattccctcgcggcaggcgctagctttctgagagcaccagcagctgtgcgcggatggcggcagtgtgtggctgcttgttgttctgagcctcggtgctccgtagctgtggtggaattgccgcgacggcctgctccacccgctgccgtacttgggtgctacctattcaattgcactgcgagaggacggaacgtttgcaaatttgcactgcatagtggctatagcagttactcactatctagagcaccggatggagctgcactggcaacagcccgagccagtccccgacaggaaaaggatgcaccaccactgtccaaagctggccaggacgttgtactccacttgcccaccgatggggtagtgctggacggccgagagagcactgatgaccacgccatcgtgcagtacgagtgggccttactgcagggagaccctagcgtcgacatgaaggtgcctcaaagcggcaccttgaaactaagccacttacaagagggcacttatacttttcaactgaccgtaacagacaccgccggacagaggtcgtctgacaacgtgagtgttaccgttctccgtgccgcatacagtacaggaggctgcctgcatacttgctcccggtaccacttcttctgcgatgatgggtgctgtatcgatatcaccctcgcatgcgatggagtccaacaatgtcctgacggttcagatgaggatttttgccagaacctaggactggataggaaaatggtaacacacacagctgctagccccgctttgcccaggacaaccggaccctcagaggatgccggtggcgactctttggtggaaaaaagtcagaaagccacagcccctaacaagccaccagctctgagcaataccgaaaaaagaaaccactctgccttctgggggccagaatctcaaattatcccggtgatgcccgactcgtccagttctggcaagaatcgtaaggaggagtcatacatcttcgagagcaaaggagacggcggagggggagagcacccggctcccgaaactggggctgtgcttccgctggcccttggactggccatcacagccctcttgcttctcatggtggcctgccgcttgaggttggtgaagcagaaactcaaaaaggccagacccataacgtccgaagagagtgactacctgattaatggcatgtacctgtag

SEQ ID NO: 51125 - DNA, 978 bp, Artificial Sequence
  Description of Artificial Sequence: Synthetic coding sequence
atggcttctgtggcgcaggagtctgcagggagtcagaggagattgccaccccgacatggagcgctgagagggcttctgctcctgtgtctgtggctgccttcgggccgtgcggcactgcctcctgccgcaccattgtctgaattgcacgctcagctttctggtgtggagcaattactagaggagtttcggcgtcagttgcagcaagagcgtccccaggaagagttagagttagagctacgcgcaggtggcggtccgcaagaagattgtccagggcctggaagtggcggttatagcgccatgcctgacgcaataataaggactaaggactcactagctgctggtgcttcgttccttcgcgcacccgctgccgtgcgaggatggagacagtgcgtggcagcatgttgctccgaaccacgctgtagcgtcgctgtggtcgagttgccacgcagaccagctccccctgccgcagtgcttggctgttacttattcaactgcacagccagagggagaaatgtctgcaagttcgctttacactcgggctactcatcgtactcactgtcccgtgcccctgatggcgctgcactggccaccgcacgcgcttctcccaggcaggagaaagacgcccctcctctctctaaggctggtcaggacgttgtcttacatctccccactgatggagtcgttctggatggcagggaatcaacagacgaccacgcaatcgtgcaatacgagtgggccctcctacagggggatccctccgtggatatgaaggtgcctcagtctggtaccctgaagctgagccacctgcaagaaggcacatatacatttcagctgactgtgaccgatactgccggacagcggagcagtgataacgtgtcagtcacggttctgcgcgctgcttacagcactggagacggatggagcatctgttgtatttgttcaaagcgcgaggctaaggagttttccgagaccagttag

SEQ ID NO: 51126 - DNA, 738 bp, Artificial Sequence
  Description of Artificial Sequence: Synthetic coding sequence
atgaaagtgccacagtcaggcaccctgaagcttagtcatctgcaggaggggacatacaccttccagctcaccgtgaccgatacggctggtcagcggtcttccgacaatgtcagtgtcaccgtgttacgggcagcctactcaactgggggttgtcttcacacctgcagccgatatcactttttctgtgacgatgggtgttgcattgacattactctcgcatgtgatggagtacagcagtgccctgatggaagcgacgaggacttttgtcagaacctcggactggacagaaagatggtaacacacaccgctgccagccccgctcttccgcgtacgacgggaccaagtgaggacgcaggcggagacagcttggtggagaaatcacagaaagccaccgcccctaataagccaccagctctgtccaacacagagaaacgaaatcactccgcattttggggcccagaatcacagattatcccggtcatgccagacagttcttcctcaggaaagaaccggaaggaagagtcctatattttcgaatcaaagggggatgggggtgggggtgaacaccctgcaccagagactggagccgttttacccctggctctgggcttggctataacggcactcctgctgctgatggtggcatgtaggctgcggcttgtgaaacaaaagctgaaaaaggcgaggcccattacaagcgaggaatccgattacctgatcaacggcatgtatctgtag

SEQ ID NO: 51127 - DNA, 2580 bp, Artificial Sequence
  Description of Artificial Sequence: Synthetic coding sequence
atggcatgtcgatggtccaccaaagaatctcctaggtggcgcagtgcactgcttttgttgtttctagcaggtgtgtatggcaacggggcacttgcagagcatagcgaaaacgtgcatatttcgggagtgtcaaccgcctgtggcgaaacacccgaacagattagagccccatctggaatcatcacctcacccggatggccctctgagtaccctgctaagattaattgtagttggtttattcgagccaaccctggggagatcatcactatatctttccaggattttgacatacagggcagccgtaggtgcaatctggactggctgacgattgaaacttacaaaaacattgagtcataccgcgcttgtggaagcacaatccctccaccatacattagttcacaagatcacatttggataaggttccattccgatgacaacatttcccggaaaggattccgcctggcatactttagtggaaaaagcgaggagccaaattgtgcttgcgaccagtttcggtgtggtaacggcaaatgtatccctgaggcctggaagtgtaataacatggacgagtgtggcgattcatccgatgaggaaatttgcgccaaggaggcaaacccacccacagccgcagctttccagccatgcgcttacaatcagtttcagtgccttagcagattcaccaaggtgtacacctgcttacccgaatctctcaagtgcgatgggaacatcgactgcctggacttgggcgatgagattgactgcgatgtaccgacctgcggccagtggttaaaatatttttatggcactttcaattctcctaactatcccgacttttatccgccaggatctaactgcacttggctaatcgataccggagatcataggaaagttattctcagatttaccgacttcaaattagacggcacaggatatggggactacgtgaagatctacgacggactggaggagaatccccataaactgcttagagtcctcaccgccttcgactctcacgcccctctgaccgtcgtgtcatcaagtgggcagattagggtgcacttctgcgccgacaaggtcaacgctgccagaggtttcaacgccacctaccaggtggatggcttttgtctcccttgggagatcccatgcggcggtaactgggggtgctataccgagcagcagcgctgcgacggctactggcactgtccaaacggcagggacgaaacaaactgcaccatgtgtcagaaagaggagttcccctgctcacggaatggcgtgtgttatccaaggagcgatcggtgcaattatcagaatcactgcccgaacggaagcgatgaaaagaactgcttcttctgtcagcctggcaatttccattgtaaaaataatagatgcgttttcgaaagctgggtttgcgactcacaagatgactgcggcgacggtagtgatgaggagaattgccctgttattgtccctaccagggtcatcactgccgcagttatcgggagcctgatttgtggcctgttactggtgattgccctgggatgtacttgtaagttgtattctctgaggatgtttgaaagacggtcgtttgaaacacagctcagccgggtggaagctgagttgttaagacgcgaggccccaccatcctatgggcagctgatcgcccaaggactcatcccccctgtggaggatttcccggtctgttcacccaaccaggcctccgtattagagaacctgcggcttgccgtgcggagccagttaggcttcacgtccgtccgcctgcccatggctggacggagctccaatatctggaatcgcatctttaactttgcccgttcgcgacacagcggttctcttgctctggtgtcagcagatggcgatgaggttgtcccctcccaatcaactagccgcgagccagagcggaaccacactcatcgatctcttttcagcgtggagtcagacgacacagatactgaaaacgaaaggcgagatatggcgggagcctctggtggggtcgccgctcctttgcctcaaaaagtcccaccgaccaccgccgtagaagctaccgtgggtgcctgtgcatcctctagcacgcagagcaccagagggggacacgccgacaatggccgtgacgtgacttctgtggaaccccctagcgtctcccctgctcgccaccagctgacaagtgctctgagtcggatgactcagggactccgctgggtgagattcaccctgggacggtctagtagcttgagtcagaaccagagtcccctgaggcagctcgacaacggtgtaagtgggcgtgaggatgatgatgatgttgagatgctgatccccataagcgacggctccagcgacttcgacgtcaacgattgctctagacccctgctcgatttagccagcgatcaggggcaggggctccgccagccatataacgccaccaatccgggagtccgaccttctaatagagacgggccatgtgaaagatgcggcatcgtgcatacagcccaaattccggatacctgcctggaagtgactctaaagaacgagactagtgacgatgaggccctgctgctttgttag

SEQ ID NO: 51128 - DNA, 2523 bp, Artificial Sequence
  Description of Artificial Sequence: Synthetic coding sequence
atggcctgccgctggagtactaaggaaagccctagatggcgcagcgccttgttgctcttgttcctggccggagtgtatgcgtgtggtgagactccagagcagataagagctccctcaggcatcatcacaagccctggttggccgtcagaatatccagctaagattaactgtagttggttcatccgcgcaaatccaggtgagataattaccattagctttcaggactttgatattcaggggtcacgacgctgtaacttggattggctgacaatagagacttacaaaaacatcgagtcatatagagcatgtgggtccacaatccccccaccctacataagcagccaggaccacatatggatccggtttcattccgatgacaatatatcacggaagggctttaggttagcctacttttccggcaagtctgaagaacctaattgcgcctgcgaccagttcaggtgcggcaacggcaaatgcatccctgaagcctggaagtgtaataacatggacgagtgtggcgattcaagcgatgaggaaatttgcgctaaggaagcaaatcccccaactgcagctgcctttcagccttgtgcatataaccagttccaatgtctatcaaggttcaccaaagtatatacatgcttacccgagagcctcaagtgcgacggaaatattgattgtttggacctgggtgatgagatagactgcgatgttcctacctgtggacagtggctgaaatatttttatggaacgttcaacagtcctaactacccagatttttatcctcccggttcaaactgcacctggcttattgataccggcgatcaccggaaggttattctgcggtttacagatttcaagctggacggcaccggttatggcgattacgtgaaaatctacgatgggctggaggaaaacccccacaagctcctgcgggtccttacggccttcgatagtcatgcacccctgacagtggttagcagcagcggccagatccgggtgcacttttgtgctgacaaagttaacgccgcacggggatttaatgctacttaccaagtggatggcttctgcttaccatgggaaatcccatgcggcggtaattgggggtgctatactgagcaacagcggtgcgacggatactggcactgtcccaacggcagggacgaaaccaactgtacaatgtgtcaaaaggaggaattcccctgtagtcgaaatggcgtatgttacccccgatctgataggtgcaactaccagaatcactgtccaaacgggtcagatgaaaaaaattgcttcttctgtcagcccggtaactttcattgcaaaaataacaggtgcgtgttcgagagttgggtatgcgattcccaggatgattgtggagacggatctgatgaggaaaactgccccgttatagtacctactcgcgtgattaccgccgcagttatcgggtctctgatttgcggcctgctgcttgttatagccctcggatgcacctgcaagctgtattctcttaggatgtttgagaggcgcagcttcgagactcaactctcacgtgttgaggctgagcttctacgtagggaagccccaccaagttatgggcagttgattgcccagggattaattccgccagttgaggattttcctgtatgttccccaaatcaggcctcagtgctcgagaacctgcgcctggctgtgcggagtcagctcggatttacgtctgtgagattgcctatggccggaagatcctcaaacatctggaacaggatttttaactttgcacgaagccgacattctggctccctggcccttgtctccgctgatggggacgaggtcgtcccctcccagagcacttctcgagagcccgagagaaatcatactcatagaagcttattctccgtcgaaagtgatgatacggacaccgagaacgagagacgggacatggccggagccagtggcggagttgccgcacctctaccccaaaaagtgcctccaaccacagccgtcgaggccactgtcggtgcttgcgctagctcctctacgcagagcacacggggaggacacgccgacaacggacgtgatgttacctcagtggagcctccatccgtctcccctgcaaggcatcagctgactagcgcactgagccgcatgactcagggcctgcggtgggtgcgcttcactctgggccgttctagcagcctctctcaaaaccagtctcctctcaggcagctcgacaacggcgtatcaggcagagaggacgacgacgacgtggaaatgctgattcccattagtgacggctcatccgatttcgacgtgaatgattgcagtcgtccgctgttagacctcgcaagtgatcaaggccagggacttcggcagccatataatgccaccaaccctggcgttcggccttctaacagagatggaccctgcgaacgctgcggtattgtccatacggctcagatcccagacacctgcctggaagtcacactgaagaacgagacgtctgacgacgaggctctgctgctttgctag

SEQ ID NO: 51129 - DNA, 8591 bp, Artificial Sequence
  Description of Artificial Sequence: Synthetic coding sequence
atggccagtgaagataatagggttccctcaccaccaccaactggcgatgatggcggaggaggaggcagggaagaaacacccaccgagggtggggctctctctctcaagcccggtttacctatccgcggtatacgtatgaaattcgctgtcttaactggactcgtagaagtgggagaagtgtctaatcgggacatcgtggagaccgtgttcaacctcctggtcggcggacaattcgatcttgagatgaacttcataatccaggagggcgagagtatcaattgcatggtggacctgctcgagaagtgtgatattacctgtcaggccgaggtttggtccatgttcacagctatcctgaaaaaatccatccgtaatttgcaagtttgcaccgaagtcggactcgtggaaaaggtgctgggaaagatcgagaaagtggacaatatgatcgcagatttgttggtggacatgctgggcgtattggcatcatataacctgacggttagagaactcaaattgttcttcagcaagctgcagggagataaggggaggtggccacctcacgccggaaagttgctttcggtcctcaaacacatgccacagaaatacggcccagacgcctttttcaacttccccggaaagagtgcagctgcaatagcactgccaccaattgctaaatggccttaccagaatgggtttacatttcacacttggctccgcatggacccagtgaacaacataaacgtggataaagataagccatatctgtactgtttccgaacaagtaagggcttgggatacagtgcccattttgtgggtggatgtttgattgtaacatccatcaagtccaagggaaagggattccagcattgcgttaagttcgacttcaagccgcagaagtggtatatggtcacaatagtgcacatatacaaccgctggaaaaactcagaactgcggtgttatgtaaatggcgaacttgccagttacggagaaatcacatggtttgtgaacacctccgatacctttgataagtgcttccttggttcaagcgaaacagccgacgccaaccgggtattctgtggacaaatgacagcagtgtacttgttctcagaggcacttaatgccgcacagatattcgcaatctatcagctgggtctcggctacaaagggacttttaaattcaaggcagaatccgacctattcctggcagaacatcataagttgctgctctacgatgggaagttgagctccgctatagcattcacttacaacccacgcgctacagacgctcagttgtgcctcgaaagcagtcccaaggacaacccatccatctttgtgcactcaccacatgctctgatgctgcaagacgtgaaggccgtactgacacacagtattcagagtgccatgcactctatcggtggagtgcaggtgctattccctctgttcgcacaattggactatcgacagtacctctctgatgagattgatctgactatatgttctactctgctggcattcatcatggagttgctcaagaatagtatcgccatgcaagagcagatgctggcttgcaagggatttctcgtgatcgggtacagcctagagaaaagctccaaatcacacgtatctcgcgctgtgctggaactttgcttggcttttagtaagtatctgtctaacctgcagaacggcatgccgctgctgaaacaactgtgcgatcacgtactgcttaaccctgcaatatggatccacacaccagccaaagtgcagctgatgttgtatacctacctttctacagagttcatcggcaccgtgaatatttataacaccatcagacgagttgggacagtgctgcttatcatgcataccttaaaatactactactgggccgtgaacccacaagatagatccggcatcacccccaagggccttgacggcccaagacccaaccaaaaggagatgctgagcctaagagctttcctgctcatgttcattaagcagctcgtgatgaaagatagcggcgtgaaagaggacgagctgcaggctatcctgaattacctgttgactatgcacgaggacgacaacttaatggacgtcctgcaattgctggtggccttgatgagcgaacaccccaacagcatgatcccagcctttgatcagcggaacggccttcgggtcatatataaactgttagctagtaaaagtgaagggatcagggtccaagccctgaaggccatggggtatttcctgaagcacctcgcacctaagagaaaagccgaggtgatgcttggtcacggactcttctccctgcttgcagaaaggctgatgctccagaccaatctaatcacaatgactacatataatgtgttgtttgaaatactgattgaacagatcggcacgcaggtaattcacaaacagcaccctgacccagatagtagtgttaagatccagaacccccagatcctcaaggttatcgccactctccttagaaactctcctcagtgcccggagtcaatggaggtccgcagagcatttctgtcagacatgattaagctttttaacaactcccgggagaaccggagatccctcctccaatgttcggtgtggcaagagtggatgctgagcctctgctattttaatcccaagaattccgacgaacagaagattacagaaatggtgtacgcaatattcagaattctgctgtatcatgcagtcaaatatgaatggggaggttggcgtgtatgggtggataccctgagtatcacacactctaaggttacttttgaaatacataaagaaaatctggcaaatattttccgcgagcagcaaggcaaagttgacgaagaaattggtctgtgttctagcaccagtgtccaggcagctagcggaattcggcgagatattaacgtgtcagtcggatcccagcagcccgatactaaagactccccggtgtgcccacattttaccaccaacggtaatgagaatagctcaatcgagaagactagctctcttgaaagcgcctccaacatagaactccagaccaccaatactagttacgaggagatgaaggccgaacaagagaatcaggagttgcccgacgaaggcacactcgaggagactctcaccaatgagacccgaaatgcagacgatctggaggtgtcctctgatataattgaggctgtagcaatctccagcaactcttttatcaccactggtaaggattccatgacagtgtcggaagtcacggcctctatctcttccccctccgaagaggacgcatccgagatgcccgagttccttgataagagcatcgtcgaagaggaagaagacgatgattacgtagaactgaaagtggagggaagtccaaccgaggaggctaacctcccaactgagctgcaggataactccctctcccctgcggcatctgaagccggagaaaagctggatatgttcggaaacgacgataagcttatctttcaagagggaaagcctgtcacagagaagcagactgataccgaaacacaggacagcaaagacagcggaattcagacgatgaccgcctccggtagctctgcaatgtctccagaaactacagtctcccaaatagcagtggaatccgatttaggtcagatgctggaggaggggaaaaaggctaccaacctcacacgggaaacgaagctgattaatgactgtcacggctcagtcagcgaagcatcctccgaacagaagatagccaagttagacgtgtccaacgtcgcgacagatacagagcggcttgagctgaaagcatcccctaatgtggaggctcctcaaccacataggcatgttctcgagatttctaggcagcacgaacagccgggacaagggattgcccctgacgcagtgaacgggcaaagacgggacagtagatccaccgtctttagaatccctgagttcaactggtcacagatgcatcagcggctgctgactgacctgctgttctccattgaaacagatattcagatgtggcggtcacattccaccaaaacagtgatggactttgtcaacagctcagacaatgttatcttcgtccacaacaccatccatctgataagccaggtgatggacaatatggtgatggcctgcgggggtattctgccactgttgtctgccgctacatcggccacacacgaattggaaaatattgagccaacacaagggctgagtatcgaagcctccgtcacattcctacagcggcttatttcgttggttgatgtcctcatctttgctagctctctcggattcacggagattgaggctgaaaaaagcatgagttcaggaggcattttgcggcagtgtctccgcttagtgtgcgctgtcgccgtacgcaattgtttagaatgtcagcagcactctcagctgaaaacccggggagacaaggccctgaagcctatgcattccctgatacctttgggcaagtccgcagccaagtctccagttgacatcgtcaccggcggtattagccctgtgcgagatctggatagacttctccaagacatggatatcaataggctgcgagcggtcgttttccgcgacattgaggactcaaagcaggcacagttcctcgccctggcagtcgtgtacttcattagcgttttgatggtatctaaatacagggacatcttagagccacagaacgagcggcatagtcagtcttgcacagagacaggcagcgaaaatgaaaatgtctccctctcggagatcacaccggcagccttctctacactgaccactgcctcagtggaggagtcagaatccacttcttcagctcgacggcgtgactccggaattggcgaggagactgccacaggactggggagccacgtggaggtgacgccccatacagcaccacctggcgtgtcagctgggccagatgctatatctgaagttttatccacactgagcctggaagtgaacaaaagcccggaaactaaaaacgatcgagggaatgatctagacaccaaggctactccttccgtgtcagtgtccaaaaatgtcaacgtcaaagatatattgcgatcattggttaacattccagctgacggggtgaccgtcgatcccgcactgctgccgccagcctgtctgggggctcttggcgacctttctgttgagcagcctgtgcagttccgtagcttcgaccgctccgtgattgtggccgcaaaaaaatcagcagtgtccccatcaacattcaacacaagcattccaacaaatgcagtttcagtggtctcgtccgttgactctgcccaggcctcagatatgggaggagagtcacctggctccaggtcctccaacgccaaacttccatctgttcccactgttgattccgtgtctcaagatccggtaagcaacatgtctatcaccgagcgccttgaacatgccctggagaaggctgccccactgcttcgcgaaattttcgtggatttcgccccatttttgtctagaacattactgggttcccacggtcaggagctgcttatcgagggtacctccctggtttgcatgaaatccagttcttccgtcgtggagctcgtcatgctcctatgctcacaggaatggcagaacagtatacagaaaaatgcagggttagccttcatagagctggtgaacgaaggcagactactcagtcagactatgaaagaccaccttgtgcgagtggccaatgaagccgagttcattctctctaggcagcgtgctgaggacatacaccgccacgccgagttcgagtccctatgtgcccagtattctgcagacaagagagaagatgagaagatgtgcgatcatttgattcgcgctgccaagtaccgcgatcatgtgacagcaacccagctcatccagaagatcatcaacatactgacggacaaacatggcgcatgggggaattctgcggtgtcccgcccactggagttctggcgcctggattactgggaggacgatctgcgacggagacggaggtttgtcagaaatcctctgggttcgacacaccccgaagccacgctgaagaccgccgtggagcacgtgtgtatcttcaaactcagggaaaattccaaggctaccgatgaggacatcctcgcaaaaggcaagcagtctattaggagtcaggctcttggaaaccagaacagcgaaaatgagatcttgcttgagggggacgacgacaccctgtcctctgtggacgagaaggatctggagaacctggcaggtccagtgagcctgtcgaccccagcccagctcgtggccccttctgtagtggtaaaggggacactctccgttacttcatctgaactatatttcgaggtggacgaggaagaccccaattttaagaaaattgaccccaagatactcgcttacacggaaggtcttcacggaaagtggctcttcactgagatcaggtctattttctcaagacggtacctcctgcaaaatactgccctggagatcttcatggcaaacagagtggctgtaatgttcaacttccctgatcccgctaccgtgaaaaaggttgtgaactacctgccgagggtgggcgtcggtacttcgttcgggctgccgcagacaaggcgcatcagtctggccagtcccaggcagctcttcaaggcatcaaacatgactcagcggtggcaacaccgggaaatcagtaacttcgagtatttaatgttccttaacacgatcgcaggtcggtcctacaacgatcttaaccaatacccagtattcccatgggtcattacgaactacgaatccgaagagctggacttgacattgccaactaacttcagggacctgtcaaaaccaatcggtgccttaaaccccaagcgagcggcattcttcgccgagagatatgagtcatgggaagatgaccaggtacccaagttccattacggaacgcactactctactgcttcattcgtattggcatggcttctccgaatcgagcccttcaccacctatttcctcaacctgcagggcggaaagtttgatcacgcagataggaccttctcctccatcagccgcgcttggagaaattcccagcgcgatacaagcgatattaaagaactaattcctgagttctactatctccctgagatgttcgtgaacttcaataactacaacctcggcgttatggacgatggtaccgtggtgtccgacgtcgaactgcccccttgggccaagacatccgaagaattcgttcatattaacagactggcgctcgaaagcgaattcgtgagttgccagctgcatcagtggatcgacttgatctttggatacaagcaacaaggaccagaagccgtacgagctttgaacgtcttttattatttgacatacgaaggagccgtgaatctcaactcaattacagatcctgtgttacgtgaagctgtggaagctcagatacggtctttcggccagactcctagccaactcttaatcgagccccaccctccgagaggctcagcaatgcaagtgtcaccactaatgtttaccgataaagcccagcaggacgtgataatggtgttgaaattcccttccaacagcccagttacgcatgtcgccgcaaacacgcagcctggactggcgacccccgcagttattactgtgaccgccaatcggctttttgcggtgaacaaatggcacaatttaccagcccaccaaggtgccgttcaggaccagccgtaccaactaccagtggagattgatcctcttattgcttctaacaccggcatgcaccggaggcaaattaccgacttgctcgaccaatccattcaggtgcactcgcaatgcttcgtcatcacatccgacaatagatatatcctggtgtgcggcttttgggataaatcctttagggtctacagtacagatactgggaggctcattcaggtcgtattcgggcactgggacgtggtgacttgcctcgctcgctctgaatcctacataggcggaaactgctacattctcagcggcagtagggatgctaccctgttgttgtggtactggaacggcaagtgctctggaatcggcgacaatcctggtagcgaaacggccgctccaagagctatcttgactggtcatgactatgaagtaacatgcgccgcagtatgcgcggagctcggactagtcctgtctggcagtcaggagggtccctgcctaatccacagcatgaatggtgatcttctgaggactctcgaaggtcctgagaattgtctgaagccaaaactgatccaagcaagtcgcgaaggtcactgcgtgatattctatgagaacggtttattctgcacattctcggtcaacgggaaactacaggccacgatggagacagacgataatatcagggccattcagttatccagggatgggcagtaccttctgactgggggagatcgaggcgtggtagtggttagacaagtttccgaccttaagcagctctttgcttaccccggttgcgacgctggcattcgcgctatggccctgagctacgatcagaggtgtattatcagtggtatggcaagcggctccattgtgctgttctacaacgacttcaacagatggcaccacgagtatcagaccaggtacta

SEQ ID NO: 51130 - DNA, 8558 bp, Artificial Sequence
  Description of Artificial Sequence: Synthetic coding sequence
atggcttctgaggacaatcgtgtacccagtccccctcccactggggatgacggaggcggagggggacgggaggagactcccaccgaggggggagcactttctctcaaaccgggattacccattagaggaattcgaatgaaatttgctgtcttgaccggccttgtagaggtcggtgaggtctcaaacagggatatagtcgagacagtgtttaatctcctagtcggcggacaattcgatctcgagatgaacttcatcatccaagaaggcgaatccatcaattgcatggtcgacctgctagagaaatgtgacatcacatgtcaggcagaagtctggtctatgttcaccgcaattctgaagaaaagcattaggaatttacaggtgtgtaccgaagttgggcttgtcgagaaagtgctgggcaagatcgagaaggtggacaatatgatcgcggacctattagtggacatgctgggcgttctggcctcatacaacttgacagtgcgagaactgaaattatttttctcaaaattgcagggcgataaaggaagatggccaccccacgcagggaaactgttaagcgtgctcaagcatatgcctcagaaatatggccctgatgcgttcttcaattttcccggaaaatctgccgctgctatcgcgcttcccccaatagccaagtggccgtaccagaacggctttacctttcacacctggctcagaatggatcccgttaacaatatcaacgtggacaaggacaaaccgtatctctactgtttccggacctccaaaggccttggatactccgcacactttgtgggaggctgcttaatcgttaccagcataaagagcaaaggaaaggggtttcagcattgtgtgaagttcgatttcaaaccccaaaagtggtacatggtgaccatcgtgcacatttataaccgctggaagaactcggaactgcgatgctacgtgaatggcgagctggcctcttacggggaaataacctggttcgtcaataccagcgacacgttcgataagtgttttctcggcagtagtgaaaccgctgacgctaatcgtgtgttttgcgggcagatgaccgccgtctacctgttttctgaagcgctgaatgccgctcagatctttgcaatctaccagctcggtcttggttataaaggtacctttaagtttaaagccgagagcgatttgttcctggcagagcatcacaagctgctgctctacgatggcaaactgagttctgccatcgcgttcacttataaccctcgggctaccgacgcacagctgtgtctggaaagtagccctaaggacaatcctagcattttcgtccacagtccacacgctctgatgttacaggacgttaaagcagtcctgacacattctattcagagtgctatgcactcaataggcggagtccaggtgctgtttccactctttgctcagttggactaccgacaatacctgagtgacgagatcgatctcacaatttgcagtactttgctcgcctttatcatggaactgcttaaaaactccattgcgatgcaggagcaaatgctggcatgtaaggggtttctggtcatcgggtactcccttgagaaaagctctaagagccacgtgagcagggcagtgttagagttgtgtctggccttttctaaatacctgtcaaatctacagaacgggatgccgctgttgaagcagctttgtgaccatgtgttgctgaatcccgctatttggatccatacacccgcaaaggtacagttaatgctctatacttacctcagcaccgagtttataggaacagtaaatatctataacaccatccgtagggttgggactgtcctgctcatcatgcacaccctaaagtattactactgggctgttaaccctcaggataggtctggtattacaccaaagggcctagatgggcctagacccaaccaaaaggaaatgttgtcgctgagggcgttcttgctgatgtttattaaacagttggtaatgaaggactctggtgtcaaggaggacgaactgcaggccatcctgaattatctgctgacaatgcatgaggacgacaatctgatggatgtgctgcagctgctagttgctctgatgagcgagcatccgaacagcatgattcccgcattcgaccagagaaacggtttgagagtgatttataaactgttggccagcaaatctgaaggaatccgcgtgcaggccttgaaagccatgggttacttccttaagcatctggccccaaagcgcaaagctgaagtaatgctgggacacggactcttttcccttcttgcagagaggctgatgctccagacgaacttgatcacgatgacaacgtacaatgtgttatttgagattctcatcgaacagatagggacacaggtgatccataagcaacacccagacccggattcctccgtgaagattcagaatcctcagatcctcaaggtgatcgctacgttgctgcgcaactccccccagtgtcctgagtcaatggaagtgaggagggcctttctgagcgacatgattaaactctttaacaacagtagggaaaatcgccgtagcctgctgcaatgctccgtctggcaggaatggatgttatctctatgctatttcaatccaaaaaattcggacgaacagaaaatcacggaaatggtgtacgctatatttcggatcctgttatatcacgctgtgaaatacgaatggggaggctggagggtttgggttgataccttaagcatcacccattccaaagtgacttttgagattcataaggaaaacctggccaatatcttcagagaacagcagggcaaagttgatgaggagataggtctgtgtagcagcacgagtgtgcaggccgcttccgggatccgtcgggacattaatgtatctgttgggtctcaacaacccgacaccaaagactcccccgtgtgcccacactttactacgaatggcaatgagaatagctctattgaaaaaacatcttctctggagagtgctagcaatatagaacttcagaccaccaacaccagttacgaagaaatgaaggctgagcaggagaatcaggagctgcctgacgagggaacattggaagagacacttaccaacgaaacccgtaatgccgacgacctagaggttagctccgatattattgaagctgtcgctatcagcagcaatagttttataacaaccgggaaggacagtatgaccgtgtcagaagtgactgcatccatatcatccccttctgaggaggacgctagcgaaatgcccgagttcctcgacaagtcaatagtggaagaggaggaggacgacgattacgttgaactcaaggttgaagggtcccccaccgaagaggctaatctacccactgagctccaggataactctctgtctccagctgctagcgaggcaggagaaaagttggatatgttcgggaatgatgataaacttatatttcaggaaggaaagcctgttacggaaaagcagactgatacggaaacccaagactctaaagactcaggtatccaaacaatgacagcctctggctcctccgccatgagccccgagaccactgtgagtcagattgctgtcgagtcagacttggggcagatgctggaagaggggaaaaaagctacaaaccttaccagggagacaaagctcatcaacgactgtcatgggtccgtgtccgaggcctcctctgagcagaaaattgctaagctggatgtgagcaatgtggccacagacaccgagcgtctcgagcttaaggcttcccctaacgtcgaggccccacagcctcaccggcacgttcttgaaatctcgaggcagcatgaacaacctggacaggggattgctcctgatgctgtaaatggccagaggcgggacagtcgatcaactgtgtttaggatccccgagttcaactggagccagatgcaccagagactgctaaccgaccttctttttagtatcgaaactgacatacagatgtggaggagccactctacgaagactgttatggacttcgtgaattctagcgataatgttattttcgtacacaatacgattcatctgatttcccaggttatggacaatatggtcatggcgtgtgggggaattctgcccctcctgtctgccgctacctcagctacccacgaattggaaaatattgaacctacccagggattatcgattgaggccagtgtcaccttcctccagagactgattagtttggtggacgttctgattttcgcttctagtctgggattcaccgagatcgaagcagaaaagtctatgagcagcggcggtatactgaggcagtgtctccggcttgtgtgcgcagtggctgtccggaattgtttggagtgccagcaacactcccaactgaagacccgtggagataaggctctgaagccaatgcattcattgattccactcgggaagtccgctgccaaaagccccgttgatatagttacggggggaatttcacccgtcagggacctcgatagactgctgcaggatatggatattaacagacttcgggctgtagtgttccgagacattgaggactcgaaacaggcacagttcttggctctggcagtggtctactttatttcggtactgatggtgtctaaatacagagacatactggaaccacaaaacgaacgccacagccagtcttgcaccgagaccggttccgagaatgaaaacgtgtccttgtcagagatcacaccggcagccttcagcaccctcactacagcgagtgtagaggagtccgagagtacaagtagcgctcgacgacgggactctgggattggcgaagaaactgccacaggactggggagccacgtggaggtcaccccacatacagctcctccaggagtgagcgccggacccgatgctatttcagaggtccttagcacactttcgttagaagtgaataaaagcccagagacaaaaaacgaccgcggaaacgaccttgacacaaaagctaccccaagcgtgtccgtgagtaagaatgttaacgttaaagacattctgaggagtctcgtgaacattcctgcagacggcgtcacagtggacccagctttacttcctcccgcatgcttaggcgctcttggggacctgtctgtagagcagcctgttcaattcagatcctttgatcgcagtgtgattgttgctgccaaaaaaagcgccgtgagtccgagcacattcaacacttccatcccgactaatgctgtaagcgtagtgtcctcagttgattcggcacaggcctcagacatgggaggggaaagccccggtagtcggtccagcaacgctaaactgccctcagtgcccacagtggactcggtcagccaggacccggtcagcaatatgtcaatcaccgaaagactggaacacgccctcgaaaaggccgctccattgctaagagagatctttgttgattttgccccttttcttagtagaacgctgctggggtcacatggccaggagctgctcattgagggaactagcttggtttgcatgaagtcctcctctagtgtcgtggagctagtgatgctcctgtgctctcaggaatggcaaaatagtatacagaaaaacgccggactggccttcattgaattggtcaacgaggggcgtctactgtctcaaacgatgaaagaccacttggtgagagtggccaacgaagctgaattcatcttgagcaggcagcgggcagaagatatccatcgtcacgcggaatttgagtctttgtgcgctcagtattctgctgacaaacgcgaggacgaaaagatgtgcgatcatctgattagggctgctaaataccgggaccatgttaccgctacccagctgatccaaaagatcatcaatatactcacagacaagcatggagcgtgggggaacagcgcagtgtctcggcctctcgaattctggagactggattattgggaagacgatcttcgccgtcgtaggcgtttcgtgcgcaaccctcttggcagcactcaccccgaggcaacactgaagaccgccgtggagcacgccacagacgaggatatactcgcgaagggtaaacaatccattcgctcacaggcactgggcaatcagaactctgagaatgaaattctgttagagggcgacgacgatactctgagctccgtagacgagaaagatctggagaacctggcgggtcctgttagcctgtcaacaccggcacagcttgtggcaccatctgtagtggtgaaaggaacactctcagtcacatcatccgaactgtattttgaagtcgacgaggaggacccaaattttaaaaagatagaccctaagatcctagcctatactgagggtcttcatgggaagtggctgtttaccgaaatccggagtatcttttcccgtaggtaccttctgcagaacaccgctttagagatctttatggccaacagggtcgccgttatgtttaatttcccagatccagcaaccgtgaaaaaggtagtgaactacctcccacgggtgggagtcggcacctcctttgggctgcctcagacacggaggatttctctggccagtcccaggcagttattcaaagcaagcaacatgactcagcgatggcagcaccgagaaatatccaactttgagtacttaatgttcctgaatacgattgccggacgatcatataacgacctaaatcagtatcctgtgttcccctgggtcatcaccaactatgagagcgaggaactggatctcaccttacccacaaacttccgcgacctatccaaaccaattggagcactgaaccccaagcgcgcagcttttttcgccgaacggtacgagtcatgggaggacgatcaggtcccgaagttccattatggaactcactacagcacagcatcttttgtcctggcttggttgctgagaattgaacctttcacaacctacttcctgaatctacagggcggaaaattcgatcatgccgacaggaccttctccagtatctctagggcttggcggaactctcagcgagacacctcggacataaaggagctgatccctgagttctattacctgcctgaaatgtttgtcaattttaacaactacaatctgggggttatggacgatgggactgtcgtgagcgatgttgagctgcctccatgggctaaaacatccgaggaatttgtgcatattaatcggcttgctttggagagtgaatttgtctcctgtcagctccaccaatggatagatttgatttttggctataagcaacaggggcctgaggctgtccgcgcacttaatgtgttctactacctgacatatgaaggagccgtcaaccttaattctatcacagaccctgtgctcagagaagccgtcgaggcgcagatccggagctttggtcagaccccgagccagctgttgatagagcctcacccacccagaggtagtgcgatgcaggtgtcccctctaatgttcacagacaaggcccaacaggacgtgatcatggtgctgaagtttccctctaattctcctgtcacccatgtggcagcgaatacccagcctgggctcgccacgcccgctgtaattaccgtgaccgctaaccggctctttgccgtgaacaagtggcacaatctccccgctcaccagggcgcagtgcaggatcagccataccagttacccgtggagatcgatcctctgattgcctccaataccggcatgcatcggcgtcagattacagacctgctggaccagtccatacaagtacattcccagtgttttgtgatcacaagtgataacaggtacatcttagtttgcggtttttgggataagtcctttcgggtgtatagcaccgatactgggcgattaatccaggtggtcttcggtcactgggatgtcgtgacatgcttagccaggagcgagagctacatagggggaaactgctatatattgtccgggtcgagggacgctactctccttctctggtattggaacggtaaatgttccgggatcggcgataacccgggaagtgagactgccgctcccagggccattctgactggacatgattatgaagtcacttgcgcagctgtttgtgccgaactgggtctcgtgctgagtggctctcaggaaggcccttgtttgatacatagcatgaacggggatttgctgaggaccctagaaggcccagagaattgccttaagcctaagcttatccaggcaagccgggagggtcactgtgttattttttacgagaatgggttgttctgtacattctccgtaaacggcaagctccaggccacaatggagaccgatgacaacatcagagcaatacagctgtcaagagacggacagtatttgctcaccggaggcgaccggggagtggtcgtggttcggcaggtcagtgacctcaagcagctatttgcttacccaggctgcgatgccggaattcgggctatggcactctcctacgaccaaaggtgtattattagtgggatggccagtggatccattgtattgttttataatgatttcaaccggtggcatcatgagtaccagactcgctatta

SEQ ID NO: 51131 - DNA, 717 bp, Artificial Sequence
  Description of Artificial Sequence: Synthetic coding sequence
atgctgggcagtccttgcctcctatggcttttggccgtaacgttcttagtgcccagagcacaacctctggctccccaggactttgaggaggaggaggccgacgagaccgaaactgcatggcctcctctgcccgcagtgccttgcgactacgaccactgccgtcacctccaggttccttgcaaggagttgcaaagagtgggacctgccgcttgtctttgtcctggactttcgagcccagctcagccccctgatcccccaagaatgggcgaggtgaggattgcggctgaggagggaagagcagtggtgcattggtgcgcccctttctcgccggtgctgcactactggcttttactttgggacggatctgaagctgctcagaagggaccacctctcaacgcaaccgttaggcgcgctgagctgaaaggcttgaagcccggaggaatctacgtagtgtgtgttgtggccgctaacgaggctggagcatcgagggtgccccaggccggaggcgagggtctcgagggcgctgacatacccgcattcggaccttgttctagattagcagttccacccaatccacgcactctagttcacgcagccgttggagtagggaccgcactcgcgctgctgtcgtgcgcggctctggtatggcatttctgtctgagggatcggtgggggtgccccagacgggctgctgccagggccgcaggagcgctatag

SEQ ID NO: 51132 - DNA, 270 bp, Artificial Sequence
  Description of Artificial Sequence: Synthetic coding sequence
atgtgccagaaggaggttatggagcaatccgcgggaattatgtaccgcaagtcgtgcgcaagttccgcagcttgtctgattgcatctgcaggctaccaaagtttctgtagccctggaaagctcaacagcgtctgtatttcatgctgtaatacccccctgtgcaatggaccgaggcctaagaagcgcggatcctcggccagcgctttgcgtcctggccttcgtacgaccattctattcctcaagctcgcactctttagtgcacactgctag

SEQ ID NO: 51133 - DNA, 426 bp, Artificial Sequence
  Description of Artificial Sequence: Synthetic coding sequence
atgtgggtactcggcatcgcagcgactttttgtggtctcttcctcctgccaggcttcgctcttcagatacaatgttatcaatgcgaggagttccagctcaacaatgattgctctagtcccgagttcatagttaactgtaccgtcaatgtacaggatatgtgtcagaaggaagtgatggaacaaagcgctggaataatgtatcgaaagagttgtgcatcatcagccgcatgtctcattgcaagcgcaggctaccagtcattctgcagccccggtaagctgaattctgtttgtatttcttgctgtaatactcctctgtgcaacggtcccagaccgaagaagcgcggaagttccgccagcgccctacggccaggattacggactactatcttgttcctgaaattggcgctgttcagcgcacactgttag

SEQ ID NO: 51134 - DNA, 495 bp, Artificial Sequence
  Description of Artificial Sequence: Synthetic coding sequence
atgcaagcccctagggccgctcctgccgcaccgctgagctatgacagacggcctagagattccggcagaatgtgggtcttaggaattgctgccactttctgcggacttttcctcctgcccggatttgccctgcagatccaatgctatcagtgtgaagaatttcagttgaacaatgactgttcaagtcccgaatttatcgtcaattgtaccgtaaacgtccaggacatgtgccaaaaggaggtcatggagcagtcggctggaatcatgtaccgaaagtcatgtgccagctctgccgcttgcctgattgcatcagcgggttaccagtctttctgcagcccaggaaagctgaattccgtatgcataagctgttgcaatacaccactgtgtaatggcccacgaccgaagaagagggggtcctccgcatccgccctgagaccaggtctgcggactaccattctgttcttaaagttagctcttttctcagctcactgttag

SEQ ID NO: 51135 - DNA, 378 bp, Artificial Sequence
  Description of Artificial Sequence: Synthetic coding sequence
atgagaggcacgcgactcgcactcctggccctggttctggccgcatgcggagagctggcgccagctctccgctgctacgtttgcccagaaccaactggagttagtgactgcgtaacaatcgccacatgcaccacaaacgaaactatgtgtaagacgaccctgtactctcgggaaattgtttacccatttcaaggggattcgaccgttactaaaagttgtgcctctaagtgtaaaccaagcgacgtggatgggatcgggcagacactgcccgtttcatgctgcaacaccgaactgtgtaatgtagatggtgcgcctgctctgaattccctccactgcggagctctgaccctactgccattacttagccttcgcctgtag

SEQ ID NO: 51136 - DNA, 741 bp, Artificial Sequence
  Description of Artificial Sequence: Synthetic coding sequence
atgggtccccagcacctgcggctggtgcaactgttttgtttgctcggagctattagtaccctacccagagccggtgctctcctctgttatgaggctactgcctcacggttccgggctgttgcatttcacaactggaaatggctgctgatgcgaaacatggtgtgtaaactgcaagagggctgtgaagaaaccctagtttttattgagactgggacagcgaggggggttgtcgggtttaaaggctgttcgtcaagctccagctaccctgcccagattagctacttggtgagccctcccggagtttcaatcgccagctatagtcgggtatgcagatcctacttgtgtaataacctaactaatctggagccttttgtgaaacttaaggcttccactcccaagtccatcaccagtgctagttgcagttgcccgacgtgcgtgggcgagcacatgaaagattgcttaccaaattttgtgaccactaatagctgccctctcgcagcaagcacatgttactcctctactttgaagttccaagctggcttcctgaacacaaccttccttctgatgggttgtgcgagagagcacaatcagcttttggcagattttcaccacatcggatcgatcaaagtgaccgaagtgctgaacatactggagaagtcacagatagtcggggcagcatcttcccggcaggacccagcctggggcgtagtgttgggactcttgttcgcgtttcgggattag

SEQ ID NO: 51137 - DNA, 636 bp, Artificial Sequence
  Description of Artificial Sequence: Synthetic coding sequence
atgggtccgcagcacctaagactggtgcagttgttctgtcttttgggtgcaatttctaccttgccaaggatgtcctgtggcgcaggctgctataaaacccagaaggggaccgcgagaggggttgtgggctttaagggctgtagctcatcttccagctatccggcacaaatcagttacctggtgtccccaccaggagtgtccattgcctcatatagccgggtatgtcgttcctacctttgcaataatctcaccaatttagaacctttcgtgaagctcaaagcgagcaccccgaagtcaatcactagcgcaagctgttcctgtccgacctgtgtcggcgagcacatgaaggactgcctgccaaattttgtgactactaattcctgcccactcgctgcatctacttgttactccagcacccttaagttccaggctggcttcttaaacaccactttcctgctcatgggttgtgctcgagaacataaccagcttctggccgatttccaccacatcggatctatcaaagttacggaagtcctgaacattctggaaaaaagccaaatcgtcggcgcagcatctagtcggcaggacccggcttggggagtggttcttggtcttctgttcgcatttagagactag

SEQ ID NO: 51138 - DNA, 756 bp, Artificial Sequence
  Description of Artificial Sequence: Synthetic coding sequence
atggccatgggggtgcctagggtgatactactgtgtctgttcggcgcagccttgtgcctcactggcagccaggccttacagtgctacagctttgagcacacttacttcggaccttttgacttgcgcgctatgaagctgccctcaatcagttgcccacacgaatgctttgaagcaatcctgtccttggacaccggctaccgcgcaccggtcaccttagtaagaaaaggctgttggactggccctcctgcaggccaaacccagtccaacgctgatgctttaccaccagattactctgttgtccgaggttgcacaaccgataaatgcaatgctcacctgatgactcatgacgcccttcccaatttgtctcaagcacccgacccccctacattgtctggggctgagtgctatgcatgtattggagttcaccaggatgactgcgcgatcggaaggtctcgccgtgtgcagtgccatcaggaccaaactgcctgttttcagggaaatgggaggatgacggtggggaacttctcagtcccagtctatattcggacctgccaccggcctagttgcactactgaaggtactacttctccgtggacagctatagacctgcaaggcagttgctgcgaaggctatctgtgcaaccggaagtccatgacccagccgtttaccagtgcctctgccaccactcctcccagagcgttacaggtattagccctcctacttcccgtccttttattggttgggctgagcgcatag

SEQ ID NO: 51139 - DNA, 627 bp, Artificial Sequence
  Description of Artificial Sequence: Synthetic coding sequence
atgaaactcccctctattagctgtcctcacgagtgttttgaggcaatcttgtcgctcgacaccggttatagagccccagttacccttgttcgcaaggggtgctggacagggcctccagctggccagacccagagcaatgccgatgcccttcccccagattattctgtcgtgcgagggtgcaccacagacaagtgtaatgcccaccttatgactcacgatgccctgccaaatcttagccaggctcccgacccgccaaccctaagcggcgctgagtgctatgcatgtattggagtacaccaggacgactgcgctattggcaggtcacggcgtgtccaatgtcatcaggaccagaccgcctgcttccaaggaaacgggagaatgaccgtcggaaacttctcagtgcctgtgtacattcgaacttgccacaggccaagttgtactactgaaggcacaacatcaccatggacagctatagatctccaggggagttgctgcgaaggatacctttgtaaccggaagtccatgactcagccttttacttctgctagcgccacaacaccccctagagctctgcaagtactggccctactcttaccagtgttactgctggttggcttatccgcatag

SEQ ID NO: 51140 - DNA, 624 bp, Artificial Sequence
  Description of Artificial Sequence: Synthetic coding sequence
atgcggctgataaccttgtcggccaacttattcacagtcccagaacggagcctcaccacaactttcagcttttctcggtataagagctcggacaggccagcgcataaagtgtctatgctccttctctgtcacgcactcgcgatcgcagtagtgcagattgtgatcttttctgagagctgggccttcgcgaaaaacatcaacttctacaacgtcaggcccccattggatcctacaccttttcccaacagtttcaaatgctttacctgcgagaacgccggagataactacaattgtaaccgctgggccgaagacaagtggtgcccacagaacacacagtactgtctgacagtgcaccacttcacttctcacggacggtccacgtcaatcactaaaaaatgtgccagtcggtccgaatgccatttcgtcgggtgtcatcactccagggatagtgagcataccgagtgtcgctcatgttgtgaggggatgatttgcaacgtggagctgccaaccaatcacactaacgctgtgttcgcagtgatgcatgcccagcggacatccggatccagtgcaccgaccctgtacctgcccgtcctcgcttgggtgttcgtgctgcctttgctctag

SEQ ID NO: 51141 - DNA, 552 bp, Artificial Sequence
  Description of Artificial Sequence: Synthetic coding sequence
atgctgtataagtcaagtgaccgcccagcccacaaagtcagcatgctcctgctgtgccacgccctggctatcgccgtcgtacagatcgtaattttttcagagtcctgggcatttgcgaagaacattaacttctacaacgtgcgaccgcctttggatccaaccccattcccaaactccttcaaatgttttacatgcgaaaatgccggtgacaactacaactgcaatagatgggctgaggacaaatggtgtccccaaaacacacaatactgtctaacagtgcatcactttacttctcatggccgaagtaccagcatcaccaaaaaatgtgcaagcaggtcggagtgtcacttcgtggggtgtcaccatagtcgggatagtgaacacacagaatgccgatcatgctgcgaagggatgatctgtaacgtggagctgcctacaaatcacacaaacgcggttttcgccgtgatgcacgcccagagaacgtcaggctcaagcgccccaaccctgtatttgcctgtcctggcatgggtgttcgttctgccactcctgtag

SEQ ID NO: 51142 - DNA, 624 bp, Artificial Sequence
  Description of Artificial Sequence: Synthetic coding sequence
atgctgctcattaccctctccgctaacctgttcacggtcccagaaagatcacttaccacaacatttagcttcagccggtataaatccagcgaccggcctgctcataaagtcagcatgctgctcctctgtcatgcccttgccattgcagtggtgcaaatagtgattttttctgagagctgggcgtttgccaagaacatcaacttttacaacgtcagaccgcctctggacccaactccctttccaaattccttcaaatgttttacttgcgaaaacgccggagataattataactgtaatcgttgggctgaggacaagtggtgcccacagaacacacagtattgtctgaccgttcatcatttcacaagtcacggcaggtcgacgagcatcaccaagaaatgcgcttcacgctcggagtgtcacttcgtagggtgccatcactcccgggacagcgaacataccgagtgcagaagttgctgtgaaggcatgatatgcaacgtggagctgcccacaaaccacacaaacgctgtattcgccgtgatgcatgcccaacgcacaagcggctctagcgcgcctacgctgtatctccccgtgctcgcgtgggtattcgttctgccactcttatag

SEQ ID NO: 51143 - DNA, 552 bp, Artificial Sequence
  Description of Artificial Sequence: Synthetic coding sequence
atgctgtataagagttctgacagaccagcccataaagtaagcatgctcttgttgtgtcatgcactcgctattgcggtagtgcagattgtgattttttccgagtcatgggcctttgccaagaacattaacttttacaatgtgagaccgccactggatcccaccccattcccaaattctttcaagtgttttacatgtgaaaacgccggtgataattacaactgtaacagatgggcagaagacaaatggtgtccgcagaacactcagtattgcctgacagtacaccattttacctcgcatgggaggagcacttctatcacgaagaagtgtgcctcacgctccgagtgccacttcgtgggctgtcaccatagccgtgatagcgagcatacagagtgcaggtcttgctgcgagggaatgatctgtaacgtggagctgccaaccaatcacacaaatgcggtgttcgccgttatgcacgcccagcggacttcaggctccagcgcccctaccctctacctgccagtcttggcctgggtgttcgtgctgcctcttttgtag

SEQ ID NO: 51144 - DNA, 378 bp, Artificial Sequence
  Description of Artificial Sequence: Synthetic coding sequence
atgaaagccctgatgctgttgaccctctccgtgctcctgtgctgggtcagtgcagatatcaggtgtcattcttgctacaaagtccctgtgctcgggtgcgtggataggcagtcctgccgtctggaaccaggacagcagtgcctcaccactcacgcttatcttgggaaaatgtgggtgttctcaaatctacgctgcgggacacccgaggagccctgccaagaggcctttaaccagacaaataggaaactggggctgacatacaacacaacatgctgcaacaaggacaactgcaatagtgcaggtcctcgtccaacccccgcactcggtctggtattcctcacctccctggccggactcgggctgtggctgctgcactag

SEQ ID NO: 51145 - DNA, 378 bp, Artificial Sequence
  Description of Artificial Sequence: Synthetic coding sequence
atgaaggcgctcatgttgctcaccctctctgttctgctgtgttgggtgtccgccgacattcgctgccattcctgctacaaagtgccagtcctggggtgcgtggaccgtcagtcctgccggctcgagccaggacagcagtgcctcacaactcacgcttatctcggcaaaatgtgggtatttagtaacctccgctgcggtacccccgaggagccatgtcaggaggcctttaatcagacaaaccgcaaactgggcctcacctataatactacttgctgcaataaagacaactgcaattctgcaggaccacgacccacacctgccctcggactcgtgtttctcacatctctggccggactcgggctctggctgttgcactag

SEQ ID NO: 51146 - DNA, 378 bp, Artificial Sequence
  Description of Artificial Sequence: Synthetic coding sequence
atgaaagccctgatgctcctgaccctgtcagtcctcttgtgttgggtttcggctgatattaggtgtcatagttgctataaggttcctgtcctcgggtgcgtcgaccggcaaagttgtcggctggagccgggtcagcagtgcttaacgacacatgcgtacttaggcaaaatgtgggtgtttagcaacttaagatgcggcacccctgaggaaccgtgtcaggaggcgttcaatcagactaaccgaaaactgggccttacatacaacacaacatgctgtaataaggacaattgtaacagcgctggacccagacccactcctgccctgggtctggtatttcttacatccctggccggtcttggcttgtggttgctgcactag

SEQ ID NO: 51147 - DNA, 378 bp, Artificial Sequence
  Description of Artificial Sequence: Synthetic coding sequence
atgaaagctctgatgttgctaactctttccgtgctcctgtgctgggtgagcgcagacatccgatgtcacagttgctataaagtaccagtgctcggatgcgtcgaccgacagagttgcaggctcgaacccggacagcagtgtctcacaacacacgcctaccttggaaagatgtgggtgttcagcaatctgcgctgtggcacgccagaagagccttgccaagaagcattcaaccagactaaccgcaagctcggcctaacgtacaatacaacatgttgcaacaaggataactgtaattcagctggccctcgacccactcctgccctggggctggtgttcctgacctctcttgccggtctgggtctgtggttgctgcattag

SEQ ID NO: 51148 - DNA, 378 bp, Artificial Sequence
  Description of Artificial Sequence: Synthetic coding sequence
atgaaagccctgatgcttctgaccttgagtgtgctgctgtgctgggtttcagcagatatccgatgtcacagctgctataaggtccctgtgctgggctgcgtcgaccgtcagtcttgtaggcttgaaccagggcagcagtgtctgactacccacgcgtacctcgggaaaatgtgggtgttcagtaatctgagatgtggtacaccggaggaaccatgccaggaagctttcaaccagacaaaccgcaagctcggactgacttacaacaccacctgttgcaacaaagataattgcaattccgccggtcctcggccaacacccgctctagggctcgtcttcctgacatctctagccggtctgggcctgtggctgttgcattag

SEQ ID NO: 51149 - DNA, 378 bp, Artificial Sequence
  Description of Artificial Sequence: Synthetic coding sequence
atgaaggcgctgatgctgctgacattgagcgtgttactctgctgggtaagtgcagacatcagatgtcattcatgttataaagttccagtgcttggctgtgtggatagacagagctgcagactagaacccggacagcaatgcctgactacccacgcatacttgggaaagatgtgggtgttttcaaacctgcggtgcggaacccccgaagagccgtgccaggaggctttcaaccagacaaacaggaaattgggactgacatacaataccacttgttgcaacaaggacaactgcaactcagccggaccgagacccactcctgcgctaggcctggtgttcctcaccagccttgccggattaggactgtggctgttgcattag

SEQ ID NO: 51150 - DNA, 378 bp, Artificial Sequence
  Description of Artificial Sequence: Synthetic coding sequence
atgaaagcacttatgctgctgacattatcagtgcttctgtgctgggtttccgcggatatacgctgccactcttgttacaaggttcccgtcttagggtgcgttgatcgccagtcttgccgacttgagccagggcagcagtgccttaccacccacgcctacctcggcaaaatgtgggtgttcagtaacctaaggtgtgggacacctgaggaaccctgccaggaggcgttcaatcagaccaatcggaagctgggactgacttataacacgacctgctgcaataaggacaactgcaattctgcagggcctagaccgactcccgctctcggcttggtgttcctgacaagcctggcgggattaggcctttggttattgcattag

SEQ ID NO: 51151 - DNA, 210 bp, Artificial Sequence
  Description of Artificial Sequence: Synthetic coding sequence
atgtgggtgttttctaacttgcggtgtggaacaccagaagagccctgtcaggaagccttcaatcagaccaatcgaaaactcggacttacctataataccacatgctgtaacaaggataactgcaactctgctgggccacgtccaactccggcactgggactggtgttcctcacctctttagctgggctcggattatggcttctccattag

SEQ ID NO: 51152 - DNA, 210 bp, Artificial Sequence
  Description of Artificial Sequence: Synthetic coding sequence
atgtgggtattctcaaacctcagatgtggaacaccagaggagccctgccaggaagcgttcaatcagacaaatcggaaactgggccttacatataacaccacgtgctgcaacaaggataactgcaactctgctggcccaagaccaacccccgcacttgggctcgtatttctcacctcactcgccggtttagggctgtggctgctgcattag

SEQ ID NO: 51153 - DNA, 894 bp, Artificial Sequence
  Description of Artificial Sequence: Synthetic coding sequence
atggccgtactcttcctgctcctattcttatgtggcaccccccaggcagccgataacatgcaagcaatttatgtggccctgggagaggccgtcgaactgccatgcccttcccctcccacactccatggagacgagcacctgtcatggttttgtagccccgcagctggttccttcacaacgcttgtcgctcaggtgcaggtcgggaggcccgcacccgaccccggaaagcctggacgggagtctaggctgcgactcttgggcaattacagtttatggctcgaaggcagtaaggaggaagatgccggtcggtattggtgtgccgtgttagggcaacaccacaactaccagaattggcgcgtgtacgatgtgctggtcttgaaaggttcccaactaagcgctagagcagcagacggcagcccatgcaacgtgttactttgctctgtagtcccatccaggcggatggattcagtgacctggcaggaggggaagggaccggtgcgagggagagtgcagagcttctggggcagcgaggccgctctgctgctggtctgtcccggagagggcctgagtgaaccacgtagtcggagacccagaattattcggtgtctgatgacgcacaacaaaggggtttcctttagcttggcagcctctatcgacgcttctccagctctgtgtgctcctagcacaggctgggacatgccctggattctgatgttgctccttactatgggccaaggggtagttatcctcgccttatcaattgtcctttggcgacaaagggtgcgcggtgcccctggccgagatgcttcaattccccaattcaaacctgagattcaggtgtatgagaacatccacttggcccgattagggccaccggcacataagcctcgatag

SEQ ID NO: 51154 - DNA, 894 bp, Artificial Sequence
  Description of Artificial Sequence: Synthetic coding sequence
atggccgtgttgttcttgctcctgttcctgtgcggtaccccccaagcagccgataacatgcaggccatctacgtggccctgggagaggccgtggaactgccttgcccatcaccccctactttacatggtgacgagcacctatcctggttctgtagcccagctgccggttcattcaccaccctggttgcccaggtgcaggtgggaagacccgctccggaccccggaaaacctgggcgtgagagcaggcttaggcttttagggaattactcgctctggctggagggatccaaagaagaagacgcagggcgttactggtgtgcagtactcgggcagcaccataattaccagaattggagggtatatgacgtactggtgctgaagggatcccagcttagcgcgagggcagctgatggttccccttgcaacgtactcctgtgcagcgtggtaccttctcgcagaatggattccgtcacttggcaagaggggaaagggccagtgcggggtagggttcagtccttctggggctcagaggcggctctgcttctggtatgccctggagaagggttgagcgagccgagatctcgccgtccaagaattatcaggtgcctgatgacacacaataaaggtgttagcttcagcttggcagcctctatagacgcctcaccggctctgtgtgccccttcaaccggctgggacatgccctggatcctcatgttactgctgacaatgggccagggcgttgtgatcctggccctgtccattgtgctgtggcgccagagggtcaggggcgctcccggaagggatgcttcgattcctcagtttaaacccgagattcaggtctacgagaatatacacctagctaggctgggccctcccgcacataagcctcgttag

SEQ ID NO: 51155 - DNA, 894 bp, Artificial Sequence
  Description of Artificial Sequence: Synthetic coding sequence
atggccgtcctcttcttgttgttgttcctctgtggcaccccacaagccgcagataacatgcaggctatatacgttgccctgggagaggcggttgaactgccatgcccaagtccccctaccctccatggtgatgagcacctgtcttggttctgcagtccagccgctggcagctttaccaccttagttgctcaggtgcaggtcggacgaccagcgcctgaccccggtaagccaggcagagagagcagactccggcttctgggaaattattcgctttggttagaaggtagcaaagaggaggatgcagggaggtattggtgtgcagtccttggccagcaccacaactaccagaattggcgtgtctacgatgtgctcgtgctaaagggctctcaactgagtgcacgcgcagctgacggatcaccctgtaatgttctgttgtgtagcgtcgtcccttctagacgtatggattccgtcacctggcaggagggaaaaggccctgtcagaggcagggtgcagtcattttggggctccgaggcggcactgctgctggtctgtcccggagaaggacttagcgaaccaaggtcacgcagaccaaggattatccgctgcctgatgacccacaacaaaggtgtgagcttctcactggcagcgtccattgatgccagcccagcactttgtgccccatctaccggatgggacatgccctggatccttatgctgttgttgacaatgggacagggggtcgtcattctggcgctgagtatagtcttgtggcgtcagcgtgtgcgaggcgctcccggtagggatgcctctataccgcagtttaaaccagagatccaggtgtacgaaaatatccatctggccagattgggcccaccggcacacaagcccagatag

SEQ ID NO: 51156 - DNA, 894 bp, Artificial Sequence
  Description of Artificial Sequence: Synthetic coding sequence
atggctgtgctgttcctcttgctattcctctgcgggaccccacaggcggcagataacatgcaggctatttacgtggcgctaggagaagctgtggaattgccgtgtcccagtccccctaccctccatggcgacgagcacctttcctggttttgttcacctgcagccggttccttcaccaccttggtggcacaggtgcaggtgggacgtccagcgcctgaccccggaaaacccggtagggagagcagactgcgccttttaggtaactactccctctggctggaaggcagcaaggaagaggatgctggcaggtattggtgtgctgttttggggcaacaccataattatcagaattggagagtgtacgacgtcctcgtgctcaaaggtagtcaactgtccgccagagccgctgacggctcaccttgcaacgttctactgtgttctgtggtcccgtcaagaagaatggacagtgtgacttggcaggaaggcaaaggtcctgtccgtgggagggtacagagtttctggggttctgaggctgcactgctgctggtttgtccaggcgaaggcttatccgaaccacggagtcggcgaccaaggatcattagatgcctgatgacacataacaaaggtgtaagcttctcactggccgcatccatcgatgctagccccgcactgtgtgcgccttccactgggtgggacatgccatggatacttatgttactcttaaccatgggtcagggggtagttatcctggctctcagcatcgtgctgtggcggcagcgagtgcgaggcgctcctgggagagacgccagtatcccacagttcaagcctgaaatccaggtgtacgagaacatccatttagcacggctcgggccaccagctcacaaaccacggtag

SEQ ID NO: 51157 - DNA, 894 bp, Artificial Sequence
  Description of Artificial Sequence: Synthetic coding sequence
atggccgtgctgttccttctgcttttcttgtgtggtacccctcaagcggcagacaatatgcaagccatttacgtcgctctaggtgaggccgtggaactgccctgtccatcccccccaacactgcacggtgacgagcacctgagctggttttgcagccccgctgctggaagcttcactaccctagtggctcaagttcaggtggggaggcccgctccagaccccggtaagccaggtcgagagtcccgcttgagactactggggaactactctttgtggttagagggctctaaggaggaggatgccggaagatactggtgcgcagtcctgggccaacatcataactaccagaactggagggtttacgatgtcctcgtgcttaagggttcacaactgagcgccagggcggcagatgggtccccttgtaatgttctgctctgtagcgtggtccccagtcggagaatggactcagtcacttggcaggaaggtaagggccctgtgcggggtagagtgcagagtttctggggaagcgaggccgctctgctgctggtgtgtccaggcgagggcctgtctgaaccgagatcccgcaggccgcgaatcataaggtgtctgatgacacataataagggagtctccttttctctcgccgcaagcatagatgccagcccggcactgtgtgcgccaagtacaggatgggatatgccttggatattgatgctgttattaacaatgggacagggagtggtgatcctcgctctttcgattgtgttgtggcgtcaacgtgtcagaggcgcacccggtcgggacgccagtattccacagttcaagcccgaaattcaggtgtatgagaacattcacctggcccgtttagggcctccagcccacaagccgaggtag

SEQ ID NO: 51158 - DNA, 1149 bp, Artificial Sequence
  Description of Artificial Sequence: Synthetic coding sequence
atggccgtcctgttcctgctactgtttctatgtggtactccccaggctgcagacaacatgcaggcaatctatgtcgccctgggtgaggccgtcgagttgccctgcccatctccaccaacactgcacggagatgaacatctcagttggttttgctcccctgcagcaggctcattcacgacactggtcgctcaagttcaagtggggagaccggcacctgaccccggtaaaccgggacgcgaatctcgcctgcggttattaggaaattacagcctctggttggagggctccaaggaagaggacgccggtaggtattggtgcgcagtgctggggcagcaccacaattatcagaactggcgcgtgtacgacgtcctggtgcttaaggggagccagctgagcgcaagggcagcagacggcagcccgtgcaacgtgctgctgtgcagcgtcgtaccatcgcgacggatggacagcgttacctggcaggagggaaagggccctgtgcgtggccgagtccagtctttctggggatcggaggccgcactcctccttgtctgccccggtgagggactcagcgaaccgaggagtcggaggcctcgaattatcaggtgtttaatgacacacaataaaggggttagcttcagcctcgcagccagtatcgatgcctctcctgccctgtgtgccccttcaacaggctgggacatgccctggatccttatgctgctgctcaccatgggacaaggtgtcgtgattctggcattatccatagtcctctggcggcagagagtccgtggggctccaggtcgcggaaatcgcatgaggtgctataactgtggagggagccccagcagcagctgcaaggaggccgtgacgacgtgtggagaagggagaccccagcctggactcgagcagataaaacttcctggaaacccgcctgtaaccctgattcaccaacatcctgcctgtgtcgcagctcaccattgcaaccaggtggagaccgaaagcgtcggagacgtcacataccccgctcatcgtgactgttatctgggcgatttatgcaactccgcagtcgccagtcatgttgcacccgctggtattttggcagccgcagccacagcgctaacctgcctcctccctggcctgtggtctggctag

SEQ ID NO: 51159 - DNA, 1149 bp, Artificial Sequence
  Description of Artificial Sequence: Synthetic coding sequence
atggccgtactcttcctgctgttgttcctctgcggcacacctcaggctgccgacaatatgcaagcaatatatgtggccctcggggaggcagtggaactgccctgtcctagtcctccgaccttgcacggtgacgaacatctgagctggttttgctctcctgctgccggatcctttaccacgctggtggcgcaggtccaggtggggagacccgctcccgatcccggtaagccaggcagggagtccaggcttagactcttggggaactacagcctgtggctggaaggaagtaaagaagaagacgccggacggtactggtgcgccgtgttaggccagcaccataactaccagaattggagagtgtatgacgtcttggtgctgaaaggttcccaattatccgccagagcagccgatggaagcccctgtaatgtgctgctgtgtagcgtcgtgccttcccgaaggatggattccgtcacatggcaggagggtaagggccctgtaagggggagggtgcagagtttttgggggtcagaagcagctctgctcctcgtttgccctggcgagggcctgtcagaacccaggtcaaggagaccacggatcattcgctgtctcatgactcataataagggagttagcttttcactcgccgcttccatcgatgctagtcccgcactttgtgctcctagcacaggctgggatatgccatggatcctaatgctcttgctaacgatggggcagggcgtagttatccttgccctgtcaatcgtcctgtggcgccagagagtgcggggagcccctggacgaggcaacagaatgcgttgttataactgcggtgggagcccaagcagtagctgcaaagaagcagtgaccacatgcggagagggcagacctcagcccggactcgagcaaattaaactgcctggcaacccgcctgtaacactgatccatcaacatcctgcctgtgtagccgctcaccactgcaatcaggtagagactgagagtgtgggtgatgtgacctatccagcccatcgtgattgctacctgggagatttatgcaacagcgcagtagcctcgcacgtagctccagctggtattctagcagctgccgcaacagctctgacctgtttgctcccaggactttggtcgggctag

SEQ ID NO: 51160 - DNA, 1149 bp, Artificial Sequence
  Description of Artificial Sequence: Synthetic coding sequence
atggcggttctctttttgcttctgtttctatgcggcacgcctcaggcagcagataacatgcaggccatatatgtggcccttggggaggccgttgagcttccctgccctagccccccaacgctgcacggagacgaacacctgtcttggttttgcagccctgcggctggaagttttactaccctcgtcgcgcaagtgcaggtgggtcggcctgccccagatcctggtaaaccaggtcgggagtctagactccgtctcctggggaattactctctgtggctggaaggatcaaaagaggaggatgcaggaaggtattggtgcgctgtgctgggacaacatcacaactaccagaactggcgagtctatgatgttctggttcttaaaggatctcaattgtccgcacgagcagcggacgggtctccgtgtaacgtccttctatgctcagtcgtccccagtaggcgcatggatagtgtcacttggcaggagggaaagggtcctgttcgcggtcgagtgcaatctttttgggggtccgaagccgctttactgctggtatgtccaggagagggtttgtctgagccaagatctaggagaccgaggatcatccgttgtttaatgacccacaataaaggggtttccttctcccttgccgcttccatcgacgctagccccgcactgtgcgcccctagcactggctgggacatgccttggattctaatgctgttgttgacgatggggcaaggggtcgtcatccttgctctgtcgatcgtgctctggcgacagagagtgcggggagctcccggtcgaggaaaccgcatgcgatgctacaactgcgggggttctcctagctcatcctgtaaggaagctgtgaccacgtgcggagagggacgcccacagccaggattagagcagatcaagctacccggaaacccccctgtaaccctgatccatcaacatcctgcctgcgttgccgcacaccactgcaaccaggtggagactgaaagcgttggtgatgtgacttatcccgcacatcgcgactgttacctcggggacctgtgtaacagcgccgtcgcaagtcacgtcgcccctgctgggatcttagcagccgcagcaaccgcactgacctgtctgctgccagggctttggagtgggtag

SEQ ID NO: 51161 - DNA, 5169 bp, Artificial Sequence
  Description of Artificial Sequence: Synthetic coding sequence
atgaggactggttgggcaacccctagacgcccagctggattactgatgctactgttctggttttttgacttagcagaaccctccggccgagccgctaacgacccattcactattgtgcacggaaacacaggtaaatgcattaagccagtgtatggctggatagtggcagacgactgtgacgagacagaagacaagttatggaagtgggtctcacagcacaggctctttcatctgcactcccagaaatgcctggggcttgacattaccaagagcgtgaacgagctgcgaatgttctcctgcgatagctctgctatgctgtggtggaagtgcgagcaccatagcctgtacggcgctgctcgatataggcttgccctgaaagatggacacggcactgctatcagtaacgccagtgacgtgtggaagaagggagggtctgaggaaagtctgtgtgatcagccctaccatgaaatctacaccagggacggcaactcctatggcagaccatgcgagttcccgttcctcattgacggtacctggcatcacgattgtattctcgatgaggaccattcgggcccatggtgcgcaactacccttaactacgagtacgaccgtaagtggggtatctgcctcaaaccagaaaatggctgtgaggataactgggagaaaaacgaacagtttggaagctgttatcagttcaacactcagaccgcactctcctggaaagaggcctatgtcagctgccagaaccagggcgcagacctgcttagtataaactcagctgcagagcttacatatctcaaggaaaaggaaggcatcgccaaaatattttggataggcctcaatcagctgtactccgctcgcggttgggagtggtcggaccacaaaccactcaatttcctgaattgggaccccgaccgtccatcggccccaaccattggcggatcgtcttgtgctcggatggatgcagaatctggtctgtggcagagctttagttgcgaggcacaactgccgtatgtgtgcagaaagcctttaaacaacaccgtggagcttacagacgtgtggacctattctgacacaagatgtgatgccggatggttgcccaataatgggttctgttacctcctcgttaacgagagtaatagttgggacaaagcacatgctaagtgcaaggccttcagcagcgaccttataagcattcattcccttgcagatgtggaggtggttgtgaccaaacttcacaacgaggatatcaaggaggaggtgtggattggattaaaaaacatcaacattcccacactcttccagtggagcgatggaactgaggtcacgttaacctactgggacgagaacgaaccgaatgtaccatacaacaagacccctaactgtgtcagctatcttggtgaattgggtcagtggaaagtccagagctgcgaagaaaaactaaagtatgtgtgcaaaagaaaaggggaaaagctcaacgatgctagtagtgataagatgtgtccgcctgatgagggttggaagaggcacggtgaaacctgctacaagatttacgaagatgaggtgccatttgggaccaactgcaaccttaccattaccagtaggtttgaacaggaatacttgaatgacttgatgaagaagtatgataaaagccttcgtaagtacttttggaccggattaagagatgtggacagttgtggagagtacaactgggccaccgtggggggtcgacggcgtgcggtcacttttagtaactggaatttcctggagcctgcaagcccgggtggatgcgtggctatgtctaccggaaagtctgttggtaagtgggaggtcaaagattgccggagcttcaaggcgctcagtatttgcaaaaagatgagtggtccattggggccagaagaggcgtcacctaaacccgacgacccatgtcccgaaggatggcaaagcttccctgcttctctgagctgttataaggtcttccacgcagaacgcatagtgaggaaaaggaactgggaggaagcggaacggttctgtcaggcactaggagcacatctttcttccttctcacacgttgacgagatcaaagagttcctccatttcctcactgaccagttctccggacagcactggctgtggatcgggctgaataagagatctcccgacctgcaggggtcctggcaatggtctgatcgcacgcctgttagtacgattatcatgcccaatgagtttcaacaggactacgatatccgggactgcgccgctgttaaggtctttcatcgcccatggcgccgtgggtggcatttttacgacgacagggagttcatctatctgcgtcctttcgcatgcgacacaaaacttgaatgggtttgccagatccccaagggcaggacgccgaagacacctgactggtacaaccctgatcgggctggaattcatggacctccccttatcatcgaagggtcagaatattggttcgtggcggatctgcatctgaattacgaggaggcagttctatactgtgctagtaatcactcttttctggctaccattacctcatttgtgggtttgaaagctatcaaaaataagatcgccaatatatcaggagacggacagaaatggtggattcgtataagtgaatggccgatcgacgatcacttcacgtatagccggtacccttggcacaggtttcccgtgacatttggcgaggagtgcctatacatgtcggcaaaaacatggctcatagatctcgggaaacccaccgattgttctaccaaacttccgtttatttgcgagaaatataacgtatcatctttagagaagtattcaccagattctgccgctaaggtacagtgctccgagcagtggatccctttccagaacaaatgctttctgaagattaagccagtcagtttgactttcagccaggcttccgatacttgccactcctatggaggcaccctgcccagcgtcctttctcagattgaacaggacttcatcactagcctgcttccagatatggaggccactctttggataggtttgagatggacagcatacgaaaagataaacaaatggactgataaccgggaactcacatactccaattttcatcccttattggtatcagggaggcttcgaatcccagaaaacttcttcgaagaagagagccgctaccactgcgccctaatactaaacctccagaagagccctttcacaggcacctggaatttcacatcttgtagcgagcgccactttgtctctctttgccagaagtattcagaggtgaagtcgcgccagacgttacagaacgcatccgaaaccgttaaatatttaaacaacctttacaagatcatcccaaaaaccctgacatggcactctgccaaaagagaatgtctgaagtctaatatgcagctggttagtatcacagatccttaccagcaggcttttctgagtgttcaggccctgctccataatagctccttgtggattggtctgttcagtcaggacgatgaactgaatttcggctggtcagatggaaagcggctgcacttttcaaggtgggcagagacaaatgggcagctggaggattgtgttgtgctggacaccgacggcttttggaagacagtggactgcaacgacaatcaacccggagccatctgttattattccggaaacgagacggagaaggaagtcaagccggtcgatagcgttaaatgtccttcgcctgtactgaacaccccttggattccgtttcagaactgctgttataatttcattattacaaaaaatcgccacatggctaccactcaagacgaagtccacaccaagtgccagaagttaaaccctaagtcgcatattctgagtattcgcgacgagaaagagaacaatttcgtcctcgaacagctgctgtattttaactacatggccagctgggtgatgctcggaatcacatatagaaacaagtccctaatgtggtttgataagactccactaagttacacacactggcgtgccggtcgacccacaatcaagaacgagaaatttctggcgggtctgtcgacagacggcttttgggacatccaaacgtttaaagtaatagaggaggccgtgtacttccaccagcattcaatcctagcctgcaagatagagatggtcgactataaggaagagtataacactactctcccgcagtttatgccttatgaggacggcatttatagtgtcatacagaagaaagttacctggtacgaggctctcaacatgtgcagccaaagcggagggcatttagcctctgtacacaatcagaatggtcagctttttctcgaagatatcgtgaagagggacgggtttccgctgtgggtaggactctcctctcacgatggctctgagtcgagttttgaatggtctgatggatccactttcgactacataccttggaagggccagacttcacccggaaattgtgtgctgctggaccccaagggcacttggaagcatgagaagtgcaacagcgtgaaggatggggctatatgttacaagccaaccaagagtaagaagttgtccaggctgacttattcaagtcggtgccccgcagctaaagaaaacggctccaggtggatccagtataagggacactgttataaaagtgaccaggcattgcattctttctcggaggcaaaaaaactgtgcagcaagcatgatcactcagcgactatagtgtcgattaaggacgaggacgaaaacaagttcgtatcacgcctcatgagagagaacaataatatcaccatgcgggtctggctcggattgagccagcatagcgttgatcagagctggtcctggctggacggcagcgaggtaactttcgtcaagtgggagaacaaatccaaatctggggtcgggaggtgttctatgctgattgcttctaacgagacgtggaaaaaggtcgagtgtgagcacggttttggtcgagtggtgtgtaaagtgcccctcggcccagactacactgctatagcaattattgtggcaactctgagcattcttgtgctgatggggggactgatctggtttctgtttcaaaggcaccgcttgcacttggccggttttagcagcgtgcgttatgcccagggagtgaacgaggacgaaatcatgctcccttcatttcacgactac

SEQ ID NO: 51162 - DNA, 5453 bp, Artificial Sequence
  Description of Artificial Sequence: Synthetic coding sequence
atgcgcaccggatgggccactcctcgaaggcctgccggtctgctgatgctacttttttggttcttcgacttagccgagcccagtggcagggccgctaacgatccatttactatcgtacacggaaacacaggcaaatgcatcaagccagtatacggctggatagtggccgacgattgcgatgaaaccgaggataagctgtggaaatgggtgagccagcatcgcctgtttcacctccacagtcagaagtgtctcgggctggatattacgaagagcgtaaacgagttacgcatgttttcttgtgatagtagcgccatgctgtggtggaagtgtgagcaccattctctctacggagccgctcgatatcgactcgccttaaaagacgggcacggtactgccatctctaatgcgagcgacgtgtggaaaaaagggggatccgaggaatcactgtgcgatcagccctaccatgaaatttacacgagggacggcaactcttatggcaggccatgtgagttcccctttttgatagacggcacctggcaccatgactgcatacttgacgaagaccattcaggtccatggtgcgctacaacactgaactatgagtatgatcgcaagtggggcatatgccttaagccggagaacggctgtgaagacaactgggagaagaacgagcaatttggtagctgctaccagtttaacacacaaaccgcactgagctggaaggaggcatatgtgtcatgccagaatcagggcgctgatctgctaagtattaactctgcagccgagctcacttatctgaaggagaaagaggggatcgccaagattttctggataggcctgaatcagctgtattctgccagaggatgggaatggagtgaccataaacccttgaattttctgaattgggatccagacaggccatccgcgcctacaatcggaggcagcagctgtgccaggatggacgcagagtcggggctgtggcagagcttcagctgtgaagctcaattgccgtatgtctgtcggaaacctctaaacaataccgtcgaactaacagatgtgtggacttactctgacacccgatgtgatgccggatggctgcctaacaatggcttctgttatctgctagtgaatgaatcaaattcatgggacaaagcccatgccaaatgtaaggctttctcgtcagatctcataagcatccattcgcttgcagacgttgaagtggtggtgacgaagctacataacgaagatatcaaagaggaagtatggatcgggctcaaaaacatcaatattcctacgctgtttcagtggtctgatggtaccgaagttactttaacatattgggacgagaacgagccaaacgtcccttacaataaaacccctaactgcgttagctaccttggggagctcggccagtggaaggttcagtcttgcgaagagaagctgaagtatgtgtgcaaaagaaagggggagaagctcaacgatgcatcctccgacaaaatgtgtccacctgacgagggctggaagagacacggcgaaacctgttataaaatctacgaagacgaggtccccttcggcacgaactgtaacctgaccatcacgtctaggttcgagcaggaatatctaaatgatttgatgaaaaagtatgacaaaagcttgaggaagtatttttggactggccttcgtgatgttgatagctgcggggaatataattgggcaaccgtgggaggacgtaggagagcagtgacattttcaaattggaacttcctggagccggctagccctggaggctgcgtagccatgagtacaggaaaaagcgtggggaagtgggaagttaaagattgtagatcctttaaagccctttccatctgcaagaaaatgtctggcccactaggccctgaggaggctagcccgaagccagacgacccttgccccgagggatggcaaagtttcccggcttctctcagctgttacaaagtgtttcacgccgagcgaatcgttagaaaaagaaattgggaggaggctgagcgtttttgtcaagcgttgggcgcacatctgtcttccttttctcatgttgacgaaattaaggagtttcttcatttcttgactgaccagttcagcggccagcactggctgtggattggcctgaataaaaggtctccggaccttcagggtagttggcagtggagcgataggacacctgtgtcaaccattatcatgccgaacgaatttcagcaggattacgatatcagggattgtgccgcagtgaaggttttccaccggccatggagacgagggtggcacttctatgacgatcgggagtttatctatctacggccattcgcatgtgacacgaagctggagtgggtgtgccagatccccaaggggagaaccccgaagactcccgattggtacaatccagatagggctgggatccatgggcctcctctgatcatagaaggctctgaatactggtttgtggctgacctacacctaaactacgaggaggcggtcttatattgtgcctcaaatcattcttttctggcaaccatcacctcttttgttggattaaaggcaattaaaaacaagattgccaatattagtggggatggtcaaaaatggtggatccgcattagtgaatggccgatcgatgaccactttacctactctcggtacccttggcacaggttcccagtaacctttggtgaggaatgcctctacatgtccgctaagacgtggcttatagaccttgggaagccaactgattgttcaactaagctcccctttatctgcgagaaatacaatgtttcgagcctggaaaagtattcgccagattccgcggcaaaggtacagtgcagcgaacaatggatccctttccaaaataagtgcttccttaaaataaagcccgtttccctgacctttagccaggcatctgatacctgtcattcctatggtggaacgctgccctctgtgctcagtcaaatcgagcaggactttattactagcctgctgcccgatatggaggcaactctatggatcggcctcagatggacggcctacgaaaaaatcaacaagtggacagacaatcgtgaactgacctactccaactttcatccgctgcttgtgtccggcagactgagaatacctgaaaatttctttgaggaggaatctagataccactgcgccctgatcctgaacctgcagaagagcccatttaccgggacttggaacttcacaagctgctcagaacgccactttgtttccctgtgtcaaaaatacagtgaggtgaaatctcgccagacattacagaacgcgagtgaaacggttaagtatctgaacaatctctacaaaatcattcccaaaacactgacatggcattccgctaagagagaatgcttgaagtctaacatgcagttggtgtcgattacggacccttaccagcaggcctttctgtcagtgcaggccctcttacacaatagtagcctgtggataggtcttttcagccaggacgacgagctgaatttcggttggtctgacggtaaacgtctgcacttcagcagatgggccgagacgaacggccaacttgaggattgtgtagtactcgatacagacggattttggaaaaccgtagactgtaatgataatcagcccggagctatctgttactacagcggtaatgaaacggagaaggaggtgaaaccagtggactccgtgaaatgtcccagccccgtgctgaacactccctggataccattccagaattgctgctacaactttattattacaaagaaccgccatatggccactacccaggacgaagttcacactaagtgccagaaactgaacccaaaaagtcatattctatctatacgtgacgaaaaggaaaataacttcgttctcgaacaactcctgtactttaattacatggcatcatgggtgatgctgggaatcacctatcgcaataagtctctgatgtggttcgacaagacgccccttagttacacccactggcgtgcgggaaggcccacaatcaagaacgagaagtttttagccggactgtccactgacggtttttgggacattcagaccttcaaggtgattgaagaagccgtttactttcaccaacattccattctggcctgtaagatcgagatggtggactataaagaggagtataacacaaccctaccacagttcatgccatatgaagacggtatatactctgtaatccagaagaaggttacctggtacgaggctctgaatatgtgctcacagtcaggagggcacttagcgtccgtgcacaatcagaacgggcagctcttcctggaagatatcgtgaagcgggacggatttcccctgtgggttgggctgtccagccacgacggatcggagagttcttttgaatggtcagatggatcaaccttcgactatattccctggaagggacagacctcccctggaaactgtgtgctcctcgaccccaagggcacctggaagcatgagaagtgtaactccgtcaaggatggagctatttgctacaagcctaccaagtccaaaaaactgtcacgcctgacatattcctcgagatgtccagcagctaaagaaaatgggtctaggtggattcaatacaaagggcactgttataaatctgatcaggcgctgcactcattttccgaagccaagaagttgtgcagtaagcacgaccactcagcaactatcgtgtctattaaggacgaagatgaaaataaatttgtctcaagattgatgcgagagaacaataatattaccatgcgcgtgtggctcggccttagtcaacactcggtagattgcccgtcctctacatggatacaattccaggacagctgctacatcttcctccaggaagctataaaggttgagagcatcgaggatgtcaggaaccaatgcacagaccatggagctgatatgatctccattcataatgaggaggaaaacgcttttatactcgacactttgaagaaacagtggaaaggcccagatgacattctgctaggcatgttttacgacacagacgacgcatcatttaagtggttcgataattctaacatgacctttgacaagtggacagatcaggacgacgacgaggacttggtggatacctgtgcatttcttcatatcaaaacaggcgaatggaaaaaaggaaattgtgaagtctctagtgtggaagggacactatgtaagactgccattccatataaacgtaaatatctttctgataaccacatcctgatttccgctctcgtgattgccagtacagtgatcctgactgtgctaggagccataatttggttcctgtacaagaagcactcggactcccggtttacaacagtcttttctacagcacctcaatccccatataacgaagattgcgttctcgtggtgggcgaggaaaacgaatatcccgtgcagtttgacta

SEQ ID NO: 51163 - DNA, 5621 bp, Artificial Sequence
  Description of Artificial Sequence: Synthetic coding sequence
atgcgcaccggatgggctacaccaagaagaccagccggtttactgatgctgctcttctggttctttgatttggccgaaccctctggcagagccgctaacgatcccttcacaatcgtgcatggcaatacaggcaaatgtatcaaacctgtttatggttggatcgttgcagacgattgtgacgagacagaagacaaattatggaagtgggtgagccagcaccgactattccatctacactcccagaaatgcctgggacttgatataacaaagtcagtcaatgaactgcggatgttttcctgcgatagctcggctatgctgtggtggaaatgtgagcaccacagcctgtatggtgcggctcgttatagactcgccctgaaggacggccatgggactgctatatccaatgcttccgatgtatggaaaaaaggcggtagcgaggagtcactgtgtgaccagccctaccacgaaatttacactagagacggcaactcttacggcaggccatgcgagtttccattcctgattgacgggacttggcaccatgactgtattctagacgaggatcatagtggcccatggtgtgcgacaactcttaattacgagtacgaccggaaatggggtatatgtctcaaacctgaaaatggttgtgaagataattgggagaaaaacgagcagttcgggagttgctaccaattcaacactcagacagcacttagttggaaggaagcctatgtgtcttgtcagaatcagggggctgacttgcttagcattaactccgccgctgagcttacatacctgaaggagaaggagggaattgccaagattttctggattggcctgaatcagctgtatagcgctcgcggttgggagtggagcgatcacaagcccctgaacttccttaattgggatccagaccgtccttctgctcctacgattggagggtcctcttgcgctcgaatggatgccgaaagcgggctctggcagtcctttagctgtgaagcccagctaccgtacgtctgcaggaagcccctgaataatacagtagagttgaccgacgtctggacatatagcgatacccggtgcgatgctggctggctgcctaataacgggttctgctatcttctggtaaacgagtcaaatagctgggacaaagcccacgcgaagtgtaaggctttttcctcagatctgatcagcattcacagtctggcagacgttgaggtggtcgttacaaaactgcacaacgaagacatcaaagaagaggtgtggattggtttgaagaatatcaatatccctacgcttttccagtggagcgacgggacagaagtgactttgacttactgggatgagaatgaacctaacgtgccttacaataagacacctaattgcgtgagctatctcggagagctggggcaatggaaggtgcagtcctgcgaggagaagcttaaatacgtgtgcaaacgtaaaggcgagaaattaaacgatgccagttcagacaagatgtgcccacctgacgaaggctggaaacgtcatggcgagacatgttacaaaatctacgaggacgaggtaccattcggaacgaactgtaatctcacgattacatcccgctttgagcaggaatacctgaatgatctgatgaagaagtatgacaagtctcttcgcaaatacttctggactgggctcagagacgttgacagctgtggcgaatataattgggccactgtgggcggaagacgacgagccgttacattcagcaattggaactttctggagccggcatcccccggagggtgtgtcgctatgtcgactggtaagtcagtgggcaagtgggaggtaaaggattgccgatcgtttaaggccctgtcaatttgcaaaaaaatgtccggcccactggggccagaggaagcaagccctaagcctgacgacccatgtccagaaggatggcaatcgttcccggcatctctctcatgctacaaggtgttccacgccgagagaatcgttcgaaagaggaactgggaggaggctgaaagattctgccaggctttgggtgcgcacttgtcctcattttcgcatgtggatgaaattaaagaattcctccacttcctgactgaccagtttagtgggcagcactggttgtggattgggttgaataagcggtcccctgatttacagggctcctggcagtggagcgataggacgcccgtgagcaccattattatgcccaatgagttccagcaagattatgacatacgcgattgcgctgccgtcaaggtctttcatcgaccttggcgacggggatggcacttctacgatgaccgggaattcatctatctgcgacctttcgcctgtgacaccaagcttgaatgggtctgccagatcccaaaaggcagaacccctaagactcctgactggtataatcccgaccgggcaggcattcacggccctccgctaatcattgagggaagcgagtattggtttgtcgccgatctgcatctgaactatgaagaggcagtcttgtattgcgccagtaatcattcttttctggcaacaattacgagctttgttggattgaaggcgataaaaaacaagatcgctaatatatctggggacggccagaaatggtggataagaatttctgaatggccaattgacgatcacttcacctattcaaggtacccatggcatcggttcccagtgacttttggagaggagtgtctgtatatgtcagcaaagacgtggttaatcgacctgggtaaaccaacagactgcagtacaaaactgccctttatttgcgagaaatacaatgtctcgagcctggaaaagtacagtccagacagcgccgctaaagtccagtgctccgaacagtggatcccatttcagaacaaatgctttctgaagatcaaacctgtcagtctgacatttagccaggcttcagacacatgccactcctacggtggaactctgcccagtgtcctcagtcagatcgaacaagatttcatcacgtccttactccctgacatggaggctacactctggatcggactcagatggacagcttacgagaagatcaacaagtggaccgacaatcgagaactcacctactctaactttcatcctctcctcgtctcaggtcgactcagaatacctgagaatttttttgaggaagagagtaggtatcactgcgccctgatacttaacttacaaaaaagccctttcacagggacgtggaacttcactagttgcagtgaacggcattttgtgagcctgtgccagaagtacagcgaggtcaaatcacgtcagacattgcagaacgcatccgaaaccgtgaagtatctaaacaatctttataagattatccctaagactctgacctggcactccgcaaagcgagaatgtttgaaatccaacatgcaactcgtttctatcacagatccttatcaacaggcttttctttcagtgcaggccctgctccacaactccagcctgtggatcggcttattttcccaggacgacgaactgaatttcggctggtctgacgggaagcgtcttcatttctctagatgggccgagacaaatggtcagctggaggactgcgtggtgctcgatacagatggattttggaagaccgtcgactgtaatgataaccagcctggagctatttgctactatagcggaaatgaaacagaaaaagaagtgaaaccggtcgattcagtaaagtgtccctccccagtccttaacacaccatggatacccttccaaaactgctgttataactttatcatcacgaagaatcgacatatggccacaactcaggacgaggtccatacaaagtgtcagaagttgaaccccaagtctcacatcctctccatacgtgacgagaaagaaaacaatttcgtgctcgaacagctattatactttaactatatggcgagttgggtgatgctgggaataacataccggaataagagtctgatgtggtttgataagactccactgtcctacacccactggcgagcaggacggccaactataaaaaatgagaaattcctggctggacttagtacggacgggttttgggatatccagacgtttaaggtgatcgaagaggcggtgtacttccatcagcactccatcctcgcctgtaaaatcgaaatggtagactacaaagaagagtacaacacaacccttccccagtttatgccctatgaggacggcatatactcagtgatacagaaaaaagtcacgtggtacgaagccctgaacatgtgtagccaaagcgggggacatttggcttccgtgcacaatcaaaacgggcaattgtttcttgaagacattgtcaaaagggacggattccctctgtgggtggggctctcctctcacgacggttccgaaagtagtttcgaatggtctgatggctcaactttcgattatatcccttggaaaggccagacttctcctggtaactgcgttctgttggaccccaaagggacctggaaacatgaaaagtgtaattctgtcaaagacggggcaatctgttacaagcccactaagtctaaaaagctctccaggctcacctacagtagccggtgcccagcagctaaagaaaatgggtcgaggtggatccagtacaaggggcattgttacaagagtgatcaggcgctgcatagtttttctgaggccaaaaagttgtgttccaaacatgaccatagcgctacaattgtgagcatcaaggacgaggacgagaacaaatttgtgagtcgcttaatgcgggagaacaacaacatcactatgagagtgtggttgggactgtcccagcattccgtggaccaaagttggagttggcttgatggctccgaggtaaccttcgttaagtgggagaacaagagtaaaagtggcgtcgggaggtgctcaatgctgatcgccagtaatgagacatggaaaaaagtggaatgtgagcacgggttcggccgtgttgtttgtaaggtgcctctagactgccccagcagtacctggatccagtttcaggacagttgttatattttccttcaggaggctatcaaggtcgagtctatcgaagatgtcaggaatcagtgcacagatcacggggcagatatgatctccatccataacgaggaagagaacgctttcatcttggacaccctaaagaagcaatggaagggtccagatgacatactgctaggcatgttttatgacaccgatgatgcttcattcaaatggtttgataatagtaacatgacatttgataagtggacagatcaagacgatgacgaggatctggtggacacctgtgcattcctccatattaaaacaggagaatggaaaaaggggaactgcgaggtgtctagcgtagagggcactctgtgcaagactgcgatcccttacaagcggaaatatctctcagacaatcacatccttatttccgccttagtgatcgccagcactgtgattctcacagtactgggtgcaatcatatggttcctttataagaagcattctgactcacggttcaccaccgtgttctcaacagctcctcagtccccttacaatgaggactgtgtgctagtggttggagaggagaacgagtaccctgttcagttcgatta

SEQ ID NO: 51164 - DNA, 1149 bp, Artificial Sequence
  Description of Artificial Sequence: Synthetic coding sequence
atgagatcacatttcctgcaatgggcattggctaccagccggaacaaggaccagatcaccaatatcttctctggattcgcgggactccttgcgattctgttagtggtggccgtgttctgcatcctgtggaattggaacaaaagaaagaaaaggcaggttccgtacctcagggtgactgtgatgcccctgttaacactcccccagacacgacagcgggctaaaaatatttatgacattctcccatggcgccaggaggacctaggaaggcatgaaagtagaagcatgcgaatatttagtaccgaaagcctactgtcacgaaattccgagtcccccgaacacgtcccatcacaggcgggtaatgccttccaggagcacactgcacacatacacgcgactgagtatgccgtcggaatttatgacaatgctatggtgccccaaatgtgcggtaacttaaccccgtcagcccactgtatcaatgtgagggcctcaagggactgtgcgagtatatcatcggaggacagccatgactatgtcaacgttccgaccgccgaagaaatcgcggagaccctggccagcacaaaatccccctccagaaacctcttcgtgcttccgtccactcaaaagctggagttcacagaggagagagacgaagggtgtggcgacgctggtgactgcacttccctgtactcccctggcgctgaagactcggacagtctcagcaacggggaaggttcatcccaaatttccaacgactacgtcaacatgacgggcctggaccttagcgccatccaggagcgacagttgtgggtggccttccagtgttgtcgtgactatgaaaatgtgcccgctgctgatccctctggttcacagcagcaagcggagaaggatgtgccaagctcaaatatcggtcacgtcgaagataagaccgacgatcccggtactcatgtgcagtgcgttaaacgcacattcctggcgtccggtgactatgccgactttcagccctttacccagagtgaggactcccaaatgaagcatagggaagagatgagtaacgaagactcctctgactatgagaacgtgctcaccgctaaactaggtggccgtgattctgaacaaggtcccggtacccagttgctgcctgatgagtag

SEQ ID NO: 51165 - DNA, 1197 bp, Artificial Sequence
  Description of Artificial Sequence: Synthetic coding sequence
atggatggcgtgactccaaccctctctacaattagaggtaggaccttagaaagtagcaccttacatgtaacaccccgatccctggatagaaacaaggatcaaattacgaatattttttcgggcttcgctggtctgcttgcaattctgttagtggtggcagtgttctgtatcctgtggaactggaacaaacggaagaaaaggcaagtgccttacttgcgcgtgaccgtgatgcctctgcttactctgccgcagacacggcagcgtgcaaaaaatatctacgacatactgccatggagacaggaagacctgggaagacatgagtcccgtagtatgaggatcttttctaccgagagtctgctcagtagaaatagcgagtcaccagaacatgtcccttctcaggccggaaacgcctttcaggagcacactgcacatattcatgccaccgagtacgctgtagggatatatgacaacgcaatggttccgcagatgtgcggtaatctgacaccatctgcccattgtatcaatgtccgggcatctcgcgattgtgcctcaataagcagcgaggacagtcacgattatgtgaatgtgcctactgctgaggagattgccgagaccctggcgtccaccaaaagtccaagccggaatctctttgtgctgccttccacccaaaaactcgaattcacggaggaacgcgatgaaggttgcggtgacgccggtgactgtacgtctctgtactcgccaggtgctgaagactctgatagcttgtcaaacggcgagggctcaagtcaaatctccaatgactatgtgaacatgacagggctggatctttctgcaatccaggagcggcagttgtgggtagcctttcagtgctgcagagactatgaaaacgtgcccgcagccgaccctagcggaagccagcagcaggctgaaaaagatgtgccatctagcaatataggccacgtagaggataaaactgacgatcctggaacccatgtccaatgcgtgaagcgaaccttcctcgcgtcaggagattatgctgatttccagcctttcactcagagcgaggactcccagatgaagcatagggaagagatgtcaaacgaggactccagtgattacgaaaacgtcctgaccgcaaagcttggtggacgggattctgagcagggccctggtacgcagctcctgccggacgagtag

SEQ ID NO: 51166 - DNA, 189 bp, Artificial Sequence
  Description of Artificial Sequence: Synthetic coding sequence
atggatcctcgggaatgcgtgtgcatgagcggaggcatctgcatgtgtggagacaattgcaagtgtacaacgtgtaattgcaagacctactggaagagctgttgtccatgttgtcctcctggttgcgccaagtgcgccagggggtgtatttgtaagggaggctctgataagtgctcatgctgtccttag

SEQ ID NO: 51167 - DNA, 369 bp, Artificial Sequence
  Description of Artificial Sequence: Synthetic coding sequence
atgaccaccgccacaaggcaggaagtcctgggcctgtacaggtctatcttccgcctggctagaaagtggcaggctactagtgggcagatggaagataccatcaaagagaaacagtacatcctgaatgaagctagaacactcttcaggaaaaacaagaacttgacggatacggatctgattaagcagtgtattgatgagtgtaccgccagaattgaaattggattgcactacaaaatcccgtatccacgccctatccatcttccacccatggggctaacccctcttcggggtcgtggtttgcgttcacaggagaagctccggaagttatcaaaacctgtgtacctgaggtcacacgacgaagtctcatag

SEQ ID NO: 51168 - DNA, 369 bp, Artificial Sequence
  Description of Artificial Sequence: Synthetic coding sequence
atgacaactgccacccgccaggaggtacttggcctgtaccgaagcatttttagactcgctcgtaaatggcaggcaacgagcggccagatggaagacacgattaaagagaagcagtatatcctgaatgaggccagaacactgtttcgcaaaaataagaacttaactgacacagacttaatcaagcaatgcattgacgagtgtaccgcacgaatcgaaatcggcctccattacaagatcccttaccctcggccaatccatctccctcctatgggcttaactcccttgagagggagaggattgcgatctcaagagaaactcaggaaactgtccaagccggtgtatctgcgcagtcacgatgaagtgtcgtag

SEQ ID NO: 51169 - DNA, 369 bp, Artificial Sequence
  Description of Artificial Sequence: Synthetic coding sequence
atgactactgctacaaggcaagaggtcctgggactataccgctcgatcttcagactcgcaaggaagtggcaggccacttctgggcagatggaggatactataaaagagaaacaatacatcctgaatgaggcaagaactttgttccgcaagaacaagaatctgacagataccgacctaattaagcagtgcatcgatgagtgcacagcacgtatagagatcgggttgcactacaaaatcccgtacccgaggcccatccacctgccccctatgggactgacacctctgcggggaaggggcctgaggtcccaggaaaagttgcgcaaactttccaagcccgtttacctgagatcccacgacgaagtgtcctag

SEQ ID NO: 51170 - DNA, 267 bp, Artificial Sequence
  Description of Artificial Sequence: Synthetic coding sequence
atggcagccagccgcttgccacctgccacgttgaccttgaagcagtttgttcggagacagcaggtgttgctactgtaccgtcgtatcctgcagactatacgacaggttccaaacgatagtgataggaaatacctgaaggactgggccagggaagaattccgcaggaacaagagtgctaccgaagaggacactattcgcatgatgattactcagggtaacatgcagctgaaggaattagagaagaccctcgcgcttgcgaagagttag

SEQ ID NO: 51171 - DNA, 273 bp, Artificial Sequence
  Description of Artificial Sequence: Synthetic coding sequence
atgaagatggcaaattcactcaggggggaggtgctcaagttatataagaatcttctatatcttggccgagactaccctaagggtgccgactatttcaaaaagcgacttaagaacatcttcctgaagaacaaagacgtcaagaatcccgaaaaaatcaaggagttaattgcccagggagaattcgtcatgaaagagctggaggcattgtacttccttcgcaagtatcgagccatgaagcaaaggtattacagcgacactaacaaaactaactag

SEQ ID NO: 51172 - DNA, 105 bp, Artificial Sequence
  Description of Artificial Sequence: Synthetic coding sequence
atggctaatagcctaagaggagaggtgctcaagctgtacaaaaatctcctgtaccttggacgggactaccccaaaggagcagactatttcaagaaacgcttatag

SEQ ID NO: 51173 - DNA, 267 bp, Artificial Sequence
  Description of Artificial Sequence: Synthetic coding sequence
atggctaattccctgagaggagaggtcctgaagttgtacaagaacttactgtacctggggagagactacccaaagggcgcagactatttcaagaagaggctcaagaatattttcctcaaaaacaaggacgtcaagaacccagaaaaaatcaaagagttgatagcacagggagagttcgtcatgaaggagctagaagccctgtattttcttagaaaatatagggccatgaaacagcgctattattccgatacaaacaaaaccaattag

SEQ ID NO: 51174 - DNA, 267 bp, Artificial Sequence
  Description of Artificial Sequence: Synthetic coding sequence
atggctaacagcctgaggggagaggtacttaagctctacaaaaatttgctttatttaggcagggattaccccaaaggcgctgattacttcaaaaaaagactcaaaaatatcttcctgaagaataaggatgtgaagaaccctgagaaaatcaaggaactgattgctcagggtgagtttgttatgaaagaactagaggctctttactttctcaggaaatatagggccatgaagcagaggtactatagcgacaccaacaaaactaactag

SEQ ID NO: 51175 - DNA, 267 bp, Artificial Sequence
  Description of Artificial Sequence: Synthetic coding sequence
atggccaattctctcagaggcgaggtcctgaagctatacaagaatttgctttacctcggacgcgactaccctaaaggggctgactacttcaaaaaacgcctcaagaatatcttcctgaaaaacaaggacgtgaaaaatccggagaaaatcaaagagttgattgcacagggtgagttcgtgatgaaagagctcgaagccttgtattttctgagaaaataccgggctatgaagcagcggtactactcagatacaaacaagacaaattag

SEQ ID NO: 51176 - DNA, 267 bp, Artificial Sequence
  Description of Artificial Sequence: Synthetic coding sequence
atggccaatagtctcagaggcgaggtcctcaaattgtacaagaacctgctctacctggggagagactatcctaagggggctgactactttaagaaacgacttaaaaatatctttctcaaaaacaaggatgtcaagaaccccgaaaaaatcaaggagctgattgctcagggggagtttgtaatgaaggaactcgaggcactctactttttacggaaatacagggcgatgaaacagcgctattactctgacacaaataagaccaactag

SEQ ID NO: 51177 - DNA, 315 bp, Artificial Sequence
  Description of Artificial Sequence: Synthetic coding sequence
atggggagagcagttaaggtcctgcagctgtttaagactcttcataggactagacagcaggtgttcaaaaatgacgctcgggcactcgaagccgctaggattaagataaatgaagagttcaagaataacaaatccgagacgtcttccaagaagatcgaagaattaatgaaaatcggcagtgatgttgagttacttctgagaaccagcgttattcagggaatacataccgatcacaatactctgaagctggttccaaggaaggatctgctggtcgagaatgtgccttactgtgatgccccaacgcagaaacagtag

SEQ ID NO: 51178 - DNA, 921 bp, Artificial Sequence
  Description of Artificial Sequence: Synthetic coding sequence
atggcaggacgtcaccaaaaccgctcttttcctctgcccggtgtgcaaagctcagggcaggtgcatgctttcggcaactgttcagattccgatatactggaggaggatgctgaggtctatgaactccggagccgtggtaaggagaaagttaggcgttctacaagcagagaccgcctcgacgatataattgtgctcacaaaagatatccaggagggagatactttgaatgcgatcgccctgcaatactgctgcactgtggcagatatcaaacgagtgaacaaccttatcagtgaccaggactttttcgccctgaggagtataaagattcctgttaaaaaattcagcagcctgacagagacactctgcccgcctaaaggccgacagacgagccgtcactctagtgtacaatactctagtgaacagcaagaaatcttgcccgcaaacgacagtttagcatactcagatagtgcaggctcctttctgaaggaggtcgatcgtgacatcgaacagatcgtgaagtgtacagataataagagggaaaatctgaatgaggtcgtgagcgcccttaccgctcaacaaatgcgtttcgaacccgacaacaagaatactcaaagaaaggacccctactatggagcagattggggaatcggatggtggaccgcggtggtaatcatgctgatagtgggaatcatcacaccagtgttttacctactctactatgagatcttagccaaggtcgacgtttctcaccacagtacggttgattctagccatttgcactctaagattacccctcctagccagcaaagagagatggagaacgggatagtgccaacgaagggcatccacttcagccaacaagatgaccacaagctctattcacaggattcacagtcacccgcagcacagcaggaaacatag

SEQ ID NO: 51179 - DNA, 921 bp, Artificial Sequence
  Description of Artificial Sequence: Synthetic coding sequence
atggctgggcgtcatcaaaataggagctttcctctcccaggcgttcagagctcaggccaagtgcatgctttcgggaactgttcggacagtgacatcttagaggaagacgcggaagtatacgagctgagatcccggggaaaggagaaagtccgccgttcgactagcagggatcgcttggacgatatcattgttctgaccaaagatattcaggaaggcgacactctgaacgcaattgctctccagtattgttgtacagtggccgacatcaaaagagtgaataacttaatctcagaccaggatttcttcgccctccgatccatcaaaatcccggtgaaaaaatttagcagcttaacagaaaccttatgcccacccaaaggcaggcaaacttctcggcactcttccgtccaatattcctctgaacagcaagaaattctccccgcaaacgactcactcgcttacagtgacagtgctggctccttcctcaaggaggtcgatagagatattgagcaaatcgtaaaatgcactgacaataagagagagaacttgaatgaggtggtgtctgctctgacagcccaacagatgaggtttgaacctgataacaagaatacacaaagaaaagatccctactatggtgctgactggggcattggctggtggacagctgtggtcattatgcttatcgtgggcattattacccccgtattttacctactttattacgagattctcgccaaagtggatgtatcccaccattccacagtcgatagtagtcatctccacagtaagattacacctccctcacaacagagggagatggaaaatggcatcgtgcctactaaaggcatacatttctctcagcaggatgatcataagctgtacagtcaagacagtcagtccccggctgcacagcaagagacttag

SEQ ID NO: 51180 - DNA, 384 bp, Artificial Sequence
  Description of Artificial Sequence: Synthetic coding sequence
atggctgggaggcaccagaatcgctctttcccattgcctggggtgcagtcgtccggtcaggtacatgcttttggaaattgctctgatagtgacatacttgaggaagatgccgaggtgtatgagctccgctcccgtggcaaagagaaggtcagaagaagtacatccagggaccgactggatgacatcatcgtgttgacaaaagatatccaggagggggacacacttaatgctattgccttacagtactgctgcaccgtatatcaaaacagttccaaaaaagtccagttccttgacaggaacaccctgtcatcgaagcggaagacggatttcaccagctttatttgtagtattttattccgcaccacaggcaattttgccagctag

SEQ ID NO: 51181 - DNA, 891 bp, Artificial Sequence
  Description of Artificial Sequence: Synthetic coding sequence
atgcgtcacgaagagctgcttacaaaaaccttccaaggcccagctgtcgtgtgcgggactcctaccagccacgtgtacatgttcaagaatggctccggtgacagtggggactccagcgaggaggagtcacatcgtgtcgtgctgcgcccaagggggaaagaacggcacaagtcaggcgtgcaccagcccccacaggcgggagctggggacgtcgttctccttcagcgtgagctagcgcaagaggattctctcaataagctggccttacaatacgggtgtaaagtagctgacataaagaaggtgaataacttcatccgagagcaggacctgtatgcccttaagtctgtgaagataccagtccggaatcatggaatcctaatggaaacccacaaggaactgaaaccattgctgtcccctagttccgagacgacggtgactgtggaacttcccgaagcagaccgggctggcgctggtaccggggcacaagcagggcagctcatgggtttcttcaagggcatcgaccaggacattgagagggcagtccagtctgaaatcttcttacacgagtcatactgtatggatactagccaccaacccctgctacccgctccgccaaagacaccaatggacggcgctgactgtggaatccaatggtggaacgcagtgttcatcatgctgttgataggaattgtactacccgtattttatctagtgtattttaaaatccaggcctcaggggaaactcccaattccctcaacacaaccgtcatcccaaacgggtctatggctatgggaaccgttccaggccaagcacctcgacttgctgtggctgtacccgcagtgacatccgctgactcccagtttagccagactacccaagccggatcctag

SEQ ID NO: 51182 - DNA, 894 bp, Artificial Sequence
  Description of Artificial Sequence: Synthetic coding sequence
atggctgtggggacccgtggcacactattgaagaagagtctcacagtctggttctgcggtccgggagcacggagcgccacgcgggctgtgtctaccagcctccccaggcgggaacaggtcacgtggtgctgctgttccggaagctggcctagacgaacagcctccacaagctggagatgctccatggcggcaaacacattctactttagaccaaatggcgctggagacactcgccaaaatcttatcccagacttttatgctttccgcgtgatcaataatgggaaggtggcagacatcaagaaggtaaacaatttcattcgagaacaggatctctacgctctcaagtctgttaaaattccagtgcggaatcatggcatccttatggagactcacaaggaacttaagcccctgctatctccctcctctgagacaaccgtcaccgtggagctacctgaagcagaccgcgctggagctggcacaggcgctcaggcgggacagctcatggggttttttaaaggcatcgatcaggatattgagcgcgcagttcaaagtgaaatcttcctgcatgaatcctactgtatggacaccagccaccagccattgcttccagcccctccgaagacgcccatggacggcgctgactgcggcatacagtggtggaatgccgtttttatcatgctcctgatcggaattgttctgcctgtgttttacctggtatatttcaaaatccaggcgtcaggggagacccctaattctcttaacaccactgtgataccaaatgggtctatggccatgggcacggtgccagggcaagcccctcgcctcgcagttgcagtgcctgccgtgacctccgcagatagccaattttctcagacaacgcaggcgggaagctag

SEQ ID NO: 51183 - DNA, 891 bp, Artificial Sequence
  Description of Artificial Sequence: Synthetic coding sequence
atgagacatgaagaactactcacaaagacattccagggccctgcagtagtgtgcgggacacctacgagtcacgtgtatatgtttaagaacggctcgggtgacagcggagatagttctgaagaagaatctcatcgtgtggttctcagaccacggggaaaagaacgtcataagtctggcgtccatcagcccccacaagccggagccggagatgtcgtcctgctgcagagagaacttgcccaggaggactcccttaacaagctcgccttgcagtacggttgtaaagttgccgacattaagaaagtaaacaattttattcgcgaacaagatctgtatgccttgaaatcagtgaaaatccccgtgagaaaccacggtattctgatggagactcataaagagctgaaacctcttctttcgccaagctcagaaaccactgttaccgtggaactcccagaggctgaccgggcaggtgccggaacgggcgcacaggccggacagttaatgggcttcttcaaaggcattgatcaggacatcgaacgagcggttcagagcgagatctttcttcatgagagttactgtatggacaccagccaccaacccttgctgcctgctccccctaagacgccaatggacggagccgattgtggaattcagtggtggaacgctgtttttataatgctgttaattgggatcgtgctgccggtgttttaccttgtctactttaagatccaggcctccggtgagacaccaaatagtctcaatacaactgttatacccaacgggagcatggcaatgggaaccgtgccgggtcaggcccctaggctcgcagtggccgtaccagctgttacaagcgctgactcccaattttcgcagaccacccaggctgggtcatag

SEQ ID NO: 51184 - DNA, 513 bp, Artificial Sequence
  Description of Artificial Sequence: Synthetic coding sequence
atggagactcataaagagctaaaacccttgctgtcaccttcatccgagaccactgtgaccgtggagctgcccgaagccgatcgggctggtgcagggaccggcgctcaggctggacaactcatgggctttttcaaagggattgaccaagatattgagagggcagtgcagtcggagattttcctgcacgaaagctactgcatggacacctcccatcaacctctcctgcccgctccaccgaaaacgcccatggatggggctgactgtggtatccagtggtggaatgcagttttcattatgctcctcataggaatcgtgttacccgtgttctatttggtatacttcaagatccaggcatcaggcgagaccccaaattcccttaataccactgttattccaaatggtagtatggccatgggcaccgtccctggccaggctccaagactcgcagtcgctgtccccgcagtgacgtcagcagactcacagttttcgcagaccacccaggccggatcatag

SEQ ID NO: 51185 - DNA, 1635 bp, Artificial Sequence
  Description of Artificial Sequence: Synthetic coding sequence
atgtctcgctgtgcccaagcagccgaggtagccgctaccgtgccaggcgctggcgtggggaatgtggggttgaggcccccaatggttcctaggcaggcgtcttttttcccaccaccagtgccgaatccatttgtacagcagacccagatcggttccgcccgtcgagttcagattgtacttttggggattatccttctccccataagagttctgctcgtagcgttaatcctcttactcgcctggccttttgcagctatctctaccgtgtgttgtcctgagaaactaacgcatcccatcacagggtggcgcaggaagataacacagacagccctcaaatttctgggacgcgctatgtttttttccatggggtttatcgttgccgtgaaggggaagatcgccagtcctctggaggcgccagtcttcgtcgcggctcctcattctacctttttcgatggcatcgcttgcgttgtcgctggactacccagcatggtgtccagaaatgagaatgcacaggtgccactgatcggtcgccttctgagggctgtgcaacccgtacttgtttctcgcgtcgatccggatagcaggaagaacactattaacgagatcattaagcgcacaacctctggaggagagtggcctcagatactggtctttccagagggtacctgcaccaacagaagctgtctcatcacattcaagcccggtgctttcatcccaggtgttccagtccaaccagtcttgttgcgctaccccaacaaactcgacacggtcacctggacttggcagggctatactttcattcagctgtgcatgcttacattctgccagcttttcactaaagtggaggtcgagtttatgccagtacaggttcccaacgatgaagagaaaaatgaccccgtgttatttgccaacaaggtgagaaacctgatggcagaggccctgggcatccccgttacagatcatacttacgaagactgccgcctgatgatctcagcgggacaactcacactgcctatggaagctggtctggtggagtttaccaaaatttctcggaagttgaaactcgactgggacggcgtgaggaaacacctagacgagtatgcctctatagcatcctcatccaagggcggtaggatcggaatcgaggagttcgccaagtacttgaagctgccagtgtcggacgtgctaaggcaattgttcgctttgtttgataggaaccatgacggaagcattgattttagagagtatgtcattggactagcagtgctgtgtaatcctagcaacaccgaggagattatccaggtcgctttcaaactgtttgatgtggacgaggacgggtacattacggaggaggagttttctaccattctgcaggcttcccttggcgtgcctgatcttgacgtgagcggcctctttaaagaaatcgcccagggcgacagcatcagttacgaagagttcaagtcgtttgctctcaaacaccccgagtacgcaaaaatcttcacaacctacctggacctgcagacatgtcacgtgtttagccttccgaaagaagtgcagacaaccccgtccacagcatcgaataaagtttccccagaaaagcacgaggaatcaaccagcgataagaaagatgattag

SEQ ID NO: 51186 - DNA, 1113 bp, Artificial Sequence
  Description of Artificial Sequence: Synthetic coding sequence
atggcgatcacactggaagaagcaccctggctgggttggcttttagtaaaagcgcttatgcgctttgccttcatggtcgtgaataatttagtcgccatcccatcatatatttgctacgttattatactgcagccactccgtgtgctggactccaaacgtttctggtatatcgaagggatcatgtacaagtggctccttggcatggtggcatcatggggctggtatgcaggatatactgtgatggagtggggagaggatatcaaagccgtgagtaaggacgaggcagtcatgctggtgaatcaccaggccacaggggacgtctgtaccttgatgatgtgtctgcaagataagggcttggtggtagctcagatgatgtggttgatggatcacatcttcaagtacaccaacttcgggatcgtttcactcgtgcacggtgatttctttattcggcagggacggtcgtatagggaccagcaactgctcttgttgaaaaagcatttggaaaacaattatcgaagcagggaccggaagtggattgttttatttccagaagggggattcctgaggaagaggagggaaacctcccaggcattcgcgaagaagaacaacctccccttcctgacaaatgttacgttacctcggtccggcgctacaaagatcatattaaacgctctcgtggcgcaacagaagaacggcagccccgcagggggagatgcaaaggagcttgatagtaagagtaaaggcttacagtggataatcgacaccaccattgcgtatcctaaggctgaacccattgacatacaaacctggattctgggatacaggaaaccaaccgtcacacacgtacactacagaatttttccaattaaagacgtgccactggaaactgacgatctaacaacttggctctaccagagatttgtcgaaaaagaggacttgttatcccatttctacgagactggggcattccctccgagcaaaggccataaagaggctgtcagccgggaaatgactttgtctaacctctggatcttcctgatccagagctttgccttcctctccgggtatatgtggtacaacattatacaatacttctatcattgcctgttttag

SEQ ID NO: 51187 - DNA, 1113 bp, Artificial Sequence
  Description of Artificial Sequence: Synthetic coding sequence
atggccattacactcgaagaagcgccatggttgggatggctgctcgtgaaggctttgatgagattcgcgtttatggtagtgaacaaccttgtggcaatccccagctacatatgctacgtgatcatactccagcctctcagggtccttgattccaagcgcttctggtacatcgagggaattatgtacaagtggctgctgggaatggtggcctcatggggatggtacgccggatacacagtaatggaatggggcgaagacatcaaggccgttagcaaagacgaggctgtgatgctggtgaaccaccaagcgaccggagacgtgtgtaccctaatgatgtgtctccaagacaaaggactggtcgtggcccagatgatgtggctaatggatcacatcttcaagtacactaacttcggcatcgtgagccttgtgcacggcgatttttttatcaggcaaggtcgtagctaccgcgaccagcagctgctgttactcaagaagcacctggagaataactaccgatcccgggaccgtaaatggattgttctattccctgagggcggtttcctgcgcaagcgcagggagacttctcaagcctttgcaaagaaaaacaatctgccttttttgacaaatgtgaccctgcctcgttctggcgcaaccaaaatcatccttaacgcattagtagcccagcaaaagaacggaagtcctgctggcggagacgcaaaggaactggacagtaagtcgaaggggctccagtggatcatcgacacaacaatagcctaccctaaggctgaacccattgatattcagacatggatcctgggctaccgcaagcccaccgtgacccacgtgcattaccggatttttcccatcaaagacgtgcccttagaaacagacgatctaacgacttggttgtaccagcgcttcgtcgagaaggaggacctactgagtcacttttacgaaactggggctttccctccaagcaagggtcataaagaggctgtgtctcgtgaaatgactctctctaatctttggattttcctcatccagtcgttcgccttcctttctgggtatatgtggtataacataattcaatatttttatcattgtctgttttag

SEQ ID NO: 51188 - DNA, 702 bp, Artificial Sequence
  Description of Artificial Sequence: Synthetic coding sequence
atggtctcaatgagcttcaaaaggaataggtccgacagattttattctacccggtgttgtggctgctgtcacgtgaggaccggcacaatcatcttggggacttggtatatggtggttaacctgctgatggccattcttctgacagtcgaggtcactcatcctaacagtatgcccgcagtcaacatacagtacgaagtgataggcaactactatagcagtgaacgtatggccgataacgcatgcgtcctgtttgccgtttccgtcctcatgtttatcatatccagtatgctggtttacggggctatctcctaccaagtgggctggcttatcccctttttttgttaccgtctcttcgactttgtcctctcgtgtctggtagcaatctcaagccttacatatctgcctcgcatcaaggaatatctggatcagctgcccgatttcccctacaaggacgaccttctggcgctggatagcagctgtctgctgttcattgtgctcgtcttctttgccctgtttattatttttaaagcctatcttattaattgtgtgtggaactgttacaagtatattaacaaccggaatgtaccagaaatcgccgtatatccagcctttgaggccccaccccagtatgttttgccaacctatgagatggccgtcaagatgccagaaaaggagccccctccaccttatctcccagcctag

SEQ ID NO: 51189 - DNA, 1251 bp, Artificial Sequence
  Description of Artificial Sequence: Synthetic coding sequence
atgccccgacagctgagtgcggctgccgctcttttcgcctcactggccgtcatactgcatgacggttcacagatgagggcaaaagccttccccgaaaccagagattacagccagcccactgctgcggctacagttcaggatatcaaaaagcctgtgcaacagcccgcaaagcaggccccacaccaaactctcgctgctaggtttatggacggacacatcaccttccaaacagcagccactgtcaaaattcctacaactacccctgccacgaccaaaaatactgctaccaccagtccaataacctataccttagttactacacaagccacacctaataattcacatacggctcctccagtgaccgaagtgaccgtcggtcctagtctcgcaccttactccctaccgccaaccattaccccccctgcccacaccacaggcacaagctctagtaccgtgagtcacacgacagggaatacgacccagcccagtaaccagacgacgctacctgccactctgtccatcgctctgcacaaatccaccacgggtcagaagcccgtccagccaacccatgcacctggcactacagctgctgcccataataccacaaggaccgccgcacccgcatccactgttcctggacctacattggctccccagccctcttccgtgaaaaccgggatctatcaagtactgaatgggtcccggttgtgcatcaaagcagaaatggggatccagctgatcgtgcaggataaagaatctgttttcagtcctagaaggtattttaacatcgatcctaatgcgacccaggccagcgggaactgtggcactcgaaagagtaatctgttattgaatttccagggaggatttgtgaatttgacttttactaaagacgaggagtcgtattacatctccgaggtcggggcatacctcacagtttccgatcctgagaccatctatcagggaatcaaacacgccgtcgttatgttccaaaccgcagtgggccacagttttaagtgtgtttcagaacagagcttgcaactttccgcccacctgcaggtcaaaacaacagacgtccaattgcaggcctttgatttcgaagacgaccacttcgggaatgtcgacgaatgctcgagcgattacacaattgtgctgcctgtcataggggctatagtggtgggactctgtctgatggggatgggcgtgtataaaataagactgcgatgccaaagcagcggctatcagagaatctag

SEQ ID NO: 51190 - DNA, 543 bp, Artificial Sequence
  Description of Artificial Sequence: Synthetic coding sequence
atgccacgacagctgagtgccgctgccgctctcttcgcctcacttgctgtcatactgcacgacggtagtcagatgcgggctaaagcctttccagaaaccagagattactctcaacccaccgccgcagcaactgtacaggatattaaaaagcctgtgcagcaacctgcaaagcaggcgccacatcagaccctcgccgcacggtttatggacgggcacatcacttttcagactgctgcgaccgttaagataccaactacaacccccgctactacaaaaaacaccgctacaacgagccccattacttacactctcgtcactacacaggccactcccaataattcacacacggcccctcctgtgactgaggtcaccgtggggccatcgctggcgccttatagtctcccccctactattaccccacccgcacacaccacgggtacaagttccagtaccgtgtcccacaccacaggaaataccacacaaccctcaaatcagactacactgcctgccacactctctattgcattgcacaaatccacgtag

SEQ ID NO: 51191 - DNA, 843 bp, Artificial Sequence
  Description of Artificial Sequence: Synthetic coding sequence
atggatctgcaggggaggggagtcccatcaatcgacagactcagggtcctcttgatgttatttcatacaatggcgcagattatggcagaacaggaagttgaaaatttaagcggactgagcacaaatcctgaaaaggacatcttcgtggtccgagagaacggcaccacttgtcttatggcagaattcgccgctaagttcatcgttccatacgacgtctgggcttctaactacgtggatctgattacggagcaggcggacatagctctaacccggggtgctgaagtgaagggcagatgcggacattcgcaatcagagttacaggttttctgggtcgatcgcgcatatgccctcaaaatgctcttcgtgaaggagtctcataacatgagcaagggcccagaggccacttggagactcagtaaagtgcagttcgtgtacgatagctccgagaaaacgcacttcaaggatgctgtctctgctggtaaacatacagctaactctcaccacctgtctgcactggtaactcccgcaggcaagtcctatgagtgccaggcacagcagaccataagtctggcatcttcggatccccagaaaacggtcactatgatcctctcagccgttcacattcaaccatttgacatcatctcagattttgttttcagcgaggaacataagtgccccgtggatgagagggagcagcttgaggaaaccctgccccttattctgggcctgatcttgggactcgtgattatggtgactcttgctatataccatgtgcatcataagatgacggccaaccaagtgcagatacccagagatagatcacagtataaacatatgggctag

SEQ ID NO: 51192 - DNA, 711 bp, Artificial Sequence
  Description of Artificial Sequence: Synthetic coding sequence
atggacctccagggtagaggagtgcctagcatcgacaggttacgcgttctgctaatgctgttccataccatggctcaaatcatggccgagcaggaggtcgagaatctaagcggactgagcacaaaccccgagaaggatattttcgtggtgcgagaaaatggaaccacttgcttgatggctgaatttgctgctaaattcattgtgccttatgatgtgtgggcctcaaattatgtggatgagagtcataatatgtctaaagggcctgaggctacatggcggctttccaaggtgcaattcgtttacgactcaagcgagaaaacacactttaaagatgcagttagtgctggtaagcatacagctaactcacatcatctgagtgctctcgttaccccagcaggcaaatcgtacgagtgtcaagcacagcagacaataagtctggcgagctccgaccctcaaaagacggtcacaatgatcctgagcgccgtgcatatccagcctttcgacatcatctcagattttgtcttctccgaagaacacaaatgtcctgtggatgagcgtgaacaattggaagagacgctgccacttatcctgggcttaatcctgggcctggttatcatggtaacgctggcaatctatcacgtgcatcacaagatgaccgccaaccaggtccaaatccctcgcgaccgcagccagtacaagcatatgggatag

SEQ ID NO: 51193 - DNA, 978 bp, Artificial Sequence
  Description of Artificial Sequence: Synthetic coding sequence
atgtcattgcaaagcagactgagcggtcgccttgctcaactgcgtgctgccggacagctactggtgcctcctcgcccaagacctggccacctggcgggtgccacacgaacacgctcatctacatgcgggccacccgcttttttaggtgtatttggacgcagagcaagaacttcagctggtgtaggcgcatggggagcggctgctgtcggccgaacagccggagtacgcacttgggccccactggctatggctgctaaagtcgacctaagcacctctacagactggaaggaggctaagagttttctgaaggggctgtctgacaagcaacgggaagaacactacttctgcaaagactttgttcgcctcaaaaaaatcccgacatggaaggaaatggctaagggtgttgccgtcaaagtggaagaaccaaggtacaaaaaggacaagcagctgaatgagaagatctcactactgcggtcggacatcacaaagctggaagtcgatgctatagtgaacgctgccaacagtagcctgttgggtggtggaggagttgatgggtgtattcacagagccgcaggcccactactgaccgatgagtgtcgcactttacagagctgcaaaacgggaaaagccaagattaccgggggataccggttaccagcaaaatatgtaatccacaccgtcgggcctatagcatacggcgagcccagcgctagccaagcggctgaactcaggagctgttacctcagttcactggatctgcttctggagcaccgacttcggtctgtggcttttccgtgcatatcaaccggagtttttggctacccttgtgaggccgctgcggagatagttctggctacacttcgtgagtggctggaacagcacaaagataaggtcgatagactcatcatctgcgtcttcttggaaaaggacgaagacatatacaggtctagactgcctcattattttccagtggcctag

SEQ ID NO: 51194 - DNA, 2151 bp, Artificial Sequence
  Description of Artificial Sequence: Synthetic coding sequence
atgaacaacttccgtgctaccatcctgttttgggcagccgcagcctgggccaagagtggcaaacctagcggagaaatggatgaagttggcgtgcagaaatgtaaaaatgccctgaaactgcctgtgctagaggttttgcctggcggtggatgggataatctgaggaatgtcgacatggggagagtcatggaactgacttactcaaactgccgtacaacagaggacggacagtatatcatccctgacgagatctttacgatcccacaaaagcaatccaacctcgaaatgaattctgagatactggaatcctgggctaattatcagtctagcacatcatattcaattaacacggagcttagcttattcagtaaagtgaatggcaaattctcgaccgaatttcagcgcatgaagacactgcaggtcaaagaccaagctataacaacgcgggttcaagtgcggaacttggtgtatactgttaaaattaatcccacgcttgaactgagcagtggttttcgcaaggagctgctggacatcagtgaccggttagagaacaaccagaccaggatggcaacatatctggccgaacttttagtgctaaactacggtactcacgtgactacctccgtcgatgccggtgcagccttgatccaagaagaccatttgcgggctagctttcttcaagactcacagtccagtcgctctgcagtgaccgctagcgccggattggctttccaaaataccgtgaacttcaagtttgaggagaattacacgtctcagaacgtcctgaccaagtcctacttgtccaatcgtacaaactctagagtgcagagcattggcggagtacccttctatcccggaattacactccaagcgtggcagcaggggatcaccaatcacttggtggccattgaccggagcggcctgcctttgcatttctttataaaccctaatatgcttcctgatcttcctgggcctctggtcaaaaaagtaagtaaaaccgttgaaaccgccgtgaagcgctattatactttcaacacctacccaggctgcacagatctgaactcgcccaattttaattttcaggccaacacggacgacggctcatgtgaagggaaaatgactaatttctcgtttggtggggtctatcaagaatgtacccagctgtcaggtaatagagacgtactactttgtcagaagctagaacagaagaatccattgacaggtgacttcagctgtccctcggggtacagcccagttcacttgctttcccagatccatgaggaaggctacaaccacctggaatgccacaggaagtgtaccttactcgtgttctgtaaaaccgtttgtgaagacgtgtttcaggtggccaaggcagagttccgggctttttggtgtgtggcaagttcccaggttccagagaacagcggactgctatttgggggacttttctcaagtaaatccatcaacccgatgactaacgcacagagttgtcccgcaggatacttcccactacgcctgttcgaaaacctgaaagtctgcgtctctcaagactacgagcttgggtccagatttgcagtgccatttggaggatttttttcgtgcacagtagggaatccgcttgtggacccagccatctcccgcgatctgggagcccctagcctgaaaaaatgtcctggcggattctcacagcatcccgctctaatctctgatggctgtcaagttagttactgcgtgaagtcaggtttgtttacaggcggatccctgcccccagctcgccttcctcccttcaccaggcctccacttatgtcccaggctgcaacgaacaccgtgatagtcactaatagtgaaaatgccagatcctggattaaagattctcagacacatcagtggcgcctgggggaacctatcgagctgcgcagagccatgaacgtgattcacggcgacggagggggactcagtggcggtgcggctgccggtgtcactgtcggggttaccacaatcctggccgtggtgatcacacttgccatctacgggaccagaaagttcaagaagaaggcatatcaggcaatcgaagagcgtcagagcctggttccaggcaccgcggcaacaggggacacgacctaccaggaacaggggcagagccccgcatag

SEQ ID NO: 51195 - DNA, 495 bp, Artificial Sequence
  Description of Artificial Sequence: Synthetic coding sequence
atgaataatttccgggcaacaattctcttctgggccgctgcagcctgggctaagtctggtaaaccgtccggagagatggacgaggtaggcgttcagaaatgcaagaacgctctaaaacttcctgtcctcgaagttctacctggtgggggatgggataatctgcggaatgtagacatgggcagggtgatggagctcacatattcgaactgcagaaccacagaggatggtcagtacatcataccagatgagatctttaccattccccagaaacagagtaatctggagatgaatagcgaaatactcgagtcttgggccaactatcagtcatcgactagctacagcatcaataccgaactctccctcttctcaaaagtcaacggtaagttttcaacagagttccaacgcgtacccgctccctgtcaggccccaacctttcatcctgccacgccccacgaaagcggctgccaccagtattgccactcggatcagttttag

SEQ ID NO: 51196 - DNA, 1398 bp, Artificial Sequence
  Description of Artificial Sequence: Synthetic coding sequence
atggaggaggaagatgaggaagctagggctctgctcgctggagggccagacgaagctgatcgcggagcacctgctgccccaggggctctgcccgcactgtgcgaccccagccgactggctcatagactgttggtgctgctcttgatgtgctttcttggattcggcagctatttttgttacgacaatccagccgctttgcagacgcaggttaagagggacatgcaagttaacacaaccaaattcatgctgttatacgcatggtacagctggcctaacgtggtgctctgcttcttcggcggtttcctgatagacagggtgttcgggatcagatggggcacaatcatcttctcctgttttgtttgtatcggtcaggtggtgtttgctctgggcggtatttttaatgccttctggctcatggaatttgggagattcgtgttcggaatcgggggagagtcattggctgtggcccagaacacatatgcagtcagctggtttaagggcaaggagttgaatctggtttttgggttgcaactgtcaatggccagaataggatccaccgtgaacatgaacttaatgggatggctgtactcaaagatagaggcactgttgggatctgctggtcacacaaccttaggcattacactgatgatcggagggattacatgcatcctcagcctgatctgcgcccttgcactcgcttaccttgatcaacgggctgagcgaattctgcacaaggagcaaggaaagacgggcgaggtgattaaacttaccgatgttaaggattttagtctgcccctgtggctgatttttataatctgtgtgtgttactatgttgctgtgtttccgtttatcggtcttggcaaagtattcttcacagaaaaattcggattcagttcacaggccgcaagtgctattaattctgtggtctatgtcataagcgcaccaatgtcccccgtgtttggtctcctcgtggataagaccggaaagaacatcatctgggtgctgtgtgcagttgcggctaccctcgtgagccatatgatgctggcattcacaatgtggaacccctggattgcaatgtgtttactcggactcagttactctctgttagcctgtgctctctggcctatggtcgccttcgtggttcccgagcatcaactgggcaccgcatacgggttcatgcagtctatacagaatctggggctagcaattatttcaataatcgctggtatgatcttggattctagaggctacctcttcctcgaggttttcttcatcgcatgcgtgagtctgagcctgttgtcagtggtcctactctatctagtcaacagagcgcagggcggtaacctgaattatagcgctaggcaacgcgaagagatcaaattcagccataccgagtag

SEQ ID NO: 51197 - DNA, 762 bp, Artificial Sequence
  Description of Artificial Sequence: Synthetic coding sequence
atggaagaggaagacgaagaggctcgggcattgcttgccggtggaccggacgaggctgataggggcgcacccgctgctccgggagcactccctgctctatgtgatccaagccggttagcacatcgtcttctggtgctccttctgatgtgttttctcggatttggaagctacttctgctacgataaccctgccgctctgcagacacaagtaaaaagagatatgcaggtaaatactacgaagttcatgctgctttacgcctggtacagttggcccaatgttgtcttgtgtttcttcggcggatttctgattgatcgcgtttttggctcaactgtcaacatgaacctcatgggatggctgtattccaagattgaggctttgctgggcagcgccggtcataccactctcggaatcaccctcatgattggaggtattacctgcatcctaagcctcatttgtgcgctggcactagcttacctggatcaacgtgccgagaggatcttgcataaggagcagggcaagactggagaagtaataaagttgactgacgtcaaggatttcagcctccctctgtggcttatcttcataatctgcgtctgctactatgtcgcagttttcccattcataggtctcgggaaggtcttttttaccgagaaattcggcttctccagtcaagccgcttcagcaattaactctgtggtctacgtaattagcgctccaatgtccccagtgttcggactgctcgtcgataagaccggcaaatag

SEQ ID NO: 51198 - DNA, 1428 bp, Artificial Sequence
  Description of Artificial Sequence: Synthetic coding sequence
atgggggtcgcattgcgtgatttgcccggacgccacgtatcttctagatcgcacgtcacggccgtgctcactgtattccacggtcggtgctttttaccaggattcggggtcgttacaaccttcccttccccctctccagctggagccatggaagaggaggacgaggaagccagggcattactcgcaggcggaccagatgaagccgaccggggagcccctgcagcacctggggcattacccgcactctgtgacccaagcaggctggctcataggctcttggtgctcctgctgatgtgtttcctcgggtttgccatctttgctatgattatcctgctgccattccgactaaagttgaatgagtggggcactataattttttcctgctttgtctgcattggacaggtggtgttcgccctgggcggaatctttaatgctttctggctcatggagtttgggcgatttgtcttcggaatcggtggcgaatctttagctgtcgctcagaacacttacgctgtgagttggtttaagggaaaggagctcaatctagtctttgggttgcagctctctatggcacgaattggctctaccgtgaacatgaatttgatgggatggctctattctaagattgaggcgttactggggagtgcagggcatacaaccctgggtattactttaatgatcgggggaatcacatgcatattgagtctgatctgcgcactggcactcgcatatttagatcagcgggcagagagaatcctgcacaaggagcagggcaagaccggcgaggttattaagcttacagacgttaaagattttagcctccctctctggctcatttttattatctgcgtatgttattatgtagcagtgttccccttcatagggctgggcaaagtgttttttacagaaaagtttggtttctcctcccaggcagcgtctgcgataaattcagtggtctatgtcatttctgctcctatgagtccagtgttcggactgctcgtggacaaaacaggtaagaatattatttgggtactgtgtgcagtggcagcaaccctggttagtcacatgatgttagcctttactatgtggaatccctggatagccatgtgcctgctaggcctgagctattcactgctggcttgcgccctgtggcccatggtagccttcgtggtccccgagcaccaactagggacagcttacggttttatgcagtctatacagaacctgggcctcgccatcataagcattatagccggaatgattttagattcaaggggctatctctttttagaggtgttttttatcgcatgtgtctctcttagtctcttgtcagtggtgttactttacctggtgaaccgcgctcaaggaggtaatctgaactacagcgcaagacagcgagaggaaattaaatttagtcacactgagtag

SEQ ID NO: 51199 - DNA, 1545 bp, Artificial Sequence
  Description of Artificial Sequence: Synthetic coding sequence
atgggtgtggcactcagagatctgccaggaaggcacgtaagctcgcgctcccacgtgacagccgtccttaccgtcttccatggccgatgctttctgccaggatttggagttgtgacaacattcccatctccctcacctgcaggcgctatggaagaggaggacgaagaagccagagcactcctcgcaggcggacccgatgaagcagatcggggagccccagccgctcctggcgctctaccagctctgtgcgatccctcgcggctcgctcacagacttctcgttcttttgcttatgtgcttcctaggattcggaagttatttctgctatgataatcccgctgctctgcagacacaggtcaaaagagacatgcaagtgaacaccacaaaatttatgcttctctacgcctggtatagttggccaaatgtagtgctgtgctttttcgggggttttctcattgatcgtgtgtttggaataagatggggcactatcatttttagttgctttgtttgcatcgggcaggtggtctttgcactagggggaatcttcaatgcgttctggctcatggagtttggacgcttcgtgtttgggattggtggtgaaagtctggcagttgcccagaacacatacgctgtctcctggttcaaggggaaagagctgaacctggtgtttggactgcagttatctatggccaggataggttcaacagttaacatgaaccttatggggtggctttactccaaaattgaggctctgttggggagtgctggccatacaacccttggtattacactaatgatcggtggtattacctgcatactgtctcttatatgtgcgttggcccttgcgtacctggatcagcgagcagaaagaatcctccataaggagcagggaaagactggggaagtgataaaactgaccgacgtcaaagactttagcctgcctctttggctcatctttatcatttgcgtatgctactacgtcgccgtttttccttttatcggactggggaaagtgttttttaccgagaagttcggcttcagttcccaagccgcttcagcaatcaactcagtggtgtacgtcatctccgcccctatgtctcccgtgttcggtctgctggtcgacaagaccggcaaaaacatcatttgggtcttgtgcgccgtcgccgctacactcgtgagccacatgatgttggccttcacaatgtggaacccatggattgcaatgtgtcttttgggcctatcttattctctcttagcttgtgccctctggcctatggtcgctttcgtggtccctgaacatcagctggggaccgcttacggattcatgcaatctattcagaatcttggattggctattatttctataatcgccggaatgatattagactcgcgcggatatcttttcctggaggttttctttattgcatgtgtttctctgtcactcctttccgtggttttgctctacctggttaaccgtgcacagggtggtaacctgaattattccgccagacagagggaagaaatcaagttcagccatactgagtag

SEQ ID NO: 51200 - DNA, 1368 bp, Artificial Sequence
  Description of Artificial Sequence: Synthetic coding sequence
atggggtggggagggggtgggggatgtaccccacggcctccaattcaccaacaaccccctgaaagacgagttgtgaccgtggtcttcctggggcttcttctggatttgctggcctttacactgctgctgccactgctgccaggccttcttgaaagccacggccgtgctcatgaccccctctacgggtcctggcagggaggggttgactggtttgcaactgccataggaatgcccgtagaaaaaaggtacaacagcgttctgtttggtgggttgatcggatctgcatttagcgtgctccagtttctctgcgctccattaacgggagcaacatctgactgtcttggcaggagacccgtgatgctgctgtgtctcatgggcgtggccaccagctacgcggtgtgggccacatcaaggagtttcgctgccttcctggcaagcagactgataggagggatttctaaaggaaacgtgagtctcagtacggccattgtagctgatctgggcagccctttggccaggtcccagggaatggccgtcattggcgtggcattctcactcggttttactttagggcctatgttaggcgctagcctgcccctggaaatggctccttggttcgccctgctctttgctgccagcgatctgttattcattttctgcttcctgcccgagacacttccgctggaaaaaagagcgccatcaatcgcgttaggcttccgggacgctgctgaccttctgtccccgttggccctgctgagattcagtgcagtggctagggggcaggaccccccttcaggggaccgcctctcctcgctgaggcgtctggggctggtgtatttcctgtatttgttcctgttctccggactggagtatactcttagctttctgacacaccagaggtttcagttctcgtccctacagcagggcaagatgtttttccttatcgggctgaccatggctaccatccagggagcatacgcccgaaggatccaccccggtggggaagtcgctgctgttaaaagagccctgctcttattggtgcccgctttcctcctgatcgggtggggaagaagtctgcctgtcctggggctgggcctgctattgtattctttcgcagcggctgtggtcgtgccatgtcttagtagtgtggtggcaggttatggttcccctggtcagaaagggaccgtgatgggcacattgcgatcactgggcgctctagccagagcagcaggacccctggttgcggcaagcgtttactggttagctggcgcacaggcatgtttcactacctggagtggcctgtttctgcttcccttttttttactacagaagctgagttaccccgctcagacattgaaggccgaatag

SEQ ID NO: 51201 - DNA, 1368 bp, Artificial Sequence
  Description of Artificial Sequence: Synthetic coding sequence
atgggatggggtgggggaggtggttgtactcctcgtccccctatccaccagcagcctccagagaggagggtggtcactgtggtgttcctcggactcctcctagacctgctggccttcactctgcttctcccattactcccaggcctgctggagagccatggaagggcgcacgaccctctgtacggctcgtggcaaggaggagtagattggttcgcgacagctatcggaatgcccgtggaaaagcgctataactcagttctttttggagggctcattggaagtgcattttccgtgctccagtttctttgcgcacccttaactggtgcaacgtctgattgtctgggaaggaggcctgtgatgctgctgtgtttgatgggcgtcgccaccagttacgccgtttgggccacgtcccgcagctttgcagctttcctagcctcccgcttgatcggcggaatcagcaagggaaatgtttcactctctacagctattgttgccgatctgggctcacccttggctagaagccagggaatggccgtgataggtgtcgcctttagccttggcttcacactggggccaatgctgggcgcaagcctgcccttggagatggcgccatggttcgctctgctgttcgcagcctcggacctcctttttatcttttgcttcctccccgaaacactgccgctcgagaagagagctccctccatcgctctgggattcagagacgctgcggacctgctttcaccattagccctcctgagatttagcgctgtggctagaggccaggatccgcctagcggcgacagactgtccagcttgagacgattgggactggtctatttcctgtatttgttcctgttttccggcctggaatacacattaagctttctcacccaccagcggtttcagttctccagcctgcagcaggggaaaatgtttttcctgattggcctgaccatggccaccatccaaggtgcctacgcacgacgcatccaccccggaggcgaagtggccgctgtaaagagagctcttctgcttctcgttcccgctttcctgctgatcggctggggccgttctctgccggtcctgggtttaggtctccttctgtactctttcgcagccgcagtcgtagtgccatgcctcagctcagtggtggccggttacggatctccaggtcaaaagggtaccgtcatgggaacattgaggtcactgggagcacttgctagagcagccggacccctcgtggccgctagtgtatactggctggccggtgcccaggcctgcttcacaacctggagtggcttgtttttactgccgttttttttattacagaagctgagctacccagcacaaacactcaaagccgagtag

SEQ ID NO: 51202 - DNA, 1350 bp, Artificial Sequence
  Description of Artificial Sequence: Synthetic coding sequence
atgtcaccagaatcaaaaaagctgtttaacatcatcatcttgggtgtggcttttatgtttatgtttaccgcgtttcagacttgtggaaatgtagcacagactgtgatccgcagcttaaatcggaccgactttcacggctctggatataccagcatggctatcatctatggcgttttttctgccagtaatttgattactccttcagtggtggccatagtcggtccccaactgtctatgttcgccagcggcctgttctacagtatgtatattgcggttttcatacagccttttccctggagtttctatactgccagcgtgttcatcggtatcgcagcagcggtgttgtggactgcacaggggaactgcttgaccatcaacagcgatgaacacagcattggtagaaattctggcatcttctgggctcttctgcagagttcccttttctttgggaacctgtacatctactttgcttggcagggaaagactcaaatctccgagtcagatagacgtaccgtgttcatcgcgctgacagtgatttccttagttggaaccgtgctatttttcttaatccgaaaaccagactctgaaaacgtactcggcgaggacgaaagcagtgacgaccaggatatggaggtgaacgagtccgctcagaacaatctcacaaaggcggtggatgcgttcaaaaagagttttaaactgtgtgtcactaaggaaatgctcctgctgagtatcacaacggcttacactggtctggagctcacctttttcagcggggtttacggaacttgcattggggctactaacaagttcggcgctgaggaaaagtctctaatcggactcagtgggatcttcatcggcatcggcgagatcctgggcggtagtcttttcggcctgctctccaagaataaccgcttcggcagaaatccagtcgtgctgctggggatccttgtccactttatagccttttaccttatctttcttaacatgccgggagatgctccaattgcgccagtgaaaggaacagatagctcagcgtacattaagtcatccaaagaggtcgccattctgtgtagtttcctactgggcctgggagactcttgcttcaacactcaactgctgtccatccttggctttctgtactctgaagactctgctcccgcttttgccattttcaagtttgtgcagtcaatatgtgctgccgttgccttcttttattcaaattatcttcttttacactggcagctactggtgatggtgatctttgggttttttggcactattagcttttttactgtcgagtgggaggctgctgcattcgtggcacgcggttctgactaccgcagtatctag

SEQ ID NO: 51203 - DNA, 1194 bp, Artificial Sequence
  Description of Artificial Sequence: Synthetic coding sequence
atgagtcctgagtcaaaaaagctattcaatatcattatcttgggagtcgctttcatgttcatgttcaccgcttttcaaacatgcggaaatgttgcacagaccgtcatcagaagtctgaatagaacagatttccatggaagcggatacacaagtatggccatcatctacggagtcttttccgcctccaacctcataacacctagcgtggtagctattgtcggccctcaattgtctatgttcgccagtggactgttttatagtatgtatatagcagtgtttattcagcccttcccttggagcttctacactgcatcagttttcattgggattgcggctgccgagtccgatcgcaggactgtgtttattgccctcaccgttattagcctcgttggcacagtgctttttttcctgatccgcaaacccgacagcgagaacgtgctgggcgaagacgagtcatcagacgatcaggacatggaagtgaatgagtctgcccagaacaatttgacgaaggccgtggacgcattcaagaagagtttcaaactctgtgtaaccaaagaaatgttgttactgtcaataactacggcgtatacaggcttagaattaactttctttagtggcgtgtacggaacctgtatcggcgcaaccaataagtttggagctgaagagaagtccctcattggactgagcggcatttttattgggataggggaaattcttggaggaagcctttttggccttctctctaagaacaaccgcttcgggcgtaacccggttgtgctattgggaattcttgtgcattttatcgcgttttatctgattttcctgaatatgccgggtgacgcccctattgcacctgttaagggaactgatagctctgcctacatcaagagttccaaggaggttgcaatcctctgttcttttctccttggcctcggagacagctgtttcaatacacagctactctccattctgggattcctgtattcagaggattctgctcctgcattcgctattttcaaattcgttcagtctatatgcgccgctgtcgcttttttctactcaaattacctgctgctacattggcaactgctggtgatggttatcttcggctttttcggaacgatttctttctttacagtggagtgggaggcagcagcattcgtggctagggggtcagactaccgtagtatttag

SEQ ID NO: 51204 - DNA, 1443 bp, Artificial Sequence
  Description of Artificial Sequence: Synthetic coding sequence
atggggccaggcccaccagctgcgggagccgctccctccccacggccattaagccttgtcgcaaggcttagttatgcagtaggccatttcctgaatgatctttgcgccagcatgtggttcacatacctcctcctgtacctccatagcgtgagggcctatagctccagaggcgcaggactgctattgctcttaggtcaggtcgctgatggtttatgtaccccactggtcgggtatgaggccgatcgcgcagcgagctgttgtgccaggtatggccctcggaaggcctggcatttggtgggaactgtttgcgtactgctttcctttccctttatttttagcccttgcctgggatgcggcgctgcaacaccagagtgggctgccctactctattacggtccttttattgtaatattccagtttgggtgggctagtactcagatctcccatctttcgcttatccccgagttagtgaccaatgatcatgaaaaggtggaattgaccgcactgaggtatgcctttacagtggttgcaaacattaccgtgtacggtgcagcttggttactgctgcacctccagggcagttcgagggtagaaccgactcaagatattagtatttctgatcagctcggtgggcaggacgtacctgtgtttcgtaatctgtctctactggtggttggtgtcggcgctgtgtttagtcttttgttccacctgggcaccagagaacggaggaggcctcatgccgaagagccgggagaacacactccattgctggccccagcgacagcacagcctctgttactgtggaagcactggttgagggagcccgcattttatcaagtcggcatcctctatatgactaccagactgatcgttaacttgtcacagacctatatggctatgtatctcacttattcgctgcacctccccaaaaagttcatagcgaccataccgctggttatgtacctgtctggtttcctgagctctttcttaatgaaaccaatcaacaagtgcatcgggcgaaacatgacctacttttctgggttgctggtgattctagcttttgcagcatgggtggccctggcggagggtctcggcgtggctgtctacgcggctgctgtgctgctcggagcgggatgcgctactatcctggtgacttctctcgccatgacggctgatttgattggtccccacaccaactcaggtgcctttgtctatggatccatgagctttctggataaggtagccaatggcttagctgtgatggcaattcaaagtctccacccttgcccgtctgaactgtgttgccgagcctgcgtcagcttctatcattgggccatggtggctgtaactggcggtgtgggagttgccgctgccctttgtctgtgtagtctcctgttgtggccaacaagactgagaagatgggacagagacgctcgaccttag

SEQ ID NO: 51205 - DNA, 1422 bp, Artificial Sequence
  Description of Artificial Sequence: Synthetic coding sequence
atgggcccaggcccacctgcggcaggagctgctcccagtccgaggcctttgtcacttgtggcacgactgtcctatgctgtggggcatttcctgaatgacctttgtgcgtctatgtggttcacctatctgttgctgtacctgcattccgtccgagcgtactcttctaggggcgctggccttctgcttctcctgggacaggtcgcagatgggctctgtaccccattggtggggtacgaggcagatcgtgccgcaagttgctgcgcccgatacggtcctaggaaagcctggcatctggtcggcactgtctgtgtgctgctctcgtttcccttcattttcagcccgtgcctggggtgtggggcagctacacctgaatgggccgctctgctctactatgggccatttattgtaatctttcagtttggctgggcctctactcaaatatcgcatctcagcctgattcctgagctggttactaatgatcatgagaaggttgagcttacggctctgcgctacgcgtttaccgtggttgccaacattacggtatacggcgctgcttggctgctcttacaccttcagggctctagccgggttgaaccaacccaggatatttcaatctctgatcagctcggtggccaagacgtgcccgtgttccggaatttaagcttactcgtcgtgggtgtgggcgcagtcttcagcctgttgtttcatttggggaccagagagagacgacggccacacgcagaagagcccggagagcacacaccactgctggcgcctgcaacagcccaaccattgttgctgtggaaacattggttgcgagagcccgcattctaccaggtgggcatcttatatatgacaacacgactcatcgttaatctcagtcagacttatatggccatgtatctgacatacagcctgcatctgcccaaaaaattcattgcgacaataccactcgtaatgtatttatccggatttttgagctctttccttatgaaacctattaataagtgcatcgggcgaaatatgacatactttagcggcttgctggtcatccttgcttttgctgcttgggtggcattggcagaagggctgggagtagctgtgtacgccgcagctgtgctgctgggggctgggtgtgcgactatcctggttacatcactggccatgacggccgatctaatcggaccgcacaccaatagtggcgcattcgtctatggctctatgtcttttctggataaagtagccaatggtctcgcagtaatggctatccagtctctccacccatgtccaagcgaactatgctgtcgagcatgtgtcagtttctatcattgggctatggtggctgtgaccggaggggtcggtgtggccgcagcactgtgcttgtgtagtctgctcttatggcccacccgccttagaagatag

SEQ ID NO: 51206 - DNA, 1617 bp, Artificial Sequence
  Description of Artificial Sequence: Synthetic coding sequence
atgggtcctggacctcccgcagctggggctgccccatcacctaggccactcagtctggtagctagattaagttacgcggtcggacactttctgaatgacttatgcgcctctatgtggtttacctacctcctgctttacctgcactcagtgcgggcttacagttcacgaggggctggcctactcctcttactgggccaggtggccgatggactgtgtaccccattagtggggtacgaggccgatagagccgctagctgttgcgcccgatatgggcctcgcaaggcctggcacttggtcgggactgtgtgcgtcctgctgtccttccccttcatctttagtccttgcctgggctgtggcgctgccacccccgagtgggcagcgctgctttactacggcccattcatcgtgatctttcagttcggatgggctagcacacagatctcccacctgagtctcatcccagagctggtgacaaacgatcacgagaaggtcgaactgaccgccttacgatacgccttcaccgtggttgccaacatcactgtttacggagccgcatggttgctgctgcacctgcaaggctcttcccgagttgaacccactcaggatatctccattagcgaccagctgggcggacaggatgttccggtgttccgaaatctttcccttttggtggtgggggtaggcgcagtgttttctctactgtttcatctagggacgagggagcgtcgcaggcctcatgcagaggaaccaggagaacatactccgctgctggccccagcaacggcgcagcctttattgctatggaaacactggctacgcgaaccagccttttaccaggtggggattctgtacatgaccactaggctgatagttaacttatcccagacatacatggccatgtacctcacttactctctgcacctgccgaagaagtttattgccaccattccactcgtgatgtatctctccgggtttttatctagctttctgatgaaacctatcaataaatgtataggcaggaatatgacttactttagcggcctgctcgtcattttagcgtttgctgcctgggttgctttggctgagggattgggtgtcgccgtctatgccgcagccgtgctcctaggggcaggctgcgctactattcttgtaacctcactggctatgacagccgacttaatcggtccccacactaattctggtgcctttgtttacggatctatgtctttccttgataaggtggccaacgggctggctgtgatggcgatccagtccttgcacccctgcccttctgagttgtgttgtcgggcatgtgtcagtttttatcattgggcaatggttgccgttactggaggagtgggtgtcgctgccgctctatgtttatgttcactccttctctggccaaccaggttacgccgatctttcctcgcgtggagacggggaaggggagaggataagggaccagggtacagttggattcctacagtgctcgtgcaaccaccccgtccgacttcaccttttctctgggaggctccactcgcctggcgctgtaccaggaagaagtggtccggtgctggcaccaagccttggcctagggaagactggggcactcattag

SEQ ID NO: 51207 - DNA, 1239 bp, Artificial Sequence
  Description of Artificial Sequence: Synthetic coding sequence
atgaggggaaagctgctacctctggctggactttacctagtgcaaggccttccctatggtctgcagtctggattactgccagtgctcctgcgcgcaggaggactgtcattgacccgggttgggttagctaaggtgctctacgctccatggttgctgaaactggcctgggcccctcttgtcgatgctcaggggtctgctagggcctgggttacccgatccaccgctgggctcggcctggtgtgtggcctgttagcaggtctgccccctccaggtgccggtcaggcagggcttcccgctgccgtagctggcctgctcctgttgttgaatctcggggcagccatgcaagatgtagccctcgatgcattggcagtccagctccttgagcccgctgagcttggccctggcaacacggtgcaagtcgtcgcctacaagctcggcgcagccttggctggcggtgcgctcttagcactactgcccactttttcatggccacagttgtttttgctgctggcggcaacatattggttagcagccgctctggcatgggctgccccagctttacgacgcctcccacagcagcccccatcagaacagcgccctcacactgcccatctgctccgagatgtgttagcagtgcctggcaccgtgtggaccgcaggctttgttctcacttacaagctcggggagcagggagccagcagtctcttccccctcttgctattagaccacggtgttagtgccccagagttgggcttatggaatggggttggcgcagtagtctgcagtatcgccggttctagcctcggcggtacactgctggccaagcattggaagctgctgcccctgttacgaagtgtcctgcgtttcaggctggggggattggcctgtcagaccgccctggtgtttcacttggatacactgggcgcttccatggatgccggaaccatattgcgcggatctgcactcttgagtctttgcttacaacatttcctcgggggtcttgtgaccaccgtgacattcacaggcatgatgaggtgctctcaactggcaccccgagctctgcaggctacacattactctctgcttgcaacattggagctgcttggcaaactgttactgggcactctagccggtggcctggcagacggcttgggacctcatccctgttttctgctgctgttgatccttagtgctttccccgttttatacctggacctggcccctagcacattcctgtag

SEQ ID NO: 51208 - DNA, 1545 bp, Artificial Sequence
  Description of Artificial Sequence: Synthetic coding sequence
atgggctgcgacggcagggttagtggtctgctgcggcgtaatttacagcctaccctgacatactggtccgtctttttcagttttggcctgtgcatcgcctttctgggtcccacactcctggatcttaggtgccaaacacatagcagtctgcctcagatcagctgggtgttcttttctcagcagttgtgcttgttgctgggcagtgctctcggtggcgtgttcaaacgcactttggcacagagcctgtgggctctctttacctccagccttgccatctctctggtcttcgccgtgatcccgttttgtagggatgtaaaggttctggcctcagtgatggctttagcaggtctggccatgggctgcatagatacggttgcaaacatgcagttagtgcgcatgtaccagaaggactcagcagtattccttcaagttctacactttttcgtaggcttcggagctctcttgtctccgcttatcgccgacccctttctcagtgaggctaactgcctgccagccaactcaactgcaaatacaaccagccgcggacatttatttcatgtaagtcgtgtattgggacaacaccatgtggacgccaagccgtggtctaaccagacatttccgggactgacgcccaaggacggagctgggacgagagttagctatgctttctggatcatggctctgatcaacctacctgtgcctatggcagtgctgatgctgctgagcaaggaacgactgcttacctgctgcccacagagacgccctctgttactgtcagctgacgagcttgctctggaaacacagccccctgagaaggaggacgcatcatccttgcctcctaagtttcagtctcacctgggacacgaagatttgttctcctgctgccagaggaagaatcttcgcggagcgccatacagcttctttgctattcatatcactggggcacttgtgctctttatgactgacggactgacaggggcatactctgcgtttgtctattcttacgcagtggagaagcccctatcagtcggccataaggtggccggttacctcccatccctgttctgggggttcattaccctgggacgccttctgagcatcccaatctcatccaggatgaagcccgcaacaatggtcttcataaacgtcgtcggtgtggtggtgaccttcctggtcctactgatattctcctataatgtggtttttctatttgtgggcacagccagcctagggctttttttgtcatctacattcccttcaatgctggcgtatactgaggatagcttacaatacaaaggatgcgccactaccgtactggtcacaggagctggtgtgggagagatggtgctgcaaatgctcgtgggaagcatcttccaggctcagggatcatattcctttttagtgtgcggggttatattcggctgcctagccttcactttctacattctattactcttctttcaccgaatgcatcccggattaccgagcgtccccactcaggatcgcagtatcgggatggagaactctgagtgttatcaaagatag

SEQ ID NO: 51209 - DNA, 1284 bp, Artificial Sequence
  Description of Artificial Sequence: Synthetic coding sequence
atgggctgtgatggcagggtgtctggcctgcttcgcagaaacctccagccaacacttacatattggagtgtctttttttcattcggactgtgcatcgccttcctgggccctacgctgctcgacctgcgatgtcagacccattccagtctaccgcaaatctcctgggtgtttttctcacagcaactgtgtctgctgttagggtctgcactaggtggcgtctttaaaaggactcttgcccagtccctgtgggctctcttcacctcctcactggcgatctctctggtcttcgcagtcatacccttctgtcgtgacgtcaaggtgctagctagcgtgatggctttggccggtctggccatgggttgcattgatactgttgcaaatatgcagttggtcaggatgtaccaaaaagactccgccgtgtttctacagctgccagtgcctatggctgtgctgatgttgctttctaaggagcggctgctgacctgctgtccacagcgccgacccctgttactcagcgccgacgagttagctctggagacacagcccccagagaaggaagacgctagctctttgcctccaaagttccaaagccatctagggcatgaggatctttttagctgctgtcagcgcaagaacttgcggggagctccctactcatttttcgctatccacattacaggggcattggttttattcatgacagacggactcacgggagcctattcagcattcgtgtactcttacgcggttgaaaagcccctcagtgtaggacataaagtagccggttatctgccaagcttattctggggcttcattactctcgggcgactgttgtccattccgataagttccaggatgaaaccagccaccatggtgtttatcaacgtggtaggcgtggtggttacctttctggtactgttgatattctcctacaacgttgtgttcttgtttgtggggacagcaagcctgggcctgttcttgagctccactttcccttctatgctagcctacaccgaagacagcctgcagtacaagggttgcgccactactgttctcgtgacaggcgctggcgttggtgagatggttctgcagatgttggtgggaagcattttccaagcacagggaagctattccttcctagtgtgcggggtgatatttggatgcctggcatttactttctacatcctgctgctgtttttccaccgcatgcatcccggactccctagcgtgccaactcaggaccggagcattggtatggaaaacagtgaatgctatcaaagatag

SEQ ID NO: 51210 - DNA, 1323 bp, Artificial Sequence
  Description of Artificial Sequence: Synthetic coding sequence
atgggctgtgacggcagggtgagtggtttgctcagacggaatttacaacccacactcacttactggtctgtgtttttcagcttcggcctgtgtatagcgttcctcggtcctaccttgcttgacctgaggtgtcagactcacagctcgctgccccagataagctgggtattctttagtcaacaattgtgtctactgttggggtcagccttgggtggtgtcttcaagcgcacgcttgcacaatctctgtgggccctttttactagcagccttgctatcagtctggtgttcgcagtcattcctttttgccgtgatgtgaaggtgctggcgagcgtgatggccctggctggcttggcaatgggatgcatcgacactgtggcaaatatgcaactggttcgcatgtatcagaaggattccgccgtttttctgcaggtcctgcacttcttcgttggcttcggcgctctactgagtcctttaatagccgaccccttcttgagcgaagccaattgccttcccgctaatagcactgccaacaccacatcacgcggacatcttttccacgtctcacgggttctgggacagcaccacgtggacgcaaagccttggtcaaaccagacattccccggactgacccccaaagacggagccggaactcgggtctcttatgcattctggattatggcactgattaatcttccagtgccaatggccgttctcatgctcctctccaaggagagactcctcacatgctgcccacaacgacgaccacttcttctcagtgctgatgaactggctctagagacccaaccaccagagaaggaggacgcttccagtttgcctccgaagttccaatctcatctcggccacgaggacctcttctcttgttgtcagaggaagaatcttcggggtgcgccatatagtttctttgccattcatattaccggagcactggttctattcatgaccgacggtctgactggcgcttactctgcgttcgtctatagctacgcagtggaaaagcccctgagtgtgggccacaaggtggcaggctacttgccctctctattttggggttttatcaccctgggcagactcttgagtatccccatctcctctcggatgaagccggctacaatggtgtttattaacgtggtcggggttgtggtcacattcttagttttgctgatcttcagttataacgtggtgtttctctttgtggggactgcctcattgggactttttttgagcagtacattcccctctatgctggcatataccgaggacagccttcaatataaggacatcccgggatctgggcaactatag

SEQ ID NO: 51211 - DNA, 1299 bp, Artificial Sequence
  Description of Artificial Sequence: Synthetic coding sequence
atggaggtgacagccgtcggtgaagaagctaatcagggagacctgctcggcttcgggcagcggtgctgtagcctggggtcttcgaacccatggttgtacagaaccgctggaatattcccagagcattgtaccgaagagaagaaaatagggacatactttagagtggcgcctcaagcctccaagtctcagagatctagatgtcatggtatggccgctagtgaggctaggccaggcgaagccaccgccgcatcttatgggaggccctttccaactcatcctcgccgtcaggagttccgagcacgagtcgttcgaggaccgactatgctggttaccgcttatctagccttcgtcggtctgctggcctcctgtttaggactggagctgtctaggtgccgagcgaagccaccaggtcgtgcgtgctccaatcctagtttcctgaggtttcagttggacttttatcaggtgtatttcctggcactggccgctgactggctgcaggccccatatctgtataagctgtaccaacattattacttccttgagggccaaatcgccatcctctatgtttgtggactcgcgtcaactgtgttgttcgggttggtagcatctagtctagtcgactggttaggacgaaaaaactcctgcgtcctattctcgttgacatactctctgtgttgtttgactaaactgagccaggattattttgttctgttagtgggtcgggctctcggcggactttcgacagccctgctattctccgcatttgaggcgtggtacattcatgaacatgttgagcgtcacgacttccctgcggagtggatccctgctaccttcgcaagagcagctttctggaaccatgtgttagccgtggtggccggtgtagccgctgaagctgtggcctcttggatcggattgggccctgtggctccatttgtcgccgctatccccctgctggcactggccggagctctcgccctcaggaactggggggagaattatgatcgtcagcgtgcattctcacgaacctgtgccggaggtctgaggtgcctgctctcagacaggcgtgtccttctgttgggcaccatccaggcgctgtttgagtccgtgatttttatctttgtgttcctgtggactcccgtgttggatccccatggggcacctttgggcatcattttttcgtcattcatggcggcaagtcttctgggctcttccctgtatagaatcgccacaagcaagaggacggttatcgagaagcaggccctgggcatttgttccgccttcgcgcttctcagctggtag

SEQ ID NO: 51212 - DNA, 1353 bp, Artificial Sequence
  Description of Artificial Sequence: Synthetic coding sequence
atgctcgtcaccgcgtaccttgccttcgttggattgttagcttcgtgtctcgggcttgaattatcacgctgtcgcgctaagcctccagggagagcctgtagcaacccctcatttctgcgcttccagctggatttttaccaggtgtactttttagcacttgccgctgactggttgcaggccccttatttatataaactgtaccaacactattactttttggaaggccagattgccatcctctacgtatgtggcttagctagtactgtgctgttcggattggtagcatcgagcctggtggactggctcggtaggaaaaattcctgtgtactgttcagcctaacttatagcctctgttgtctgactaagttatctcaggattatttcgtgctgcttgtgggccgtgctctcggcggtctctcaacagccctcctcttctctgcgtttgaggcatggtacatccacgagcatgtggaaagacatgattttcctgccgagtggataccagccacatttgcccgagcagccttttggaatcacgtcctagctgtggttgccggagttgcagctgaagccgttgctagctggattggcctgggtccagttgcccctttcgtcgcggctataccccttctggcactggcgggagcactggcactgcgaaactggggcgagaattatgacagacaaagagcttttagcagaacctgcgccggtggactgcggtgcctgctttctgatagacgcgtgttgttgctgggcaccatccaggccctgtttgagagcgtcattttcatctttgtcttcctctggactcccgttttggacccccacggagcccctctggggataatattcagcagcttcatggcagcctccctcctgggttcaagtctctaccgcatcgccaccagtaagcgctatcatctacagcctatgcaccttctgtctcttgctgttctgatcgtcgtgttttccctatttatgctaacattcagtacttcgcccggtcaggagagccccgttgaaagcttcatcgcctttctccttatagaactcgcatgtggactgtacttcccaagtatgtcatttctccggagaaaagtgatacccgagacagaacaggcgggtgtgctgaactggttcagggtgcctttgcacagcctggcttgccttggtctgctggttttgcacgactctgatcgtaagaccggaacacgcaacatgttctctatctgctctgccgtcatggttatggcccttttagcggtggtgggactcttcaccgtcgtcagacacgacgctgagctgagggtgcctagcccaacagaggagccttacgcacctgagctctag

SEQ ID NO: 51213 - DNA, 1674 bp, Artificial Sequence
  Description of Artificial Sequence: Synthetic coding sequence
atggaggtcacagccgtaggagaggaagctaatcagggcgacctgcttggctttggacaaaggtgctgttccctgggctcctcaaacccatggttatacagaacggctgggatttttccagagcattgcacagaggagaaaaaaatcggcacatacttccgcgtggccccacaagcctctaagtcccagcgcagccgctgtcacggaatggcagcctccgaggctcgacccggtgaggccacggccgcttcttacgggaggccatttccaactcaccctcgacgacaagaatttcgcgctcgggtcgtgaggggacctaccatgctggtcaccgcttacctagccttcgtaggattgctcgcatcttgccttggactggaactgtcacgctgtagggccaagccacctggacgtgcgtgcagcaaccccagttttcttaggtttcagctggatttctaccaagtttattttcttgccctggcagctgactggctgcaggccccatatctgtacaagttatatcagcattactactttcttgagggccagattgcaatcttgtatgtatgcggactcgcttccaccgtactgttcggcctcgtggctagttcgttggtcgactggctggggagaaaaaactcatgtgtactgttttccctgacttactcgctctgctgcttgactaaactctcccaggactatttcgtgttgctcgtgggacgggcattgggaggcttaagcacggctcttctgttctctgcgttcgaagcgtggtacatccacgagcatgttgagcgccatgatttcccagccgaatggatacctgccaccttcgctagagccgctttttggaaccacgtgttggcagtggtggctggtgtggcagcggaggcagtggcctcgtggatcggtttggggcctgtcgcaccgttcgtggctgctatccctttacttgcattggccggtgcacttgcattgcggaactggggtgagaactacgaccgacagcgtgccttctctaggacttgcgcagggggtttgagatgtcttctaagcgacagaagggtactacttttagggacaattcaggccctattcgagtccgtgatctttattttcgtgttcctgtggacccccgtactcgacccccatggcgctcccctaggaattatcttctcaagcttcatggctgcatcactactgggctctagtctctaccgtatcgccacatcgaaacgataccacctgcagcccatgcaccttctgagtctggccgtgctgatagtggtctttagcctgttcatgttaacttttagcacatctcctggtcaggagagcccagtcgaatcctttatagcgttccttctcattgagctggcttgtggactgtatttccctagcatgagcttcctgagacggaaggtgatccccgagactgagcaggctggagtattgaattggttccgagtgcctttgcacagcttggcttgcttaggtctgctggtgctacatgattctgataggaaaaccggaacccggaatatgttctccatttgttccgcagtgatggtcatggccctcctcgctgtggtaggtctgtttaccgtagtacgtcatgatgcagagctgcgagtcccctcacctacagaagagccgtacgccccagagttatag

SEQ ID NO: 51214 - DNA, 1395 bp, Artificial Sequence
  Description of Artificial Sequence: Synthetic coding sequence
atggaagtgactgctgtcggggaggaagctaaccagggggatctacttggctttggacagagatgctgctcattaggctcttccaacccttggctgtacaggaccgccggtatctttcccgaacactgtaccgaagaaaagaagatcggcacgtatttccgcgtcgccccacaggctagcaaaagccagagaagtagatgccatggcatggccgcatcagaggccagaccaggcgaagctacggctgcctcttacggcaggccgtttcctacgcacccccgtaggcaggaatttcgcgcacgcgtggtaaggggccctacgatgctcgtgacagcctacttggcctttgtcggcctgttggcgtcatgcctgggcttggaactcagccggtgcagagctaagccaccgggaagggcgtgttcaaatccgagctttctcagatttcaacttgacttttatcaggtgtacttcctggcactagccgctgactggctccaagcgccatatctgtacaagctttaccagcactactactttctggaaggccagatcgctatactatacgtttgcggattggccagcacagtgttattcggcctggttgcatcttcccttgtcgattggctgggcaggaagaacagttgtgtgttgttcagccttacctattccctctgctgcctcacaaagctgtcccaggattatttcgtcctactggtggggcgagccctcggaggcctgagcactgcacttctcttttcagcattcgaggcctggtacattcacgagcacgtagagaggcatgatttccccgctgagtggatcccggcaacctttgccagagccgctttttggaaccacgtcctggctgtggtggccggtgtggctgccgaggcagtggcatcttggattgggttgggccctgtggcaccatttgtggcagcaatcccattgctggcgttggctggcgctctcgctctccgcaactggggcgaaaactacgataggcagagagccttctcgagaacgtgtgctgggggtctacgatgtctattgagcgatcgaagggtcctgctgctggggacaatccaagccttgtttgaaagtgtcattttcattttcgttttcctctggacacccgtgctggacccccacggggcaccgctaggaattattttctcatcattcatggcggcttcactgctcggctctagtctgtaccggatagccacttctaaatctgacagaaaaacgggtacccggaacatgttttctatctgtagcgcagtgatggtcatggcattactggccgtggtgggactgtttaccgtggttcgccacgacgctgaactccgggtgcccagccctacagaagagccatacgccccagaactttag

SEQ ID NO: 51215 - DNA, 1761 bp, Artificial Sequence
  Description of Artificial Sequence: Synthetic coding sequence
atgtcggccaatccgagatgggacatcagtagggcactgggcgttgcgaaattgtttcacttagtgtgtggtgtcagagaggcgtgcgtcaccccttttttaaccctatacctgcgtcagctaggtctagcggcaccctgggtgggaacactgatgggcactaaacatttaattgcagcgttttgggctcccgtgtgcgccttcttggcaaagtcatatcgtaaaagacgtgccttgctcatagggagcctgctaggttctgtgggggcatctctgctgatggttctagtgccccctgtggacaaaaatcgtgtccactttccatgcaacggttctagcggcttgacttccaccgacgccctgccgggagtgacattaccggtcaatatcactagtgcacaggaatcggctagctcccacccagccaagaggaccgccgaggttgagatgcccggtttcagaaaccccccaggcgagtccgatcgggaaacattcagagatcttcatgtttacctggctccctctgtggagggcgcaagaacgaccagtcaggctctgctccatcctgtaactagtggtctgaaggatcatccatgggaggtcacattcgaagtcgtgaagacagccctgccattgcttccaggtggcaaggggccagggaatcccgctaatctgagtgggaccaaaggaaaggcctgggctttcgatctctctctggaggccctgcgtcgaacttttatcctgagtctaggatcagtagcgttttgggagctacttactgctcccctggaacaggttgcagatgatagcttgtacgagtttctcgactttgtggatgccacagatcggtacaggtccctgtgggtgtggcgcctcttaggaatgagcgccggagtgtgtggaatcaccgctttggtcggacagctggactgcttcctgatgacctctgggcctcggggtgttgtccatttttacggctattcagtggtttcgacgttggcgctcctggtgtccatcgccttccccatcccaatctgccagcagtgggaaccctcttacaaacgcgttaaagccctatccatcgtggggggagatccgcacttgatactgctggcctctactaccgtcttggtgggcgctatcgttagcaccgtacagaacttcctgttctggcatatgaaagatcacggatcaggagaacttgtgatgggcttctctgtggcactctctctgcttggagaaatcctgctgcaccctttcaaagccaccctgctgcgtaagctgagtcggacaggcctggtagggttgggtctgagctgtttagcaggacaactcctgtattattcctttctctggtcctggtggtcggtgctcccgatccagatactctcagcaatttccaatcgtgccctgtggtgggccgttggcgctagcgtagaggaccttgccacccctcgcatggagcgtgcactgagtgccttattcaggggtcatttctacgggtctggatgcagtctgggtagttttgtgggaggtttcgttgtcatgcgctttagtcttgcagttctgtatcaggcctgctgtgtggcgctgttactttggcttgccctgcttctatccatccagaggcggctgcccagagagcgtaaaatcaagtactccaaattgctgtccatggaggtgagtgataccagcgacagtgaacaaggcactgaacaggattggttggtgaaggcgatgagagaggagcacagcgactag

SEQ ID NO: 51216 - DNA, 1680 bp, Artificial Sequence
  Description of Artificial Sequence: Synthetic coding sequence
atggcagggcctacagaagcggagaccggtttggcggaacctcgggctctgtgcgcacagaggggacaccgcacatacgcaagacgatgggtgttcctactggccattagtctgttgaactgttcaaacgctacactttggctatccttcgcgccagtcgcagatgtcatcgctgaggacctcgtgctgtcaatggaacagattaactggctttctttggtatacctcgtggtgtcaactcccttcggtgtggctgcaatttggatcctcgatagtgttgggctcagggctgccaccatcctaggggcttggttaaactttgctggatctgtccttagaatggttccctgcatggtggtcggcacacaaaacccctttgcctttctgatggggggtcagtcgctttgcgcactggctcaaagtttggtgatcttctcgcctgcaaagttggcagccttatggttcccagaacaccagcgggcaaccgctaatatgcttgcgaccatgagcaatcctctcggcgttctggtggccaacgtcttgtctcctgtccttgttaagaaaggagaagacattccgctgatgctcggggtgtatacaatccccgcaggggtggtgtgcctattaagtaccatttgtctgtgggagtccgtcccccctaccccaccatctgctggcgctgcttcttcaacctcagagaaatttctcgacggattgaagctccttatgtggaacaaggcatatgttattttggctgtgtgcctgggaggaatgatcggcatttcagccagtttttccgctctgttggaacagatcctgtgcgcatccgggcactcgtccggtttctccggattgtgtggagcactcttcatcacgtttggcatattaggggcattggccttgggcccttatgtggatcgcacaaagcatttcacagaggcaactaaaatcggtctttgccttttttctttggcttgtgtcccatttgccctggtgtctcagttgcaaggccagaccttggcgttggctgctacctgttcattgctgggactgttcgggttttctgtaggacctgtagctatggagctggctgttgagtgcagcttcccagtaggggaaggtgctgccacaggtatgattttcgtccttgggcaagccgaaggaatcctgataatgctggctatgaccgccctgactgtgaggcgcagtgaaccgtcattgagcacctgtcagcagggggaggacccactggattggacagttagcctccttctcatggcaggactctgtaccttcttcagttgcattctggcagtgttttttcatacaccatatagaaggctgcaggctgaaagcggagaaccacccagtacccgcaatgccgtggggggtgcagacagtggccctggagttgatcgcggaggggcaggacgggctggagtcctggggccatcaacagctacccccgaatgcacagctcggggagcttccctcgaggaccccagaggacctggaagccctcatccggcttgtcaccgcgctacgccaagagcacagggacccgcagccaccgacgctccttctcgtcccggaaggttggcaggacgcgtgcaggcctccaggttcatcgacccagccggtagccactctagcttcagcagcccatgggtaatcacatag

SEQ ID NO: 51217 - DNA, 1326 bp, Artificial Sequence
  Description of Artificial Sequence: Synthetic coding sequence
atggctggacccacagaggcagagaccggtttggcggagccccgtgcgctgtgcgcccagagaggccatcgcacatacgccagaagatgggtctttttgctcgccatctctctactgaactgttccaatgctacaatcaactggctaagcttagtgtatctagtggtcagcacacccttcggtgtggcagcaatctggattttggactctgtgggcctaagagccgcactgggagtgtataccattcccgcaggggtcgtgtgtctccttagcaccatctgtctatgggaatccgtgccacctacccccccttccgctggagccgcttctagtacctctgagaagtttttagacggcctgaagttgcagctcatgtggaacaaggcttatgtgatcctagctgtctgcctcggcggtatgataggtatatcagcctcatttagtgcactgttggaacagatactgtgcgccagtgggcattcctccggcttttctgggttgtgtggagctctctttattacgtttggcatcctcggggcacttgccctggggccatacgtcgatagaaccaagcacttcactgaggctacaaaaatcggcttatgcctgttctctctggcttgcgtgccctttgccttagtcagccagttacagggccagaccttggctttagccgctacctgcagtctgctggggctgtttggctttagcgtcgggcctgtggctatggaactcgccgttgagtgtagtttccctgttggcgagggggctgctaccggaatgatttttgtgctggggcaggctgaaggcatcttgataatgctggctatgacagcactcacagtcaggcgcagcgaaccaagccttagcacctgccaacaaggtgaggacccgctggattggactgtcagtttgctgctgatggctggactgtgtacgttcttctcatgtattcttgctgtgttctttcatacaccgtataggaggcttcaggccgagtccggagagcctccctcaacacggaacgctgtagggggagccgatagcggccctggggtggatcggggtggggcaggtcgcgcaggcgtccttggtcccagtactgccacccccgagtgcacggccagaggggcatcgctcgaggatcccaggggccctggctcaccgcaccctgcttgccaccgggctacacctagggctcagggcccagcagccactgacgctccgtcacgtcccggacgcttggctggaagggtgcaggccagccgctttatcgatccagctggatcccacagcagtttttcatccccatgggtaattacatag

SEQ ID NO: 51218 - DNA, 1683 bp, Artificial Sequence
  Description of Artificial Sequence: Synthetic coding sequence
atggccggtcctacagaggccgagacaggattagcggaacctagagccctgtgtgcccaacgaggacacagaacgtacgccaggcgctgggtgtttctcttagccattagccttctgaattgttctaacgccactctgtggctgagctttgcacccgtggccgatgtgatcgcagaagacctggttctatctatggagcagatcaattggctgtctcttgtgtatctggtggtgagcaccccgtttggtgtggccgcaatatggatactggattctgtgggactgcgagctgccaccattctcggcgcatggctcaattttgctggaagcgtgttacggatggtgccgtgcatggtcgtgggtacgcaaaacccattcgcattcttaatggggggtcagagtttatgtgccctggcacagtcgctcgtgatcttttccccagcgaagctggccgctctgtggtttccggagcaccagcgtgccaccgccaatatgctagctactatgtcaaaccctctaggtgtgctggtagccaatgttctgtcacctgtcttggtgaaaaagggcgaggacatcccccttatgttgggagtatacaccatacccgctggggtggtatgcctgctctctactatatgtctgtgggagtcagtgccccctactcccccttccgctggagccgcaagttctacttccgagaagttcttggacggccttaagctgcagctcatgtggaataaagcctatgtgatcttagcagtctgtctcgggggaatgataggcatcagcgcctcgttttcagcgctgctggaacaaatattatgtgcatcggggcatagttcaggcttctctggcttgtgcggcgcactcttcataacctttggaatcctgggcgcattagccctcggtccgtacgtggaccggacaaaacacttcacggaggcaaccaagattggcctgtgcctcttctcactggcttgtgtgccgtttgctctcgtttcacagctgcagggacaaacgttggccctcgcggcaacgtgttccctgttaggactgtttggattttccgtggggcctgtggccatggagctggccgtagagtgcagtttccctgtcggcgagggagccgctaccgggatgatttttgttttaggacaggcagaaggtattctcataatgctggccatgacggcgctgactgtcagacggagcgagccatctctgtctacctgccaacagggcgaggacccccttgattggactgttagcctgctacttatggccggtctctgcacattcttttcatgtatccttgccgttttcttccataccccttacagacgtctgcaggccgaaagcggcgaaccaccatctacccgcaacgccgtaggcggtgccgacagtggacctggcgttgataggggaggcgcagggcgtgcaggcgtgctaggtccaagtaccgcaacacccgaatgtactgccagaggcgcatcactggaagatccccgaggtccagggagcccgcacccggcttgtcatcgagcaaccccacgggcacaaggtcccgctgctaccgacgccccaagtcgccctggcaggctggctggcagggttcaggcttccaggttcatagacccagccggaagccacagttcatttagctccccctgggtaatcacatag

SEQ ID NO: 51219 - DNA, 1425 bp, Artificial Sequence
  Description of Artificial Sequence: Synthetic coding sequence
atggagctggggggacactgggacatgaacagcgctcctcggttggtctctgagacggccgaacgcaagcaggaacaaaagacaggtacagaagctgaggcagctgattcgggggctgttggcgcacggcgtttcctactctgtttatatctggtcggcttcctcgatctcttcggagtgagcatggtcgtgccccttttgtccctccacgtgaaatctctaggggcatcaccaacagttgcgggaattgtcggctcctcatacgggatactgcagttattctcatctactctcgtgggctgttggagcgacgtggtgggcaggaggagttcactattggcctgcatcctgctcagcgcactgggttatctgctgctgggagctgcgaccaatgtttttctgttcgttctggctcgcgtgccagccggtatctttaaacataccctgagtatttccagggctcttctgtcggacgtagtccccgagaaggaaaggcctctggtaatcgggcacttcaataccgccagtggcgtgggttttatcttaggtccagttgtgggaggttatttgactgaactggaggacgggttctatttgacggcattcatatgcttcctggtgttcattctgaatgccggactcgtctggtttttcccctggcgagaggctaagcccggtagcacggaaaaggggttgcctctccgtaagacccatgtccttctcggacgaagtcacgacactgttcaggaggccgcaacctcacgcagagctcgtgccagtaagaaaacagcccagccctgggtggaggtggttctggcgctgagaaacatgaagaacctcctgttctcagagatgtgggacatcttcctcgtgcgactcctaatggccatggcagtaatgctttattattctaatttcgtcctagctctggaggagcggttcggagttaggccaaaggtgaccggttacctgatctcttactcaagcatgttgggtgctgtggcaggcctggcactgggcccaatcctgagactgtacaagcacaacagccaggctctgctcctgcactcaagtatcctgacttgcaccctgctattgttgtattctcttgcgccaacgatgggggctgtcgtgctgagtagtactctcctcagcttctcaactgcgattggcagaacatgcatcactgacctccagctcactgtgggaggcgcacaggcctcgggcacgcttattggggttgggcaatccgtgactgccgtggggcgaatcatcgctccactgcttagcggcgtggcgcaggaagtgagtccctgcggtccgcctagcctcggcgctgtcctagctctggtcgctatattcatcatgtccctgaacaagaggcacagcagtggggatgggaacagcaaacttaaatccgagtag

SEQ ID NO: 51220 - DNA, 465 bp, Artificial Sequence
  Description of Artificial Sequence: Synthetic coding sequence
atggccgtgatggccccacgtactctgttattgctgctgagcggggctcttgccctgacccaaacatgggccggaagtcattcaatgagatacttcttcacgtccgtcagccgacccggacgaggtgaaccgcgttttatcgccgtcggatacgtggacgacactcagttcgtgcggttcgacagtgatgctgcctcccagaggatggagccaagagccccatggatcgaacaggagggcccagagtattgggatcaggagacccggaatgttaaagcccagtcccaaaccgatagggtagacctgggcacgctgaggggctattataaccagtctgaggccggatctcataccatccagatcatgtacggctgcgacgtggggagtgacggcagatttttgcggggttatcggcttaggtcaccttccgccagtggcaggcggccaatgagaaggtctagctag

SEQ ID NO: 51221 - DNA, 900 bp, Artificial Sequence
  Description of Artificial Sequence: Synthetic coding sequence
atggcggtgatggcacctaggacgttgctgctattgttatctggggctctggcactcactcaaacatgggcaggatcacacagcatgcgctatttcttcacttccgtgtctcggcctgggcgaggagagccacgttttatcgccgttggatacgtggatgatacacagtttgtgagatttgacagtgacgcagcttcccaacgaatggaacccagggcaccctggatcgagcaggagggacctgaatactgggaccaggagacaaggaatgtaaaggctcagagccagaccgatcgcgtggacttggggaccctgaggggttattacaaccagagcgaggcagggagccataccatccagatcatgtacggatgtgacgtgggaagcgacggcagattcttgaggggctaccggcaggatgcttacgatggcaaggactatatcgccctcaatgaagatcttagatcctggaccgctgctgatatggctgcccaaataaccaaacgcaaatgggaggccgctcacgaggccgaacagctgcgggcatatttagatggcacttgcgtcgagtggttgcggagatacctagagaatggtaaagagacactacaaagaactgacccccctaaaacacatatgactcatcatccgatttcagatcacgaggctaccctgagatgctgggctctcgggttttaccctgccgaaatcacactgacctggcagcgcgacggagaagaccagactcaggacactgaattggtggagacaaggcctgcaggtgacggtaccttccagaagtgggccgctgtggtcgtgccttctggagaagaacagcgatatacctgtcatgttcagcatgaaggcttgccaaaacctcttaccctgcggtgggtgtag

SEQ ID NO: 51222 - DNA, 1116 bp, Artificial Sequence
  Description of Artificial Sequence: Synthetic coding sequence
atggcagtgatggccccacgaactctgctgctgttattatctggggctcttgcactgacacagacttgggcaggaagccattccatgagatatttttttacgtcagtgtctcggccaggacgaggtgaaccaaggttcattgccgttgggtatgtagatgacacgcagttcgtgagatttgactcagatgcggcttctcagaggatggagccgagggctccttggatagagcaagagggcccagaatattgggaccaggaaacccggaatgtgaaagcgcagagccagacagatagagtggacttagggaccctgcggggatactataatcagagtgaggccggatcccacaccatacagattatgtatgggtgcgatgtgggctcggacggtcgcttccttcgaggatacagacaggacgcttatgatggcaaggactacatcgctctgaatgaagacctgcgcagttggaccgccgcagacatggcggctcagattacaaaacggaagtgggaggccgctcacgaggcagagcagctgcgcgcatacctggacggaacgtgtgttgagtggctgcgtaggtacctggagaacggcaaggaaaccttgcagcggaccgacccacccaagactcatatgacacaccaccctattagcgaccacgaagccaccctcaggtgctgggcactgggattctaccctgcagagatcacgctcacatggcaaagggacggggaggatcagactcaggataccgaacttgtggagacaagacctgccggagacggcacatttcagaaatgggcagcggttgtcgtccccagtggagaggaacagcggtacacttgccacgtgcagcacgagggcttgcccaagccactgacattacgctgggaactgtcctcgcagccaacgattccaatagtcgggataatcgccggtctggtcctcttaggagccgtgattaccggggcagttgtcgccgcagtcatgtggagaaggaaaagctcggggggagagggagtgaaagatcggaagggcggatcctatacgcaggcagcgtccagcgacagtgcacagggtagcgacgtgtctcttaccgcttgtaaagtttag

SEQ ID NO: 51223 - DNA, 1098 bp, Artificial Sequence
  Description of Artificial Sequence: Synthetic coding sequence
atggccgtgatggccccaaggacccttctcctgcttctgtccggggctcttgcgctgacgcagacatgggctggatctcacagcatgcggtatttttttacttccgtctccaggcctggacgtggcgaacctagattcattgcagttgggtatgtagacgatacacagttcgtccggtttgattctgatgcagctagccagagaatggaaccacgcgctccttggattgaacaagagggcccagagtattgggaccaagaaacaagaaacgtcaaagcccaaagccaaactgaccgagtcgacctcgggaccttgcgtggctactacaaccagtccgaggcaggatctcacacgatacaaatcatgtacggctgcgacgtgggcagtgacggcaggtttctgcgtgggtacaggcaggatgcctacgatggcaaggattacattgccctaaacgaggatctgagatcatggaccgcagctgatatggcagcccagatcactaaacgcaagtgggaggctgcccacgaggcagagcaactacgagcctacctggatgggacatgcgtcgagtggttacggcgatatctcgagaacggaaaggagacactgcaaagaactgacccccctaagacccacatgactcatcacccgattagtgaccacgaagcaaccctccgctgctgggctctgggtttttatccagctgagatcactctgacctggcagcgtgatggggaggaccaaactcaggataccgaactagtcgagacccgacctgccggagatggcacatttcagaagtgggctgccgtcgtcgtcccttcgggggaggagcagcggtatacatgccacgtgcagcatgaagggttacctaagcccctgacactacggtgggagctgagctcacagccaacgattcccatagtgggcattatagctggactcgtgctgctcggcgcagtgattacaggggctgttgtggccgcagtgatgtggagaaggaagtcttccgaccgcaagggcggaagctatactcaggccgcaagcagcgactccgctcaggggtctgacgttagcctgaccgcctgtaaggtatag

SEQ ID NO: 51224 - DNA, 900 bp, Artificial Sequence
  Description of Artificial Sequence: Synthetic coding sequence
atggctgtgatggccccacgtaccctagtgctcttgttgagcggagccctggccctaacgcaaacctgggctggcagccactcaatgagatacttctacactagtgtgtcacgtccagggcgaggcgagcctagattcatcgccgtggggtatgtagacgatacccagttcgtgaggtttgattccgacgccgcatcacaacgcatggagcctagagcgccatggattgagcaagaggggccagaatactgggatcgtaacacccgcaacgttaaagcccattcgcaaaccgatcgggctaatctcggcactctgcgtggctattataaccagtcagaagatggctctcacaccattcagcggatgtatgggtgtgatgtcggacccgacggtcgttttttaaggggttatcaacaagacgcttatgatggaaaagattacattgccctaaacgaagacctacggagttggacagccgcagatatggcagcccagatcacacagcggaaatgggagactgcgcatgaggcggagcagtggcgggcttatctggaagggaggtgtgtcgaatggttgaggcgttacctcgaaaacggaaaagaaactctgcagcgcacagatgcccctaagacccacatgacgcaccacgctgtgtctgaccacgaagccacactgagatgctgggccctgtctttctaccccgcagaaatcaccttgacctggcagcgggacggggaggaccagacccaggatacagagttagtcgaaacccgccctgctggagacggaacattccagaaatgggcgtccgtggtagttcccagtgggcaagagcagaggtatacctgtcacgttcagcacgaagggttgccaaagcccttaaccctcaggtgggtgtag

SEQ ID NO: 51225 - DNA, 1098 bp, Artificial Sequence
  Description of Artificial Sequence: Synthetic coding sequence
atggccgtaatggccccaaggacattggtcctgttgctgtcgggagctcttgctctgacccaaacttgggccggaagccactcaatgaggtacttttacactagcgtatccaggcctgggagaggtgaaccgagatttattgccgttggctacgtcgatgatacacaatttgtgagattcgattccgatgcagcctcacagaggatggaaccgcgtgccccatggattgagcaggaaggccctgaatactgggaccgtaacactcggaatgtcaaagcccactcccaaacagatcgcgctaacctgggaaccctcagaggatattataaccagtctgaggacggcagccatacaatacagagaatgtatggctgtgacgtgggacccgatggccgatttctgcggggatatcaacaggatgcttacgatgggaaagattacatcgcactgaacgaggacttaagatcctggaccgctgccgacatggccgcacaaattacccagaggaagtgggaaaccgcacacgaagcagagcagtggcgggcttacctagagggcagatgcgtggagtggcttaggcgttatcttgagaacgggaaagaaacattgcagcgtacagatgccccaaagacgcatatgacacatcacgcggtctctgatcacgaggcgacactgagatgttgggcgttgtctttctacccagcggaaattaccctgacatggcagcgggatggcgaagatcagacgcaggatactgagctggtggaaacaaggcctgcgggtgatggaactttccagaaatgggccagcgttgttgtccccagcggccaggaacagcgatacacctgccacgttcagcatgagggtctgcccaaacccctgaccctcagatgggagcctagtagtcagcccaccatccccattgtcgggatcatagccggattggtgctgttcggcgcagttattgctggggctgttgtggccgcagttatgtggcgacgcaagagcagcgacagaaaaggaggtagctactctcaggccgcatctagcgattctgcacagggttctgacatgagccttacagcctgtaaggtttag

SEQ ID NO: 51226 - DNA, 1116 bp, Artificial Sequence
  Description of Artificial Sequence: Synthetic coding sequence
atggcggtgatggcccctaggaccctcgtcctgctgctgagcggtgctctggcccttacacaaacctgggccggttcccactcgatgcggtatttttacacttctgtatcacgccctggcaggggcgaacctcgttttatagccgttgggtatgtcgacgacactcaattcgtcagatttgatagtgacgccgctagccaaaggatggagccgagagccccatggattgagcaagagggccctgaatactgggaccgaaacactaggaacgtgaaagcacactcacagacagatcgcgctaacttgggtacactgagggggtactataaccagagcgaagacggctcacacacgatccagaggatgtacggctgtgatgtgggcccagacgggaggtttttgcgtggataccagcaggacgcatatgacgggaaagattacattgccctcaacgaggatctccggtcgtggaccgccgctgacatggctgcgcagatcacacaaagaaaatgggagacagctcacgaggctgaacagtggcgagcctatttggagggtcgctgtgttgaatggctgcgcagatacctggagaacggcaaagagaccttgcagaggactgacgcccctaaaacccacatgactcaccacgctgtgagcgatcacgaggccacattgaggtgctgggccctatcattctaccctgcagagattaccctgacatggcagagggatggagaagaccagacccaggataccgagctggtagagactagacccgctggcgatggcactttccaaaaatgggcatccgtggttgtgccctctgggcaggaacagagatacacatgtcatgttcagcacgaaggcctgccgaaaccgctgacactgcggtgggagccctcttcacagcctactataccaatagtgggcattatcgctggcctggttttgttcggcgcagtgatcgccggtgcagttgtggcagcggtaatgtggcggagaaagagcagcggcggtgaaggcatgaaggacagaaagggtggcagctacagtcaggccgcatcctcagactcagcccaggggtccgacatgtctctcacggcttgcaaagtgtag

SEQ ID NO: 51227 - DNA, 1098 bp, Artificial Sequence
  Description of Artificial Sequence: Synthetic coding sequence
atggccgttatggcccctcgtacactgctgttactgcttagtggagctctcgcccttacccagacatgggcaggctctcactccatgaggtacttttttacatcagtgtccagaccaggtcgcggtgaacctcgcttcattgccgtcgggtacgtcgacgatactcagtttgtcaggtttgattcggacgctgcttcccagcgaatggagcctagagcgccatggatcgagcaggagggacccgagtattgggatcaggaaaccaggaacgtcaaggcacagtcccaaacagaccgcgtggatctgggaaccttaaggggatattacaaccaatcagaagctgggtctcacaccatccaaattatgtatggatgcgatgtcggctcagacggaagattcctcagaggctaccgccaggatgcctacgatggcaaagattatatcgctctcaatgaggatctgcggtcctggacggctgccgatatggccgctcagatcacaaagcgcaagtgggaagcagcccatgaggctgagcagttaagggcgtacctcgatggaacctgcgtggaatggcttaggcgctatctggaaaacggcaaggaaactctgcagcgaactgaccctccaaagacccacatgacacatcatccaatttcggatcatgaggcaactctcagatgctgggcactcgggttctatccagctgagataacgcttacatggcagagggacggcgaagaccagacccaagacacagagctggtagagacacggccagcaggagacggtacatttcagaaatgggccgctgtggtggttcccagcggcgaggagcagagatatacctgccacgtgcagcatgaagggctgcctaagcctctcaccttgagatgggagctctcctcccaacctacaattcccatcgtaggaattattgccggtcttgtcctgctgggagccgttataacaggggcagtggtggcggctgttatgtggcgcaggaagagctcagatcgaaagggtggttcgtacacccaagcagcgtccagcgactcagctcagggcagcgatgtcagcctgacagcctgtaaggtatag

SEQ ID NO: 51228 - DNA, 900 bp, Artificial Sequence
  Description of Artificial Sequence: Synthetic coding sequence
tgagccgtcatggccccaagaaccctcgtgctactactatctggcgctctcgcactgactcaaacttgggccggttcacactcgatgcgatattttttcacaagtgtcagccggccaggtaggggcgagcctaggttcattgctgtggggtacgtagacgacacccagttcgttcggttcgatagcgacgccgctagccagcggatggagccaagggcaccatggatcgagcaagagggtccagaatactgggatggtgaaacccggaaagtgaaggcccattcgcagacacaccgagtggacttagggacgctcagaggctactacaatcagagtgaggctggctcccacaccgttcagcggatgtacggatgcgatgtgggaagtgattggcggtttctccggggttaccatcaatatgcctacgatggtaaagactacatagctctgaaggaggacttaagaagctggacagccgcagatatggcggcacagacaactaaacacaagtgggaggctgcccatgtggctgagcagctacgcgcttacttagagggaacatgtgtggaatggctacggagatacctggaaaacggcaaggagacactgcagcgcaccgatgctcccaaaacccacatgactcaccacgcagtgagtgaccatgaagccactcttagatgttgggcgctgtcgttttacccagcggagattactctcacttggcagagagacggtgaagaccaaacccaggacacagagctagtggaaaccaggccagccggagacggtactttccagaaatgggcggctgttgtggttcccagtggccaagagcagaggtacacatgccacgtgcaacacgagggactaccaaagccccttaccctgaggtgggtctag

SEQ ID NO: 51229 - DNA, 900 bp, Artificial Sequence
  Description of Artificial Sequence: Synthetic coding sequence
atggcagtcatggcaccccgtaccctcttattgctgctgctgggggctctagctttgacccagacatgggcgggttcacacagcatgcgttacttcttcaccagcgtttcccgcccaggccgaggcgaacctaggtttatcgccgtgggctatgtggatgatactcagttcgtcagattcgacagtgatgcagcatcccagcggatggagccccgagccccttggattgaacaggaagggccagagtactgggatcaagagacacgcaatgtgaaggcacattcacagacagatcgcgaatcattgcgcattgctttacgctactacaatcaatctgaggcagggtcacataccattcagatgatgtacgggtgcgatgtaggccctgacggacggctgctccggggttatcagcaagacgcttatgatggtaaagactacattgccctaaatgaagatctgcggagttggacagccgcagacatggcagcccaaatcacacagcgcaagtgggaagcagcacgcgtggcggagcagctccgcgcatacctcgaaggaacatgcgtcgagtggctacggcgttacctagaaaatgggaaagagacattacagcgaacagacgcacctaaaactcacatgacacaccacgccgtgagcgaccacgaggcaactctgcgatgctgggccctgagtttttacccagccgagataacactgacctggcaacgggacggtgaagaccaaacccaggatacagaactcgtcgaaacccgacctgctggcgacggaacctttcagaagtgggcttccgttgtggtgccgagtggacaggaacagcgatacacgtgtcatgttcagcatgaagggctgcccaagccactgacgctgaggtgggtctag

SEQ ID NO: 51230 - DNA, 900 bp, Artificial Sequence
  Description of Artificial Sequence: Synthetic coding sequence
atggcagttatggcccctaggacccttctactcttactgagtggggctctggccttgactcagacatgggctggatcccattcaatgaggtatttctttacgtctgtgtctaggcccggacggggtgagcctcgcttcatcgctgttggttacgtggacgatacacagttcgtaagatttgactccgatgccgcttctcagaagatggaaccaagagctccctggatcgaacaggagggcccagaatattgggatcaggaaacaagaaatatgaaagctcactctcagaccgatcgtgctaacctcggtacactccggggttattacaaccagagcgaggacggaagtcatactatccaaattatgtatgggtgcgatgtcggcccagacggcagatttctccgcggttatagacaggatgcgtacgacggcaaagactatatcgctcttaatgaggatctgcggtcctggacggccgcagatatggccgctcaaattacaaaacggaagtgggaggccgtccacgctgccgagcagcgacgcgtgtacctggaagggagatgtgtggacggactccgacgttacctcgagaatggaaaggagaccctgcagagaaccgatcctccaaaaacccacatgacccaccatcctattagtgaccatgaggccactctccgctgttgggccttgggattctaccctgcagagattacactgacttggcagagggacggcgaggatcagacacaggatacggaactggtggagactcggccagcaggagatggaaccttccagaaatgggccgcagtagttgtgcccagcggcgaagaacagagatatacgtgtcacgtccagcacgagggtctgccgaaaccccttaccctaaggtgggtgtag

SEQ ID NO: 51231 - DNA, 1116 bp, Artificial Sequence
  Description of Artificial Sequence: Synthetic coding sequence
atggccgtaatggcacctaggacgttgctgctgcttctgtcaggggctctcgcactaacacaaacctgggcaggctctcacagcatgcgctacttctttacttctgtgtcgaggcccggtaggggtgagcccaggtttatcgcggttggatatgtggacgacacccagttcgtgcgcttcgatagtgatgctgcctcacagaaaatggagcctagagccccatggatcgagcaggagggccctgaatattgggatcaagaaacccggaacatgaaagcgcactctcaaactgatcgtgccaacttggggaccttgagaggatattacaatcagagcgaagacggcagtcacactatccagatcatgtacggctgtgacgtgggaccggacgggaggttcttgcgtggctacaggcaggacgcttacgacggaaaggactacatcgcactgaacgaagatttgcgaagctggaccgctgccgacatggctgcccagatcactaaacgaaagtgggaagccgtccacgccgctgagcaaaggcgcgtctatttggaaggcaggtgcgtcgatggcttaagaaggtacctggaaaacggcaaggaaaccctgcagcgcaccgacccccctaagacccacatgacccaccacccgatcagtgaccacgaagcaacactgcggtgttgggctctgggattctatcctgcagagataacactgacctggcagcgggatggagaggaccagacacaggacacggagctggtggaaacgcgcccagcaggtgacgggacatttcagaaatgggctgccgtagttgtcccctcaggagaagagcaacgctacacctgccatgtgcagcacgagggccttcccaagccccttaccctgcgctgggaattgtctagccaaccaaccataccaatcgtaggcattattgctggattagtactcctcggcgctgtaattaccggtgccgttgtggcagcagtcatgtggcgccgaaaaagttcaggcggtgagggcgttaaggatagaaagggaggaagctacacacaggcggctagttccgatagcgcccagggctcggacgtgagtctgaccgcgtgcaaggtgtag

SEQ ID NO: 51232 - DNA, 1098 bp, Artificial Sequence
  Description of Artificial Sequence: Synthetic coding sequence
atggctgttatggcgccacgtactttgctactcctcctgtccggcgctctggcattgacacagacgtgggccggatctcattctatgcgctatttttttacgtctgtatccagacccggacggggagaaccaaggttcatcgcagttggttacgtagacgatacacagttcgtccgatttgattctgacgctgcaagccagaagatggagccacgagccccttggatagagcaagaaggcccagaatattgggatcaggaaacacgtaacatgaaagcacatagccaaactgatcgggcaaatctgggcaccctgaggggatactacaatcagtcagaagacgggagccacactatccaaatcatgtacggttgcgatgttggtcccgacgggagattcctcaggggataccggcaagacgcgtacgacggtaaggattacatcgccctgaatgaggatctccgcagttggacagccgctgacatggccgctcagattaccaagcggaagtgggaagccgtgcatgccgcagaacagcgacgcgtatacctcgagggaagatgcgtcgatggcttgaggaggtatcttgagaacgggaaagagactttgcaaaggacagaccctccaaaaacacacatgacgcatcaccctatatcagatcatgaagctactttgagatgctgggcgttgggattctatcctgctgaaatcactctcacatggcagcgggatggcgaggatcagacccaagataccgagctggtggaaacacgtccggcaggcgatgggacgttccagaagtgggccgctgttgtcgtgccctccggggaagagcagaggtacacatgtcatgtgcagcacgaaggcctgccgaaacctttaacactacggtgggagttaagttcccagccgacgatccccatcgtggggatcatagctgggttggtgcttttgggagcagttattaccggcgctgtggtggcagcagtcatgtggagaagaaaatctagtgataggaagggcggatcctatacccaagcagcttcttctgattcagcccagggatcggatgtatcgttaactgcttgcaaggtatag

SEQ ID NO: 51233 - DNA, 1116 bp, Artificial Sequence
  Description of Artificial Sequence: Synthetic coding sequence
atggcagtaatggctcctaggactctggttctgttactgagtggtgccctggccctcacacagacttgggcaggatcacattctatgagatactttttcacctccgtaagtaggcccggtcgcggagagccgaggttcatagcggtgggctatgtagacgacacacagttcgtgaggttcgacagcgacgccgcatcccaaaggatggaacccagggctccttggatcgagcaggagggacccgaatattgggacggtgagaccaggaaagtgaaagctcattcccagacacaccgggtggacttgggaacactgagaggttactacaaccagtctgaggccggttctcatacggtgcagaggatgtacgggtgtgatgtaggctctgattggcggttcctgcgcggataccatcagtatgcatacgatggcaaggactacatcgctctcaaagaggacctcaggagctggacggccgctgatatggccgctcagacaaccaaacacaagtgggaggctgctcacgttgcagagcaactgcgggcttatctggagggtacttgtgtggaatggctgagaagatatttagagaacggaaaagagaccctgcagcgtaccgacgcgccaaagacacatatgacccatcacgccgtgagtgatcacgaagctaccctgagatgctgggcactctccttctacccggcagagataacgctgacttggcagcgagatggtgaagaccaaacccaggacactgagttggtggaaactcgtcctgcgggagacgggaccttccagaagtgggccgcagtggtcgtcccaagtggccaagagcagagatatacctgccacgtccagcacgaaggactgccaaaaccactgacgctccgatgggagccatcatcccagccgaccatccctattgttggaattattgcgggactggtactctttggggcagtgatcaccggggcagtggtagctgcagtcatgtggagaaggaaatcgtcaggtggcgagggcgtgaaggatcgaaagggaggttcttactcccaggccgcatcctccgactccgcccaggggtccgacgtgtcccttaccgcctgcaaagtatag

SEQ ID NO: 51234 - DNA, 900 bp, Artificial Sequence
  Description of Artificial Sequence: Synthetic coding sequence
atggccgttatggccccacgaacactgctgctgcttctgtccggcgcactggctctgactcaaacttgggcaggaagccactccatgagatatttttttacctccgtctcccgtcccggacgcggagagcccagattcatcgccgtgggctatgttgacgatacccagtttgttaggttcgacagtgatgctgcaagccagaagatggagcctagagccccatggattgagcaggaagggcctgagtactgggaccaggaaacacggaatatgaaggcccacagtcagactgatcgggcaaatctggggacgctgcggggatactataaccagtcagaggacggcagccacactatccagatcatgtacggatgcgatgtgggacccgacggcagattcctgcggggttatcggcaagacgcctacgatggcaaggattatatagctttgaacgaggatctgaggtcctggacggctgcagacatggccgcacaaatcactaagagaaaatgggaggctgtgcacgctgctgagcaaaggcgcgtgtatctggaaggccgatgtgtggatgggcttaggcgatatctcgagaatgggaaggagacactgcagcggactgacccaccaaaaactcatatgactcaccatccaatcagtgatcacgaagcaacactgcgatgttgggcactgggattttatcccgctgagataacacttacttggcagagagacggggaagatcagacccaagacaccgagctagtagaaactagaccggctggagatggcactttccagaagtgggcagcggtggtggttcctagtggagaggagcagcgctatacttgtcacgtccagcatgagggactgccaaaaccacttacgctccgttgggtttag

SEQ ID NO: 51235 - DNA, 1098 bp, Artificial Sequence
  Description of Artificial Sequence: Synthetic coding sequence
atggctgttatggctccacgaactcttttgctgctgctgtctggcgcacttgcacttacacagacttgggctggcagtcattccatgagatacttctttaccagcgtcagtagacccggtcgtggcgaacctaggtttatcgccgtgggctatgtagacgacactcagttcgtgaggttcgattctgatgccgctagtcagaagatggagccaagggctccatggattgagcaagaggggccagagtattgggatcaggaaaccaggaacatgaaggctcacagtcagaccgatcgcgctaatcttgggactctcaggggttactataaccaatctgaagatggcagccacaccattcagatcatgtacggctgtgacgtcggcccagacggtcgtttcttgagaggttaccgacaggatgcttacgacgggaaagactatatcgccctgaacgaggatctcaggtcttggaccgctgcggacatggccgctcagatcaccaagagaaagtgggaggccgttcacgccgcagaacaacgacgtgtgtacctcgaaggtcgctgtgtggatgggctgcgcaggtacttggaaaatggaaaagagaccctgcagcgaactgacccccctaagactcacatgacacaccaccctatttccgatcacgaggctacattacgctgttgggctcttgggttctatccagccgagataacccttacctggcaacgtgacggcgaagatcagacacaggatacagaactggttgaaactcgaccagctggggacggcacatttcagaaatgggcagcggtggtcgtcccatctggggaggaacagcgatacacttgccatgtgcaacacgagggcctccccaagccgctgacactgagatgggagctgtcctcacagccgacaattccgatcgtcggtatcatcgctggacttgtactgctaggtgcagttattaccggcgctgtcgtggcggctgtgatgtggaggagaaagagttccgatcggaagggcggttcttacacacaggctgctagtagcgattctgcacaaggctccgatgtcagcctgacggcttgtaaagtgtag

SEQ ID NO: 51236 - DNA, 1116 bp, Artificial Sequence
  Description of Artificial Sequence: Synthetic coding sequence
atggccgtcatggcccctaggacactgttacttctgctgtctggcgctttggcgctgacccagacatgggctggcagtcactcaatgcggtattttttcacatctgtgtctagacctggacgaggtgaacctcgatttatagccgtggggtacgtggatgacacccagtttgtgcggttcgattcagacgcagccagtcagaagatggagcctagggccccatggatcgaacaagaaggacccgagtattgggaccaggaaacaagaaacatgaaggcgcactcacaaactgatagggctaacctgggtaccttgcgcggatactacaaccagtcggaggatggctcccacacaattcagataatgtacggttgtgatgtaggcccagatggtcggtttctgaggggctaccggcaggacgcttacgacggcaaagattacatcgcccttaacgaggacctgcgctcttggacggccgcagatatggcggctcagatcaccaaacgaaagtgggaggccgtgcacgcagccgagcaaaggagagtatatctggagggaagatgcgtcgacggtctcaggcgatatctcgagaacgggaaggagaccctgcagcgcacagaccctcccaaaacccacatgacccaccatcccatcagcgaccacgaagcaacactcagatgttgggcccttggtttctatcccgctgagattacactgacgtggcagcgagacggggaagaccagacacaggacaccgaacttgtggaaactagaccagccggagacggaacgttccagaaatgggctgctgttgtcgtcccatcaggtgaggagcagcgctacacttgtcacgtacagcatgagggcttacccaagcccctcactctgcgttgggagcttagctcccagcctaccattcctatcgtgggcattattgccggtctggtgctgctcggggctgtcattaccggcgctgttgtggccgctgtcatgtggcgcagaaagtctagcggcggagagggggtgaaagatcgcaaaggagggtcatacacacaagcagcatctagcgactccgcccagggatcagatgtgtcactgactgcatgcaaagtgtag

SEQ ID NO: 51237 - DNA, 900 bp, Artificial Sequence
  Description of Artificial Sequence: Synthetic coding sequence
atggcagtgatggcccctagaactctgctcctgttgctgttaggcgcactggccttaacacagacctgggccggttctcatagtatgagatattttacaacctcagtgagccgcccaggacggggagagcctcggtttatcgccgtgggctatgttgacgacacgcagttcgtcaggtttgacagcgacgctgctagccagcggatggaaccacgggctccttggattgaacaggaaggtccagagtactgggacctgcagactcggaacgtgaaggcccaatctcagacagaccgtgccaacctcgggactttgaggggttattataatcagtcagaggccggtagccacaccatccagatgatgtacggctgcgatgtcgggtccgacggccgttttctgcgcggatatcggcaggacgcatatgatggaaaagattatattgctctcaacgaggatctgcggtcgtggaccgccgcagatatggcagctcaaattacccagcgcaagtgggaagccgcacgagtggccgaacagctgcgtgcctatctagagggaacctgcgtggaatggctcagaaggtacctggagaacggcaaagagactctgcagaggacagatgccccaaaaactcacatgactcaccacgcagtgtctgaccatgaggccaccctgagatgctgggcactgtcattctatccagccgagatcaccctaacctggcagcgggatggggaagaccagacacaggatactgagttggtggagacacgcccagctggcgacggtactttccagaaatgggcatcggtggtagtgccaagcgggcaggaacagcgctacacatgccacgtgcaacacgagggacttcccaagcccctcaccctgcgctgggtgtag

SEQ ID NO: 51238 - DNA, 1098 bp, Artificial Sequence
  Description of Artificial Sequence: Synthetic coding sequence
taagcagtgatggcccctcggaccctggtgctgcttctgtccggggctctggcactgacccaaacatgggccggatctcactccatgaggtacttctttacaagcgtgtctcggcctggcagaggggaaccaaggttcatcgcagtaggttatgttgacgatacacagtttgtgaggtttgactccgacgctgctagtcagaggatggagccacgggctccatggatcgagcaggaggggcctgagtactgggatggagaaactaggaaggtgaaggcacacagccagacccaccgggtagacctagggacactgcggggatattacaaccaatccgaggccggatcccataccgtgcaacgaatgtatggctgtgatgtcggttccgattggcggttcctgcgcggataccatcaatacgcctatgacgggaaagattacatcgcgctcaaggaggacctgaggagctggacagcagctgacatggctgcacaaacgaccaagcataagtgggaggctgcccacgtagcggaacagctgagagcatatctcgagggaacctgcgtggaatggctgcggcgatatctggagaatggtaaagagacccttcagcgaaccgatgccccaaagacccacatgactcaccacgctgtgtcagatcatgaggcgacgctacggtgttgggctctgagcttttatccagctgaaataacgcttacgtggcagcgggacggagaggatcagacgcaagacacggagctggtggagacacgccctgcgggagatggcacatttcagaaatgggccgctgtcgtggtgccttctgggcaggagcaacggtatacatgtcacgtacaacacgaggggctgcctaagccactgacactccgctgggaaccttcttctcagccaactattcctattgtcggcattattgccggtttggtcttgtttggggcagttatcacaggggcagtggtggccgctgtcatgtggcggcgaaagtctagtgatcggaagggtggctcctacagtcaggcggcttcttctgattcagcccaagggtccgacgtgtctctaacagcctgtaaggtctag

SEQ ID NO: 51239 - DNA, 900 bp, Artificial Sequence
  Description of Artificial Sequence: Synthetic coding sequence
atggctgtgatggccccacgcacactggttcttttgctgagtggagcattggcattgactcagacctgggctggctctcacagcatgagatacttttttacaagtgtctcccggcctgggaggggagagccccgattcatcgccgttggctacgtggatgacacacagttcgtgagattcgacagcgatgcagcttctcaacggatggaacctcgtgccccttggatcgaacaggaaggtcccgagtattgggatggcgagacccggaaggtgaaggctcacagccagacacaccgcgtggacttggggaccctgcgcggatactataaccagtcagaggcagggtctcacacagtccaaaggatgtacgggtgcgacgtcggctctgactggagattcctgcgcggttaccatcagtacgcttacgacggtaaggattatatcgccttgaaggaggatctgcgcagttggacagccgcagacatggcggctcaaaccacaaagcacaaatgggaggccgctcatgtcgccgagcaacttcgcgcttacctcgaagggacatgcgtggaatggctaagaaggtacctggagaatggtaaggaaaccctccagcgaacagatgctccaaaaacccatatgactcaccacgccgtgtccgaccacgaagctactcttaggtgttgggccctgtctttctaccctgccgagataacactgacatggcagagggacggggaggatcagacacaggacaccgaactggtggagaccaggcctgcaggggacggaacctttcagaaatgggccgctgtggtcgtgcctagcggtcaggagcagcgctacacctgccatgttcagcacgaaggcctgcccaagcccctaacattaagatgggtttag

SEQ ID NO: 51240 - DNA, 1098 bp, Artificial Sequence
  Description of Artificial Sequence: Synthetic coding sequence
atggccgtcatggcccctagaacattgctgttacttctgcttggggctctagccctgacacagacttgggcaggcagccacagtatgcgttatttttttacaagtgtgtcgcggcctggacggggagagcctcgatttattgcagtggggtatgtcgacgatactcagtttgtgcgcttcgatagcgacgcagcctcccagcggatggagccaagggctccttggattgagcaggaagggccagagtactgggaccaggaaacgcgaaatgtgaaggcacactcccagaccgacagagagtcactgcgcatagctctcagatactacaatcagagtgaggccggatctcacactatccaaatgatgtatggatgcgacgtgggtccagacggacggctcctccgcggatatcagcaagatgcctatgatgggaaggattatatcgcgctgaacgaagaccttagatcttggaccgcagctgacatggctgcccaaatcacgcagaggaagtgggaggctgcaagagtggccgagcagctgcgggcataccttgaagggacctgtgtcgagtggctgagaagatatctcgaaaacgggaaagaaaccctgcagaggaccgatgcaccaaagacccacatgacccatcacgccgtgtctgatcacgaagccacactcaggtgctgggcactgagcttctatcccgctgagatcacccttacctggcaaagagacggtgaggaccagacacaagataccgagctggtggaaacacgaccagccggagacggcacatttcagaagtgggcaagtgtagtcgtaccaagcgggcaggagcagcgttacacttgccacgtacagcacgaggggttacccaagccacttactctgaggtgggaaccgagttcacaacccaccatacccatcgttgggatcatagccggactggttttgtttggggcaatgttcgcgggagccgtggtcgctgccgtgagatggagacgtaagagttctgacaggaagggcggtagctattcacaggccgcaagctctgattccgcacagggctccgatatgtcgctgacggcctgtaaggtctag

SEQ ID NO: 51241 - DNA, 1116 bp, Artificial Sequence
  Description of Artificial Sequence: Synthetic coding sequence
tgagcagtcatggctcccagaactctcgtgttattgttatcaggggcactggccctgacacaaacttgggctgggtcacactctatgaggtacttttttacctcagtgtctcgacctggtaggggcgagccccgttttatcgccgtgggttacgtcgacgatacacagtttgtgaggtttgattctgatgctgcatcccagcggatggagcccagagccccttggatcgagcaggaaggaccagagtactgggatggtgaaacccgaaaagtgaaagcccactctcagactcatcgggtggacctgggaacattgcgaggatattataatcagtcagaagccggaagtcatactgtgcagagaatgtatggctgtgacgttggttccgattggcgatttttacggggatatcatcagtacgcctatgacggcaaggactacattgcgctgaaggaggatctccggtcctggaccgctgctgatatggctgctcaaaccacaaaacataaatgggaggctgcccatgtggcagagcagctgagagcatacttagaaggcacctgtgtggagtggctgcgccgatacctcgaaaatggtaaggaaaccttacagaggaccgatgcaccaaagactcacatgactcatcatgccgtgtccgatcacgaagccactctgcggtgctgggctttatcattttaccctgcggagatcacattaacgtggcagcgggacggcgaggatcagacccaggacacagagctcgttgaaacaagacctgccggtgacggaaccttccagaagtgggccgcagtcgtcgtgccgtcagggcaagagcagagatatacttgccacgtgcaacatgaaggactcccaaagcccctcacattacggtgggagccaagttcgcagcccacaatccctattgtgggaataatcgcgggactggtactgtttggtgccgtcatcaccggggctgtggtcgccgcagtgatgtggaggcgcaaaagctccgggggtgagggcgtgaaagaccgcaagggcggaagctactctcaggccgcatcctctgactcagcacaggggtccgatgtctccttgaccgcctgtaaggtgtag

SEQ ID NO: 51242 - DNA, 1098 bp, Artificial Sequence
  Description of Artificial Sequence: Synthetic coding sequence
atggcagtcatggcacccagaacactactgctgctcctactgggggcactcgcgttgactcaaacgtgggccggatcccacagcatgcggtactttacgactagtgttagtaggcctggcagaggtgagcctcgattcatagctgtgggctacgtagacgatacccaatttgtccgtttcgattcagatgcagcctctcagaggatggaaccgagagctccctggatcgagcaggagggacctgagtattgggacctgcagacacgtaacgtgaaggcacagtcccagaccgatcgtgcgaaccttgggaccctgcggggatattacaatcaatccgaggctggctcacataccattcagatgatgtatggctgcgatgtgggaagtgatgggaggtttctgcgcggttatagacaggacgcttacgatggaaaggattatattgccctcaacgaagatctgagaagctggaccgcggctgacatggctgcccagattacccagcggaaatgggaagctgcacgggtagctgagcaactgcgggcttatctggaaggcacctgcgtagaatggcttcggcgatatctcgagaacggcaaggagaccttgcagcgaaccgatgcacctaagacacacatgacccaccatgctgtctccgaccacgaggccaccttacgctgttgggcattgtctttttatcctgcagagattactttgacttggcagagagacggcgaggaccaaacacaggatacagagctcgtggagaccaggccagcgggtgatggaacattccagaagtgggcctccgtggttgtacctagcggacaagagcagcgctacacttgtcacgtgcaacacgaagggttgcccaagccgctgacccttcgctgggagcccagttcacagcctaccattcctattgtgggaatcattgctgggctagtactgtttggcgctgtgtttgctggcgctgtggtggccgcagtgcgttggcggaggaaatctagcgataggaaaggtggatcatactctcaggcggcaagttccgattcggcgcaggggagtgacatgtccctcacagcgtgcaaggtctag

SEQ ID NO: 51243 - DNA, 1098 bp, Artificial Sequence
  Description of Artificial Sequence: Synthetic coding sequence
atggctgtcatggcaccaagaactctggtgctgttgctttctggggcactggccctcacacagacatgggcgggtagccacagtatgagatatttttttacttcagtttctagaccaggacgaggggagccgagattcatcgcagtgggctatgtggacgatacccagttcgtgcgcttcgacagtgacgctgcttcgcagcggatggaacccagagccccttggatcgagcaggaagggccagagtactgggacggcgaaacccgaaaagtaaaagctcacagccagacccaccgagtggatcttggaacactgagggggtactataatcagtcagaggctggatctcacaccgtgcagagaatgtacggctgcgatgtaggatccgactggcgctttctgcgcggttaccatcaatacgcatatgacggcaaggattatattgcgctcaaggaagacttgcggagttggacagccgctgatatggccgcacagacaactaagcataaatgggaagccgctcatgtagctgagcaactgcgcgcttacctggaagggacatgtgtggaatggttgcgacgatacctggaaaatggcaaggagacgctgcagaggaccgatgccccaaagacgcacatgacccaccacgccgtatctgatcacgaggccacgctccgctgttgggcgctgagcttttatcccgcagaaataacattgacttggcagcgcgacggagaggaccagactcaggacactgaacttgtcgaaaccaggcctgcgggtgatggtacattccaaaagtgggctgccgtggtggtgccttcggggcaggagcagaggtacacatgccacgtgcaacatgaaggtttaccgaagccacttacacttaggtgggagccatctagccagcccactatccctattgtaggaataattgcagggttggttttatttggtgcggtgattactggggcagttgttgctgccgtgatgtggcgtagaaaatcttctgatcggaaaggaggctcttacagtcaggcggcttcttctgattccgcacagggctctgacgtctcactcactgcttgcaaggtgtag

SEQ ID NO: 51244 - DNA, 1029 bp, Artificial Sequence
  Description of Artificial Sequence: Synthetic coding sequence
atggctgtgatggcaccgaggacactgctcctcctactgctaggggctcttgctctgacgcaaacttgggccggttcacatagtatgcgctattttaccacaagcgtgtcacgccctggaagaggtgagcctagattcatcgcggttggatacgtggacgacacacaattcgtgcgctttgattcagacgcagcttcacagcgaatggaacctcgtgccccttggattgagcaggagggtcccgagtactgggacctccaaacacgtaacgtaaaggcacagtctcagacggatcgcgcaaacttgggcactctgagggggtactacaatcaatccgaagcgggaagtcatacaattcagatgatgtatggctgtgacgtcggatcagatggacggttcctgcgcggataccgacaggatgcatacgatggcaaagattacatcgcacttaacgaggatctaagaagctggacagcagctgatatggctgctcagataacacagagaaaatgggaagctgccagagtcgctgagcaactcagggcttacctagaaggaacatgcgtggagtggcttcgtcggtacctggagaacggcaaggaaaccctgcaacgcaccgatgctcccaagactcatatgacacaccacgccgtctcagaccatgaggctactttgagatgctgggccctgagcttttatccagctgagatcaccctgacctggcaacgggacggcgaagaccagacccaggacaccgaactcgtggaaacgcggccagcgggagacgggacatttcagaagtgggcctccgtggtggtgccctcgggccaggagcaaagatacacatgtcacgttcaacacgaaggattacccaagcctctcactctccgatgggaacccagcagccagcctacaatccccatcgttggcataatagcaggcctggtgctgttcggggctgtgtttgcaggagccgtcgtggccgcagtaagatggcgtcggaagtctagcggtggagtgaagggatag

SEQ ID NO: 51245 - DNA, 345 bp, Artificial Sequence
  Description of Artificial Sequence: Synthetic coding sequence
atgacccatcatccaattagcgatcacgaagctaccctccgttgctgggccctgggcttctatcccgctgaaattaccctgacctggcagcgtgatggagaagaccagacacaggatacagaactggttgagactcggcctgcaggagatgggacctttcagaagtgggctgctgtggtcgtgccaagcggcgaagaacagcgatatacatgccacgttcagcatgagggattgcccaaacctctgaccctgaggtgggaccgtaaagggggaagctacactcaggctgcttcaagtgatagcgcacaaggaagtgatgtgtccttgacagcctgtaaagtgtag

SEQ ID NO: 51246 - DNA, 465 bp, Artificial Sequence
  Description of Artificial Sequence: Synthetic coding sequence
atggccgtgatggccccacggacgctgctcctcctacttagtggggctctagccttaacccagacctgggccggatcccactccatgagatacttctttacctctgtttcccggcctggccgaggagagcccaggtttatagctgtcgggtatgtagatgatacacagttcgttcgattcgactccgacgctgcgagccaaaaaatggaaccaagagcaccatggattgaacaggagggaccagaatattgggaccaggagactaggaacatgaaagcccactcacagactgaccgtgccaacctaggcacactccgcggttattataatcagagcgaagacggcagtcacacaattcaaatcatgtacggatgtgacgtcgggccagatgggcgattcctgcggggttacaggctccggtccccaagcgcctccggtcgaagatccatgcgtcgctcctcttag

SEQ ID NO: 51247 - DNA, 1098 bp, Artificial Sequence
  Description of Artificial Sequence: Synthetic coding sequence
atggcagtaatggccccacgtacgcttgttctcctgttgtccggtgctttggctctgacgcagacttgggctgggtctcactccatgagatattttttcacatcggtctcacggcctggccgaggcgaacctagattcattgccgtgggctacgttgatgatacacagtttgtcaggtttgacagtgacgctgcatcccaacgaatggagcccagagcaccctggattgagcaggagggaccagaatattgggatggcgagactcgcaaggtgaaagcccacagccagacacatcgagtggatcttggaaccctccggggttactacaatcagtccgaggccggatcccatactgtacagcggatgtatgggtgcgacgtcggaagcgattggcggtttctcaggggctatcaccagtatgcatacgacggaaaggattatatagccctaaaagaggatctgagatcctggaccgcagcggatatggccgctcaaacaaccaaacataaatgggaagctgcgcacgtggctgagcagctccgcgcatatctggaagggacctgtgtggagtggctgcgcaggtatctggaaaacggcaaggagacccttcaacggacagacgcccctaagacccatatgacacaccatgcggtgtcggaccacgaggctacactgcgttgctgggcgttgtctttctatccagcggagataaccttgacgtggcagcgggacggagaggatcagacgcaggatactgagctggttgagactcgtccagccggagacggcaccttccagaagtgggccgcagtcgttgtgccgtctggtcaggagcagaggtacacgtgccacgtacagcacgaagggttaccaaagccattgactctcaggtgggagccatcttctcagcctacaatacccattgtgggtattattgccggtctcgtgctctttggagcagtgattaccggcgctgtggtcgcagccgtgatgtggcgcaggaagtcctcagataggaaggggggaagctactcccaagccgcatcgtccgactctgcccaaggttctgatgtttctttgaccgcctgcaaggtgtag

SEQ ID NO: 51248 - DNA, 1089 bp, Artificial Sequence
  Description of Artificial Sequence: Synthetic coding sequence
atggctcctagaactttattgctgcttctcagcggggctctcgctttgacgcagacctgggccggatcccacagtatgagatatttctttacgtccgtgagtcggcctgggagaggagagccccgatttatagccgttgggtatgttgacgacacccagtttgttcgattcgactctgatgctgcatcccaacggatggagccgcgtgccccatggattgagcaggaaggaccagaatattgggatggggaaacacgtaaagtcaaagcacactcccagacccaccgcgtcgacctcgggacactgcggggatattataatcaaagcgaggccggatcccacaccgttcagagaatgtacgggtgtgacgtagggtcagactggaggtttcttcgcggatatcatcagtatgcatatgacgggaaagactatattgccctgaaggaagacttaaggtcctggaccgcagccgatatggctgcccagacgacaaaacacaagtgggaagccgctcacgtagccgagcaactgagggcctatcttgaaggtacttgcgttgaatggctgaggcgctacctggaaaatgggaaagagactctgcaaagaaccgacgctcctaagacccacatgacacatcacgccgtatccgaccacgaagccaccctcaggtgttgggctttatctttttacccagcagaaattacgctcacgtggcaacgagacggcgaggaccagacacaggatacggaactcgtagagaccaggcccgcaggggatggcacattccagaaatgggccgctgtggtcgtcccctcagggcaggagcagaggtatacttgtcatgttcagcatgaagggctgccaaaacctctcaccctccgctgggagccctctagccagcccacaatccccatcgtggggataatcgccggactcgtgctctttggagcagtgattactggcgctgttgttgctgcagttatgtggcgcaggaaatcctccgacaggaagggtgggagctactcccaggccgcatcttcagatagtgcccagggctccgatgtgtcccttaccgcgtgtaaagtatag

SEQ ID NO: 51249 - DNA, 1098 bp, Artificial Sequence
  Description of Artificial Sequence: Synthetic coding sequence
atggcagtcatggcgcctcgaactctggtgcttctactgagcggagcgctagcattaacacagacttgggctggcagccactcaatgcgctacttttacacttctgtgtctcgccctggcaggggagaacctagatttatcgcggtagggtacgtggatgacactcagttcgtgcggttcgactctgacgcagcaagccagcgcatggagccccgagctccttggatagagcaagagggccctgaatactgggacagaaacacccggaatgtgaaggcccattcccagactgatagagcaaacctcgggaccctacgaggttattacaatcagtcagaggatggaagccacactattcaaagaatgtacggttgcgacgtggggcctgacggcaggtttctgagagggtaccaacaagacgcttacgatggcaaagattatatcgctctgaacgaggacttgaggagctggacagctgcagatatggcagcgcagataacgcagcgaaaatgggagaccgctcatgaggctgaacagtggagggcttatctggaaggcagatgtgtagaatggctaagacgctatttggagaatggaaaggagaccctgcaacgtaccgatgcccctaaaacacacatgacacatcacgcagtctccgaccatgaggccactttacgttgttgggccctgagcttctatccagctgaaataacgcttacgtggcagagggacggagaggaccagacgcaggatacagagcttgtcgagacacgtcccgcaggagatggcactttccagaaatgggcgtcagtagttgtcccttccggacaggaacagagatacacttgccacgttcagcatgagggcctgcctaaaccactgaccctgcgctgggagccttcgtcacagcctactatccctatcgtgggaatcattgcaggcctggtcctcttcggcgcagtcatcgccggtgctgtggtcgctgcagtgatgtggaggagaaaatcatcagatagaaagggaggctcctacagccaggcagccagtagcgatagcgctcagggtagtgacatgtccctcaccgcctgtaaagtttag

SEQ ID NO: 51250 - DNA, 888 bp, Artificial Sequence
  Description of Artificial Sequence: Synthetic coding sequence
atggctgtgatggccccacgcactttgctgctcttgctgctcggagcgctcgccttaacgcagacctgggccggatctcacagcatgaggtatttcaccacaagtgtctccagaccaggccgtggcgaacctcggttcatcgccgtgggctacgttgacgacacgcagtttgtgagattcgactcagatgccgctagtcaacgcatggaaccaagagctccctggattgaacaggagggacccgaatactgggaccttcagacccgcaacgtcaaggcccagagccaaactgatcgggcttatctcgagaacggcaaagagacactccagagaacagacgcaccaaagacgcacatgactcaccatgctgttagcgaccatgaggctacgctacgttgctgggctctgtctttttatcctgccgaaattaccctcacatggcaaagagatggagaagaccagacacaggatacagagctggtcgagacgagacccgctggcgatgggacttttcagaagtgggcttccgtggtggtaccaagcggccaagaacagaggtatacctgtcacgtgcagcatgagggactgcctaagccactaaccctgcgttgggagcctagcagccagcctaccatacccattgttggcataatcgcaggcctggtgctcttcggagcggtgttcgccggtgccgtggtcgcggcagtgcgctggcgcaggaaaagttctgggggagaaggcatgaagggtgggagtgaaatcagctgtttgactgagggaagcaagacccaagtggaagtgtgtccggcatccctattaggttctaccatccacaattacggtccgactcagcctggcccatgtgtccctgcccttactctgctgtag

SEQ ID NO: 51251 - DNA, 1098 bp, Artificial Sequence
  Description of Artificial Sequence: Synthetic coding sequence
atggcagttatggctcccagaacactgctgctcctcctgtccggcgcattggccctcacccaaacgtgggctggcagtcacagtatgagatattttttcacaagtgtgagcaggcctggacgaggggagcccaggtttatcgccgtggggtacgtggatgatacccagttcgttcggttcgactccgacgcagccagccagaagatggagccgcgtgcgccatggatcgaacaggaaggaccagagtactgggatcaggagacacggaatatgaaggcgcactcacagaccgacagggcgaacttgggtacactgaggggatattataaccagtcagaagacgggagccacaccatccaaattatgtatggctgtgatgttggccctgatggacgatttctgagaggatatcgccaggacgcatatgatgggaaagactacatcgccttgaatgaggatctccgctcctggactgccgctgatatggctgcacagattaccaaaaggaagtgggaagccgttcatgccgcagaacagcgcagagtttatctcgaaggaaggtgcgtcgatggactcaggcgctatctcgaaaacggcaaagaaaccctgcagagaactgatccaccaaaaacccatatgacccaccaccctatttcggaccatgaagccacattgcgttgctgggctctgggcttttacccagctgagatcaccctgacctggcagagggacggggaagaccagactcaagatacagaactcgttgaaacaagaccggcaggtgacggaacattccagaagtgggccgctgtggtcgtgccatccggcgaagagcaaaggtatacttgccacgtacagcacgagggtttgcccaaaccactgacattacggtgggagctgtcgtcacaacctaccattcctatagtaggaattatcgccggactggtgctgctcggggctgtgatcaccggcgcagtggtggccgctgtcatgtggcgtagaaaatcttctgatcggaaggggggtagctatacccaagccgcatcgtctgactccgcccagggatccgacgtcagtttaaccgcttgcaaagtgtag

SEQ ID NO: 51252 - DNA, 888 bp, Artificial Sequence
  Description of Artificial Sequence: Synthetic coding sequence
atggccgtcatggcgccaaggactctgctgttactgttactgggggctctagcactaacccagacctgggccggttcccactccatgcgctacttctttacaagcgtgtctaggccgggaagaggggaacccagatttatcgcggtcgggtacgttgatgatacgcagttcgttaggtttgatagcgacgccgcaagccaaagaatggaaccacgcgcaccgtggatcgagcaggagggcccagaatattgggaccaggagactcgcaacgttaaagcccactcacagaccgaccggagatacctggaaaatggaaaggagactctccagcggacagatgctcctaaaacacacatgacccatcatgccgtgtctgaccacgaggcaacactacggtgctgggccctctcattctatcccgctgagattaccctcacatggcaacgagatggcgaggaccaaacccaagacactgaattggtagagactcggcctgcaggagacggcactttccaaaaatgggcaagcgtggtggtgccgtcaggtcaggagcagcgatacacttgccatgtacagcacgagggtctccccaaaccattaacattgcgatgggagccgtcctcgcaacctacaattcctatagtggggattatcgctggcctggtgctgttcggagctatgttcgctggagccgtggtcgctgctgtccgctggcgccgaaagagcagtggaggggagggaatgaaaggcggatctgaaatttcctgcctcactgaaggaagcaagacacaggtcgaagtgtgcccggcttccctgcttgggtcgacgattcataactacggccctacccagcctggcccatgcgtgcccgcactcaccctcctctag

SEQ ID NO: 51253 - DNA, 1098 bp, Artificial Sequence
  Description of Artificial Sequence: Synthetic coding sequence
atggcagttatggctcctcgtaccttactactgctgctgttaggcgctctcgccctcacacagacatgggcagggtcacacagtatgcgatacttcaccacgagcgtgagccggcctggcaggggtgaaccgagattcatcgcagtgggctatgtcgacgatacccagtttgtgaggtttgattctgatgctgctagtcagagaatggagcccagagcaccttggattgagcaggaaggtcctgaatattgggacctgcaaacgcgtaatgtgaaggctcagtctcagaccgaccgggctaacctcggaacacttagaggctactataatcaatctgaagccggtagccacacaatccagatgatgtatggctgcgatgtaggatcagatggtagattcctgagggggtaccggcaggatgcctatgatggaaaagattatatcgccctcaacgaagatttgaggagctggacggctgccgacatggccgctcagatcacccagcggaagtgggaggccgctagggtggccgaacaacttcgggcttatctggagggaacgtgcgtcgaatggctgagacggtatctggagaacggtaaggaaacgctgcagcggaccgacgctcctaaaactcatatgacccaccacgccgtttccgaccacgaggctacactgaggtgctgggcactgagtttttaccctgcggagataaccctcacctggcagagagatggagaagatcagacccaggatactgaattggttgagaccagacccgcaggggacggtacgttccagaaatgggcttccgtggtggtaccttccggccaggaacagcgctacacttgtcacgttcaacacgagggtctgccaaaaccacttacacttagatgggagccctcctcccagccgaccatacccatcgttggaattatcgccggactggtgctcttcggagccgtgtttgcgggagccgtcgtggcggctgtgagatggcgtagaaagagctccgacaggaagggcggttcttactctcaggcagcctcaagtgactcggcgcaaggctcagatatgagcctcactgcctgcaaagtctag

SEQ ID NO: 51254 - DNA, 345 bp, Artificial Sequence
  Description of Artificial Sequence: Synthetic coding sequence
atgacacaccaccctatctccgatcacgaggctactctgaggtgttgggcactcggtttttatccagcggaaattaccctgacatggcaaagagacggggaggaccaaacccaggacacagagctcgtggagactagacctgcgggagatggcacttttcagaaatgggcagcagtagtcgtgcctagtggggaagagcagcgctacacttgccacgtccagcacgaaggcctgcccaaacccttgacactcagatgggaccggaagggaggcagttacacccaagcggcaagctccgacagcgcccagggcagtgacgtgtctctaacagcatgtaaagtctag

SEQ ID NO: 51255 - DNA, 888 bp, Artificial Sequence
  Description of Artificial Sequence: Synthetic coding sequence
atggctgtcatggcgccacgaacattggtgttactgctgtctggcgcactcgcacttacccagacatgggccggtagccatagcatgagatacttctatactagcgtgtcgcgtcctgggaggggtgagcctcgctttatcgccgtgggatatgtggacgatacacagtttgtccgcttcgactctgacgcagcttctcaaagaatggaacctcgcgcaccatggatcgagcaagaggggccagagtactgggaccgcaacacaagaaatgtcaaagcccattctcagactgacagggcctacctggagaatggaaaggaaacccttcaacgcaccgacgctccaaagacacacatgacacatcacgctgtgagtgaccatgaggccacgttgcgctgttgggctctgagcttctacccggcagaaatcactctgacatggcagcgggacggagaagaccagacgcaggatactgaactcgtggagacacgaccagctggcgatggcacgtttcagaagtgggcgtctgttgtggtgccatccggccaggaacaaagatacacctgccatgtccagcatgagggcctgcccaaaccattgaccctgcgatgggaaccttcaagtcagccaaccatccccatcgttggtataatcgcaggcctggtgttgtttggcgcagtgatcgcgggagccgtggtggctgcggtgatgtggcgacgcaaaagctccgggggtgaaggaatgaaaggaggaagcgaaatctcatgtctgaccgaggggagcaaaacgcaggtcgaggtgtgtccagccagcctcctgggttcgaccattcacaactacgaacctacccaacccggtccgtgtgttccggctctgactctgttgtag

SEQ ID NO: 51256 - DNA, 465 bp, Artificial Sequence
  Description of Artificial Sequence: Synthetic coding sequence
atggctgtgatggccccacgcactctgttgcttcttctgtcaggcgctttggcgctcacacagacctgggccggtagtcactcaatgcgctacttcttcacatctgtcagcagacccggtcgcggtgaaccaaggtttatcgcggtgggctatgtggatgatacacagttcgtgcggtttgactccgatgctgcttcccaaaagatggaaccacgtgctccatggattgagcaggagggacctgagtactgggatcaagagacaagaaatatgaaagcccactcccagacggatcgggcaaacctcgggaccctgcgtggctactataaccagtccgaagatggttctcacacgatacagataatgtacggttgtgatgtgggtcctgacggacgcttcctgagaggatatcgcctccgctcccccagcgcctcgggcagacgttccatgagacgaagttcctag

SEQ ID NO: 51257 - DNA, 1098 bp, Artificial Sequence
  Description of Artificial Sequence: Synthetic coding sequence
atggctgtcatggctcccaggactctgttactccttctgtccggcgcactggctttgacccagacgtgggcaggtagccattctatgaggtactttttcactagcgtgagcaggcctggacgcggagagccacggtttattgctgtgggctatgtggacgacactcagtttgtgagattcgacagcgatgctgcaagccaaaagatggaaccccgagcgccatggatcgagcaggaaggtccggagtactgggaccaggagactaggaatatgaaggcccactcacagactgacagagcaaatctaggcactttgcgcggttattacaatcagtctgaggacggctcgcatactattcagattatgtacgggtgcgatgtggggccagacgggaggttcttgcggggatataggcaggacgcttacgacgggaaagactacatagctcttaatgaggacctgagatcctggactgctgctgacatggcagcccagatcacaaagcggaagtgggaagccgtccatgccgcagagcagcggagagtgtacctggaaggtcgctgcgtggacgggctgaggcgctacttagaaaacggaaaggagacgcttcagcgcactgaccctccaaaaacacatatgactcatcaccccatttccgaccacgaggcaactctgcgctgttgggcactgggcttctatcctgctgagatcaccttaacgtggcagcgcgatggcgaggaccagacacaagatacagagttagtagaaacgcggcctgctggcgacggcacctttcagaaatgggcggctgtggtagtcccctccggggaagaacagagatacacttgtcacgtccaacacgaaggattaccaaagcctttaacccttagatgggagctctcatctcaacccaccattcctattgtcggcattatcgcaggcctcgttcttcttggagctgtaatcaccggagcagtggtggccgctgtgatgtggcggcgaaaaagcagtgatagaaaggggggaagctacacccaggctgccagcagcgattcggcccaagggtccgacgtctctttgaccgcctgtaaagtttag

SEQ ID NO: 51258 - DNA, 1098 bp, Artificial Sequence
  Description of Artificial Sequence: Synthetic coding sequence
atggccgtgatggcccctagaacactgctattactgttgctgggcgcactcgcccttactcagacttgggcagggtcccactcaatgcggtatttcttcacctctgtgtcacgcccaggccgaggcgaaccacggttcatcgctgtgggctacgtggacgacactcagtttgtccgctttgactccgatgccgctagccagagaatggaacctagagccccatggattgagcaagagggcccagaatattgggaccaagagacacgtaatgtgaaagcccactctcaaacagacagagagtccctccggatcgctttacgctactacaatcagtcagaagctggaagccataccattcaaatgatgtatggatgtgacgtggggccagacgggagactgctgagaggttatcagcaagatgcctacgatggaaaagactatatcgcactgaatgaagatctacgatcctggaccgctgcggatatggctgctcagattacacaaagaaaatgggaagccgcacgggtagcagaacagctgcgggcatacctcgagggtacctgtgtcgaatggctgagacgctacctggagaacgggaaggagacgttgcagcgcacagacgctcctaaaacccacatgacccatcatgcagtctcagatcacgaggccactctcaggtgttgggctttgtcattttacccggctgaaatcacgctgacatggcagcgggatggcgaagatcagacccaggacacagagttggtggagacaagaccagcaggcgatggtaccttccagaaatgggccagcgtcgtggtaccatctggccaagagcagaggtacacgtgccacgtacaacatgagggcctgcccaaaccactgaccctcagatgggagccaagcagtcagcctaccattcctatagtcggtataattgccggactcgtgcttttcggagccatgtttgcaggtgctgtcgtcgctgcagtgagatggcgtaggaagagttccgacagaaaggggggatcctactcgcaggcggcaagcagcgacagtgcacaagggtctgatatgtccctaaccgcctgtaaggtctag

SEQ ID NO: 51259 - DNA, 345 bp, Artificial Sequence
  Description of Artificial Sequence: Synthetic coding sequence
atgacgcaccatcctatttctgaccacgaggctacccttcgctgttgggctttaggcttctaccccgcagagatcaccctgacgtggcagcgagacggcgaggaccagacccaggacacagaactcgtggaaactaggcctgcaggagacgggacattccagaagtgggctgcagtggtggtcccatctggagaggaacagcgttacacctgtcacgtgcagcacgaaggcctcccgaagccgctgaccctaaggtgggatagaaagggaggctcctatacgcaagcagcaagcagcgattcagcccaagggtcagacgtcagcctcaccgcctgtaaagtgtag

SEQ ID NO: 51260 - DNA, 1089 bp, Artificial Sequence
  Description of Artificial Sequence: Synthetic coding sequence
atgagagttactgctcctaggacgctgctgctgttgctttggggcgctgtggcgctaacagaaacatgggctggaagccattccatgagatactttcatactagtgtgagccgcccaggcaggggggaacccagattcattagcgtaggctatgtggacggcacccagtttgtgcgttttgactcagacgcagcgagtcctaggactgagccgagggcgccttggattgaacaagaaggcccagaatattgggataggaacacacaaatctctaagacaaacacccaaacctaccgagagagtctgcgcaatctgagaggatattacaaccagagcgaggctgggagccatactctacagcggatgtatgggtgcgacgtgggtcctgacggtcgattactcagaggccacgaccaatcagcatacgacgggaaagactacattgcactcaatgaggaccttagttcctggacagctgccgacactgccgctcagatcacccagaggaaatgggaggccgcaagagtggcggagcaactgcgcgcatatctggagggcacttgcgttgaatggttgcggcgacacttagagaacggcaaggaaacactgcaaagggcggatcctcctaaaacgcacgtcacgcaccacccaatttcggatcatgaggcaacactaaggtgttgggccctgggcttctacccagccgagataacactaacatggcagagagacggtgaagaccaaacccaagatactgaattggtggaaacaaggcctgcgggagataggactttccagaaatgggccgctgtggtggtgccctctggcgaggaacaaagatatacctgtcatgtacaacatgaagggctgccaaagcctctgactcttagatgggagccatcaagtcaaagcactatcccgatagtcgggattgtcgccggtctggcagtcctcgctgtggtcgtaatcggcgctgtggtagctacggtgatgtgccgcagaaaaagcagcgggggaaaggggggttcctatagccaggcggcatctagcgatagcgcacaggggagcgacgtctccttgacagcttag

SEQ ID NO: 51261 - DNA, 1089 bp, Artificial Sequence
  Description of Artificial Sequence: Synthetic coding sequence
atgctggttatggctccccgtaccgtgctcctgctgctgtcagccgctcttgccctgaccgaaacttgggcgggttcacactccatgagatatttttacacatccgtttcacgcccaggccgtggcgaacctagatttatcagcgtgggatatgtagatgacactcaatttgtgcggttcgacagcgacgctgcctctccacgcgaggagcctagagctccttggatcgagcaagagggacctgaatattgggaccgaaatactcagatttacaaagcccaggctcagactgatcgggaaagcctgagaaatctgaggggatattacaatcaatccgaggcaggctctcacactctgcagagcatgtacggatgtgacgtcggacctgatggccgactgcttcgagggcatgaccaatatgcctatgacggcaaggattatatcgctctgaatgaagacctgcgtagttggacagcagccgacactgccgctcagattacgcagcggaagtgggaggctgcgcgtgaggccgagcagaggcgcgcatacctggaaggagagtgcgttgaatggctccggagatacttggaaaatggcaaagataagctcgagcgggcagatcccccaaagacgcacgtgactcaccaccccatcagcgaccacgaggctacactgcgctgctgggctctgggattctaccccgcagagattacactgacctggcaaagggacggagaggatcagacacaggataccgagctcgtcgaaacccgtccagccggagacaggacatttcagaagtgggcagccgtggtcgtcccctctggagaagagcaaagatatacttgccacgtgcaacacgaaggattgccaaagccgctgactctgaggtgggaaccttcatcgcagtccactgttccaatagttgggattgtggccggtttagccgtgctagctgtggtcgtaatcggggcagtagtcgccgcagttatgtgtaggaggaagagttctggcggtaagggcggatcttattcccaagccgcttgttccgacagtgcgcaggggtccgatgtgtcgttgactgcgtag

SEQ ID NO: 51262 - DNA, 726 bp, Artificial Sequence
  Description of Artificial Sequence: Synthetic coding sequence
taaccagacgggaggctgttgagagggcataatcaatatgcttatgacggaaaggattacatcgccctcaatgaggatctgaggtcctggacggctgctgatacagctgcacagataacacagcgaaagtgggaggcagctcgggtagccgagcaggatcgcgcatatcttgagggtacttgcgtagagtggctgcgacgctacttggaaaatggaaaggatactctggagcgggctgaccccccaaaaacccacgtgacccaccacccaatctctgaccacgaggccacactgcgatgctgggccctgggtttctatcccgctgagattactctaacgtggcagcgggatggcgaggaccagactcaggataccgagctagtagagacccgcccagccggtgacaggactttccagaaatgggccgcagtagtcgttccgtcaggcgaagagcagcggtatacttgtcatgtgcagcacgaaggcctgccaaagccactgacactgcgctgggagcctagctctcaatccacagttcccattgtgggaattgtcgccggactcgcggtgcttgctgtcgtcgtgattggcgctgtggtcgccgctgtgatgtgtaggcgaaaatcttctgggcactttctgccgacaggtggcaaaggcggaagctatagccaggccgcatgctccgatagtgcacaggggtcagatgtgtctttgactgcctag

SEQ ID NO: 51263 - DNA, 726 bp, Artificial Sequence
  Description of Artificial Sequence: Synthetic coding sequence
tagccagatgggcgactgctaaggggccatgatcaaagcgcatacgatggaaaagactacatcgccctcaatgaagatctttcctcctggacggcagcggacaccgccgcacaaatcacgcagcggaagtgggaagcggcacgggtggctgagcaactccgcgcatacctggaagggacttgcgttgagtggttgcgcaggcacctcgaaaacgggaaggaaaccttgcaacgtgcagacccaccaaagacacatgtcacacatcatcctattagcgaccacgaggctacgctgcggtgctgggcgctcggtttctatccagcagagatcaccttgacttggcagcgtgatggcgaggaccaaacgcaggacactgaactagtggagacgagacctgctggtgatcgcaccttccagaaatgggctgccgtggtcgtgccttccggagaggaacagcgctatacatgccatgtccagcacgagggcctaccaaagccgctcacactgaggtgggaacccagcagccaaagtaccattccgatcgtgggtatagtagctggcctggccgtgctggctgtcgtggtaattggtgccgtggtcgctaccgttatgtgcagaaggaagagctctgggcactttttgcctactggcggtaaaggtgggagttactctcaagccgctagctctgatagcgctcaggggtccgatgtgtctctgacagcttag

SEQ ID NO: 51264 - DNA, 1089 bp, Artificial Sequence
  Description of Artificial Sequence: Synthetic coding sequence
atgagggtgacagcccctcggacactcttgctcctcctctggggggcagtggcgctcaccgaaacttgggctgggagtcactcaatgagatacttttacacagccatgtctcgtccagggcgaggtgagcctcgctttattaccgtcggatacgtagatgataccctcttcgtgagatttgactcggatgctacgagcccacgcaaggagccacgagctccctggatagagcaggaggggcctgagtactgggaccgagagacccagatcagcaagaccaacacacagacctatagggagaatctgagaacagcccttcgttactacaaccagtccgaggcaggttctcatatcatacagcgtatgtacggatgtgacgtcggtccagacggacgtctcttgcgcggttacgaccaggatgcctatgatggcaaagactatatcgctctcaacgaggacttgagttcttggacagctgccgataccgcagcccagataacccagagaaaatgggaggcggctcgagtggccgagcaggaccgcgcatatctggagggcctgtgcgtcgagtccctgagacgttacctcgagaacggaaaagagacgctgcaacgggcagatccccctaagacacacgtgactcaccaccccatatctgaccacgaagttacccttaggtgttgggccctgggcttctaccccgctgagattacactgacttggcagcgagatggagaggatcagactcaagacaccgagctagtggaaactagacccgctggggacaggacctttcagaagtgggccgcagtcgtagtaccttcaggcgaggaacagaggtatacatgccacgttcagcatgagggtttaccaaaaccactcacccttcgttgggagccatcaagccagtctactgttccaatagtcggaatcgttgccggtcttgcggtcctggcagtcgtggtgatcggcgcagttgtagctgccgtgatgtgtcggaggaagtccagcggcggaaaagggggatcttattcacaagcagcctgttccgactctgcccaagggtccgatgtgagcctcacggcctag

SEQ ID NO: 51265 - DNA, 726 bp, Artificial Sequence
  Description of Artificial Sequence: Synthetic coding sequence
tagcccgatgggagactgctgcggggacatgaccagagcgcatatgacggaaaggattacattgcacttaatgaggatctttcgtcatggaccgccgctgacaccgccgcacagatcacccagagaaaatgggaagccgctagagaggcggagcagtggagagcttaccttgaagggctgtgcgtcgagtggctccggaggtacctcgagaatgggaaagagacattgcaacgtgctgacccgccaaaaactcacgtcacccatcatccgatttctgaccacgaggctactctgcggtgttgggctctggggttctaccccgctgaaattaccttaacttggcaacgggatggggaggaccagacccaggatactgaattggtagaaaccaggcccgctggtgatcgtacattccagaagtgggccgcagtggtagttccttccggtgaagaacagcggtacacctgtcacgtgcagcacgaggggctccccaaacccctgaccctgaggtgggaacccagtagccaaagcactatccctatcgtgggtatagtggccggactggcagtgctggctgtcgtcgttatcggagccgtcgtagccacggttatgtgcagacgcaagtctagtggccattttttgcctactggagggaagggtggcagttactcacaagctgcctcatcagactcagcccaggggtctgacgtatctttgaccgcctag

SEQ ID NO: 51266 - DNA, 1089 bp, Artificial Sequence
  Description of Artificial Sequence: Synthetic coding sequence
atgctagtgatggctccgagaacggtgctgcttttattatccgctgccctcgctttgacagaaacctgggcgggatctcactccatgcgctactttgatactgcaatgtctagaccaggaagaggcgaaccccgattcatctcggtagggtatgtagatgacactcaattcgtaagattcgattctgacgccgcaagcccacgtgaggagccacgtgctccatggatcgaacaggaaggcccagaatactgggatcggaatacccaaattttcaaaaccaatacccagacagatcgggagagtctccgcaacctgcgaggatactacaatcaaagtgaggctggttctcacaccctgcagtccatgtatgggtgtgacgtcggacccgatgggaggctcttacgagggcacaatcaatatgcgtatgatggtaaggactacatcgcactgaacgaggatttgcgttcctggactgccgcagacaccgctgcacagatcacccaaaggaaatgggaggcggctcgtgttgcagaacaggaccgtgcgtacctggagggcacatgtgtggagtggcttaggcgctaccttgaaaacggaaaggataccctggaacgagccgaccctcccaagacgcatgttacacatcaccctataagtgaccacgaggcaactctacgctgttgggccctgggtttctatcctgccgagatcacattgacctggcagagggacggcgaggaccagacccaggacaccgaactggtggagactcggccagctggcgatcggacatttcagaaatgggccgctgttgtggtcccctcaggtgaggaacagagatacacctgccacgtccagcatgagggtctgcccaagcccttgacactccgctgggagccctcatcacagtcgacagttccaattgtgggcattgtggctggcctggctgtattggcagtggttgtgattggagcggtcgtcgccgctgtgatgtgtagaagaaaatcctcgggtggtaaaggagggtcatactcgcaggctgcctgttctgactccgctcaggggagtgacgtgagccttaccgcgtag

SEQ ID NO: 51267 - DNA, 678 bp, Artificial Sequence
  Description of Artificial Sequence: Synthetic coding sequence
taaatgttggtgatggcccctcgcacggtgctacttcttctgtccgcggctttggcattgaccgagacgtgggccggatcacatagcatgcggtacttttacacttccgtttcccggccagggcgtggtgagccacgctttattagcgtgggctacgtggatgacactcagttcgtcagattcgattcagatgctgcttcccctcgggaggagcctagggccccttggattgagcaggagggacccgagtattgggatcggaatacccagatttacaaggctcaggcacagaccgacagggaatcccttaggaatctgaggggatactacaaccagtctgaggccggatcccacactctgcaatccatgtacggctgcgacgtgggacctgacggcaggctgctcaggggccacgatcagtacgcatatgatgggaaggactatattgcccttaacgaggatctgcgctcttggacggctgccgacacagctgctcaaattacacagaggaagtgggaagctgcaagggaggccgagcagcgccgtgcataccttgaaggagaatgtgtggagtggttacggagatatcttgaaaatggcaaagataagctggaacgggcagaccaggagcagaaatccctatttccagcacaacgtctggagctgagcaatgaatag

SEQ ID NO: 51268 - DNA, 726 bp, Artificial Sequence
  Description of Artificial Sequence: Synthetic coding sequence
atgtacggctgtgacgtgggtcccgatgggagactcttacgtggtcacgatcagtatgcctatgacggaaaagattacattgcgctcaacgaagacctccgctcgtggaccgctgcagacaccgcagctcagatcacacagcgaaaatgggaggccgcacgggaggccgagcagcgtcgcgcatatcttgaaggagagtgcgtggaatggttgaggcggtatctcgagaatgggaaagacaagctggaacgtgctgatccgcctaaaactcacgttacccatcatcccattagtgaccacgaagcaaccttgagatgttgggccctcgggttttatcccgcagaaatcactctaacttggcagcgagatggtgaagaccagacgcaggatacagagctggtggaaacgagaccggcaggggatagaaccttccagaagtgggcggctgtcgtggtcccctctggtgaagaacagagatatacttgccacgtccaacatgaaggcttaccaaagcccctgactttgcgttgggagccatcctctcaatctaccgttcctattgtgggcattgtagctggccttgccgtgttggccgtggtcgtgataggagctgttgtggcagcagttatgtgtcgacgcaagtcttctgggggtaaaggcggatcctattcacaggctgcttgctcagactctgcacagggctctgacgtttcactgactgcctag

SEQ ID NO: 51269 - DNA, 741 bp, Artificial Sequence
  Description of Artificial Sequence: Synthetic coding sequence
atggcgagcgtcgggagacgtgaaggaactgccggtggcggagcaggcccaggggaaccacggcgagaagagggaagggcaggtctgagcccttcctccccgcctggtagtcattcaatgaggtacttctataccgccatgtctcgtcccggaaggggcgagcctcgcttcattacagtgggatatgtagacgacacccttttcgtacggttcgactctgacgccacaagccccagaaaggagccaagggcaccatggattgagcaggaggggccagagtactgggacagggagacgcagatctcaaagacgaacacccagacataccgtgagaatcttagaacagctctgagatactataatcagtccgaagctggtagtcacataatacagaggatgtacgggtgcgacgtaggtccggacgggcgactcctgaggggctatgaccaggacgcttatgacggcaaagactatatcgcactgaacgaagatctctcttcgtggactgctgctgacaccgccgcacaaataactcaacgaaagtgggaggcagcgagggtggcagaacagctccgagcctatctcgaagggctgtgcgtggaatctctaagacgctacctggagaacggcaaggaaaccctgcagcgggctgatccacctaagacccacgttactcaccatcccatcagcgatcacgaggtcacccttcgatgctgggccttgggcttctatccggcttag

SEQ ID NO: 51270 - DNA, 741 bp, Artificial Sequence
  Description of Artificial Sequence: Synthetic coding sequence
atggcctcagcaggacgtagcgaggggacagctgggggtggagccggaccagaggagcccaggagggaagagggcagggccggtctatctccaagttccccgccagggtcccatagcatgcggtacttctacacaagcgtatctcgcccaggccgtggggagcctcggtttatttctgtggggtacgttgatgatacccaatttgtgcggttcgactctgatgcagcctcgccccgtgaggaaccacgggctccctggatagagcaggaaggacccgaatactgggaccgtaatactcagatttataaggctcaggctcagacagaccgtgagtcactaagaaatctgagaggctattataatcagtctgaggctggcagccacactctccagtccatgtacggatgcgatgtgggccctgatgggcgattactgaggggtcacgaccaatacgcttatgatggaaaggactatattgcactcaatgaggacttgcgctcttggacggctgcggacactgctgctcagatcacacagaggaagtgggaagccgctcgagaagcagagcagagacgggcttaccttgagggggagtgcgtggaatggctccggagatatttagaaaacggtaaagacaagttggagcgcgcagatccgccaaaaacacatgtgacgcaccatccaattagcgaccacgaagcaacccttcggtgctgggcccttgggttctaccccgcatag

SEQ ID NO: 51271 - DNA, 1089 bp, Artificial Sequence
  Description of Artificial Sequence: Synthetic coding sequence
atgcgcgtaactgcacccagaacgctcctgttactactctggggcgcagttgcactgacagagacttgggccggtagccattccatgcggtacttttatacagcaatgtcacggcctggcaggggtgagccccgttttattactgtgggttatgtcgacgacacactgttcgtgaggttcgactctgacgctacctcacctcggaaggaaccacgcgcaccgtggatcgaacaggagggcccagaatattgggatcgcgagacccagatctccaaaaccaacactcagacttatcgtgaaaatctcagaactgctctgaggtactataatcagtcagaggccggaagccacattatacaaaggatgtacggatgcgacgttgggcctgacggccgtttgctgcgaggctacgaccaagacgcttatgatggtaaggattacatagccctgaatgaggacctgagctcttggaccgccgctgacaccgccgctcagatcacacaaaggaagtgggaagctgctagagtggcagaacagctccgcgcatacttagagggactctgtgttgaaagtttgcgacgataccttgaaaatgggaaggaaactctgcagagggcagatccacccaagactcatgtgacacaccatccgattagcgatcacgaagttaccttacggtgttgggccctgggcttctaccctgctgagatcaccctgacatggcagcgcgacggggaggatcagacgcaggacaccgaactggttgagacccgacccgctggagacaggaccttccagaaatgggctgctgtcgttgtgccctccggcgaggaacagagatacacctgccatgtgcagcacgaagggttgcccaaacccctgaccttacggtgggaaccctcttcacagagcaccgtgcccatcgtggggatcgtggcgggactcgccgttctagctgtggttgttattggcgcagttgtggcggctgtcatgtgccgcaggaagagctcgggaggcaagggaggctcttattctcaagccgcttgttccgatagcgctcagggtagcgacgtgagcctgacagcttag

SEQ ID NO: 51272 - DNA, 726 bp, Artificial Sequence
  Description of Artificial Sequence: Synthetic coding sequence
taaccagatggtcgtcttctgcgaggatacgatcaggatgcatatgatggtaaagattatattgcccttaacgaggatcttagctcttggactgctgccgacaccgcagcacagataactcagaggaagtgggaagccgcaagagtcgccgagcagctgcgcgcatatcttgagggcctttgcgttgagtcactccgacgctacctcgagaatggaaaggagactttacagcgggcagacccccctaaaacccacgtaactcaccaccctatcagtgaccatgaggtaacactgagatgttgggcgcttgggttctaccctgcggaaatcaccctgacttggcagcgggatggagaggaccagacgcaggacaccgaactggtcgagacacgaccggctggggaccgaaccttccagaaatgggccgcagttgtggtcccaagtggcgaagagcagcggtatacttgtcatgtacaacacgaaggcttgccaaagccgctgactcttagatgggagcctagttctcagtctaccgtaccgatagttggaatcgtcgccggattggccgttttagccgtggttgtgatcggagcagttgtcgctgcagttatgtgccggagaaagtcctcgggacattttcttcccactgggggtaagggaggcagctattcacaagctgcttgtagcgattctgcccagggatccgacgtgtccctgaccgcctag

SEQ ID NO: 51273 - DNA, 726 bp, Artificial Sequence
  Description of Artificial Sequence: Synthetic coding sequence
tgaccagatggtagactcctgcgtggatacgaccaggatgcttacgatggaaaggactacatcgccctgaacgaggacttatcatcctggaccgcagccgatactgccgcacagatcacgcagcgcaagtgggaggctgctcgcgtagcggagcaggatcgtgcctatctggaaggactgtgtgtagagtccttgcggcgatatctggaaaacggcaaggagaccctgcagcgagcggatcccccaaaaactcacgtgacccaccatcctatttcagatcatgaggtcacactgagatgctgggccttaggcttttatccagcagagatcacactgacgtggcagcgcgacggggaggaccagactcaggatacggagcttgtggaaaccagacccgctggcgacagaacatttcaaaagtgggccgctgttgtagtgccttccggcgaagagcagaggtacacatgtcacgttcagcatgaaggactgcctaagcctcttactctcaggtgggagccctcttctcagagcactgtccctatcgtagggattgtggctggcctggccgtgcttgctgtggtcgtcattggcgctgtggtggccgctgttatgtgcaggcgcaagagttccgggcattttctccccacaggaggaaagggcggatcttacagtcaggcagcttgttcagactccgcccaaggatctgatgtctcactgaccgcatag

SEQ ID NO: 51274 - DNA, 741 bp, Artificial Sequence
  Description of Artificial Sequence: Synthetic coding sequence
atggcttctgttggaaggtccgagggaacagcaggcggaggggcaggtccaggcgagcctagacgcgaggagggaagagcaggactcagtccttcatctccacccggatcccactcaatgcgctacttttatactgctatgtctcgccctggccgtggagagcctagatttatcgccgtggggtacgttgatgacacacagttcgtccgcttcgacagtgacgctgctagccctcgaatggctccccgagccccttggattgaacaggagggcccagagtattgggaccgggagacacagatctctaaaacaaacactcagacatacagagaatccttaaggaatctgcggggatattacaatcagagcgaggctgggtcccacactctacagcggatgtacggatgcgacgtggggccagacggacgccttttacgagggcacgaccagagcgcttacgacgggaaagactatattgccctgaacgaagacctgtcctcctggacagctgccgatacagctgcacagatcacccagaggaagtgggaggccgcacgagaggccgaacagtggagggcctacctggaaggtctctgcgttgaatggttgcgtcggtacctggaaaacggcaaggagacgctccagcgggctgacccgcctaagacacatgtgacccatcacccaatctccgatcacgaggccacactcagatgctgggcacttggtttttacccagcctag

SEQ ID NO: 51275 - DNA, 741 bp, Artificial Sequence
  Description of Artificial Sequence: Synthetic coding sequence
atggcgtccgccggtagatcagaaggcacagcaggcggaggagctggccctgaggaacccaggagagaagagggcagagcaggcctctcgccctcatcaccccctggcagccatagcatgaggtactttgatacagccatgagccgccctggccgtggggagccgcgattcatctctgtaggctatgtggacgacacgcagttcgtccgctttgactctgacgccgctagtccacgtgaggaacccagggccccttggatcgagcaggaaggcccagaatactgggatcgcaatactcagatcttcaagaccaatacacagaccgaccgagaatccctgcgtaacctgagggggtactacaatcagagtgaggcaggaagtcatacactgcagagcatgtatgggtgcgacgtgggtcccgacgggagactcctccggggtcataatcagtacgcttacgatggcaaagattatattgccctaaatgaagatctcagaagctggaccgctgccgataccgctgcacagatcacccaaaggaagtgggaagcagccagggtggcggaacaggatcgcgcatacttggagggcacctgcgtggaatggctgcgacggtacttagaaaacggcaaggacaccctcgagagagcggatccaccaaagactcatgtcacccaccatcccatcagtgatcacgaggcgacccttcgatgttgggcgctaggcttttaccccgcatag

SEQ ID NO: 51276 - DNA, 741 bp, Artificial Sequence
  Description of Artificial Sequence: Synthetic coding sequence
atggcctcagtaggacgaagagaaggcacggccggtgggggagccggaccaggggaacctaggcgggaagagggcagagccggtttgtctccatcgtctcccccaggttcgcatagcatgagatacttttataccgctatgtcccgccctggaaggggggaacccaggtttataacagtgggctatgtcgatgatactctctttgtaagatttgacagcgacgcaacgagcccgagaaaagagcctagggctccctggatagagcaggagggacccgagtattgggacagggagacccagatctcaaaaacgaacactcagacctatcgagaaaacctcagaacagccttgcgctattacaaccagagcgaggcgggtagccacataatacagcgaatgtacggatgtgacgtgggacctgatggtagactgttacgcggatatgaccaagacgcgtatgatggcaaggattatatcgctcttaatgaggacctttcaagttggactgccgctgacaccgccgctcagatcactcagaggaagtgggaagccgcacgggtcgcagagcaggaccgggcttacctcgagggactatgcgtggagtctctacggaggtacctcgaaaatggtaaggagactcttcagcgcgcagatccacccaagactcacgtgacacatcacccaatttcagaccacgaagtgaccctcaggtgttgggccctaggtttttatcctgcttag

SEQ ID NO: 51277 - DNA, 1089 bp, Artificial Sequence
  Description of Artificial Sequence: Synthetic coding sequence
atgcgtgtcacagctccgagaaccgtcctattactcctttctggagcccttgccctgactgagacttgggccggatcacattctatgagatacttttatacggccatgagcaggccgggtagaggggagcctagatttattgctgtcgggtatgtggacgacacgcagttcgtccgcttcgactcagacgcagcttcacctaggatggcaccacgggcaccttggattgaacaggaggggcctgagtactgggatagggagacccaaataagcaagactaatactcagacttatcgcgaatcactgcgcaatctgcggggatattacaatcagagcgaggcagggagccatacactgcagagaatgtacggatgtgacgtcggcccagacggcagactattgagagggcacgatcagtctgcttatgatggaaaagactatattgcgctgaatgaagacctctccagttggactgctgctgatacagctgcccagatcactcagcggaaatgggaggctgctcgggaagctgagcagtggagggcctatcttgaggggctgtgtgtcgagtggcttcggaggtacctcgagaacggcaaagagaccttgcagcgggctgaccccccaaaaacccatgtgacgcaccaccctatatccgatcacgaagccacgttacggtgctgggctctagggttctatcctgcggaaatcacccttacgtggcaacgagatggagaggatcagacacaggatactgagctggtcgagacacggccagctggcgatcgcacctttcagaagtgggcagcagtggtggtaccctccggcgaagagcagaggtatacttgccatgtacagcatgagggcctgcccaaaccactgacactacgctgggagccaagctcacaatcaaccataccaatagttgggattgttgccggtttggccgtgctggcggtggtggttataggagccgtggttgccaccgttatgtgtcgcaggaaatctagcggcggaaaagggggttcatattcccaggccgcatcaagtgactccgcccagggctcagatgtcagcctaaccgcctag

SEQ ID NO: 51278 - DNA, 609 bp, Artificial Sequence
  Description of Artificial Sequence: Synthetic coding sequence
atgtatggttgcgacgtgggacctgatgggaggcttctcagaggccacgaccagtatgcgtacgatgggaaggattacattgcccttaatgaagacctgagatcctggaccgcagccgacaccgccgcacaaatcacgcagcgaaaatgggaggctgctagagaagcggagcaacgaagggcctatctggagggcgagtgcgtggagtggctgcgtcgttatcttgagaacggcaaggataagctggaaagggcagacccaccaaagacccatgtgacacatcatcctatcagcgatcacgaagcgaccctgcgatgctgggctcttggcttctaccctgctgaaatcactctgacctggcaaagggacggtgaggatcagacacaggacactgaactggtcgaaacaaggcctgcaggcgacagaacattccaaaagtgggcggcagtggtggtgcccagcggggaagagcagaggtatacgtgccacgtccagcatgagggccttcccaagccccttacccttcggtggggagggaagggcggaagttatagtcaggccgcatgttcagactccgcacagggctcagacgtgtccctcactgcgtag

SEQ ID NO: 51279 - DNA, 675 bp, Artificial Sequence
  Description of Artificial Sequence: Synthetic coding sequence
atgctggtcatggcaccacggaccgttctcttactgctgtctgccgctctcgccttgaccgaaacgtgggccggatcacattctatgaggtacttcgatacagccatgagcagacctggtcgcggtgagcctcgtttcatttctgtcggttacgttgacgatacacagtttgttcgatttgatagcgacgctgccagccccagagaggaaccgagggccccatggatcgaacaggaggggccagaatattgggatagaaatacacagatattcaaaacaaacactcaaactgatagggagtctctccggaatctgcgtgggtactacaaccaatctgaagcaggttcccataccctccagtccatgtacgggtgtgacgttggccctgatggcagactgcttcgcggacataatcagtatgcctatgacggcaaggattatatcgcgctgaacgaagacctgcggtcctggacagccgcagacaccgctgcccaaattacccaacgtaagtgggaagccgcaagggtggctgaacaagacagggcgtacctggaggggacatgcgtggaatggctcaggcggtacctagagaatggcaaggacacactggaaagagcggaccaggagcagaaaagtctcttccctgctcagcgactggaactctcaaatgagtag

SEQ ID NO: 51280 - DNA, 675 bp, Artificial Sequence
  Description of Artificial Sequence: Synthetic coding sequence
atgcgcgtcacggccccaaggactgtgctactgcttctctcaggggctttagctcttaccgaaacatgggccggaagtcattccatgaggtatttttacacggcgatgtccagaccagggcgaggagagcctcgcttcattgctgttggctacgttgatgatacgcagttcgtgagatttgatagcgacgccgcttccccgagaatggcacccagggccccatggatcgagcaggaagggccagagtattgggaccgggaaactcagatttcaaagaccaacacgcagacataccgggaaagtttaagaaacctgcggggatattataatcaatctgaggctgggagccacaccctgcagaggatgtacggatgcgacgtcggtccagacgggcgactccttcgaggacacgaccaaagtgcatacgacgggaaggactacatcgctctgaacgaagacttaagctcatggacagctgccgatactgcagcccagatcactcagcgcaaatgggaggcagcacgggaagcggaacaatggagggcatacttggaaggtctttgcgtggagtggctccggagatacctcgagaatgggaaggaaactctgcagcgggctgaccaagaacaaaagtcccttttccccgctcagagactggagttgtcgaatgaatag

SEQ ID NO: 51281 - DNA, 675 bp, Artificial Sequence
  Description of Artificial Sequence: Synthetic coding sequence
atgcgggttacagcccctcgtactctactgctgctgctgtggggggctgtggcccttaccgagacatgggcaggttcccactcgatgagatacttccacacaagtgtgtcacgacctggcagaggggagccaaggttcatctccgttggctatgtcgacggcacgcagttcgttagattcgactccgacgcagcttccccgaggaccgagccgcgtgccccatggatcgagcaagagggtccggaatactgggaccggaacacccagatcagcaagactaatacccagacatatagggaatcactgaggaacctccgcggttactacaatcagagtgaagcgggaagccacactctgcaacgcatgtacgggtgcgacgtggggccagacggaaggctcctgagaggccatgatcaaagcgcatatgacgggaaggattacatagctttgaacgaagacttgtcaagttggacagcagcagatactgcggcacaaatcactcagcgaaaatgggaagccgcaagggtggctgagcaactgagagcgtacctcgagggaacatgcgtggagtggctccgacgtcatcttgagaatggaaaggaaacattgcagcgggcagatcaggagcagaagtctctgttccctgcccagagactcgaattgagcaatgaatag

SEQ ID NO: 51282 - DNA, 675 bp, Artificial Sequence
  Description of Artificial Sequence: Synthetic coding sequence
atgcgagtaacggccccacgcactctgttactgcttctgtggggagctgtggcacttacggaaacctgggcgggatctcactccatgcggtacttctacacagcaatgtcccggccaggaaggggcgaacctagattcatcacagtgggatatgtggatgacaccctctttgtacgattcgattcagatgctacaagcccacggaaagaaccccgagccccatggattgaacaggagggccctgaatattgggacagagagacccagatcagtaagaccaatactcagacctatagagaaaatcttcggaccgcgcttcgctattacaatcagtcggaagctgggtcccacatcatccagcgtatgtacggatgcgatgtgggacccgacggaagactgctccggggatatgaccaggacgcctacgacggaaaggactacattgcattgaatgaagatctgtctagctggaccgccgcagataccgctgcacaaataacccagaggaagtgggaagctgccagggtggccgagcagctacgcgcttacctggaggggctgtgcgtggaaagcctgcgtaggtacctggaaaatgggaaggagactcttcagagagctgatcaggaacagaagtccctgttcccagcacagcgccttgaactgtccaacgagtag

SEQ ID NO: 51283 - DNA, 675 bp, Artificial Sequence
  Description of Artificial Sequence: Synthetic coding sequence
atgagagttacagccccacgcacattactacttttactttggggggctgtggctcttacagaaacctgggctggctctcattctatgcggtacttttatactgctatgtctagaccaggccgtggcgaaccccgttttatcaccgtggggtatgtggatgatacactctttgtgcggtttgacagcgatgccacttcgcctagaaaagaaccacgggcaccttggatcgaacaggaggggccagagtactgggatcgcgagactcagatctcgaaaactaacacccagacatacagggagaatttgcggacagcccttcgctactacaatcaatccgaggccggtagtcacattatacagaggatgtatggttgtgacgtgggcccagatggcagactgttgagaggctacgaccaggacgcttatgatgggaaggactatattgccctgaacgaagatctgtcttcttggactgcggctgatacggcggctcagatcacgcagagaaaatgggaggccgctcgcgtagccgagcaggatagggcgtatctcgaaggattgtgcgtggagtctctcaggcggtatttagaaaatggcaaagagactcttcagcgtgcggaccaagaacaaaaatccctgtttccggcacaaagattagagttgagtaatgagtag

SEQ ID NO: 51284 - DNA, 1302 bp, Artificial Sequence
  Description of Artificial Sequence: Synthetic coding sequence
atgagggtcaccgccccacggaccctcctactgctgctgtggggcgctgtggcccttacggagacctgggcagggtcccactctatgcggtacttttataccgcaatgagccgacccggaagaggagagccacggttcatcactgttggctacgtagacgacactttgtttgttcggttcgatagcgacgccacttctccacgtaaggaacctcgcgcaccatggattgaacaagaaggacctgaatactgggaccgagaaactcagatcagcaagaccaatacccaaacgtaccgagagaacctgcgtactgccctgcggtactataatcccggtaggcgttcacgtttgcctatcccgcatgttcgccctggaagtccgagggtgtccggctctgagattcggccaaggggacgcggaaccaggccagacccacgtcctgctagagcacccggagccttcaccagattccacttccagctgaggcctaagagtccgagggtcggccgagggggagctggacttgggaccggattaaccgctggacccggacctggtagtcatatcattcagcggatgtacgggtgtgatgtagggccagatggcagactgctgcggggatatgaccaagatgcctacgacggaaaggactatatcgctctgaacgaagatctgagtagctggaccgctgccgacactgccgctcagattactcaaagaaagtgggaagccgcacgcgttgccgaacagctccgcgcatatctcgaaggtctctgcgtggagtctcttagaaggtatctggagaatgggaaggagactctccagcgggcagatccacccaagacacacgtgactcatcatcccatttccgatcatgaggtgacactccggtgttgggcattaggcttctatcccgcagaaattacactgacatggcagcgggatggagaagaccagactcaggacaccgaattagtggagacacggccagccggagatcggaccttccagaaatgggctgccgtggtggtgccaagcggggaagagcaaaggtatacatgccacgtgcagcacgaggggttaccgaagccacttaccctaagatgggaaccatctagtcaatcgacagttccaatagtaggaattgttgcaggcctggcagttttggccgtcgtggtcatcggagcagtggttgccgctgtgatgtgtagacgtaagtcatccggaggtaagggcggaagctactctcaggcagcctgtagtgatagtgcccagggctcagacgtgagcctgactgcctag

SEQ ID NO: 51285 - DNA, 726 bp, Artificial Sequence
  Description of Artificial Sequence: Synthetic coding sequence
atgtacggctgtgacgtcgggccagatgggcgactgttgcgtggccataaccagtacgcctacgacggaaaggactatatcgctctaaatgaagacttacggtcgtggactgccgcagataccgcagcccagatcactcagaggaagtgggaagccgcacgtgtagctgaacaggaccgagcctatctggaaggaacttgcgtggagtggctgaggcggtatttagaaaacgggaaggacacactggaaagagcggatcctccaaagacacacgtaactcaccatcctatctcagatcatgaggccactctgcggtgctgggcgctgggtttttaccctgcggagatcacattaacctggcagcgggacggcgaggaccagacccaggacaccgagctagtcgaaacccggcctgctggcgaccgaacttttcaaaaatgggccgcagttgtagtgccctctggcgaggaacaacggtacacttgccatgtgcagcacgagggcctgcccaagcccctgactctccgctgggaaccgtcatctcagtccaccgtgcccatagtcggaattgtggctgggctggcagtcttagcagtggtggtgataggtgctgttgtagctgccgtcatgtgtcggaggaaaagttcgggcggtaagggcggatcttattcacaagctgcctgtagtgatagtgcacaggggtccgatgtctctctaacggcgtag

SEQ ID NO: 51286 - DNA, 1302 bp, Artificial Sequence
  Description of Artificial Sequence: Synthetic coding sequence
atgagggtcactgccccacgtactctccttctgctgttgtggggagccgtcgcgctcacagagacatgggctggcagtcactcaatgcgatacttttatacagcgatgtcaagacctgggaggggtgaacccaggtttatcaccgtcggctatgtggatgacactctctttgtgcgtttcgattctgacgctacaagcccaagaaaagagcctcgagcaccttggatcgaacaggaaggcccagagtactgggatagagagacacagatttcaaagactaatactcaaacttaccgtgaaaatttgcgaaccgctctgaggtattataacccaggcaggcgatctcggttacctatcccacatgtgcgacctgggtcccctagggtatctgggtctgagatccgtcctcggggacgcggtactagaccggatccgaggcccgctagggcacctggcgcttttacgcgctttcatttccagctacgccctaagtcccccagggtgggccgtggcggtgccggactcggaactggtttgaccgctggacctggccctggatcacatatcattcagcgtatgtacggctgcgacgttggacctgatggaagactcctccggggatatgaccaggacgcctacgacggaaaggattacatcgcattgaatgaggacttgagtagctggacagccgctgacaccgcggcacaaatcacccaacggaagtgggaagcggctagagtagccgaacaggaccgcgcttacctcgaaggactctgtgtcgagagtttgaggcgctatctggagaacggaaaagagaccctacaacgggctgacccccctaaaacacacgtgactcatcacccaattagtgatcacgaggtgacactcaggtgctgggcacttggtttttaccctgccgaaataacactcacatggcagcgtgacggcgaagaccagactcaggatacggaattggtcgagacccggcctgcaggcgatagaacttttcagaaatgggcagctgtggtcgtcccttcaggagaggaacagcggtatacctgtcacgtgcagcatgagggcttacccaaaccactgactctgaggtgggaaccaagctcccagagcacggtgcctatcgtgggcattgttgcaggcctggccgtcttggccgtcgtcgtcataggagcagtggttgcggcagtcatgtgcagaagaaagtcatccggaggcaagggtgggagctacagtcaagcggcatgtagtgattcagcccagggaagtgacgtatctcttaccgcttag

SEQ ID NO: 51287 - DNA, 1077 bp, Artificial Sequence
  Description of Artificial Sequence: Synthetic coding sequence
atggtcgacgggacactgctcctactcctgtcagaggcccttgccctgacacagacatgggccggatcccactcgctgaagtatttccacacatctgtatcaaggcccggacgcggagagcccagattcatttctgtgggatacgttgatgacacacaattcgtgcgttttgataatgacgctgcctcccccaggatggtccctcgggctccgtggatggagcaggagggatcagagtactgggatcgggagacaaggtcagcgagggatactgctcaaatattccgtgtgaacctcagaacccttaggggttactacaaccagagcgaggcaggctcacatacgctccagtggatgcacggatgtgaacttggacccgatggtcgcttcctcaggggttacgaacagtttgcttatgatggtaaggactacctgaccctgaatgaggacctgagatcatggacggccgtggacaccgctgcccagatttccgaacaaaagtccaacgacgcgagcgaggccgaacatcagcgcgcttacctggaagacacctgtgtggagtggctacataagtatctggagaagggcaaagagaccctgttgcacctagaacctcctaaaacccacgtgacacaccaccccatcagtgatcatgaggccaccctgcgatgttgggccttgggattttaccccgctgagatcacactgacctggcagcaagacggcgaaggtcacactcaggacaccgagctggtagaaacgagacctgcaggggatggtacattccagaaatgggcagccgtggttgtcccttccggggaagaacagcgttatacctgtcacgtacagcatgagggcctgccagagcctgtcactctaaggtggaagccagcatcacagcccacaataccaatcgttgggataatcgctgggctcgtcctactgggtagtgtggtttccggtgccgtggtggcagccgttatttggagaaagaaatccagcgggggaaagggtgggtcctattctaaggcagagtggagcgattctgctcaaggctcagaaagccattcgctgtag

SEQ ID NO: 51288 - DNA, 1077 bp, Artificial Sequence
  Description of Artificial Sequence: Synthetic coding sequence
atggtggatggtacattgctgcttctgctgtccgaagcattggcactgactcaaacttgggctggatcccattccctgaagtacttccatacaagcgtctctcggcctggcagaggagaacctcgtttcatctctgtgggatatgtggatgatacccagttcgtccggtttgataacgatgcagccagccccagaatggtcccacgcgctccatggatggagcaggaaggttctgaatattgggatagggagacccggagcgcaagggataccgctcagatattccgggttaacctgcgtaccctccgcggatattacaaccagtcagaggcgggttctcataccctgcagtggatgcacggttgtgaattaggtccagatagaagattcctccggggatatgaacagtttgcctatgacgggaaggattacttgacactgaacgaggatctgcgaagttggacggccgtggatacagctgcacagatctctgagcagaaatccaacgacgctagtgaggctgaacaccaaagagcctacctagaagacacatgtgtcgagtggctacacaagtacctggaaaagggtaaggaaactctgctccacctcgagcctcctaagacgcatgtgacacaccaccctatctcagaccacgaggccactctccgctgctgggctctcggtttttacccggcagagatcaccctcacctggcagcaagacggcgaaggccatacccaggatacagagctagtggaaacacggccagccggtgacggcactttccaaaagtgggccgctgtggtcgttccctccggagaggagcagcgctatacatgtcacgtccaacacgaaggcttaccagaacccgtgactctcagatggaaacctgccagccagcctaccattcccattgtgggtatcattgctggactggtgctgctgggctcagtcgtctcaggggctgtggtagctgctgtcatatggcgtaagaagtcctcaggcggtaaaggcggaagctacagcaaggcagaatggagcgacagtgcccagggcagcgaatcccattcactgtag

SEQ ID NO: 51289 - DNA, 1077 bp, Artificial Sequence
  Description of Artificial Sequence: Synthetic coding sequence
atggtagacgggacactccttctgctcctgtctgaggccctggctctgactcagacatgggccggatcccattctttgaagtactttcacactagtgtctcccgaccgggacgaggagagccacggttcatttccgtaggttatgtcgatgatactcagttcgtacgtttcgataacgatgctgccagtcctaggatggtacctcgcgcaccctggatggaacaggaaggctcggagtactgggaccgcgagaccagaagcgccagagatactgcgcagatcttcagagtgaacctccgcacgctacgaggctattacaaccagtccgaagcgggatcccatacactgcagtggatgcacggatgtgagttgggacctgaccgacgattcctgcgcggatatgagcagtttgcatacgacggcaaagactatctgactctgaacgaggaccttcgttcctggaccgcagtcgacacagcggctcaaatctcggaacagaagtcgaacgatgcttctgaggccgaacatcagagagcatacctagaggacacttgcgtggagtggctgcataaatatctcgaaaagggaaaggagacgctcctgcacctagagcctcccaaaacccacgtgacccatcatccaatctctgaccacgaagcaaccctgcgctgctgggctctgggcttttatccagccgagatcacattaacatggcagcaggacggtgagggccatacccaggacacagagttggtagaaactcgccctgcaggtgatggaaccttccaaaagtgggcagcggtggtcgtgccaagtggcgaggagcagcgatacacgtgccatgtgcaacacgaagggttgcctgagcctgtcactctgagatggaagccagcctcccagcccaccattccaatagtgggaattatagcgggactggttcttctgggatctgtggtatctggagctgtcgtagcagcagtcatctggagaaagaaatcatcaggcggaaaaggcggatcctactctaaggccgagtggtcagacagtgcccaaggaagcgagagccattccttgtag

SEQ ID NO: 51290 - DNA, 1077 bp, Artificial Sequence
  Description of Artificial Sequence: Synthetic coding sequence
atggtggatggcacattactgctacttctgtccgaggccctggccttgacccaaacatgggctggcagtcactctttgaaatatttccacactagcgtgagcagacccggaaggggcgaacctcgcttcattagcgtgggctacgttgacgacacccagttcgtgaggtttgacaatgatgctgccagccccaggatggtgccaagggccccatggatggaacaagagggaagcgaatactgggatagagagacaaggtctgcacgcgataccgctcaaatttttcgggtaaatttgagaaccctccgaggatattacaatcagtccgaggccggaagccatactttgcagtggatgcatggctgtgaactgggcccagaccgcaggttccttcggggttatgaacagttcgcttacgatggaaaagattatcttactctgaacgaggacctacgctcctggaccgccgtagatacagccgcacagattagtgagcaaaagtccaacgacgcttctgaagccgagcaccagagggcatatctggaggacacctgtgtcgagtggctgcacaaatatctagaaaagggaaaggagactctgctacacctcgaaccccctaaaacccatgtcactcatcatccaattagcgaccacgaagctactctccgctgttgggccctaggcttttaccctgccgagatcaccttgacctggcagcaggatggcgagggccacacccaggatacggagctggtcgaaacccgccctgccggtgatggtacattccaaaaatgggccgctgtagtagtgccctctggcgaagagcagcgctatacctgtcacgtgcagcatgagggcttgcccgaaccggtgaccttgcgatggaagcctgcttcacagcctactattcccatcgttggaataattgcaggactggttctgctcggcagtgttgtgtctggcgctgtggttgcagctgtgatctggcgcaaaaagtcttccggcggtaagggcggaagttactccaaggcagaatggtctgactcggcccaagggagcgagagccacagcctgtag

SEQ ID NO: 51291 - DNA, 1077 bp, Artificial Sequence
  Description of Artificial Sequence: Synthetic coding sequence
atggtagacggtacactgctgctcctactgtccgaggccttggcattgacccagacgtgggccggaagccattccctgaaatatttccatacttcagtgagcagaccaggcaggggagaacctagatttattagtgtgggatatgtggatgatacccagttcgtacggttcgataatgacgccgcttcccccaggatggttcccagagccccatggatggaacaggagggttccgaatattgggaccgggagacacgaagcgcacgggatacagcccagatctttagagtgaatctgagaacactgagagggtactacaaccaaagcgaggcaggttcccataccttgcaatggatgcacggatgcgagctcggacccgacgggaggttcctgcggggatacgagcaattcgcctacgacgggaaagattacctgaccctgaatgaggacctgcgatcttggaccgcggtggacactgcagcacagatcagcgaacagaagtccaatgacgcgtctgaggctgaacatcaacgggcatatctggaagacacttgtgtcgagtggctacacaaatacctggaaaaggggaaggagacacttttgcacctcgagccaccgaagacccacgttacccaccatcccatttcagaccacgaagccacgttgaggtgttgggcattgggcttttatcccgctgaaataaccttgacttggcagcaagatggcgagggacatacacaggacacagagctcgtggagactcgtccagccggagacggtaccttccagaaatgggctgcggttgtcgttccgtcaggcgaagaacagcgttacacttgtcacgttcagcatgaggggctgcctgaaccagttactttgagatggaaaccggcttcccaacccaccataccgattgtggggatcatcgccggtctcgtcctgctgggctctgtggtgtcaggcgctgtcgttgccgctgttatctggagaaagaagagctctgggggtaagggtggatcctacagtaaagccgagtggtccgactccgctcagggcagcgagtcccactctctctag

SEQ ID NO: 51292 - DNA, 1077 bp, Artificial Sequence
  Description of Artificial Sequence: Synthetic coding sequence
atggttgatggcacactcttgctgttgctgagcgaagctttggcattaactcagacatgggccggtagccacagccttaaatactttcatacctccgtttcccgaccagggagaggcgaacctaggtttatttcagtgggctacgtggacgatacccaattcgttaggttcgataatgacgcagcgagccctagaatggtcccgagggccccatggatggaacaggagggaagtgagtactgggatcgagagacgaggagcgccagagatacagcccagatcttcagggtcaacttgaggactttgcggggttattacaaccagagtgaggccggttcgcacaccctgcagtggatgcacgggtgtgagctcggacccgaccgtaggttcctgcgcggttatgaacagttcgcctatgacgggaaggactatctgacccttaacgaagaccttcgttcttggacagcagtcgacactgcagcccagatttctgaacaaaaatcaaacgacgcttctgaggccgaacaccagcgcgcttatctggaagatacttgcgtggagtggctgcacaagtatctggaaaaagggaaagaaaccctcttacacttggagccgccaaagacacacgtgactcatcacccaatctcagatcacgaagctactctaaggtgctgggctctcggattttacccagcagagattactttgacctggcagcaggacggagaagggcatacgcaggataccgagctggttgaaacgagaccagccggtgacggcacattccaaaagtgggccgctgtcgtggttccatccggggaggagcagcgctatacctgccatgtccagcatgagggcctccccgaaccggtgactttgaggtggaagccggcaagccagcccaccattccaatcgtgggcatcatcgcaggcctggtcttgctgggatccgtggtgagtggcgctgtggtggctgcagtgatctggaggaaaaagagctcggggggaaaaggaggatcctactccaaggctgaatggtctgactcggcccagggcagtgaaagccatagtctttag

SEQ ID NO: 51293 - DNA, 1077 bp, Artificial Sequence
  Description of Artificial Sequence: Synthetic coding sequence
atggtcgacgggacccttctcctactcttgtctgaggccctcgcacttacacagacttgggccggttcacattcattaaagtacttccacacctctgtgagtaggcctggacgaggcgagccgaggtttatttcagtgggctacgtcgacgacactcagttcgtcaggtttgacaatgacgctgccagtccaaggatggtgcctagagccccttggatggagcaagaaggctcagaatactgggacagagaaacccgttcagcacgggacacggcccagatcttccgcgtcaatctgcggacactgaggggctattacaatcagagtgaggcaggcagccacaccctgcagtggatgcacggttgtgagttaggacccgacggacggttcctcagaggatatgagcagttcgcttacgatggcaaggattacctcactcttaatgaggatctacggagttggacggcagtggatacggccgcacaaatcagtgagcagaagtccaatgatgcttccgaagcagagcatcaaagggcatacctggaagacacttgtgtggaatggctacacaaatacttagagaaggggaaagaaacactcttgcatctagagccacccaaaactcacgtgacacaccacccaattagcgaccatgaagctacactcaggtgctgggcccttgggttttatcccgcagaaataaccttaacttggcagcaagacggcgaaggtcacacacaagacacagagctcgtcgagacaagaccagctggggatggcacctttcagaagtgggccgcagtagtggtcccttcaggggaagagcaaagatatacctgccatgtgcagcatgagggcttgcccgagccagtgaccttgcgttggaaaccagcttcgcagcccactattccaatcgtgggcattatcgctggtctggttcttctgggtagtgtagtgtctggggcagtggtggcggctgtaatttggaggaagaagagtagtggtggtaaagggggatcttacagtaaagctgagtggtctgattccgcccagggttctgaaagtcattccttatag

SEQ ID NO: 51294 - DNA, 1200 bp, Artificial Sequence
  Description of Artificial Sequence: Synthetic coding sequence
atggagccttctttttattcctctagaaggccgtggcccttgcccagacccggacgtgtgtctgctggctcgggttggaagcgcccactgcctggggtggaaagggggagacctggcggaggagaagggttaggggagccccgacgggaggagggtcgtgctgatctctccccctcgtcccccccaggttcgcactcattaaagtactttcatacgtccgtatcaagacctgggcgtggtgagcccaggttcattagcgtcggctacgtggatgacacgcaatttgtgcgcttcgacaacgatgctgcttcaccgaggatggtccctcgggcaccctggatggagcaagaaggatcagaatactgggatcgagagacccggtcagctagagataccgcccagatttttagggtcaatttgcggacgctgcgcggttattacaaccagtctgaagccggttcccacacgctccagtggatgcatggatgcgaattgggccctgatagacgattccttcgcggatacgagcaatttgcctacgacggtaaggactatctcacgctgaatgaggacctgcgctcctggactgctgtcgacacggcagcacagatttctgaacaaaaatctaacgacgcctccgaggcagaacatcaacgggcttacttggaggatacatgcgtggaatggctacataagtaccttgagaagggcaaggagactctgcttcacttggaacccccaaaaacgcatgtcacacatcacccaatatcggaccacgaggcaaccctccgctgctgggcgctgggtttctaccctgcagagatcacgttgacttggcagcaagatggagaaggtcatacgcaggacacggaactcgtcgaaacaagacctgccggagatggcacatttcagaaatgggccgctgtggttgtccctagcggtgaagaacagcggtacacctgtcacgtgcaacacgagggccttcccgaacccgtcactctgcggtggaagcctgccagccagcctaccatccctattgttgggattattgcgggattggtcctcctaggttccgttgttagtggtgcggtggtagctgccgtgatctggagaaagaaaagttctgggggtaaagggggaagctactcgaaagcggagtggtctgatagtgcccagggctcagagtcccatagcctttag

SEQ ID NO: 51295 - DNA, 1329 bp, Artificial Sequence
  Description of Artificial Sequence: Synthetic coding sequence
atggcgccaaggagtctgcttctgctgcttagtggtgccctggcactcacggacacctgggcaggttctcactccctgaggtacttttctaccgccgtttcccggcctggcaggggagaacctcgatacattgccgtggaatacgtcgacgatactcaattcttgcggttcgacagtgatgcggctattcccaggatggagccacgtgagccctgggtggaacaggagggaccccagtattgggaatggacaactggttatgctaaagcaaacgctcaaaccgacagagtcgcgctccggaatctgctacggaggtataaccagtctgaggccggaagccatactcttcagggcatgaacggctgcgacatgggtcccgacggcaggctcttgaggggctatcatcagcacgcttatgatggtaaagactatatctccttgaatgaggacctgaggtcctggaccgcagccgacactgtggctcagataactcagaggttctatgaggccgaagagtacgctgaagaatttcgcacctacctagaaggggagtgtctggagcttctgaggaggtatctggagaatggtaaggaaactctgcaaagagcagacccccctaaggctcacgtcgcccatcatcccatttcagaccatgaggctacactgaggtgctgggctctaggattttacccggctgagatcaccttgacctggcaacgggacggggaagagcagacccaagatacagagctggtggaaacacgcccagcgggagacgggaccttccagaagtgggccgctgttgttgtgcctcccggagaggaacaaaggtatacttgtcacgttcagcacgaagggctaccccaacctctgattctccggtgggaacagtccccccagcccacgattcctatcgtggggatcgtggctggcctagtggtgctcggagcggtggttaccggggcagttgtcgctgcggtgatgtggcggaagaaatcttcagatcggaaccggggatcctacagccaggccgcagcctatagcgtagtctctggaaacttaatgatcacatggtggtccagcctctttttgttgggcgtgctcttccaaggctacctgggctgcctgcgatcacattccgtgcttgggcgaagaaaggttggagacatgtggatcctttttttcctgtggttatggacctccttcaatactgcgttcctggccctacagtcactgaggttcgggtttggttttcggagggggagaagtttcctgctgcgctcgtggcaccatcttatgaagcgcgtgcaaatcaagatcttcgactag

SEQ ID NO: 51296 - DNA, 1041 bp, Artificial Sequence
  Description of Artificial Sequence: Synthetic coding sequence
atggcccctagaagcttgctcttacttctgtcgggggctcttgcactaaccgatacatgggccggaagccactctcttcggtacttttctacagcggtgtcaaggccaggaagaggagagccccgttatattgcggttgagtatgttgatgacacacagtttctacgctttgactctgacgctgctattcccagaatggaacccagagagccatgggttgagcaggagggtccgcaatactgggaatggacaacaggatacgccaaggctaatgcccagacagacagagtggctctgcgaaaccttctcagacgatacaaccagtctgaggcgggatctcacacgctgcagggaatgaatgggtgtgacatgggccctgatggacgtctgctcagagggtatcaccagcatgcatacgatggcaaggactacatctccctgaacgaggatctgagaagttggaccgccgctgatactgtggcccaaataacccagcgcttctatgaagccgaagagtacgctgaggagttccggacgtacctggagggggagtgcttggagctgcttcgaagataccttgagaatggaaaagagacgctgcagagggctgacccccctaaagcccacgtagcgcaccatccgatctccgaccacgaagcaactctccgctgctgggcactgggcttttatccagctgagataacactgacatggcagcgggacggcgaggagcagacacaggacaccgaactcgtggaaacgcgcccagccggagatggaacattccagaagtgggccgctgtggttgtgcctcccggtgaggaacagcggtatacatgccacgtgcagcatgagggcctgccacagcctctcattctgcgctgggaacagagtccacagcccacgatccctattgttggtatcgtggccggacttgtggtacttggcgctgtcgtgactggcgcagtggtagcagctgtcatgtggcgaaagaaaagctctgatagaaacaggggcagctatagccaagccgctgtgtag

SEQ ID NO: 51297 - DNA, 1041 bp, Artificial Sequence
  Description of Artificial Sequence: Synthetic coding sequence
atggccccacgttcactgctgctgctgctgagcggcgctctggccctcaccgatacatgggccggaagtcatagcctccgctacttctcgaccgccgtgagccgccctggcagaggcgagcctcgctacatcgccgtggagtacgtggatgatacccagtttctgagattcgattcagacgcggcaataccgagaatggaacccagggaaccttgggtggagcaagaagggccacagtactgggagtggacaaccggctacgccaaagctaacgcccagaccgacagggtcgccttacgaaatctgttgcggaggtacaaccagtctgaagctgggtctcataccctgcaggggatgaacggatgcgacatgggtccagatggcagactgctgcgcggatatcaccagcacgcttacgatgggaaagattacatctcgctaaatgaggaccttcgcagctggactgcagccgacactgtggcccagattacccagagattttatgaggctgaggaatatgccgaggagtttaggacatacctggagggcgagtgtttagagttacttcgcagatacctcgagaatgggaaggagactctgcagcgggctgaccccccaaaagcgcacgtggcccaccaccccatttctgatcatgaggccactctccggtgctgggctcttggattttacccagcagaaatcacactcacatggcaaagggacggcgaagagcagacgcaagatacagaattggtggaaacccgcccagctggggacggtacctttcagaaatgggccgcagtggtggtgccctccggagaagaacagcgctatacttgccacgtgcagcacgaaggtctcccccagcctctcatactacgatgggagcaaagtcctcagcccacaatcccgattgtggggattgtggctgggctggtcgtccttggggcagtggtaacaggagccgtggttgccgctgtgatgtggcgaaagaaatcaagtgacaggaatagagggagttattctcaggcggctgtttag

SEQ ID NO: 51298 - DNA, 765 bp, Artificial Sequence
  Description of Artificial Sequence: Synthetic coding sequence
atggcaccacgtagtctactgttattgctgtctggagccctcgctctgactgatacctgggctgggagccactctttacgatacttttccacggcagtttctaggcctggccgaggtgagcctcggtacattgctgtagagtatgttgatgatactcaattcctgcggttcgacagtgacgctgctatacccagaatggagccacgtgaaccatgggttgagcaggagggtccccagtattgggaatggacgacaggatacgccaaagccaatgcccagacagacagggttgctctgcgaaacttattgcgacggtataatcagagcgaagctggcagccatactctgcaaggaatgaatggttgtgatatgggtccagacggacgactgttgagaggttaccaccagcacgcttatgacgggaaggactatatctcccttaacgaggacttgcgttcttggaccgccgcagacacagtggctcaaattacacagcgcttttacgaagcggaggaatacgctgaggagttcagaacctacctggagggggagtgcctcgagttattacgtcgatacctggagaatggtaaagagacactgcagagggccgaacagagtccacaaccaacaattccaattgtgggcattgtcgcaggcctggtggtgcttggtgctgtggtgacgggtgccgtggttgctgccgttatgtggaggaagaagtcatccgaccgaaacagaggcagttactcacaggcggctgtatag

SEQ ID NO: 51299 - DNA, 1005 bp, Artificial Sequence
  Description of Artificial Sequence: Synthetic coding sequence
atggcccctcggtccctcctgctgctcttatccggagcgctggctctgacggacacatgggctggctcccacagcctaaggtactttagcacagccgtatcacgcccaggcagaggcgaaccccgatacatcgccgtggagtacgttgacgacacgcagttcctaagattcgattctgacgccgcaattcctcgtatggaaccacgagagccctgggtggaacaggaaggaccccagtattgggagtggactacgggctacgccaaggcaaatgcccagaccgaccgtgtggctcttagaaatcttctccgtcgctataaccagtctgaagctgggtctcatacgctacagggaatgaatggatgcgatatgggcccagacgggcgtttgctccgaggctaccaccagcatgcctacgatgggaaggactatatctctctcaatgaggacctcagaagctggacagcagctgacacagtggcccagataacccaaaggttttacgaagccgaggaatacgcagaagaattccggacatatttggagggagaatgcctcgagctcctgcggaggtacctggagaacgggaaagaaaccctgcagagagccgaccctccaaaagcccacgttgcacaccatccaatttccgaccatgaggcaaccctccgctgttgggccctcgggttctatcccgcagaaatcaccctcacttggcaaagggatggagaagaacagacacaagacacggagctcgtagaaacaaggccagctggagatgggactttccagaaatgggccgctgttgtggtgccatctggggaagagcagcggtatacctgtcatgtccagcacgaggggctgccccagcccttgatactgagatgggagcaatcccctcagcctaccatccccatcgtggggattgtggccggtttagttgtgttgggcgcagtggtcaccggcgctgttgtcgcagccgtgatgtggagaaaaaagtcctcgtag

SEQ ID NO: 51300 - DNA, 765 bp, Artificial Sequence
  Description of Artificial Sequence: Synthetic coding sequence
atggctccgaggtccttacttctcctcttgtcgggggctcttgctctcactgatacctgggcagggagccattctcttcgatatttttctactgccgtgtcccggcctggcagaggcgaacccagatatatcgccgtcgaatatgtcgacgacacacaattccttcggttcgactctgatgccgcaatcccaagaatggaaccacgcgaaccttgggtggagcaagaaggacctcagtactgggaatggactactggttacgcgaaggcaaatgcccagaccgatcgggtggctcttagaaacctactccgcaggtacaaccagtcagaggctggcagccatacgctgcaaggaatgaatggatgcgatatggggccagacggccgactgctgcgcggttatcatcagcacgcctatgacgggaaagattacatctcactgaacgaggacctgcgcagctggacagccgctgacaccgtcgcacaaattacacaaagattctacgaggccgaagaatatgccgaggaattcagaacttatctcgagggggaatgcctcgaactcctgaggaggtatctcgagaacggtaaggagaccctgcagcgggctgaacagtctccccagcctaccatacctatcgtgggcattgtagctggactagtggttctcggcgcagtggtgacaggagctgtcgtcgccgcagtcatgtggaggaagaagtcctcagaccgcaacagaggatcctatagtcaggccgcagtgtag

SEQ ID NO: 51301 - DNA, 1041 bp, Artificial Sequence
  Description of Artificial Sequence: Synthetic coding sequence
atggcccctcgcagtctgcttctgctactcagtggcgcattggcactcacagatacctgggccggaagtcatagtctgagatatttttcgaccgccgtctcccggcctggtcgaggggagcccagatacatcgctgtcgagtacgtagatgatactcagttcctgcggttcgactccgatgctgccatcccaaggatggagcccagagaaccttgggtggagcaggaagggccacagtactgggaatggaccacaggttacgcgaaggcaaatgctcagacagacagggtggcacttagaaacctgttgaggcggtacaatcagtctgaggctggcagccacacattgcagggcatgaatgggtgcgatatggggcctgatggccgtcttcttcggggatatcaccagcacgcatacgacgggaaagactacattagcctgaatgaggacttaaggtcgtggactgccgctgacacagtcgcacaaattacccagagattttatgaagcggaggaatacgccgaagagtttcggacatacctggagggcgagtgtcttgaactgctacgcaggtatttggaaaatggaaaagagacacttcagcgagcagaccctcctaaggcccacgtggctcatcatccaatttcggaccacgaagccaccctaagatgttgggcgctagggttttaccccgcagagataacactcacctggcaaagagatggtgaggagcaaacccaggacaccgagctcgtggaaactcggccagccggagacggaacattccagaagtgggcagcagtagtcgtgcctccaggggaggaacagcgttatacatgtcacgtgcaacacgaagggttaccacagccactcatcctcagatgggagcagagcccacagccgacaatccccattgtgggcatcgtggcgggactggtggtgctcggagctgtggtgacaggggctgtggtcgccgctgtgatgtggagaaaaaagtcaagcgatcggaaccgcggaagttactctcaggcagcagtctag

SEQ ID NO: 51302 - DNA, 765 bp, Artificial Sequence
  Description of Artificial Sequence: Synthetic coding sequence
atggctcctcgctctctgctgttgcttctgagtggagccctggccctcacagatacttgggctgggagccactccctccggtacttttcaaccgctgttagtcggcctggcaggggtgagcctcgatatattgccgtggaatacgtggacgacacacaattcttacggttcgactctgacgccgcaatccctaggatggagccacgggaaccttgggtcgaacaggagggaccccagtactgggagtggacaacaggctatgctaaagctaatgcacagactgacagggtcgccctgcgaaacctcctacgacgctataaccaatctgaggcgggatcccacacactacaagggatgaatggctgcgacatgggccctgacggtcggctactccggggataccaccagcacgcctacgacgggaaggattacatttcactcaacgaagacctcaggagctggaccgccgctgacactgtagcccagattacgcagaggttttacgaggcagaagaatacgccgaggagttccggacatacttggagggagaatgtctggagttgctccggagatatctggagaatgggaaggaaactttacagagagcggaacagagccctcagcccacaatccccatcgttggaattgtggcaggcctcgttgtgctgggtgccgtggtgactggtgcagtggtggccgcagtgatgtggagaaaaaagtcctccgatcgtaaccgaggtagttacagccaggcggcagtctag

SEQ ID NO: 51303 - DNA, 1329 bp, Artificial Sequence
  Description of Artificial Sequence: Synthetic coding sequence
atggccccaagaagtttactgcttctcttgtccggagcgctggccctgacagacacgtgggccggatcacactccctgcgctacttctcaactgcagtgagtaggcctggcaggggtgaacctcgatatatagctgtggagtacgtggacgatactcagtttctgaggtttgactctgatgccgctattcctcgtatggagcctcgcgagccctgggtggaacaagagggcccacagtattgggaatggaccaccggctacgctaaggcaaatgcacagacggatcgggtggccctgaggaatcttctgcggcgatacaatcaaagcgaggctgggtctcacactctgcagggaatgaacggctgcgacatgggtcctgacgggagactgctcagaggctaccaccagcacgcctacgatggaaaggactatatttccttaaacgaggatctccggtcctggacagccgctgacaccgtcgcccaaatcacacagcggttctatgaagcagaagagtatgccgaagaatttcggacttacttggagggtgaatgtctcgaactacttcgaaggtacttggagaatggaaaggagaccctgcagcgagccgacccaccaaaggctcatgtggcccatcacccaatttctgaccacgaagccacactgaggtgctgggcacttggcttctatcctgcagaaattacacttacatggcagcgtgatggtgaagagcagacgcaggacactgaactcgttgagacccggcctgctggagatggaacgttccagaaatgggccgcagtcgtggtcccttcaggcgaggaacagagatacacatgccatgtgcaacatgaggggcttccccaaccactgatcctgaggtgggagcagagcccacagccaacaatccctattgtcggcatcgtggctggcttagtggtgctcggtgcggtggtgactggggcagtggtggcagctgttatgtggcgaaagaaatcgtccgaccggaaccggggatcttattcccaagctgccgcatactccgtggttagcggtaatttaatgatcacatggtggtcttctttgtttctactaggcgttctgttccaagggtatttgggctgtctgaggagccatagcgttctcggcaggcgcaaagtcggagacatgtggatcctgttctttctgtggctgtggaccagctttaacacagcattcctcgctctccaatctctccgcttcgggttcgggtttagaagaggacgtagctttttactgcgttcctggcaccatctgatgaagcgcgttcagatcaaaattttcgactag

SEQ ID NO: 51304 - DNA, 1041 bp, Artificial Sequence
  Description of Artificial Sequence: Synthetic coding sequence
atggctcctcgcagtcttctgctgttactctcaggcgcactggcactgacagacacttgggccggatcacactctctgaggtacttttcgacagccgtgtcacggccagggcgaggcgagcccaggtacatagctgttgagtatgttgatgatactcagttcctgagatttgatagcgatgcagccattcctaggatggaaccgagagaaccttgggtcgagcaagagggtccgcagtactgggagtggacaaccggttacgcgaaggctaatgcccagactgatcgagtcgcactgaggaatctgctcaggaggtataatcagtcggaggctggttcgcacaccctgcaggggatgaacgggtgcgacatgggtccagatggccgattactgaggggataccaccaacacgcttacgatggtaaggactatatctcccttaatgaagacctgagatcatggacggcagctgacacagtggctcagatcacacagcgtttttacgaagccgaagagtatgctgaggagtttaggacctacttggagggagaatgcttggagttactccgacgctatctagagaacggcaaggaaacactgcaaagagccgatccccctaaggcgcatgtggcacaccaccctattagcgaccatgaagccaccctgaggtgctgggcccttgggttctacccagcagagatcacactgacctggcagcgcgatggggaggaacagacacaggatactgaacttgtcgagaccaggccggctggcgatggcacttttcagaagtgggccgcagttgtcgttcctagcggagaggagcagcgatacacatgccacgtccagcatgagggcctgccccagcctctgatactgagatgggagcagtcaccccagcctaccattcccattgtcggaatcgtggctggcttggttgtactcggtgctgttgttacaggagccgttgtggcagccgtaatgtggcgtaagaagtcatccgatcggaaccgcggaagctacagccaagcagctgtgtag

SEQ ID NO: 51305 - DNA, 1329 bp, Artificial Sequence
  Description of Artificial Sequence: Synthetic coding sequence
atggctccgaggagcctactgctgctcctgagcggagccctggcactcacagacacatgggccggaagccattccctcaggtacttctctacggcagtaagcaggcctgggagaggagagccaagatacattgccgtggagtacgtagacgatacacagtttcttagatttgattccgacgctgcaatcccacgtatggagccccgtgagccatgggttgagcaggagggtcctcagtattgggagtggacaacaggttatgctaaggcaaacgctcagactgatagagtggccctgcggaacctgctcaggaggtacaatcagagtgaagctggatcacataccttgcaggggatgaatggatgcgacatggggcctgacggcaggctcctgagagggtatcaccagcacgcttacgacgggaaggattacatttcactgaacgaagacctgaggtcctggaccgcggctgacaccgttgcgcagatcacccagcggttttatgaggcagaggagtacgccgaagagttccgtacttatctcgaaggagaatgtctggagctcctcagacgctatctcgagaacggaaaagaaaccctgcaacgcgcagaccccccaaaagcccacgttgcccaccaccccatttctgatcatgaggcgaccctgcgatgttgggcccttggcttctaccctgcagagatcacgcttacttggcagcgtgacggagaagaacagactcaggacacagagttggtggagactcgtcctgcaggggatggaaccttccagaagtgggcagccgtggtggtgccttctggggaagaacagagatacacatgccacgtgcaacacgaaggcttgccacagccactgattctgcgatgggaacaatcacctcaaccgactatccccattgtcggtattgtggctggtctggtagtactcggggcagtggtgacaggagctgtggtggcagccgtgatgtggcggaagaagagttctgatcgtaatcgcggatcatattcccaggccgctgcctattcggttgttagcggtaacctgatgatcacatggtggagcagtctcttcctgctcggggtgctatttcagggatacttaggatgccttcggagccactcggtgcttggacgtcgtaaggttggcgatatgtggatcttgttttttctatggctgtggaccagctttaacaccgcatttttggcgctgcaaagcctgagattcggattcggattcagacggggacggtctttcctcctacgttcctggcaccacctgatgaaacgggtgcagattaaaatctttgactag

SEQ ID NO: 51306 - DNA, 1050 bp, Artificial Sequence
  Description of Artificial Sequence: Synthetic coding sequence
atggctccaaggagcttgctgctgcttttgtctggtgcactcgccctaaccgacacttgggctggatctcactccttgcgctatttttctaccgccgttagcaggcctggccgaggagaaccacgctacatcgcggtggagtatgtcgatgatacccaattcctgcgtttcgatagcgatgctgccatccctcgaatggaacccagggagccctgggttgagcaggagggcccacagtattgggaatggaccacgggttacgccaaggccaatgcacagaccgatagggtggctctacggaacctgctgaggcggtatctggagaatgggaaagagaccctgcagagagcagacccaccaaaggcgcatgttgctcatcatcccattagtgaccatgaggcaaccctgcggtgctgggcccttggcttttaccccgctgagattactttaacatggcaaagggacggagaggagcagacacaagacacagaactcgtggaaactaggccagcgggagacggtacctttcagaagtgggctgccgtggtggtgccacccggagaggaacagcgatacacatgtcatgttcagcacgagggactgccacaaccacttattctgcgatgggagcagtccccacagcctacaattccaatcgttggaatcgtggctggcctggtcgtgttgggagccgtggtgacaggggctgtagtggccgctgtgatgtggagaaagaagagctccgaccggaatcgtgggtcatactctcaggctgccgcttactccgtggtgtccggaaacctcatgatcacctggtggtcgagtctgtttctgctgggggtcctgtttcagggctacctgggttgcctgcgatcccacagcgtattggggaggcgtaaggcacagctgctcagcgtttctacttcccaaacatctatcttaatacaagaacaattctcccaccagaggactctggccatgtccggtaagatgttctgctgtcatgactggtctgaggaggaggtgcttccggctagctgcggagaatag

SEQ ID NO: 51307 - DNA, 396 bp, Artificial Sequence
  Description of Artificial Sequence: Synthetic coding sequence
atggctcctcggagtctgcttctgttgctgagtggcgctctggccctgacggatacctgggctgggagccactctctccgatatttctcaacagctgtgtcaaggcccggtcgcggagagcccagatacatcgctgtggaatatgtggatgatacacagttcctgcgcttcgactccgacgcagctatccctcgtatggaacccagagagccatgggtggagcaggaaggaccccaatactgggagtggactaccggctacgccaaggccaacgctcagaccgacagagtcgccctcaggaatcttctgcgcaggtacaatcaatccgaggcgggttctcacaccctccagggaatgaatggctgcgacatgggcccagacgggcgacttctgtag

SEQ ID NO: 51308 - DNA, 396 bp, Artificial Sequence
  Description of Artificial Sequence: Synthetic coding sequence
atggcccctcgcagcctgttgctccttcttagtggggcactggccttaaccgatacttgggctggatcccacagcctgcgctacttctccactgccgtgtcccggccaggcaggggggaaccacgttacatcgcagtcgagtatgtcgatgacacacagtttttgcgttttgactccgatgctgccattcctaggatggaaccgagggagccttgggtcgagcaggaaggacctcagtactgggagtggaccacaggctatgccaaggctaacgcccagaccgatagggtcgcattgagaaaccttctccggcgttacaatcaatcagaggcaggtagccatactctccagggtatgaacggttgcgacatggggccagatgggcgtctgctgtag

SEQ ID NO: 51309 - DNA, 396 bp, Artificial Sequence
  Description of Artificial Sequence: Synthetic coding sequence
atggcaccgaggagtctgctgctgctcttaagtggagcccttgccctaaccgacacatgggcagggtctcattctttacgctactttagtactgctgtaagtcgtcccggtcgaggggagcccagatatattgctgttgagtatgtggacgacactcagtttctccgattcgactccgacgccgctatcccacgcatggagcctcgcgaaccttgggtcgagcaggaaggcccacagtactgggaatggaccaccggatatgctaaagcaaatgcacagaccgaccgcgtggcccttaggaatctgctcagacggtacaatcagtccgaggctgggtcacacacactccagggcatgaacggctgcgatatgggaccggacgggcgacttctgtag

SEQ ID NO: 51310 - DNA, 642 bp, Artificial Sequence
  Description of Artificial Sequence: Synthetic coding sequence
tagcctgaccccccacctggtcgcgttcccggtgcttttactgaacacgcttatgatgggaaggactacatcagtcttaacgaagatttgcgtagttggacggccgcagatactgtcgcacagatcacacagcggttttacgaggcggaggagtacgccgaagagttccgcacgtaccttgagggggaatgcctggaactgttgcgcaggtatttggagaacggcaaggagacactgcagcgggcagatcctccgaaggcacacgtggcccaccatccaatatcagaccatgaagctacactgcgatgctgggccttgggcttctatcctgccgagattactctgacttggcaacgtgacggcgaagagcaaactcaagataccgaactcgtggagactagacccgctggagatggaaccttccagaagtgggccgcagttgtggtcccatccggcgaagaacagaggtacacgtgccacgttcaacatgaaggcctcccccaacctctgatactcaggtgggaacaatctccacagccaacaatcccgatagtcggtattgtagctggtctggtagttctgggcgcagtggtgactggcgcagtggtggctgccgttatgtggcgcaaaaaatctagctag

SEQ ID NO: 51311 - DNA, 765 bp, Artificial Sequence
  Description of Artificial Sequence: Synthetic coding sequence
atggcacctcggagtttacttctgttgctgtctggggcacttgcactcaccgacacttgggctgggtcacacagccttaggtactttagcacagcggtttcgcgaccaggcaggggggaaccacgctacattgctgttgagtacgtcgacgatacacagtttctgaggttcgactccgatgccgcaatacctagaatggaaccccgagagccatgggtggaacaggaaggtccccaatactgggagtggaccaccggctacgcaaaagcaaatgcccagactgatcgggtggccctccgcaatctccttcgccgatataaccaatccgaagccggtagtcataccctgcagggaatgaatggttgtgatatgggacccgacgggcgtttgttacgtggctatcaccagcatgcatatgatggaaaggattatatttcactgaacgaagacttgagatcgtggaccgcagccgatacggtcgcccagattacacagaggttctacgaagcagaggagtacgctgaagaattccgtacctatttagagggtgagtgcctggagctgctgcggcgttacttggagaacggaaaggagacactgcaaagggctgagcagtccccacaaccgacgattccaattgtggggatagtggcagggctggtagtgcttggcgctgttgttacaggcgctgttgtcgccgctgtgatgtggcggaagaaatccagcgatcgcaatcggggaagctattcccaagccgctgtttag

SEQ ID NO: 51312 - DNA, 396 bp, Artificial Sequence
  Description of Artificial Sequence: Synthetic coding sequence
atggcccctcggagtctgctgctcctgctcagcggcgctctggccctgacagatacttgggctggaagtcactccctgcggtatttttccacggctgtgtcaagacctggcagaggcgaaccccgttacatagccgtggaatacgttgacgacacccagttcctgaggtttgattcggatgccgcaatacctcgtatggagcctagagaaccttgggtggaacaagaggggcctcaatattgggagtggacgaccggctacgcgaaagccaacgcgcaaaccgatcgtgtggctcttagaaatttacttagacgatataatcaaagtgaggctggatctcatactctacaggggatgaacggctgcgatatggggcctgacgggaggctgctgtag

SEQ ID NO: 51313 - DNA, 678 bp, Artificial Sequence
  Description of Artificial Sequence: Synthetic coding sequence
tagcccgatccgccaccgggacgggttccaggcgctttcactgagcatgcatacgacggaaaagattatatttccctaaacgaggatctgcggtcatggacagccgctgacaccgtggcacagatcacacagcggttttatgaagctgaggagtacgcagaagaattccgcacctacttggagggcgaatgccttgagctgttgcgccgttatcttgaaaacggtaaggagaccctccaaagggccgatcccccaaaggcccatgttgctcaccatccgatttcggaccatgaggcaacgcttcgctgctgggcactgggattctatccagccgagattacactgacgtggcagagagacggcgaggagcagacacaagacactgaacttgtggaaaccagaccagcgggagatgggactttccagaaatgggctgctgtcgtggtcccctctggcgaggaacagaggtacacctgccacgttcagcacgagggcttgcctcagcctctgatcctgcggtgggagcaaagcccacaacctacaattcccatcgtgggaattgtggctggactggtggtcctcggcgctgtagtaacaggggcagtcgtcgccgcagttatgtggagaaagaagagtagtgatcgaaacaggggcagctactcacaagccgctgtgtag

SEQ ID NO: 51314 - DNA, 1005 bp, Artificial Sequence
  Description of Artificial Sequence: Synthetic coding sequence
atggcccctcgatcgctgctgttgctgctgtcaggggctctagcactcactgatacttgggctgggtctcactccctaagatacttctccaccgcagtgagtagacccggacgtggcgaaccaagatatatcgcggtagaatatgtggatgacacgcagttccttaggtttgatagtgacgcggcaattcctaggatggaacctcgggagccatgggtcgagcaggagggaccacagtactgggagtggactaccggttatgctaaggcaaatgcgcagaccgaccgggtggcactccgaaatctactcaggcggtataaccagtctgaagcgggttcacacacattacagggtatgaacgggtgcgacatgggtccagacggaaggctcctgagaggttaccatcaacacgcctacgatggtaaagactacatctccctgaacgaggacttacggtcctggaccgctgctgacacagtggcccagatcacacaacggttctatgaggccgaagaatatgccgaggagtttcggacttatctggagggagaatgtctggagcttttaagaagatatctagaaaacggcaaggagaccctgcagagagcggatccgcctaaagcgcatgtggcacatcacccaatctccgaccacgaggccacactccgctgctgggccctcgggttttaccccgcagagattacacttacctggcaacgcgacggggaggaacaaacacaggacactgaacttgtggagacgaggcccgctggggatggaacttttcagaagtgggctgccgtagtcgttcccagcggggaggaacagaggtatacctgccacgtgcagcacgagggactgccacaaccactcattcttcgctgggaacagagcccgcagcccaccataccaatagtcggaattgtggcgggtttggtcgtcttaggagccgttgtgactggcgctgtggtcgccgcagtcatgtggcgaaaaaaatcatcctag

SEQ ID NO: 51315 - DNA, 1041 bp, Artificial Sequence
  Description of Artificial Sequence: Synthetic coding sequence
atggccccacgttctttgttgctgctcctgtcaggagcattggccttaaccgacacgtgggcgggaagtcattccctgaggtactttagcaccgctgtctcacggccaggcaggggcgagcctaggtacatcgcagtggaatacgtcgatgatactcagttccttagatttgacagtgatgccgctatcccgagaatggagccccgagagccttgggtggaacaggagggtccccagtactgggaatggacaaccggatacgccaaagccaatgcccagacagaccgagtggcccttaggaacctgcttaggaggtataatcagtcagaggccggatctcataccctgcagggcatgaacgggtgtgatatggggccagacggtcgcttgctccgcggatatcaccagcatgcatatgatggtaaggattacatcagcctcaatgaggatttgcggtcctggacagctgctgatactgttgcccaaatcactcagcggttttacgaagctgaggagtatgccgaggaatttagaacttacctggaaggagagtgtctggaacttttaagacggtacctggagaacgggaaggagacattgcagagagcggacccaccgaaggcgcatgtcgcacatcatcccattagcgatcatgaagctaccctgagatgctgggccctgggtttctatccagctgagataacactgacctggcagcgggatggagaagaacaaactcaggataccgagctcgtggagacgaggccagcaggcgatggcacgtttcagaagtgggcagcagtcgtagtaccaagtggcgaggaacaacggtacacatgtcatgtacagcacgaaggtctcccgcagcccctgatcttgcgctgggaacaatcccctcagcccacaataccaatagtaggtatcgtcgcaggcctagtagtgctgggcgctgtagttaccggtgctgtcgtcgcagcagtaatgtggcggaagaagagctctgatcggaatcggggaagctactcccaggccgcagtgtag

SEQ ID NO: 51316 - DNA, 375 bp, Artificial Sequence
  Description of Artificial Sequence: Synthetic coding sequence
tgagcagtgatgtggagaaagaaatcctctggacacttcctaccgatagatcgtaataggggcagttatagtcaggcggcagcatattccgttgtgagtgggaatctgatgatcacttggtggtcctcgctgtttcttctaggggttctctttcaaggatatctggggtgcttgcgttcgcactccgtcctaggcagacgcaaagttggggacatgtggattctgttttttctgtggctgtggacttcttttaacactgcctttctggccctgcagagcctgcggtttggcttcggcttcaggcgcggacggtcatttttgctgcgatcatggcatcacttgatgaaacgggtgcaaatcaaaatttttgactag

SEQ ID NO: 51317 - DNA, 375 bp, Artificial Sequence
  Description of Artificial Sequence: Synthetic coding sequence
taagccgtgatgtggagaaaaaagtctagcggacactttctcccaatcgaccgtaataggggctcctactcgcaagccgctgcatattcagttgtctccgggaacctgatgattacatggtggtctagtctatttctcctgggggttctatttcagggatacttaggatgtctgagatcccactccgtactgggcaggcgcaaagttggagacatgtggattctctttttcttgtggctgtggacttccttcaacacagcgtttctagccctccagagccttcggttcgggtttgggtttcgtagagggagaagcttcctgctgcgcagctggcaccacttgatgaagagggtgcagatcaagatctttgactag

SEQ ID NO: 51318 - DNA, 678 bp, Artificial Sequence
  Description of Artificial Sequence: Synthetic coding sequence
tgaccagatcctcccccaggcagagtgccaggggctttcacagaacacgcctacgatgggaaggattacatttcactcaacgaggacctgcgatcatggacagccgcagatacggtcgcccagataacccagcgcttttacgaggctgaagagtacgccgaagagttccggacttatcttgaaggcgaatgccttgagctgctgagacgctatctggaaaacggcaaggaaaccctacaaagggctgatccgcctaaggctcatgtcgcgcatcaccctattagcgaccacgaggctactctgcgatgctgggccttggggttttacccagcagagattaccctgacatggcaaagagacggagaagaacagactcaggacaccgaactcgtagagacacggcctgcaggtgacgggacattccagaagtgggctgccgtggtcgttccgtcaggggaagaacagaggtatacatgtcatgtgcagcatgaaggcctcccccagccactcatattaaggtgggagcaaagtcctcagccgactatccccattgtcggtatcgttgctgggctggtggtactgggggcagtagttacaggtgctgtcgtagctgcggtgatgtggcggaagaaaagttccgatcgaaatcggggttcttatagccaagcagccgtttag

SEQ ID NO: 51319 - DNA, 1329 bp, Artificial Sequence
  Description of Artificial Sequence: Synthetic coding sequence
atggccccacgaagcttgctcctgctgctgtcgggggctctggccctgacagatacctgggccggtagccattctctgcggtattttagcaccgccgtctcaaggcctggtcgtggcgaaccccgttatattgccgtcgagtacgtggacgatactcagtttctgcggttcgattcagatgcggcaattcctcgcatggaaccacgagagccatgggttgagcaggaaggtcctcaatactgggagtggactacaggctacgccaaagcaaatgcgcagaccgatcgcgtcgcattgcggaatctcctgcgcaggtacaaccagtctgaggctgggtctcacactctacaggggatgaatggctgtgatatgggaccggacggtagactgctgaggggctaccaccagcacgcatatgacggaaaggattatatttccttgaacgaggatctgcgctcttggacggctgctgacacagtcgcgcagattacccagcgattttacgaagctgaggaatacgcagaggagtttaggacatatttagagggggaatgcttggagctgctacgcagatatctggaaaatggcaaggaaactcttcaacgggcagatcccccaaaagcccacgtcgcacaccaccccatatcggatcatgaagccaccctgaggtgttgggctttgggtttctacccagccgaaattaccttaacttggcagcgtgacggcgaggaacagacccaagatactgaactagtagaaacacgccctgctggggacggaacatttcagaagtgggcagcagtggtggtcccttccggagaagaacagagatatacatgccatgtacagcacgaagggttgccacagcctctgatcctcagatgggaacagtcaccgcagcctaccatcccgatcgtcggaatcgtcgcagggcttgtagtgctcggtgcggtcgtcacaggcgcagttgtggccgcagtgatgtggcgcaaaaagtcttctgatcgtaatagaggttcttattcacaggccgctgcttactccgttgtgtctggcaatctaatgatcacgtggtggtcgtccctatttttgctcggcgtgttgtttcagggttatctaggatgcctgcggtcacacagcgtgctggggagacgcaaagtaggagatatgtggatcctgttttttttgtggctctggacttcgtttaacacagcgtttctcgctcttcagagtctgaggtttgggtttggtttcagaaggggcaggagctttcttttacggtcctggcatcacctcatgaaaagagtgcagattaagatattcgattag

SEQ ID NO: 51320 - DNA, 678 bp, Artificial Sequence
  Description of Artificial Sequence: Synthetic coding sequence
taacctgacccgccacctggaagagttccgggagccttcacccagcatgcttacgacggtaaagactatattagcttaaatgaggatttacgctcttggactgcagcggacactgtcgctcagattacgcagcgcttctacgaggccgaggagtacgctgaggagtttaggacatacctggagggagaatgtcttgagctgctccgaagatacctcgagaacggtaaggagacactccagcgagccgaccccccaaaggcacacgtggcgcaccatcccatcagcgaccacgaggccaccctgagatgctgggctttggggttctacccagccgagattaccttgacatggcagagagatggcgaagagcaaactcaggacaccgagctggtggaaactaggcctgccggagatggcacctttcagaaatgggcagctgttgtcgtccccccaggcgaagaacagcgctacacatgtcatgtgcagcacgagggtctgccacaacccctgatcttacgttgggaacagtcccctcagcccacgattcctatagtagggattgtagccggtctcgtagtgttaggtgcagtggtcacaggagcagtggttgccgcagtgatgtggagaaagaaatccagtgaccgcaacagggggtcctattcccaagccgctgtttag

SEQ ID NO: 51321 - DNA, 1329 bp, Artificial Sequence
  Description of Artificial Sequence: Synthetic coding sequence
atggcccctcggagtttactgcttctattgtccggcgctttggctttgaccgacacctgggctggatcgcattccttacgctatttctccactgcagttagtaggccgggacgaggcgagcctcgttatattgcagtggagtacgtcgacgatacccaattcctgagatttgacagcgatgccgctataccacggatggaaccccgtgaaccctgggtggagcaagagggaccacagtattgggagtggactacaggttacgccaaggcaaatgctcagacggacagagtcgctctcagaaatcttctgaggcggtacaatcagtcagaggccggaagtcatacactccagggcatgaatggctgcgacatgggtcccgatggacgtttactgaggggttaccatcagcacgcctatgatgggaaggactacatctccctaaacgaagatctgcggtcctggaccgcagctgatacggtggcgcagataacccagcgattttatgaggctgaggagtatgccgaagagtttcggacttatctcgaaggcgagtgcctggagttattgcgccgatacttggagaatgggaaagaaactttacagagagccgatcctccaaaggcccatgtggcgcatcacccaatctccgaccatgaggctaccctgagatgttgggcactggggttctacccagccgagattaccttaacctggcagagggatggggaagagcagacacaggacactgaattggttgaaaccaggcctgccggtgatgggacatttcaaaagtgggcagctgtggtggtgccctcgggcgaagagcagagatacacctgccatgtccagcatgaaggccttccccaacctttgatacttcggtgggaacagtctccacagccaaccatacctattgttggaatcgttgctgggctggtcgtgctcggagccgtcgtcacgggagccgtggtggcagcggtgatgtggcgtaaaaagtcaagcgacagaaacagaggctcttactctcaggccgctgcatattcggtggtgtccggcctgctaatgatcacctggtggtcttctttgttcctgttgggcgtactctttcaggggtacctgggctgcctgcgctcccattccgtgctcgggagacgcaaggttggcgacatgtggatactttttttcctttggctatggacatcttttaataccgccttcttggccctgcagagtctgcgatttggttttgggttccgaagagggaggagcttccttctgcgcagctggcaccacctgatgaaaagggtccagataaaaatcttcgactag

SEQ ID NO: 51322 - DNA, 678 bp, Artificial Sequence
  Description of Artificial Sequence: Synthetic coding sequence
taaccagaccccccacccggaagagttcccggagcctttaccgagcatgcatacgacggcaaagactatatatccttgaatgaagatttacggtcctggacggcagcggatacggtcgctcagatcactcagcgattttacgaggcggaagagtacgccgaagagtttagaacttacctagaaggagagtgcctagagttgctccggaggtacctcgagaacggtaaggaaaccctccaacgggctgacccacctaaagcgcacgtcgcccatcaccctatttcggaccatgaggccaccctccgctgctgggctcttgggttttatccagccgaaattaccctcacctggcaacgggatggtgaggagcaaacccaagatactgagttggtggaaacgagaccagctggggatggcacctttcagaaatgggcggcagtcgtggtaccttccggggaggaacagaggtacacctgccatgttcagcacgagggcttgccgcagcccctgattctgcgctgggaacagagcccacagcctaccatcccaattgtgggaatcgtggcaggactggtcgtgctgggggctgttgtgaccggcgctgttgtagccgctgtcatgtggaggaaaaagagctctgacagaaatcgcggatcatatagccaagcagcagtgtag

SEQ ID NO: 51323 - DNA, 765 bp, Artificial Sequence
  Description of Artificial Sequence: Synthetic coding sequence
atggcacccaggtccctcctgctcctactctcaggtgcgctcgcacttactgatacttgggccggatcacactccctgcggtacttttctacggcagtgagccgtccaggacggggagagccgcgatacatagccgtggagtacgtggatgacacacagttcctgcgctttgattcagacgcagccataccgcgtatggagccaagggagccctgggtggagcaggaaggcccacagtactgggagtggaccacagggtacgccaaagccaatgcgcaaactgacagggtggctcttcggaatctattacggcgttataaccaaagcgaggccggaagccataccctgcaaggcatgaacggatgtgacatggggccagacggacggttactgagagggtatcaccaacacgcttacgacggaaaagattatatatcactaaatgaggacttgcgatcctggacagctgccgatacagttgcacagattacccagcgattctacgaagcagaggaatatgccgaggagttccgaacatatctcgagggtgagtgcctggagcttcttaggcgctaccttgaaaacggtaaggaaacactccagagagcagagcagtctccccagcccactatacccatcgtgggaatagttgctggactcgtggtgctcggagccgtagtgaccggagctgttgtggccgcagtgatgtggagaaagaaaagttcagaccgaaatagaggttcttattcccaggccgctgtctag

SEQ ID NO: 51324 - DNA, 1041 bp, Artificial Sequence
  Description of Artificial Sequence: Synthetic coding sequence
atggcccctcggagcctgctcctgctgttatcaggcgctttggctctgaccgacacttgggcgggatcacacagtctcagatacttttcaacggctgtcagcaggcccggtagaggcgaaccacggtatatcgcggtggagtacgtggacgacactcagtttctgaggttcgattccgacgccgcaatccctcgaatggaacctcgcgagccctgggtggagcaggaaggacctcagtattgggagtggacaacaggatacgctaaagccaacgcccagactgaccgggtagccctgcgcaatcttcttcgcagatataatcagtcagaggccggttctcacactctgcagggaatgaatggctgtgacatggggccagacgggcgtctgctgcggggatatcatcagcacgcttatgacggtaaagactacatctcactcaatgaagatctgaggagttggactgccgcagacacagttgcccagattactcaacggttctacgaggccgaggaatacgcagaggagttcagaacttacctggaaggcgaatgcctggagctccttaggcggtaccttgagaacgggaaagaaacactgcaaagggctgatccacccaaagcccatgtggcccatcatcctatttcagaccacgaggccaccttgcgctgctgggctctaggcttctatcctgccgaaattactctgacgtggcagcgcgacggcgaagagcagacacaggatacggagctagtggagacccggcctgcaggcgatggtactttccagaagtgggctgctgttgtggtaccttctggtgaggaacagagatacacttgccatgttcagcacgaaggcttaccgcagccccttatattaagatgggaacagtctccacagccaacaattccgatcgttgggatcgtggctggactggtggtgttaggcgctgtggtcactggagccgtcgtcgcagctgtgatgtggcggaagaagtcaagtgatcgcaatcggggatcctactcacaggccgctgtatag

SEQ ID NO: 51325 - DNA, 396 bp, Artificial Sequence
  Description of Artificial Sequence: Synthetic coding sequence
atggctccacgatcactactgcttcttctgagtggggcattagcgcttactgacacttgggcaggaagtcatagcctgaggtacttcagcactgccgtcagcagacccggaagaggagagccaagatacattgcagtggagtacgtggacgacacccagtttctcaggttcgactccgacgccgcaatcccaagaatggaacctcgggagccatgggtcgaacaggagggaccccagtactgggaatggaccacagggtacgccaaagctaatgcacagaccgacagggtggcactgaggaacctcctccgtcggtataatcagtcagaggccggttcccacacactgcagggtatgaacggctgtgacatggggccagatggccgactgctgtag

SEQ ID NO: 51326 - DNA, 33 bp, Artificial Sequence
  Description of Artificial Sequence: Synthetic coding sequence
tgagcagtgatgtggaggaagaaaagctcctag

SEQ ID NO: 51327 - DNA, 780 bp, Artificial Sequence
  Description of Artificial Sequence: Synthetic coding sequence
atgaatggttgtgacatggggcctgacggccgactgctcagaggttaccaccaacatgcctatgatggcaaggattatatttccctgaatgaggatctacggagctggaccgccgcagacaccgttgcccagatcacacagcgattttacgaggctgaagagtacgccgaggaattccggacttatctggagggcgaatgcctggaactgttgaggagatacttagagaatggcaaggagactctgcagcgtgcagaccctccgaaggcccatgtggcccaccacccgatcagtgaccacgaagccactctgagatgttgggccttgggcttctatcctgctgaaattaccttaacctggcaaagagacggagaagagcagacgcaggatacggagcttgtggagactcgccctgcgggagacggtacattccagaaatgggctgctgtggtggtacctcccggagaggagcagaggtatacttgtcatgtgcaacatgaaggcctgccacagcctctgatcctcagatgggaacagtccccccaacctacaatccctattgttggcatagtcgcagggctggtcgtcctcggtgctgttgtcacaggagcagtggtggctgctgtgatgtggaggaaaaagtcctccgcatacagcgtggtgagcggcaacttgatgataacctggtggtctagcctgtttctgcttggtgtgctgtttcagggatacctcgggtgcctgagatcacattcagtccttggtagacgtaaacacttctag

SEQ ID NO: 51328 - DNA, 765 bp, Artificial Sequence
  Description of Artificial Sequence: Synthetic coding sequence
atggcgccaagaagcctccttctccttctgtcgggagcgttagccttgacagacacatgggctggcagtcacagtcttcggtattttagtaccgctgtgtcaaggccaggaagaggagagcccaggtatatcgctgttgaatacgttgatgatacccagttcctccgttttgacagcgatgccgctatccccaggatggaacctcgggagccatgggtggagcaggagggaccccagtattgggaatggactaccggttacgccaaggccaacgctcagacagatcgtgttgccctccgtaacttgctgagacggtataaccagtcagaggccggatcccataccctgcaagggatgaatggatgcgatatgggccctgatgggaggctgctgagaggctatcaccagcacgcctacgacggaaaagactatatctcgctgaacgaggatttacggtcatggacagcagctgataccgtcgcccagatcacacagcggttctatgaagccgaggagtacgctgaagaattccgtacatacctagaaggagagtgcctggagctgttacgacggtacctcgaaaatggcaaagaaacacttcagagggcagagcaaagcccgcagcctaccatccccatcgttggaatcgttgccggtctggtggtgttgggggctgtggttacaggcgctgtcgttgctgccgtgatgtggaggaagaaatctagtgatcggaataggggaagctattcacaggctgcagtgtag

SEQ ID NO: 51329 - DNA, 729 bp, Artificial Sequence
  Description of Artificial Sequence: Synthetic coding sequence
atggccccacggtctctgctgttgcttttgtccggagcactggccctgaccgatacttgggctggctctcattccctgcgatacttcagcacggcagtgtcaaggcctggtcgcggagaacccaggtatattgccgtggagtacgtggacgacacgcagttcctccgttttgacagcgacgcagctatcccacggatggagcccagggagccttgggtcgagcaagagggtccccagtactgggaatggaccacggggtatgcaaaggctaacgctcaaacggaccgtgtggcgctgcggaatctgctgcgccgatataaccagtcggaagccggaagccatacactccaggggatgaacgggtgcgatatgggacctgatggacggcttctgcggggttatcatcagcatgcttatgacgggaaagactacatttcactgaacgaggacttgcggagctggaccgccgctgataccgttgcgcagatcactcaacggttttacgaagccgaggagtatgccgaggagttccggacctacctggagggtgagtgcctggagttactcagacgatacttggagaatggcaaggagaccctccaacgggcagagcaaagtccccagccgactatccctattgtcggtatcgtggcgggactggtggtcctgggcgctgttgtcaccggtgctgtcgttgccgctgtgatgtggcgtaagaaatcaagttag

SEQ ID NO: 51330 - DNA, 396 bp, Artificial Sequence
  Description of Artificial Sequence: Synthetic coding sequence
atggccccacggtcactgctactccttctgagtggagctctcgcactcacagacacttgggctggcagtcacagtctgaggtactttagtactgcagtttcacgaccaggaaggggcgagccccgatacatcgccgtggagtacgttgacgatacacagttcctacgattcgactcagatgccgctattccacggatggagccacgcgagccctgggtggaacaagaggggcctcagtattgggaatggacaacaggctacgccaaagcaaatgctcagaccgatcgagtagcacttagaaacctgctaagacggtacaatcaatcggaagctggctcacatactctgcagggcatgaatggctgtgacatgggacctgatggcaggctcctttag

SEQ ID NO: 51331 - DNA, 375 bp, Artificial Sequence
  Description of Artificial Sequence: Synthetic coding sequence
tgagctgtcatgtggagaaagaaaagcagtggccatttcctccctattgacaggaaccgcggtagctattctcaagctgcagcttatagcgttgtgagcgggaatcttatgattacatggtggtcttcattgttcctgttaggggtactctttcagggctacctaggatgcttgagatctcacagcgtactgggcagaagaaaagtgggagacatgtggatcttattttttctatggctttggaccagctttaacacggccttcctggccctacagagtttgaggttcggttttggcttccggagaggcagatcatttctcctgcgctcttggcaccatctgatgaagcgagtgcaaatcaagatattcgactag

SEQ ID NO: 51332 - DNA, 1041 bp, Artificial Sequence
  Description of Artificial Sequence: Synthetic coding sequence
atggccccacggtccctgcttttgcttttgagtggcgctctggctctaaccgatacctgggcaggctcccacagtttaagatatttctctacagctgtgagcagaccaggtaggggagagccgagatatattgcagtggaatacgtggatgatacccaattccttcgttttgacagtgatgcggctatacccagaatggaaccccgagagccatgggtagagcaagaggggcctcagtattgggagtggaccaccgggtacgcaaaggctaacgcacagacggatagggtggccctgagaaacctactccgcagatacaaccagagcgaggcaggaagccacacactgcagggcatgaatgggtgcgatatgggcccagatggcagactcttgcgcggttaccaccagcacgcttacgacgggaaggactacatttccttaaatgaagatctgcggtcatggaccgctgcagatacagttgctcaaatcacccaacggttttacgaagctgaggaatacgccgaggaatttcggacctatctagaaggcgagtgcttagagctgctccgcaggtatctggagaatggcaaggagactctgcagagagccgatccacctaaagcccacgtcgcccaccaccccatcagcgatcacgaagcaacactgcgctgctgggcactggggttctatccagctgagatcactttgacttggcagagagatggcgaagagcaaacacaggacaccgagctggtggaaactcgtccagccggtgatggaaccttccagaagtgggctgcagttgtcgtgccttctggtgaagagcaaagatacacctgtcatgtgcagcacgaaggtctgccccaacccctcatcctacgctgggaacagagccctcagcccacaattcccatcgtgggaattgttgcagggttggtggtcctcggagccgtggtgaccggggcagtggtggccgctgtgatgtggcgtaaaaagtcctccgatcggaacagaggttcatattctcaggccgcagtgtag

SEQ ID NO: 51333 - DNA, 1329 bp, Artificial Sequence
  Description of Artificial Sequence: Synthetic coding sequence
atggcgccacggagcttgctcctactactcagcggtgcattagcacttaccgacacctgggccggtagtcacagcctgcggtatttttcaactgcggttagccgcccagggaggggcgagccccgttacattgctgtcgagtatgtcgatgatactcaatttctgaggttcgatagcgacgccgcaatcccgagaatggagccaagggaaccatgggtggaacaggaaggccctcaatattgggaatggaccactggatatgccaaggctaacgcgcagaccgacagggtagcgctgagaaatctccttcgcaggtataaccaatctgaagctggttcacacaccctgcaaggtatgaatggctgtgatatggggccagatggcagactcttgaggggctatcaccagcacgcttatgacgggaaggattatatctcgttaaatgaagaccttcgcagctggacagccgctgatacagtggcacaaattacgcagaggttctatgaagccgaagaatacgcggaggaatttaggacctatctggaaggggaatgcttagaattgctacggaggtaccttgaaaatggaaaagagactctgcagcgggcagatccgccaaaagcgcatgttgcgcaccatcccattagcgaccacgaggctacattgaggtgctgggccttaggtttctatcctgccgagatcactttgacctggcaacgcgatggcgaggaacaaacccaagataccgaactagtcgaaacacggcctgccggtgatggtacgtttcagaagtgggccgctgtggtagtgccttcgggcgaagagcagagatacacttgccacgtgcagcacgaggggctcccacagcctctaatcttgcgctgggagcagtccccccaaccaaccatccctatcgtgggtattgttgctggcctggtggtactcggggctgtggtgaccggagccgtagtggccgcagttatgtggcggaagaagtcatccgaccgcaacaggggcagctattctcaagcggctgcatatagtgtcgttagtggaaatttgatgattacttggtggagctccctcttcctactcggcgtattgttccagggataccttgggtgtttgcggagccattccgtgctcggcaggcgcaaagttggagatatgtggatccttttcttcctgtggctctggacatccttcaacactgcttttcttgcgcttcagtcattgagatttggattcggatttcgccgagggagaagtttcttacttcgcagttggcatcacctgatgaagagggtgcagatcaaaatcttcgactag

SEQ ID NO: 51334 - DNA, 396 bp, Artificial Sequence
  Description of Artificial Sequence: Synthetic coding sequence
atggccccaagaagtcttctgctcttattgtctggcgctttggcccttacagatacctgggccggttcccacagtctgagatattttagcaccgcggtttcaagaccgggacgtggcgagccacgttacatcgccgtggagtatgtggatgacacacagtttctacggttcgattccgacgcagctatcccccgtatggaaccacgcgaaccatgggtggagcaagagggtccacagtactgggagtggaccacaggatacgccaaggccaatgcccaaacggaccgagttgccttaagaaacttgcttcggcgatataaccagtcagaagccggttctcatacgctacaggggatgaatggatgtgacatgggcccagacggccgtctgttatag

SEQ ID NO: 51335 - DNA, 375 bp, Artificial Sequence
  Description of Artificial Sequence: Synthetic coding sequence
tgagccgtgatgtggcgaaaaaaaagtagcgggcactttttgccaatcgaccgcaaccggggatcttacagccaggccgctgcctacagcgtcgtgtcgggactgttgatgattacctggtggtctagcctgtttctcctcggcgtcctgtttcaaggctacctcggatgtctccggagtcacagcgtgttaggcagacggaaggtcggcgacatgtggattctcttttttctgtggctgtggacttcttttaacaccgcgtttctggccttacagtctttaagattcggattcggatttaggcgcggtagatcatttctgctgcgctcctggcatcacttaatgaaaagggtccagattaagatatttgattag

SEQ ID NO: 51336 - DNA, 1260 bp, Artificial Sequence
  Description of Artificial Sequence: Synthetic coding sequence
atggcacccaggtccctcctgctgctgttatctggagccctggccctgacggatacctgggctggcagccatagtctcagatattttagcaccgccgtctccagacccggacgcggtgaacccaggtacatagctgtcgagccgtgggttgagcaggaggggccacagtattgggagtggacaacggggtatgcaaaggcgaatgctcagacagacagggtggcattgaggaacctgttgcgacggtataatcaaagcgaggccggaagccataccctgcaaggaatgaacggctgtgacatgggccctgacggcagactactgcggggttaccaccaacacgcgtacgatggcaaagactacatatctctaaacgaggatttgcggtcgtggactgcagctgatacggtagcccagattacacagagattctacgaagcagaagagtacgccgaagaattcaggacctatttggaaggggaatgcttggaactcctgaggcggtatctggaaaacggcaaagaaacgctccagcgcgcagacccccctaaggcacatgtggcccaccatcccatcagtgaccacgaggctaccctgagatgttgggcattagggttttatccagcagagatcacactcacatggcagagggacggcgaagaacagacgcaggacacagaattggtggagacgcggccagcgggtgatggcaccttccagaaatgggctgccgttgtggtcccacctggcgaagagcagcgctatacatgtcacgttcagcacgaagggcttccccaacccctcatcctgagatgggagcagtcaccccagcctacgatcccaatcgtgggaatagttgcgggtctcgtggttctaggtgcagtcgtgactggagcagtagtcgccgctgtgatgtggcgcaagaaatcaagtgatcgaaacaggggctcctatagccaggcggcagcatattccgtggtatcgggtaaccttatgattacctggtggtcatccctgtttcttctgggggtcctcttccagggctacctgggctgcttacggtctcactcagtgttgggacgtagaaaggtcggggacatgtggatcctgtttttcttgtggttgtggacgtccttcaacactgcctttctcgcactgcagtcactaaggtttggatttggatttagaagagggaggtcctttttgctgaggagttggcatcacctgatgaaaagggtgcagatcaagatcttcgactag

SEQ ID NO: 51337 - DNA, 375 bp, Artificial Sequence
  Description of Artificial Sequence: Synthetic coding sequence
taagctgtgatgtggcgcaaaaagtcgagtggacacttcttacctatcgataggaaccggggaagctacagccaagctgctgcctattctgttgttagcggtaacctgatgataacatggtggagctctctttttttactcggagtgttgtttcagggatatttaggatgccttaggtctcactccgtgctcggtagaagaaaggtgggtgatatgtggatactatttttcctgtggctgtggacttcttttaacaccgcgtttttagccctgcagtccctgaggtttggcttcggttttaggcgaggacgtagctttctcctccggagctggcaccaccttatgaagcgggtgcagatcaagatcttcgactag

SEQ ID NO: 51338 - DNA, 678 bp, Artificial Sequence
  Description of Artificial Sequence: Synthetic coding sequence
tagccagacccacctcccggacgggtcccaggcgcttttacacagcacgcttacgatggcaaggactatatttctctgaatgaagatttgcggagttggacagcggctgacacggtggcacagatcacccagagattctatgaggccgaagaatatgccgaagaattccgcacctacctggagggcgagtgtttagagctgctgcggagatacctggaaaacggcaaggaaacactgcagcgagccgatccacctaaggcacacgttgctcatcatcccattagcgaccatgaggccacattgcggtgctgggcactgggattttatcctgcagaaataactctaacctggcagagggacggtgaagaacagacccaggacactgagttggttgagactcgtcctgcaggcgacggtaccttccagaaatgggccgctgtggtggtcccatctggggaggagcaaagatacacttgtcatgtgcaacacgaagggcttcctcagcctctgatactgcgatgggaacaaagccctcagccgactataccaatagtcggcatcgttgccggactggtagtgctgggcgctgtcgtaacaggtgctgtggtggctgcagtcatgtggagaaagaagagctcagacaggaataggggctcttattcccaggccgctgtgtag

SEQ ID NO: 51339 - DNA, 678 bp, Artificial Sequence
  Description of Artificial Sequence: Synthetic coding sequence
tgacctgatcccccaccagggcgagtgcctggagcatttactcagcatgcatatgacgggaaggactacatttctctgaatgaggacctgcggtcatggacagcagcagacacggtagcccagataacccagaggttctatgaggccgaagagtatgccgaagagttcagaacctatctggaaggcgagtgtctggagctgttgcggcgatacctcgagaacggaaaagagacactgcagcgcgcagaccccccaaaagcacacgtcgctcaccatcctattagcgaccatgaagccactcttagatgctgggcgctcggattctatcccgcagagatcaccttgacttggcaaagggacggcgaggagcagacccaggacacagaattggtcgagacccgcccagcgggagacggaaccttccagaagtgggccgctgtcgtagtcccatccggtgaagaacaacggtacacctgtcatgtccagcatgaaggtttgccccagcctctcattctcaggtgggagcagagcccccagcccaccatcccaatcgtgggcatagtcgccggactggtcgttcttggcgcagtagtgacgggggctgtcgtcgcagctgtgatgtggaggaagaaaagcagcgatcgcaatagaggctcttatagtcaggctgcagtctag

SEQ ID NO: 51340 - DNA, 375 bp, Artificial Sequence
  Description of Artificial Sequence: Synthetic coding sequence
tgagcagtcatgtggcgaaagaaatccagtggccatttcctgcccattgatcggaatcggggttcctattcccaggcagccgcatactctgtcgtctcaggcaacttgatgatcacgtggtggtcaagcctgttcctcctgggtgttctgttccagggctacctgggatgccttaggtctcattctgtgctcgggaggcgcaaagtgggagacatgtggatactgttctttctgtggctgtggacttcattcaatacagctttcctggccctccaatccctacggttcgggttcggttttcgcagagggagaagttttctgctcaggtcttggcatcatcttatgaaaagggtccagatcaagattttcgactag

SEQ ID NO: 51341 - DNA, 780 bp, Artificial Sequence
  Description of Artificial Sequence: Synthetic coding sequence
atgaatggctgtgacatgggtcctgatggaaggctcctccgtgggtaccatcagcatgcatacgacggcaaagactacatttccctcaatgaagacttgagatcttggactgcagcggataccgtggcccagattacacagcgcttctacgaagccgaggaatacgccgaggagtttaggacctacctggagggggagtgcctggagcttctgcgcagatatctggagaacggcaaggaaactttgcaacgggctgacccacctaaagcacacgtagcccatcatcctattagtgatcacgaggcaacactccggtgctgggccctcgggttttacccagccgaaatcactctgacctggcagcgggacggtgaagagcagacgcaagacactgaactggtcgaaacgaggcccgctggagacggtactttccaaaagtgggcagctgtagtcgtgccttccggagaggagcaacgttatacctgtcatgtgcagcatgaaggtctgccccagccattgattctgcgatgggagcagtcccctcagcccaccatcccaattgtcgggattgtggcaggcctggtcgttcttggggctgtcgtcaccggtgccgtggtcgccgcagtgatgtggaggaaaaagagctctgcctactctgttgtgtctgggctgctgatgatcacttggtggtcgagtctgttcctgttaggagtgttatttcagggctacctgggctgtcttcgatcccacagtgtcctcggaagacggaaacacttctag

SEQ ID NO: 51342 - DNA, 1050 bp, Artificial Sequence
  Description of Artificial Sequence: Synthetic coding sequence
atggcacccagatcactactgctcttgctcagtggagcccttgctctaacggatacctgggctggcagtcatagcctgaggtatttttctaccgccgtgagccgcccaggaagaggagaacccagatacattgctgtcgaatacgttgacgacacacaatttctgagatttgacagcgacgctgccattcccaggatggaacctagggagccatgggtggagcaagaaggtcctcagtactgggaatggaccactgggtatgccaaagcgaacgctcagacggatcgggtggcgctgcgaaatctgcttagacgctatctggagaacggcaaagagaccttacagcgcgcagatcctcccaaggctcatgtcgctcatcatccaatctccgaccacgaagcaaccctacgatgctgggctctggggttttatccagccgaaattactttgacatggcagagggacggtgaagaacaaacacaagataccgaactggtggagacccggccagctggggatgggaccttccaaaaatgggccgctgttgtggtgccgagcggcgaagagcagcgttatacatgtcacgtgcaacatgaaggtctgcctcagccactcatcctgcggtgggagcaaagccctcaaccaacaattcctatcgtcggcattgtagcgggacttgtcgtcctgggcgctgtcgtgactggagctgtggtagccgcagtgatgtggaggaaaaaatctagtgacagaaaccggggatcgtatagccaagccgcagcgtacagcgttgtttccgggaatctgatgatcacctggtggtcatctttgttcctgctcggcgtactcttccagggttacctaggatgcctgcgttcccattctgtgcttggacggcgtaaggctcagctactgtcggtgagcacttctcagacctctatcctcatccaggagcaattcagtcaccagagaactctggccatgagcggaaagatgttctgctgccacgattggagtgaggagaaagtgctgccagcttcctgcggcgagtag

SEQ ID NO: 51343 - DNA, 1260 bp, Artificial Sequence
  Description of Artificial Sequence: Synthetic coding sequence
atggcccctaggtccttgctgcttctcctgtccggagctcttgccctcaccgatacctgggccggttcccattcactcagatacttttccaccgccgtgtcccggcctgggcgaggggagcccagatacatcgccgtagagccttgggtcgagcaggagggtccacagtattgggagtggacaactgggtacgcaaaagccaacgcacagacagacagggtcgccttgcgcaatctgctcaggcgttacaatcagagcgaagccggttcgcatactctgcagggcatgaacggctgcgatatgggtccagacggccgacttctgcggggataccaccagcatgcgtacgatgggaaagattacattagcttgaacgaagatctgcgcagttggacagctgccgacacggttgcacagatcactcaacgattctacgaagccgaggagtatgctgaagaatttcggacgtatctggaaggcgagtgcctggagctactcagacgctacctagagaatggcaaggaaacactgcagcgggctgatccacccaaagcccacgtggctcatcatccgattagtgatcacgaggccacattgaggtgctgggcgttgggtttctacccggcagagatcacgctgacctggcagagggacggcgaggaacagacccaggacacagagctggtcgagacccgtcccgcaggcgacggtacctttcagaagtgggcggctgttgttgtcccttcaggagaggaacagaggtatacatgccatgtacagcacgagggcctcccacagcctctgattctacgctgggaacagtctccccagcctaccatcccaatcgttgggatcgtggcaggcctcgttgtgctcggcgctgtggttaccggtgccgtagtggcggctgtgatgtggcggaagaagtcttctgacagaaaccggggatcatattctcaggctgccgcttattccgtggttagcgggaatctgatgatcacttggtggtcttcgttgtttttattgggggtgctgtttcagggatacctcggctgcctgagatctcattcggtcctgggcagacggaaggttggcgatatgtggattttgttcttcctctggctgtggacatccttcaacactgcctttcttgcactgcagtctctgcgctttggcttcgggttcagacgcggtcgctccttcctcttacgttcctggcatcacttgatgaagagagtccagattaaaattttcgattag

SEQ ID NO: 51344 - DNA, 1050 bp, Artificial Sequence
  Description of Artificial Sequence: Synthetic coding sequence
atggcccctcgcagccttctgctgttgttgtctggggctctcgccctcacagacacgtgggccggaagtcacagtctcagatatttctccaccgcagtttctaggcccggaagaggagagcccaggtacattgcggtggagtacgtagacgacacccagtttctcagattcgacagtgacgccgctattccccgtatggaacccagagagccctgggtggaacaggagggtccccaatattgggagtggactactgggtatgcgaaggcaaacgcacagaccgatagggtggcgctcagaaatctgctgagaagataccttgaaaatggcaaggagactcttcagcgagcagacccccctaaagctcacgttgcccaccacccgatcagtgaccacgaggcgaccctgagatgttgggccctcggcttctatcccgcagagatcactctgacatggcaacgagatggcgaggaacaaacacaggacacagaactggtggaaacaaggcccgctggtgatggcactttccaaaagtgggcagcggttgtggtcccctcgggcgaggaacagcggtacacatgccatgtccagcatgaaggtctgcctcagccattaatcctaagatgggaacagtcaccacagcctaccatccctatcgtggggatcgtcgccggtctggttgtgctgggagcggtggtcaccggggcagtggtcgctgcagtgatgtggcgcaagaagagctcggataggaacaggggatcttactcccaggccgctgcttactccgttgttagtggcaacttgatgatcacctggtggagttccttgttcctgttaggggtgctctttcagggttatctcgggtgcttgaggagtcactctgtgctggggagaaggaaagcacagctcctttccgttagtacaagccagaccagcatattaatccaggaacagttttcacaccaaaggacccttgcaatgtcgggaaagatgttctgttgccatgactggtccgaggaaaaggtacttccagcctcctgtggagaatag

SEQ ID NO: 51345 - DNA, 780 bp, Artificial Sequence
  Description of Artificial Sequence: Synthetic coding sequence
atgaacggctgtgacatgggtccagacggacgtctgctgagaggttaccatcagcatgcttacgatggaaaagattatatctcattaaacgaggatcttcgctcatggaccgcggctgataccgttgcccagatcacccaaagattctatgaggcagaagaatacgcagaagagttccgcacgtacctggagggtgagtgccttgagctcctgcggagatacttggaaaacgggaaggagacccttcagagagctgatccaccgaaggctcacgtcgcccaccatcctatttctgaccacgaagcaacgctcagatgttgggccctagggttctacccagctgagatcactcttacgtggcagcgggacggcgaagaacagacccaggacacagagctggtggagacacgccctgcaggtgatgggacatttcagaagtgggctgccgtagttgttccctctggggaagagcagaggtacacctgtcatgttcagcacgaaggcctgccacagccactgattttgcgctgggaacagtctccacagcctaccatacctatcgttggcatcgtggctggccttgttgttctcggggctgtggtgacaggtgcggttgtcgcagccgtgatgtggcgaaaaaaaagttccgcttactctgtcgtgtcaggaaatctgatgatcacctggtggagttcactttttctgctcggagttctgtttcaagggtatttgggatgtttgaggtcccactccgtcctgggtaggcgcaagcatttctag

SEQ ID NO: 51346 - DNA, 780 bp, Artificial Sequence
  Description of Artificial Sequence: Synthetic coding sequence
atgaatgggtgtgatatgggacctgatgggagattactgcggggttatcaccagcatgcctacgacggaaaggattacatatcactgaacgaagatttgagatcctggacagctgccgatacggtggcccagatcacgcagcggttttacgaggctgaagagtatgctgaagaattccgcacttatctggagggcgagtgcctggaactcctaagacggtatttggaaaacggaaaggagactctccagcgagctgatccgcctaaagcccatgtggcccatcaccctattagtgatcacgaggccacactgcgttgttgggccctgggcttttacccggcagagattaccctaacatggcagcgagatggcgaggagcaaactcaggataccgaactggttgaaaccagaccggctggggacggtacttttcaaaagtgggcggctgtggtcgtgccttctggagaagagcagaggtacacatgccatgtgcagcatgaagggttaccccagccccttatcctgaggtgggagcaaagcccccagcccactatccccatagtgggcattgtggcaggccttgtcgtcctaggcgctgtagtgactggggcagttgtggcagccgtgatgtggagaaaaaaaagtagtgcttattctgttgtctccggaaatttgatgataacctggtggagctcactgtttttgctaggggttcttttccagggttacctcggctgtctgcgatcgcatagcgtactcggtcgtcgaaagcacttctag

SEQ ID NO: 51347 - DNA, 1260 bp, Artificial Sequence
  Description of Artificial Sequence: Synthetic coding sequence
atggcgccaaggagcctcttgctactgcttagtggcgcactagcgctgacagacacttgggctgggtcccacagcctgagatatttttccaccgccgttagccgtccaggacgcggagaacccaggtatatagccgttgagccatgggtggaacaggaaggtccacagtactgggaatggactactggatacgccaaagcgaatgcccagaccgatagggtggccttgcgcaatctgcttcgacgttataaccagtccgaggcgggaagccacaccttacaaggtatgaatggatgtgacatgggcccagacggcaggctcttgcgcggttatcatcagcacgcttacgacggaaaggactacataagtctcaacgaggacctgaggtcatggaccgctgcggacactgtggcccaaattactcaacgcttctacgaagctgaagagtacgcagaggagttccgtacctacctcgaaggcgaatgcttagagctgctcaggagatatctcgaaaatggtaaagaaaccctgcagcgtgcggatcccccaaaagcgcacgtggctcaccatccaatctcagaccacgaagccacattgcggtgttgggcgctgggtttttacccagcagagataactctgacatggcagcgcgacggggaagagcagactcaggatacagagctagtggaaacacgacccgctggagacggcacgtttcaaaagtgggccgcagtggtggtgccctcaggagaggaacagcgttatacctgtcacgttcaacacgagggactgcctcaacccctaatcctgcgctgggagcagagcccacagccaacaatccccattgtcggaatagtagccggattagtggtattgggagcagtcgttaccggagccgtggtggccgcagtgatgtggcggaagaagagttctgataggaaccgcggtagttacagtcaggcagccgcttattcggtcgtgtctggcaatctgatgatcacatggtggtcctctttatttctcttgggcgttctctttcaggggtacctcggttgcttgcgaagccacagcgtgctaggacgtcgaaaggtgggagacatgtggatattatttttcctgtggctttggacttcctttaacaccgccttcttggctttgcaatcattgcgtttcggttttggatttcgcaggggcagatctttcctgctgagatcttggcaccacttgatgaagagggtccaaataaagattttcgattag

SEQ ID NO: 51348 - DNA, 1050 bp, Artificial Sequence
  Description of Artificial Sequence: Synthetic coding sequence
atggcaccaagatccttgcttctactcctatccggagccctcgcactaactgatacatgggcaggctcgcactcccttaggtacttcagcactgccgtttcccgaccaggccgaggtgaacctagatatatagccgtggagtacgtggacgatactcagttcctgaggttcgacagcgatgctgcgatacccagaatggaaccaagggagccttgggtggaacaagaggggccacagtattgggagtggacaaccggatacgcaaaggctaatgcccaaactgaccgcgttgcgctgaggaatctgctgcggagatacttggaaaacggaaaagaaaccctgcagcgagccgatcccccaaaggcccacgtggctcatcaccctatttccgatcacgaagccacccttcgctgctgggctctgggattttaccctgccgagatcaccctcacttggcaacgagacggcgaagagcagactcaggacacagaactggtggagactaggcctgctggcgacggcacttttcaaaagtgggccgcagtcgtggtaccgagcggagaagagcagagatatacctgccatgttcagcatgagggactgccacagccattgatattgcgttgggaacaatccccccagccaaccatccccatagtgggtatagtggccggactggtggtactaggtgctgtggttacaggtgcagtggtggccgctgtgatgtggcgcaagaaaagctccgaccggaaccgaggcagctactcccaggcagccgcatactctgtagtcagcggtaacctcatgattacatggtggagctcactatttcttctgggagtgttgttccagggttacctcggctgcctgagaagccactctgtgctcgggagacggaaagcccaattactctctgtgtctacctctcagaccagtatcctgattcaagagcagttttcgcaccaacgaactttggccatgtcgggaaagatgttttgctgccacgactggtcggaggagaaggtcttacctgcctcctgtggcgagtag

SEQ ID NO: 51349 - DNA, 1308 bp, Artificial Sequence
  Description of Artificial Sequence: Synthetic coding sequence
atggcgcctaggtctctgctgctattactctctggagcattagccctgacagacacatgggctggttcccatagcttgcgatacttcagcactgctgtctcccgcccaggtcggggagagcctagatacatcgctgtcgagtacgtcgatgacacacagttcttgcgctttgactccgacgcagctataccaagaatggaaccccgagaaccctgggtggagcaggaggggcctcaatactgggagtggactacggggtatgctaaggccaatgcacagacggaccgcgtcgctcttcgaaacctgttgagaaggtataaccagtccgaggcgggatcccacactctgcagggtatgaatggttgtgatatgggcccagatggcaggttgctgagggggtatcatcagcatgcttatgacggaaaggactatatttccctgaatgaggacttgcgatcctggacagccgctgatacagtggcgcagatcacccaacgattctacgaggcggaagagtatgccgaggaattccgaacttacttggagggcgaatgtctcgagctcctgcggagatatcttgaaaacgggaaggagaccctccagagagcggacccaccaaaggcccatgtcgcgcaccatcccatctccgaccacgaagcaacccttaggtgttgggcgctcggcttctacccagctgagattacactgacttggcagagagacggcgaagagcagacccaggacaccgagctagtagaaacgcgccctgctggcgacggcaccttccagaagtgggccgcagtggtggtgcccagtggcgaggaacagagatatacctgccacgtacaacatgaaggcctgccccagcctttgatcctccggtgggaacaaagccctcagcccaccattccgatagtcggtatcgtcgccggactggttgtcctcggcgcagtagtcactggtgcagtggttgctgccgtcatgtggcgtaagaagtccagcgaccgcaatcgaggatcttatagccaagccgcagcttactctgttgtatccggactgctgatgattacatggtggagctcgttgtttttattaggagtgctcttccagggctaccttggatgtctgcgatcacatagcgtactgggaaggcgaaaagcccagctcttgtctgtgtctacgtcacagaccagcattcttatccaggaacagttctctcaccaacggacactggcgatgtccgggaagatgttttgttgccacgactggtccgaggaagaggtactgccagcaagttgcggcgaatag

SEQ ID NO: 51350 - DNA, 1041 bp, Artificial Sequence
  Description of Artificial Sequence: Synthetic coding sequence
atggcccctagatcactgctgctgcttttgtcaggcgctttggccctcactgacacttgggccggaagtcatagcctgcggtattttagcacggctgttagccgcccaggacgcggagagcctaggtatatcgccgtggagtatgtcgatgatacacagttcttgcggttcgacagcgatgccgctatccctagaatggagcccagggagccttgggtagagcaggaaggtcctcagtactgggagtggaccacaggttatgcgaaagcaaacgcccaaacagaccgagtcgccctcaggaatctgctcagaaggtataaccagtccgaggcaggctcacatacactgcagggaatgaatggctgtgatatgggcccagacggtagattgctgcgtggataccatcaacacgcatacgatgggaaggactacatcagtctcaatgaagacttaagaagctggaccgccgctgacacagtggcacagattacacagcgcttctacgaagccgaggagtacgctgaggagttcagaacctatctggagggtgagtgtttagaacttcttagacgttacctggaaaatggcaaggaaaccctgcagcgtgctgatccacccaaggcacatgtggcgcaccatccaatcagtgatcacgaagcaactctgcgttgttgggctcttgggttttacccagcagagataaccctcacatggcagcgcgatggggaagaacagactcaggacactgaactggtggagactcgccctgcaggagacggcacctttcagaagtgggcggcagtcgttgtaccttccggtgaggagcagcgctatacttgtcacgttcagcatgagggactgccccaacccttgatactgcgctgggaacaaagcccacagccgaccatccccatcgtgggaatcgtggcgggtctggtggttctcggtgccgtagtgaccggggctgtggtggctgcagtgatgtggcggaagaaaagttccgataggaatcgcggaagctactcccaggcagccgtctag

SEQ ID NO: 51351 - DNA, 780 bp, Artificial Sequence
  Description of Artificial Sequence: Synthetic coding sequence
atgaacggctgtgacatgggacccgatgggaggctccttcgtggatatcatcaacatgcatatgatggtaaagattacatatctctcaacgaggatctcaggtcctggaccgccgcagatacagtggcgcaaatcacccagaggttctacgaagccgaagagtacgccgaggagtttcgcacctatctcgagggtgagtgtctggagctactacggaggtatctggagaatggaaaggagactcttcaacgcgcagatccccctaaggcacacgtggcacatcaccccatctcagaccatgaggcgacactccgttgttgggccctgggattctatccggctgagattacgttgacttggcagcgcgacggcgaagagcaaacccaggatactgagctagtggaaacaagacccgctggcgacgggactttccagaagtgggccgcagtggtggtacctagtggcgaagagcagcgatatacatgccacgtgcagcacgagggattgcctcagccactcatactgcgatgggaacaaagcccccaaccgactattcctattgtgggcatcgtggccggactggtggtgctcggggctgtggtcaccggtgccgtcgtcgcggcagtgatgtggcggaaaaagtcaagcgcctacagtgtggtgtccggcaacctgatgattacgtggtggtcatcactgtttttacttggcgtcctgttccagggctacctcggctgtctccgatcccacagcgtgctggggagaaggaaacatttctag

SEQ ID NO: 51352 - DNA, 1041 bp, Artificial Sequence
  Description of Artificial Sequence: Synthetic coding sequence
atggcccctcgctccttgcttctgttactgtccggggctctcgcattgactgatacctgggccggttcccacagtctcagatatttctcgacagccgtgtcacgcccaggccgaggcgagccccgatacattgcagtagaatacgttgatgacactcaatttctgaggttcgattcagacgctgccatcccacgcatggaacctagggagccctgggtcgaacaggaggggccacaatattgggaatggacaactggttatgcaaaagcaaacgctcagacagaccgagttgctctcaggaatttgcttaggaggtataatcaatcagaagcagggagccacactctgcaaggcatgaacgggtgcgatatgggccctgatggacgactgctccgtggttatcaccagcacgcctacgacggaaaagattacatttcactcaatgaggatttacgcagttggaccgccgctgacacggtcgctcaaataacccagcggttttacgaggcagaagagtacgcagaagaattccggacctacttggaaggagagtgtttggaattgctgagacgttacctggagaacggaaaggaaactcttcagcgggcagatccgccaaaggcccacgtcgcgcatcatcccatcagtgatcacgaggctaccctgcggtgttgggccctgggcttctacccagcagagatcactctcacatggcagcgagatggtgaagagcagacgcaagacacggaattggtggaaacaagacccgcaggcgatgggacgttccagaagtgggccgcagtcgtggtaccttccggagaggagcagaggtacacgtgccatgtccagcatgaaggcctacctcagccactgatcttgcgatgggagcagtcgccccagcctacaattccaatagtaggcatcgtggcaggactggtagtgttgggtgccgtcgtgactggcgctgttgtcgccgctgtgatgtggagaaagaagtcctctgaccgaaatcgtggctcttactctcaggccgctgtgtag

SEQ ID NO: 51353 - DNA, 1050 bp, Artificial Sequence
  Description of Artificial Sequence: Synthetic coding sequence
atggctccgaggagcctgttgcttttgttatcaggcgctcttgcactgaccgatacatgggctgggtcccactccctcagatacttctcgaccgctgtgagccgtccgggtcggggagaacctcgatacatcgccgtagagtacgtagatgacactcagttcttgcggtttgacagtgacgcggcaattcccaggatggaacccagggagccctgggtggagcaagaaggtcctcagtactgggagtggaccaccggatacgcaaaagctaacgctcaaactgatcgagttgccctccggaacctcctccgcagatacctagaaaacggtaaggaaactctccaaagggccgatccaccgaaagcacatgttgcgcaccacccaatatcagaccatgaagctacacttcgatgttgggcactggggttttatcctgctgaaatcacgcttacatggcagcgcgatggtgaggagcagacccaggataccgaattggtggaaaccaggccggctggagacgggaccttccagaaatgggctgctgtggtggtgccaagtggcgaagagcagcgctacacctgccacgtgcaacacgagggtctgccccagccattgattttgcgatgggagcagtccccacagccaaccatccccatcgtgggaattgtcgccggtcttgtcgtgctgggcgctgttgtcaccggtgccgtggtcgcagctgtgatgtggagaaagaagtcgtccgatcggaatcggggttcatattcccaagctgccgcttactctgtggtgtcagggaacctgatgatcacttggtggtcctctctgttcctcttaggtgtactgttccaaggctacctcggttgcttgcgcagccattcggtccttggtcggaggaaggcccagctactgtcagtctccacttcacagacatcaatactgatccaggagcagttttcccatcaacggaccctcgccatgtccggtaagatgttctgttgccacgactggtccgaggaggaggtactcccggctagttgcggagagtag

SEQ ID NO: 51354 - DNA, 1260 bp, Artificial Sequence
  Description of Artificial Sequence: Synthetic coding sequence
atggctccgagaagtctcctcctgcttctctcgggtgccctcgcccttactgacacttgggccggttctcattctctgcgctatttctccaccgctgtatccagacctggtaggggcgagcctcggtatatcgctgtagagccttgggtggagcaggaaggcccacagtactgggaatggaccaccggatacgcaaaagccaacgcacagactgatcgtgtcgccctgagaaatctattgcggagatataaccaatcagaggccggaagccacaccttgcagggcatgaatggttgtgacatggggcctgatggcaggctgcttcgcggttatcaccagcacgcgtacgatgggaaagattacatcagcctgaatgaggatttacgatcctggacagcggctgacacagtggcacagatcacacaacgcttttacgaagctgaagaatatgctgaagaattcagaacctatctggaaggggagtgcctggagctgctgaggcggtatctggaaaatgggaaggaaaccctgcaacgggctgatccaccaaaggcccacgtggcccaccacccaatcagtgaccacgaggccacgctccgttgttgggccttgggcttctatccggcagagataactttgacctggcagagggacggagaggagcaaactcaggataccgagctggttgaaacaagacccgctggggatggcactttccagaagtgggccgcagttgtggttccctcaggtgaggagcaaaggtatacgtgtcatgtacagcacgaaggactccctcagcctctgattctgagatgggagcagagtccccagccgacaatacccattgtcggtatagtcgcaggactggttgtcctgggggctgtcgtcacaggggctgtcgtggcagcggtgatgtggagaaaaaagtctagcgacaggaaccgaggatcttattcccaggctgctgcttactctgtagtgagcggtaatttaatgattacctggtggagctcactctttctgctcggagtgctcttccagggataccttggatgcctccgaagccacagtgtcttgggcaggcgaaaagtgggtgatatgtggatcctattttttctgtggttatggacgagtttcaatacggcgttcctcgcgctgcagagtctcagatttggctttgggttcaggaggggtagaagctttctcctgcgcagttggcaccatcttatgaaacgcgtacaaattaagatcttcgattag

SEQ ID NO: 51355 - DNA, 780 bp, Artificial Sequence
  Description of Artificial Sequence: Synthetic coding sequence
atgaacgggtgtgatatgggcccagacggccgactgctgcgcggataccaccagcacgcgtacgacgggaaggactacatctctctgaacgaagacttaagatcctggacggcagccgatacagtcgcccagatcacccagcgtttctacgaagccgaggagtatgctgaggagttccggacttatttggagggggagtgcctggaattgctccggcgatatctggagaatggcaaagagaccttgcagagagctgacccaccaaaagctcatgttgcgcaccacccaatttccgatcatgaagccaccttgcgctgttgggcactgggcttctatcccgctgagattactctcacctggcaaagagatggtgaagagcagacccaagatactgagctcgtagaaacccgtccagccggagatgggactttccagaagtgggccgctgtagtggtgccgagtggtgaagaacaacgttacacatgccacgttcagcacgaagggcttccccagccgcttattttgcgatgggagcagtcgcctcaacctactatccctatagtaggaattgtcgctggacttgtcgtcctgggtgctgtagtgacgggtgcagtagtggccgcagtgatgtggagaaagaaaagtagtgcgtattccgtggtcagtggcaatttgatgattacatggtggtccagcctgttcctgctgggtgtattatttcagggttacctcgggtgcctacgctcgcactccgtgctgggccgtcgcaaacatttttag

SEQ ID NO: 51356 - DNA, 1260 bp, Artificial Sequence
  Description of Artificial Sequence: Synthetic coding sequence
atggcccctcgaagtctgctgttactgctaagtggtgcgttagcccttactgatacctgggctggatctcactctctgcgctacttttccacagcagtcagtagaccgggacgaggggagcctcgatatatcgctgtcgagccttgggtcgagcaagaagggccacagtattgggagtggaccaccgggtacgccaaggccaatgctcaaactgacagggtggccctaagaaacctccttcgtagatataatcagagcgaggccggttcacacaccctgcaaggcatgaacggctgtgacatggggcctgacggcaggctgctgagagggtaccatcaacacgcttatgacggtaaagattatatcagcctgaatgaagacctgcgttcctggaccgccgctgataccgttgctcagatcacccagaggttttacgaggccgaggaatatgctgaggagttccggacctatttagagggcgagtgcttggaactgctgaggcgctatctcgaaaacggaaaagaaaccctgcagcgggctgatccacctaaagcacatgtcgcccaccaccccatttccgaccacgaagctaccctgagatgctgggcccttggtttctatccagcagagatcacccttacctggcagcgtgacggcgaagaacagacacaagacaccgagctggtcgaaacaagaccagcaggcgacggtacatttcagaaatgggccgcagtggttgtaccttctggcgaagaacaacgctatacatgccacgttcagcacgaaggtctgccccaacctctgatcctccgctgggaacagagcccccaaccaacgataccaattgtcggaatagttgcaggactggtcgtcctcggcgcagtggtgacaggcgctgtcgtggctgccgtgatgtggcgaaaaaaatctagcgaccgaaataggggatcatattcacaggcagctgcttactccgtggtctccgggaacctgatgatcacctggtggagttcactttttctcctgggggtcttgtttcagggttacctgggctgtctgaggagccactctgtgttgggtcgcagaaaggtcggggacatgtggatcctcttcttcctctggctctggacaagtttcaacacagcttttcttgctcttcagtcactccgattcggcttcggtttccgccgaggtagatcttttctgctacgttcgtggcaccatttaatgaagagggtccaaattaaaatcttcgactag

SEQ ID NO: 51357 - DNA, 1041 bp, Artificial Sequence
  Description of Artificial Sequence: Synthetic coding sequence
atggcacccaggtctttactcctgctcctctcaggtgccctggcgttaaccgatacttgggccggttcccacagtttgagatacttctccacggccgttagtcgccctgggagaggtgagccgagatacatcgctgtagagtatgttgatgatacccaatttctacggttcgacagcgacgccgctatacccagaatggaacctcgggaaccatgggtggagcaggagggcccacagtactgggagtggactacgggctatgcgaaggctaatgctcaaaccgaccgggttgcgttaagaaacttgttgcgcagatataaccagtccgaggccggatcgcacacgctgcaaggaatgaatggctgcgacatgggaccagacgggagactcctgcggggataccatcagcatgcctacgatggaaaggattatattagcttgaatgaagacctccgttcgtggaccgccgcagatacggtcgctcaaatcacacagcggttttacgaggccgaggaatacgccgaggaattccgcacttacctggagggtgaatgcctggagctgctccgccgatatcttgagaacggaaaggaaaccctccaacgtgccgaccctcccaaggctcacgttgctcaccacccgataagtgaccatgaggcaactttgcggtgttgggctctcggcttttacccggctgaaataacattgacgtggcagcgcgatggcgaagaacagacacaagacactgaattagtggaaaccaggcctgctggagacggcactttccagaagtgggctgcagtcgttgttccttcaggcgaagaacagagatatacctgccacgtacagcacgaggggctgccacagcccttgattctcaggtgggaacagagcccccagccgacgattcccattgttgggattgtcgcaggcctggttgtactcggcgcagtagtgaccggcgcagtggtcgctgccgtcatgtggcggaagaaatcatctgacagaaatagagggagttattcacaggctgccgtttag

SEQ ID NO: 51358 - DNA, 1041 bp, Artificial Sequence
  Description of Artificial Sequence: Synthetic coding sequence
atggcgccaaggtctctgctcctgctcctgtccggtgcattggccctcacggacacatgggcgggttcgcactccctgcgctactttagcacagccgtgtcacgccctggtagaggcgagccccgttatattgccgtggaatatgtcgacgacactcagtttttacggtttgatagtgatgctgccattccccgaatggaaccacgggagccttgggtcgagcaggaaggccctcagtattgggagtggaccacaggatacgcgaaagccaacgctcagacagaccgagtggccctgaggaatctactgcggcgttataatcagtccgaggccggttctcatactctacaaggcatgaacggctgtgacatgggacctgacgggaggctgctgcgcggataccatcagcatgcttatgacggcaaggactatatatctctgaatgaggatctgcgatcttggaccgccgctgacactgttgcacaaatcacacagcggttttacgaggccgaggagtacgcagaagagttcagaacctaccttgagggcgagtgtctcgaactgctgagaagatatctagagaacggcaaagagactctacagcgtgctgacccgcctaaggcccacgtggcccatcaccccatctccgatcacgaagccaccctccgttgctgggccctcgggttctacccagcagaaatcaccctcacctggcaaagagatggggaagagcagactcaagacacggaactggtagaaacccggcctgctggagatggcacgttccaaaagtgggccgcagttgtggtgccaagtggtgaggagcagaggtatacatgccacgtccaacacgaagggctcccacagcctcttatccttcggtgggagcagtccccccaaccaaccatccccatcgtcggcattgtggcaggattggttgtgctgggggcagtcgtcactggcgcagtggtcgccgctgtcatgtggcgcaagaaaagcagcgaccgcaatagagggagttacagccaagcagccgtttag

SEQ ID NO: 51359 - DNA, 1017 bp, Artificial Sequence
  Description of Artificial Sequence: Synthetic coding sequence
atggccccacgctcccttttgctgttgctcagcggagcacttgcactgacagatacatgggccggaagtcatagcctgagatacttcagtacggctgtgtcccggcctggccgaggcgagcccagatacattgccgtggagtacgtggacgacacccagtttctcagattcgactccgacgccgctatcccccgaatggagccgagagaaccgtgggttgaacaggaggggcctcaatactgggagtggaccacaggatatgccaaggctaacgctcagacggaccgtgtcgccctgcggaatctgttgcgaagatacaatcagtctgaagcaggttcacataccctgcaggggatgaatggctgcgacatgggccctgacggacgccttttacgtggatatcaccaacatgcctacgatgggaaggattatatctcgttaaacgaggatctgaggtcatggactgcagccgataccgtcgctcaaattactcagcggttttatgaggctgaggagtatgcagaagagttccgaacttacctcgaaggtgaatgcctggagctgctacgccgttatctagagaatgggaaggaaaccctgcagcgcgcagatccaccgaaggcccatgtggctcatcatccaatttctgaccacgaagccacccttcgctgctgggccctgggattctaccctgcagagatcacactcacctggcaacgcgacggagaggagcagacacaggatacagaactcgtcgaaacgcgaccagcaggtgatggcaccttccagaagtgggctgcagttgtggtgccctccggagaggaacagcgctacacttgccacgtgcagcatgagggactgcctcagccactcatcctccgctgggagcagagtccacaacccaccattcctatcgtggggattgtagcaggcctggtggtgctgggtgccgttgtgactggagccgtggttgccgctgtcatgtggaggaagaagagctcgggcaggaagggctag

SEQ ID NO: 51360 - DNA, 1260 bp, Artificial Sequence
  Description of Artificial Sequence: Synthetic coding sequence
atggctccccgaagtctgctgctgttgctgagcggcgcattggcactaactgacacatgggctggcagccactcactgaggtacttctccaccgccgtgagccgcccagggagaggggaaccaaggtacatagctgtggagccctgggtggagcaggaaggccctcaatattgggagtggacaacagggtatgctaaggctaatgctcagaccgacagagttgctctccgcaacctccttcgccgatataatcagagcgaagcaggatcccatacgcttcagggtatgaacggatgcgatatgggcccagatgggaggttgctgagagggtatcaccagcacgcatatgatggcaaagattatatctccttgaatgaagaccttaggtcgtggacagcagcagacaccgtagcgcagattacacagcgattctatgaggcagaggagtatgccgaggaattccgaacttatctggagggcgaatgtctggagctgctgagaagatatctcgaaaacggcaaagagaccctacagagggccgaccccccaaaggcgcatgtggcacaccacccgatcagcgatcatgaggctaccctgaggtgttgggctctgggattttacccagcagaaataaccctaacatggcagagggatggagaagaacagacccaggacactgaattagttgagactaggccagccggtgacggcacttttcaaaaatgggccgctgtggtcgtcccctcgggagaagagcagagatacacatgccacgtgcagcacgagggcttgccacagccactgattcttagatgggaacagagcccccagcctacaatcccaatagtagggatcgtggcaggacttgtggtgctgggcgctgtggttactggagcagtcgtggctgccgtcatgtggagaaagaagtcttctgacaggaatagaggctcttactctcaagcggcagcctactccgtagttagcgggcttctgatgattacttggtggagctctctgtttttgcttggagttctcttccagggttatctcggctgcctcagatctcattcagtcttggggaggagaaaggttggcgacatgtggatcctcttctttctgtggctttggacatccttcaacacggcctttctggcattgcaatcgctgcgattcggattcggttttaggaggggtcgctcttttttgctccgcagctggcaccacttgatgaagcgggtgcaaataaagatctttgactag

SEQ ID NO: 51361 - DNA, 1017 bp, Artificial Sequence
  Description of Artificial Sequence: Synthetic coding sequence
atggtggtgatggcgcctcgcactttgtttctgctgctcagtggcgctctgacattaactgagacatgggctggaagccactcaatgaggtacttcagcgccgcagtcagccgccctggccgaggagagccacggtttatcgctatgggctacgtagatgacacgcagtttgtgcggttcgactcagactccgcatgcccacgtatggaacctcgggctccgtgggtcgaacaggagggccctgaatattgggaggaggaaaccagaaatactaaagctcatgcacagaccgaccgcatgaatcttcagactctccgcggttattataatcagagcgaagcctctagtcataccctacagtggatgatcggttgcgacctgggttccgacggcaggttgctgagagggtacgaacagtatgcctacgatgggaaggactatctggccctgaacgaagatctgcggtcctggactgccgcagacacagcagcccagatctccaagaggaagtgcgaggccgcaaatgtcgcagaacagcggagggcttaccttgaaggtacctgcgtcgagtggctgcacaggtatctagaaaacgggaaagagatgttgcagcgggctgacccacctaagacacacgtaacacatcaccccgtgttcgactatgaggctacgctgcggtgctgggcccttggattctaccctgcagaaatcattctgacctggcagcgggacggcgaggaccagacccaggatgtcgagcttgtcgaaacccggcctgccggagatggtacctttcagaaatgggccgcagttgtcgtgccttcaggggaagagcagcggtatacttgccatgtacagcatgagggtcttcctgagccactgatgctcagatggaagcagtcctcactgccaacaatacctatcatgggaattgtggccggattggtcgtcctagctgcagttgtgaccggcgctgccgtggctgcggtactatggaggaaaaaaagttccgactag

SEQ ID NO: 51362 - DNA, 465 bp, Artificial Sequence
  Description of Artificial Sequence: Synthetic coding sequence
atggtggtcatggctccgcgaacccttttcctgttgctttcaggcgctctcacactcaccgagacttgggctggctcccatagtatgagatattttagcgccgctgtgagtcgcccaggcagaggggaacctagattcatcgccatgggttacgtggacgatacccagttcgtgagattcgattctgattccgcttgtccaaggatggaacccagggctccctgggtggagcaggagggccctgagtattgggaagaagaaactcggaacaccaaggcacatgcacagactgatcggatgaatctgcagaccctgcgcggttactataaccagtcagaggcaaagcagtcatctctgccaacaataccaatcatgggaatcgtggctggcctggtggttcttgcagcagttgtgacaggggcagcagtggccgctgtattatggcggaaaaaatcctccgactag

SEQ ID NO: 51363 - DNA, 741 bp, Artificial Sequence
  Description of Artificial Sequence: Synthetic coding sequence
atggtcgttatggcaccaaggacactatttctgctactcagtggggctcttaccctgactgagacatgggctggcagtcattccatgcggtactttagtgctgctgtgagtcggccaggcagaggagagccccgattcatagcgatgggctacgtagacgacacacagtttgttcgcttcgatagcgacagcgcttgtccacgcatggagccacgggcaccgtgggtcgagcaggagggcccagaatattgggaggaagagactagaaataccaaagcccacgcacaaacagaccggatgaatctgcaaaccctgcgagggtattataaccagtcagaagccaaccccccaaagacgcacgtgactcaccatcccgtattcgactacgaggcgactctgcgatgctgggccctggggttttatcccgctgaaatcatccttacctggcaaagagatggagaggaccaaacccaggatgtggaattagtggaaactagaccagcgggagatgggaccttccaaaaatgggccgctgtcgtggtgccgagcggggaagagcaacgctacacttgccatgtgcaacacgaaggcctccctgagccattgatgttgcgctggaaacagagctccctccccacaatccccataatgggtatcgtcgcaggcctcgtggtgcttgccgctgtggtcacaggggcagcggttgctgctgtgctgtggcgcaagaaatcctcagattag

SEQ ID NO: 51364 - DNA, 1032 bp, Artificial Sequence
  Description of Artificial Sequence: Synthetic coding sequence
atgaaaactccaagaatggtcgtcatggcacctaggacactttttctgctgctttccggagctctgacgctgaccgagacctgggcgggatcgcattccatgcggtatttctccgccgctgtctcgaggcctggaagaggggaacccagatttattgcaatgggctatgtagacgatacacagtttgtgcgttttgattctgatagcgcctgtcccagaatggaaccacgtgccccatgggtcgagcaggagggccctgaatattgggaagaggagacacgaaatacaaaggcgcacgcgcagactgaccgcatgaacctccagaccctgagaggctactacaatcaatcagaggcctccagtcacaccctacagtggatgattggttgtgacttggggtcggatggtcggcttctacggggatacgagcagtatgcttacgacggaaaagactaccttgccttaaacgaggatctccgctcctggaccgccgctgacacagccgcacagatatcaaaaaggaagtgcgaggccgctaacgtggctgaacagcggcgagcttatctggagggcacctgtgtcgagtggttacaccgctaccttgagaatggcaaggaaatgcttcagcgcgcagatccgcctaaaacacatgtgacacatcaccccgtatttgactacgaggccaccctgagatgttgggcgctcggattttaccccgctgaaatcattttaacatggcagcgagacggagaggaccagacccaagatgttgaactggttgagacaaggcctgccggagatgggacgtttcagaagtgggctgccgtggtggtacctagcggagaggagcaacggtatacctgtcatgtccagcacgagggactgcccgaaccgctgatgctcaggtggaagcagagttctctgcccactatacctatcatgggaatcgtggctggacttgtggtactcgccgcagtcgtgacgggagccgcagtagctgccgttctgtggaggaaaaagtccagcgattag

SEQ ID NO: 51365 - DNA, 1017 bp, Artificial Sequence
  Description of Artificial Sequence: Synthetic coding sequence
atggttgtaatggccccacgcactctgtttttgctgctgtctggtgctctgactctcaccgaaacatgggcagggagccattccatgcgctacttcagcgccgctgtgagtagacctgggaggggggagcctcgatttattgcgatgggctatgtagatgacacacagtttgtacgtttcgattccgattccgcatgtccaagaatggagcccagagccccatgggtagaacaggagggccctgagtactgggaagaggagacgcgcaatactaaggcacacgctcagactgacaggatgaacctccaaacactgcgcggatattacaatcagagcgaggcctcatcccatactctgcagtggatgattggttgcgacctgggttccgatgggagattacttaggggatatgaacagtacgcgtatgatggcaaggactacctggcgcttaatgaggaccttcggtcatggactgctgcagataccgccgcacagattagcaagcgaaagtgcgaagccgcaaatgtcgcagagcagaggcgcgcatatctagaaggcacatgcgtagagtggctgcataggtatcttgagaatgggaaggagatgctgcagagagcagatccacctaagacacatgtgacacaccatcccgtgtttgattatgaggccaccctcagatgctgggccctgggattctacccagctgagattattctgacttggcagagagacggggaggaccaaacccaggacgtcgagcttgtcgaaactcgacccgctggtgatggcacctttcagaagtgggctgcagttgttgttccgtccggcgaagagcagaggtacacctgtcacgtgcagcacgaggggcttcctgagcctttgatgctacggtggaaacagtcatcattgccaacaatccctatcatggggatcgtggcaggcctagtggtgttagcggctgtagttacaggggctgctgttgctgcagtgctgtggcgcaagaaatctagtgactag

SEQ ID NO: 51366 - DNA, 465 bp, Artificial Sequence
  Description of Artificial Sequence: Synthetic coding sequence
atggttgttatggcccctcgcaccctttttttgctgctctcaggcgctctcacgttgacagagacgtgggcgggaagccatagcatgcgatatttttccgccgcagtgagccggcctggccgaggcgaacctcggttcatcgcgatgggatatgtcgatgacactcagtttgtgaggtttgacagtgactcagcatgtccacggatggaacctagggccccatgggtggaacaggaaggcccagagtattgggaagaggagacgaggaatactaaagcacacgcccagactgatagaatgaacctgcagaccctcaggggttactataatcagtccgaagctaagcagtccagcctgcctactattcccattatgggaatcgtggctggccttgttgtgctggccgctgtcgtaacaggcgctgctgtggcagccgttctgtggaggaagaaaagcagcgattag

SEQ ID NO: 51367 - DNA, 741 bp, Artificial Sequence
  Description of Artificial Sequence: Synthetic coding sequence
atggtcgttatggccccaagaacactcttcttgctcctgagtggcgcactgaccctcacagaaacgtgggccggtagtcactccatgcgttacttcagtgccgctgtttctaggccaggcagaggtgagccaagattcatcgcaatgggttacgttgatgatactcagtttgtccggtttgacagtgactccgcctgcccacggatggagccccgagcaccctgggtagaacaggagggacccgagtattgggaggaggaaacaaggaacaccaaggcacacgctcagaccgatagaatgaatctgcagactcttcgcggatattacaatcagagcgaagcgaatccgccaaaaacacacgtgactcaccatcctgtgttcgattacgaggcaacactccgatgttgggccctaggcttctaccctgcagagatcatacttacatggcagagagatggtgaggaccagactcaagacgttgaactagtggaaacccgacctgccggtgatggtaccttccagaaatgggccgcagtagttgtgccctctggagaggaacagaggtacacctgtcatgtccagcacgagggcctgccagaacccctgatgctacgctggaaacagtcctcccttcctaccataccaattatgggcatcgtggcaggcttagtagtgcttgccgcagtcgtcactggggctgctgtcgccgcagtgctgtggcggaaaaagtctagtgattag

SEQ ID NO: 51368 - DNA, 1032 bp, Artificial Sequence
  Description of Artificial Sequence: Synthetic coding sequence
atgaaaacgccaagaatggttgtcatggcacctaggacactgtttcttctcctgtccggggctctgacactcacggaaacatgggcaggatctcactcaatgcgctacttctccgcggcagtgtctagacctgggaggggggaacccaggttcattgcaatgggatacgtggatgatacacagtttgttaggttcgacagcgattcagcctgtccgaggatggagcctcgagctccctgggtcgagcaggaggggcctgagtactgggaggaggagaccaggaacacaaaagctcatgcccaaacagataggatgaatctccagacattaaggggctattataaccaatccgaggctagttctcatacgctgcagtggatgatcgggtgtgatctggggagcgatggcagactgcttcgaggctacgagcaatatgcctatgatggaaaagactatctcgcgctgaatgaggatctgcgaagttggacggccgcagacaccgctgcccagatctcaaagcgaaaatgcgaggcagccaatgtggctgaacagcgtcgcgcttacttggaaggtacatgcgttgagtggctccatcggtacctggagaacggaaaagaaatgttgcagcgcgcagatccccctaaaactcacgtcacacaccacccggtgttcgactatgaagcgacgctgcgctgttgggccctcggattttaccctgccgagattattctcacatggcagcgggacggggaggatcagactcaggatgtggaactggtcgagacacggccagctggggatggtacatttcaaaagtgggccgcagtggtagtgcccagcggggaagagcagagatacacttgccacgtgcagcacgagggattgccagagcctctaatgttgcgatggaagcagtcaagcctgcccactattcctataatgggcatagtagctggactggtagtcttggcagcagtggtaaccggagccgctgtggccgcagttctgtggcggaaaaaaagctcagattag

SEQ ID NO: 51369 - DNA, 1032 bp, Artificial Sequence
  Description of Artificial Sequence: Synthetic coding sequence
atgaagactccgagaatggttgtgatggcaccacggaccctgtttctcttactgtccggggctttgactcttacagagacttgggctggtagccactctatgcggtatttcagcgccgctgtgtcacgacccggtagaggcgagcccaggtttattgctatgggatacgtggacgatactcagttcgtgaggtttgattccgatagtgcctgtcctaggatggagcctcgcgctccatgggttgaacaggaaggccctgagtactgggaagaagaaacccggaataccaaagcacacgctcagacagaccgcatgaacctccaaaccctgagaggctattacaatcagagtgaagcctctagtcatacccttcagtggatgattggctgtgacctaggttccgatggcagacttctgcgcggatacgaacagtatgcttacgatggcaaggactatctggcgcttaatgaagaccttcgcagctggacggctgcagacactgcagcccagatctccaaacgcaagtgcgaagccgcaaatgtcgcggaacagaggcgggcttatctcgagggtacgtgcgtggaatggctgcacagataccttgagaacggcaaggagatgttacaacgggcagacccacccaaaacacacgtgacgcatcacccagtcttcgattacgaagccacattacgctgctgggccttgggattctacccggcagaaattatcctcacttggcaacgggacggggaggatcagacacaagacgtggagctcgtggaaaccaggcccgcaggtgatggaacctttcagaaatgggcagcagtggtggtgccttccggcgaggaacagcgttatacttgtcatgtccagcacgagggcttgcccgaacccttgatgttaaggtggaaacaatcgagccttccaactataccaatcatgggaattgtggcgggactcgtcgtgctggcggctgtagtcacaggcgctgctgtggcagctgtgctctggcgcaagaagtcaagcgattag

SEQ ID NO: 51370 - DNA, 741 bp, Artificial Sequence
  Description of Artificial Sequence: Synthetic coding sequence
atggtggttatggctccacggaccctcttcttgttgcttagcggcgctttaaccctgaccgaaacgtgggctggcagtcactcaatgcggtacttttccgcggctgtcagtcgtcctggtcgtggggaaccaagattcatagcgatggggtacgtcgatgacacccaatttgtgcggttcgactctgatagtgcgtgcccaaggatggaaccgcgagctccttgggtggagcaggagggaccggagtactgggaagaagagacacgcaataccaaagcccacgcccagaccgaccgtatgaacctccagacactgcggggttattataatcaaagcgaggctaatccaccgaagacccacgtcacccatcatccggtgttcgactacgaagctaccctacgatgttgggcgcttggcttttatccagccgagataatcctgacttggcagcgagatggggaggatcagacccaggacgttgagttagtggaaacgagaccggcaggtgatgggaccttccagaagtgggctgcggttgtggttccgagtggagaggagcagaggtacacttgccacgtccagcacgaggggctccctgaacctctgatgctgaggtggaaacaaagctcactgccgaccatccccattatgggtattgtggcaggcttagtggtactggctgcagtcgtaaccggggcagccgtggccgctgtgctatggaggaagaagtcatccgactag

SEQ ID NO: 51371 - DNA, 465 bp, Artificial Sequence
  Description of Artificial Sequence: Synthetic coding sequence
atggtcgtgatggccccacgcactctgttcctcctcctatccggcgcacttactcttaccgagacttgggccggatcacactccatgaggtacttcagtgctgctgtgtctagacctgggcgtggggagcccagatttatcgccatgggttacgtggacgatacccagttcgttagatttgattctgacagcgcttgcccgcgaatggagccacgagcaccctgggtggagcaggaggggccagaatactgggaagaagagacaagaaataccaaggctcacgctcagaccgaccggatgaacttacagacactgcggggttattataatcagtccgaagctaagcagagctctctgccaaccatccctattatgggcattgtggcaggtctcgtggtgttagcggctgttgtcactggcgcagcagtggccgcagtgctgtggcgcaaaaaatccagcgattag

SEQ ID NO: 51372 - DNA, 1032 bp, Artificial Sequence
  Description of Artificial Sequence: Synthetic coding sequence
atgaaaaccccgcgaatggtggttatggctccacgaaccctgttcttgttactcagcggagcccttacactgactgagacctgggccggatcacattccatgcgatacttttctgctgccgtgtcccggcctggacgaggcgagcctagattcattgccatgggatacgtggacgatacacagttcgtgaggtttgactcagatagtgcctgcccacgcatggagcctcgcgctccttgggtcgaacaggagggcccagagtactgggaagaggagacccgcaacacaaaagcacacgcgcagactgatagaatgaatctgcaaaccttgaggggctattacaaccagtctgaagcaagttcccataccttacagtggatgattggttgtgacctgggctcagatgggaggttgctgcgcggttatgaacagtatgcgtacgatggcaaggactacctggctcttaatgaggatttgcgtagctggaccgcagccgacaccgctgcccagatctccaaacggaagtgcgaggcggcaaacgtggcagagcagaggcgagcttacttggaagggacctgtgtcgagtggctgcaccggtatctggaaaacggtaaagagatgcttcagagagccgacccaccaaaaactcacgtcacccaccaccccgtcttcgactacgaggctaccctacgctgttgggctcttggtttttaccccgctgaaatcattctcacttggcagagggatggcgaggatcagacacaggacgtggaactggttgagactcgccctgccggtgacggaacctttcaaaagtgggcagccgtggttgtaccgtcaggggaggaacagcggtatacctgccacgtccaacatgagggcctgcccgaaccactgatgctgagatggaagcagtcttcccttccgaccatcccaatcatgggtatcgtggccggtctggtggtcctagccgcagtcgtaaccggagccgcagtagcagcggttttgtggcgcaaaaagtcaagcgattag

SEQ ID NO: 51373 - DNA, 1032 bp, Artificial Sequence
  Description of Artificial Sequence: Synthetic coding sequence
atgaagactccacggatggttgtgatggcaccacgtactctctttctcctgctgtccggcgcactgaccctgacagaaacctgggctggatctcactcgatgcgttatttcagcgccgctgtctctagacccggaagaggggaaccaaggttcattgcaatggggtacgtggacgatactcagtttgtgaggttcgattctgatagcgcctgtcccagaatggaacctcgcgcaccttgggtcgaacaagagggcccagaatactgggaggaagagacaagaaacacaaaagcacacgcgcagactgatagaatgaacctgcaaactctgagaggatactataaccaaagcgaggccagttcccatactctgcaatggatgatcggatgtgacctggggagtgacggtcgcttgctgaggggctacgaacagtacgcatacgatggtaaagactacctagcgttaaatgaggaccttaggtcttggaccgctgccgatacggccgcacagattagcaagcggaagtgtgaagccgcaaacgttgcagaacagcggagggcctacctggagggcacttgcgtagagtggctgcatagatacttagaaaatgggaaggaaatgctgcagcgcgcagaccctcccaagacccatgtcacccaccaccctgtctttgactacgaggccacccttagatgctgggcactaggtttctacccagcagaaatcattttgacttggcaacgagatggggaggaccagactcaggatgtagagttggttgagacgagacccgctggggacgggaccttccaaaagtgggcagccgtagtcgtgccctctggagaagagcagcggtacacctgccatgtgcagcatgagggtctcccagaacccctgatgctccgttggaaacaatccagtctgcccacaattccaattatggggattgtcgctgggctggtggtcctggccgctgtagtgacaggagccgctgtggccgcagtgctgtggagaaaaaagtcatcagattag

SEQ ID NO: 51374 - DNA, 1017 bp, Artificial Sequence
  Description of Artificial Sequence: Synthetic coding sequence
atggtggtgatggcgcctagaacactgttcttgctgctgagcggtgctcttaccctgactgaaacatgggccggatcccactccatgaggtatttctctgcggcagtgagccgtccaggcaggggtgaaccaagatttattgccatggggtatgtggatgacacccaatttgtgcgttttgactcggactccgcatgccctcgcatggaaccacgcgctccttgggtggaacaggaaggtcccgagtattgggaggaggagacgcgcaataccaaagctcacgctcagaccgataggatgaacctgcagaccctacgcggatactataaccagtctgaagcctcaagtcacaccctgcagtggatgatcgggtgcgacctaggttctgatggcaggctgctaaggggctatgagcaatatgcctacgatggaaaggattacctcgcactgaacgaagacctgcgcagttggaccgccgcagatactgcggcacagatttcaaagcggaagtgcgaagcggcaaatgtcgccgagcagcggagagcctatcttgagggaacttgtgtggagtggttgcaccgatacctcgagaacggaaaggaaatgctacagcgcgctgaccctcctaagacgcacgttactcatcatcccgttttcgattacgaggccacactgaggtgttgggcactgggtttctaccctgcagaaatcatcttgacttggcaaagggatggagaggaccagacacaggacgtggagctggtggaaacgcgacccgcaggcgacggcacattccagaagtgggccgcagtggtggtcccttccggagaagagcaacggtatacatgtcacgttcagcacgaggggctgcccgagccgctgatgctaagatggaagcaatccagcctgcccacaatccctattatgggcattgtcgctggactcgtcgtgctggccgctgttgtgacaggggctgccgttgcggctgtgctgtggaggaagaaaagctccgattag

SEQ ID NO: 51375 - DNA, 1017 bp, Artificial Sequence
  Description of Artificial Sequence: Synthetic coding sequence
atggtcgtcatggctccaagaaccctcttcttactgttaagcggagcccttacccttaccgaaacgtgggccggttcgcacagcatgcggtacttctccgctgcagtgagcagaccaggacgcggtgaacctagatttatcgcaatgggatacgtggatgacacgcaattcgtaagattcgattctgactctgcatgccccagaatggagcctagggctccttgggtagagcaggagggacccgagtattgggaagaggagacacgcaatacaaaagctcacgcacagaccgaccggatgaatctgcagaccctgcggggatattataaccagtccgaggcgtccagccacacactgcagtggatgatcggctgcgatctggggtccgatggcagactgctgcggggatacgagcagtacgcctacgacgggaaggattacttggccctgaacgaggacttgcgctcgtggacagcagcggacaccgccgctcaaataagcaagcgaaagtgcgaagcagccaatgtggcggaacaacgccgagcttatctcgaaggaacttgtgtcgagtggctgcatcggtatctggaaaacggtaaagagatgctgcagcgagctgatcctcctaaaacacacgtgacacaccacccagtgttcgactacgaagctacactccgatgttgggctctgggattctatcccgcagagatcatcctcacctggcaaagagatggcgaggaccagacccaggatgtggagcttgtggagacccggccagccggagatggcacattccaaaagtgggcggctgtggtggtcccgtcaggggaagagcaaaggtacacatgtcatgtccaacatgaaggcctacctgaaccgctgatgttaagatggaaacaatccagcttgcccaccatccccatcatgggcatagtggctggattagtggtccttgccgcagtggtcactggtgccgctgtcgcagccgtcttgtggcgcaaaaagagtagtgattag

SEQ ID NO: 51376 - DNA, 741 bp, Artificial Sequence
  Description of Artificial Sequence: Synthetic coding sequence
atggtggtcatggccccacggaccctctttctgttactgagcggagccctgacgctaactgagacttgggccggatcacacagtatgcggtacttctctgcagcggtaagcaggccgggaagaggtgagcctcgctttatcgccatgggctacgtggatgacacccagtttgtccgattcgactctgactcagcctgcccaagaatggagcctcgagcgccttgggtggagcaggagggcccagaatattgggaagaagaaacccgcaatacaaaagcccatgctcagaccgacagaatgaatctccaaaccctgagaggatactataatcagtccgaggcaaatccgccaaaaacacatgtgactcatcatcctgttttcgactatgaggctaccctccggtgctgggccctgggattttaccctgccgaaataattctcacgtggcagcgagatggtgaggaccagactcaagacgtggaactcgtggaaaccagaccagctggcgatggaaccttccaaaagtgggcagcggtggttgtcccttcaggggaagagcaaagatacacgtgtcatgtgcaacacgaggggcttcctgagccacttatgctgagatggaaacaaagcagcctgccgaccattccgattatgggcattgttgccggactggtcgtgctagcggcagttgtcaccggggctgctgttgcggctgtcttgtggaggaaaaagtcttccgactag

SEQ ID NO: 51377 - DNA, 1017 bp, Artificial Sequence
  Description of Artificial Sequence: Synthetic coding sequence
atggtggtcatggccccaagaacactttttcttctattgtctggtgctctcactttaaccgaaacttgggcagggtcacactccatgcgctatttcagtgctgcagtatcaaggccaggccgaggagagcccagatttatcgcaatgggctatgttgatgacacccagtttgtgagatttgacagcgatagtgcatgccctcgaatggagccaagagctccatgggtggaacaggagggccctgagtattgggaagaggagacacgaaacactaaggcacacgcccagacggatcgtatgaaccttcagactctgcgcggatactataatcagtcagaggcttcatctcacactctgcagtggatgattggatgcgacctgggtagcgatggcagattgttgaggggctatgagcagtatgcctacgacggcaaggattatcttgcactgaatgaagacctcaggtcctggactgcagctgacactgctgcccagataagtaaaaggaagtgcgaggctgctaacgtggccgaacagcggagagcgtatctggagggaacctgcgtcgagtggctacacaggtatttagaaaacggcaaggaaatgctgcagcgggcagaccccccaaaaacccacgttacgcaccatcccgtgtttgactatgaagctacactgcggtgttgggctctaggtttttatcctgccgagataattttaacgtggcagagggacggcgaggatcagacccaggatgtcgagctggtggaaacccgccctgccggagacggaacctttcagaaatgggccgctgtcgtggtcccttctggagaggagcaacggtacacttgtcacgtgcagcacgaaggattgccagaacctctcatgctgcgatggaaacagtcctctctccctactatacccatcatgggaatcgtcgccggacttgtggtgttagcggctgtggtcactggagcagctgtggctgctgtgctgtggcgaaaaaaatcctcagactag

SEQ ID NO: 51378 - DNA, 1017 bp, Artificial Sequence
  Description of Artificial Sequence: Synthetic coding sequence
atggtggtgatggccccaaggactctgttcctactgctcagtggggctttaacccttactgaaacatgggcaggatctcactccatgcggtacttttctgctgcagtgtcccgcccagggcgaggggagccccgattcatcgccatgggttatgtggatgatacacaatttgttcgctttgacagcgactccgcgtgcccaaggatggagccaagagctccgtgggtggagcaggaggggccagagtattgggaggaggagactcggaatacgaaagcccatgcacagacggatcgcatgaacctccagacgttaagagggtactacaatcagtctgaggcctcatcacatacactacaatggatgataggctgtgacctgggcagtgatgggaggctcctgagagggtacgaacagtatgcctacgacggaaaagactacctcgccctcaacgaggacctccggtcgtggactgcagccgatacagcagctcagatctccaagcggaaatgcgaggcagctaacgtcgctgagcagcgcagggcttacctcgaaggtacctgtgtcgagtggctccaccggtatctcgaaaacggcaaggagatgctgcagcgtgccgatccgcctaagacccacgtcacccatcaccccgtttttgattatgaagcaacacttcggtgctgggccctgggcttttaccctgcagagatcatcctcacttggcaacgggatggagaggatcagacgcaggacgtcgagctagtggaaactcggccagccggtgacgggacatttcagaagtgggcagccgtggttgtgccttccggagaagagcagagatatacatgtcacgttcaacatgagggtttgcctgagcctctcatgctccgctggaagcaatccagtctgcctacaattcctatcatgggcatcgttgctggattggtcgttctggccgcagttgtcacaggcgctgctgtggcggctgttctgtggaggaaaaaatctagtgactag

SEQ ID NO: 51379 - DNA, 465 bp, Artificial Sequence
  Description of Artificial Sequence: Synthetic coding sequence
atggtagttatggcccctcgaactctgtttttgcttctgtccggcgctctcacattgaccgagacttgggctggcagccactcaatgcgctatttttctgctgctgtgtctagacccggaaggggtgagcccaggtttatagcgatgggatacgtcgacgatacacagttcgtgcgttttgatagtgacagcgcatgcccacgaatggaaccaagagcgccatgggtcgaacaggagggtcccgagtactgggaggaagagactaggaacaccaaggctcacgcacaaaccgatcggatgaatctgcagactcttagaggttactacaatcagtccgaggctaagcagagctccctcccgaccattccaatcatggggatcgtcgcgggtctggtggtgcttgcggcagtggtaacaggagcagcagtggctgcagtcctgtggagaaagaagagctctgactag

SEQ ID NO: 51380 - DNA, 741 bp, Artificial Sequence
  Description of Artificial Sequence: Synthetic coding sequence
atggttgtgatggcaccacggacactcttcctgctcttaagcggcgcactaacgctcacggaaacctgggcaggaagccattctatgcgctatttctctgcagcagtgagccgcccagggcgtggggagcccaggttcatcgctatgggttacgtggatgatactcagtttgtgcgcttcgatagtgatagcgcatgcccaaggatggagcccagggcaccatgggtggaacaggagggacctgagtactgggaagaagaaactaggaatacaaaagcccacgcccaaacggatcgcatgaatcttcagacgctgcgcggttattataaccaaagcgaagctaatccccctaagacacatgtaactcatcacccagtcttcgattacgaagctaccttgcgctgttgggccctgggattttatcccgctgaaatcattctgacttggcaacgagatggagaggaccagacacaagatgtcgaactggtggagacccggcctgctggagatggcacgttccagaaatgggcggctgtagtggtgcctagcggggaggaacagaggtacacatgccacgttcagcacgaaggtctgcccgaacctttgatgctgaggtggaagcagagtagtcttccgactatcccgatcatgggcattgtggccggacttgtggtgctggcagcagtggtcacaggagccgcagtggctgcagttctctggcgtaagaaaagttctgattag

SEQ ID NO: 51381 - DNA, 1032 bp, Artificial Sequence
  Description of Artificial Sequence: Synthetic coding sequence
atgaagacacctaggatggtcgtgatggctcctaggactctctttctgctgctgtccggggcactgacactcaccgagacctgggcagggtcccatagcatgaggtatttctcagctgctgtgagcagacccggtaggggcgagcccagatttatcgcaatgggatatgtggacgacacccaattcgtgagattcgactctgatagcgcatgtccacgcatggaacctcgtgccccatgggtggaacaggagggtcctgagtactgggaagaggaaactaggaacactaaagcccatgcccaaactgatagaatgaatctgcaaaccctcagggggtactacaatcagtctgaggccagctcccacacccttcaatggatgattggctgtgacctgggatccgatggacggctgctccgtggttacgaacaatacgcgtacgatgggaaagattatttggcgcttaacgaagacctgcgtagttggacagcagctgacactgctgcacaaatctctaaacgcaagtgcgaggcagcaaacgtcgctgagcagagacgggcttacctggagggaacctgcgtggaatggctgcatcgttatcttgaaaacggcaaagaaatgctgcaacgggctgatcctcccaagacccacgtgacccatcaccccgtgtttgactatgaagcgacgttgcggtgctgggccctgggcttttacccagccgagattatcctgacatggcagcgggatggcgaagatcagacacaggacgtagagctggtggagacacggcctgccggagacggcaccttccaaaagtgggcagctgtcgttgtgcctagcggagaggagcagcggtatacgtgccacgtccagcacgagggcttgccagagcccctgatgctaaggtggaagcagtccagtctgcccactatcccaatcatgggaatcgtggctggcctggtggtgcttgccgctgttgtcactggtgccgctgtcgctgctgtactgtggcgcaagaaatcttcagattag

SEQ ID NO: 51382 - DNA, 741 bp, Artificial Sequence
  Description of Artificial Sequence: Synthetic coding sequence
atggtagtgatggctccccgaacactgtttctgttactgtccggtgctctgacactcacggagacttgggccggaagtcactctatgcggtacttttccgcagctgtgagtaggcctggaagaggagaacctcggttcatcgccatgggatatgtggatgacacccaattcgtacgatttgactctgacagtgcatgtccaaggatggagcccagagcgccttgggtggaacaagagggcccagaatactgggaggaagagaccaggaacaccaaagcccacgctcagacagacaggatgaatctgcagacattaaggggctactataaccagagcgaggctaatcctcccaaaacccacgtcactcatcaccccgtgtttgactacgaggccacgctgcgatgttgggccctgggcttttaccccgcagagattattctcacttggcaaagagacggggaagatcagactcaagacgtggagttagtggagacaagaccagcaggggacggaacattccagaaatgggcagccgtagtggtgccatctggagaagagcagagatatacttgccatgttcagcatgagggcctgcccgaaccactgatgctgaggtggaagcaatccagccttcctacaattcccataatgggcattgtagcaggactggtcgtgcttgctgctgtggttactggcgctgcagtggccgcagtgctttggcggaagaaaagcagcgactag

SEQ ID NO: 51383 - DNA, 1017 bp, Artificial Sequence
  Description of Artificial Sequence: Synthetic coding sequence
atggtggtcatggccccaaggactctgtttctcttattatctggggctctaaccctgacagagacatgggccggttcacatagcatgagatacttctcagccgctgtgtctcggccagggaggggcgaaccgaggttcattgccatggggtatgttgatgacactcaattcgtgcgttttgactctgactctgcctgtccccgtatggagcccagagctccttgggtcgagcaggaggggcctgaatattgggaggaggaaactagaaatactaaggctcacgcgcaaactgaccgaatgaatctccagaccctgcgaggttattataaccaatccgaagctagcagccatactctgcagtggatgatcggttgcgatctcggaagtgatgggaggctgttacggggttacgaacagtacgcatacgatggaaaagattacctggctttgaatgaggatcttcggagttggactgctgccgacaccgcagcgcaaatctccaaacgcaagtgtgaggccgcaaacgtggccgaacaacgacgggcatatctggaaggtacctgtgtggaatggctgcacagatatttggagaacggaaaagaaatgttgcagagggcagacccaccaaagacacacgtgacccatcacccggtgttcgattatgaagccacattacgttgctgggcactgggtttctatccggctgagatcatacttacttggcagcgtgatggggaagatcaaacacaggacgtcgaacttgtcgagacaagacccgcaggggatgggacatttcagaagtgggcggctgtggtggtgccttcaggggaagaacagaggtacacctgtcatgtccagcacgaaggactgcccgaacctttaatgctgaggtggaagcagtctagtcttccaactatccctattatgggcatcgttgccggacttgtggtcttggcagccgtcgtgaccggagccgctgtcgccgctgtcttgtggaggaaaaaaagttcagactag

SEQ ID NO: 51384 - DNA, 465 bp, Artificial Sequence
  Description of Artificial Sequence: Synthetic coding sequence
atggtggttatggccccacgtaccttatttctcctgctgtctggtgctctcaccttaacagagacctgggctggttctcacagcatgcggtatttttctgcggcagtgagtagaccagggaggggcgaaccgaggtttatagccatgggctacgtcgatgacacacagttcgtccgcttcgactctgactcggcatgccctcggatggaacctagggctccttgggtggagcaagaagggccagagtattgggaagaagaaacacgcaacactaaggcgcacgcacagactgatcgcatgaacctgcagacgctgcggggatattataaccaatcagaagccaagcagagttcactaccaacaatccctatcatgggcattgtggctgggctggtcgtccttgccgctgtggttaccggggctgctgttgcagccgtgctttggagaaagaaatcatcggactag

SEQ ID NO: 51385 - DNA, 465 bp, Artificial Sequence
  Description of Artificial Sequence: Synthetic coding sequence
atggtggtgatggcccctcgcactctgttcctcctgttatcaggagcactcaccctcaccgagacatgggccggtagtcacagcatgcggtacttctccgcggctgttagccggcctggccgaggtgagccgaggttcatcgccatgggatatgtggatgatacgcaattcgtcagattcgactcagattccgcttgtcccaggatggaacccagggctccttgggtagagcaggaaggccctgaatactgggaagaagagactcgcaacaccaaagcacacgcccagaccgatcgtatgaatctccagaccttgcgcggttattacaatcaatccgaagccaagcagagcagcctaccgacaattcctatcatgggcatcgtggctgggctagtggtgctggctgccgttgtcaccggcgctgcagttgccgctgttctctggcgtaagaaaagttcagactag

SEQ ID NO: 51386 - DNA, 1017 bp, Artificial Sequence
  Description of Artificial Sequence: Synthetic coding sequence
atggtggtaatggccccaagaacactttttcttctgctgtcaggcgcactgacactcactgaaacatgggcaggatcacacagtatgcggtatttttcggctgcagttagcagacccggtcgtggtgagccacgctttatcgcaatgggatatgttgacgacacacagtttgtgaggttcgattctgattccgcttgtccaaggatggagccaagagcaccctgggttgaacaggagggaccagagtactgggaagaggaaactcgtaatacaaaagctcacgcccagacagaccggatgaatcttcagacactgagggggtattacaatcagtctgaagcatctagtcatacactccagtggatgataggatgtgacctcggatccgacggtcggctgttgaggggctatgagcagtacgcttacgacggaaaggattacttagcactcaatgaagatctcaggtcttggacagccgcagacacagctgcgcaaatttctaagcgcaagtgcgaagccgcaaatgtggccgagcagaggcgagcctaccttgaaggaacgtgtgtggaatggctgcaccggtatctggaaaacggcaaggaaatgctgcaacgggcagatcctccgaagactcacgtcacccaccatcctgtctttgattacgaggccacactaagatgttgggccctcggattttaccccgcagagatcatactgacctggcaaagggacggcgaggaccagacgcaagatgtggaactcgtagaaacccggcctgccggtgatgggacattccaaaaatgggcagccgttgtggtcccgtcgggggaagagcagcgttacacatgccatgtccagcatgaggggcttcccgagcctctgatgttgcgctggaaacagtcttccttgccaacaattccaatcatgggcattgtggcaggactggtggtcctagctgcagtggtaactggggctgctgtggccgctgtactctggcggaagaaatcatccgactag

SEQ ID NO: 51387 - DNA, 1032 bp, Artificial Sequence
  Description of Artificial Sequence: Synthetic coding sequence
atgaaaaccccaaggatggtggtgatggcgcctcgcaccttattccttttgctttccggtgccttgacattaaccgagacctgggccggaagccactccatgcgctatttttccgctgcagtgagtaggccgggaagaggggagcctcgctttatcgcgatgggctacgtagacgacacgcagttcgtgcgctttgacagtgattccgcgtgccccagaatggagccccgtgctccctgggtggagcaagagggccctgaatactgggaggaggagactaggaatacaaaggcccacgcacagaccgatagaatgaaccttcaaaccctccggggttactacaaccaaagtgaggcctcttctcatactttacagtggatgatcgggtgcgacctgggcagtgacgggcgactgctaagaggctatgagcagtatgcctatgatgggaaggattacctcgccctcaatgaagaccttcgcagctggactgccgctgataccgccgctcagatcagtaagaggaaatgtgaagctgccaacgtggcagagcagagacgcgcttatctggagggaacatgtgtggagtggctgcatcggtacctggaaaatggaaaagaaatgctgcagcgagcggatccacccaagacccatgtgactcaccatccagtgttcgactacgaggcaaccctgaggtgctgggccctaggattctatcccgcagagattatattaacatggcagcgcgacggtgaagaccagacacaagatgtggagctggtggaaaccagacctgccggtgacggtactttccagaagtgggccgctgttgtggtgccgtccggcgaggaacagaggtatacttgtcacgtgcaacacgaaggattgccagagcccttaatgttgcgctggaagcagagttcactgccaaccatacctattatgggaatcgttgcgggtctcgttgtcctggctgctgtcgtcaccggagcagcagtggctgctgtgctgtggcggaaaaaaagttcggattag

SEQ ID NO: 51388 - DNA, 741 bp, Artificial Sequence
  Description of Artificial Sequence: Synthetic coding sequence
atggttgtgatggcccctaggaccctctttctgctgttgtcaggggcactgactctgacggaaacttgggcgggaagccactccatgagatatttctctgccgcagtgtcgagacctggtcggggtgagcctcgcttcattgccatgggatatgtggatgacacacagtttgtaagattcgattccgatagcgcttgtccgaggatggagcctagagctccttgggtagaacaggaagggcctgaatactgggaagaagagacacggaacacaaaagcacacgctcagacagaccggatgaaccttcagactctgcgaggctactacaaccagtccgaagctaacccaccgaaaacccatgtgactcaccatcctgtgtttgattatgaagctaccctgcgctgttgggccctcggattctaccctgccgaaatcatcctaacctggcaacgcgacggagaggatcagacacaagatgtcgagctggtcgagactaggcctgccggagatggcaccttccagaagtgggccgctgttgtggtgccctctggggaggaacaaagatacacatgtcacgttcagcatgagggactacccgagcccctaatgttgcgctggaaacagtcaagccttcctactatacccattatgggaatcgttgccggactagttgttcttgcagcggtggtgaccggtgccgctgtcgcagctgtgttgtggagaaaaaaaagttccgattag

SEQ ID NO: 51389 - DNA, 741 bp, Artificial Sequence
  Description of Artificial Sequence: Synthetic coding sequence
atggtagtgatggcgccacggaccctgttcctgctattaagcggcgcacttactctcacagagacttgggctgggagtcactctatgcgctatttttctgcagcagtatcacggcctgggagaggagagcccagattcattgctatgggttacgtcgacgacacccaattcgttaggttcgacagtgacagtgcatgccccaggatggaaccacgagccccttgggtagagcaggaaggacccgagtattgggaagaagagacacggaacaccaaggcccatgcgcagactgataggatgaacttacaaactttaagaggatactataaccagagcgaagcaaatccccctaaaacacacgtgacccatcaccccgtgttcgactatgaggctacgcttaggtgctgggcgctgggattttatcctgccgaaatcatcctgacttggcaacgagacggcgaagaccagactcaggacgtcgaattagtggaaacccgtccagctggagacggcacttttcagaagtgggcagctgttgtggtcccgagtggggaggagcaaaggtacacctgccatgtccaacacgaaggcctgcctgagcctttaatgctgagatggaagcagtcctcgctacctactatccccatcatgggaatcgtggccggtctcgtagtgctggcagcggtggttacaggcgctgcagtggccgctgtgctgtggaggaaaaaaagttcagattag

SEQ ID NO: 51390 - DNA, 465 bp, Artificial Sequence
  Description of Artificial Sequence: Synthetic coding sequence
atggttgttatggctccacggactttattcctccttctttcaggcgctctgaccctgacagagacgtgggcaggaagtcactccatgcgctatttctcagcggcagtctctcgccctgggagaggagagccccgtttcattgcaatgggatatgtagatgacacccagtttgttcgcttcgattccgattctgcctgcccccgaatggaaccacgggctccatgggtggagcaggaaggaccagagtactgggaagaggagactcggaacaccaaggcgcatgcgcagacagatcggatgaacctacagaccctacggggatactacaatcaatccgaagctaaacagtctagtctcccgaccatccccattatgggcattgtggctggacttgtggtcctcgccgcagtggtgacaggagccgctgtcgccgcagtactctggcgcaagaaaagctccgattag

SEQ ID NO: 51391 - DNA, 741 bp, Artificial Sequence
  Description of Artificial Sequence: Synthetic coding sequence
atggtcgtgatggctccacgaacgttgttcctcctgctgagtggcgctctcactttaactgagacatgggctggatctcactcaatgcgctatttttctgcggctgtaagcagacccggaaggggggagcccagatttatcgcgatgggatacgtcgacgatacccaatttgttcgctttgactccgacagcgcttgcccgagaatggaacccagggccccatgggtggagcaagaaggccctgagtactgggaggaggagacacgcaatacaaaggcgcacgcccagacagatcgcatgaatttacagactttgcggggttattacaatcagtcagaggcaaaccccccaaaaacccatgtaacacaccaccccgtattcgattacgaggccacccttcgctgctgggccctagggttctaccctgccgagattatcctgacttggcaaagagacggggaagatcagacccaggacgtggaattagtggagacgagacccgctggcgacggaacctttcagaagtgggcagctgttgtagtgccgtctggagaggaacagaggtatacatgccatgtgcaacatgagggtttgccagagcctctgatgctgcgctggaaacagtccagcctccccaccatccccatcatggggatagttgccggactggtcgtcttagctgccgtggttacaggcgcagccgtcgctgccgttctgtggagaaagaaaagtagtgactag

SEQ ID NO: 51392 - DNA, 741 bp, Artificial Sequence
  Description of Artificial Sequence: Synthetic coding sequence
atggttgtaatggctcccagaacactgttccttctcctctcaggcgcacttacactcactgagacatgggccggttcacacagcatgagatacttttcagccgctgtgagccgacctgggagaggggagcccagatttatcgcaatgggatatgtggacgatacacagttcgtgaggttcgactccgactctgcctgcccgagaatggagcccagagccccatgggttgaacaggaagggcctgagtattgggaggaagagacgcgcaatacaaaggcacacgcacagaccgacaggatgaacctgcagacacttagggggtactacaatcagtccgaagcaaacccacccaagacccacgtcacccatcaccctgtgttcgactatgaggctactttacggtgttgggccctgggattctaccccgcagagattatcttaacctggcagcgggacggggaggaccaaactcaggatgtcgagctggtagaaacacgccctgccggagacggcaccttccagaagtgggccgctgtcgtggtgcctagcggggaagagcagcggtacacctgccacgtacaacatgaagggcttcctgaacccttgatgctccgttggaaacagtcttctctaccaacaatcccaatcatgggtattgtggcaggtcttgtagtcctcgccgcagtcgtaactggggctgccgtggccgctgttctttggaggaaaaagtcctctgactag

SEQ ID NO: 51393 - DNA, 741 bp, Artificial Sequence
  Description of Artificial Sequence: Synthetic coding sequence
atggtcgttatggccccacgaacgctctttctcctgttgtccggagccttaaccctaactgagacatgggctgggtcccactcaatgaggtacttttccgcagcagttagccgtccgggaagaggcgagcctcgtttcatcgccatgggctatgtggatgacactcagtttgttcgttttgatagcgacagcgcatgcccccgaatggaaccaagggcgccatgggtagaacaggagggccctgagtattgggaggaggagacccggaacactaaagcccatgcacaaaccgaccgaatgaatcttcagacattgagaggatactacaatcaatccgaagccaatccaccgaaaacacacgtgactcaccaccccgtgttcgattacgaggcaaccctgcgatgttgggccttagggttttatccagccgagatcattcttacctggcagagagatggcgaggatcaaactcaggatgttgagctcgtggagactcggcctgccggtgacggcacgttccagaagtgggcagcagttgtagtgcctagtggtgaagaacagcgttatacctgtcacgtgcagcatgagggtttacccgaaccacttatgcttagatggaagcagagttcactcccgaccatccccatcatgggaatcgtggcgggactcgttgtgttagctgcggtggtcactggtgctgcagtcgctgctgttctttggcgaaaaaaatcatctgattag

SEQ ID NO: 51394 - DNA, 741 bp, Artificial Sequence
  Description of Artificial Sequence: Synthetic coding sequence
atggttgtgatggcgcctcgcactctgttcctgcttctttctggcgcactcacgcttaccgagacatgggcaggaagtcattcgatgcggtatttttcagctgccgtgagccgcccaggaaggggggagccccgtttcatagccatgggatatgtggatgacacccagttcgtgcgctttgattctgactcagcttgtccccgtatggagccgcgagctccatgggtggaacaagaggggcctgagtattgggaagaggaaactcgtaataccaaggctcacgcccaaactgatcggatgaacttacagaccctgagaggctactacaaccagtccgaagcaaaccccccaaagacacatgttactcaccacccagtttttgattatgaggccacgctccgctgttgggcgctgggtttttacccagccgaaattatcctgacctggcaaagggacggtgaggatcaaacccaggacgtcgagctggtcgaaactagaccggcaggagacgggaccttccagaaatgggccgctgtcgtcgtgccaagcggagaggagcagcggtatacttgtcacgtacagcacgaaggcctgcccgaaccgctgatgctccgctggaagcagtcctcactgcctacaatcccgataatgggaatagtggcagggctagtagtgctagcggcagtggttaccggagccgctgtggcggctgtgctgtggcggaaaaagagcagtgattag

SEQ ID NO: 51395 - DNA, 741 bp, Artificial Sequence
  Description of Artificial Sequence: Synthetic coding sequence
atggtcgttatggcccctcgaacattgttcctgctgctatccggagccctgaccctgacagaaacgtgggcagggtcccattcaatgcggtatttctccgccgcagtgtcccggcctggcagaggtgaacccagattcatagccatgggttatgtcgacgatacacagtttgtcagatttgatagtgattctgcctgccctagaatggagccgagggccccatgggttgaacaggaagggccagaatactgggaggaggagactaggaacaccaaagcacacgctcagaccgatcgcatgaatttgcagacacttaggggctactacaaccagagcgaagccaaccctccgaaaactcacgtgacccatcatccagtcttcgattatgaagctaccctgagatgctgggcccttggcttttatccagctgaaatcatattgacctggcaaagggatggggaagatcagactcaggacgttgaactggtggaaacgaggccagcgggagatggaacattccagaagtgggcagcggttgtcgtcccatcaggtgaagaacagcgttacacatgccatgtacaacacgaaggtcttccagaacccctgatgttacgatggaaacagtcttctctgcccactatccccatcatgggcatcgtggccggtctggtggttctggcagccgtggtgaccggggctgcggtcgccgctgtgctctggaggaaaaagtccagcgactag

SEQ ID NO: 51396 - DNA, 741 bp, Artificial Sequence
  Description of Artificial Sequence: Synthetic coding sequence
atggtagtgatggctccgaggacactattcctactgctctcaggcgctttgaccctgaccgaaacatgggccggtagccactcaatgcgttactttagtgccgcagttagccgccctgggaggggtgaacctcgctttatagcaatgggctacgtggatgacactcagttcgtccgatttgactctgactccgcatgccctaggatggaaccaagggccccatgggtagagcaggagggccctgagtattgggaagaagagacgcggaatacaaaggcacacgcccagaccgaccggatgaatcttcaaaccttgcgaggttattataatcagagcgaggccaacccgcctaaaactcacgtcacacaccacccagtgttcgattacgaggcgactctgcggtgttgggcacttgggttttaccccgctgaaattatccttacttggcagcgcgatggggaggatcagacccaggacgttgaactggtcgaaacaaggcctgccggtgacgggacattccagaaatgggccgctgtggtggtcccttctggggaagagcaaagatatacatgccacgtgcagcatgagggccttccagagcctctcatgcttcgctggaaacagtccagtttgcctacaatacctattatgggaatcgtcgctggcctcgtggtgctcgccgcagtagtcacaggggcagctgtcgccgctgttctttggcggaaaaaatctagcgattag

SEQ ID NO: 51397 - DNA, 1017 bp, Artificial Sequence
  Description of Artificial Sequence: Synthetic coding sequence
atggttgtgatggcccctcggactctgttcctcctactcagcggtgctctaacattgaccgaaacatgggctggcagtcactctatgcgctatttctcggctgcagtgtctcgccctggcaggggagagcctcggtttatagcaatgggatacgtcgacgatacgcagttcgtgcggtttgattctgactcggcctgcccaaggatggaacctagggcaccctgggttgaacaggaaggaccggagtattgggaagaggaaactcgcaatactaaggcccatgcccaaacagacagaatgaatctgcagactttgaggggatattataaccagtccgaagcctcctctcacactctgcaatggatgatcggatgcgacctgggctcagatggaaggctcctaagagggtacgaacagtatgcatacgatggcaaggactacctcgctctgaacgaggatctgcgctcatggaccgcggcagataccgccgcacagatctcaaaaagaaagtgtgaagcagcaaatgttgccgaacagcgccgagcctatctcgagggcacatgtgtggagtggctgcaccgctacctggagaatgggaaagagatgttacaacgggcagatccacccaaaacacacgtgactcaccaccccgtcttcgactatgaagctactctcaggtgttgggctctgggcttctatccagcggaaatcatcctcacttggcagagggatggagaggatcagacacaggatgtcgaactggttgagacccggcctgccggagacgggacattccagaagtgggctgcagtcgtagtcccatctggcgaggagcagcgctatacttgccacgtccagcacgagggactcccggagcccttgatgctgcggtggaaacagagttctctgcccaccatcccgatcatgggcatcgtggccggactggtggtgctcgcggctgtggttacaggtgctgccgtcgctgctgtgctctggaggaagaagtccagcgactag

SEQ ID NO: 51398 - DNA, 1017 bp, Artificial Sequence
  Description of Artificial Sequence: Synthetic coding sequence
atggtggtgatggccccacggacactgtttctcctactgagcggagcattgacactcaccgaaacatgggccggtagccatagcatgcgctatttttctgccgctgtgagccgtccgggaaggggtgaaccccgattcattgcaatgggctacgtggacgacactcagttcgtgcggttcgacagtgactcagcttgcccccgtatggaacctcgcgcaccttgggtggaacaggaaggacctgagtattgggaagaagaaacacgcaatacaaaggcacacgcacagacagacaggatgaacttgcagaccctgaggggctactacaaccagtccgaggcgtctagtcacacccttcagtggatgattgggtgcgaccttggatccgacggtagactcctaagagggtatgaacagtatgcctacgacggcaaagattatttggcactgaacgaggacctgcgcagctggacggcagcggatacggctgcccagatctctaaacgcaaatgcgaggctgcaaatgtagccgaacagcgtcgcgcatacttggagggaacgtgcgtggaatggcttcaccgataccttgaaaacgggaaggagatgctgcagcgcgctgatccccctaaaacccacgtgacccaccaccctgtttttgattacgaggccaccctgcggtgctgggctttgggcttctaccccgctgagatcattctgacttggcagagagacggagaggaccagactcaagacgtagagctggtagaaactagacccgctggagacggtacattccaaaagtgggcggctgtggtagttccttctggcgaggagcaaagatatacatgtcacgtccagcacgagggtcttccagaacccttgatgctaagatggaagcagtcatccctgcctactataccaattatgggcatcgtggccggacttgtggtgcttgccgcagtcgtcactggagcagccgtcgccgcagtcctctggcgcaaaaagtcatctgactag

SEQ ID NO: 51399 - DNA, 1017 bp, Artificial Sequence
  Description of Artificial Sequence: Synthetic coding sequence
atggtagtgatggcaccaagaacattatttctgttactgagtggcgcactcacgctcacagaaacctgggctggctcccattcaatgaggtactttagcgctgccgtgtcccgtccagggagaggagaacccagattcatcgccatgggctatgttgacgatactcagtttgtgagatttgattccgactcagcttgtccacgcatggaacccagagctccctgggtggaacaggagggcccagagtactgggaggaggagacccgcaatactaaggcacacgctcagacggatagaatgaaccttcagacacttcggggatactacaaccagagcgaagcgagcagccatacactacagtggatgatcggctgtgacctgggtagcgacggacgcttacttcgtgggtacgagcagtacgcttatgatggcaaagattatctggcactgaacgaagatttaaggtcttggacagcagcagacacagcagcgcagatctcaaagaggaaatgtgaagcggcaaacgtggctgagcagcgacgggcttatctcgagggaacttgcgtggaatggttgcatcgctatcttgagaacggcaaggagatgctccagcgggctgacccccctaaaacccacgtaacacaccaccctgtgtttgattacgaagccactcttaggtgctgggccttaggcttctatccggcagaaatcatcctgacctggcaaagagacggagaagaccagacacaggacgtcgaactggtagagactagaccagccggagacggcacattccagaaatgggccgcagttgtagtgccatctggcgaggagcagaggtatacctgccacgtacaacatgagggcctccccgagcccctaatgctgaggtggaaacagtcttccctgccgactattcccattatggggattgttgccggtctggtggtactggccgcagtagtcacgggagcagcagtggccgctgtcctttggaggaaaaagagctcagattag

SEQ ID NO: 51400 - DNA, 1017 bp, Artificial Sequence
  Description of Artificial Sequence: Synthetic coding sequence
atggttgttatggcgcctaggacactgtttctgcttctaagtggggcactcaccttaactgagacttgggcgggttctcactccatgagatactttagtgctgctgtttcgagacccggacgcggagagcccaggttcatcgccatggggtatgtggatgacactcaatttgtgcgcttcgattcagactccgcctgtcctcgcatggaaccccgagcaccatgggtggagcaggaggggccagaatactgggaggaggaaacacgcaatacaaaggcccatgcacagactgaccgcatgaacctgcagaccctccgaggttactacaatcagtccgaggcctcaagccacacacttcagtggatgatagggtgcgatctgggttccgacggcaggctgctgcgaggatacgagcagtacgcatacgacggaaaggactatctggcccttaacgaggacctgcgatcatggaccgcagcggatacagcagctcagatatctaagcggaaatgtgaagcggctaatgtcgcagaacagcggagggcctacctggaaggtacttgtgtggagtggcttcatcgctacctggagaatggcaaagagatgttacagcgggctgacccaccaaagactcatgtgacccatcaccccgtgtttgattacgaagctactctccgatgctgggcactgggattttacccagccgagataattctcacctggcagagggatggtgaggaccagacccaggatgtggagctagtagaaacccggcctgccggagatggaacgtttcagaaatgggcggctgtggtggtgccttcgggcgaagaacagcgctacacctgtcacgtacaacatgagggacttcctgagcctcttatgctgagatggaagcagtccagcctccccaccatcccaatcatgggtatagtggctgggctagtggtgctggcagctgttgttacaggcgctgccgtggccgcagtattgtggaggaagaagtcatctgactag

SEQ ID NO: 51401 - DNA, 1017 bp, Artificial Sequence
  Description of Artificial Sequence: Synthetic coding sequence
atggtggttatggctcccagaacattgttccttctcctttccggcgctctaactctcaccgaaacctgggctggaagccatagcatgcggtactttagtgccgctgtttctagacccggtcgcggagagcccaggttcatcgccatgggatatgtggatgacacgcaatttgtgaggtttgactctgatagtgcatgccccaggatggaaccacgtgccccatgggtagaacaagaaggtcccgaatattgggaagaagaaaccagaaatacaaaagcacatgcccaaacggaccgtatgaatctccaaaccctccgcggttactataaccagtccgaggctagtagtcacacccttcagtggatgattgggtgtgacctcggcagcgatggtcggctcttgagaggctacgagcagtatgcctacgacggcaaagactacctagctctaaatgaggacttgagatcatggacagccgcagacacagcagcacagattagcaagcgcaaatgcgaggccgctaacgtcgctgagcaacgcagggcctacctggagggaacttgtgttgagtggcttcatcggtacctggagaatggcaaggagatgctgcagcgcgcagaccccccaaaaacccacgtaacgcatcatcctgttttcgattacgaggccaccctcaggtgttgggccctcgggttttatccagccgaaatcatcctgacatggcaacgagacggggaagatcaaacgcaggacgtggaactcgtggaaaccagaccagccggagatggcacttttcagaaatgggcagctgtcgttgtgccatcaggagaagagcagaggtatacctgtcacgtgcagcacgaggggctgcccgaaccactaatgctgcggtggaaacagtcttcgctcccgacaattcccattatgggcatagtcgccggtctcgtggtcctcgccgcagttgtgacgggggcagctgtggcggcagtcctatggaggaaaaagagcagtgactag

SEQ ID NO: 51402 - DNA, 1017 bp, Artificial Sequence
  Description of Artificial Sequence: Synthetic coding sequence
atggtggtgatggcacctagaactttgtttctgctcttatccggggcactcacgctcacggaaacgtgggccggtagccatagcatgcggtatttctctgccgctgtgagtcggcctggtagaggcgaacctagattcattgcaatgggctatgtagacgatacccaattcgtgaggtttgactcagattcagcctgcccacggatggagcctagggccccatgggtcgaacaggaaggccctgaatactgggaggaggagacacggaacacgaaggcccacgcacaaaccgatcgaatgaacttgcagacgcttcgcggttactacaatcaatcggaagcctcctcccacaccctgcaatggatgatagggtgcgacctgggctctgatggccgtcttctccggggttacgagcaatacgcttatgatggaaaggattatcttgcattgaacgaggacttgagatcctggaccgcagctgatacagccgcacagatatcaaaacgaaaatgcgaagcggctaacgttgccgagcaaaggcgagcctatcttgagggaacatgcgttgagtggttgcacaggtatctagagaacggtaaggagatgttgcagagggcagacccacctaaaacgcacgttacccaccaccctgtcttcgactatgaggcgactttgaggtgctgggcacttggcttttacccagctgaaattattctcacctggcagagggacggggaagatcaaacacaggacgttgagctggtggaaactagacctgcgggtgatgggactttccagaaatgggcggctgtggtggtcccttccggtgaggagcagaggtatacgtgtcacgtgcagcatgaaggactgcctgaacctctgatgttacgctggaaacagtcctcactgcccaccatccccattatgggcatcgtcgctgggctggtggtcctggctgccgttgtgacaggggctgccgtggctgcagtgttatggagaaagaagagttctgattag

SEQ ID NO: 51403 - DNA, 372 bp, Artificial Sequence
  Description of Artificial Sequence: Synthetic coding sequence
atgggccatgagcagatgttgcctctcctctggctgctgccccatagttgggccgttccagaagctccaacgccaatgtggccagacgatctgcagaaccatactttcctgcacactgtgtattgccaagacggcagcccatctgttggcttgtcagaagcctacgacgaggaccagctgttttttttcgactttagccagaacactcgcgtgcctcgcctgcctgagttcgcagattgggctcaggagcagggtgacgcaccggcaatcctgttcgataaggaattctgcgagtggatgattcagcaaatcggacctaagctggacggcaaaattcccgtcagcagaggccaggagttttccggggagtag

SEQ ID NO: 51404 - DNA, 786 bp, Artificial Sequence
  Description of Artificial Sequence: Synthetic coding sequence
atgggccacgaacagaaccagggggctgctctactacagatgctcccattgctatggttactgcctcattcctgggccgtgccagaggcacccacccccatgtggccagacgacctgcagaatcacaccttcttgcacaccgtgtattgccaggacggctctccctctgtcggactgagcgaagcctatgatgaagatcagctgtttttttttgacttttcacaaaacacaagagtgccgcgacttcccgaattcgcagactgggcacaggaacagggagatgctcctgccatcttgttcgataaggagttctgcgagtggatgatccagcagatcgggccaaaactggatgggaagatcccggtatctagagggtttccgattgctgaggttttcactcttaagcccctcgagtttgggaaacccaacacgctcgtttgttttgtgtccaatttgttccccccaatgctcaccgtgaactggcaacatcattcggtacctgtggaagggttcggacccacatttgtttccgccgtggatgggctgtctttccaggcattctcttatctgaactttactcccgaacccagtgatatattcagctgtatcgtgacccatgagatagacaggtatactgctatcgcctactgggttcctagaaatgcgctgccttctgatctgctggagaacgtgctgtgtggcgtggcctttggcctgggggtcctggggattatcgttggcatcgttcttataatctattttaggaagccttgtagtggcgattag

SEQ ID NO: 51405 - DNA, 684 bp, Artificial Sequence
  Description of Artificial Sequence: Synthetic coding sequence
atgggccacgagcaaaaccagggcgctgcccttctccagatgcttccattgctctggctcttgccacatagttgggctgtgccagaagcacctactcctatgtggcccgatgacctgcagaaccacaccttccttcatacagtttactgccaggatggatctcccagcgtaggactgagcgaggcttacgatgaagatcaactgttcttttttgatttctcgcagaatacccgtgtccctcgactccctgaattcgcagactgggcacaagaacagggcgatgcccctgccatcctgttcgataaggagttctgcgaatggatgattcaacaaattggtccaaagctagacggcaagatcccagtttctcgagttaactggcagcaccactccgtcccggtggaaggctttgggccaacctttgtatctgccgtggacggcttatcgtttcaagcattttcctatttgaactttaccccagagccctccgacatttttagttgcatcgtcacccatgagatcgatcgttacaccgccatagcctattgggtccctcgtaacgcactcccatctgatctgcttgagaacgtcctctgtggagtggcatttggacttggcgtgctggggattatcgtcggcatcgtgctgattatatattttaggaaaccatgttcaggagactag

SEQ ID NO: 51406 - DNA, 501 bp, Artificial Sequence
  Description of Artificial Sequence: Synthetic coding sequence
atgggccatgaacaaaaccagggcgcagcactgctgcaaatgctccccctgttgtggttgttgccccacagttgggctgtaccggaaggattccctattgcggaggtgtttaccctcaagccgctcgagtttggaaaacccaatacactggtctgtttcgtgtccaacctgttccctcccatgctgacagtcaattggcagcaccattcggtgcctgtagagggcttcggtccaacctttgtgtctgcagtggatggattgagcttccaggccttttcctacctcaacttcacaccagagccttctgacatcttttcttgtattgttacccacgaaatcgatcgctacactgccatcgcctactgggttcccagaaatgcattgccctcagacctacttgagaatgttctctgcggcgtggcgttcggcttgggcgtgctcggtatcatcgtgggcatagtgctaattatttacttccgaaagccttgttcgggtgattag

SEQ ID NO: 51407 - DNA, 786 bp, Artificial Sequence
  Description of Artificial Sequence: Synthetic coding sequence
atgggtcacgagcagaaccagggagctgcactgctccaaatgctcccactcctgtggctcctcccccacagttgggctgtgcctgaggcccctacacccatgtggcccgatgacttgcagaatcatacttttttacacacagtgtactgtcaagatggctcaccaagcgtcggcctgtccgaagcttacgacgaggatcagttgttcttttttgacttttctcagaataccagagttccccgactacccgagttcgctgactgggctcaggagcagggtgatgcgcctgctatcttgtttgataaagagttctgcgagtggatgatccagcagatcgggcctaaactcgatgggaagatccctgtgtcccgcggatttccaattgctgaggtgttcactctgaagcccctcgagttcggcaagcccaacacacttgtctgtttcgtgtccaatctgttccctcctatgctgaccgtcaactggcaacatcattctgtccccgtggaaggattcgggccaactttcgtgtcagcagtagatgggctgtcttttcaggccttctcctacctaaatttcacaccagagcctagtgatatattttcatgcattgtgacacatgagatcgacagatacaccgccatagcctattgggtgccacgaaacgctttgcccagcgacctgttagagaatgtgttgtgtggtgtagcattcggccttggagttctaggcatcatcgtgggtatcgtactcataatatatttcagaaaaccatgttcgggcgactag

SEQ ID NO: 51408 - DNA, 684 bp, Artificial Sequence
  Description of Artificial Sequence: Synthetic coding sequence
atgggccacgagcagaatcagggcgcagcccttctgcagatgctacctctcctgtggttactccctcattcttgggctgttcccgaggcaccgacccccatgtggccggacgacctgcagaaccatacttttctgcatactgtgtattgccaagatggcagtccttccgtggggctaagtgaggcttacgacgaagatcaattattttttttcgatttttcccagaatactagagttcctcgcctgcccgagtttgctgactgggcccaagaacagggagatgctccagcgatcctctttgacaaggagttttgtgaatggatgatccaacagattggtcctaaactcgatggaaagataccggtgtcaagagtgaattggcagcaccattccgtacccgtcgaaggttttggccctacgtttgtgtcagccgtggatggtctgagtttccaggctttttcatatctaaactttacccctgagccaagtgacatttttagttgcattgtaactcatgaaatcgaccgttacaccgctattgcatactgggtgccacggaacgcccttccctccgaccttctggaaaacgttctctgcggagtggcttttggtctgggcgtgctgggaattatcgtcggtattgtgctgataatctattttcgcaaaccctgcagcggcgattag

SEQ ID NO: 51409 - DNA, 501 bp, Artificial Sequence
  Description of Artificial Sequence: Synthetic coding sequence
atgggtcatgagcagaatcagggggctgctctcctgcagatgttgccgctcctgtggctccttccacactcatgggccgtccctgaggggtttcccatcgcggaggtgtttaccctgaaacccctggaattcggaaagcccaacaccctcgtttgctttgtgagtaacctattccctccaatgctaacggtgaactggcaacaccactctgtcccagtggaagggttcgggccaacattcgtatcagctgtcgatggtctgtcattccaggcattttcttacctaaactttaccccagaaccctccgacattttcagctgtatcgtcactcacgaaatagaccgatacaccgccattgcatattgggtgcctcggaacgccctgccgtctgatcttctggagaacgttctgtgcggcgtcgccttcggcttgggagtgctaggcataattgttggcatcgttctgatcatctacttccgaaagccttgtagcggcgattag

SEQ ID NO: 51410 - DNA, 726 bp, Artificial Sequence
  Description of Artificial Sequence: Synthetic coding sequence
atgaaatggctgaagaaatgcctggacactgcacccacgcccatgtggccagacgatcttcaaaaccatacattcctgcacacagtgtattgccaagatgggtcaccatcggttggtctttctgaggcctatgacgaggatcagctgttctttttcgattttagtcagaacacaagggtgccacgccttccagaattcgctgactgggctcaggaacagggggatgcccctgcaattttgttcgataaagagttctgtgaatggatgatccaacagatcggtcctaaactggacggcaagattcccgtgagccgagggtttccgatagccgaggtatttaccctgaagcccctagagtttggtaagccaaacactttggtgtgttttgtgagtaacctgttcccccctatgctgacagttaattggcagcatcattctgttcctgtagaaggctttggaccaacattcgtgtccgccgtggacggtctctcctttcaagccttctcctatcttaatttcacccccgaaccaagcgacatcttctcttgcatcgtcacccacgagatcgaccgttacacagcaattgcatattgggtgcctcgcaacgcgcttccttccgacttactcgaaaatgtgctgtgcggggtggctttcggtcttggcgtcttggggatcattgtcgggatagtcttgattatctattttcggaaaccttgctccggatag

SEQ ID NO: 51411 - DNA, 510 bp, Artificial Sequence
  Description of Artificial Sequence: Synthetic coding sequence
atgtggcctgatgatctgcaaaatcacaccttcctgcacacagtttactgccaagatggcagcccaagtgtgggcttgtccgaagcatatgatgaagatcagctgtttttctttgacttctcccagaatacgagggttcctcgactgccagagttcgcagactgggcgcaggagcaaggcgatgccccagcgatcctcttcgataaggagttctgtgagtggatgattcagcagatcggtcccaagctggatggaaaaatcccggtgagccggggatttccaatagccgaagtgttcaccttaaagccactggaatttgggaagccaaatacgctcgtgtgctttgtgtccaatctcttcccacccatgcttaccgtgaattggcagcaccactctgtccccgtggaggggtttggcccaactttcgtgtctgcggtggacgggctgagcttccaggctttttcttacctaaactttaccccagaaccgtccgatatattctcctgctag

SEQ ID NO: 51412 - DNA, 873 bp, Artificial Sequence
  Description of Artificial Sequence: Synthetic coding sequence
gtgtcctgctggttgagtgattcttgccaagaactgcagcgcagaggcatcattctctgctcatatggggtgacgtccccaatcgctgtgtttggccgacccggtagattgaggaacaggcgccactttgagcgaagacttgtcccaatgaaatggctgaaaaagtgcttggatactgcaccaactccaatgtggcccgacgatttacagaaccatacattcctccacacggtctactgtcaggacggcagcccatcggtcggcctcagcgaagcatacgatgaggaccagttgtttttcttcgatttctcccagaacactcgcgtccctcggctcccagaatttgccgactgggcccaggagcagggggacgctcctgctatcctgtttgataaggagttttgtgaatggatgattcagcagatcgggcctaagctggacggaaaaattccagtttctaggggcttcccaatcgcagaagtattcaccttgaagccgcttgaatttggtaaacccaataccctcgtatgtttcgtgagtaaccttttcccgcctatgctgaccgtaaactggcagcaccacagcgttcctgtggaggggttcggacccaccttcgtatctgctgtggatggtctgtcctttcaggcattcagctatctgaacttcacccctgagccgtccgacattttttcatgtatcgtgacccatgaaatcgatcgctacacggccatcgcctactgggtacctcgaaatgccttaccatctgatctgctcgaaaatgtcttatgcggagtggccttcggccttggcgtcctgggaatcattgtgggcattgtcttaataatatacttcaggaagccctgctcgggatag

SEQ ID NO: 51413 - DNA, 510 bp, Artificial Sequence
  Description of Artificial Sequence: Synthetic coding sequence
atgtggcctgatgatctccagaaccacaccttcctgcacaccgtatactgtcaagacggatccccctccgtcggactgtccgaagcctatgatgaggatcaactgttcttttttgattttagccagaacactcgggtgcctcgactgccggaatttgcggattgggcccaggagcagggagacgcacctgccattctgttcgataaagaattttgcgagtggatgattcaacaaataggccctaagctggatgggaaaataccagtctccaggggttttcctatcgctgaagtgttcactttaaagccgttagaattcggtaaaccaaacaccctcgtttgttttgtgagcaacttatttcccccaatgttgacagtcaactggcagcatcacagcgtgcctgttgaaggctttggcccaaccttcgtttccgccgttgacggcctttctttccaggcctttagttaccttaatttcactccagaaccttccgacatttttagttgctag

SEQ ID NO: 51414 - DNA, 684 bp, Artificial Sequence
  Description of Artificial Sequence: Synthetic coding sequence
atgggccacgagcaaaaccagggggctgctcttctccagatgttacccttgctctggctcctgccacactcctgggcggtacccgaggcccctacacccatgtggccagatgacctgcagaatcatacttttctgcacaccgtgtattgtcaggatggtagcccttccgttggcctttcagaggcctatgacgaggatcagctgtttttttttgatttctcccaaaacaccagggtgcctcgtttgcctgagttcgccgactgggcccaggagcagggcgatgcccctgcaatcctgtttgacaaggaattttgcgaatggatgattcaacaaataggacctaagttggatgggaagatcccggtgtctagagtcaactggcagcaccacagcgtccccgtggagggattcgggcctaccttcgtaagtgccgtggacgggctgagcttccaggcatttagttacctgaacttcaccccagaacccagcgacatcttttcctgtatcgtgacgcacgagattgaccggtacactgcaattgcttactgggtaccacggaatgctctcccaagcgatctacttgagaacgtgctgtgtggggttgcttttggccttggcgtgctgggaatcatcgtagggattgtgctgatcatttatttccggaagccgtgctcgggggattag

SEQ ID NO: 51415 - DNA, 510 bp, Artificial Sequence
  Description of Artificial Sequence: Synthetic coding sequence
atgtggccagatgatttgcaaaatcatacctttttgcacactgtgtactgtcaagatggatccccatccgtcggcctctctgaggcttatgatgaagaccaattattctttttcgattttagtcagaatacacgggtccctcgtctgcctgaatttgcagactgggctcaggagcagggggacgcacccgctattctgttcgacaaagagttttgtgaatggatgattcagcagataggaccaaagctggacggcaagatccccgtgtctagaggttttccaattgcagaagtatttaccctgaagccgctcgagttcggaaagcccaacactctggtgtgctttgtgagcaatctgttcccccctatgttaactgttaattggcagcatcatagtgtgccagtggaaggcttcggacccacatttgtctctgccgtggatggcctgagcttccaagctttcagttatctaaactttacacccgagccgtctgacatcttttcgtgttag

SEQ ID NO: 51416 - DNA, 501 bp, Artificial Sequence
  Description of Artificial Sequence: Synthetic coding sequence
atgggacatgaacagaatcaaggagccgcactgctgcagatgctgccactcctctggcttctgccacattcttgggcagtgcccgaaggctttccaatagcggaagtctttaccctgaaacccttagaattcggcaagcctaacactctggtgtgttttgtctctaacttgttcccaccgatgcttaccgttaattggcagcaccactcagtgcctgtggagggcttcggcccaactttcgtgtccgccgtcgacggtctgagcttccaggccttctcgtacctgaactttacccctgaaccaagtgacatcttctcctgcatcgtcacacatgagattgaccggtacaccgccattgcttactgggtgccacgaaacgcgctaccctccgacttgttggagaacgtgttgtgtggggttgcatttgggctgggcgtgctagggatcatagtgggaattgtactcataatctattttagaaagccttgttccggtgactag

SEQ ID NO: 51417 - DNA, 684 bp, Artificial Sequence
  Description of Artificial Sequence: Synthetic coding sequence
atgggccacgagcagaaccagggtgcagcattgctccaaatgctgcctttgctgtggttacttcctcacagttgggctgtccctgaggccccaacgcccatgtggccagatgacctgcagaaccacacctttctacatacagtgtactgtcaggacggttccccctccgtaggcctttccgaagcttacgatgaggatcagttattttttttcgatttctctcagaacacgcgggtccccagactgcctgaattcgccgattgggctcaggaacaaggggacgcacccgctattcttttcgacaaagaattctgcgagtggatgatccagcagattgggccaaaacttgacgggaagattcccgtgtctagggtgaactggcaacaccacagcattccagtcgagggcttcggtccaacctttgtgagtgccgtcgatggtttgtcctttcaggctttttcatacctgaattttactcctgagcccagtgatatcttcagttgcatcgtgactcatgaaatagacagatatacagccatcgcctattgggttcctcggaatgcactgccaagtgaccttctggagaatgtcctttgcggagtagccttcggcctcggagtgcttggaatcattgtgggaatcgttctgatcatatacttccgcaagccctgcagcggggactag

SEQ ID NO: 51418 - DNA, 873 bp, Artificial Sequence
  Description of Artificial Sequence: Synthetic coding sequence
gtgtcatgctggttaagcgactcttgccaggagcttcagaggcggggaattattctatgcagttatggtgttacctcacccatagccgtgttcggccgtcccggaaggctgcgcaatcgtaggcactttgagcggcgtctggttcctatgaagtggctgaagaaatgcctggatacagctcccacacccatgtggcccgacgatctccaaaatcacactttcctgcacaccgtgtactgtcaggacggcagcccgtcggtaggtctctcagaagcctatgacgaagatcaactgttcttcttcgactttagccagaatacgcgcgtacccaggctgcctgaatttgctgattgggctcaggagcagggcgacgccccagcaatattgttcgataaggagttctgtgaatggatgattcaacaaataggcccaaagcttgatggtaaaattccagtctcccgaggattccccattgctgaggtgtttacattaaaacccctcgagttcggtaaaccaaacactctggtttgtttcgtctcaaatttgtttccaccaatgttgactgttaactggcagcaccatagtgtgcccgttgaaggcttcggtcctactttcgtgagcgccgtggacggacttagcttccaagcatttagctatctcaacttcacgcctgaaccatctgacatattcagttgtatcgtcacccatgagattgacaggtataccgctattgcctactgggtgcctagaaacgctctccccagcgacctgctggaaaatgtgctgtgtggcgtcgccttcggtctcggggtactgggtatcatagtaggaatcgttctgattatttacttccgaaagccttgctctggctag

SEQ ID NO: 51419 - DNA, 510 bp, Artificial Sequence
  Description of Artificial Sequence: Synthetic coding sequence
atgtggcccgatgatctgcagaaccacactttccttcatacagtatactgtcaggacggctcaccaagcgtcggcctttcagaggcctacgacgaggaccagctatttttctttgatttcagtcaaaacactagggtgcctcgcctgccagaattcgcggattgggcacaagaacagggagatgcaccggctatcctgttcgacaaagagttctgcgaatggatgattcagcaaattggccctaagctggacggcaaaattcctgtgtctcgcggttttcctatagccgaagtattcacgctgaaacctctggagttcggaaagcccaacactttggtatgcttcgtaagcaacctcttcccccctatgctgactgtaaattggcagcatcactccgtgcctgtggaaggctttggtcccacattcgtgagcgcagtggacggcctaagtttccaggccttctcatatctcaacttcacgcccgagccttccgatatttttagttgctag

SEQ ID NO: 51420 - DNA, 510 bp, Artificial Sequence
  Description of Artificial Sequence: Synthetic coding sequence
atgtggccagacgacctccaaaaccacactttcctgcacaccgtgtactgccaggacggttctccgtccgtgggtctgagcgaagcctatgacgaggaccagctgtttttctttgacttttctcaaaacacaagggttcctcggctacctgaatttgctgattgggctcaggagcagggggatgcgccagccatccttttcgacaaggagttttgtgagtggatgatccagcaaataggcccaaaactagacgggaaaatccctgtcagtcggggattcccaatcgcggaggtgttcacattgaagcctctggagtttggaaagcccaacaccctggtgtgtttcgttagtaacctgtttccccctatgctgactgttaactggcagcaccacagcgtgcctgtcgagggattcggcccaactttcgtatctgccgtggacgggctctcattccaggcatttagttatttaaattttacccccgagcccagcgatatattcagctgctag

SEQ ID NO: 51421 - DNA, 684 bp, Artificial Sequence
  Description of Artificial Sequence: Synthetic coding sequence
atggggcatgagcagaaccagggcgcagctctcctgcagatgcttcctcttttgtggttactgcctcattcatgggcggtccccgaggctcctactccaatgtggcccgacgacttgcagaaccacacatttctgcacaccgtctattgccaggatggcagtcctagtgtgggtttgagcgaagcttatgatgaggatcagttattcttctttgacttcagtcaaaatacccgcgttcccagactccctgagttcgcagactgggcacaagagcagggcgatgcccctgccatccttttcgataaggaattctgtgaatggatgatccaacagattggcccaaaactcgacgggaagattccagtgtctcgggttaattggcagcatcactccgttccagtggaaggcttcggtcccacttttgtgtcagctgttgatggccttagcttccaggctttcagctatctcaattttacgccagaaccatccgacatattcagttgtattgtcacgcacgagatcgaccgatatacggcaatcgcctactgggttccgaggaatgcgctccctagtgacctactggagaatgtgctgtgtggcgtagcattcggccttggggtactgggcatcatagtcggcattgtgctgattatttatttccgaaagccctgcagtggggactag

SEQ ID NO: 51422 - DNA, 873 bp, Artificial Sequence
  Description of Artificial Sequence: Synthetic coding sequence
gtatcctgttggttgagcgatagctgtcaggagttgcagaggcggggtataattctgtgttcatatggcgtgaccagccccatagccgtgtttgggaggccagggcgactgaggaatcggaggcacttcgagaggcggcttgtccctatgaagtggctgaagaagtgcctcgatactgccccaacgccgatgtggccggatgatctgcagaaccatactttcttacataccgtgtattgtcaggatgggtcaccatctgtgggactatctgaggcgtacgacgaggatcagctcttctttttcgacttcagccagaacacccgcgtgcccaggctacccgagttcgccgactgggcccaggagcagggcgatgcccctgcaatcctattcgacaaggagttttgtgagtggatgattcaacaaatcggcccaaaactagatggaaaaatacccgtttccagggggttcccaatcgccgaagtgttcaccctaaagcccctggagtttggaaagcccaacactctagtttgtttcgtctctaatctgtttcccccaatgcttactgttaattggcagcaccacagtgtgcctgtcgagggcttcggacccacctttgtgtccgccgtcgatgggctgtctttccaggcctttagttacttgaacttcacaccagaaccatcggacattttcagttgtatcgtaacccacgaaatagataggtatacagctattgcctactgggtgccccgtaacgcactgcccagtgatctgctggagaacgtgctgtgtggggtagccttcgggctaggtgtgcttggcatcatcgtgggaatcgtactgataatttatttccgcaagccctgttcagggtag

SEQ ID NO: 51423 - DNA, 786 bp, Artificial Sequence
  Description of Artificial Sequence: Synthetic coding sequence
atgggccacgaacagaaccagggcgctgctctgctccaaatgctccccctcctgtggttgctcccgcattcatgggcagtgccggaggcccctacccccatgtggccagacgatctgcagaatcacaccttcctgcacacagtgtattgtcaggacgggtcaccttcagtgggcctgtcagaagcgtatgacgaggaccagctgttcttcttcgatttttcgcagaacactagggtaccccgactcccggaatttgcagattgggcccaggagcagggcgatgctcctgcaatcctgttcgataaggaattttgcgagtggatgattcagcagatcggaccgaagctggacggcaagataccagtcagtaggggcttcccaatagccgaagtcttcacgctgaagcccctggaattcggtaaaccaaacaccctcgtgtgtttcgtttccaaccttttccccccaatgctcaccgtcaactggcagcaccactcagttccggttgagggcttcggccctacctttgtcagtgcagtggacggactatccttccaggctttcagctatctgaatttcacgcccgagccctctgatattttctcctgtatagttactcatgagatcgaccggtacacagctatcgcatactgggtgcctagaaacgctcttcccagtgacctcctggagaatgtactttgcggagttgccttcgggctgggagtgctgggcattatagtaggcatcgtgcttatcatctattttaggaagccatgctctggggattag

SEQ ID NO: 51424 - DNA, 501 bp, Artificial Sequence
  Description of Artificial Sequence: Synthetic coding sequence
atggggcacgaacagaaccagggggcagccctattgcagatgctccccctgttgtggctcctcccacacagctgggcagtcccagaaggattcccgattgccgaagtctttacactcaagccactggaattcggtaagcccaacaccctcgtgtgctttgtgagcaatctgttccctccaatgctgacggttaactggcagcaccattcggtgccggtcgagggcttcggaccaaccttcgtctcagcagttgacggtttgagcttccaagccttttcgtacctgaatttcactccagagccttctgatatatttagttgcattgtgacgcacgaaattgatcgctatactgctattgcctactgggtgccgcgtaatgcactgccctctgacctactagagaatgtactttgtggggtggctttcggactgggtgtgctggggatcatcgtgggaatcgttctgatcatttactttaggaagccgtgctccggcgattag

SEQ ID NO: 51425 - DNA, 510 bp, Artificial Sequence
  Description of Artificial Sequence: Synthetic coding sequence
atgtggcctgatgatctgcagaatcacaccttcttacacaccgtgtactgccaggacggttcaccttccgtgggcctatctgaggcctatgatgaggatcagctcttttttttcgacttctctcagaacacacgggtgcctaggcttcctgagttcgctgattgggctcaggagcagggcgacgcaccagcaatactctttgataaggagttctgcgaatggatgatccagcagatcggacccaagttggacggcaagattccggtatccagagggtttcccattgccgaggtgtttacactcaaacctctggagtttgggaagcctaacactctggtttgcttcgtgtcgaatctgttcccccctatgctgaccgtaaattggcaacaccactccgtacccgtggaggggttcggccctacatttgtttccgcagtggacggcctttcgttccaggctttttcttatctcaacttcaccccagagccatctgatattttttcctgttag

SEQ ID NO: 51426 - DNA, 786 bp, Artificial Sequence
  Description of Artificial Sequence: Synthetic coding sequence
atggggcacgaacagaatcaaggggcagccctgttgcagatgcttcctctcttgtggcttcttccccactcatgggcagttccggaagctcccactccaatgtggccagacgaccttcagaaccatactttcctacacaccgtgtactgtcaggatgggtccccaagtgtgggcctctcagaagcttacgacgaggaccaattgtttttcttcgacttctctcaaaacacgcgggttcccaggttaccggaattcgccgactgggcccaggaacagggagatgccccagccatcctgtttgacaaggagttctgtgagtggatgatccagcagattgggccaaaactggacggcaagataccagtgagtaggggtttcccaatcgccgaagtattcacccttaagccccttgagtttggtaagccaaacactctggtgtgtttcgtcagtaatctgttcccgccaatgctcacagtcaattggcaacaccactccattccagtggaaggttttggtcccacctttgtaagcgcggtggatgggctaagctttcaggccttcagttatctgaactttacccccgagccctccgacattttctcctgtatcgtgacccacgaaatcgacagatatactgccatagcgtattgggtaccacgcaatgccctgcccagtgatctcctagaaaacgtgctgtgtggggtggccttcggcctgggcgttttgggcatcatagtgggtatcgtattaatcatttacttccgcaagccctgtagcggggactag

SEQ ID NO: 51427 - DNA, 873 bp, Artificial Sequence
  Description of Artificial Sequence: Synthetic coding sequence
gtgagctgctggctgagtgatagttgccaggagttgcagaggcgaggaattatactgtgttcgtatggagtcacctctcccatcgccgtcttcgggaggccgggtcggctgagaaaccggcgacactttgagagacgactcgtaccaatgaagtggctcaagaagtgtctagacacagcccctacgccgatgtggccagacgacctgcagaatcacacatttctgcatacagtttattgccaggatggatcccccagcgtgggcctgagcgaagcctatgatgaagatcagctgtttttttttgatttcagccagaacaccagagttcccaggcttcctgagtttgcagactgggcccaggagcagggggacgcgcctgctattctcttcgacaaagaattttgtgaatggatgatccagcagattggaccaaagctggatggtaagatcccagtgagcaggggattcccaatcgctgaggtgtttaccctgaagcccctcgaatttggcaagcccaatactctggtgtgctttgtgtccaacctgttccccccaatgctcaccgtgaactggcagcatcactccgtacccgtcgaaggatttggacccacctttgtgagtgccgtagacggcctctcctttcaggcttttagttacttgaatttcacccccgagccatccgatattttctcgtgcatcgtaacccatgagattgatcgctacacagccattgcatactgggtcccccgaaatgctctacccagtgacctccttgaaaacgtgttatgcggagtggcctttggtctgggggtgctggggatcatcgttggaatcgtactgataatttatttccggaaaccttgcagcggatag

SEQ ID NO: 51428 - DNA, 510 bp, Artificial Sequence
  Description of Artificial Sequence: Synthetic coding sequence
atgtggccagacgatctacagaaccacactttcctccacactgtgtattgccaggatggttctcccagtgtaggtctttcagaggcctacgacgaggaccagctcttctttttcgattttagccagaacactcgggtgcctagactcccagagtttgccgactgggcacaggaacaaggagatgcccctgcaatcttgttcgacaaggagttctgcgagtggatgatacagcaaatcggcccaaagcttgatggcaagatcccagtctcccgcggatttcctatcgccgaagtgttcacgctcaagccactcgagtttggcaagcccaacacattagtatgttttgtaagcaacctgtttccccctatgctcacggtcaactggcagcaccatagtatcccggttgaaggcttcggccctaccttcgttagtgcagtcgacggcctgtcattccaggctttctcttatctgaattttacccctgagccttctgatatatttagctgttag

SEQ ID NO: 51429 - DNA, 786 bp, Artificial Sequence
  Description of Artificial Sequence: Synthetic coding sequence
atgggccatgaacaaaaccagggagccgcattactgcagatgctgccattactatggctgctcccgcattcttgggcagttcctgaagccccaaccccaatgtggcctgatgatttgcagaatcacacctttctgcacaccgtgtactgccaggacggttctccgtccgttggtttgtcagaagcttacgatgaagaccagctctttttcttcgactttagtcagaacacacgggtccctcggttacccgagttcgcagattgggcccaggagcaaggagacgccccagcaattttgtttgataaggaattttgcgagtggatgattcaacagatcggcccaaagctcgatggaaaaatccccgtttcccggggattccctatcgctgaggtctttacccttaaacccctggaatttggcaagccaaatacccttgtatgcttcgtctcaaacttgtttcctccgatgctgacggtgaattggcagcatcattctgtgcctgtagaaggtttcgggccaacattcgtatctgcggtggacggcttatccttccaggctttctcctacttaaatttcactccagagccttccgacatctttagctgtattgtaactcacgaaattgaccgctataccgctatcgcttactgggttcctcgcaatgccttacctagcgatttactggagaatgtcctgtgcggtgtagccttcggtctgggcgttctcggaatcatagtggggattgtgcttatcatttacttccggaagccgtgcagtggggattag

SEQ ID NO: 51430 - DNA, 501 bp, Artificial Sequence
  Description of Artificial Sequence: Synthetic coding sequence
atgggccacgaacaaaaccagggtgcggctctccttcagatgctgccactgctgtggttgttgccacacagctgggccgtccccgaaggcttccctattgccgaggtgtttacactcaagcccttggagtttgggaaacctaatactctcgtgtgctttgtgagtaatctcttccccccaatgctgacagtgaactggcagcatcatagcatcccggtggaaggtttcggcccaacatttgtgtccgccgttgacggactgagtttccaagcgttctcttatctcaacttcactcccgaaccttcggatattttctcttgtatcgtgacacacgagattgacaggtatactgccattgcatactgggttccgagaaacgctctgccctccgacctgcttgagaatgtactgtgcggtgtcgccttcggcttgggcgtgttgggcataatcgtcggaatcgtcctaattatctacttcaggaaaccctgttccggggactag

SEQ ID NO: 51431 - DNA, 786 bp, Artificial Sequence
  Description of Artificial Sequence: Synthetic coding sequence
atgggccatgaacagaaccagggagccgcactcctacagatgctgccccttttgtggctgcttccacacagctgggcggtgcccgaagctcccactcccatgtggccagacgacttacagaaccataccttccttcacactgtttattgccaagatgggagtccttcggtaggattatccgaggcttacgacgaggatcagttatttttcttcgatttctctcaaaacactcgtgtgcctcgcttaccggaattcgcagactgggcacaggaacagggagatgccccagctattctcttcgataaagaattttgcgagtggatgattcaacagattggccctaagctggacgggaaaattccagtctcaagaggctttccaatagctgaggtgttcacactgaagccattggagttcggcaagccgaacactctggtgtgctttgttagcaatctgtttccgccaatgttaaccgtcaactggcagcatcacagcgtccccgttgaaggttttggaccaaccttcgtgtcagcggtcgacggactgagctttcaggcgtttagctacctgaactttacccctgagcctagcgatattttttcctgtatcgtaacccatgagattgaccgttatactgccattgcttactgggtgcctagaaacgcactgccttctgatcttctcgagaacgttctgtgcggcgtcgcctttgggcttggagtcctggggattatcgtgggaatcgtgctgatcatctacttccggaagccctgcagcggggattag

SEQ ID NO: 51432 - DNA, 684 bp, Artificial Sequence
  Description of Artificial Sequence: Synthetic coding sequence
atgggacatgaacagaaccagggagctgcacttctccagatgctacccctgctctggctcttaccacactcatgggccgttcccgaagctcccactccgatgtggccggacgacttgcagaatcacacattcttacacaccgtttactgtcaggacggaagtccctcggtcggtctttccgaagcttatgacgaggaccagctttttttttttgatttttctcagaatacccgcgtcccgagactaccggaatttgctgattgggcacaagagcaaggcgacgctccggcaattctgttcgataaagagttctgcgagtggatgatacagcagattggaccaaaacttgatggaaaaatacccgtcagtagggtgaattggcaacatcactcggtgccggtggagggattcggccctaccttcgtaagtgcggtcgacggcctgagcttccaggccttcagctacctcaatttcacgcctgaaccatctgacatattctcctgtatcgtgactcatgagatcgacaggtataccgctatagcttactgggtacccaggaacgcccttccaagcgacctgttggagaacgtgctgtgcggcgttgcctttggcctgggggtgctggggatcatcgtggggattgtgctgattatttactttcgcaaaccctgcagcggagactag

SEQ ID NO: 51433 - DNA, 501 bp, Artificial Sequence
  Description of Artificial Sequence: Synthetic coding sequence
atgggtcacgagcagaatcagggagccgcactgctccagatgctgcccctgctttggctccttcctcattcctgggcagtccctgagggctttcctatagcggaagttttcacgctgaagccgcttgagtttgggaaacctaatacactggtctgctttgtgagtaacttatttccacccatgttaacagtgaactggcagcaccacagtgtccccgtcgaaggttttggcccaacctttgtttctgccgtggatggcctctcttttcaggctttctcatacctgaacttcacgccagaaccctccgacatcttttcctgtatcgtgacacatgagatagatcgctacactgcgattgcttactgggtgccaaggaacgctctcccaagtgacttgctcgagaatgtgctttgcggtgtggcgttcggcttgggggttctgggaattattgtgggcatagtcctgatcatatacttccgcaagccctgctccggcgactag

SEQ ID NO: 51434 - DNA, 684 bp, Artificial Sequence
  Description of Artificial Sequence: Synthetic coding sequence
atgggccatgagcagaaccaaggagcggctctgcttcagatgctgcccctgctgtggttgttgccacattcatgggcagtgccggaggcccctacacctatgtggcccgacgacttgcagaatcatacttttcttcacacggtttattgtcaagacggtagtccctccgttggattgtccgaggcatacgatgaggatcagctgttctttttcgatttttcacagaatacccgggtccctaggcttcctgagtttgcagattgggcccaggaacaaggtgacgccccagctatcttatttgacaaggaattctgtgagtggatgatacagcagatcggaccgaagttagatgggaaaatcccagtgtcccgagtgaattggcagcaccattcagtgcccgtggagggcttcgggccaacctttgtgtctgcagtggacgggttgagtttccaggcatttagctaccttaatttcactccggagccgagcgatattttcagctgcattgtgactcatgagatcgacagatatacagctatcgcatactgggtgcctcggaacgcactaccctccgacctgctggaaaatgtactgtgtggcgtagcctttggtctgggggtgcttggaattattgtggggatcgtgttgataatctacttccgcaagccgtgctcaggcgattag

SEQ ID NO: 51435 - DNA, 684 bp, Artificial Sequence
  Description of Artificial Sequence: Synthetic coding sequence
atgggccacgaacagaaccagggagcggcactactgcaaatgctacctctgctgtggctactgcctcattcatgggccgtgcccgaagcacccactcccatgtggcccgacgaccttcagaatcacaccttcctgcacactgtctattgtcaagacgggtcgcccagcgtcggactttccgaggcgtacgacgaggatcagctttttttctttgatttctcacagaacactcgagtgccaaggctgcccgagtttgccgactgggcccaggaacagggtgatgcccctgcaatactcttcgataaagagttttgcgagtggatgattcaacagattgggcctaagttggatgggaagatacctgtaagcagagtaaactggcagcaccattctgtgcccgtggagggattcggccctactttcgtatccgctgtggatggcctttcgtttcaggcgttttcctacttgaacttcacgccagagcccagcgatattttctcgtgtatcgtcacccacgagatcgatagatatactgccattgcttattgggtgccccgtaacgccctgccgtcggacctcctggagaacgtcctgtgcggcgtagctttcggactgggtgtgctgggtattattgtcggcattgtccttatcatctatttccggaagccttgtagcggtgattag

SEQ ID NO: 51436 - DNA, 786 bp, Artificial Sequence
  Description of Artificial Sequence: Synthetic coding sequence
atgggccacgaacagaatcagggagccgctctcctgcagatgctgcccttgctgtggctactgccacacagttgggccgtaccggaggcacccaccccaatgtggcctgacgacctgcagaatcataccttcttgcatactgtctactgccaagacggcagccccagcgtgggccttagcgaggcgtacgatgaagaccagttgttcttctttgatttctcccagaacacaagagttccccgtctgccagaatttgccgactgggcccaagagcagggtgatgcccctgccatattgtttgataaagaattttgcgaatggatgattcagcaaatcgggccaaagctcgacggcaaaatccctgtttctcggggattccctatcgctgaggttttcaccctaaagcccctggaattcgggaagcccaacacactggtgtgcttcgttagtaacctgttcccgccaatgttgaccgtgaactggcaacaccattctgtcccggtggagggatttgggccaacatttgtgagcgccgtagacggcctctcattccaagcctttagttatctgaactttacgcccgagcctagcgatatattctcttgcatcgtgactcacgaaatcgatagatacactgcaatcgcctattgggtaccaagaaatgcattaccttctgatctgctcgagaacgtgctgtgcggtgtggcatttggtctgggagtcttgggcattattgtcggaatagtcctaatcatctactttcgaaaaccatgcagtggtgactag

SEQ ID NO: 51437 - DNA, 501 bp, Artificial Sequence
  Description of Artificial Sequence: Synthetic coding sequence
atgggtcacgaacagaaccaaggtgccgctctgctgcagatgttgccactgctgtggttgctacctcattcgtgggccgtcccagagggatttccaatcgctgaggtgttcactctcaagcctttggagtttggcaaacccaacacactcgtctgtttcgttagtaacttattccctcccatgttaacggtgaattggcagcatcactcggtccccgtggagggcttcggacccacctttgtgtcagctgtggatggcttaagctttcaggctttctcttatctgaactttacccccgagccctcagacatcttttcgtgtattgtaacacacgagattgaccggtacactgccatcgcatattgggttcctcgcaacgctctgccttctgacctccttgaaaacgtcctctgcggcgtggcctttgggcttggggtgttggggatcattgtcggcattgtgttgataatttactttcggaaaccctgctcaggtgattag

SEQ ID NO: 51438 - DNA, 786 bp, Artificial Sequence
  Description of Artificial Sequence: Synthetic coding sequence
atgggtcatgagcagaaccaaggggcagcgttacttcagatgttgcccttgctttggctacttccccattcatgggccgtgcccgaagctcctacgcccatgtggcccgatgacttgcagaatcacacattcctgcacacggtatactgccaagacggcagtccctcagtcggcctcagcgaagcctacgacgaggatcagctcttctttttcgacttcagccagaacactcgcgttcccagattgcctgagtttgccgactgggcccaggaacaaggcgacgcacccgctatattattcgacaaagagttttgcgaatggatgattcagcagattggtccaaagcttgatgggaagattcccgtgtcacggggttttccaatagcggaggtgttcaccctgaagcctctggaattcggaaagccgaataccctggtttgctttgtctctaacctttttcctcccatgttgactgtcaattggcagcaccattcagtgccagtggagggtttcggaccaacatttgtgtccgccgtcgacggtctttcctttcaggccttttcctatctcaactttacaccagagcccagcgatatcttcagctgcatcgtaacccacgaaattgacaggtatactgcaatcgcctactgggtccccagaaatgccctgcccagtgacctcctggagaatgtgctgtgcggggtagcctttggactcggggttctggggatcattgtcggcatcgtgctaatcatatactttaggaagccctgttcaggtgattag

SEQ ID NO: 51439 - DNA, 873 bp, Artificial Sequence
  Description of Artificial Sequence: Synthetic coding sequence
gtgagttgctggctctccgatagttgccaggaactgcaaaggcggggaattattttgtgttcctacggggtgaccagtcctatcgccgtcttcggaaggccaggacgacttagaaacaggagacacttcgagcgtcgactcgttccgatgaaatggctgaaaaaatgcctggatacagcccctacccctatgtggcctgatgatctccagaaccatactttcttgcatacagtctactgtcaggacgggagcccaagcgtgggtctgtcagaagcttatgatgaagatcagctgtttttttttgatttctcacagaataccagagttcctcggctccctgaatttgcagactgggctcaagaacagggagacgctcctgcgatcctgtttgataaagaattctgcgaatggatgatccagcagatcggccctaaactcgacgggaagatacctgtatctcggggattcccgatcgccgaggtttttactttgaaacctctggagtttgggaagcctaataccctcgtgtgcttcgtaagcaacctgttcccacctatgctgaccgtgaactggcagcaccactccgtgccagtggaggggttcggacctaccttcgtgtccgctgtggatggcctgtcctttcaggccttctcctacttaaactttactccggagcctagcgacattttctcatgtatcgtaactcacgaaattgaccgctataccgccattgcctactgggttcctaggaatgccctgccgtctgacttactcgaaaatgttctgtgcggcgtggcctttggcctcggcgtcctggggatcatagtcgggattgttctcataatctactttagaaaaccctgttcgggctag

SEQ ID NO: 51440 - DNA, 873 bp, Artificial Sequence
  Description of Artificial Sequence: Synthetic coding sequence
gtttcttgctggctcagtgatagctgtcaggaacttcagagacgagggataatcctgtgtagctatggtgtcacttccccaattgcagtgtttggcagaccaggtcggttgcggaataggcggcactttgagagacgcctcgtgccaatgaagtggctgaaaaaatgcctcgacaccgctccaactcccatgtggccggatgaccttcaaaatcatacgtttctccacactgtgtactgtcaggacggcagccccagtgttgggctgagcgaggcatatgacgaggaccaattgtttttttttgacttcagccagaacaccagggtccctcgccttcccgagttcgcagattgggcgcaggaacagggcgatgctccagcaatactgttcgataaggaattttgcgaatggatgatccagcaaatagggccaaaactagacggcaagatccctgtcagcagggggtttcccatagccgaggtgttcactctgaagcctctagagtttggcaaacctaacacgctggtgtgcttcgtgagcaacctattccccccaatgctcactgtcaattggcaacatcactcaattccggtcgaggggttcggacctaccttcgtgtccgcagtggatggcctaagtttccaggccttcagctatttgaattttacacccgagccatcagatatctttagctgtattgtgacgcatgagatagatcggtacactgcgatcgcctactgggtgcctcggaacgccctcccatctgatctgttggagaacgtgctgtgtggtgtagcgtttgggctgggcgtattagggattattgtggggattgtgctgattatatatttcaggaagccctgcagcggatag

SEQ ID NO: 51441 - DNA, 873 bp, Artificial Sequence
  Description of Artificial Sequence: Synthetic coding sequence
gtttcttgctggttgtcagactcctgccaggaattgcagcgaaggggcattatcttgtgcagctacggagtgacgtcccctatagccgtcttcggacggcctggaagacttaggaaccggagacatttcgagcggcgactcgtcccaatgaaatggctgaagaaatgtttggatacggccccaacccccatgtggcccgatgatctgcagaatcacacttttcttcacaccgtttattgtcaagacggcagtccctccgttggcctcagtgaagcgtatgacgaggaccagcttttttttttcgacttctctcagaatacaagagtacccaggctacccgaatttgcagactgggcccaggagcagggggatgccccagcgatcctgtttgataaggagttttgcgagtggatgatccagcaaatagggccaaaacttgacggaaaaatccctgtgtcaagaggcttccctatagcagaagtatttactctgaaaccactggagtttggaaaacccaatacactggtttgctttgtttctaacttgtttccacctatgctgacagtgaactggcagcatcacagtgtccctgtggagggcttcggtcccaccttcgtcagtgcagtggatggcttgtcctttcaggcgttctcctacctcaactttactcctgaaccttccgacatattcagttgcatcgtcacacacgagatcgaccgttacaccgcaatcgcttactgggtgccccgaaatgctctgccctcagaccttctggagaacgtgctatgtggggtagcgtttgggctgggcgtcttgggaattatcgttgggattgtcctgatcatctatttcaggaagccgtgtagcggttag

SEQ ID NO: 51442 - DNA, 501 bp, Artificial Sequence
  Description of Artificial Sequence: Synthetic coding sequence
atgggacacgagcaaaaccagggtgcggcactgttgcaaatgttacccttgctgtggttgctgcctcacagctgggcagtcccggaagggttccccattgcagaagtatttactctgaaacctcttgagttcggcaagcccaatactctagtttgtttcgtcagtaatctgtttccccctatgcttactgtcaactggcaacatcacagcgtcccggtggaaggcttcgggccaacttttgtgagcgccgtcgatgggctgtcctttcaggcctttagctacttaaacttcacacctgagccaagtgacatattttcctgtattgtgactcacgagatagaccggtacactgctatcgcatattgggtcccacggaatgcactgcccagtgatctcctggagaatgtgttatgtggggtggcctttggcttaggtgtgctcggcattatcgtgggaattgtcctgataatttatttccgcaagccgtgcagcggcgattag

SEQ ID NO: 51443 - DNA, 510 bp, Artificial Sequence
  Description of Artificial Sequence: Synthetic coding sequence
atgtggcctgatgatctgcaaaaccacaccttcctgcacaccgtatattgtcaggacgggtcacctagcgttggcctgtcagaggcgtatgatgaagaccaattgttcttttttgacttttcacagaatacgagagtcccacgcttacctgagtttgcagattgggcccaagaacagggcgatgctcccgcaattttgtttgataaagaattttgtgaatggatgatccagcaaattggtcccaagctggacggcaagattcccgtcagccggggtttcccaatagcggaagtcttcacactgaagccactggagtttggcaaaccgaacactctggtgtgtttcgtgtctaacctctttccaccaatgctcaccgtaaactggcaacaccactcagttccagtggaaggctttggtccaacatttgtgtcggcagtggacgggctcagttttcaggcattctcttatctcaattttacgcccgaaccctcagatatcttctcctgctag

SEQ ID NO: 51444 - DNA, 792 bp, Artificial Sequence
  Description of Artificial Sequence: Synthetic coding sequence
atgatcacatttttgcctctgcttcttggtttatcacttgggtgcacgggcgcagggggatttgtggctcacgtagaaagtacatgcctactcgatgatgccggtacacccaaagattttacgtattgtatctcgttcaataaggatctcctcacctgctgggaccccgaagaaaataagatggctccctgtgagttcggggtgttgaattctctagcaaatgttctgtcacaacaccttaaccagaaagacacactgatgcagaggctgcgaaatggactacagaactgcgctacgcatactcagcctttctggggaagccttacgaatcgcactaggcctccgtctgtgcaggttgctaaaacgaccccgtttaacactcgcgaacctgtaatgttagcctgctatgtttgggggttttaccccgctgaagtgacaatcacctggagaaagaatgggaaactggtaatgccccacagctccgcccacaagaccgcacaacccaacggcgattggacatatcagaccctgagccatctggctttgacgcccagctacggggacacatatacatgcgtggtggagcacattggtgctccagagcccatacttcgagattggacacccggactgtcgcccatgcaaacactgaaagtatctgtgtccgcggtcacccttggtctcgggctgattatattctcactgggtgtgatttcctggagaagggctgggcactcttcctacactcctcttcctggttcaaactacagcgagggctggcatatcagctag

SEQ ID NO: 51445 - DNA, 792 bp, Artificial Sequence
  Description of Artificial Sequence: Synthetic coding sequence
atgatcacattcttgccgctgctgctcggcctgagccttggctgtactggcgctggaggattcgtggcccatgtcgagtccacttgtctgctggacgacgctggcacacctaaagacttcacctactgtattagctttaacaaggacctgctgacctgttgggacccggaggagaacaagatggccccatgcgaattcggggttttgaacagcctcgctaatgtgctgtctcagcacctcaaccagaaagacacactgatgcagcggttgcgaaacggtctccagaattgcgcaacacatacccaaccgttctggggaagcctcacaaatcggacccgccctccaagtgtccaggtcgccaagacaaccccttttaacactagagaacctgtcatgctggcatgctatgtttggggtttttatccagctgaagttacgatcacgtggagaaaaaatggaaaactcgtaatgccccatagctccgcccacaagactgcccagcccaacggagactggacctaccagactctgtcccatctcgctctgacgccctcatatggcgatacatacacatgcgtagtggaacatattggggctcccgaacctatcctccgggactggactccaggattatcccctatgcaaactctgaaagtctctgtgtccgccgtgacactgggactggggttaataatcttcagtctgggcgttatctcctggcggcgagctgggcacagcagttataccccgctccctggatccaattactctgaggggtggcacatctcttag

SEQ ID NO: 51446 - DNA, 792 bp, Artificial Sequence
  Description of Artificial Sequence: Synthetic coding sequence
atgattacattcttgccactgttactggggctgagcctaggctgcacgggcgctggagggtttgtggcacacgttgaaagtacttgccttctggacgatgcagggacacccaaggattttacctactgcattagcttcaacaaagatctccttacctgttgggacccagaagaaaacaagatggctccctgtgagtttggagtgttgaacagcttagctaacgtcctgtctcagcacctcaaccagaaggacactcttatgcaaaggttgagaaacggcctgcagaactgcgcaacgcatacccagccattttggggaagtctgacgaatcgcacaagacctccgtcagtacaggtggccaaaacgactcctttcaatacccgggaacccgtgatgttggcttgctatgtgtgggggttttatccggctgaagtcacgataacatggaggaagaacggcaagctcgtcatgccccactcttctgctcacaaaaccgcgcagccgaacggtgattggacataccaaacgttgagccacctcgcactcaccccctcttacggtgatacatacacatgtgtggtggaacacaccggggcacccgaaccaattttaagggactggacacctggactcagcccaatgcagacactgaaggtttccgtctcagccgtcaccctaggtttgggactgatcatattttcattaggggtgattagctggagaagggctggccattcttcctatactcccctgccaggctcaaactatagcgaaggttggcacatttcttag

SEQ ID NO: 51447 - DNA, 426 bp, Artificial Sequence
  Description of Artificial Sequence: Synthetic coding sequence
tgaacgcgccctccctctgtacaggtggcaaagaccacaccgtttaatacccgagaacccgtgatgcttgcgtgctatgtatggggattttaccctgctgaagttactatcacttggcggaaaaatgggaaacttgtcatgccacactctagtgcgcacaagacagctcagcccaacggagattggacatatcagactctgtcacacttagctctcacgccgtcctatggcgatacgtacacctgtgtggtcgaacatataggtgcccctgagccaatacttagggactggacacctggcttatcccctatgcaaaccttaaaagttagtgtcagcgccgttacccttggcctaggtcttattattttctccctgggtgtcatctcctggagacgggcaggacactcccggtggcacatcagctag

SEQ ID NO: 51448 - DNA, 774 bp, Artificial Sequence
  Description of Artificial Sequence: Synthetic coding sequence
atgatcaccttcctaccactcctgctcgggctgtccctgggatgcactggcgctggaggattcgtggcccacgtcgaaagcacctgcctcctcgatgacgccggaaccccaaaggacttcacttactgcataagttttaataaggaccttctgacatgttgggacccggaagagaataagatggcaccatgtgagttcggtgtcttaaattctctggccaacgttctgtcacagcatctaaaccagaaggataccctcatgcagaggctgcggaatgggctccagaactgcgctacccacacccagccgttctggggctctctcaccaacagaaccaggccccctagcgttcaggtggcaaaaacaacacccttcaatacaagagagcccgtgatgctcgcctgctatgtttgggggttttatccagctgaggtgaccattacctggagaaagaacgggaaactcgtaatgccacattcctcagcacataaaaccgcacagcctaacggcgactggacctatcagaccctgtcacatttagccctgacaccgagttatggtgacacctacacctgtgtcgtcgagcacattggagcccctgaacccattctgcgggattggacccctggcttgtcccctatgcagaccttaaaggtctctgtaagcgccgtgaccctggggctcggtctgatcatattcagcttgggagtgatctcatggcgtagagctggacattcatcggacctgataatctccctgctcttcatcctatag

SEQ ID NO: 51449 - DNA, 321 bp, Artificial Sequence
  Description of Artificial Sequence: Synthetic coding sequence
gtggccaaaactaccccttttaatacccgcgaacccgtcatgctcgcatgttacgtctgggggttttatccagccgaagtgacaataacttggagaaaaaacggaaaattggtgatgccccacagcagtgcacacaagactgcccagccgaacggtgactggacatatcagaccctgagtcacctggcgcttaccccctcatacggggatacgtatacctgcgtagtggaacatacaggggcacccgagcccatactgagagattggtcttatacacctctgcctggctccaattactcagaaggatggcacatctcctag

SEQ ID NO: 51450 - DNA, 426 bp, Artificial Sequence
  Description of Artificial Sequence: Synthetic coding sequence
tgaacccgccctcccagcgtccaggtggctaaaacgacgccgttcaatacccgtgagccggtcatgctggcatgctatgtgtggggtttctaccccgctgaggtgactattacttggcgaaagaatgggaaattagttatgccgcactcatccgcccacaaaacggcacaacccaatggcgactggacataccagaccctctcgcatctcgcactcactccctcctatggggacacatatacctgcgtcgtggaacatacaggggctccagagcccatcctgcgagactggactcctggcctgagcccaatgcagaccctcaaggtcagtgtgagcgcagtcaccctaggactgggccttattatcttctcactaggtgtgatttcttggaggagagccggacattcccgctggcacatctcatag

SEQ ID NO: 51451 - DNA, 528 bp, Artificial Sequence
  Description of Artificial Sequence: Synthetic coding sequence
atggggcatgagcagaatcagggcgcagccctgctgcaaatgctgccactactttggctgctgcctcacagttgggccgtgcctgaagaacaatccatgattacgtttttgcccctcctgctgggcctgagcctgggttgtactggcgcaggcggtttcgtcgcccacgtggagagcacttgtctcctcgatgacgctggaacaccaaaggactttacctactgcattagcttcaataaagatctattaacatgctgggatccagaggagaataagatggctccctgcgagttcggtgtgctgaacagtctggcgaatgtgttgtcccagcatttgaaccaaaaagatacattaatgcagcggctgagaaatgggctgcagaactgcgccacacacacccaacctttctggggctccctcacaaatcggacgaggcccccatctgtgcaggtggccaagaccaccccatttaatacgcgagagccagtaatgcttgcttgctacgtctggggtttttacccggcttag

SEQ ID NO: 51452 - DNA, 528 bp, Artificial Sequence
  Description of Artificial Sequence: Synthetic coding sequence
atgggtcatgaacagaaccaaggcgctgctctcctccaaatgttaccacttctgtggctcctcccccactcatgggcggtgcccgaagagcagtcaatgataacatttttaccattactcctcggattgagtctggggtgcacaggggctggaggtttcgtggcccatgtggaatccacatgtctgctggacgatgcaggaactccaaaagacttcacttattgcatttctttcaataaggacctcctgacgtgctgggacccggaggagaacaagatggctccctgcgaattcggtgtgctgaattccctggccaacgtgctttcacaacatttaaatcagaaggataccctgatgcagcggctgaggaatggactacaaaattgcgccacccacactcagccattttggggttctctcaccaatcgtacccgccctccttcagtacaggtggccaaaactacaccatttaacactagagagcccgtcatgctggcgtgctacgtgtggggcttctatcctgcttag

SEQ ID NO: 51453 - DNA, 651 bp, Artificial Sequence
  Description of Artificial Sequence: Synthetic coding sequence
atgatcaccttcttacccctgcttctgggccttagcctcgggtgcacaggcgctggaggatttgtagctcatgtggaaagcacctgccttctcgacgatgccggtaccccaaaggactttacctactgtatctcttttaacaaagacctccttacttgctgggatccggaggaaaacaaaatggcgccttgtgagtttggtgtccttaattctctagcaaatgtgctgagtcaacatcttaaccagaaggatacattaatgcagcgtctgcggaacggcctgcagaactgcgctactcacactcagccattttggggctcactcacaaaccggaccaggcccccatctgtgcaggtggcaaaaactaccccattcaatacgcgggaacccgttatgcttgcttgctatgtttgggggttctatcctgccgaagtgactatcacctggagaaagaacggcaaactggtaatgccacattcatctgcccacaagacggcccaacctaacggagactggacctatcagacgttgtctcatttggcccttaccccaagctacggagacacgtatacctgtgtggtggaacatacaggcgcaccagaaccaatactcagagattggagcaagtgcatggctgacggctggaactag

SEQ ID NO: 51454 - DNA, 792 bp, Artificial Sequence
  Description of Artificial Sequence: Synthetic coding sequence
atgataacttttctgcccctgttgctgggcctgagccttggatgcaccggggcagggggattcgtcgcacacgtggaaagcacttgccttctggacgacgcgggtaccccaaaagatttcacatactgtatttctttcaataaagatctgctgacgtgctgggacccggaagagaataaaatggcaccatgcgaatttggagttctcaattcactcgccaacgttctgagccagcatctgaatcagaaggacaccttaatgcaacgactacggaacggactacaaaattgtgcaactcacacacagcctttctggggtagtctgacaaaccgaacacgacctccctctgtacaagttgctaagactacccccttcaatactagagagcctgtcatgctggcatgctacgtgtgggggttctacccggcagaggtcaccattacctggcggaagaacggaaaactggtgatgcctcatagcagtgcccacaagacagctcagcccaatggcgattggacataccagaccttatcccatcttgcactcaccccgagttacggtgatacctatacctgtgtcgtggaacacacaggcgctccagaacctatattacgagattggactcctggcctctcaccaatgcagactctgaaggtttctgtgagcgctgttactctcgggctgggtcttatcatattttctctgggagttatttcctggcggagggccggacatagctcttacactcctcttccaggatcgaattactcagaaggctggcacatctcatag

SEQ ID NO: 51455 - DNA, 774 bp, Artificial Sequence
  Description of Artificial Sequence: Synthetic coding sequence
atgatcactttcctgccgttgttgctgggactcagcctgggctgcactggagctggcggtttcgtagcacacgttgagagtacatgtttactggatgacgccggaacacccaaagactttacctactgcatttcgtttaacaaagacctgttaacctgttgggatcccgaggaaaataagatggctccttgtgagtttggagtgcttaactcactggctaatgtgctttcccaacacctgaatcagaaggacaccctaatgcagagactgagaaatggactgcaaaattgtgctacccatacccagcccttctggggaagtctgacgaaccgtacccggcctccaagtgtacaggtagccaaaacaactcccttcaacacgcgggaacccgttatgctcgcctgctacgtgtggggattctacccggctgaggttacaattacctggagaaagaacggaaagctcgttatgccccattccagcgcacacaaaaccgcccaacccaatggcgattggacctatcaaactttaagccatcttgccctcactcctagctatggcgatacatatacctgcgtagtggaacatactggtgcccctgaacctatactccgtgattggacgcccggactgtcacccatgcagaccctcaaggtctctgtgagcgccgttactttggggctgggtctgattatctttagtctaggcgtcatttcctggaggagggcgggacatagctccgacctcatcatctccttgctatttatcctttag

SEQ ID NO: 51456 - DNA, 321 bp, Artificial Sequence
  Description of Artificial Sequence: Synthetic coding sequence
gtggccaaaaccaccccctttaacacccgcgaacccgtgatgttggcatgttatgtttgggggttttaccccgctgaagtgacgatcacttggaggaaaaatggcaagctggtaatgccccattcatcagcgcacaagacggcccagcctaacggcgactggacatatcaaaccctgagtcacctcgccttgaccccaagctatggggacacgtacacttgtgtcgttgaacacattggggcaccggagcccatcttacgcgattggtcatataccccgctcccagggtctaattatagtgaaggctggcacatctcctag

SEQ ID NO: 51457 - DNA, 792 bp, Artificial Sequence
  Description of Artificial Sequence: Synthetic coding sequence
atgatcaccttcctcccccttctcctggggctttcgcttgggtgcacgggagccggagggtttgtcgcccacgtggaaagcacatgcctgctggacgacgcgggaactccaaaagattttacatattgtatcagctttaacaaagatttattaacttgctgggacccagaagaaaataagatggcgccatgcgagttcggggtgttaaattcgctggcgaatgtcctatcccagcacctgaatcagaaggacacactgatgcagagactcagaaacggactccagaattgtgccactcatacccagcccttctgggggagtcttacaaatcgtaccagaccaccttccgttcaggtggcgaagactaccccattcaacacccgagagcccgtcatgctcgcttgttatgtgtggggcttctatccggctgaggtgacgataacctggcgaaagaacggcaagcttgtcatgccccactcttccgcacataaaaccgcacagcccaacggcgattggacctaccaaacactgtcccatctggcgttgaccccctcctatggggatacttatacttgtgtggtggagcataccggcgctcccgagccaatcctccgggactggacacctgggctctcccccatgcagacactgaaagtatcagtctctgccgtgacattagggctgggcctcattatctttagcctgggagttatctcatggcgtagagccggtcacagttcctatactcctttacccggatcaaactatagcgaaggctggcacatttcctag

SEQ ID NO: 51458 - DNA, 426 bp, Artificial Sequence
  Description of Artificial Sequence: Synthetic coding sequence
tagacccgccctcctagcgtgcaggttgccaagacaacaccttttaacactcgggaaccagtgatgctggcctgctatgtttggggtttctaccccgctgaggtgacgattacatggagaaagaatggtaaactggtgatgccccattcctccgctcataagacagcccaacctaatggggattggacctatcagacactaagccatctggccctaactccatcatacggagatacctatacctgtgtagtcgaacatactggcgctccagaacccatcctgcgggactggacccccggtctgagccctatgcagacgctgaaagtgtcagtatccgctgtgactctgggacttggactgattattttttcactaggggtcataagctggcgcagggcaggacatagcaggtggcatattagttag

SEQ ID NO: 51459 - DNA, 792 bp, Artificial Sequence
  Description of Artificial Sequence: Synthetic coding sequence
atgataactttcctcccattactgcttggacttagcctgggttgtacaggagccggaggcttcgtggcccacgtcgagagcacatgtctgctggatgacgcaggtactcctaaggatttcacatattgtatttcgttcaacaaggatctcttgacgtgctgggatccagaggaaaataaaatggcgccatgtgaattcggcgtactgaacagtctggccaatgtcctttcccagcacctgaaccaaaaagacacgctgatgcaaagactgcgtaacgggctccaaaactgtgccacacacacgcagcctttttggggcagtctaacaaacagaacacggccaccttcagtgcaggttgcgaagactactcctttcaataccagagaacctgtaatgctggcatgttatgtttggggtttctatcccgcagaggtcacaataacatggaggaaaaatgggaagcttgtgatgccgcattccagtgcccacaagaccgcccaaccgaatggtgactggacatatcagaccctgagccacctggctctgaccccaagctacggcgatacatacacctgcgtggtggagcatattggcgctcctgagcctattctgagagactggacccccggtctgagtccaatgcaaaccctgaaagtgtcagtgagtgcagtcacattgggcctgggtttaataatatttagtctgggcgtcatcagctggaggcgagcaggccactcttcatatacccctctgcccggttccaactacagcgagggttggcacatatcttag

SEQ ID NO: 51460 - DNA, 774 bp, Artificial Sequence
  Description of Artificial Sequence: Synthetic coding sequence
atgatcacttttctgccactgctactgggcctgagcctgggatgtaccggggctggcggttttgtcgcacacgtggaaagcacctgtctgctggacgacgcagggacacctaaggactttacctattgcatcagtttcaataaggacctcctgacttgctgggaccctgaagagaacaagatggccccttgtgagttcggtgtgctgaattctctcgccaacgtcttgtcccaacatctgaaccagaaagacacattgatgcagagactgcggaacggtctgcaaaattgcgccactcacactcagcccttttggggctctctcactaacaggactagacccccatcagtacaggtcgccaagacaactccctttaatacacgcgagccagtgatgttggcctgttacgtctgggggttttaccccgctgaggttactattacatggcgaaaaaacgggaagctagtcatgccccactcctctgctcacaaaaccgcccagcccaatggggactggacctaccagactttgtctcatcttgcacttacacctagctacggcgacacatacacgtgcgtcgtggagcacatcggggcacccgagcccattctgagggattggactcccggacttagtccaatgcagacactaaaggtctctgtgagcgccgtcacccttgggcttgggctgatcattttttccctgggcgtgatttcatggagacgcgctggccactcttccgaccttatcatcagtttactgttcattctgtag

SEQ ID NO: 51461 - DNA, 528 bp, Artificial Sequence
  Description of Artificial Sequence: Synthetic coding sequence
atgggacacgaacagaatcagggtgccgctttactgcagatgctacctctgttatggctcctcccccactcttgggctgttcccgaggagcagtctatgataaccttcttgcccctgctgctcgggctcagcctgggatgtacgggcgcaggcggattcgtagcacacgtggagtccacatgcctgctggatgacgccggaactccaaaagattttacatactgcattagtttcaataaggacctcctcacatgttgggatcccgaggaaaacaaaatggctccctgcgaatttggagttctgaacagcttagctaacgtgctgagccagcatctgaatcagaaagatacactaatgcaaagactaaggaatggcctgcaaaattgcgcaacccatacacagcccttttggggctcccttactaatcggacccggcctccttcagtgcaggttgccaaaacaaccccgttcaacactcgggagccagtgatgctggcatgctatgtgtgggggttttatcccgcatag

SEQ ID NO: 51462 - DNA, 528 bp, Artificial Sequence
  Description of Artificial Sequence: Synthetic coding sequence
atgggccacgagcaaaatcagggtgccgctcttctacagatgctcccactactgtggctgctaccgcactcttgggccgtacccgaagagcaaagtatgattacttttcttcccctcttgctgggcctcagcctgggctgcaccggcgctggaggattcgtggcacatgtggagagcacatgtctgctggacgacgcaggaacgcccaaggactttacatactgcattagctttaataaggacctgttgacctgttgggatccggaggagaataaaatggcaccgtgcgaattcggagtcctcaatagcctggcgaacgtactgagccaacacctgaaccagaaggatacactaatgcagcgactacgcaacggccttcagaactgcgctacacatacacaaccattctggggatctctgaccaacagaactcggccaccgagtgtgcaagtggccaagacaactccttttaacacccgcgagccagtgatgctggcctgttatgtctggggtttttatccagcatag

SEQ ID NO: 51463 - DNA, 321 bp, Artificial Sequence
  Description of Artificial Sequence: Synthetic coding sequence
gtggcgaagactacaccttttaacacacgtgagccagtgatgttggcatgttacgtatggggtttttaccctgctgaagtgaccatcacttggcggaagaacggcaaacttgtcatgccacactctagcgcccacaaaacagcacaacccaatggtgattggacttaccagaccctgagccatctcgctttaacgccatcttacggggatacatatacatgcgtggtggagcacatcggtgccccagagcctattctccgggattggagttacacgcccttgcccggatccaactactcagagggatggcatataagttag

SEQ ID NO: 51464 - DNA, 426 bp, Artificial Sequence
  Description of Artificial Sequence: Synthetic coding sequence
taaacacgaccaccctctgtgcaggttgccaagaccaccccatttaatactcgcgagccagtgatgctcgcatgttatgtgtggggcttctatccagcagaggtgactatcacctggcgtaagaatggcaaactggttatgccccattctagtgcccataaaacggcccagcccaatggcgattggacatatcagacgctcagtcatttagccttgacacctagttacggggacacttacacctgcgtggtcgaacacaccggagcacctgagccaatcttgcgagactggactcctggcctctctccgatgcagactctgaaggtgtctgtgtccgccgtcacgttaggcctggggcttatcattttctcgctcggcgtaatctcgtggcgtagagccggacactcaagatggcatatctcctag

SEQ ID NO: 51465 - DNA, 528 bp, Artificial Sequence
  Description of Artificial Sequence: Synthetic coding sequence
atgggacacgaacagaatcagggcgcagccttgctccaaatgctgcctttactttggcttctgcctcactcttgggcagtccccgaagaacagtctatgattacttttctccccctgctgctgggactgtcgctgggctgtaccggcgctggcggtttcgtggcacatgtcgagtctacgtgtctgttggatgatgcaggcactcccaaagacttcacttattgcatttcctttaataaggatctgctgacttgttgggaccctgaagagaataagatggctccttgcgaatttggagtgttaaattccctggccaatgtcctgtcacagcacctgaatcaaaaggatacactcatgcaaaggctgcggaatggtctgcagaactgcgcaacccacacacagcccttctggggttctcttacgaatagaactcgccctccctccgtacaagtagcaaaaacaacgccatttaacacccgagagcccgttatgctcgcttgttatgtgtggggcttctaccctgcctag

SEQ ID NO: 51466 - DNA, 321 bp, Artificial Sequence
  Description of Artificial Sequence: Synthetic coding sequence
gtggccaagacaactccatttaacacacgggaaccagtcatgctggcctgttacgtgtggggcttttaccctgctgaggttaccattacctggcgcaaaaatggtaagttggtcatgccacacagttctgcacacaagacagcccaacccaacggcgactggacatatcagactctcagtcatttggcacttactccttcctacggcgacacgtatacatgcgtggtagagcacaccggcgcaccggagcctattctgcgcgactggtcatacaccccccttccagggtcaaattactctgagggttggcatattagctag

SEQ ID NO: 51467 - DNA, 321 bp, Artificial Sequence
  Description of Artificial Sequence: Synthetic coding sequence
gtagccaaaacaactccgttcaacactcgagaacccgttatgctcgcctgttacgtatggggtttctacccagcggaagtaaccatcacatggcgaaaaaatggtaaactggttatgccccactcttctgcgcacaagaccgcacagcctaacggcgattggacataccagacgttgagccacctggcactgaccccatcttacggggatacctacacctgcgttgtggaacacatcggagcccctgagcccatactccgggattggtcatacaccccgctacccggaagcaattactcagaaggttggcatatatcatag

SEQ ID NO: 51468 - DNA, 321 bp, Artificial Sequence
  Description of Artificial Sequence: Synthetic coding sequence
gttgccaaaaccacaccgtttaatacaagggaaccagtgatgcttgcgtgttatgtgtggggattttacccagccgaggtgacgatcacttggcgaaagaatggtaaacttgtgatgccacacagtagcgcacacaaaaccgcccagccaaatggcgactggacttatcaaacgctcagccatctcgctctgacaccatcctacggagatacttatacttgcgttgtcgaacacatcggggctcccgaacccatcctgcgagactggtcctacaccccactaccgggttccaattattctgaaggctggcacatctcatag

SEQ ID NO: 51469 - DNA, 426 bp, Artificial Sequence
  Description of Artificial Sequence: Synthetic coding sequence
tagacacgaccaccttcagtacaggtagcgaaaaccactcctttcaataccagggaacctgttatgcttgcctgctacgtgtgggggttttatcccgctgaggtaacaatcacctggagaaagaatgggaagctcgtcatgccccacagctcagcacacaaaactgctcagcccaatggggactggacataccaaactctgagccacctcgctctcaccccatcatatggcgacacttacacctgcgtggtcgaacatattggggcacctgaaccaatacttcgggattggaccccaggcctgtctcctatgcagaccttgaaggtgtccgtgagcgccgtcaccttaggcctggggctcatcatcttcagcctgggcgttatatcttggaggcgtgccggtcatagccggtggcatatctcatag

SEQ ID NO: 51470 - DNA, 321 bp, Artificial Sequence
  Description of Artificial Sequence: Synthetic coding sequence
gtcgctaaaactacaccctttaatacacgggaaccagtcatgctggcctgttacgtctggggattttatcctgccgaagtgactattacttggaggaaaaacggcaagctagtgatgcctcattcaagcgcacataaaacggcccagcccaacggcgactggacctatcagaccctgagccacctcgctctgacaccatcctatggcgacacttatacctgcgtggtggaacataccggagctccagaacccatactgagggactggagctacactcccctacctggaagcaactactctgaaggatggcacatttcttag

SEQ ID NO: 51471 - DNA, 774 bp, Artificial Sequence
  Description of Artificial Sequence: Synthetic coding sequence
atgatcacattcttacctttgttgcttggactttctcttggctgcaccggagcaggcggtttcgtcgcccatgtagagagtacctgcctcctggacgatgcaggaacccccaaagactttacttactgcataagcttcaataaagacctgttaacttgttgggaccccgaggaaaataaaatggctccttgtgaatttggggttctgaattcactggcgaacgtgctctctcagcacctgaaccaaaaggacactttaatgcaacgtctgcggaacggcttgcagaattgtgctacccacacacagcctttttggggtagcctcaccaataggacaaggcctcccagcgtccaggtggctaaaacgacccctttcaacacacgggaacccgtgatgctcgcatgctacgtgtggggcttctatcctgctgaggtgactatcacttggcgtaaaaacggcaaacttgtcatgccacattcctcagcacataaaacagctcagccgaatggggattggacctatcagacgctgtctcacctcgcgctgaccccatcctatggcgacacttatacatgcgtggtcgagcacaccggggcacctgagcccatcctacgcgactggacacccggtctgtcacccatgcagaccctgaaagtgtccgtctccgctgtcacattggggctggggctgattatcttctcactgggggtaatttcttggcggagggccggacactccagtgatctgatcatcagtttgctcttcatactgtag

SEQ ID NO: 51472 - DNA, 792 bp, Artificial Sequence
  Description of Artificial Sequence: Synthetic coding sequence
atgattacctttttacctttgctgctaggtctgtcactcggctgtactggcgctggcggatttgtggcccacgtggagtctacatgtcttctggatgacgccggtactcccaaggattttacatactgcattagcttcaataaggaccttctgacttgttgggacccagaagaaaacaaaatggcaccgtgcgaatttggcgtcctaaactccctcgccaatgtcctctctcagcacctgaatcagaaggacactctcatgcaacggctgagaaacggtttgcagaactgcgccacgcacacgcagccgttttggggctcccttactaacaggacccggccaccctctgtgcaagtggctaagaccaccccattcaacacccgggaacctgtcatgctggcgtgctacgtctggggcttttacccagcagaggtgactatcacctggcgcaaaaacggcaagctggtgatgccgcactcttctgcccacaagactgcccagcccaacggagactggacataccagaccctttctcacctggccctcaccccatcttacggcgatacgtatacttgtgttgttgagcacataggcgctccggaacctattctgcgagactggacgccaggattgtcacctatgcagacgctgaaggtgtctgttagcgccgtgactctggggctggggttgatcatcttcagtctgggcgttatctcctggcgaagagcgggacattctagctacaccccgctgccaggctcgaactattccgaaggatggcatatttcctag

SEQ ID NO: 51473 - DNA, 321 bp, Artificial Sequence
  Description of Artificial Sequence: Synthetic coding sequence
gtcgccaagacaaccccctttaatacccgagagcctgtgatgcttgcatgttatgtctggggcttctatcctgccgaggtcacaatcacatggcggaaaaatggaaagctcgttatgccacactctagcgcgcacaaaaccgctcagccaaatggggactggacgtatcaaaccctgtcacacctggccctgacccctagctacggcgatacctatacctgcgtggtcgagcatacaggggcaccggaacccattctgcgggattggagttatacaccactgcctgggtccaattactcagaaggctggcatatcagttag

SEQ ID NO: 51474 - DNA, 426 bp, Artificial Sequence
  Description of Artificial Sequence: Synthetic coding sequence
tagactcggcctccctccgtgcaggtcgccaagaccacgccctttaacactcgcgagcccgtgatgctggcctgctatgtttgggggttctaccctgcagaggtaaccatcacgtggcggaagaatggaaagttagtgatgccccattcatccgctcataagaccgcacagccaaatggagattggacataccagacactctctcacctggccttaaccccgtcttatggagacacctatacctgcgtggtggagcacaccggtgccccagaacctattctgcgcgactggactccgggattatcgccaatgcaaacccttaaggtcagtgtctccgccgtcacacttggcctgggacttattatattctcgctcggcgtgatctcttggagacgcgctgggcacagccgctggcacatcagttag

SEQ ID NO: 51475 - DNA, 774 bp, Artificial Sequence
  Description of Artificial Sequence: Synthetic coding sequence
atgatcacgttcctccccttgcttctgggcttatcactgggctgcaccggggcaggcggttttgtggcccatgttgagagcacctgccttcttgatgatgccggaactcccaaagacttcacgtactgtatatctttcaataaagacttattgacctgctgggaccctgaggagaacaagatggccccttgcgaatttggagtcctgaactctcttgccaatgtgctgagccaacatctcaaccagaaggacactcttatgcagagattgagaaacggactgcagaactgcgctacacacacccagcctttctggggaagcctgactaatagaacaaggccacccagtgtgcaggttgccaaaaccacgcctttcaacacccgcgaaccggtgatgctggcctgctatgtatgggggttctatcctgccgaagtcactattacgtggcgcaagaacgggaagctggtcatgccccactccagtgctcacaaaacggcccagcccaacggcgattggacttaccagacactcagtcatcttgcgcttacaccttcctatggggatacgtatacttgcgttgtagagcacacaggcgcacctgagcccatactgcgcgattggacgcccggactctccccaatgcagaccttgaaggtttcagttagtgcagtgacccttggcctgggattaatcatattctccttaggtgtgatatcttggaggagagccggtcattcctctgatcttatcatctcgctgctttttattctgtag

SEQ ID NO: 51476 - DNA, 774 bp, Artificial Sequence
  Description of Artificial Sequence: Synthetic coding sequence
atgatcacatttcttcccctgctgttgggcctgagccttggctgcaccggcgcagggggatttgtcgcgcatgtggagagcacctgcctgctagatgatgctggcactcctaaagacttcacttactgcatcagttttaacaaggaccttctcacttgttgggatccagaggaaaacaagatggctccgtgcgagttcggagttcttaattctttggcaaacgtcctgagccagcatctgaatcaaaaggataccctgatgcaacgcctccgcaacggcctgcagaactgcgccactcacacccaaccattctggggcagcttaactaaccggaccagaccgccaagtgtgcaggtcgccaaaacaaccccctttaacactagagagcctgtgatgctggcgtgttatgtatggggcttttatcccgcagaagtgacaataacctggaggaaaaacggcaagctggtgatgccccactcctcagcccataagaccgctcagccaaatggggattggacttaccaaaccttaagccacctggcactgaccccaagctacggggatacttacacctgtgttgtcgagcatattggcgcacctgagccaatcctgcgtgactggaccccagggctgagccccatgcagactctgaaagtctccgtgtccgccgtgacactgggcctggggctcataattttttccctcggcgttatttcgtggagacgtgcgggtcattccagtgatttgatcattagcctgctgtttatactgtag

SEQ ID NO: 51477 - DNA, 528 bp, Artificial Sequence
  Description of Artificial Sequence: Synthetic coding sequence
atggggcacgaacaaaaccagggggcagctcttttgcaaatgctacctttattgtggctccttccccatagctgggccgttcccgaggagcaatctatgattacattccttcctctgctgcttggcctgtctctgggatgtaccggagccggagggtttgttgcccacgtcgagtccacctgcttattggacgatgcaggcactccgaaagactttacctactgcatttccttcaataaagatctacttacctgctgggaccccgaagagaataaaatggccccttgcgagtttggggtgttaaactctctggctaacgtactctcgcagcaccttaaccagaaagacaccctcatgcagagactacggaacggcctccagaactgtgcaactcatacacaacccttttggggatctctgacgaatcgcacccggcctccatccgtgcaggtggcaaaaaccaccccgtttaacacacgggaaccggtgatgctcgcctgttacgtttgggggttttaccctgcctag

SEQ ID NO: 51478 - DNA, 426 bp, Artificial Sequence
  Description of Artificial Sequence: Synthetic coding sequence
tagaccaggcctccgtctgtccaggtagccaaaacgactccctttaatacacgcgaaccggtgatgctggcctgttatgtctgggggttctaccccgctgaggtcaccatcacatggcggaagaatggtaagctggtgatgccccactcttctgcccacaaaaccgcccagcctaatggagattggacgtaccagacactgtctcatctggctcttaccccatcatacggggatacatatacatgcgtcgtggaacacattggagcaccagaaccaatcttgagggattggacgccgggactatctccaatgcagacactgaaggtctctgtgagtgctgtgaccctgggcctcggcctaatcatatttagtcttggcgtgatttcttggcggcgagctggccacagcagatggcacatctcctag

SEQ ID NO: 51479 - DNA, 528 bp, Artificial Sequence
  Description of Artificial Sequence: Synthetic coding sequence
atggggcatgagcaaaaccagggagctgcccttctgcagatgctgcctttgctctggttacttccccattcttgggccgttcctgaggagcagtctatgatcacattcttgccactcttgctcggactctctttgggatgcacaggtgctggcggattcgtcgcacacgtcgaaagcacttgcctgctggacgatgccggaacaccaaaggactttacgtattgcatttcttttaacaaagatttgctgacctgttgggatcccgaagagaacaagatggctccctgcgaattcggggttctgaattctctcgcgaacgtccttagccagcatctgaaccagaaggacaccttgatgcagaggctgcgcaacggtttgcaaaattgtgccacgcacactcagcctttctgggggagtctgactaatcgcacaagaccaccatccgtccaggtcgcaaagaccaccccctttaataccagggagccggtgatgctcgcatgttacgtctggggattttatcctgcatag

SEQ ID NO: 51480 - DNA, 528 bp, Artificial Sequence
  Description of Artificial Sequence: Synthetic coding sequence
atgggccacgagcaaaaccaaggcgcagctttgcttcagatgctcccactgttgtggctcctcccacacagctgggctgtgcccgaagaacaaagcatgatcactttcctgcctttgctgctcgggttatctctgggctgcacgggcgcagggggttttgtggcccacgtggaatccacctgcctgctggatgacgcaggaactcccaaggactttacctactgtatctccttcaataaggacttgctgacctgttgggatcctgaagagaataaaatggctccctgcgaatttggggtgctaaatagcctggcaaatgtactgagccaacacctgaatcagaaagatactctaatgcagcgcctcaggaatgggcttcagaattgcgctactcatacccaacctttctgggggtctcttacaaataggacaaggccgccaagcgtgcaggttgccaaaaccacaccatttaacaccagagagcccgtaatgttggcctgctacgtgtgggggttctaccccgcttag

SEQ ID NO: 51481 - DNA, 792 bp, Artificial Sequence
  Description of Artificial Sequence: Synthetic coding sequence
atgatcacctttcttccactgctgctggggctaagcctcggctgcacaggtgccggtggattcgtggcccatgtggaatccacctgcctgcttgacgatgctggaacccctaaggattttacctactgcatctcttttaataaagatctgctgacttgctgggatcctgaagagaataagatggccccatgtgaattcggcgtgttgaacagcctagccaacgttctgagccagcatcttaaccagaaagatacgcttatgcaacgtctccgcaatggtctccagaactgtgctactcatacccaaccattctggggaagcctgacgaacagaaccaggccaccttctgtccaggtagcaaagaccacacctttcaatacgagggaacccgttatgctggcctgttatgtgtggggattttatccggcagaagtcaccattacctggcgcaaaaatggcaagttggttatgcctcattcctctgcccacaagaccgcccagcccaacggcgattggacctatcaaacgttatcccatctcgcacttactccttcctatggagatacttatacttgtgtggtggaacacaccggcgctccagagccgatcctgagagattggactcctggactcagtcccatgcaaacactgaaggtgtcggtgagcgccgtgaccttaggactaggtctgattatcttttccctgggcgttatctcctggcggagagccggacactcgtcttatactccgctgcctggtagtaactactctgagggatggcacatctcctag

SEQ ID NO: 51482 - DNA, 426 bp, Artificial Sequence
  Description of Artificial Sequence: Synthetic coding sequence
tgaacccgccctccctccgtccaggtggcaaagactaccccctttaacacaagagagcccgttatgctggcttgttacgtgtggggtttttaccctgccgaagtcacgatcacctggagaaaaaacggaaaactagttatgcctcacagtagcgctcacaagacggctcagccgaatggggactggacctatcaaacattgtctcatctagccctgacaccctcttatggagatacctacacatgtgtggtggaacatatcggagcacccgaaccgatcctccgggactggacaccagggctatctccaatgcaaaccctgaaagtgtccgtgtcagccgttaccctgggccttggtcttatcattttctctctgggggttatcagctggcggagagccggacattcccggtggcatattagttag

SEQ ID NO: 51483 - DNA, 774 bp, Artificial Sequence
  Description of Artificial Sequence: Synthetic coding sequence
atgatcacatttcttcccctactgttggggctgtccttaggttgtacaggagctggcggatttgttgctcacgtcgagagcacctgcctgctggacgatgccggaacccctaaagactttacatactgtatctcattcaataaggacctgctcacttgttgggatcccgaagaaaacaagatggccccatgcgagtttggcgtgttaaatagcttggctaatgtgctgtctcagcacctgaaccagaaggacacactgatgcagcggctccgcaacggccttcagaactgcgccacccacacacagccattttggggcagcttaactaaccggactagacctccttctgtgcaagtcgccaaaacaaccccattcaacacccgggaaccggttatgctggcatgctatgtgtggggcttttaccccgcagaagtgacaatcacatggcggaaaaatggaaagttagtgatgccgcactcaagtgctcacaagaccgctcagcccaatggggattggacgtatcagacgctctctcatctggcactgactccttcatatggagatacatacacgtgcgtggtagagcacatcggggctccagagcccattttgagagattggacacctggactcagtcctatgcagaccctgaaggtctctgtatctgccgtcacactcggcttgggtctgattatctttagcttaggtgttatctcatggcgcagggccggtcacagttccgacctcattatcagcctgctgtttatcctgtag

SEQ ID NO: 51484 - DNA, 774 bp, Artificial Sequence
  Description of Artificial Sequence: Synthetic coding sequence
atgataactttcctccctttgctgctgggtctgagcttggggtgtactggagcaggcggtttcgtggcccatgttgagagcacctgtcttctggacgatgccggtacgcctaaagacttcacttattgcatatctttcaataaagatttgctgacctgctgggaccctgaggaaaataaaatggcaccatgcgaatttggagtactgaacagcctggctaacgtgttaagtcagcacctgaaccagaaggacacccttatgcagagattaaggaatggcctacagaactgtgctactcatactcaacccttttggggaagtctcaccaaccggacaaggcccccatccgtgcaggtagccaagaccaccccttttaatactagggaacctgtgatgctcgcttgctatgtgtggggattttatcccgcagaagtgactataacttggcgaaagaacgggaagctcgtgatgccccactctagtgcacataagactgcacagccaaacggcgactggacatatcaaactttgtcgcatctggccctcacaccttcctacggcgacacctatacttgcgtggttgaacatactggagcccctgagcctatcctcagagattggacgccaggcctctctcctatgcagacgctgaaggtgagtgtttccgctgtgactctgggtttgggcctcattatcttctcgttgggcgtcatctcctggcgaagagccggtcactcctctgacctgatcatcagtcttctttttatcctgtag

SEQ ID NO: 51485 - DNA, 651 bp, Artificial Sequence
  Description of Artificial Sequence: Synthetic coding sequence
atgatcacctttttgccgctgctgctaggacttagtctgggatgcacaggcgctggcggatttgtggcacatgtcgaaagcacatgtctgctggacgacgctggcacccctaaagactttacctactgtatcagcttcaacaaggacctcttgacttgttgggacccagaggaaaacaaaatggcaccatgcgagttcggcgtactgaatagtctagccaatgtgctcagccagcatctgaaccagaaagataccctcatgcagcgtctgagaaacggactccaaaactgcgctacacacacgcaacctttctggggtagtctcacgaacagaacgaggccccctagcgtgcaagttgccaaaacgactccatttaatacccgagaaccggtaatgcttgcttgctacgtttgggggttttatccagctgaagtcaccattacctggaggaagaacgggaagctcgtgatgccccacagcagcgcccataagaccgcccagccaaatggcgactggacataccagaccctttctcacctggcgttgacaccatcttacggagatacgtacacgtgtgtggtagagcacatcggcgctccagagccaattctgcgagattggtccaagtgcatggctgatgggtggaactag

SEQ ID NO: 51486 - DNA, 171 bp, Artificial Sequence
  Description of Artificial Sequence: Synthetic coding sequence
atgccccactcatcagcccacaaaaccgcacaaccaaacggggattggacttaccagaccctctctcacctggcactgacaccttcgtatggggacacctatacgtgtgtggtggaacatattggagcacctgagcctatccttcgtgactggcgctggcacattagttag

SEQ ID NO: 51487 - DNA, 171 bp, Artificial Sequence
  Description of Artificial Sequence: Synthetic coding sequence
atgcctcacagtagcgcccataaaacggcccagcctaacggtgactggacataccagactctatcccaccttgctctgacccctagttatggggatacctatacctgtgtagtggaacacattggggcacccgagcctatactcagggattggcgatggcacatctcgtag

SEQ ID NO: 51488 - DNA, 651 bp, Artificial Sequence
  Description of Artificial Sequence: Synthetic coding sequence
atgattacattcttgcctctgctcctcggcctgagtcttggatgcacgggcgctgggggattcgtagcgcatgtggagtcaacctgtctgctggatgacgccggaaccccaaaggattttacctattgcattagcttcaataaagacctccttacttgctgggacccagaggaaaataagatggcgccatgcgagttcggggttcttaacagtctcgccaatgtgctctcacagcatctcaaccagaaggacactcttatgcagaggcttagaaacggcctacagaactgcgccacgcatacgcagcccttttggggctctctgactaacaggacaagacccccatccgttcaggtggcgaagaccaccccctttaatacaagagaacccgtcatgcttgcgtgctatgtgtggggtttctaccccgcagaggtaaccatcacatggaggaagaacggtaagctggtgatgccgcatagttcagcacataaaactgctcagcctaatggggattggacgtaccagaccctgtctcatttggccttaaccccaagttacggcgacacatacacctgcgtagtcgagcacacaggggctcccgaacctattctgcgcgactggtccaaatgcatggctgacggctggaactag

SEQ ID NO: 51489 - DNA, 207 bp, Artificial Sequence
  Description of Artificial Sequence: Synthetic coding sequence
atgccacactcttccgctcataagaccgcccagcctaacggcgattggacataccagaccctgagtcatctcgcccttacgcctagttacggcgacacatatacatgcgtggtggaacacatcggagccccagaacctatcctgcgggactggagttatacccctcttcctggatcaaattatagcgagggatggcatatctcatag

SEQ ID NO: 51490 - DNA, 171 bp, Artificial Sequence
  Description of Artificial Sequence: Synthetic coding sequence
atgccacacagtagcgcccacaagacggcacagcccaatggtgactggacttaccagactttgtctcaccttgctctgacccccagctatggtgacacctatacatgtgtcgtggaacatatcggcgctcctgagccaatccttcgagactggagatggcacatctcttag

SEQ ID NO: 51491 - DNA, 288 bp, Artificial Sequence
  Description of Artificial Sequence: Synthetic coding sequence
atgccccactcctccgcacacaaaacagcacagcccaatggggattggacttatcagactctgtctcacctggccctgacccccagttacggagatacatacacctgtgttgtggagcatattggggctcccgagccaattctgagagactggactccgggtctcagtccaatgcagaccctcaaagtgagcgtctctgcagtcacgttgggcctcgggttgatcatattttcgttgggtgtgatctcgtggcgcagggccggtcactctcggtggcacataagctag

SEQ ID NO: 51492 - DNA, 207 bp, Artificial Sequence
  Description of Artificial Sequence: Synthetic coding sequence
atgccacacagctctgcacacaaaaccgcccagccgaatggtgactggacttatcagacactgagccacctggcacttacaccttcatatggtgatacatatacgtgtgttgtggaacacattggagcaccagaacctatcctcagagattggagctacacgcccttacctggtagcaattactctgaaggttggcatataagctag

SEQ ID NO: 51493 - DNA, 207 bp, Artificial Sequence
  Description of Artificial Sequence: Synthetic coding sequence
atgccacatagttcagcccataagacagcacagcccaacggcgattggacctaccagacactgtcccatctcgccctcaccccgagttatggcgacacctatacgtgcgttgtggaacacattggggcacccgagcccatcctgagggattggtcatacacacctttaccaggctccaactactcggaaggatggcatatctcctag

SEQ ID NO: 51494 - DNA, 288 bp, Artificial Sequence
  Description of Artificial Sequence: Synthetic coding sequence
atgccgcactccagtgcccacaagacagctcagcccaacggtgattggacctaccaaacactctctcaccttgcacttacaccttcttacggtgatacctatacctgcgtggtggaacacatcggcgctcctgaaccaatattaagggattggacacctggactgagtccaatgcagactctgaaagtatccgtcagtgccgttaccttgggactggggctgattatattttccctcggggtgatctcctggagaagagccggacactcacgatggcatatctcctag

SEQ ID NO: 51495 - DNA, 651 bp, Artificial Sequence
  Description of Artificial Sequence: Synthetic coding sequence
atgattacttttctccccctattactcggactatcacttggatgcacgggcgcaggcggtttcgttgctcacgtggagtctacatgtttgctagacgatgccggaaccccaaaggacttcacttactgcatctcctttaacaaagatctccttacatgctgggaccctgaagagaataagatggctccctgtgagtttggggtgttaaactcccttgcaaacgttctctcccagcacctcaaccagaaagacacactgatgcagagattacggaatggactccagaattgtgcaactcatacccaaccattttggggatccctaacaaatagaaccagacctccttcagtgcaggtagccaagactacccccttcaatactcgggagcccgtgatgttggcctgctatgtgtggggattttatcccgctgaggtaaccatcacctggcgaaagaatggaaaattagtgatgccccattcctctgcccataaaacagcccaaccgaacggggactggacctatcagacgctgtcccatttagcactgacacccagttacggggacacttacacttgcgtggtggagcacattggggctcccgagcccatccttagggattggagtaaatgcatggccgatggttggaactag

SEQ ID NO: 51496 - DNA, 207 bp, Artificial Sequence
  Description of Artificial Sequence: Synthetic coding sequence
atgcctcattcttcagctcacaagacagcgcagcccaatggcgactggacctatcagaccctgtctcacttagcgctgaccccatcatacggcgacacatatacttgcgtggtagaacatatcggcgctccagagccaatcctcagagactggtcgtacacacccttgcccggaagtaattattccgagggttggcacataagttag

SEQ ID NO: 51497 - DNA, 651 bp, Artificial Sequence
  Description of Artificial Sequence: Synthetic coding sequence
atgatcacctttctgcccctgttgctgggcttgtcattaggatgcaccggtgccggaggttttgttgcccacgtggagtccacttgtctgttggatgacgctggtacaccaaaggattttacgtattgcattagctttaataaggatctgctgacatgttgggatccggaggagaacaaaatggccccttgcgaatttggggttttgaactcacttgcgaatgtgctgtcgcaacacctgaaccagaaagatactttgatgcaacgcctgcgtaacggtctgcagaactgtgctacacacacacagccgttctggggctctttgacaaataggacacgccctccctctgtacaggtagccaagaccacaccgttcaacacacgggagcctgtaatgctggcctgctacgtgtggggcttctatcctgccgaagtgactattacatggagaaaaaacggtaagctcgtgatgcctcacagctctgcccacaagacggcccagcccaatggtgattggacctaccagactctgagccacttagcacttaccccaagctacggggatacatacacttgcgtggttgaacataccggcgcaccagaaccaatccttagagattggtccaaatgtatggccgatggatggaattag

SEQ ID NO: 51498 - DNA, 651 bp, Artificial Sequence
  Description of Artificial Sequence: Synthetic coding sequence
atgatcaccttcctccctctgctgctaggcctatcactgggctgcaccggcgcaggcggatttgttgcacatgtggagtcgacttgcctgcttgatgacgccggtaccccgaaggatttcacttactgtatcagtttcaataaggatctgctcacttgttgggacccagaggagaacaagatggctccttgcgaattcggagttctaaatagcttggccaacgtgctctcacagcaccttaatcagaaggatacattgatgcagcggcttaggaacggactgcagaactgcgccactcatacccagcccttttggggctccctgacgaaccgaactcgcccaccgtctgtgcaggtggcgaagaccactccattcaacacaagggagccggtaatgctggcctgttacgtctggggcttctatcccgcagaggtgaccatcacctggagaaagaatggaaaactggtcatgcctcactcatcagcacacaaaacggcccagccaaatggcgactggacctaccaaactttatcgcatctggcactcactccgagttacggagatacttatacttgtgttgtcgagcatacaggcgcacctgagccaatcctccgagattggtctaagtgcatggcagacggatggaactag

SEQ ID NO: 51499 - DNA, 171 bp, Artificial Sequence
  Description of Artificial Sequence: Synthetic coding sequence
atgccccattcttccgcacataagactgcgcagccgaacggtgactggacataccaaactctttctcacttggccctaacccccagttatggagacacatatacctgcgtggtggaacatattggcgctcctgagccaatacttcgggattggcggtggcacataagctag

SEQ ID NO: 51500 - DNA, 651 bp, Artificial Sequence
  Description of Artificial Sequence: Synthetic coding sequence
atgattacattcctacctctcttactgggtctgagtcttggatgtacaggcgctggcggttttgtagctcatgtggagtccacctgcttgctcgatgacgccggtacccccaaagattttacctattgtatatcgttcaataaggatctcctcacatgctgggatccagaggaaaacaagatggcgccttgcgagtttggggtgcttaatagcctggccaatgtgctgagccagcatctgaatcaaaaggacactctgatgcagcgtcttcggaacgggctccagaactgtgcgactcacactcagcccttctgggggtcattaaccaacagaactcggcctcctagcgtgcaggtggccaaaactacaccatttaatactagggagccggtaatgctggcttgctatgtctgggggttctacccagcagaagtgacaatcacttggcgcaagaatggcaagctggttatgccgcatagctccgcccataaaaccgctcagcctaatggagactggacttaccagactctgtcccacttggctttgacacccagctacggtgatacatatacctgcgttgtcgagcacattggggcaccggagcccatcttgcgagattggagtaagtgcatggccgatgggtggaactag

SEQ ID NO: 51501 - DNA, 288 bp, Artificial Sequence
  Description of Artificial Sequence: Synthetic coding sequence
atgccccacagtagcgctcacaaaacagcacagcccaacggggattggacataccagactctgtcccatttggcattgacgccttcatacggagacacgtacacttgcgttgtggaacatatcggtgctccagagccaattctgcgggattggacacctgggttgagtcccatgcagactcttaaagtgtcagtatctgccgtgacgctcggactgggtctgatcattttcagtctgggcgtgatttcatggagacgcgcaggccattccagatggcacatttcctag

SEQ ID NO: 51502 - DNA, 288 bp, Artificial Sequence
  Description of Artificial Sequence: Synthetic coding sequence
atgccccatagttctgcccacaaaaccgcccagcctaacggcgactggacctatcaaacattgtctcacctggccctcactccctcttacggggacacttacacatgtgtagtcgagcatattggggcacctgaacccattcttagggactggacccccggtctatctccaatgcagactctcaaagtgtccgtaagtgccgtaacactcggtctgggcctcattattttctctttgggtgtaatttcatggcggagagccggtcattcccgctggcatatcagctag

SEQ ID NO: 51503 - DNA, 651 bp, Artificial Sequence
  Description of Artificial Sequence: Synthetic coding sequence
atgatcacgttcttaccactgctcttagggctatcgttgggctgtaccggggcaggcggattcgtagcccatgtggaaagcacctgcctactggacgatgctggaacgccaaaggattttacatattgcatttccttcaataaggatttattgacttgctgggacccagaagagaataaaatggctccctgtgagttcggagtgctaaattcactggcaaatgtgctgtcccagcacttgaatcaaaaggatacactcatgcagcgcctcagaaacggcctgcagaactgtgccactcatactcagccgttttggggatccttgaccaataggacccgccctccctcagttcaggttgccaaaaccactcctttcaatactagggaacctgtgatgctggcatgttacgtttggggattttaccctgccgaggtgacaattacttggcggaaaaatggcaagctagtgatgcctcactctagcgcacataagacggctcagccgaatggcgactggacctaccagactctgagccaccttgcgctcacaccatcctatggagacacatatacatgcgttgtagagcacataggggctcccgaacccatcctaagggactggagcaagtgcatggcagatggatggaactag

SEQ ID NO: 51504 - DNA, 465 bp, Artificial Sequence
  Description of Artificial Sequence: Synthetic coding sequence
atggccggtgggggaccacaggctaacccggactatctgttccatgttatcttcctgggagatagcaacgtaggcaagaccagcttcctgcatctgcttcaccaaaactcctttgccacgggtctgaccgccacggtgctccacccatccctgtgcgtgcttggcgtcgactttcgggtcaaaactctactagtcgataacaagtgtttcgtgttgcagctgtgggatacggccggacaggagcggtaccactcaatgacacgccagcttttacgtaaggcagacggagtagtactgatgtacgatattaccagccaggagagcttcgctcacgtgcgctactggctggactgtctgcaagacgccggtagcgacggcgtcgtcattctcctcctgggcaacaaaatggattgtgaagaggagagacaggtgtccgtggaggccggtcagcagctagcacaatag

SEQ ID NO: 51505 - DNA, 261 bp, Artificial Sequence
  Description of Artificial Sequence: Synthetic coding sequence
atggccctccgggctgggctggtgttaggctttcatacccttatgactctgctgtcacctcaggaagcaggcgcaaccaagggacgcgctgggcgacataggagaaatcagagtccaagtgggcatcccggtggcgctttgcagccacagcagagccaccagagggcctctaccggtgacagagcacctcaagtgtccggaggcgctggtcccgctcagcatcctcatctgcacaggggccagcacctgccaccgtgttag

SEQ ID NO: 51506 - DNA, 261 bp, Artificial Sequence
  Description of Artificial Sequence: Synthetic coding sequence
atggccctcagggcaggactggtgttaggattccatactttgatgactctcttatcaccccaggaggccggagcaaccaaaggcagggcgggaagacatcggagaaaccagtcacccagtggccacccgggaggagccttacagccgcagcagtcacaccagagggccagcaccggagaccgggcacctcaagtgagcggaggagccggtcccgcacaacatccacatctacaccgcggacagcaccttccaccgtgctag

SEQ ID NO: 51507 - DNA, 753 bp, Artificial Sequence
  Description of Artificial Sequence: Synthetic coding sequence
atggcactaagagccggactcgtcctaggattccacacgctcatgaccctgctgtctcctcaggaagcaggcgctacgaaagcggatcatatgggtagctacggccctgcattttaccagagctacggggcttcggggcagttcacccacgaatttgacgaagagcagctcttctcagtagacctcaagaaatcagaggccgtttggcggctgcctgagttcggcgactttgctcggttcgacccacagggtggacttgccggaatcgcggcaatcaaagctcacttagacatcctggtggaaagaagcaatagatccagggccatcaacgtcccacccagggtgaccgttctcccaaaaagccgggtggagcttggccaacccaatattttgatctgtattgtggataacatttttcctccagtgatcaacatcacttggctccggaacggccaaacagtaactgagggcgtggcacagacatcattttactcacaaccagaccacctctttaggaaattccactatcttcctttcgtgcccagtgctgaagatgtgtatgactgccaggtggagcattggggtctggacgcgccactcttaagacattgggagcttcaggtccctattcctcctcccgacgcaatggaaactctagtttgtgcgctgggcctcgcaatcggcctggttggattcttggttggaaccgtcctaattatcatgggcacctatgtatccagtgtcccaagatag

SEQ ID NO: 51508 - DNA, 261 bp, Artificial Sequence
  Description of Artificial Sequence: Synthetic coding sequence
atggcactgcgtgccggactggtgttgggcttccacacccttatgacactcttgagtccccaggaggcaggagcgaccaagggatgggccggacgtcacagaagaaatcagagtccttctgggcatccgggaggagccctgcagccacaacaaagtcaccagcgggcttctaccggtgacagagccccacaagtgtctggaggcgctggaccagctcaacatcctcacctccaccgtggtcagcatctgcctccttgctag

SEQ ID NO: 51509 - DNA, 261 bp, Artificial Sequence
  Description of Artificial Sequence: Synthetic coding sequence
atggccttacgcgcaggactggtcctcggctttcacacactcatgaccctactgagcccccaggaggccggtgcaacaaaggggagagccggtcgccataggcggaaccagtctccttccggacaccccggaggcgctttgcaaccccaacagagtcatcagagggcgtcaaccggcgacagagctccccaggttagcggcggagcagggccagcccagcacccccacttgcaccgcggtcagcaccttcccccttgctag

SEQ ID NO: 51510 - DNA, 753 bp, Artificial Sequence
  Description of Artificial Sequence: Synthetic coding sequence
atggcccttagggccggtttggtgcttggcttccacactctgatgactctcctcagcccccaggaggcaggggcaaccaaggccgaccacatgggcagttatggcccagcattttatcagtcatacggagcatctggccaatttactcacgagttcgatgaagaacagcttttttcggtcgatctgaaaaagtcagaagctgtctggaggttgcccgagttcggggactttgctcgatttgacccccaaggaggattggccggtatcgcagctattaaggctcatttagacatcttagtggaaaggtctaacaggtcacgagctattaatgtgccccctcgggttaccgtccttccaaagtcaagagtggagttgggtcagcctaacatccttatctgtatcgtcgacaacattttccccccagtgatcaacatcacctggctgagaaacggtcagaccgtgacggagggcgtagctcagacgtcattctatagtcaacccgatcacctgtttcgtaagttccactatctgccctttgttccctctgctgaggatgtgtacgattgtcaagtcgagcactggggtctagacgctcccctgctgaggcattgggagctgcaggtccctatccccccacccgacgccatggagactcttgtttgtgcccttggcctggcaatcggcctcgtgggcttccttgtgggcacagttcttattatcatggggacctatgtatcatctgtaccgagatag

SEQ ID NO: 51511 - DNA, 753 bp, Artificial Sequence
  Description of Artificial Sequence: Synthetic coding sequence
atggctctgagggcaggcctggtgctcggtttccacacccttatgacactgctgtcccctcaggaagcaggagctacgaaagccgaccatatgggttcgtatgggccagccttttaccagtcatatggagccagtgggcagtttacccacgagttcgatgaagagcaactcttttctgtggacctcaaaaagtcggaggcggtttggcggctgcctgaattcggcgattttgctcgctttgacccgcagggtggactcgcaggaatcgccgctatcaaggcacatctggacattctggttgagcgtagcaataggtcccgggctatcaacgtgccaccaagggtcacagtgctgcctaaaagtcgagtcgagctcgggcagccaaacattcttatatgtatcgtcgacaacattttcccgccagttatcaatattacctggttgcggaacgggcagacggtcaccgaaggcgtcgctcagaccagtttctattctcagcccgaccatttattccgtaaatttcactatctgccatttgtgcccagcgcagaggacgtctacgactgccaggtggagcattgggggctcgacgctccactgctgcgtcactgggagctgcaagttcccatccctccgccagacgcgatggaaaccctcgtgtgcgcactcggcctcgccatcggtcttgtgggtttccttgtcggtacagtgctgatcatcatgggcacgtatgtcagctccgttcccagatag

SEQ ID NO: 51512 - DNA, 186 bp, Artificial Sequence
  Description of Artificial Sequence: Synthetic coding sequence
atggctctaagggctgggttggtgctgggctttcacacattgatgacattactctctccccaggaagccggagccacaaaagctgaccacatggggtcttacgggccacctagtacgtctctgactgctcctagggcatcttctccgatgaacttgatgagaaactcctgtagtttatggacgtag

SEQ ID NO: 51513 - DNA, 753 bp, Artificial Sequence
  Description of Artificial Sequence: Synthetic coding sequence
atggcactacgggctggcctggtattgggattccataccttgatgacgctgctgtctccacaagaagccggagcgacaaaggccgatcacatgggatcttatggacctgccttctaccagtcatacggtgcctctggacagttcacacacgaatttgatgaagagcaactgtttagtgttgatctgaagaaaagcgaggcggtgtggaggctgccagagtttggcgattttgcaagattcgacccccagggcggtctggcagggatagccgcaattaaagcgcatttggatatcctggtggagaggtcaaaccgctcgcgtgcaattaacgtcccaccccgagtgacagtccttccaaaaagccgtgtcgaacttgggcagcccaatatcttgatctgtatcgtggataacattttccccccagttataaacattacttggttgagaaatggtcagactgtcacagaaggagtggctcagactagcttctactcacaaccggatcatctcttcagaaaatttcattacctcccattcgtcccaagcgccgaagacgtctatgactgccaggtggaacactgggggctcgacgcccctcttctgcgacactgggagctgcaggtgccgattcctccccctgatgccatggagactctggtctgcgccctggggctggccataggcctggtcggttttttggtcggtacagtcttaatcataatgggaacctacgtttcttctgttccgcgttag

SEQ ID NO: 51514 - DNA, 753 bp, Artificial Sequence
  Description of Artificial Sequence: Synthetic coding sequence
atggcactgagggcaggactggtgcttggatttcacactctgatgaccctgttatcccctcaggaagctggcgcaactaaggcggatcatatgggatcctatggcccagcgttttaccagtcatacggcgctagcggacaatttacacacgagtttgacgaagaacagctgttctcagtcgatttgaaaaagtctgaggccgtctggagactgcccgaattcggggacttcgctcgttttgatccacagggaggcttggccggaatcgctgcaataaaggctcacttggacatcctcgttgagaggtcaaacagatcgagagccataaacgtgcctccccgagtgactgttctgcccaagtcacgggtagagctgggacaaccgaatatcttgatctgcatcgtggacaacatctttccccctgtgattaacattacctggttaagaaatggccaaaccgttacggaaggcgtggctcaaactagtttctattcccagcctgatcatctgttccgcaagtttcactatctgccttttgtgccaagcgcagaggatgtgtatgattgccaggtcgagcattggggactggacgctcctctgttgaggcactgggagcttcaagttcccatacccccaccagacgcgatggaaaccctagtgtgcgccttgggactggctatcggtcttgtgggcttcctcgtagggacagtgcttatcataatgggcacttacgtctcatccgtgcctcgctag

SEQ ID NO: 51515 - DNA, 261 bp, Artificial Sequence
  Description of Artificial Sequence: Synthetic coding sequence
atggccctcagagcgggactcgtgttaggcttccacactttgatgacgctgctgtcccctcaggaagccggagcgacaaaagggagggccggacgtcacagacgcaaccagtccccgagtggccatccaggcggagcccttcagccacaacagagtcatcagcgcgcatctactggggacagagcaccacaggtgtctggcggagcaggaccagcgcagcacccacaccttcaccggggacagcacctgcccccatgttag

SEQ ID NO: 51516 - DNA, 615 bp, Artificial Sequence
  Description of Artificial Sequence: Synthetic coding sequence
atgggaagctacgggccagctttttaccagagctatggagcttctggacaatttacccatgaatttgatgaggaacagctatttagcgtcgatctgaaaaagtccgaagcagtatggcgtttgcccgaattcggcgatttcgcccgtttcgatccccagggaggcttagcaggaatcgcggcaatcaaggcacaccttgacatcttagtggagcgctccaaccgctctcgagccataaatgtgcctcctcgtgtgactgtgctgcccaagtcccgagtggaattggggcagcctaatatattgatttgtattgtagacaatatctttccgccagtcatcaacatcacatggctgcgcaatgggcagaccgtcaccgagggcgtggcgcagacgtccttttattcccaacctgatcacctgttccgcaaattccactacctacctttcgtcccaagcgccgaagatgtctacgattgtcaggttgagcactgggggcttgatgcccctctgctgaggcattgggggaacgacccgagcgagcgtaacgacctttgggagactccttgcagatctagctgggtgtgtgattcaccttgtgtcctttccgcactgtag

SEQ ID NO: 51517 - DNA, 753 bp, Artificial Sequence
  Description of Artificial Sequence: Synthetic coding sequence
atggctcttagggctggactggtgttaggcttccacacactgatgacgctgctctcgccccaggaggcaggggctacaaaagcagaccacatgggttcatacggaccggcattttatcagtcttacggagcctccggacagtttacccacgagttcgacgaggagcagctcttctccgtagacttgaaaaaaagcgaagccgtgtggcgactccccgagtttggggacttcgccagatttgaccctcagggcggtcttgcgggtatcgctgccattaaagcacacctagacatccttgtggaacgctcgaaccggagtagggccataaacgtgccccctagggttactgtactgcccaaatctcgcgttgaacttggtcagcctaatatcctgatatgcatcgtggacaatatattccctccagtcattaacatcacctggctcagaaacggccagactgtgaccgaaggcgttgctcagacatctttctatagccagccagaccacctgttccgtaaattccactacctgccctttgttccatctgcagaagacgtgtatgattgtcaagttgagcactggggtctggatgcacccctgctgcgacactgggaactccaggtcccgatcccgccacctgacgccatggagaccctggtgtgtgcactgggtttggcgatcggcctagtcggatttctggtggggacagttctgataattatgggtacttacgtctccagcgtcccaagatag

SEQ ID NO: 51518 - DNA, 261 bp, Artificial Sequence
  Description of Artificial Sequence: Synthetic coding sequence
atggcgctgagagcaggcctggttctaggatttcacacacttatgactctactgtcacctcaggaggccggagctactaaaggctgggctggaaggcacaggcggaaccaatcaccgtccggccaccctggtggagccttgcagccacagcaatcccatcagagagcgagcaccggggatcgcgcacctcaggtgagtggcggagccggaccagcgcagcatccccatctccaccgaggccaacatctccccccatgctag

SEQ ID NO: 51519 - DNA, 261 bp, Artificial Sequence
  Description of Artificial Sequence: Synthetic coding sequence
atggcgctgagagccggactggtgctggggttccacacccttatgaccctcctgagccctcaagaggctggcgctacaaaggggagagccggacggcataggcggaatcagagcccgagcggacatccgggaggcgcactgcagccccagcaatcccaccagcgcgcatccactggcgacagagctcctcaggttagtgggggagcagggccagctcaacaccctcaccttcaccgcggacaacacctccctccatgctag

SEQ ID NO: 51520 - DNA, 186 bp, Artificial Sequence
  Description of Artificial Sequence: Synthetic coding sequence
atggctttaagggccggtctggttttgggattccatactctgatgaccctcctcagcccacaagaggcaggggctacaaaagcagaccatatgggcagctatggaccaccctccacttctcttactgccccacgggcatcttctccaatgaatctgatgcggaactcctgctccctgtggacttag

SEQ ID NO: 51521 - DNA, 186 bp, Artificial Sequence
  Description of Artificial Sequence: Synthetic coding sequence
atggcacttagagccggactggttttaggtttccatactctgatgaccctgctgtctccccaagaagcgggagccactaaggcagatcatatgggctcttacggaccaccttcaaccagcttaaccgcccctcgagcttccagccctatgaatctgatgagaaacagctgtagcctatggacctag

SEQ ID NO: 51522 - DNA, 615 bp, Artificial Sequence
  Description of Artificial Sequence: Synthetic coding sequence
atgggctcgtacggaccggctttctatcagtcttatggggcaagcgggcagttcactcatgagtttgatgaagaacagttgttttcagttgatcttaagaagagtgaggccgtctggagactgcctgagttcggagacttcgctaggttcgacccccagggcggactggcgggaatagctgcaataaaagcccacctcgacattttggtggagcggagcaatcgatcgcgggcaattaacgtgccacctcgcgtgaccgtactgccaaaaagccgggtagaactcgggcaacccaatattctgatttgcattgtggataacatcttccccccagtcataaacatcacctggctccgtaatggacagactgtgacagagggggtggcccagacgtctttttattctcaacccgatcacctgtttcgtaagtttcactaccttccttttgtgccgtcagctgaagatgtttatgactgtcaagttgaacattggggtctcgacgcaccactactaaggcactggggtaatgatccaagcgagaggaatgacctctgggagacaccctgcaggtcatcctgggtatgtgactcgccgtgcgtcctctcagcactgtag

SEQ ID NO: 51523 - DNA, 615 bp, Artificial Sequence
  Description of Artificial Sequence: Synthetic coding sequence
atggggtcatacggaccggcattctatcagtcatacggcgcttccggccagttcacccacgaatttgacgaggaacagctgttctctgtggatctgaaaaagagcgaagcagtgtggaggcttccagaattcggggatttcgcaaggtttgacccccaggggggtttggccggaattgcggctatcaaagctcacctggatatccttgtggaaaggtctaatagatcacgggctattaacgtacccccacgagtaacagtgttgcccaaaagccgggtggaactcggtcaaccaaacatactgatctgcatcgtggataacattttccctcccgtcatcaatattacgtggctgcgcaatgggcagaccgttacggaaggagttgcccaaacatcattttactcacaaccggaccaccttttccggaaatttcattatctgccattcgttccctccgcggaggatgtttacgactgccaggtcgagcattggggcctggatgcccctcttttacgtcactggggcaacgacccaagcgagcgtaacgatctctgggaaaccccctgccgctctagctgggtatgtgacagcccttgtgtgctcagtgctttatag

SEQ ID NO: 51524 - DNA, 615 bp, Artificial Sequence
  Description of Artificial Sequence: Synthetic coding sequence
atgggaagctacgggccagcattctaccagtcctatggagctagtggacagtttacacacgagtttgacgaagagcagctcttctcagtggatcttaagaaatccgaggcggtgtggaggcttcccgagttcggtgatttcgcacgcttcgaccctcaggggggactcgcgggaatcgctgccataaaggcccacttagacattctcgtcgagcgcagcaatcggagtagagccatcaacgtacccccaagggtgacagtgctacctaaatcccgagtcgaattaggccagccaaacattttaatttgcatagttgacaacatcttccccccagttattaacatcacctggcttcgtaacgggcaaacggtgacagagggggttgctcagacatccttctatagtcagccggatcatttgtttcgtaaatttcactaccttcccttcgttcctagtgccgaggatgtctatgactgccaggtcgaacactggggtctggatgcaccactgctgcgtcactggggcaacgatccttcggaacgaaatgacctctgggagacaccctgtcgtagctcatgggtctgcgacagtccctgtgttctttcagccttatag

SEQ ID NO: 51525 - DNA, 186 bp, Artificial Sequence
  Description of Artificial Sequence: Synthetic coding sequence
atggccctgcgggcagggctggtgttgggcttccacacactgatgactttgcttagccctcaggaagccggagctacaaaggccgaccacatgggatcatacggaccgccaagcacttctttaactgctcctcgcgcatcctcacccatgaacctgatgcgaaattcatgctccctgtggacctag

SEQ ID NO: 51526 - DNA, 615 bp, Artificial Sequence
  Description of Artificial Sequence: Synthetic coding sequence
atggggtcctacggtcccgctttctaccagtcctatggggcaagtggccagttcacccacgagttcgacgaagaacagctattttcagtggatctcaaaaaatctgaagccgtctggcgcctgccagagtttggcgattttgcacgtttcgaccctcaggggggactggccggaattgccgctatcaaggcccatctcgacatcctcgtggaaaggagcaaccgtagtagggcaattaatgtgccaccacgcgttactgtgctccccaagtctagggtggagttgggccagccgaacatactgatctgtatagttgataacatctttcctccagtgatcaacatcacctggcttcgcaacgggcagaccgtgactgagggggtagcacaaacttctttctatagccagccagatcatttgttccggaaattccactacttacccttcgtccccagtgccgaggatgtttacgattgtcaagtggagcattggggattggatgccccattattaagacactggggtaatgacccaagcgaaaggaatgacctttgggaaacaccatgtaggtcttcgtgggtgtgtgactctccctgtgtgctttcagctctgtag

SEQ ID NO: 51527 - DNA, 615 bp, Artificial Sequence
  Description of Artificial Sequence: Synthetic coding sequence
atggggtcctacggccctgccttttatcagtcttatggggcatcaggacagttcacccatgagttcgatgaggaacagctgttctcagtggatctgaagaagtctgaagccgtgtggcggctccctgagtttggggattttgcaagatttgaccctcagggtggactcgctggcatcgccgctataaaggcacatttggacatcctggttgaacgcagcaaccgtagccgcgctatcaacgtaccgcctagagtgactgtcctacctaaatcaagggtcgagctggggcaaccaaacatactgatatgtatcgtggacaatatcttcccacctgtcatcaacattacctggctgaggaacggacagacggttacagagggagtggcccagaccagcttttattcccagccagatcatctgttcagaaagtttcactaccttccctttgtcccctcggctgaggacgtatatgattgtcaggtagagcactggggcctggacgcacccctgcttaggcattgggggaacgatccctctgagcggaatgatctctgggaaaccccctgtcgatcttcttgggtgtgcgattctccgtgcgtgctctccgcgctgtag

SEQ ID NO: 51528 - DNA, 186 bp, Artificial Sequence
  Description of Artificial Sequence: Synthetic coding sequence
atggccctcagggcgggtctcgtgctggggttccataccctcatgaccctgctatccccccaagaggcaggtgccacgaaagccgatcacatgggctcttatgggccaccaagcacctcactcacagcaccacgcgcatcgagtcccatgaacttgatgcggaattcctgtagcctgtggacctag

SEQ ID NO: 51529 - DNA, 186 bp, Artificial Sequence
  Description of Artificial Sequence: Synthetic coding sequence
atggcattgcgtgccggactcgtcctagggtttcatactctgatgactcttctgtctccacaggaagcgggagcaaccaaagctgatcacatgggtagctacggaccaccttcgacgtctctgacagcgcctcgagcctcgtccccaatgaatctcatgcggaactcctgctccctttggacgtag

SEQ ID NO: 51530 - DNA, 186 bp, Artificial Sequence
  Description of Artificial Sequence: Synthetic coding sequence
atggcactgagagccggactcgtcctcggtttccacacactcatgacactgttaagcccacaggaggctggcgctactaaggctgaccacatgggaagctacggccctccttccacctctctgaccgcaccaagggcgtcatctcccatgaatctgatgagaaacagctgctccctctggacttag

SEQ ID NO: 51531 - DNA, 615 bp, Artificial Sequence
  Description of Artificial Sequence: Synthetic coding sequence
atgggttcttacggaccggctttctatcagtcgtatggggcatccggccagtttacacatgagtttgatgaggagcaactcttctccgtcgacctgaaaaagagtgaagccgtttggcggctccctgagttcggtgacttcgcgaggtttgacccacagggcggacttgctgggatcgcagcaatcaaagctcatctagatattctggtggagcggtctaaccgttcacgggctataaacgtcccccctagagtcacagtgctgcctaagtctagagtcgagcttgggcagcccaacattctcatctgcatcgtggacaacattttcccccctgtgatcaatataacctggctccgcaacgggcagacagtcacagaaggagtggcacaaaccagcttttactctcaacctgaccatctgttccgtaagttccactacctgccctttgttcctagcgctgaggatgtgtatgattgtcaggtggagcattggggtttggatgcccctttactgcgccattggggcaatgatccaagcgagagaaatgacctctgggaaacgccatgtcgcagttcatgggtctgcgatagcccatgtgtcctgtccgcactgtag

SEQ ID NO: 51532 - DNA, 549 bp, Artificial Sequence
  Description of Artificial Sequence: Synthetic coding sequence
taaaacctcacaaggctggacagcagcatgacgcagggtacagattccccagaggacttcgtcatccaagccaaggctgattgctacttcaccaacgggactgagaaggtgcagttcgtagtccgctttatctttaatttggaggaatacgtgagattcgattcagatgtgggaatgtttgtcgccctcacaaagctgggacagccggacgccgagcagtggaactctcgtctcgacctgttagagaggtctaggcaagccgtcgatggtgtgtgtcggcataattatcggctcggagctcccttcacagtgggccgaaaagaagtgacagtatatcctgaacgtaccccactgttacaccagcataacctgcttcactgttcagtcacagggttctacccaggggatattaagattaaatggtttcttaacgggcaggaagagagggctggcgtgatgtccaccggtccaattcgaaacggagactggacattccagactgtggtgatgttagaaatgacccctgaactgggccacgtctatacatag

SEQ ID NO: 51533 - DNA, 822 bp, Artificial Sequence
  Description of Artificial Sequence: Synthetic coding sequence
atggggtccggttgggtgccctgggtcgttgccctgttggttaacctgacccgtctggacagttcgatgactcaggggactgattccccagaagattttgtcatacaggcaaaagccgactgttacttcactaacggtacagaaaaggtacagttcgtggtccgatttattttcaatttagaggaatatgttcgttttgatagcgacgtaggaatgttcgtggcgttgacaaagctggggcagccggacgctgagcaatggaatagccggctggacctgctggaacgttctcgccaagccgtcgacggggtgtgtagacacaattataggcttggggcacccttcacggtgggcaggaaagtgcagccagaagtgaccgtttatcctgagcggacacctcttctgcatcagcacaacctgctgcactgttccgtgacgggattttatcctggtgacatcaaaattaaatggttcctaaacgggcaagaggagcgcgcaggagtaatgagcaccggcccaattcgaaatggtgactggacatttcagaccgttgtcatgctcgaaatgactccagagctaggccacgtctacacctgtttagtcgaccatagcagtttgctaagtcccgtgtcggtggagtggcgcgctcagtccgagtactcatggcggaagatgttgagtggtatagccgctttcttgctcgggcttatttttctattagtagggatcgtgatacagctgagggcccaaaaggggtatgtccgaactcagatgtctggcaatgaagttagcagagccgttctgctgccccaaagctgctag

SEQ ID NO: 51534 - DNA, 822 bp, Artificial Sequence
  Description of Artificial Sequence: Synthetic coding sequence
atgggcagtggctgggtgccgtgggtggttgccctattggtgaacttaacgcggctggacagcagcatgacccagggtaccgacagtcctgaagacttcgttattcaggccaaggctgattgttacttcactaatggaaccgagaaggtgcagtttgtggttcggtttatattcaacctcgaggagtacgtgagattcgactcggacgttgggatgtttgtggctctaactaaactgggacagccagacgctgaacagtggaatagtcgactggatctcctggagcgctccaggcaggccgtggatggcgtgtgcagacacaactaccgacttggtgctccatttactgttggcagaaaggtacagccggaggtgacagtctatcccgagaggactcccctgctccaccaacataatctgctgcactgttcagtcacaggattttaccctggggacattaagattaagtggttcttaaacggacaagaggagcgtgcgggtgtgatgagcactggcccaatccgaaacggagactggaccttccagaccgtggtgatgttggagatgacgcctgagctcggacacgtgtacacatgcttagttgatcattcctccctgctctcacccgtctccgtggagtggcgcgctcagtctgagtactcttggcggaagatgttgtctggcatagctgccttcttgctgggcctcatctttctgctggtggggatcgttattcagctcagggctcagaaaggatatgtgaggactcaaatgagcggtaatgaggtctcccgcgcagtcctactgcctcagagctgttag

SEQ ID NO: 51535 - DNA, 549 bp, Artificial Sequence
  Description of Artificial Sequence: Synthetic coding sequence
taaaatctgacaagactggattcaagcatgacacagggcactgactcccccgaggactttgttatccaggctaaagcagattgttattttacgaatggaacagaaaaagttcagttcgtggtcaggtttatattcaatctggaagagtatgtgagatttgattccgacgtgggcatgttcgttgctctgaccaaactggggcagcccgacgccgagcagtggaattccaggctggatttgttggagcggtcccgccaggccgtcgatggagtgtgtcgacataattatagactgggggctccctttactgtcggacggaaggaagtgacagtctacccagaaaggacacccctgcttcaccagcacaatctgctgcattgctctgtgacaggattttaccccggagacataaagattaaatggtttctaaacggccaagaggaaagggctggcgtgatgagcacgggacctatccgcaatggagactggacattccagacagttgttatgctggagatgactcccgagctgggacacgtgtatacatag

SEQ ID NO: 51536 - DNA, 822 bp, Artificial Sequence
  Description of Artificial Sequence: Synthetic coding sequence
atgggatcagggtgggtaccttgggtcgtggcgttactggtcaatctgaccaggctagatagcagcatgacacaggggaccgacagccccgaagacttcgtgatacaggccaaagctgattgctattttactaacggcacagagaaagtgcagttcgtcgtgcgattcatatttaatctggaagagtatgtgcgattcgattctgacgtcggaatgtttgtcgccctcaccaaactcgggcagcccgatgctgagcaatggaactcaaggctggaccttctcgagcggagtcgccaggctgttgacggcgtatgcagacataactacagactcggtgcaccctttactgtcgggcgtaaagtgcaacccgaggtgaccgtatatccagaaaggacaccactgctgcaccaacacaatttactgcactgttcagtaactggtttctatcccggtgatataaaaatcaagtggtttctcaacggccaggaagagagggctggtgtcatgagcactggccctattagaaacggcgattggacatttcagaccgtcgtcatgctggaaatgactcctgagttagggcacgtatatacttgcctggtggatcactcgagcctattgtcccccgtgtctgtcgagtggcgggctcagtccgagtatagttggagaaaaatgctgtccggaatagctgcttttctgctcggtctcatatttctgctggtgggcatcgtgatccaattacgcgcacagaagggatacgtgaggacccaaatgtccggcaatgaggtgagccgggctgtactgctgccccagtcgtgttag

SEQ ID NO: 51537 - DNA, 549 bp, Artificial Sequence
  Description of Artificial Sequence: Synthetic coding sequence
tgaaacctgactcgactggatagttctatgactcaggggaccgacagccctgaggacttcgtcattcaagccaaagcagattgctatttcacgaatggcaccgagaaggtccagttcgtggtgcggttcatttttaacctggaagagtatgtgcgatttgactctgacgtggggatgtttgttgccttaactaaactgggacagccagacgccgaacagtggaattcaaggcttgatttgctggagaggagcaggcaggctgtggatggcgtctgccgccataactaccggctcggagcacctttcaccgttggccgtaaggaggtgaccgtctatcctgagcggacacctcttctgcaccagcacaacctcctgcactgtagtgtgacaggcttctaccctggagacatcaagataaagtggtttctcaatggtcaggaggaacgcgctggggtcatgtccaccggcccaattcgcaatggggattggaccttccagaccgtggttatgttagaaatgacacccgaattaggccacgtgtacacctag

SEQ ID NO: 51538 - DNA, 549 bp, Artificial Sequence
  Description of Artificial Sequence: Synthetic coding sequence
tgaaacctgaccaggctcgactcttcaatgacccaggggactgactccccagaggatttcgtgatccaagccaaagcggactgctactttacaaatgggacggagaaggttcagtttgtagtcaggttcatcttcaatcttgaggagtacgtgagatttgatagcgatgtgggaatgtttgttgcactcacgaagttaggtcagcctgacgcggaacagtggaattctcgcctcgatttactcgagagatcccgacaagccgtcgatggcgtgtgcaggcacaactatagactaggcgcaccctttaccgtgggtcggaaagaggtaactgtgtatcccgagcgcactcctctgctgcaccagcacaatctgcttcattgctccgtgaccggattctaccccggagacatcaagatcaagtggttcttgaacggccaggaagagagggccggagtcatgtccaccggcccaatcagaaacggcgactggacctttcagacagtggtgatgctagaaatgactcccgaattaggtcacgtctacacatag

SEQ ID NO: 51539 - DNA, 549 bp, Artificial Sequence
  Description of Artificial Sequence: Synthetic coding sequence
tgaaacctgacacggttagattcctctatgacccagggcactgacagccccgaagatttcgtgatccaggctaaggccgactgttatttcacaaatgggactgaaaaggtgcagttcgtggttcgcttcatatttaaccttgaggaatacgtgagattcgactctgatgttggtatgtttgtagccctaaccaagctgggacagcctgacgcggagcagtggaatagccggctggatctgctggagagatctaggcaggccgtcgatggcgtatgccgtcacaattatcgtctaggggcaccctttaccgtcgggaggaaagaggtaactgtttatcccgaacgtaccccgctgttacatcagcacaatctactgcattgcagcgtgaccggcttctacccgggagatataaaaattaagtggtttttgaatggtcaggaggaacgggctggagttatgtctacaggcccaattcgcaacggcgactggacctttcagacagttgtgatgttagaaatgactccggaattgggacacgtttatacatag

SEQ ID NO: 51540 - DNA, 822 bp, Artificial Sequence
  Description of Artificial Sequence: Synthetic coding sequence
atgggtagcgggtgggtaccttgggtggtagctttgctagtgaatctgacccggctggatagctccatgactcaagggaccgacagtcctgaagacttcgtgatacaggccaaggcggactgttatttcactaacggaactgaaaaggtgcaattcgtggtgagattcatctttaacctggaggaatatgtccggtttgattctgacgtaggtatgttcgtcgctctgacaaaactgggacagccagatgccgaacagtggaacagtcgcctggatcttctagagcgctcaagacaagccgtagacggagtctgccgccacaattatagactcggggctccatttactgttggacggaaggtacaacctgaagtgacggtgtatccggagcgaactccgctgctgcaccagcacaatctgcttcactgcagcgtgactggtttctatcccggtgacattaagatcaagtggttcctgaatgggcaagaagagcgtgcgggagtgatgagcacaggtccaattcgaaacggcgattggacatttcagactgtggtgatgttggagatgacccccgagctgggtcatgtttacacgtgcctcgtggaccatagctccctgctctcacctattagcgtggagtggagggctcaatccgagtacagctggaggaagatgctgagcggcatcgcagcattcttactgggattgatattcctgctggtgggcatcgtgatacagctccgcgctcagaaaggctacgtgagaactcaaatgagtggaaacgaggtgagtagggctgtactgctgcctcaatcctgttag

SEQ ID NO: 51541 - DNA, 822 bp, Artificial Sequence
  Description of Artificial Sequence: Synthetic coding sequence
atgggaagcgggtgggtgccctgggtggtggcccttctagttaatttgacccgcctggatagtagcatgactcaggggacagatagccccgaggatttcgtgatacaggctaaagcagactgttacttcaccaatggaactgaaaaggtccagttcgtggtgaggtttattttcaatctcgaagaatatgtccgcttcgactctgatgtcggcatgttcgtcgctttgaccaagctggggcaacccgacgccgaacaatggaattctagactcgacctgctggaacgcagtcgccaagccgttgacggtgtttgccgccataactatcgcttgggtgcccctttcaccgtgggacgcaaggttcaacctgaagttacagtgtatccggagcggacgccgttactgcaccagcacaacttgctccactgctccgttactgggttttaccccggtgatattaagatcaaatggttcctgaacggtcaagaagaacgcgctggggtcatgagcactggacccattagaaatggagactggacattccagactgtggtgatgttggaaatgaccccagaattggggcacgtttacacctgtttggtggatcattcttccctcctctcccctgtctccgtcgaatggcgggcacagtcagagtactcctggcgtaagatgctcagcggaatcgccgctttcctcttggggctcatattcctcctagtaggaatcgtgatacagctaagggcccagaaagggtacgtgcggactcaaatgtcagggaacgaagtcagcagggccgtgctcttgccccagagttgctag

SEQ ID NO: 51542 - DNA, 549 bp, Artificial Sequence
  Description of Artificial Sequence: Synthetic coding sequence
taaaatcttactagactggacagctccatgactcagggaacagatagtcctgaagatttcgtgattcaagcaaaggcagattgctactttaccaatggtacagaaaaggtccagttcgtcgtacgtttcatctttaaccttgaagagtatgtacggtttgactccgatgtcgggatgttcgtcgccttaacaaaactgggacaaccagatgcagagcaatggaactccagactggacttactcgagcgtagcagacaagcagtcgatggggtttgtcgccacaattacaggctcggtgctcccttcacagtcgggaggaaggaagtaaccgtctatccggaaagaacacctctgctgcaccaacataatttactacactgctccgtgactggattctaccctggagatattaagatcaagtggtttttgaatggtcaggaggagagagcaggagttatgagcacgggccctattaggaacggcgattggacattccagacagttgtgatgctggagatgactccggaactggggcatgtatacacatag

SEQ ID NO: 51543 - DNA, 822 bp, Artificial Sequence
  Description of Artificial Sequence: Synthetic coding sequence
atgggctctggctgggtcccctgggtggtggctttactggtcaatctaacaagactcgatagctccatgactcagggcaccgattccccagaagacttcgtgatccaggcaaaagcagactgctattttacaaacggcacggaaaaagtccagtttgttgtccggtttatatttaatttagaggagtatgttaggttcgattccgacgtcggtatgtttgtagcattgactaagcttggtcagcctgacgccgaacagtggaactcacggcttgacctgctggagcgctctcggcaagctgtggacggtgtgtgtcgccacaactatcgcctgggagcaccattcacagtcgggagaaaagtacaaccggaggtcacggtgtaccccgagagaacacctcttctccatcagcacaacttactacactgtagtgttactggcttttaccctggagatatcaagatcaagtggtttttgaacgggcaggaggagagagccggtgttatgtccaccgggccaatccggaacggagattggaccttccagacagtggtgatgcttgagatgacacccgaactggggcacgtgtacacatgtctagtagatcatagctcgctcttgtccccagtatctgtagagtggcgggctcagagtgaatatagttggaggaagatgctgtcaggcatcgctgccttcttgttgggtttgattttccttctggtgggaatcgtgatccagctgcgagcccaaaagggctatgttcgtacgcagatgagcggcaacgaagtgagtcgcgctgtgctcctcccacagagctgctag

SEQ ID NO: 51544 - DNA, 411 bp, Artificial Sequence
  Description of Artificial Sequence: Synthetic coding sequence
atgtcatggaagaaggccctgaggattcccggagggctgcgagtagcgaccgttacgcttatgttagcgatgttaagcacgcctgtcgcggagggcagagacagcccggaggacttcgtgtaccaatttaaaggaatgtgctatttcaccaacggtaccgagagggtccgcttggtgactcggtacatctacaatcgggaggaatacgcgagatttgactccgatgtcggggtgtatcgcgcagtcaccccgctggggcctcccgacgcagaatactggaatagccagaaagaagtcctggaacggaccagagcagaactagacaccgtctgccgccacaactaccaactggagttgcgcaccactttgcagaggcggggaactgtaactggcccttcacggtcctggtag

SEQ ID NO: 51545 - DNA, 840 bp, Artificial Sequence
  Description of Artificial Sequence: Synthetic coding sequence
atgagctggaagatggccctacaaattccagggggattttgggctgcagctgtcacagtgatgcttgtgatgctcagtacaccagtcgctgaggctagagacttcccaaaagatttccttgtgcagtttaaaggcatgtgctattttaccaacgggacagaaagggttaggggagtggcaagatatatttacaacagagaggaatatggacggtttgattcagatgtgggtgaatttcaggccgtcacagagctgggacgatccattgaggattggaacaattacaaagatttcctggagcaggagcgcgcagcggtggacaaggtctgcagacacaattatgaggctgaactgagaaccaccctccaacggcaggtggaaccgacggtcaccattagtccttcccgcaccgaggctctgaaccaccacaatctgctagtatgtagtgtcacggacttttatcctgcccagatcaaggtacagtggtttaggaacgaccaagaagagaccgcaggcgtagtgtccaccagtctgatccggaacggagactggacgtttcagatccttgtcatgttagaaatcacccctcagcgaggcgacatctacacgtgccaggtggaacatcccagtcttcagtctcccattaccgtggaatggagagcgcagagcgagtccgcccagagtaagatgctcggcggagtgggcggatttgtcctcggactgatatttctcggtctgggtctgatcatccgccatcgaggtcagaagggaccccgtgggcctcctcccgctggtaatatcagcgccatgatacagagtggggagcgcgctcaggcctag

SEQ ID NO: 51546 - DNA, 696 bp, Artificial Sequence
  Description of Artificial Sequence: Synthetic coding sequence
atgagctggaaaatggcgcttcagatcccaggcggtttttgggcagcagctgtcactgtcatgttagtcatgctctctacccccgtggctgaagcccgagacttccctaaagattttttagtccagttcaaaggaatgtgctactttaccaacggtacagaacgtgtgagaggggtagctagatacatctacaatcgcgaagaatacggcaggtttgattcagacgttggcgagttccaggcagtgaccgagctgggccgttctattgaggattggaataactataaggactttcttgagcaggagagggctgcggtggacaaggtctgccggcataattacgaggccgagctgcggactaccctgcaaaggcaggtggaacctacagtcaccatttcaccctcaagaaccgaagctctcaaccaccataacctcttggtgtgtagtgttacagacttctaccccgcacagatcaaagttcagtggttcaggaacgaccaagaagaaaccgcaggggtggtcagcaccagtttaatccgcaacggggactggacatttcagatccttgttatgttagagatcaccccgcagaggggggatatctatacttgccaagtggagcaccctagcttgcagagcccaattacagttgagtggaggccacggggtccccctcctgctggcttattacactag

SEQ ID NO: 51547 - DNA, 807 bp, Artificial Sequence
  Description of Artificial Sequence: Synthetic coding sequence
atgagctggaagatggcgctgcaaatacccggtgggttctgggccgcagctgtgacagtcatgttggtcatgttaagcactcctgtggctgaggccagggatttcccaaaggactttcttgtccagtttaagggtatgtgctatttcactaacggcacagaacgggtgcgcggtgtcgctcgatatatctacaatcgggaggagtatgggcgatttgactccgacgtcggcgagttccaggccgtgactgagctgggacgctcaatcgaggattggaataattataaggacttcttggagcaggagcgggcagccgttgataaggtgtgtcggcacaattatgaagctgaactcagaaccactctccagcggcaggtcgagcccactgtcaccatctctcccagccgtaccgaagcactcaaccaccacaatctgctggtatgttccgtgacggacttttaccccgctcagattaaggtccagtggttccgaaatgatcaggaggagacagcaggagttgtttctactagcttgatcaggaacggcgactggacctttcagatcctggtgatgttagagattacgccccagagaggtgacatttatacttgtcaagtggaacaccccagccttcagtcacctatcaccgtcgagtggagagcccagagcgaaagcgctcagtccaaaatgttagggggagtcggcggattcgttttagggctgatcttcctaggcctcggtcttattatcaggcaccggggacagaaagggccacgcggaccccctcccgctggactgttgcactag

SEQ ID NO: 51548 - DNA, 684 bp, Artificial Sequence
  Description of Artificial Sequence: Synthetic coding sequence
atggcattgcagatccccggaggattctgggcagctgcagtcactgtcatgctcgtcatgctctctactcctgtggcagaggcaagggactttccaaaggattttttggttcagtttaagggcatgtgctactttacgaacggaactgaaagagtgaggggcgttgcccgttacatttataacagggaagagtacggcaggtttgattctgatgtcggagagttccaagccgtaaccgagttgggtcgctccattgaggattggaataactacaaagattttctggaacaagagcgggctgccgttgataaggtgtgcagacacaactatgaagcggagctgcgaacaaccctccagcgccaggtcgagcctacggttactatcagtccgtccagaactgaggccctgaaccatcacaacttattggtgtgttcagtaacagacttctatcctgcacagataaaagtgaggtggttccgcaatgaccaggaggaaacagcaggtgtcgtgagcaccagtcttatcagaaatggcgactggactttccaaattctggtgatgctcgagatcacacctcagagaggtgatatctatacatgccaggtagagcacccgagtctccagagtcccattacagttgagtggcggcctcggggaccaccgccagctggccttttgcattag

SEQ ID NO: 51549 - DNA, 828 bp, Artificial Sequence
  Description of Artificial Sequence: Synthetic coding sequence
atggcgctccagataccagggggattttgggctgctgccgtcaccgtcatgctcgtcatgttgagcacgcctgtcgctgaggcgcgagactttcccaaagatttcctggtccagttcaaaggaatgtgctactttaccaatgggacggagcgagtcaggggcgtggctcgctacatctataaccgggaggagtatggcaggttcgattccgatgtgggcgagtttcaagccgtcactgagctgggacgctcaatagaagattggaataattataaagattttctcgagcaggagcgagcagctgttgacaaggtgtgtcgacacaactacgaggccgaactgcgcacaacactacaacggcaagtggagcctacagttaccattagcccttctaggacagaggccctgaatcaccacaaccttctagtgtgtagcgtgaccgacttttacccagcacagattaaagtaagatggttccgaaacgaccaggaggagactgccggtgtggtttccacttccctcattagaaatggcgattggacttttcagattcttgtgatgctcgagattactccgcagcgaggagatatctatacatgccaggttgagcatccgagcctccagagtccaataaccgtggaatggcgggctcaatcggaatccgcccagagcaaaatgttgtctggcatcggaggcttcgtactcggcctgatatttctaggtctcggcctaatcatacggcatcggggacagaagggtccacgtggtcctcctcccgctggcaatatctctgccatgatccaaagcggtgagagggcccaggcttag

SEQ ID NO: 51550 - DNA, 657 bp, Artificial Sequence
  Description of Artificial Sequence: Synthetic coding sequence
tgattgcagattcccggtggcttttgggctgcagccgtgacagttatgctggtgatgttgtccacgccagtggcagaggctcgggacttccccaaagatttcttggtccagttcaaagggatgtgttacttcacaaatgggacagagcgggtcagaggcgtggccagatacatttataaccgcgaagaatatggaaggtttgactcagatgtgggagaattccaagcagtgacagaactgggaaggagcatcgaagactggaataactacaaggattttctggagcaggaacgcgcagccgtggataaagtgtgtcggcacaactacgaagccgagttgaggacaaccctacagagacaagttgaaccaacggtaaccatctctccatctaggaccgaagccttaaaccatcacaacttgctcgtgtgttctgtgaccgacttctacccagctcagatcaaggtgcagtggtttcggaacgaccaggaggaaactgccggtgtagtcagcacctccctgatccgaaacggagactggaccttccagattctggtcatgctcgaaatcacacctcaacgcggtgatatttacacttgccaggtggaacacccatcacttcagtcccccatcaccgttgaatggaggttgctccactag

SEQ ID NO: 51551 - DNA, 696 bp, Artificial Sequence
  Description of Artificial Sequence: Synthetic coding sequence
atgtcatggaaaatggccctgcagattcctggcggtttttgggcagctgcggtgactgtcatgttggtgatgcttagcacgccagtggcagaagctcgcgatttccctaaagatttcctggtacagtttaaggggatgtgctactttacgaatgggacggagagggtaagaggggtggctcgctacatttacaatcgagaagagtacggaagattcgactcagatgtgggagagtttcaagcagtaactgaactgggcaggtcgatcgaagactggaataactacaaggattttctcgagcaggaacgcgctgctgtggacaaagtgtgtcggcataactacgaggctgagctgaggacgacactgcagcgacaggtggagccaaccgtgaccatcagccccagccggacagaagccctgaatcaccacaaccttcttgtgtgtagcgtgactgatttctacccagcgcaaattaaggttcaatggttcaggaacgaccaagaggagacagccggagtcgtgtctaccagtttgatcagaaatggagactggactttccaaatcctggtgatgctggaaataacccctcagcgaggtgatatatacacttgtcaggtcgagcatccttctctccagagccctatcaccgtggagtggaggccaagaggccctcctccagcaggtctgctccattag

SEQ ID NO: 51552 - DNA, 657 bp, Artificial Sequence
  Description of Artificial Sequence: Synthetic coding sequence
tagctgcaaatccccggtgggttctgggctgcagccgtcactgtcatgctggtgatgctttcgaccccggtcgccgaagcgagggattttcctaaggacttcctcgtgcagttcaagggaatgtgctacttcactaacgggacagagagggtgagaggtgtcgcgcgttacatctataaccgggaggagtacggtcggtttgattccgacgtgggcgaattccaggctgttaccgagttagggcgaagcatcgaggactggaataattataaagatttcctggagcaggagcgtgccgctgtggataaagtgtgccgtcataactacgaggctgaactccggaccaccctccagcgtcaggtcgagcccactgtaacaatctcaccatcgcgaacagaagctctgaatcaccataacttgttagtgtgctccgtaacggacttctaccctgcccagatcaaggtgaggtggtttcgtaatgatcaggaggaaaccgccggagtggttagtacatctctaatacggaacggcgactggacgttccaaattctggtgatgctcgaaatcactccccaaagaggcgacatctacacctgtcaggtcgaacaccccagtctgcagtctcctataactgtggaatggaggctgttacattag

SEQ ID NO: 51553 - DNA, 657 bp, Artificial Sequence
  Description of Artificial Sequence: Synthetic coding sequence
tgactgcagatccctggcggtttctgggcggcagccgtgacagtcatgctggtcatgctgtctacgcccgtggccgaggcacgggattttcccaaggattttctggtacagtttaaaggcatgtgctattttaccaacggcactgagagagtgcggggtgtggcgcgatatatttataatagggaagaatatgggaggttcgatagcgacgtgggcgagtttcaggccgtgactgagctcggtaggtcaattgaagactggaataattacaaagattttctggagcaggaacgagcagctgtggacaaggtatgccggcataactatgaagccgaactcagaaccacactgcagcggcaagtcgaaccaaccgtgaccatctcgcccagtaggactgaggcactaaaccaccataatctcttagtttgttctgttaccgatttttaccctgcccagattaaggttcaatggttcaggaatgaccaggaggagaccgccggagtggtgagcacatcactaatcaggaacggtgattggacctttcagatcttagtcatgttggagattacaccacaaaggggggacatctatacctgccaggtggagcatccttcgctacagtcaccaatcacggtggaatggaggctgttacattag

SEQ ID NO: 51554 - DNA, 840 bp, Artificial Sequence
  Description of Artificial Sequence: Synthetic coding sequence
atgtcctggaaaatggccctgcaaatacctggaggattctgggctgccgctgttactgtaatgttagtgatgctctccacccctgttgcagaggccagggactttcctaaagactttcttgtccagttcaaggggatgtgctacttcactaacggaacggaaagggtgcggggagttgccaggtacatctataatagagaagagtatggcagattcgactctgatgtgggagaattccaggccgtgaccgaacttgggaggagcattgaagactggaataattataaagacttcctggaacaggaacgcgctgccgtggacaaagtgtgtcggcacaattatgaggccgaacttagaaccactctgcagcggcaggtggagcctacggtaactatcagtccaagtagaaccgaagccctgaaccaccacaacttgctggtttgtagcgtcacagatttttacccggctcagatcaaagtgcagtggttccgcaacgaccaggaagagacagccggagttgtttccacatccttaatcagaaatggtgattggacctttcagatccttgtaatgctcgaaattacgcctcagcgcggagacatctacacatgccaggtggaacatccttcattacaaagccctatcacagtcgaatggagagcccagtcagaaagcgcacagtccaagatgctcggcggtgttggcggattcgtcttggggctgatttttttggggctcgggcttatcattagacatcgaggacagaaagggccacgtggccctccacccgcaggcaacatttccgctatgattcaatccggagagcgggctcaggcctag

SEQ ID NO: 51555 - DNA, 795 bp, Artificial Sequence
  Description of Artificial Sequence: Synthetic coding sequence
atggccctgcaaatccccggagggttctgggccgcagcagtgactgtaatgcttgtcatgctctccactcctgttgcagaggccagagatttcccaaaagactttctggttcagttcaaggggatgtgctactttacgaacggtacggagagggttaggggggtggctcgctacatctacaacagagaagaatacggacgtttcgactcggatgtgggagagtttcaagctgtgactgaacttggtcgcagtatagaggactggaataactacaaggattttttggaacaggagcgtgcggcagtcgataaagtatgtcgccataactacgaggccgagttgagaacgactctccaacgccaggtggaacctacagtaaccatcagcccgtcacggactgaagccctgaaccatcacaacctcctggtgtgctctgttacagatttttatcctgcacagattaaagtgcggtggttcagaaacgaccaggaagaaacagcaggcgtggtgtctacttccctaattagaaacggagattggaccttccaaatcctggtgatgctcgagataactccgcaacgaggcgatatctatacatgtcaggtggaacatcctagtctgcaatctccaattaccgtagagtggagagcccagtccgagtctgcgcagagcaagatgctttccggtatcggcggattcgtgctgggcctgatcttcctgggcctggggctcataatcagacacagaggacaaaaggggccacgcggaccacctcccgcaggacttctgcattag

SEQ ID NO: 51556 - DNA, 657 bp, Artificial Sequence
  Description of Artificial Sequence: Synthetic coding sequence
tgactccagattcccggaggattctgggctgccgcagtcaccgtaatgctggttatgctgagtaccccagtggcggaggcacgagacttccccaaagactttctcgtgcagtttaaaggcatgtgctatttcacaaatggcaccgaacgagtgcggggagtggcccgatatatttataacagggaggagtatggcagatttgactccgacgtgggggaattccaggccgttaccgagcttgggagatctatcgaggactggaataattataaagacttcctggagcaggaacgtgctgctgtggataaagtgtgcagacacaattacgaggctgagctgagaaccaccctgcagaggcaagtggaacccacagtaactatcagtccttctcggactgaggcactgaatcatcataatctgcttgtgtgcagcgtgacagacttctaccccgctcaaatcaaggtgagatggttcaggaacgaccaggaggaaaccgctggcgtggtgagtacctctctgatacgcaacggtgactggactttccagatcctcgttatgctggagattactccacagcgtggcgacatatatacgtgccaggttgagcacccgagcctgcagtcaccaattactgtagaatggcgcctcttgcattag

SEQ ID NO: 51557 - DNA, 657 bp, Artificial Sequence
  Description of Artificial Sequence: Synthetic coding sequence
taactccaaatccccggtgggttctgggctgcagcagttactgtgatgctcgttatgctcagcaccccagtcgccgaagcaagagacttcccgaaagattttttggtccagtttaaaggcatgtgctatttcaccaacggcaccgaacgagtgcgaggagtcgctcgatacatctacaaccgcgaagaatatggaaggtttgacagtgacgtgggagaattccaggctgtaaccgagctaggaagatcaattgaggattggaacaactacaaagactttttggagcaggaacgagccgcagttgataaagtgtgcagacataactacgaagccgaactccggacgacgctccagaggcaggtcgaacctacagttacaatctccccatctcgaacagaagctctgaaccatcataacctgcttgtgtgctccgtcactgacttctacccagcacagataaaggtgcagtggttcagaaacgatcaggaggaaaccgcaggcgtggtatccacctctctcattcgcaacggcgactggacattccagattctcgtgatgcttgaaataaccccacagcggggagacatctatacctgtcaagtcgagcacccaagcctgcagagcccaatcacagtcgagtggcgactgttgcactag

SEQ ID NO: 51558 - DNA, 684 bp, Artificial Sequence
  Description of Artificial Sequence: Synthetic coding sequence
atggctctgcagattcccggtggattctgggcagcagcggtgacagtgatgctggtgatgttgtccacacccgtcgctgaggcgagagatttcccaaaggactttctggtccagttcaagggtatgtgctatttcacgaatggaactgagagggtgcggggtgtggccaggtacatctataaccgggaggagtacggtaggtttgactcggacgttggcgagtttcaggccgtgaccgagctgggcagaagcatcgaggattggaataattacaaagattttttagagcaagaaagggcagccgttgacaaagtttgcagacacaactatgaagccgaattaagaactaccttgcagaggcaggtggaacctaccgtgaccatctccccttcacggaccgaggcactcaatcatcacaatctgctagtgtgtagtgtcactgatttctacccagcgcagatcaaagtgaggtggtttagaaacgatcaggaggagaccgccggagtcgtgtccacctccctcatcaggaatggtgactggactttccagatcttagtaatgctggaaatcaccccccagcgcggagacatctatacttgccaagtcgaacatcccagtctgcagtcacccattacggtagaatggagaccacgcggtcctccaccagctggcctgctccattag

SEQ ID NO: 51559 - DNA, 657 bp, Artificial Sequence
  Description of Artificial Sequence: Synthetic coding sequence
tgactgcagatcccaggcggtttttgggccgcagccgttactgtgatgttggttatgctcagtaccccagtcgcagaggccagagacttccccaaggactttcttgtgcaattcaaagggatgtgttactttacgaacggaaccgaacgggtcaggggggtggcccgatacatttacaatcgcgaagagtatggtaggttcgacagcgacgttggagaatttcaggcggttactgagctgggacgatccattgaagactggaataactacaaggacttcctcgagcaggaaagagctgcagtggataaggtatgtcggcacaactacgaagcagagcttcgcactactcttcaaaggcaggtggagcccaccgtgaccatctctccatctcggaccgaagccttgaaccaccacaacctactggtctgctccgtgaccgacttctacccggctcagataaaggtgagatggtttaggaatgatcaggaagaaacagcaggcgtggtcagtaccagtctgattcgcaatggagattggacattccagatcctggtgatgctggaaatcacccctcagcggggtgatatatacacatgtcaagtggagcatcctagcctccagagccctataactgtggagtggcggctgctgcattag

SEQ ID NO: 51560 - DNA, 696 bp, Artificial Sequence
  Description of Artificial Sequence: Synthetic coding sequence
atgtcatggaagatggcactgcagatccctgggggattttgggcggcagctgtaacggtcatgctggtgatgctcagcacacctgtcgctgaggccagagatttccctaaagacttcctggtgcaattcaaaggcatgtgttacttcactaatggcacagaacgcgttcgcggagttgctcggtatatctataaccgagaagagtacggtcgattcgattccgacgtaggtgaattccaggcggtgactgaactgggtcggtccatcgaggattggaataactacaaggacttcctggaacaagaaagggcagctgtggacaaggtgtgcaggcacaattacgaggccgagctgaggactacactgcagagacaggtggagccaactgtgacgattagtccctctaggaccgaggcgctcaaccaccacaaccttctcgtctgctccgtgacggatttttatcctgcgcagataaaggtgcagtggttccggaacgatcaggaggagaccgctggggtggtttccacaagtctgatacggaacggggattggaccttccaaatactcgtgatgctcgagattacaccgcagcgcggagacatctacacttgccaggtggagcacccctcgctgcagagcccaatcacggtggagtggcgacctcggggtccaccaccagctggtttacttcactag

SEQ ID NO: 51561 - DNA, 795 bp, Artificial Sequence
  Description of Artificial Sequence: Synthetic coding sequence
atggccctacaaatacctggaggattttgggcagccgcagttaccgtgatgctggttatgctgagtaccccagtggctgaagccagggattttccgaaggattttctcgtgcagtttaaaggtatgtgctacttcaccaacgggacagagagggtgcgcggagtggccagatacatctacaatcgggaggagtatggccgattcgactccgacgtgggagaattccaggcagtcaccgagttgggacgctctatagaagattggaacaactacaaagacttccttgaacaggagcgagcagcagtagataaagtatgccgacacaactacgaggccgagctccgtacaaccttgcagagacaagtagaaccaaccgttacaatcagccctagccggacagaggctctgaaccatcacaatctgcttgtgtgtagcgtgactgatttttacccagcccaaattaaggttcgatggtttaggaacgatcaggaagagaccgctggtgtggtatctacctccctaatacgtaacggggattggacttttcaaatcctagttatgctggagataacaccacaacgcggtgacatatatacatgccaagtcgagcacccgagcctgcagagccctatcacagttgaatggcgggctcagagcgagtctgcccagagtaagatgctatccggcattgggggtttcgtactggggctcattttcctgggcctcggactgattattagacacagagggcagaaaggcccaaggggaccacctcccgctggtctgttgcactag

SEQ ID NO: 51562 - DNA, 795 bp, Artificial Sequence
  Description of Artificial Sequence: Synthetic coding sequence
atggctttgcagatcccgggaggattttgggctgcggcagtaacagttatgcttgttatgctttctacgcctgttgctgaagctagagattttcccaaggactttctcgttcagttcaaggggatgtgctactttacaaatgggactgagagagtacggggagtagctcgatacatctacaaccgtgaagagtatggcagattcgacagcgatgtcggggaatttcaagccgtaaccgagctgggccgatcaattgaagactggaacaattataaggatttcctagaacaggaaagggcggctgttgataaggtgtgtaggcataactacgaagctgagctgcgcaccacacttcagaggcaagtggaacccacagtgacaatctccccctccagaacagaggccctgaaccaccataaccttctcgtgtgctcagtcaccgacttctacccggcacaaatcaaagttcgatggttcagaaatgatcaagaagaaactgccggagttgtctccaccagcctcattcgaaatggggactggactttccagattctggtaatgctggagatcacgccgcagaggggagacatttatacctgccaggtggagcacccttctctgcaatcacctatcaccgtagagtggcgggctcagagcgagagcgcccagtcaaagatgctgagtggtattggcggattcgttctcggcctaatattcttgggactgggcctaattataaggcacagagggcagaagggacctagaggacctccacctgcgggactcctccattag

SEQ ID NO: 51563 - DNA, 807 bp, Artificial Sequence
  Description of Artificial Sequence: Synthetic coding sequence
atgtcatggaaaatggcccttcagattcctggaggattctgggctgctgcggtgaccgtaatgctcgttatgctctcaacaccagtggcagaggcaagggactttcccaaggacttcttggttcaattcaaggggatgtgttattttactaacgggacagagagggtccgcggtgtcgcacgatatatttacaatagagaagagtatggcagattcgactctgacgttggcgagttccaggctgtcacagagctggggcgttccattgaagattggaacaattacaaagactttctggaacaggagagggccgcagtggacaaggtctgtcgtcataactacgaagccgagctgagaactacgctccagcgacaggtggaaccgactgtgactatttcaccgtctcgcaccgaggctttgaaccatcacaacctcctggtgtgcagtgtcacggatttctaccccgcacagattaaggtccagtggttccgaaatgatcaggaagaaactgccggtgtcgtttcgaccagcctgattaggaacggggattggacatttcagatattggtgatgttagagattactcctcagcggggtgatatttacacctgccaggtcgaacacccgtctctgcaatcaccaattaccgtggaatggagggcccaatcagaatcagcccaatctaagatgctcgggggtgtcggagggtttgtgctgggcttgatctttctgggcctgggtctgatcattcgacatcgaggccagaaggggccacggggaccccctcccgcaggattgctacattag

SEQ ID NO: 51564 - DNA, 807 bp, Artificial Sequence
  Description of Artificial Sequence: Synthetic coding sequence
atgtcctggaaaatggctcttcagattcccggagggttttgggctgcagctgtgacagtcatgcttgtgatgctgagtacccccgtggccgaggcacgggatttccctaaagatttccttgtacagtttaaaggaatgtgctacttcacaaacgggacagaacgcgtgcgcggagtggcccgatacatctacaaccgagaggagtatggcaggttcgatagcgatgtaggtgagttccaggcagttactgagctcgggaggtccattgaagattggaacaactacaaggattttctcgagcaggagcgcgctgctgtggataaggtatgccggcataattacgaggccgaattgaggactactctccagagacaggtagagcccactgttacaatttccccttcaaggacagaggctctgaatcatcataaccttctcgtttgtagcgtgactgacttctaccctgcccagatcaaagtccaatggttccggaacgatcaggaggaaaccgcaggcgtcgtttccaccagcttgatccggaacggcgactggacctttcagatcctggttatgcttgagataactcctcagcgtggggacatttatacgtgccaagtcgagcaccctagcctccagtcccctattaccgttgaatggagggcacagagcgagtctgcgcagtccaagatgctcgggggagtcggtggttttgtgcttggcctgatattcctggggttggggctcatcattcgccacagagggcagaaagggccacggggaccgccacccgcagggctgctccattag

SEQ ID NO: 51565 - DNA, 696 bp, Artificial Sequence
  Description of Artificial Sequence: Synthetic coding sequence
atgtcgtggaagatggctctgcaaatcccgggtgggttctgggcagcagctgtgacagtaatgctggtgatgctttccacccctgtagcagaggctagggattttccaaaggattttttagtacaattcaaaggaatgtgctatttcactaatggaactgaaagggtgcgcggagtcgcacggtacatctataatagagaggagtatgggcgttttgacagtgatgtgggggaattccaggcggttacagaactgggaaggtcgatcgaagactggaataattataaggatttcctggaacaggagagggctgcagtagataaggtgtgccggcataattacgaggcagagttaaggactaccttgcagcgccaggtggagccgacagtcaccatcagccccagtaggactgaagccttgaatcatcacaacctacttgtatgttctgtcacagacttttatcccgctcagattaaagtacaatggtttagaaatgaccaagaggaaactgcaggagtggtatctaccagcctcattcgcaacggggactggacattccagatcttggttatgctagagatcaccccccaacggggagatatctacacctgccaggtggagcaccccagtctccagagccctatcacggtcgaatggaggccccgtggtcccccacctgccggtctcctccactag

SEQ ID NO: 51566 - DNA, 840 bp, Artificial Sequence
  Description of Artificial Sequence: Synthetic coding sequence
atgagctggaagatggccctccaaatacccggaggcttctgggctgctgctgtgacggtcatgctcgtaatgttgagcacacctgtcgcagaggcaagggattttcctaaagattttctcgtgcaatttaaaggcatgtgttacttcaccaatgggactgaacgcgtcaggggtgtagccaggtatatctacaatcgtgaagagtacggtagatttgatagcgacgtgggagagttccaggccgtcactgaacttggcaggtccatcgaagactggaacaattataaagactttctcgaacaggaacgagccgctgttgacaaagtgtgccgccacaactatgaagccgagcttcgcactacactgcagagacaggtcgagcccactgtgactatctctcccagcaggacagaagctctcaaccatcataatctacttgtgtgcagtgtgaccgacttctatcctgcccagatcaaagtgcagtggttcaggaacgatcaagaagagactgctggagtcgtcagcacttctctgattcgaaacggcgattggacattccagattctggtgatgctggaaattaccccccagcgcggagacatatacacatgccaggtcgagcaccccagccttcagtcaccgattacagttgagtggcgcgctcaaagtgagtccgcccagtcaaagatgctcggcggagtgggcggttttgtgctggggctcatcttcctaggcctgggtctgattatccgacatcgcggacagaaaggtcccaggggcccaccccctgccggaaacatctcagcaatgatacagtcaggagagcgcgctcaggcctag

SEQ ID NO: 51567 - DNA, 657 bp, Artificial Sequence
  Description of Artificial Sequence: Synthetic coding sequence
tgacttcagatccctggcggattttgggccgcagccgtgaccgtgatgctggtgatgctgtcaacaccagtggccgaggcccgtgattttccaaaggactttctagtgcagtttaagggcatgtgttacttcacaaatgggactgaaagggtgcggggagtggctcgatacatatacaatagagaggagtatggcaggttcgattctgacgtaggagagttccaggccgtcactgagctgggaagatccattgaggattggaacaactacaaagatttcctggagcaggaacgcgctgctgttgataaggtctgtcgtcacaactacgaggccgagctgagaactacactccaacgccaggtggagcccactgtgacaatctcacctagtcgcacagaggccctgaaccaccataacttgctcgtgtgctctgtgactgatttttatccggcacaaattaaagttcggtggttccgaaatgatcaggaagagacggcaggcgtggtgtccacctcgctgatcaggaacggcgattggaccttccaaatccttgtcatgctcgaaattacgccacagaggggggacatctatacatgccaggttgagcacccctccctgcagagccctattacggtggagtggcgcttgttgcactag

SEQ ID NO: 51568 - DNA, 828 bp, Artificial Sequence
  Description of Artificial Sequence: Synthetic coding sequence
atggctctgcagattcccggaggcttctgggcagcggctgtgaccgttatgcttgtgatgttgtccacacccgtggcagaagccagggatttccccaaagactttctggtgcaattcaagggcatgtgctattttactaacggcacagagagggtgcggggtgtggccaggtacatttacaatcgtgaagaatacggcagatttgacagcgacgtcggcgaatttcaggccgtgacagagttaggcaggtctatagaagactggaacaactataaggactttctggagcaggagcgcgcagccgtggacaaggtttgccggcacaattatgaggctgagttgcgcactactttacagcgacaggtggagccaacagtgacaatttcaccgtctcggaccgaagccttaaatcatcataatctcctggtttgttctgttactgacttctatcctgcgcagattaaggtccgctggtttcgtaacgaccaggaagagaccgctggcgtggtaagcacctcactgatccggaatggagactggacatttcagatcctggtaatgctggagattaccccgcagcgcggtgacatctacacttgtcaagtcgagcacccatcgctccaaagccctatcacagtcgagtggcgggcacagtctgagtctgcccagagtaaaatgttatctggcatcggtggcttcgtattgggcctgatattcctcggccttgggctgatcatccggcaccgaggccagaagggtcctcgaggacctcccccagccggaaatatctcggctatgatccagtctggagagcgggcacaggcatag

SEQ ID NO: 51569 - DNA, 795 bp, Artificial Sequence
  Description of Artificial Sequence: Synthetic coding sequence
atggccttgcaaattccgggtggattctgggccgcagccgtgacagtaatgctcgtaatgctgagtacccctgttgccgaggcccgagactttccaaaggactttctagtgcagtttaagggtatgtgctacttcacaaacgggacggagcgggtgagaggagttgccagatatatctacaaccgagaagagtatggtagatttgactcggacgttggcgaattccaggcggtgactgaactcggcaggagtattgaggactggaacaactataaggacttcctggagcaggagcgggctgctgtcgataaggtgtgccggcacaattatgaagctgagctacgaaccactttgcagcgccaggttgaaccgactgtgaccatcagcccctcgcgcactgaggcgctgaaccaccacaatctgttggtttgctccgtcaccgatttttatcccgcacagatcaaagtcagatggttccgaaacgaccaggaggagaccgctggggtcgtatctacttccttgatacgtaatggagattggacttttcaaattcttgtaatgctagaaatcacaccccagaggggtgacatttatacctgccaggtggaacaccctagcttacaatctccaatcactgtcgagtggcgtgctcagagtgaatcagcgcagagtaaaatgctgagcggcatcggagggttcgtcctcggcctcatctttctcgggctcggactgattattaggcataggggacagaaggggcctcggggacccccacctgccggtctgctgcattag

SEQ ID NO: 51570 - DNA, 684 bp, Artificial Sequence
  Description of Artificial Sequence: Synthetic coding sequence
atggcactacagattccagggggattttgggcggctgccgtgactgtaatgctcgttatgttgtctaccccggtcgccgaggcacgggatttccccaaggattttcttgtgcaattcaaggggatgtgttacttcacaaatggtacagaaagggtacgaggcgttgccagatatatctataaccgggaggagtatggtaggttcgacagcgacgtcggagagttccaggccgtgacagagctgggcagatctatcgaggactggaacaactataaagactttctggagcaagaaagagctgccgtggacaaagtttgccgccataactacgaagcagaattacggactaccttacagcgccaggtcgaaccgactgtgaccatctccccctcccgcaccgaggctctaaaccatcataacctgctcgtatgctctgtaacggatttttatcccgctcagataaaagtgaggtggtttcgcaacgaccaggaggagacagccggagtcgtgtccacatctctcatacgcaacggagattggactttccagattctggtaatgctcgagattacaccacagcggggtgatatttatacttgccaggtggaacacccttcgctccagagccctatcacagtggagtggcggcctcgtggacctccacccgcaggcctgttacactag

SEQ ID NO: 51571 - DNA, 840 bp, Artificial Sequence
  Description of Artificial Sequence: Synthetic coding sequence
atgtcgtggaaaatggccctgcagatacctggcggtttttgggcagctgcggtgacggtgatgttagtgatgctgtcaacacctgttgccgaggccagggactttccaaaggacttcctggtgcagtttaagggcatgtgctacttcacgaacggcacagaacgggtgcggggtgttgctcgttacatttataacagggaagagtacggcaggttcgacagcgacgtgggagagtttcaagcagtgacggaactggggagaagcatagaggactggaacaactacaaagacttcttggagcaggagcgggcagccgtggacaaggtctgccggcacaattacgaagccgaactccgtaccacactccaacgtcaggtggagccgaccgtcactatttccccgagcaggaccgaagcgctcaaccaccataacctccttgtgtgctcagttactgacttttaccctgctcagattaaagttcagtggtttaggaacgatcaagaggagactgccggagtggtctccacgagcctcattcggaacggggactggactttccagatcctcgttatgttagagattacacctcaaaggggcgacatatacacatgccaagtcgaacacccttcgctacaatcacccattaccgtggaatggagagcccagtccgaatccgcacaaagtaaaatgttggggggagtggggggtttcgtccttggactgatattcctcggtctcgggctcattatccggcatagaggccagaaagggcctagagggcctcccccagccggtaatataagcgctatgattcagtcgggggagcgggctcaggcctag

SEQ ID NO: 51572 - DNA, 828 bp, Artificial Sequence
  Description of Artificial Sequence: Synthetic coding sequence
atggctctgcagatcccagggggattctgggctgccgcagtgactgtgatgctggtgatgctctcaacaccagtcgcagaagcaagagactttcctaaagatttcctggtgcagtttaaaggcatgtgctatttcaccaacgggaccgagcgggtgagaggagtggctcgatatatatataacagggaagagtacggaaggttcgattccgacgtcggcgaatttcaagcagttactgagctgggcagatccatcgaagattggaataactacaaggacttcctagaacaggagcgggctgctgtggataaggtatgcagacacaactacgaggccgaacttcggacaacgcttcaaagacaggtcgaacccactgttacaatcagtccctcgcgcaccgaagcactgaaccatcacaatctgctagtatgtagtgtcacagacttctaccctgcacagatcaaggtgagatggtttagaaatgaccaagaggagacagcgggagtggtcagtacttcattgatcagaaacggcgactggacctttcagatcttagtgatgctggagatcactccacagaggggagacatctacacctgccaagtggaacacccgtctctccaatccccgattaccgtggagtggagagcccagagcgagtctgcacagagtaaaatgcttagcggaataggagggtttgtgctgggtttgattttcctgggactggggcttatcataaggcacaggggacagaagggccctagagggccaccgcctgctggtaatatctctgctatgattcagtcaggggagagggcccaggcttag

SEQ ID NO: 51573 - DNA, 657 bp, Artificial Sequence
  Description of Artificial Sequence: Synthetic coding sequence
tagctccaaatccctggcggtttctgggctgccgctgtaaccgtgatgctggtgatgctctctacacctgtggccgaagccagggactttccaaaagacttcctcgtccaattcaaaggtatgtgctattttactaacggcactgagcgggtcagaggggtcgccagatatatctataacagagaagagtacgggcgattcgatagtgacgttggggaattccaggcagtgaccgaactcggtcgaagcattgaggattggaacaattataaagactttctcgagcaggaacgcgcagctgttgacaaggtgtgtagacacaattatgaggccgagctgcgtaccacccttcagcgacaggtggagcccactgtgactatcagccctagtagaacagaagcgctgaatcaccacaacctcttagtctgctccgtgactgacttctaccctgctcaaatcaaggtccagtggttcagaaatgaccaggaggagacggcgggagtagtaagcacaagtctgataaggaatggggattggacgttccagatactggtgatgcttgagatcacacctcaacgcggagatatctatacgtgccaggttgaacatccctctttacagagccccatcaccgtggaatggcgactgctccactag

SEQ ID NO: 51574 - DNA, 828 bp, Artificial Sequence
  Description of Artificial Sequence: Synthetic coding sequence
atggccctgcagatccctggcggattttgggccgctgcagtgactgtcatgctagtcatgctgtctaccccggttgctgaggcacgcgactttccgaaagattttctcgttcaattcaagggaatgtgttatttcaccaacggtaccgaaagggtgagaggagtggccagatacatctacaatagggaggagtacggtcggttcgactcggatgtgggtgagttccaggccgtcacagaactgggccgaagtatcgaggattggaacaactataaagattttcttgagcaagaaagagcagccgtggacaaagtctgtcgtcacaattacgaagcggagctgcgcactacattgcagaggcaggttgagcctaccgtgacaatcagcccctcgaggaccgaagcactgaatcaccataacctcttggtgtgtagcgtcacggacttctaccccgcacagataaaagtacgctggtttagaaatgatcaggaggaaaccgcaggggtggtaagtacgtcgcttattaggaatggtgactggacctttcagatcctggtgatgcttgagatcactccccaacgtggtgacatctatacatgtcaggtggagcacccaagcttgcaatcacccataacagtggaatggagagctcagtccgagagcgcacagtcaaagatgttatcaggcatcggcggatttgtgctggggctgatcttccttggtctcggcctgatcatccgacacagaggacaaaagggcccacgaggccctcctcctgccggaaacataagcgccatgatccagagtggagagagggctcaggcctag

SEQ ID NO: 51575 - DNA, 684 bp, Artificial Sequence
  Description of Artificial Sequence: Synthetic coding sequence
atggcactccagattcctggtggcttctgggccgctgcggtcacagtgatgctggtgatgctgtccacccctgtcgcggaggcacgggacttccctaaagatttcctagtgcaattcaagggaatgtgctacttcaccaatgggacagagcgagtcaggggagtggctcggtacatctataacagagaagagtacgggagatttgatagcgatgtgggggagtttcaggctgtcacagaactcggtcgctccatcgaggattggaacaattacaaagatttcttggaacaagagagagccgctgtggataaagtttgccggcacaactatgaggcagagctcagaaccacattgcagcggcaggtggagcccacagtgacaatctcacctagtcggactgaggcgctgaatcaccataatctgctcgtctgcagcgtgactgatttctaccccgcacaaattaaagtgaggtggtttcggaatgaccaggaggagacagccggagtcgtttccacaagtctgatcagaaacggagactggaccttccagattctggtgatgctggaaattacaccacaacggggagatatctacacgtgtcaggtggaacacccttcactgcagagccccataacggttgaatggaggcccagaggaccacctccagcaggcctactccattag

SEQ ID NO: 51576 - DNA, 807 bp, Artificial Sequence
  Description of Artificial Sequence: Synthetic coding sequence
atgagttggaagatggcacttcagatccccggtggtttttgggccgctgccgttaccgtcatgcttgtaatgctgtcaactccagtagcagaagccagggacttccccaaggactttcttgtgcagttcaaagggatgtgctacttcactaacgggaccgagagggtcagaggcgttgcacgctatatctataaccgcgaagaatatggcaggtttgacagcgacgtcggggaattccaggcggtgaccgagctcggtcgctctatcgaagactggaataattataaggacttccttgaacaggaacgcgctgcagtagataaggtttgtcgccacaactacgaggccgaacttagaacaacattgcagaggcaggtggagcctaccgttaccatctctccttctagaactgaggctctgaatcaccataacttactggtgtgcagcgtgaccgacttttatccagctcagatcaaagtgcagtggttccgaaacgaccaggaggagacagcaggcgttgtaagcaccagtctgattagaaacggcgactggactttccagatcctggtcatgctcgaaattacacctcagaggggagacatatatacctgccaggtggaacatcctagcttgcagagccctatcacagtggagtggcgagcacaaagcgaatctgcccagtccaaaatgctaggaggggtggggggttttgtacttggcttaatctttctgggcctagggctgatcattcggcatcgtggccaaaaaggcccacgaggccctccccctgcaggccttttacattag

SEQ ID NO: 51577 - DNA, 627 bp, Artificial Sequence
  Description of Artificial Sequence: Synthetic coding sequence
atgctatccactcctgtagctgaagcaagggactttcctaaagattttcttgttcaatttaaaggtatgtgctactttaccaatggaacggagagggtgcggggagtggcgaggtatatatacaatcgcgaggagtacggacgctttgactctgacgtcggagagttccaagccgtgacggaacttggaaggagcattgaggactggaacaattacaaagactttctagaacaggagagggcagcagtggataaggtgtgcagacataattacgaagctgaattgcggaccacgctgcagcggcaagtcgagcccaccgtcaccatcagcccatctcgcaccgaggcgcttaaccaccacaatctgctggtatgcagcgtgactgacttctaccccgcacagataaaagtgcagtggttccggaatgaccaggaagagaccgcgggtgtcgtgtcgacatcccttattcgcaacggggattggacctttcaaatcttagttatgttagagattacgcctcagaggggtgatatctacacctgccaagtggagcatccttccttacagtcacccatcaccgtggagtggcgccctcggggtccgcctcctgctggcctgctgcattag

SEQ ID NO: 51578 - DNA, 828 bp, Artificial Sequence
  Description of Artificial Sequence: Synthetic coding sequence
atggcgctccagatccctggtggattctgggccgctgccgttaccgtgatgttggtgatgttaagcacaccagtagctgaggccagagactttcccaaggacttcctggttcagtttaaaggtatgtgttactttaccaacggtacggagagagtgagaggtgtggcaaggtatatctacaatcgggaggaatacggtaggtttgattccgatgttggggagttccaagccgtgaccgagctggggcgatctatagaggactggaacaattacaaggatttccttgagcaggagagagctgctgttgacaaggtctgcaggcataactacgaggctgaactcagaactactctccagaggcaggtcgagccaaccgttacaataagtccaagccgaacagaggcattgaaccatcataatctgctggtctgctccgtgacagacttttatcctgcacagataaaagtgcagtggtttagaaatgatcaagaggaaaccgccggagtggtcagtactagcctgatcagaaatggcgactggactttccaaatcctggtgatgctggaaatcactccccagagaggcgatatctatacgtgtcaggtggagcacccgagcctgcagagtcctattacagtggagtggagagcgcagagcgagtcagcccaatctaaaatgttggggggtgtgggaggattcgttctgggacttattttcctggggctaggacttatcatccggcacaggggccagaaagggcctcgcggtccccctccggcaggcaatatatctgccatgattcagtctggggaaagagcacaagcctag

SEQ ID NO: 51579 - DNA, 627 bp, Artificial Sequence
  Description of Artificial Sequence: Synthetic coding sequence
atgctgagtacccccgtagcagaggcaagggacttcccaaaggattttttggtgcagttcaagggcatgtgttactttaccaacggcaccgagagagtgcgcggtgtagctaggtatatttataatcgcgaggagtatgggcgtttcgatagcgacgttggggaattccaggcggtgactgaactgggccgttccatagaggactggaacaattacaaggatttcttggagcaggagagggccgctgtggacaaggtgtgtcggcataactatgaagccgagttgaggaccaccctgcagcgccaggttgagcccactgtaacgatttctcctagtagaacggaagctctgaatcatcacaatctgttggtatgctctgttaccgatttttaccctgcccagataaaggtaaggtggttcagaaatgaccaagaagaaactgccggtgtggtttcgacatctctaatacgaaacggtgattggaccttccagatcctggtgatgttagagattacaccccagcgaggcgacatctacacttgccaggtcgagcacccgtctctgcagagtccgatcaccgtggagtggagacccaggggaccccctcctgctgggcttttgcactag

SEQ ID NO: 51580 - DNA, 627 bp, Artificial Sequence
  Description of Artificial Sequence: Synthetic coding sequence
atgctatctacccctgttgctgaagctagggatttccctaaggatttcctggtccaatttaaggggatgtgctacttcacaaacgggactgagagagtccgaggcgtcgcccgttacatctataaccgcgaggaatatgggcgttttgactctgacgtgggcgagtttcaggcagtcaccgagttgggacgctccatcgaggactggaacaattataaggactttctggagcaggagcgggctgcagtggataaagtgtgccgccataactacgaggctgaattgaggaccactcttcagcggcaggtggagcccacagtcactatctctccctcaaggacagaagcactgaaccatcacaatctccttgtctgctctgtgacggatttctatcccgcacagatcaaagtccagtggtttaggaatgatcaggaagaaacagctggggtggtaagcacgtccttgatcagaaatggtgactggacctttcagatcctggttatgctggaaattaccccccagagaggggatatctatacctgccaggtggaacacccaagtctgcagtcaccaataaccgtcgaatggcggcctaggggtcctccacccgcaggcttgcttcactag

SEQ ID NO: 51581 - DNA, 627 bp, Artificial Sequence
  Description of Artificial Sequence: Synthetic coding sequence
atgctgtcaactcctgtggcggaagccagagactttccaaaagacttcctggtgcagttcaagggaatgtgttactttacaaacggcacggaacgggtgagaggcgtggccagatacatctataacagggaggagtatggaagatttgattccgacgttggagagtttcaggccgtgactgagctagggaggagtatcgaggactggaataactacaaagacttcctcgagcaggagagagccgctgtggacaaggtatgccgacataactatgaggccgaattgcgaaccacccttcagcgccaggtcgaacccacagtcacaataagcccatccaggacagaggccctaaatcaccacaacctgctcgtgtgtagcgtgacagacttttatcccgcacaaataaaggtgcagtggtttaggaacgatcaggaggagactgcgggagttgtgtctactagtctgatccggaatggggattggaccttccagatcctggttatgttagagatcacaccgcaacgcggtgacatctacacctgtcaggttgagcacccatccttgcagagtcctataaccgtggaatggcggccaaggggtcccccaccagctggacttctccattag

SEQ ID NO: 51582 - DNA, 627 bp, Artificial Sequence
  Description of Artificial Sequence: Synthetic coding sequence
atgctcagtactccagtcgcggaagctagggacttcccaaaagattttctggtccagtttaagggaatgtgctatttcactaatggcacagagcgggtccgcggagtcgctaggtatatttataaccgagaagagtacggaagatttgactcagacgtcggcgagttccaggccgtaaccgaactgggaagaagtattgaagactggaacaactacaaggactttttagagcaagagcgggctgccgttgacaaggtctgccgccacaactatgaagcggagttacgaacaaccctgcagcgccaggtcgagcctaccgtgaccatcagtcccagccgcactgaggctctgaatcaccacaacctgctggtttgctccgtgaccgacttctatccagcacagattaaagttcgctggttccgaaacgatcaggaggaaacagccggagtggtcagtacttcgctaattcgcaacggcgactggacctttcagatcctcgtcatgctcgaaatcacacctcagcgcggagacatctatacctgccaggttgagcatccttctctgcagtcgcctatcaccgtggagtggcgccctcgcggtcctcccccagccggtttgctgcactag

SEQ ID NO: 51583 - DNA, 627 bp, Artificial Sequence
  Description of Artificial Sequence: Synthetic coding sequence
atgctgagcacgccggtcgcagaagccagagatttccccaaagattttctggttcagttcaaaggaatgtgttatttcaccaacggcacggagcgggttcgcggagtggcacgttatatatataatagggaggaatacggcaggtttgacagtgacgttggtgaatttcaagctgtgaccgagctgggacggagcattgaagattggaataactataaggacttcctggagcaagagcgcgctgccgtggataaggtgtgtcggcacaactatgaagcagagcttcgaaccacgctacagcggcaggtcgaacctaccgtgaccatatcaccatcccggacggaagccctgaatcatcataatctactggtgtgctctgttactgacttctaccctgcacagatcaaagtgcagtggttcaggaatgatcaagaggaaaccgcaggagtcgtgtctacatcactgatacgaaacggcgactggacatttcaaatcttggtgatgctagagattacaccacagaggggcgacatttacacgtgtcaggtggaacacccatcactgcaatcccccataacggtggagtggcgccctcgcggtccccctcccgctggccttctccattag

SEQ ID NO: 51584 - DNA, 828 bp, Artificial Sequence
  Description of Artificial Sequence: Synthetic coding sequence
atggccttacagattcctggaggtttctgggctgcggcagtaactgtcatgttggtaatgctgtctacccccgttgcagaggcccgtgactttcccaaggactttttagtgcaattcaagggcatgtgctactttactaatgggacggagcgcgtccgcggagtcgcaagatacatctataatagggaagagtacgggcgatttgattcagacgtcggtgaattccaggctgttacagagctaggacgatccatcgaggactggaacaactacaaagatttcctcgaacaggaacgggctgccgtggataaggtatgtcggcacaattatgaagctgagctgcgtactaccctgcagagacaagtggagcctactgtcaccatcagtccgagtaggaccgaggcgctcaaccaccataatcttctggtgtgcagcgtgaccgacttctacccagctcagattaaagtacaatggttcaggaacgaccaggaggaaaccgctggcgttgtctcgacttccttgatcaggaacggcgactggacgttccagatcctcgtcatgctcgagatcaccccccagcgaggcgacatttatacttgccaggtggaacatcccagcttacagagcccgatcactgtagagtggcgggctcagagcgagtcagcacaatcaaaaatgctgggtggggtcgggggtttcgttctgggcctcatatttctgggtctcgggctgatcatccgtcaccgaggacagaagggacccagggggccaccgccagctggaaatatttccgctatgatacagtcaggcgaaagggcacaggcctag

SEQ ID NO: 51585 - DNA, 627 bp, Artificial Sequence
  Description of Artificial Sequence: Synthetic coding sequence
atgctctccaccccagtggccgaagccagagattttcctaaggacttcctagtccagtttaagggcatgtgctacttcacaaatggcacagaaagagtgcgcggagtcgccagatacatctataatagggaggaatatggccgtttcgactctgacgtgggagaattccaggccgttaccgagcttggccgatcgatcgaagactggaacaattacaaggacttcctggaacaggagcgggcagccgtggataaggtgtgtaggcacaattacgaggccgaactcaggacaactctgcagaggcaggtggagcccaccgtaacaataagtccgtcaaggaccgaggctctgaaccaccacaacttgctggtgtgcagcgtgacagatttttacccggctcaaatcaaggtgcggtggtttcggaatgatcaggaagaaaccgctggagtcgtgagcaccagcttaatccgcaacggcgattggacattccagattctggtcatgctggaaatcaccccgcagagaggggatatctatacttgccaagtggagcacccttccctacagagccctattacagtagaatggcgccctcggggaccccctccggctggccttcttcactag

SEQ ID NO: 51586 - DNA, 828 bp, Artificial Sequence
  Description of Artificial Sequence: Synthetic coding sequence
atggctctgcagatcccaggagggttttgggccgctgctgttaccgtgatgttagtgatgttgtccactcccgtcgcagaagctcgcgacttcccaaaagatttccttgtccagtttaaaggcatgtgttattttacgaacggaacggaacgcgtgagaggcgtcgctagatacatctataatcgcgaagaatacggtagattcgactcggacgtgggagaattccaagcagtcactgagctcggcaggagtatagaggactggaataattataaggacttcctcgagcaggagagggcagcggtggacaaggtgtgccggcataattacgaggcggaactgcggacaactcttcaaagacaggtcgagcccacggttaccatctctccatcacggactgaggctcttaaccaccacaatctgctcgtctgctccgtcactgatttttatcccgcacagatcaaggtgcagtggttccgcaatgaccaggaggagacggccggagtggtcagcacttccctcatcagaaacggcgactggaccttccagattctcgtcatgcttgagataacaccgcagcggggagacatttacacctgtcaggtagaacacccaagcctgcaaagccccatcactgttgaatggagggcacagagtgaaagtgcccagtctaaaatgctgggaggcgtcgggggattcgtgctgggccttattttcctgggcttaggtttgatcattaggcaccgtgggcaaaaaggtcccaggggacctccgccagccggaaatatctccgctatgatccaatcaggtgagcgagcccaggcatag

SEQ ID NO: 51587 - DNA, 828 bp, Artificial Sequence
  Description of Artificial Sequence: Synthetic coding sequence
atggctctgcagattcccggagggttttgggcagctgcagtgacagtcatgctggtgatgctctccactccagtggctgaggcacgggatttccctaaggacttccttgtgcaattcaaaggcatgtgttacttcacaaacggtacggaacgcgttaggggcgtcgccagatatatctacaaccgggaggagtacggacgatttgattccgatgtaggcgagtttcaggcggttacagagctgggcaggtctattgaagactggaataattacaaggatttcctcgaacaggaacgggcagcagtcgataaagtatgcaggcacaactacgaagccgagctgaggaccacactgcagagacaggtggaaccaacggtgaccatttctcccagtcgcaccgaggctttgaaccatcacaacctgctagtgtgctccgtgaccgatttttaccccgctcagatcaaggtgcagtggttcaggaatgaccaggaagaaacagctggcgtggtatccacttccctcatcaggaacggcgactggacgttccagatactggtgatgttagagattacacctcagcggggtgacatatatacatgtcaggtggagcacccctctttgcagtcccctataactgtcgagtggagagcccagtctgagtcggctcaatctaaaatgctcggaggtgtcggcggattcgtcctcgggcttatcttcttggggctgggcctcatcattcgacaccggggacagaagggccctagaggccctccaccagccggaaacatctccgcgatgattcagagtggggaaagggcacaagcctag

SEQ ID NO: 51588 - DNA, 690 bp, Artificial Sequence
  Description of Artificial Sequence: Synthetic coding sequence
atggccatcagtggcgtgccggtgttaggcttctttattattgctgtgttgatgtctgctcaggaaagctgggctattaaggaggaacatgtgataatccaggcagagttctatcttaaccccgatcaaagcggagaatttatgttcgattttgatggggatgaaatatttcacgttgacatggctaagaaggagactgtctggcgcctagaagaattcggcaggttcgcatccttcgaggctcagggggctctggcgaacattgctgtcgataaagccaatctagagattatgaccaaacgcagcaactacacacccattacgaacgataagtttactcccccagttgtcaatgtgacttggctccggaacggcaagccagtcactactggggtctcagagactgtgttcctgccccgtgaggatcacctgtttaggaaattccactatctccccttcctccctagcactgaagacgtttatgattgcagagtggagcactgggggcttgatgaacccttactgaaacactgggaattcgacgctccttcgcccctgccagagacaactgagaatgttgtctgcgcactcggtctgaccgtcgggctcgtcggtatcataataggtacgatttttattattaaaggtttgaggaaatccaacgccgctgaaagacgtggtcctctttag

SEQ ID NO: 51589 - DNA, 765 bp, Artificial Sequence
  Description of Artificial Sequence: Synthetic coding sequence
atggcaattagcggagttcctgtactgggtttctttattatcgcagtattgatgtcggcccaggaatcttgggccatcaaggaggaacatgtcattattcaggccgagttctatctgaaccctgatcaaagtggcgaattcatgtttgattttgacggtgacgaaatattccatgtggacatggctaaaaaggagactgtgtggagattggaagaattcggacggttcgcttccttcgaggcccagggcgcacttgccaatattgccgtggataaagcaaatctggagattatgaccaaacgaagtaactatacacctattaccaatgttcccccagaagttacagtgctgaccaacagccccgtcgagctgcgggagcccaacgtactcatttgctttattgacaagtttacgcctccggtcgtgaatgtgacttggttacggaatggcaagcctgtgaccactggcgtgagcgaaaccgtgtttctgcctagggaggatcacctgttccggaaattccattatctgccctttctcccaagcaccgaggacgtctatgattgcagggttgaacactggggcctggacgaaccccttctgaaacactgggaatttgatgctccttcacccctcccagagaccacagagaatgtggtatgtgctctgggtttgaccgtagggctggtcggtattataatcggaactattttcatcatcaagggtctgaggaagtctaacgccgcagagcggaggggcccactgtag

SEQ ID NO: 51590 - DNA, 690 bp, Artificial Sequence
  Description of Artificial Sequence: Synthetic coding sequence
atggccatttctggcgtgcccgtcctggggttcttcatcattgcagttttgatgagtgcacaggagtcttgggctattaaggaggagcatgttattatccaggcagagttctacctgaacccagaccagtctggagagttcatgttcgacttcgatggtgatgaaattttccatgtggatatggccaagaaagaaaccgtttggagactggaggagttcggcaggttcgcctcatttgaggctcagggagccctggcaaatatcgccgtcgacaaggctaaccttgagattatgacaaagcgttcaaactacacacctataacaaacgataagttcaccccgccagtggtgaatgtgacctggttaaggaacgggaagccagtgactacaggagtcagtgagacggtgtttctgcctcgagaggatcacttgttcagaaagttccattacctgccttttctcccttctacagaagatgtgtatgactgccgggtcgagcattggggccttgacgaacctctgttgaagcactgggagttcgatgctccgtctcctctaccagagactaccgaaaatgtagtgtgtgccctaggtctgaccgtggggctagtcggcattatcatcggaacgatcttcatcatcaagggcgtgcgcaagagcaacgcagctgaacggcgaggccctttatag

SEQ ID NO: 51591 - DNA, 765 bp, Artificial Sequence
  Description of Artificial Sequence: Synthetic coding sequence
atggccatctcaggcgtgcccgtcctggggttcttcattattgccgtcctcatgtccgcccaggagtcctgggccatcaaggaggaacatgttataatccaggccgaattctacctgaacccagaccaaagtggcgagtttatgttcgacttcgacggggacgagatcttccacgtagacatggccaaaaaggagaccgtgtggagattggaagagtttggacgcttcgcctccttcgaagcccagggcgctctcgccaacatcgctgtcgataaggccaatctggagatcatgacaaaacgcagcaattatacccccataactaatgtacctccagaggtaactgtcctcacaaacagcccagtggagctgcgcgagcccaacgtgctgatatgctttattgacaaatttacccctccagtcgtgaatgtgacatggcttcggaacgggaagccagtcactacgggggtctctgagacagtgttcctgcccagagaagatcatttgttcaggaagtttcactacctcccctttcttccatctaccgaagatgtgtacgactgtcgagtggagcattggggattagatgaacccctgttgaaacactgggaatttgacgcaccaagcccactgcctgaaaccacagagaatgtagtgtgtgcactcggactcactgtggggctggtagggatcataatcgggacaatttttatcatcaagggtgtacggaaaagcaacgctgccgaaaggcgtggaccattgtag

SEQ ID NO: 51592 - DNA, 765 bp, Artificial Sequence
  Description of Artificial Sequence: Synthetic coding sequence
atggctatttctggagtacctgtgctgggattcttcatcatcgcggtgctaatgtccgcccaggaatcatgggcgattaaagaggagcacgtgatcattcaggcggagttctatctgaatcctgaccaatctggcgagttcatgtttgatttcgatggcgacgagatcttccacgttgacatggccaaaaaagagactgtgtggcgactcgaggagttcggacggttcgccagcttcgaagctcaaggagccctcgccaacatcgctgtggataaggccaatctcgagatcatgaccaaacgatcaaactacacccccatcaccaatgtgcctcccgaagtgactgtattgactaattctccggtggaattgcgcgagccaaacgttctgatatgtttcattgataagttcactcctccagttgtaaatgtcacatggctgcgaaatggaaaacccgtgaccaccggggttagtgagaccgtgtttctacctcgagaagaccacctgttccgtaagtttcactacttgcctttcctgccttcgaccgaggatgtttatgactgtagggtggaacactggggactggatgaacccctcctcaaacactgggagttcgacgccccttcaccactgcctgaaaccacagagaatgtggtgtgcgcccttggactgaccgtgggcctcgtcggcattattatcggaaccatctttatcataaaggggctgcgaaaaagtaacgcggctgagcgtcgagggccattatag

SEQ ID NO: 51593 - DNA, 690 bp, Artificial Sequence
  Description of Artificial Sequence: Synthetic coding sequence
atggccatctctggcgtacccgtgctgggcttctttattatcgcagtcctgatgtctgcccaggaaagctgggccatcaaggaagagcatgtgatcatccaagccgagttttacctgaacccagatcagagtggagagtttatgttcgatttcgacggcgacgagatttttcacgtggacatggcaaaaaaagagacagtttggcgcctggaggagttcggacgtttcgcctcctttgaggcccagggagctctggcgaacattgccgtggacaaagcaaatctggagattatgacaaaaagatccaactatacgcccattaccaatgacaagttcacaccccctgtagttaatgttacttggcttcggaacggcaagcccgtgactacaggggttagtgaaactgtctttctgcctcgagaggaccacctctttcggaaattccactatctaccttttctgcctagcactgaagacgtgtacgactgcagggtcgaacattggggcttggacgaaccactactcaaacactgggagttcgacgccccaagccctctgccagagaccactgagaatgtcgtgtgcgcactgggcctgaccgttgggcttgtcggaataattatcgggactattttcatcatcaaaggtgtccgcaagagcaacgctgcagaaagacgcggaccgctctag

SEQ ID NO: 51594 - DNA, 765 bp, Artificial Sequence
  Description of Artificial Sequence: Synthetic coding sequence
atggccatcagtggggtgccagtcttgggttttttcatcattgcagtcttaatgagcgctcaggagtcttgggctatcaaggaggagcacgttatcatccaggctgagttttacctgaaccctgatcagagtggcgagtttatgttcgacttcgatggagacgagatcttccatgttgatatggctaagaaggaaactgtatggcggttagaagaatttgggcgattcgccagttttgaggcccagggagccttggctaatatagctgttgataaagcaaacctggaaatcatgacaaagaggtccaattatactccaattactaatgtccccccagaggtcaccgttctgactaacagtcccgtggagctgagagaacccaatgtactgatatgcttcattgacaagttcacacctcccgtggtcaacgtgacatggctgcgtaatggcaagccagtaaccactggggtgtctgagaccgtcttcctccctcgcgaagatcatctgttcaggaaattccactacctcccgttcctcccttccactgaagacgtatatgattgccgggtagaacactggggactcgatgaacccctacttaaacattgggagttcgacgccccaagtcctctcccagaaacaaccgaaaacgtggtctgcgcactgggtctgacagtcgggctggtaggtataatcatcggtaccatttttatcatcaagggcgtacgcaaatccaatgcagctgagaggcgaggacctctttag

SEQ ID NO: 51595 - DNA, 765 bp, Artificial Sequence
  Description of Artificial Sequence: Synthetic coding sequence
atggccattagtggagtgcctgtcttaggttttttcatcattgcagtgctgatgtctgcccaagagtcctgggctatcaaagaagagcacgtaatcatacaggccgaattctacctgaaccccgatcaaagcggcgaatttatgttcgacttcgacggggatgagatctttcacgtcgatatggcgaagaaagagactgtgtggagattggaagagttcggtcggttcgcaagctttgaagcgcagggagcccttgcgaacattgccgtagacaaagccaatttggaaatcatgaccaaaaggagtaattacacccctattactaatgtccctccagaagtgacagtgctaacaaattcgcctgttgaacttagggaacctaatgtgctcatctgcttcatcgataaatttactccacccgtggttaacgttacatggttgaggaacggcaaaccagttacgaccggagttagcgaaacagtgttcctgccacgagaggaccacctttttagaaagtttcactaccttccctttcttccgagtaccgaggacgtttatgactgtagggtcgaacattggggtctggacgaacccctgttgaagcactgggaattcgatgcaccgagtcccctgcctgagacaaccgaaaatgtagtgtgcgcactcggcctgacggtcggactggttggaattatcattggcacaatctttatcattaaaggggtcagaaagtcaaacgctgccgagcgccgagggccactgtag

SEQ ID NO: 51596 - DNA, 690 bp, Artificial Sequence
  Description of Artificial Sequence: Synthetic coding sequence
atggctatcagcggcgtcccagtgctgggttttttcattatcgccgttttgatgagcgctcaggaaagctgggcgataaaagaagagcatgtgatcatccaagcagaattttacctgaacccagaccaatcaggagagtttatgttcgattttgatggcgacgagatctttcatgtggacatggcaaagaaggaaaccgtgtggagattggaggagttcggcaggtttgccagtttcgaggcccaaggggctctggcaaatatcgccgtcgacaaagctaacctagagatcatgactaaacgcagtaattacacccccatcacaaatgataagtttacccccccagttgtgaacgtgacatggctacggaacgggaagcctgttaccaccggcgtgagcgaaaccgtcttcctcccccgagaagaccacttatttagaaaatttcattatctgccatttctgccttcaaccgaggacgtctatgactgtagggttgagcattggggtctcgatgagccactgctcaagcattgggagtttgacgcaccctctcctttaccagagaccaccgagaatgtggtgtgcgcactaggcttgacggtagggcttgttggcattattataggtaccatatttatcattaagggtgtacgcaagagtaacgccgcagagaggcgcggtccattgtag

SEQ ID NO: 51597 - DNA, 765 bp, Artificial Sequence
  Description of Artificial Sequence: Synthetic coding sequence
atggcaatctccggtgtccccgtgctcggattttttataatcgcagtcctcatgtctgctcaggagagttgggccataaaagaagaacacgtgattatacaagcagagttttacctgaatcctgatcaatccggcgagttcatgttcgacttcgacggtgatgagatattccacgtggacatggccaagaaagagaccgtctggcgcctggaagagtttggccgtttcgcttccttcgaagctcagggagcgttggccaacatagccgttgataaagcaaacctggaaatcatgacaaagaggagtaattatacacctatcaccaatgtgcccccagaggtcactgtgctaacaaatagcccagtcgaattaagggagcctaacgtgcttatttgcttcatcgataaatttaccccacctgtcgtgaacgtcacctggctgaggaacgggaagccagtgacgaccggtgtttctgagacggtctttctacccagagaggaccacctgttccgaaagtttcactatctaccattcctgccatcgactgaggacgtgtatgattgcagggttgaacactggggcctagatgagcccctgctcaagcattgggaattcgatgccccaagtcccctgccagaaaccaccgaaaacgtcgtgtgcgcactcggcttgactgtcggactggtgggcattattataggaacaatctttatcattaaaggggtccgaaagtcaaacgctgctgaaaggagaggacccttatag

SEQ ID NO: 51598 - DNA, 690 bp, Artificial Sequence
  Description of Artificial Sequence: Synthetic coding sequence
atggctatttctggggtcccagtgttgggtttctttatcattgctgttctcatgagtgcccaggagtcatgggccataaaggaagagcacgtaattatccaggctgagttctatctgaatccagatcagagcggcgagttcatgttcgatttcgatggagatgaaatctttcatgtggacatggccaagaaggaaaccgtttggcgactcgaggagttcgggcgattcgccagcttcgaggctcaaggtgcactcgctaacattgcagtggataaggcaaatctggagataatgaccaagcggagtaactacacacctatcacaaacgataagtttacacctcccgttgtgaatgtaacatggctcaggaatggcaaaccagtgacaactggcgtgtccgaaacggtgttccttcccagagaggatcacctgttcaggaaatttcactatttaccattcctgccaagtactgaagatgtgtatgattgtagagttgaacactggggcctcgacgagcccctgctgaagcactgggagttcgatgccccttctcccctcccggaaactactgagaacgtggtgtgcgcattaggactgacagtcggactcgtgggaattattatcggaacaatatttatcattaagggggtcagaaagtctaatgcggctgaaaggaggggaccgctttag

SEQ ID NO: 51599 - DNA, 690 bp, Artificial Sequence
  Description of Artificial Sequence: Synthetic coding sequence
atggctatctcgggggtccccgttctcgggttctttattatagccgtgctcatgtccgcacaagaaagctgggcaatcaaggaggagcacgtgatcattcaggctgaattttatctaaatcccgatcagagcggggaatttatgtttgatttcgacggcgatgagattttccatgtggacatggcgaagaaggaaaccgtgtggcggctggaggaatttggtagattcgcgagcttcgaagctcagggagctcttgctaacattgccgtagacaaagcaaacttggaaatcatgaccaagcggtccaattatacgcccatcaccaatgataagttcactccaccagtggtgaacgtgacctggctgcgaaatggcaaacctgtgacgacaggggtgagtgagacagtcttcctgccgagagaagatcatctctttagaaaatttcactacttgccctttctgcccagtactgaggacgtctacgactgccgtgtggaacactggggtctggatgaacccctcctgaaacactgggaattcgacgctccctctccactcccagagacaactgagaatgtggtgtgcgctctcggactgactgtgggcctcgtggggatcatcatcggaacgattttcatcattaagggggttagaaaaagcaatgccgcagagagacgtggacccctgtag

SEQ ID NO: 51600 - DNA, 690 bp, Artificial Sequence
  Description of Artificial Sequence: Synthetic coding sequence
atggccatctccggcgtgccggtcctcggattcttcattatcgccgttcttatgtcagcccaagaatcctgggcaataaaggaagaacacgtgatcatacaggcagagttctatttaaacccagatcagagtggcgagttcatgtttgactttgacggtgacgaaatttttcacgtcgacatggccaagaaggagacagtttggagattggaagaatttggtcggtttgctagctttgaggcccagggtgcgctcgcaaacattgcagtggacaaagccaatcttgagatcatgaccaagagatcaaattatactccaattacaaatgacaagttcaccccacccgtggtaaatgtgacatggctgcgcaatggcaagccagttaccactggggtctcggaaacggtgttcttgccacgggaggaccatttgtttagaaaattccactatctgccctttttgcccagcacagaggatgtgtacgattgtcgggtggagcactggggcctggacgagcctctgctcaaacactgggagttcgatgccccatcccctttgcctgaaactacagagaacgtcgtgtgtgctctcgggttgaccgtaggcctcgtgggcataataataggcaccattttcattatcaagggactgagaaaatccaatgcagccgaaagacgtggccctctgtag

SEQ ID NO: 51601 - DNA, 765 bp, Artificial Sequence
  Description of Artificial Sequence: Synthetic coding sequence
atggctataagcggagttcctgtgctcgggttctttataattgcagtgctgatgtcagctcaggaaagctgggccatcaaagaggaacatgtgatcattcaagccgaattctacctgaatccagaccaatcaggcgagtttatgtttgattttgacggcgatgagatatttcacgttgatatggccaagaaggagaccgtgtggcgcctcgaagaatttggaagatttgcttcatttgaggcccagggggcactggcaaatattgccgtggataaggcaaatctcgaaattatgaccaagcggtcaaactatacccccatcaccaatgtgcctcccgaagtgacagtgttgaccaattcccccgtcgaactgagggaacccaatgtcctcatctgctttatcgataagtttacacctcccgttgttaacgtcacatggctccggaatgggaagccggtcacaactggagtatctgaaacagtgtttctgccaagggaagaccatttgttcagaaaatttcactacttaccattcctgccctcaaccgaggacgtgtacgactgtagagtggaacactggggtctggacgagcccctgctgaaacactgggagtttgatgctcccagcccactgccagaaacaacggaaaacgttgtgtgcgccctcggcctgaccgtcggcttggtgggtatcattatcggcaccatctttatcattaaaggcgtgcgcaagtctaatgcggcagagcgtcgagggcctctgtag

SEQ ID NO: 51602 - DNA, 543 bp, Artificial Sequence
  Description of Artificial Sequence: Synthetic coding sequence
atggcaatatcaggcgtccccgtgttgggattctttataattgccgtcctgatgtcagcacaggaatcatgggcaatcaaagaggaacacgtgattattcaggccgaattttacctcaatcctgatcagtccggggagtttatgttcgatttcgacggtgatgaaatctttcatgtcgacatggcgaagaaggagaccgtgtggagactggaagagttcggccgattcgcgtcgtttgaggcccagggagcactggcgaacatcgctgttgacaaggctaatctggagatcatgaccaagaggtctaaaccgtccccacgggattaccgggaacgtggggtctgcccaggacccgactgtgggagcggcggtcatcactactgggatcaccttcatcatcagggaatagctcagaagcagtgctccagaactcaaggggcaagtgtcaggcacatggaggttatggtgttcttgagggagaagattaccgaagagacttccgctctgatggcacttcagagttggcagtattacaatccctag

SEQ ID NO: 51603 - DNA, 714 bp, Artificial Sequence
  Description of Artificial Sequence: Synthetic coding sequence
atgtcagcccaggagagttgggccatcaaggaagaacacgttataattcaggctgaattctacctaaacccggatcagtccggagagttcatgtttgactttgatggtgacgagatttttcatgtggatatggcaaaaaaggagaccgtttggcggttagaggagtttggacgcttcgcctctttcgaagcccagggggctctggccaacatagccgttgacaaagcgaatctggagatcatgactaaaagaagcaattataccccaatcaccaacgtaccccctgaagtgactgttctcactaactctcccgtcgaactgcgcgaacccaatgtgctgatatgttttatcgacaagttcacccctccagtcgtaaacgttacatggttgaggaacggcaagccagttaccacaggcgtgtctgaaaccgtgtttctcccgcgagaggaccacctttttaggaagtttcactatttgccattccttccttcgaccgaggacgtctatgactgtagggtcgagcattggggcctggacgaacccctgcttaagcattgggagttcgacgccccttccccgctgcctgagacaaccgagaatgtggtgtgcgctctgggcctgaccgtgggactcgtgggcattatcatcgggactattttcattatcaaaggggtgagaaagtcgaacgcagctgaacgccgaggcccactttag

SEQ ID NO: 51604 - DNA, 498 bp, Artificial Sequence
  Description of Artificial Sequence: Synthetic coding sequence
atggccaaaaaagagacagtctggagacttgaggagttcggaaggttcgcctcgttcgaagcacagggtgccctcgctaacattgcagtcgacaaggccaatctggagattatgaccaagagatccaactacactccaattacgaatgtaccccctgaggtgacggtgctcactaatagcccagtcgagctgcgggagcccaatgtgctgatatgttttatcgataagttcactcccccagtggttaacgttacttggctcagaaacggaaaaccggttacgactggcgtgtctgagaccgttttcctttccatcgcgttttcctgcatttacttccctctttttcctataatactactgtcaccttgtaatgcaagcggtatcaaacacaccggagtgtgcctttgctatggtatgccccacggcgcaagcctcgtgtatctgttgtttaaggtgtcaagcaactgtgacttctccgaacataataaattattctag

SEQ ID NO: 51605 - DNA, 453 bp, Artificial Sequence
  Description of Artificial Sequence: Synthetic coding sequence
atggccatcagcggtgttcctgtcctcgggtttttcatcatcgctgttctcatgtccgcccaggagagctgggccatcaaagaggagcatgtgattatccaagccgaattctaccttaatcctgaccaaagcggagagttcatgtttgatttcgatggagacgagatttttcatgtcgacatggccaaaaaggagacagtgtggagactagaagaattcggaagattcgcttcgtttgaagctcagggagcgcttgcgaatatcgcggtggataaagctaacttggagattatgacaaaacgaagtaactataccccgatcaccaatgtcccgcctgaagtgaccgttctcacaaattctcctgtggagctcagggaacctaatgtactcatttgctttatcattaagggagtcaggaaatcaaatgctgccgagcgccgaggcccactttag

SEQ ID NO: 51606 - DNA, 543 bp, Artificial Sequence
  Description of Artificial Sequence: Synthetic coding sequence
atggctatttctggcgtccccgtgctggggttttttattattgccgtactaatgtctgctcaggagtcttgggccatcaaggaagaacacgtgatcatccaggccgaattctatctcaatcccgaccagtctggcgagtttatgtttgactttgatggcgatgagatttttcatgtggatatggccaaaaaggagactgtgtggagactcgaggagtttgggcgtttcgcctcattcgaggcccagggggctctagcgaatattgccgtcgacaaagcaaacttggaaatcatgaccaagagatcgaagccttctcctagggattaccgggagagaggagtatgtccaggtccagactgcggctccggaggacaccactattgggaccaccttcatcaccagggcagcgcacagaaacaatgctctaggacacagggagcttctgtgaggcatatggaggtcatggttttccttagggagaagattactgaggagacatcggccctgatgacactgcagtcatggcagtactataatccgtag

SEQ ID NO: 51607 - DNA, 543 bp, Artificial Sequence
  Description of Artificial Sequence: Synthetic coding sequence
atggccatttcaggggtgcccgttctgggcttcttcataattgctgtgctcatgagcgcgcaggagagctgggctattaaggaggaacatgtgatcatccaggccgagttttacctcaatccggatcagtccggcgagttcatgttcgattttgatggtgatgagatttttcacgtggacatggctaagaaggagacggtctggagattggaggagttcgggaggtttgccagcttcgaggctcagggtgctctggccaatatcgctgttgacaaggccaacttagaaattatgacaaagcgttcaaagccaagtcccagggattatagagaacggggagtatgtccaggccctgattgtggatccgggggacatcactactgggaccacctccatcatcagggttctgcacagaaacagtgtagtagaactcaaggagcatccgtgcggcacatggaggtgatggtttttttacgcgaaaagatcactgaagagactagcgcactgatgaccctccaatcttggcaatactataacccctag

SEQ ID NO: 51608 - DNA, 498 bp, Artificial Sequence
  Description of Artificial Sequence: Synthetic coding sequence
atggccaaaaaggagaccgtttggagattggaggaattcgggagatttgctagctttgaggcacagggcgctctcgctaacattgctgtggacaaggccaacctcgaaattatgactaagcgatccaactatacccctatcaccaacgtgcccccagaggttaccgtgcttaccaactctcctgttgagctgagggagcccaatgtcctgatttgcttcatagataagttcacgccccctgttgtgaacgtgacgtggctcagaaacggcaagccagtaacaaccggtgtaagcgagacagtctttctgagcattgcctttagctgtatttatttccctctgttccctattattctcctgtctccatgtaatgcctccggaatcaagcataccggagtttgtctgtgctatggtatgcctcatggagccagcctggtgtatcttctcttcaaggtgtctagtaactgtgacttttctgagcataataagctgttttag

SEQ ID NO: 51609 - DNA, 543 bp, Artificial Sequence
  Description of Artificial Sequence: Synthetic coding sequence
atggcgatttccggggtgccggtgcttggctttttcattatcgctgttctgatgagcgctcaggagtcgtgggccatcaaagaagaacatgtgattatccaggccgagttttacctgaacccagaccagtccggcgagttcatgtttgacttcgacggagacgaaatattccatgtggacatggccaagaaggagaccgtgtggcggttggaggaattcggtcgttttgctagcttcgaggcccaaggagcgcttgcgaacatagccgtcgataaggctaacttagagatcatgacgaagcgctcaaagccttcacccagagactatcgcgaaaggggcgtgtgccctggtccggactgcggatcgggcggtcaccattactgggaccatcttcaccatcagggatccgctcaaaagcagtgtagccgtacacaaggggcttccgtaaggcatatggaagttatggttttcttgcgggagaaaataactgaggaaacgagcgcccttatgacactacagagctggcaatactacaatccttag

SEQ ID NO: 51610 - DNA, 498 bp, Artificial Sequence
  Description of Artificial Sequence: Synthetic coding sequence
atggcgaagaaagagactgtgtggcgtctggaagaattcggccgatttgccagctttgaggcccaaggcgcactggccaacatcgctgttgacaaggctaacctcgaaatcatgactaagcgttcaaactacacaccgattactaacgtccctcccgaggtgacggtccttaccaattcgccagtggagctccgtgagcccaacgttttgatctgtttcatcgacaaatttacgccaccggtggtcaacgtgacttggttgcgcaatggaaagcctgtgacaactggggtgtctgaaacagtgttcctgtcaatagcattttcctgcatctacttcccactgtttcctataatcctgttgagcccttgtaatgcgtctggaatcaaacatactggcgtgtgtctttgctacggaatgccccacggcgcatctctggtctatctgctgtttaaggtgtcctcaaactgcgacttttctgaacacaataagctgttctag

SEQ ID NO: 51611 - DNA, 714 bp, Artificial Sequence
  Description of Artificial Sequence: Synthetic coding sequence
atgtcggcccaggaaagctgggccatcaaagaggaacatgttattatccaggccgagttctacttaaaccctgatcaaagtggcgagtttatgttcgattttgatggcgatgagatcttccatgtggatatggccaagaaagaaactgtgtggaggctggaagaattcggaagattcgcgtcgttcgaggcacagggcgcactggccaatattgcagtcgataaggccaacttggagatcatgacgaagcggagtaattataccccaattaccaatgttcctcccgaggtgactgtgctcactaactcacccgtcgagctgcgagagccaaacgtgctgatttgcttcatcgataaatttacacctcccgtcgtgaacgtgacctggctgcggaatggaaagccagtgactacaggagtctctgagactgtctttctgcccagagaggaccacttattcaggaagttccattatctgcccttcctgccatctacagaagacgtttacgactgcagggttgagcattggggactcgacgagccactgctgaagcattgggaatttgacgccccaagtcccttgcccgaaactacagagaatgtcgtatgcgctctaggcctgacagtcgggttagtcggaatcatcattggaactattttcatcattaagggcgtccggaagtcaaatgctgctgaacgcagggggcctctctag

SEQ ID NO: 51612 - DNA, 543 bp, Artificial Sequence
  Description of Artificial Sequence: Synthetic coding sequence
atggccatatcaggcgtccctgtgttaggattttttatcatcgctgtccttatgtcagctcaggaatcttgggccattaaagaggagcacgtcataattcaggctgagttctatctgaacccggaccagagcggagagtttatgttcgactttgacggggacgaaatctttcacgtggatatggccaagaaggaaaccgtctggagactggaagagttcggtcgcttcgcaagctttgaagcccaaggcgcacttgctaatattgccgtcgacaaggccaatctcgaaatcatgaccaaacgttccaagccctcccctagagattatcgtgagaggggcgtttgtccgggacccgactgtggatctggtggtcatcattactgggatcatttgcatcatcaaggatccgcacagaaacagtgtagccgtacccagggtgcttcggtcagacatatggaagttatggtcttccttagggaaaagataacagaagagaccagcgccctcatgactctacaatcatggcagtattacaacccttag

SEQ ID NO: 51613 - DNA, 498 bp, Artificial Sequence
  Description of Artificial Sequence: Synthetic coding sequence
atggccaagaaggagacagtctggagattagaggaatttggtcgcttcgcctcattcgaagcccaaggggctcttgctaacatcgcggtggacaaggctaatctggagattatgacaaaaaggagcaactacaccccaatcacaaacgtgcctccagaggtcacagtcctgacaaactcccctgttgaactgcgtgagccaaacgtgctgatttgcttcatcgacaagttcacacctccagttgtgaatgtgacgtggcttcgaaacggcaaacctgtgacaacaggagtcagtgaaacggttttcctgtccattgccttctcgtgtatttactttcccctctttcctataatcttgctgtctccctgtaatgcttctggaatcaagcacactggcgtctgcctctgttacggaatgccccatggcgcttcactcgtctacctgctgtttaaggtgagcagtaattgcgatttctccgagcacaacaagctgttctag

SEQ ID NO: 51614 - DNA, 498 bp, Artificial Sequence
  Description of Artificial Sequence: Synthetic coding sequence
atggcgaagaaagagaccgtctggcgattagaggagttcgggcgtttcgcgtcttttgaagcccagggagccctggcaaacattgccgttgacaaggccaacctggagatcatgacaaaacgatcaaactacaccccaatcacaaatgtgccccctgaggtgacagtgctcacaaacagcccggttgagctgcgagaaccaaacgttctgatctgctttatcgacaagttcacacctcctgtcgtcaatgtcacctggctacggaatggaaagcctgtcacaacaggcgtgtctgagaccgtgtttctgagtatcgcgttcagttgcatttattttcctctgttccctattattctcctctcaccatgcaacgcctcaggcatcaagcatacaggtgtttgcctgtgctatggtatgccccatggggcttctctagtgtatctcttgttcaaggtgtccagcaactgtgatttcagcgaacacaataaactcttctag

SEQ ID NO: 51615 - DNA, 714 bp, Artificial Sequence
  Description of Artificial Sequence: Synthetic coding sequence
atgagtgctcaggagagttgggccatcaaagaggaacatgttattatccaggccgagttctacctcaatcctgatcagtccggcgagttcatgtttgatttcgatggcgacgagatctttcatgtcgacatggctaagaaggagaccgtatggcgccttgaagagttcgggagatttgcttcgtttgaagcacaaggtgcgctggccaacattgcagtggacaaagccaatctggaaattatgacaaaacggagtaattacactccaataaccaacgtccccccagaggtcacagtcttgactaattctcccgtggagttacgcgagcctaacgtcctgatctgctttattgacaaattcacccctcccgtcgttaacgtgacatggttaagaaacggaaaacctgtaactactggtgtgtcagagacagttttcttaccgcgagaagaccacctcttcaggaaatttcactatttaccattcttgccaagcaccgaggatgtttacgattgcagagttgaacattggggacttgacgagccccttctgaagcattgggaatttgacgctcccagccccctgccggaaaccacagagaacgttgtttgtgccctcggactcaccgtgggacttgtcggtatcatcatcggtacgattttcatcattaaaggggtgcgtaaatccaacgcagccgagcgcagaggcccattatag

SEQ ID NO: 51616 - DNA, 543 bp, Artificial Sequence
  Description of Artificial Sequence: Synthetic coding sequence
atggcgatctcaggagtgccagtgctggggttctttataatcgcggtcctgatgagtgctcaagagtcatgggcgatcaaggaagagcacgttatcattcaggccgaattctacctgaatccagatcagtccggggagttcatgtttgattttgatggggacgaaatattccatgtggatatggctaagaaggagactgtgtggagactggaggaattcgggcgtttcgccagcttcgaggcgcaaggagcacttgccaacattgctgtcgataaggccaacctggagattatgaccaagagaagcaagccctctcccagggactatcgggaatgcggggtctgccctggccctgattgcggtagtgggggacaccattactgggaccacctccaccatcagggtagcgcacagaaacagtgttccagaacccagggagcttcagttaggcatatggaggtcatgatgtttcttcgggagaaaataacagaagagacatctgctctcatgaccctgcagtcctggcagtattacaacccctag

SEQ ID NO: 51617 - DNA, 498 bp, Artificial Sequence
  Description of Artificial Sequence: Synthetic coding sequence
atggcaaaaaaggaaaccgtttggcggttagaagaattcgggcgattcgcgtcatttgaagcccagggcgctttagcaaatatagccgtagataaggcaaatctcgagatcatgacaaaaagatctaactacacacccatcacgaacgtgccaccagaagttacagttctgacaaatagtcccgtcgagttgcgggaacccaatgtactgatttgcttcatcgacaaattcactccaccagtagtcaatgtaacttggttgcgcaacggaaagccagtgacaaccggcgtctctgagactgtgttcctctccatagcattctcttgcatatatttccctctctttcccatcattctgctttcaccatgtaacgcctcaggcattaagcataccggcgtgtgtctatgttacggaatgccccacggcgcttctctcgtgtatctgcttttcaaagtgtcctctaattgtgacttctccgagcacaacaaactcttttag

SEQ ID NO: 51618 - DNA, 714 bp, Artificial Sequence
  Description of Artificial Sequence: Synthetic coding sequence
atgtcagcgcaagagagttgggctatcaaggaggagcatgtgataatccaggccgagttctacctcaaccccgaccagagcggggaattcatgttcgattttgatggtgacgaaatcttccatgtggacatggctaagaaagagaccgtgtggcgactcgaagaatttggaaggttcgcttcgtttgaagcacagggagctctcgcgaatatagccgtcgacaaggccaatctcgagatcatgactaagcgtagtaattacaccccaatcaccaatgtcccgccagaggtgaccgtcctgactaatagtccagtggaacttcgagaaccaaacgtgctcatttgctttatagacaagttcacccccccagtggtgaacgtgacctggttgcggaacggcaaacccgtgactaccggcgtttcagagacagtttttctcccacgagaagaccacctattcagaaaatttcactatctgcccttcctccctagtacagaggatgtttacgactgtcgtgtagagcactggggactggatgagccactgctcaaacactgggaatttgatgccccatccccactgcccgagactaccgaaaacgtagtctgtgctcttgggctcactgtaggccttgtgggcataatcattggcacgattttcattatcaaaggagtacgtaaaagcaacgctgccgagcgcaggggtcctctgtag

SEQ ID NO: 51619 - DNA, 801 bp, Artificial Sequence
  Description of Artificial Sequence: Synthetic coding sequence
atggtttgtcttaaactgccagggggatcatgtatggcggctctaaccgtcacccttacagtcctctctagcccgttggcccttgccggtgacactcaacccaggtttctggagcaagccaagtgtgaatgccattttcttaatggaaccgagagggtttggaacttaattcggtatatctataaccaggaagaatacgctaggtacaattcagacctcggcgaatatcaggcagttaccgagctcggccgacccgatgcagagtattggaatagtcagaaggacctcctagagcgaagacgcgctgaggttgatacgtactgtcggtataactatggcgtggttgagtcctttaccgtgcagcgaagagttcagcctaaagtgaccgtctatccctccaaaacccagcccttgcagcaccacaatcttctggtatgttctgtgaacgggttttacccaggctccattgaagtcaggtggttccgcaatgggcaggaggagaaggccggagtcgttagtactggtctcattcagaatggcgactggacattccagaccctggtgatgctggagactgtacctaggagcggcgaggtgtacacttgtcaagttgagcatccaagcatgatgtcccctctgactgtgcaatggtccgctaggagcgagagtgctcagagcaagatgctgtcaggagttgggggatttgtgctcggacttctcttccttggcactggcttgtttatttattttagaaatcaaaagggtcacagtggactccagccgactgggctgctttcatag

SEQ ID NO: 51620 - DNA, 801 bp, Artificial Sequence
  Description of Artificial Sequence: Synthetic coding sequence
atggtctgtctcaagttaccaggtggctcttgcatggcagccctcacggtgacgctgacagttctgtcctctcctcttgcgctcgctggagatacacaacctcgattcttagagcaagcgaagtgtgagtgccacttcctgaatggcacagaaagggtatggaatctgatcaggtatatttacaaccaggaggaatatgcacgctacaacagcgatctgggggaataccaggctgtgacagaacttggtcgccctgatgcggaatattggaactcacagaaagatcttctggaaaggcgaagggcggaggtcgacacttattgccgctacaattacggggtagtggagtcctttactgttcagagacgtgtacaacccaaagtgactgtctatccatccaagacacaacctctgcagcaccacaacctgttggtgtgctccgtgaatggcttctaccccggatctatcgaggtgcgttggtttcgcaacagccaggaggagaaggccggagtggtctccacgggactgatccagaatggcgactggacctttcagacattggtgatgctcgaaacagttcctaggtcgggcgaggtgtatacctgccaggtcgaacatccatcaatgatgagtccgctgaccgtgcaatggtccgcgaggtcagagagcgctcagtccaaaatgttgtctggagtagggggatttgtcctgggcctgctcttcctcgggacagggttgtttatttatttccgcaaccaaaagggacatagcgggctccagccaaccggactcctctcttag

SEQ ID NO: 51621 - DNA, 801 bp, Artificial Sequence
  Description of Artificial Sequence: Synthetic coding sequence
atggtctgcctgaagctaccgggaggaagctgcatggctgcactgaccgtaacactgactgtgctgagctcccctcttgccttggcaggggatacccagcccagatttcttgaacaggcaaaatgcgagtgccactttctgaacggtaccgaacgagtttggaatctaattaggtatatctacaaccaggaggagtatgcccgttataactcagacctaggagaatatcaagctgtaacggagttgggcagacccgacgccgagtattggaattctcaaaaggacctgctggagcgcagacgcgcagaggtggacacctactgcagatacaactatggagtggtggaatctttcacagtgcaaagacgagtccagcctaaagtgacagtgtatccatctaagacacagcctttgcagcaccacaaccttttggtttgctcggtgaatggtttttacccaggatccatagaagtgcggtggtttcggaatggtcaggaagaaaaggctggtgttgtttctacaggacttatccaaaacggcgactggaccttccagaccttggtgatgcttgagacagtcccacggtccggagaagtatatacttgccaggtagagcacccttcaatgatgtccccattgactgtacagtggtctgctcgcagtgagtccgcacagagcaagatgctatccggagtgggtggctttgtcctcggattactgttcctagggacgggactgtttatctattttcgtaatcagaagggtcactcaggactgcagcctaccggcctactcagctag

SEQ ID NO: 51622 - DNA, 1173 bp, Artificial Sequence
  Description of Artificial Sequence: Synthetic coding sequence
atgtcagtgagagttgccagagtcgcatgggtcagagggctgggtgcctcctatcggcgaggagcctcatcttttccggtgcctcctccaggggctcagggggttgccgaactgctgagagatgccacaggcgcagaagaagaagccccatgggcggctaccgagagaaggatgccgggtcagtgctccgtgctcttgtttcccggacaagggtctcaggtggtgggcatgggccgagggttgttaaactaccctagggtgcgtgaactctacgctgccgctcgcagagtcctgggatatgacctgttagaactgtctttacatggaccccaggagactttggaccgtacagtccactgtcagcctgccatattcgtcgctagcttggctgccgtcgagaagctgcatcatctccagccctcagtaatcgagaattgtgttgctgcagccggtttctccgtgggtgagttcgccgcacttgtttttgccggagctatggagttcgccgagggcctctacgcggtcaaaatccgcgctgaggcaatgcaagaggcgagtgaagctgttcctagcgggatgctgagcgttctcggtcaaccacagtccaagttcaatttcgcttgtcttgaggcaagggagcattgtaagagtctggggattgagaaccctgtgtgcgaagtctctaattatctcttccccgactgtagggtgatttccggacaccaggaagcacttcgattcctccagaagaactcctcaaagttccatttccggaggacgcggatgctccctgtttcgggggcttttcacacccgtctgatggagcctgctgtcgaacccctgacccaggccctaaaggccgtcgacataaagaagcccttagtgtctgtttacagtaatgtccacgcacaccggtacagacaccccggtcatattcacaaactccttgcacagcaactggtcagtcctgtaaaatgggagcagaccatgcacgccatttatgagagaaagaaaggcagggggttcccgcaaacatttgaggtgggacctggtcgccagttaggcgcaatccttaagagctgtaatatgcaggcctggaagagttattcagctgtggacgttctgcaaaccctggagcacgttgaccttgaccctcaagagccaccacgctag

SEQ ID NO: 51623 - DNA, 543 bp, Artificial Sequence
  Description of Artificial Sequence: Synthetic coding sequence
atgagcgttagagtcgctcgagtggcttgggtccggggactcggagccagttaccgaaggggcgctagcagcttcccggtgcccccacccggtgctcagggtgtggccgaattgctgcgcgatgcaactggggctgaagaggaggccccttgggccgcaaccgagcgtagaatgcctggacagtgttccgtgctgctcttcccagggcaaggttcccaggttgtgggtatgggcagagggctcctgaactacccccgtgtcagagaactctatgcggcagcaagaagagtcctcggatacgatctgctggaactctccctccacgggcctcaggaaacactcgaccgcaccgtgcattgccagccggcaattttcgtggcctctcttgccgctgttgaaaagctccaccaccttcagccctcggtaatcgaaaactgcgtggccgctgccggtttttcagttggggagttcgctgctctggtgtttgcaggtgccatggaattcgctgagggcagcacggtgagtcctgaagagtttctttag

SEQ ID NO: 51624 - DNA, 3414 bp, Artificial Sequence
  Description of Artificial Sequence: Synthetic coding sequence
atgcctctcagcagccacctgctgcctgccctcgttctctttctcgcgggatcatccgggtgggcttgggtacccaatcactgtaggagccccggtcaggctgtgtgtaactttgtctgtgactgtagagattgcagcgacgaagcacagtgcggatatcacggtgccagccctactctcggggcaccctttgcatgtgactttgaacaagacccgtgtggatggagagacatttccacatcaggttactcttggctcagagatagggccggagccgctctggaaggccctggaccacactcagaccatacccttggaactgacctcgggtggtacatggctgtgggaacacacagaggaaaagaagcatctactgctgccctgcgctctcctacccttagggaggccgctagttcctgtaaactaaggctgtggtaccacgctgcttcgggcgacgtggctgagctgcgcgtggagctgactcacggcgcagaaaccctgacgctgtggcagtcgacagggccttggggcccaggatggcaggaactagccgtgacaaccggccgtatccgcggagactttcgggtgacattctccgcaactaggaacgctactcaccgaggtgctgtggctctcgacgacttagaattctgggattgtggtctccctaccccacaggccaactgcccgcctggccaccaccactgtcagaataaggtgtgcgtggaacctcaacaactgtgcgatggcgaggataactgtggcgatctgagtgacgagaatccattgacctgtggcagacatatcgccactgatttcgagactgggctcggcccttggaacaggtcagaggggtggagccgaaatcatcgtgccggaggaccagagcgtccgtcctggcccagaagggaccacagccgcaattccgcccaaggttccttcctagtgtcagttgccgagccaggaacgcccgctattctgtccagccctgaatttcaggcttccgggaccagcaactgttcactggtgttttatcagtatttatccggaagtgaagcagggtgccttcagctcttcctccagactttgggccctggcgctccccgagctcccgtcttgctgaggcgtcggaggggagagctcgggacggcctgggtacgagacagggtagatatccaatccgcctatccttttcagatcctgctggccggacaaactggtcctggcggtgtggtgggcctggacgacctcatcctgtcagatcactgtcggccagtgagcgaagttagtacattgcaacccctgccccctggacccagggccccagcgcctcaacctttaccacccagttctcgcctgcaggactcatgcaaacagggacacctcgcatgtggcgacctctgcgtcccaccagagcaactttgtgattttgaggagcagtgtgcaggaggggaagatgagcaggcatgcgggactacggactttgagtctcccgaggcaggtggctgggaagatgcctccgtgggcaggctccaatggaggcgagtgagcgcccaggaatctcagggaagtagcgcggctgccgctggacacttcctgtcgcttcagcgggcttggggacaactgggagcagaagcccgtgtcttaaccccgctgctcggcccatcgggaccttcttgtgaactgcacctggcctactacctgcagtcccaaccgagggaggtgtcctgcaatttcgaacgagacacatgtagttggtaccccggacatctgagtgatacccactggcgatgggtggaatccaggggccctgaccacgatcatactacaggacagggacactttgtattgctggatcccaccgacccgcttgcatggggccactccgcccacctgctgtctcggccacaagtacccgcagctccaaccgaatgtctgagcttctggtaccacctgcacgggccacaaattgggacgctgagacttgccatgcgcagggaaggcgaggaaacacacctatggtctagaagtggcacacagggtaaccgttggcatgaagcctgggccaccctgtcacaccagcctggaagtcacgcgcaataccagctattattcgaaggactgagagatggctaccacgggacaatggctctggacgacgtggccgtgcggcctgggccatgttgggccccaaactattgctcatttgaggactccgactgcggattctcccccggaggccaagggctgtggagaaggcaagctaatgcgagcggtcacgccgcatgggggcctcctaccgaccacacaacggaaaccgcccaaggccattatatggtggtagacacaagcccggacgcactccctagggggcagacggcgtccttgacttctaaggaacatcgccctctggcccagcctgcctgtcttacattttggtatcacggctccctacgttcccccggtacactgcgcgtctatctggaggaaagaggaaggcaccaagtccttagcctgagcgcccacgggggactcgcgtggcggctcggttccatggacgtccaagcagagcgggcatggcgcgtggtcttcgaggccgtcgccgctggtgtcgcacacagttacgtcgcactggatgatttactgctccaggatgggccttgtcctcagccagggtcttgcgattttgagagtggcttatgtggttggtcccacctggcttggccgggactaggaggatatagctgggattgggggggtggagccactccttcacgctaccctcagccgcctgtcgatcataccttaggaacagaagccggtcacttcgccttctttgaaactggggttctcggcccaggcggacgggcagcttggcttaggtcagaaccactgccagccacccccgcatcctgcttacgattctggtaccacatgggtttccctgagcacttttacaagggagaattgaaagtgttattgcactccgctcaggggcaactggcagtgtggggtgccggaggacacagacggcaccagtggctcgaggcccaagtggaagtggccagcgccaaggagttccagatcgtgttcgaagccacactgggcggtcaaccagccctaggccctatcgccctggacgatgtcgagtatctggccggacagcactgccaacagccagccccatctccaggtaacaccgctgctccgggtagtgtcccagctgttgtggggagcgctctgctgcttctgatgctgctcgtgctccttggtcttggaggccgtcgctggctgcagaaaaaaggatcatgcccgtttcagtccaatacagaggcaactgctcctggattcgacaacatcctcttcaacgccgatggcgtgactttgccagcctcggttacctccgatccttag

SEQ ID NO: 51625 - DNA, 3609 bp, Artificial Sequence
  Description of Artificial Sequence: Synthetic coding sequence
taaggctgggcctgggtccccaaccactgtcggagccctgggcaagccgtttgcaatttcgtctgcgattgcagggactgttcagatgaggcccagtgcgggtaccacggggcttctcctacccttggtgccccttttgcatgcgattttgagcaggatccttgcggttggcgggatatctctacctctggctattcttggttgcgggacagagccggtgctgctttggaagggccaggccctcactccgaccatacactaggaacggatctgggctggtacatggccgtggggacccaccggggtaaggaagccagtactgctgctctcagaagtcccacactgcgggaggctgcctcaagctgcaagctcagactgtggtaccacgcggctagcggcgatgtagccgagctgagagtcgaactgacacacggagccgaaaccctgacactatggcaatctacggggccatggggccctggctggcaggaactggccgtcaccaccggcagaatcagaggagacttcagggtgactttcagcgcgacacgtaatgcaacacatcgcggtgctgtggctctcgatgaccttgagttctgggactgcggactccctacaccacaggccaactgtccaccgggtcatcaccattgccagaacaaggtgtgcgtggagccgcagcagctctgcgacggcgaggacaactgcggcgatctgtccgatgagaacccactcacgtgcgggcgtcacatagcaactgactttgagactggattgggcccatggaaccgcagtgaaggctggtcccgcaaccaccgggcaggtggacctgagcgccctagctggcctcggcgtgaccatagtcgtaacagcgctcagggctcttttctggtgagcgtcgccgagcctggcacaccggctatcctgtcatcaccggagttccaggctagcggtacgtctaattgtagcctcgtgttttaccagtacctctccggcagcgaggcaggctgtttacagctgtttctacagaccctggggcctggagcccctagggccccagtgctgctcagaaggcgtaggggagaactgggtactgcatgggttcgggatagggtcgacatccagagcgcatatccattccagattcttctcgctgggcagaccggaccgggtggcgttgtgggactggatgatctgattctgtccgatcattgtcgacctgtgtcagaggtctcaacactgcagccacttcccccaggcccaagagcccctgcgcctcagcctctgcctcccagttcacgccttcaagactcttgtaaacaaggccacctggcttgcggcgacctgtgtgtccctcctgaacagctctgcgattttgaggagcaatgcgcagggggtgaagatgaacaagcatgtggaacaactgatttcgagagcccagaggccggtgggtgggaggatgcctccgtgggacgactacagtggagaagagtcagcgcccaggagagccaggggagctccgctgcagccgctggtgaggcccagggccacttcctgtccttgcaaagggcatggggacagttgggcgcagaagcacgcgttctgaccccattactcggacctagtggtccttcttgtgaactccatttagcctattaccttcagtcccagcctcgaggcttccttgccctggtcgtggtggacaacggctcacgggaattggcttggcaagccctgtcttcgagcgcgggaatctggaaagtcgacaaagttttactgggtgccagaagacgaccgtttagactggaattcgtcggccttgtcgaccttgatgggccagaccagcagggggcaggagtagataatgtcacactcagggactgcagcccaacagtgacaacagagagagatagagaggttagttgtaacttcgaaagggacacatgcagttggtatcccggacatttatcagatacacattggcgttgggtggaatccaggggtcccgatcatgaccacacgaccggacagggacacttcgtgctgctagatcccactgacccactggcctggggccacagtgcgcaccttctgagtcgccctcaggttcctgctgctccaactgaatgtctctcattctggtaccatcttcatggcccacagattggcactcttaggttggccatgaggagggaaggagaggagacgcatctctggtcgaggtcggggacccaggggaatcgctggcatgaggcttgggcaacacttagtcatcagccaggttcacacgctcaataccaactactttttgaaggtttgcgtgatgggtatcacggcacaatggcactagacgacgtcgcagtccgaccagggccttgctgggcaccaaattactgttccttcgaagatagcgattgcggattttcaccaggcggtcaggggctatggcggaggcaagccaatgctagtggccatgcagcatggggcccaccgaccgatcataccaccgaaaccgctcagggacactatatggtggtcgatacatctcctgacgccctaccaaggggccaaacagcttccctgacgtccaaggagcaccgcccactcgcccagccagcgtgtctcacattctggtaccacggcagcctccggtctcccggaaccctgcgcgtttaccttgaggagcgcggtcgtcaccaagttctgagtctgtcggcgcatgggggactggcgtggcgattgggcagcatggatgtccaggccgaacgcgcatggcgggtggttttcgaagcagtggcagccggtgtggcgcactcttatgttgcgcttgacgaccttctcctccaggacggcccttgcccacagcctggatcctgcgactttgaatctggcttatgcggctggagccacctcgcctggccgggtctgggaggatactcatgggactggggcggtggcgcaaccccctctcgatacccgcagccccctgtggatcacaccttggggaccgaggctggccacttcgctttcttcgaaacgggggtattgggcccaggaggccgtgctgcctggctgcgctcggaacccctcccagccactcccgctagctgccttcggttttggtaccacatgggatttcctgaacatttttacaaaggcgagctcaaggtgcttttacatagcgctcagggccagctggctgtgtggggcgctgggggtcatagacgtcatcaatggctcgaagcgcaggtggaggtcgcatctgcaaaggagttccaaatcgtttttgaggctacactcggtgggcagcccgctctgggaccaatcgctctggacgacgttgaatatttggcaggccagcactgtcagcagcccgcaccctccccaggaaacactgcagctccaggctcagttcctgcagtggtgggctctgctctgttgctccttatgctgttggtcctgcttggattagggggtagacgatggctgcaaaagaaggggtcgtgcccattccagtctaacactgaagccactgcgcctggattcgacaatatactgttcaacgccgatggcgtgaccctgccagcttccgtcactagtgacccatag

SEQ ID NO: 51626 - DNA, 3651 bp, Artificial Sequence
  Description of Artificial Sequence: Synthetic coding sequence
atgcctctgtcttcccatctcttaccagccctggtgctgttcttggccggttcaagcggctgggcttgggtacccaaccactgtcgtagcccaggacaggcagtgtgtaactttgtgtgcgactgtcgtgattgcagcgatgaagcccagtgtggttaccatggcgcatcacctaccttgggcgcaccttttgcatgtgactttgaacaggatccctgtggatggcgggatatctcaacttctggatactcatggctgagagaccgagccggtgccgctctcgagggccctggtccacatagtgaccacacacttggaactgacttaggctggtacatggccgtgggaacccacagaggaaaggaggcaagtacagccgctctgcggagtcccacactccgcgaagctgccagcagctgtaagttgcggctgtggtaccacgccgcatccggggatgtcgcagagctgcgtgtggagctaacccatggcgctgagacgctgaccctgtggcagagtacagggccatggggtcccggatggcaggagttggcagttaccacaggccgaattcgtggcgatttcagggtcaccttctctgccacccgcaatgccacccatcgtggtgccgtggcactggatgatctggaattttgggattgtggactccccacacctcaggccaactgtcccccagggcaccatcattgtcagaacaaggtgtgcgtggagccccaacagctgtgcgacggcgaagacaattgtggcgatctcagcgacgaaaaccccctgacatgtggcagacacattgccaccgacttcgaaacagggctgggcccttggaaccgctctgagggttggagcaggaatcatagggccggaggacctgagcgtccttcctggccaaggagagaccactctaggaattcggcacagggttcgtttctggtttcggttgccgagcctggcaccccggcaatcctttctagccccgaattccaggctagcgggacaagcaactgttctctcgttttctatcaatacctcagcggcagcgaggccggttgtctacaattgtttctgcagaccctgggccctggagctccgcgtgcaccagtgctgctgcgccgaaggaggggtgagctaggcactgcttgggtaagggacagagttgacatacagtctgcttaccccttccagatcctgctggccggacagacagggcctggaggcgttgtcggtctggatgatctgatcctgtcagatcattgtaggccagtctctgaggtatcaaccttacagcccctgcccccaggaccccgagctcccgctcctcagcccctgcccccatcctctcggttgcaagattcctgcaagcaaggtcatctcgcatgcggcgatctatgcgtccccccagaacaactatgtgacttcgaggagcaatgtgctggaggcgaggacgaacaggcctgcgggacgacagactttgagtctccagaagcaggaggctgggaggatgcctccgttggcagattgcagtggaggcgggtgtctgctcaggagagccaaggctctagcgcagcagcggctggccatttcctttctctccaaagagcttggggtcagctcggcgctgaggcccgagttctgactccactgctggggccaagcggcccatcatgtgagctacatctggcatattaccttcaatcacagccgaggggatttctggccctcgtggttgtggacaatgggtcaagggaactggcctggcaggctctgtcctccagcgcaggcatctggaaggtcgataaggtcctgcttggtgccagacgtcggccatttcgattggaatttgtggggttagtggatctggatggcccagatcagcagggagcgggtgtggacaacgtcacacttcgggactgttcccctacggtaaccactgaaagggaccgcgaagttagctgcaattttgagagagacacttgcagctggtatcccggacacctgagcgatactcactggaggtgggttgaatctaggggccctgatcacgaccacacaaccgggcaggggcactttgtactgcttgatcccactgatcccctggcgtggggtcatagcgcccaccttttgtcaaggccccaagttccagctgcgccaacagaatgcctaagcttctggtatcatttgcatggtccccagattggaacactccgtttggcaatgaggagagagggcgaggaaacacatctctggtcccggtcaggtacccagggcaaccggtggcatgaggcctgggccacgctgtcccaccagcctggttcccatgcacagtaccagctcctgtttgaagggcttagagacggctaccatggcaccatggccttggacgacgtcgccgtccgcccaggcccatgttgggcaccaaactattgcagtttcgaggactccgactgcggatttagccccggaggccagggcctgtggcgacgccaggcaaatgcaagcggccacgcggcatggggcccaccaactgatcacacgaccgaaactgcgcaggggcattatatggttgtagacactagtccagatgctctgcccaggggacagactgcctctctcacaagcaaagagcataggccactcgcccagccagcttgtctgacattctggtaccatgggtccctgaggtctcccggaaccctgagagtctacctcgaggaacgagggagacaccaggtgctgagcctgagtgcccacggaggccttgcatggagattgggctccatggacgtccaggcagaacgggcttggcgggttgtttttgaggccgtggccgctggtgtggcccactcctacgtggccctggatgacctgctgttacaggacggcccttgccctcagccagggtcctgcgatttcgagtccggtttgtgcgggtggagccacctggcctggcctggcctgggcggttattcctgggattggggaggcggtgcaacaccctctaggtatccgcagccaccagtcgaccataccttggggaccgaagctgggcatttcgccttctttgagaccggagttttgggtcccggaggcagagcagcctggcttagaagcgagccgctgccagctactcctgcttcttgcctcagattttggtaccacatggggttccccgagcatttctataaaggggagctaaaggtgttactgcactcagctcaaggacaactggcagtgtggggagccggaggccaccggaggcaccagtggctcgaagcacaggttgaggtggccagtgcaaaagaattccagatagtgtttgaagctaccctggggggtcagcccgctctggggcctattgcactggacgatgtggagtacctggccggacaacactgccagcaacctgcaccatctccaggaaatacggctgcccctggatcagtccccgctgtagtgggctccgcactcctactactgatgctgctcgttttgttaggtctggggggtagacgttggttgcagaagaaaggctcctgccccttccaatccaataccgaggcaactgccccagggtttgacaacatactgtttaacgcagatggagtgaccctgccagcctccgtgactagcgatccctag

SEQ ID NO: 51627 - DNA, 1353 bp, Artificial Sequence
  Description of Artificial Sequence: Synthetic coding sequence
atgatgcagttcgcctggcaaagctataagagatacgctatggggaagaacgagttacgcccactcaccaaggacggctacgaaggaaacatgttcgggggattaagcggtgctactgtaattgattctctggacacactctacttgatggaactcaaggaagaattccaagaggcaaaggcctgggtgggtgagagcttccacctcaacgtgtccggagaggctagtctgtttgaagtgaacattaggtatattggagggcttctgagcgccttctacttgacaggcgaagaggtctttcggattaaagccatccggctgggcgaaaaattgctccccgcattcaatacaccaacagggataccaaaaggcgtggtcagtttcaaatctggtaattgggggtgggccaccgctggatcttcttcaatccttgcggagtttggctccctacatctggagttccttcatctaaccgaactgtctggcaatcaagtctttgccgagaaggtaagaaacatccgcaaagtcctgcgaaaaatcgagaaaccttttggcttatatcccaattttctgtcaccggtgagcggcaactgggtgcagcaccatgtctctgtcggagggctcggggactccttctatgaatatcttattaagagctggctgatgtctggcaagactgacatggaagcaaaaaacatgtactacgaagccctggaagctatcgagacgtatctgctcaatgtctcaccaggtggattgacttacatcgcagaatggagaggaggaatcctggatcacaagatgggtcatctggcgtgcttcagtggtggcatgatcgccctaggcgcagaggatgccaaggaggaaaagagagctcattacagggaactcgccgctcagatcaccaagacatgccatgagagctacgcgaggagcgacaccaagcttggccctgaggccttttggttcaactcaggtagggaagccgtcgctacccagctctctgagagctactacattttgcgtccagaagtcgtcgagtcctatatgtacctgtggcggcagacccataatccaatctatcgcgaatggggctgggaggtcgttctagcactcgaaaagtattgcagaacagaggcgggattcagtggaattcaggacgtctatagctctacgcctaaccatgacaacaagcaacagtctttctttcttgctgagacattgaagtacctttatctgctcttttcagaggacgatttactgagcctggaagactgggtgtttaacaccgaagctcaccccttgcccgtgaaccatagtgattcttcaggaagagcgtgggggcgtcactag

SEQ ID NO: 51628 - DNA, 1206 bp, Artificial Sequence
  Description of Artificial Sequence: Synthetic coding sequence
atggagctgaaggaggagttccaggaggctaaagcatgggtcggggaaagcttccaccttaatgtatcaggtgaggcctcactctttgaggtcaacatacggtacattggcggactcctctctgcgttttatctcaccggtgaggaggtttttcgaatcaaggcaatccgcttgggagaaaaactgctgcctgcctttaacacacccacaggcatccccaaaggcgtcgttagcttcaagtcaggaaactggggctgggcgactgcgggaagttctagcatcctagctgagttcggttccctccacctggagtttctgcatctgacggaactctcaggcaatcaagtgtttgccgaaaaagttaggaacatcaggaaggtcctgcgaaagattgagaaaccgtttggactatatcctaattttctgtcacccgtgtccggcaattgggtccagcaccatgtaagcgtgggaggccttggggattcattttacgaatatctgattaagtcatggctgatgtcaggcaaaacagacatggaagcaaagaatatgtattacgaagccttggaggccatagaaacatacctactgaatgtcagcccaggcggactgacatatatcgccgagtggcgcggaggtatactggatcataagatgggtcacctggcctgcttctcaggaggtatgatagccctcggcgctgaggatgccaaagaggaaaagcgggctcactatcgagagctagccgcacagattacaaagacctgtcacgagagctacgcgagatcggacaccaagctgggtccggaggccttctggtttaacagcgggagggaagcagtcgccacccagctctcagaaagttactatatcttgcgaccagaagtcgtggaatcctacatgtatctttggagacaaacacacaacccaatctaccgcgagtggggctgggaagtggtgctagctttagagaaatactgtaggacggaggcaggcttcagcggaatccaagacgtgtactcctccactccgaaccacgacaataaacagcaatccttctttctggccgaaacactcaaatacctttacctgctgttctcggaggacgatctgctgagtcttgaggattgggtttttaacactgaggctcatcccctgcccgtaaaccattctgattctagtgggagggcctggggccgacactag

SEQ ID NO: 51629 - DNA, 1170 bp, Artificial Sequence
  Description of Artificial Sequence: Synthetic coding sequence
atgatgcaattcgcttggcagtcctataaaaggtacgccatgggtaagaacgagctacggccactgactaaggatggttacgagggcaatatgttcgggggtttgtcgggagctaccgtcatcgactctctcgacacactctacctcatggaactgaaggaggagtttcaagaagccaaggcctgggtgggagaaagtttccatttgaacgtgtctggagaagcctcattatttgaggtgaacattcgatatatcggagggttattgagtgccttctacctgacaggagaggaggtgttccgcatcaaggctatcagactgggcgaaaaactgttacccgctttcaacactccaaccggaattcccaagggtgtggtatcgtttaagagtgggaattggggatgggccactgcgggaagttcttcaatcctggccgagtttgggtctctgcacctcgagttcctgcaccttacagagctgtcaggaaatcaggtgttcgctgagaaagtgaggaacatccgcaaagttctcagaaagatagaaaagccctttggcctgtatcccaacttcctgtcccccgtgtccggcaattgggtgcaacaccacgtatcggtggggggtctcggagactctttctacgaatacttaattaagagttggcttatgtccggaaagaccgacatggaggccaagaacatgtactacgaggcccttgaagccatagagacgtacctgttaaatgtatcacccggaggactgacgtacattgccgaatggagaggtggcatccttgaccacaaaatgggacatctggcttgtttctctggaggcatgatagcccttggggcagaagacgccaaagaagaaaagcgagcgcactatcgagaactggccgcacaaatcaccaagacctgccacgagagctatgcaaggtccgatactaaattaggtcccgaagctttctggttcaattccgggcgagaggctgtggccacacagctatcagaatcttattacatcctgagacccgaggtggtcgagagttacatgtacctgtggaggcagacacataatcccatttaccgggaatggggctgggagggagctggattgggtgaaatcctgtccgataggtcacggttcctatgggaccctagaagagtgcagtag

SEQ ID NO: 51630 - DNA, 1893 bp, Artificial Sequence
  Description of Artificial Sequence: Synthetic coding sequence
atgctgatgagaaaagtccccggatttgttcccgcaagcccatggggacttcgcttgccccagaagtttttatttttgttgtttctttcggggttagtgacactgtgctttggtgcactgtttttgctcccccactcctcaagactgaagaggctgttcctggctcctaggacacagcagccgggactagaggtggtggcagaaatcgccggtcacgccccagccagggagcaggagccccctccgaatcctgcccctgccgcaccagccccaggggaggatgacccctcaagttgggctagccctagacggagaaagggaggactaagacgtacccgccctacagggcctcgtgaggaagccacagcagcgcgaggcaacagcatcccggcatctaggccaggggatgagggtgttcctttccgattcgacttcaacgcctttcggtcaaggctccgacatccagtgctgggtactagagctgatgaatcccaggaaccccagtcccaggtgcgtgctcagcgggagaaaatcaaggagatgatgcaattcgcctggcagtcttacaagcgctatgccatggggaagaatgagctgaggcctcttacaaaggatggttacgaaggtaatatgttcggtggccttagtggcgcaaccgtcatcgactccttggatacactgtacctgatggagctgaaagaagaattccaagaggccaaagcttgggtaggcgaatccttccatctgaatgtgagcggggaagcgtctctgttcgaggtcaatatccgctacatcggcggtcttttgtctgcgttttatctgacgggggaagaggttttcagaatcaaggccatcaggttaggagagaagctcttgccggcttttaatactcctaccggtattccgaaaggcgtggtgtcattcaagtcaggaaactgggggtgggctaccgccggaagctcctcaattctcgccgaatttggcagtctgcatctggagttcctacacctcactgaactgtccggaaatcaggtgttcgccgagaaagtcaggaatatccgcaaagtccttagaaagatcgaaaagccattcggattatatcctaacttcctgtccccggtctccggcaattgggtccagcatcatgtctctgtcggaggactcggggacagcttctacgagtacctcataaagtcatggctgatgtctgggaagacggacatggaggcgaagaacatgtactacgaggcccttgaagctattgagacttacctgctcaacgtttcaccaggcggtttaacgtacatagccgaatggcggggaggtattctcgaccacaaaatggggcacctcgcatgtttctccggaggaatgattgccctcggagccgaggatgctaaagaagagaagcgagcacattatagggaacttgccgcacagattactaaaacatgtcacgaaagttacgcccgaagtgataccaagttagggccagaggcattttggtttaattccggaagggaagcggtggccactcagctgagtgaaagctattacatactgcgccctgaggttgtggaaagttatatgtacctttggagacagacccacaacccaatctaccgcgagtggggatgggaggtggtcctggcattagaaaagtattgccgcaccgaagccggattttccggcatacaagatgtgtatagttccacacccaatcacgataacaagcagcagtccttctttcttgccgagacgctcaagtacctgtacctgctgttttctgaagatgaccttttatccttggaggattgggtatttaatactgaggcccacccactgccagtgaatcatagcgacagctctggccgtgcctggggcaggcattag

SEQ ID NO: 51631 - DNA, 258 bp, Artificial Sequence
  Description of Artificial Sequence: Synthetic coding sequence
atggcatccgatttagatttttcacctcctgaggtgccagaacctactttcctggagaaccttctaaggtatggcttgttcctcggagcaatttttcagctgatctgtgtcttggctatcatcgtcccgattcctaagagtcatgaggctgaggcagagccatcagaaccaaggtcagctgaagtgacacggaagcccaaggctgcagttcctagtgtcaacaagcggccaaaaaaggaaacaaagaaaaagcggtag

SEQ ID NO: 51632 - DNA, 258 bp, Artificial Sequence
  Description of Artificial Sequence: Synthetic coding sequence
atggcaagcgacctggatttctcgccccctgaagttccagaacctacttttctggaaaacctcttgcggtatggcctgtttcttggggcaattttccagcttatatgtgtgctcgccattattgtccctattcccaaatcccacgaagccgaagctgagccttctgagccccgtagtgccgaagtcacccggaaacctaaggctgcagtgccctctgtaaataagagacccaagaaggagactaaaaaaaagcgttag

SEQ ID NO: 51633 - DNA, 171 bp, Artificial Sequence
  Description of Artificial Sequence: Synthetic coding sequence
atggcgtccgacctcgatttctcaccacctgaggtgccagaacctacattcctcgagaacctgctccgatacggcctgttcttgggcgctatctttcaacttatttgtgtgctggcgatcatagttcctatacccaagtcccacgaggcagagtttcacgtcgaggcatag

SEQ ID NO: 51634 - DNA, 258 bp, Artificial Sequence
  Description of Artificial Sequence: Synthetic coding sequence
atggccagcgacctggacttcagcccaccagaggtgcccgagcccaccttcctagagaatttgctgcgctatggtctgttcttgggggctatattccagttaatttgcgttcttgccatcatagtaccaattcctaaatcacatgaagctgaggcagagcccagtgaacctcggagtgccgaggttactagaaaaccaaaagccgctgtgccctccgtcaacaagagaccaaaaaaggagacaaaaaaaaagcggtag

SEQ ID NO: 51635 - DNA, 258 bp, Artificial Sequence
  Description of Artificial Sequence: Synthetic coding sequence
atggccagcgatctcgactttagccctcccgaggtgcccgaacctaccttcttggagaatttactgagatacggcttgttcctaggcgctatatttcaactcatttgtgtgttagctatcattgtgccaatacccaagagccatgaagccgaggccgaaccgagtgaaccacggagcgccgaggtgactagaaaaccaaaggccgcagtgccgtctgttaacaagcgaccaaagaaggaaacgaagaaaaagaggtag

SEQ ID NO: 51636 - DNA, 258 bp, Artificial Sequence
  Description of Artificial Sequence: Synthetic coding sequence
atggcatccgacctcgatttcagccctccggaggtgcccgagccgactttcctcgaaaacctcctgagatacggactctttttaggggctatctttcagcttatatgcgtacttgccataattgtgccaatcccaaaatcacacgaggcagaagcagaaccatcagaaccccgttcagcggaggttacacgaaaacccaaagcagcagtccccagtgtaaataagcgtccgaaaaaagagaccaaaaaaaagcggtag

SEQ ID NO: 51637 - DNA, 708 bp, Artificial Sequence
  Description of Artificial Sequence: Synthetic coding sequence
atgatcactggatcccctcagatgacatggtgccccccattttggactccaccaataagtacggcatctaggtacggtagccatggggcattttaccgttataaaaactctatgggaaagtcactccctctgttctacatctacgatagctatttaactagccccgaggcatgggctcatctcctgacacctaacggaccacactccatccgtaacactccctatgatggagtgtttatcgccttactcgttgaggagggtcacacccacgatatcctggccgcagggtttgacggtatgtacacttatttcgcctcaaatggcttttcctttggcagttctcaccagaactggaaagctgtgaagaatttctgcgacgctaacaatctgatgtttattcccagtgttggacctggatatatcgatacctctattaggccgtggaataaccataatactagaaaccgcgtcaacggaaagtattatgaaacggcgctgcaggccgcacttacagtgaggcctgagatagtttccattacgtcctttaatgagtggcacgagggcacacagatagagaaggctattcctaagaaaactcccactcggttatacctcgactatctccctcaccagccatccctttatttggaacttacacgacgctgggccgaacatttcatcaaagaaaaagagcagtggctgatgtag

SEQ ID NO: 51638 - DNA, 1374 bp, Artificial Sequence
  Description of Artificial Sequence: Synthetic coding sequence
atggctaggcgcagacggagggcttgcatcgctttattccttgtcctcctgttcgccttcgggaccctgatgggattgcgtacacttaaggccccagacggtctccccgcactcggcccaggcctggaactggcacctttcgaacggagaccagagggcgcacctgcccctgcagccagagcccctgctgcccctgctgcgcctcctccccctccaccaccaccccgaacggcggatcccggtggaagcccaggccctgccccagccgaggcagaacctgccccagtgcagtcgctgagggtgtacagcgacctgcacgctttttattactcctggtatggatcaccacgtagggaaggacattatatccactgggaccacgtcatggtgcctcactgggatcccaagatcagcgcctcctatcctaggggcagacactctccaccagatgatctgggcagttccttctaccccgagttagggccatacagctcgagagacccagaggtcctcagagaacatatgacccaactgaaggaagccgcaattggggtgctggttctcagttggtatccacccggtatggctgacgacaacggcgagcctagcgacgatctcgtccctgctatcctagataccgcccaccagtatagcattcaggtggctttccacatccaaccttacaagggcagggacgatattacagtccatgataacattaaatacataattgacacttatggttcccacggcgctttttatagatacaagaatagtatggggaagtccctgcctctcttctacatctacgactcctacctgacatccccagaggcctgggcccacctgttgacaccaaacggacctcactcaatccgcaacacgccatatgatggagtattcatagctctgctcgtggaagagggtcacacccatgatatcctcgctgctggcttcgatggcatgtacacatactttgccagcaatgggttcagctttggatcatcacaccaaaattggaaggccgtgaaaaacttctgcgatgctaacaacttaatgttcatcccctcagttggccctggctacatcgacacatctatccgcccttggaataatcacaatacaaggaatcgagtgaacggaaaatactatgaaaccgccttacaagccgcattgacagttaggcccgagatcgtgtctataacctcctttaatgaatggcatgagggcacgcaaatagagaaagccatccccaagaaaacccccacgaggttgtatctggactacctgccccaccagccttcattatatctggagctgaccaggcgttgggcagagcacttcattaaggagaaagagcaatggctcatgtag

SEQ ID NO: 51639 - DNA, 753 bp, Artificial Sequence
  Description of Artificial Sequence: Synthetic coding sequence
atggcacggcgtcgccgacgcgcttgtattgcgttgttcttagtcctgctctttgcctttggtaccttgatgggcctgaggaccctgaaggcccctgacggcctgccggcactgggaccgggactcgaactggccccattcgaaagacgacccgagggtgcaccagcccctgcagctcgcgcacctgcagcgccagccgctccgcctccccctccacctccaccccgaacagccgacccagggggatccccaggacccgctcctgccgaggcggaaccagcgccagtgcaaagtcttagagtttatagcgacttgcatgccttttattactcttggtacggctcgccacgaagagaagggcactacattcactgggatcatgtaatggtacctcattgggacccaaaaatcagcgcctcctacccaagaggtcggcacagcccacctgacgacctcgggtcaagcttttatcctgagttggggccttacagttctagagacccagaggtgctgcgggagcacatgacgcagctcaaagaggccgctattggagtcttggtattgtcctggtatcctcccggtatggcagacgacaacggagagccgagtgacgatctagtcccagccattttagatactgctcatcaatactcaatacaagtggcgtttcatatccagccatacaagggcagagacgacattaccgtgcacgacaacataaagtacatcatcgataccaccggcaagctgtag

SEQ ID NO: 51640 - DNA, 1437 bp, Artificial Sequence
  Description of Artificial Sequence: Synthetic coding sequence
atgttcaagttccaccaaatgaaacacatcttcgagatactcgataaaatgcgctgtttgcgcaagagatcaacagtgagcttcttaggggtgttggtgatctttttgttgtttatgaatctgtatatcgaggatagttatgtattggaaggagacaaacaactgatccgcgagacgtctacgcaccagctgaacagtgagaggtacgtgcataccttcaaggatctatccaatttttcaggggcaatcaatgtgacctacagatatttggccgctacacctctgcagaggaagcgttacttgaccatcggtttgtcgtccgtgaagagaaagaaggggaactatctgctggaaaccatcaagtccatctttgagcagtcttcgtacgaagaactgaaagagatctcggtggtggtacacctggccgactttaactcttcttggagggacgcaatggtgcaggacattacacagaagtttgcacaccatatcatcgctggtcggctcatggttatccatgctcccgaagaatattacccgatcctggacgggctgaaaagaaattacaatgaccctgaggatagggttaagttccgctccaagcagaacgtcgactacgcttttcttctcaatttctgtgccaatacatctgactattacgtgatgctcgaggatgacgtgcgttgctcaaagaacttcctcaccgctatcaaaaaggtaatagcttcccttgagggaacctactgggtgacccttgagttttcaaagcttggctacatcggaaagctataccatagccatgacctgcccaggctcgctcacttccttttgatgttctaccaggagatgccctgcgactggcttcttacgcacttccggggactcttggcgcagaaaaatgttataagatttaaaccttctttgttccaacacatggggtactactccagttataaggggactgaaaataaacttaaagacgatgatttcgaagaagaaagttttgatattccggataatccaccggcttccctgtacaccaatatgaacgttttcgagaattatgaggcctcaaaggcatactccagtgtggacgagtacttctggggcaagcccccatccaccggagacgtgttcgtaattgtgtttgaaaaccctataatcataaagaagatcaaggtcaacaccggcactgaggatagacagaatgacatcttgcaccacggcgctctggatgtgggggaaaatgtcatgccgtctaaacagcgccgacagtgttccacctacctccgcttgggtgaatttaagaatgggaactttgagatgtcaggcgtgaatcagaagatcccttttgatattcactgcatgcgtatctacgtgactaagacccagaaagagtggttgattataaggtcgatttcgatatggacgtcctag

SEQ ID NO: 51641 - DNA, 1524 bp, Artificial Sequence
  Description of Artificial Sequence: Synthetic coding sequence
atgctcgggaaagatatggtcagattcgtggtacggaagactgtgcaacggtcggtggccaaggggagccgacgctgcaagaagcgaatgttcaagtttcaccaaatgaaacacatctttgagattctcgataagatgaggtgtttacggaagcgcagcaccgtgtcgttcctgggcgtgctggtcatcttcctgcttttcatgaatctctatatcgaggattcttacgttctcgagggcgacaagcagctcatccgcgaaactagtacccatcagctgaatagcgagcggtacgtgcatacctttaaagacctctcaaacttcagcggcgcaatcaatgtcacctatcgttacctcgcagctaccccgctccagcggaaaaggtatctcaccattggactttcctctgtcaaacgcaagaaaggaaactaccttctcgaaacaattaagtcaatttttgagcagtctagttatgaggaactgaaggagatctctgtggtggtccacctggccgatttcaacagctcttggcgagacgcaatggttcaagatattacacagaagttcgcacatcacataattgctggaaggctcatggtcatacacgcgccagaagaatattatcctatactggatggacttaagcgaaactacaacgacccagaagatcgagtgaagttccggagcaaacagaacgtggattacgctttcctcctcaacttctgcgcaaacacatctgattactacgtgatgttggaagatgatgttcgatgctcaaagaattttcttacggcaattaaaaaagtcattgcatccttggagggcacttactgggtgaccttggagtttagtaagttaggctacattggaaaactgtatcacagtcacgatttgcctcgattagctcacttcctccttatgttttatcaggaaatgccatgtgactggctgctgacccatttccggggactgctagcccagaagaatgtgattagattcaagcccagtctgtttcagcacatgggttattatagttcttacaaggggactgagaacaagctcaaagatgacgatttcgaggaagagagttttgacattcctgacaaccctcctgctagcctgtacactaacatgaacgtgtttgaaaattacgaagcatccaaagcatattcgtcagtagatgaatatttctgggggaagccccctagcacaggggacgttttcgtgatcgtgttcgaaaatcccattattattaaaaagatcaaagtcaatacaggaacagaggataggcaaaatgatatcctgcaccatggcgcactagatgtaggagagaacgtgatgcccagtaagcagcgcaggcagtgcagcacatacctccgactgggggaattcaagaatggcaatttcgagatgtccggcgtcaaccaaaaaatccccttcgacatccactgcatgcgtatctacgtgacaaagacacaaaaggagtggctgattatacggtctatcagtatctggacttcctag

SEQ ID NO: 51642 - DNA, 1197 bp, Artificial Sequence
  Description of Artificial Sequence: Synthetic coding sequence
atgtttaaattccaccaaatgaagcatatcttcgagatcctggacaaaatgaggtgtctgaggaaaaggtcaactgtgtcttttttaggggtcctggttatttttttgctgttcatgaatctgtacatcgaggattcttacgtactggagggggataaacaactcataagagagaccagtacccatcagttaaatagtgagaggtacgtccatacttttaaggacctgagcaatttttcgggcgcaattaacgtgacttatagatatctggccgctacgcctctgcaacggaagcggtatttaacgatcggcctttcatctgtgaaaaggaagaaaggcaattacctcctggagacaatcaagagcatcttcgagcaatcatcttacgaggagcttaaggagatctctgtagtggtacatttggccgatttcaactcgtcatggcgcgatgctatggtacaggacattactcagaagtttgcacaccacattattgccggtagattaatggtcatccacgcccctgaagagtactaccccatcctggatggacttaaacgcaattacaacgaccccgaagacagagtgaagtttagaagtaaacagaacgtcgactacgcgttcctgcttaatttctgcgccaatacctccgattactatgtgatgcttgaggatgatgtgcggtgtagtaaaaatttcctgacagcaatcaagaaggtgattgctagtcttgagggcacatactgggtcacacttgagtttagcaagctcggttatatcggaaagctctaccacagtcacgatctccccagactcgcacactttctcctcatgttctaccaggagatgccctgtgattggctgcttactcacttccgcggattactggcacaaaagaacgttatccggttcaagccatccctgtttcagcacatgggctactattccagctataaggggacggagaacaagttaaaagacgatgattttgaggaagagtccttcgacatccctgacaatcctccggcttcactctacaccaacatgaacgtgttcgaaaattacgaggccagcaaggcttacagcagtgtggatgaatacttctggggtaaaccgccttcgacaggtgacgtgtttgtgatagtgtttgagaaccccatcatcatcaagaagatcaaggtgaacaccgggacatag

SEQ ID NO: 51643 - DNA, 1437 bp, Artificial Sequence
  Description of Artificial Sequence: Synthetic coding sequence
atgttcaagttccaccagatgaagcatatattcgagatcttggataagatgagatgcctaaggaagcggtccactgtgagttttctgggcgtgctcgtgattttcctactattcatgaacctgtacatcgaggacagctacgtactcgaaggcgacaagcagctgatcagagaaacgtccacccatcagctgaacagcgagaggtacgtgcatacctttaaagacctatccaatttttccggggctattaatgtgacatatcgctatctggctgccacgccgcttcagcggaaaagatacttgactataggactctccagcgtgaaaagaaaaaagggcaactacctgctcgagacgatcaagtccatctttgaacagtcttcttatgaggagctgaaggaaatctccgttgtggtgcacttggctgatttcaatagcagctggagagatgctatggtgcaggatattacccagaagttcgctcaccacattatcgccggacgattgatggtgatccacgcgcctgaagagtattacccgatactcgatggactgaaaagaaattataacgatccggaagatagagtgaagttccggtccaaacagaatgttgactacgccttcctgttgaatttctgtgctaacacctctgattactacgtcatgctcgaggatgacgtgcggtgcagcaagaatttcctgacggccatcaaaaaagttattgcgagtcttgagggaacttattgggtgacacttgaattttctaaactgggctatatcggcaagctgtatcattcacacgacttgccaagactagctcacttccttctcatgttttatcaggagatgccttgtgattggctattaacccacttcaggggacttttggcgcaaaagaatgtgatccgattcaagcccagcctgtttcagcatatgggttattatagctcctacaaaggcactgagaataaactcaaagacgacgactttgaagaagaaagtttcgatatccccgacaatccaccagctagtctgtacactaatatgaatgtgttcgaaaattacgaggcgtcaaaagcttattcctctgtggacgagtatttctggggcaaacctcctagcacaggtgacgtgttcgtgatcgtcttcgagaacccaatcatcatcaaaaaaatcaaagtcaacaccggaactgaggacaggcagaacgacatcctccaccatggcgctctcgatgtgggggagaacgtcatgccatctaagcagcgtagacaatgtagcacttaccttaggctcggcgaattcaagaacggcaattttgaaatgagtggagtcaatcaaaaaatccccttcgacatacattgcatgcgaatttatgtaactaagacccagaaggagtggctgatcatcaggtccatatccatatggacgagctag

SEQ ID NO: 51644 - DNA, 1437 bp, Artificial Sequence
  Description of Artificial Sequence: Synthetic coding sequence
atgttcaagttccatcagatgaagcatatctttgagatactcgacaaaatgcgctgcctgcgcaaacgaagcactgtcagctttctcggggtactagttatcttcctgcttttcatgaatctatacattgaggactcatacgtgcttgagggagacaagcaattgattcgggagacatccactcaccaacttaattctgagcgatacgtgcataccttcaaagacctgagtaattttagtggtgctatcaacgtgacatatagatatcttgctgcgactcccttgcagcggaaacgatacctgaccatcggcctaagcagtgttaaaagaaagaaggggaattatctcctggagacgattaaaagtatcttcgaacagtcatcatatgaggaactcaaggaaatatctgtcgtagttcacctggcagattttaacagctcgtggcgggatgctatggtacaggacatcacccagaagtttgcccaccatatcatcgctggtcggctgatggttatccacgctcccgaggagtattatccaattctcgacggcctcaagcggaactacaacgaccccgaagatagggtcaaatttaggagcaaacagaacgtagattatgctttcctcctgaacttctgtgccaatacctcagattactacgtgatgctcgaagatgacgtgcggtgttccaagaactttcttactgcgatcaaaaaagtaattgcaagtctagagggcacctactgggtgacgctcgaatttagcaaactgggctatatcggcaagctctatcactcccacgacctgccaaggctcgcgcatttcctcctgatgttttaccaggaaatgccttgtgattggctcctaacccactttaggggccttttagcgcaaaaaaatgtaattcggttcaaaccaagcctcttccagcatatggggtactactcttcttacaagggcaccgaaaataagctcaaggatgacgatttcgaggaagaaagcttcgatattccggataatcctccagcctccctctacactaatatgaacgtgttcgagaattacgaggcctccaaagcctactcgtccgttgacgaatacttttggggcaagcctccttccaccggcgatgtatttgttatcgtctttgaaaaccccataattatcaagaaaattaaggtgaacaccgggacggaggatagacagaacgatatcctgcaccacggcgctttagatgtgggcgaaaatgtcatgccatccaagcagaggaggcagtgcagcacgtatctgaggctgggggaatttaagaatggaaattttgagatgtccggcgtgaatcagaaaatcccctttgacatacactgcatgagaatttatgtcaccaagacacaaaaagagtggctcattattagatctatctcgatatggacgagttag

SEQ ID NO: 51645 - DNA, 1437 bp, Artificial Sequence
  Description of Artificial Sequence: Synthetic coding sequence
atgtttaagtttcatcaaatgaagcacatttttgagattcttgataaaatgcgatgtcttcgcaaaaggtctaccgtttccttcctaggggtgttagtgattttcctactgttcatgaatttatatatagaggactcatacgtccttgagggcgacaagcagctaattcgtgagacctctacacatcaactgaacagcgaaagatatgtgcacacctttaaagacttatctaacttttctggcgctatcaatgtcacttacaggtacctggcggctacacctctgcagagaaagcggtacctgacgatagggctgtcgtctgtgaagagaaaaaagggcaactacctgctggaaacaattaagtctatcttcgagcagtctagctatgaggaactgaaagagatctcggtagtagtacaccttgctgacttcaattctagctggcgggacgctatggtacaagatattactcaaaagtttgctcatcacatcatcgcagggagactcatggtgatccacgcccctgaggagtattaccccatactggatggactgaagcgaaactacaatgatccggaggatagggtaaagtttcggtctaaacagaatgtcgattatgctttcttgctcaacttctgtgcaaacacctcagactattacgtgatgctggaagatgatgtgaggtgcagcaagaattttctgactgccatcaagaaagtgatagcaagtctggaaggaacctattgggtgaccctggagttctcaaagctgggctacatcggtaaactataccattcacatgatctgcctcgactcgcccatttcctccttatgttttaccaggaaatgccctgtgattggcttttgacccacttcaggggactcctcgctcagaagaacgtgatacgctttaagccatcactattccagcacatgggctactattcttcttacaaaggcacagagaataaactgaaagatgatgatttcgaagaggagagctttgatatcccagataacccaccggcatctctgtacacaaacatgaatgtgtttgaaaattacgaggcctccaaggcctattcttctgtcgacgagtacttctggggcaaacctccatccacgggcgacgtcttcgtaatcgtgtttgagaaccctattataattaagaagatcaaagtgaacactggcactgaggatcgacagaatgatattctccaccacggcgcattggacgtcggcgaaaacgtgatgccctctaagcagagacgccagtgctcaacctacctgcgcctcggggagtttaagaacggcaacttcgagatgtcaggggtaaatcagaagatacccttcgacattcactgcatgcgcatttacgtcaccaagacacagaaggaatggctgatcatcaggtctatttcaatctggacatcttag

SEQ ID NO: 51646 - DNA, 1437 bp, Artificial Sequence
  Description of Artificial Sequence: Synthetic coding sequence
atgtttaaatttcaccagatgaagcacatcttcgaaatcctggacaaaatgcgctgcttgcgaaaacgctctactgtgagctttcttggggtcctcgtcatctttcttctcttcatgaacctttatatagaggatagctatgttctggaaggtgacaagcaacttattagggagacaagtacccaccagttgaactctgagagatatgtgcacacatttaaggaccttagcaatttctctggtgctattaacgtgacctacagatatctggccgcaaccccactgcagaggaaacgttatctcaccatagggctctccagcgtgaaacggaagaaggggaactatctcctagaaaccatcaagagcatttttgagcagtcaagctatgaggagctcaaggaaattagtgttgttgtccatctggcggacttcaacagctcctggcgtgatgccatggtgcaagacattactcagaagtttgcacaccacatcatcgcaggacggctgatggtcatccacgctcctgaggaatactatcccattctggacggactaaagaggaactataacgatccggaggaccgcgtaaagttcaggtcaaagcagaacgtcgattacgctttcctgctcaacttctgcgcgaacacgagtgactactacgttatgctcgaagatgatgtgcgatgctctaaaaactttctaactgctatcaaaaaggtaatcgcctccctcgagggcacgtattgggttacactcgaattctcaaaattgggctacatcggtaaactgtatcacagccacgatctaccacggcttgcacattttctgctcatgttttatcaggagatgccgtgcgattggttgctaacccacttcaggggtctgcttgcacaaaagaacgtgattcggttcaaaccaagcctattccagcacatgggctactatagctcctacaagggtacggagaacaaactaaaggatgatgattttgaggaggaatctttcgacatcccggacaatccgcctgctagcctgtatacaaacatgaacgtgtttgagaattatgaagcctcgaaagcatactcttctgtggacgaatatttctggggcaagccacccagcactggggatgtctttgtcatagtgtttgaaaacccaatcatcattaagaagattaaggtaaacaccggaaccgaagaccggcagaatgatattcttcaccacggagccctcgatgtcggagagaacgttatgcctagtaaacagaggcgccagtgttcaacataccttagattgggcgaatttaagaatgggaacttcgagatgagtggtgtcaaccagaagattccctttgatatccactgtatgcgcatatatgttaccaaaacacagaaggaatggctcatcattcgatcaatatctatatggacgagctag

SEQ ID NO: 51647 - DNA, 810 bp, Artificial Sequence
  Description of Artificial Sequence: Synthetic coding sequence
atggcccgagcttcctctggtaatggctccgaagaggcctggggcgcactccgagcaccccagcagcaactacgggagctttgtccgggagttaacaatcaaccttacctttgcgagagcggtcactgttgtggagagacgggatgttgtacatattattacgagctttggtggttttggcttttatggactgtcctgattttgttctcttgctgttgtgcttttcgacacagaagagccaaattgcggctgcagcagcaacagaggcagcgcgagattaacctcctggcctatcacggagcgtgccacggtgctggcccatttcctactggaagcctgctggacctgcgtttcctgagcacgtttaagcctcctgcctatgaagacgtcgtgcaccggccaggaacacctccgccaccatacacagtcgcccctggcagacctctgaccgcctcgagtgagcagacatgttgttcttcctcttcatcgtgccctgcccatttcgaaggcactaacgttgagggggtttcttctcatcagagtgccccaccccaccaggaaggcgagcctggagccggtgttacacccgcttccacaccgccatcttgtcggtacagaaggcttacgggcgattccggcattgagctgtgcccttgcccagcgtccggagaaggtgagcctgtgaaggaagtcagggtttccgccaccctccccgatttggaggattactctccctgcgcactcccccctgagagtgtaccacagattttccccatgggactgagtagctccgagggagatattccatag

SEQ ID NO: 51648 - DNA, 2196 bp, Artificial Sequence
  Description of Artificial Sequence: Synthetic coding sequence
atgaaaactcgcagtcccaagccactcctgaccggcctgatgtgggcccaacagggtaccaccccagggacaccaaagctgcgccatacatgcgaacagggcgacggcgttgggccttatggctgggaattccacgacgggctgtctttcgggaggcaacacatccaggacggcgctcttcgactcaccaccgaatttgttaaacggccaggcggacaacacgggggagactggagttggcgcgtgaccgttgaaccccaagattccggaacgtccgcattgcccctcgtttctctgtttttctatgtcgtgactgatggcaaagaagtgctgctgccggaggtaggggcaaagggccagttaaaatttatcagtggacacaccagcgaactcggtgattttagattcaccttgctgccccctactagccctggggacacagcacccaagtacggcagctacaatgtgttttggacgagtaatcccggattaccattgctgaccgagatggtcaaatcaaggctgaatagttggtttcagcacagaccaccgggagctcctcccgaacgttatcttgggctgcctggatcactcaaatgggaggatcgcggaccctcaggccagggtcagggtcaatttctaattcagcaggtgacacttaagatcccgatctcaatcgagttcgttttcgagtcgggatctgcacaggcgggaggcaatcaagccctgccacgcctcgccggtagtcttctgacccaagcactcgagagtcacgcagagggttttcgcgagcgatttgagaagaccttccagctgaaagagaaggggttgagttcaggcgagcaggtgctgggtcaggccgctctatcaggactacttggcggaatcggatatttctacggtcagggcctggtgttaccggacattggcgtcgaagggtccgaacagaaggtggaccccgcactgtttcccccagtgcctctctttacagctgttccgagcagatctttcttccccagggggttcctgtgggatgagggatttcatcaattggtggtgcagcgctgggaccccagccttacccgggaggcactgggacactggctgggccttctcaatgctgacgggtggataggaagagagcagatcctgggcgatgaggcacgggctcgcgttccgcctgagtttctggttcagcgcgcagtccatgccaatccgcctactctgctccttcccgtggcccacatgctcgaagtgggtgacccggatgatctggctttcctgcgcaaggctctgcccagattgcacgcttggttcagttggttgcatcagtcccaagctgggcctctaccgctgagctatcgctggcgagggcgtgaccctgcattgccgacgctactaaaccccaaaaccctgcctagtggactcgacgattatcctcgcgcatcacacccctccgtcacagaaagacacctcgatctgagatgttgggtagctttgggagcgcgtgtgcttacgagactcgctgagcacctgggcgaagccgaggtggcagctgaacttggcccactcgctgcgtctctggaagccgcagaaagcctggacgagttgcactgggctcctgagctgggggtgttcgccgacttcggaaaccatacaaaggctgtgcagctaaaaccgagacctccgcaggggctggtccgggtcgtaggtagaccacagccccaactccaatatgtggatgccctgggctatgttagtttgtttcctctcctcttgcgcttgcttgacccaacttccagccggcttggaccactgctggatatcttggcagactcacgccatttgtggtctcctttcggcttgcgctccctggcagccagctcaagcttttacggccagcggaactctgaacacgaccccccatactggcgcggagccgtgtggctgaacgtaaactaccttgcccttggtgctctgcatcattacggtcacctagagggaccccatcaagccagagccgctaagcttcacggagaactgcgagcgaacgtcgtgggcaatgtgtggagacagtaccaagctacaggcttcctctgggagcagtacagcgacagggatggcagaggaatgggttgtaggcccttccacgggtggaccagccttgtcctgttggcaatggccgaggattattag

SEQ ID NO: 51649 - DNA, 480 bp, Artificial Sequence
  Description of Artificial Sequence: Synthetic coding sequence
atggcccgaggcgagcgaaggcgacgcgctgtgcctgccgaaggggtgagaactgcagagagagcggctcgcggaggccctgggaggcgcgacggaaggggaggtgggcctcgatcaacggccggtggggttgcgttagccgttgtcgtgcttagtcttgctctgggcatgagcggcagatgggtcctcgcctggtatcgggcacgacgcgcagtgactctgcatagcgccccaccagtcttgcccgcagatagcagttcacctgccgtggctcctgaccttttttggggaacttaccgaccccacgtatacttcgggatgaaaaccaggtcgccaaagcccttgctaaccggactgagatacttctgccctcccttcgggctgccagttctcctttgcggggatcggtggcagggcagccctaccacccgaggctggggccagggcgctgtggaggtctatcagtgggcccaccagtag

SEQ ID NO: 51650 - DNA, 1296 bp, Artificial Sequence
  Description of Artificial Sequence: Synthetic coding sequence
atgttctttggcggagaggggtcattgacgtatacgcttgtgatcatctgtttcttgacactgaggctcagtgccagtcagaactgtctgaaaaaatcacttgaagacgtggtcattgacatccagagttctctgagtaaaggtattcgaggcaacgaacccgtgtataccagcacccaggaagactgtatcaattcgtgttgttccactaagaacatctccggggataaagcctgtaacttgatgatattcgatacccgcaagactgcacgacaacccaattgttacctgtttttttgccctaatgaggaggcatgtcccctgaagccagccaaaggcctgatgtcctatcgaatcatcacagacttcccttcgctcacccggaatttgccatcccaggaactgcctcaagaagactcgctgttgcatggccaattcagtcaggccgtaacccctctggctcaccaccacaccgactactcaaaaccgacggatatttcttggagggacacactgtcacagaaattcggatccagtgaccaccttgagaaactcttcaagatggatgaggcaagcgctcagctactggcttacaaggaaaagggccactcccagagcagccagttttcaagcgaccaggagatcgcgcatctcttgcctgaaaacgtttcagcgttaccggcaacagtggcagtggccagcccacataccacatctgctacccctaagccagctacacttctgcccacaaatgctagcgtgaccccttctggaacttcccagcctcagttggcaacaacagcacccccagttaccaccgtgacctctcagcctccgacaaccctcatttccaccgtgttcactcgggcagcagctaccctgcaagcaatggccacgaccgcggtactaacaacgacattccaagctcccacggatagcaaaggcagcctggaaaccatcccgttcacagagataagcaatctgacactcaatactggcaacgtgtataatccgaccgcgttgtctatgagcaatgtagagtcgagcactatgaataagactgctagctgggaaggacgtgaagcgtctccagggtcatctagccagggcagcgtgcccgagaaccagtatggtctacccttcgagaagtggctgcttattgggtcactcttgtttggcgtcctctttctggtcattgggctcgtgcttttgggcaggatcctctctgagtctttgaggcgcaagcgttactcccggttggattacctgatcaatggcatctacgtcgacatttag

SEQ ID NO: 51651 - DNA, 174 bp, Artificial Sequence
  Description of Artificial Sequence: Synthetic coding sequence
atgtttttcgggggtgaaggaagtctcacatacacattggtgatcatttgctttcttaccttgcgcctctcagcctcacaaaattgcctcaagaagagtctagaggatgtggtgattgacattcagagttctctgtcaaagggtattagaggtaacgaacctgtctatacgtag

SEQ ID NO: 51652 - DNA, 615 bp, Artificial Sequence
  Description of Artificial Sequence: Synthetic coding sequence
atggaggcaccagccgagctcctggccgcactgcctgctctggcaaccgcactggctctgcttctagcatggcttttagttcggcgaggcgctgcagcatctccagagccggcaagagcccctccagagcctgcaccacctgcagaggccacaggggctccagctcctagccgcccatgtgccccagagcctgcagcatcacccgctggcccagaggaaccaggagagcccgcaggattgggagaactcggcgagccagccggtcctggagagcctgagggtccgggtgatccagctgctgcccctgccgaggctgaagagcaggcagtcgaggcacgacaagaggaggagcaggatctggatggcgaaaagggtcccagctctgagggaccagaggaagaggacggggagggattcagtttcaaatatagtccaggaaagttgcggggtaatcagtacaagaagatgatgacaaaagaggagctggaagaagagcaacgagtgcagaaggaacagctggcagctatattcaaactcatgaaggacaacaaagagacattcggagagatgtcagacggggacgtacaggaacagctgagactctatgacatgtag

SEQ ID NO: 51653 - DNA, 534 bp, Artificial Sequence
  Description of Artificial Sequence: Synthetic coding sequence
atggaggctccagctgaactacttgcagctctccccgcattagcgaccgccctcgcactgttgctcgcatggttgttggttcgcaggggcgctgcagcatcacctgagcccgcacgggctccacctgaaccagcgccacctgcagaggcaactggagccccagcgccatccaggccttgcgcccctgagcccgctgctagtcccgcaggaccggaagagccaggcgagccagccggactgggcgagcttggagagccagctggccctggagaaccagagggccctggagatccagctgctgccccagctgaggccgaggaacaggcggtggaagccagacaggaagaagagcaagacctcgatggcgaaaaagggccatcctctgaaggtcccgaggaagaggacggtgaagggttctcattcaaatattcaccgggaaagcttcgcggtaatcagtacaagaagatgatgactaaagaggagttagaggaggaacagcgaattgaacttacctctgaccttaccagcctctag

SEQ ID NO: 51654 - DNA, 513 bp, Artificial Sequence
  Description of Artificial Sequence: Synthetic coding sequence
atggaagcaccggctgaactgcttgccgcactgccagccttggctacagcgctggcactgctgcttgcatggttgcttgtgcgccgaggcgcagcagctagtcctgagcctgcgagggcccctcctgaacccgctcctcccgcagaagctacaggtgctccagctccttccagaccatgcgccccagagccagcagcatcgcctgcaggacctgaggaaccaggggagccagccggtctcggcgagctcggtgagccagccggaccaggcgagccagagggaccaggcgatcctgcggctgccccagctgaagcggaagaacaagccgtcgaagcgcgacaggaggaggagcaggaccttgacggagagaagggcccttcatcagaagggcctgaagaggaagatggagagggattttccttcaagtatagcccaggcaaactgaggggtaaccagtataagaaaatgatgaccaaagaagagcttgaggaagagcagcggactcagcggtag

SEQ ID NO: 51655 - DNA, 513 bp, Artificial Sequence
  Description of Artificial Sequence: Synthetic coding sequence
atggaagctcctgccgaattactcgcagcattgcctgccctcgctactgcgttagccctccttctggcctggctcctcgtcaggcggggtgcagcagcgtcgccagagcccgcaagagccccacccgaaccagccccaccagctgaagccacgggcgctcccgcaccatctaggccatgtgcgccagaacccgctgccagcccagccggtcctgaggaacccggagagccagccggactaggcgaactcggtgaacctgctgggccaggagaacccgaaggccctggcgacccggcagctgcccctgctgaggccgaagagcaagcggtcgaagcgcgtcaggaagaggagcaggatcttgacggggagaagggaccgtccagcgaaggacccgaggaggaggatggcgaaggtttttctttcaaatacagcccaggtaaactccgcggtaaccagtataaaaaaatgatgactaaggaggagctcgaagaggaacaacgaaccgaagagtag

SEQ ID NO: 51656 - DNA, 1329 bp, Artificial Sequence
  Description of Artificial Sequence: Synthetic coding sequence
atggcgttgccatccaggattctgctgtggaagttggtcctgcttcagagctccgcagtgcttctccatagcggcagctcagtgcctgcggctgctgggagttcagtggtgtccgaaagtgccgtatcttgggaagcgggagcgagggctgtcctcaggtgccagagtcccaggatggtttggacccaggatcgcctgcatgaccgccagcgggtcttgcattgggacttgaggggtccaggtggcggtccggctcgtcgccttcttgatctgtattcagccggagagcagcgggtatacgaggcaagggaccggggtcgcttggagctctccgccagcgccttcgacgacggaaatttttctctgttgattagagcagttgaggaaaccgatgcagggctctatacgtgcaacctgcatcatcactattgtcatctctacgaaagcctcgctgtacgcctggaggtgaccgacggccctcctgcgacccctgcttattgggatggagagaaggaagtgctggcggtggctcggggagcgccagcactgctgacatgtgtgaatcgtgggcatgtgtggaccgacagacacgtggaagaggctcaacaagtcgtgcattgggatagacaacctcccggtgtcccccatgacagggccgatcggcttttagatctgtacgcttccggagaaagaagggcctatgggcctttattcttgagggacagagttgccgtaggagctgacgctttcgaacgcggagacttttcgcttcggattgagccccttgaggtcgcggatgaaggaacatactcctgtcacctgcatcaccactattgcggactacacgagagaagggtgtttcacctgacagttgccgaaccccacgcggagccacccccaagaggcagtcccggtaatgggtcttcacattctggggcacctggccctgacccaacactcgccaggggacataacgtcataaacgtgattgtccctgagtctagagcacacttttttcagcagctcggatatgtccttgctacattactgctgtttatactgctgctggttaccgtcttactggccgctcgacgacggagagggggatacgaatactcagaccagaagagcggcaagagcaagggaaaagatgtaaatctagccgaattcgccgtggccgcaggggatcagatgctgtaccgatcagaagacatacagctggactacaaaaacaatatccttaaagagagggcagagctggcccattcaccgctacccgctaaatatatcgacttagacaaaggctttagaaaggagaattgtaaatag

SEQ ID NO: 51657 - DNA, 1026 bp, Artificial Sequence
  Description of Artificial Sequence: Synthetic coding sequence
atggccttgccgtctcgtatattactatggaaattggtccttctgcaaagctcagccgtcctcctgcacagtgctgtagaagagacagatgctggcctttacacttgtaacctgcaccaccattactgccacctgtacgagtctcttgccgtgcggctcgaggttacagatggccctcccgctaccccagcttattgggacggcgagaaggaggtgctggccgtcgcgaggggggcacccgcattgttaacctgcgttaatagaggtcatgtatggaccgacagacacgtggaagaggctcaacaggttgtgcactgggatcgacagccacccggtgttccacatgatcgggctgatagactcctcgacctctacgcgtcgggcgagaggcgcgcatatgggccactctttctgcgggatagagttgccgttggagcggacgccttcgagcggggagatttctctctgcgaatagagcccctcgaggtggcggatgagggaacctacagttgtcatctgcaccaccattactgcgggctccacgagaggagggtcttccatctaactgtcgcagaacctcacgccgaaccaccaccaagagggtcccccggtaatggctcttcccactcaggcgctccagggccagatccgaccctcgcacgcggacataatgtaataaatgtgattgtgccagagtcgcgggcacacttcttccaacaactgggctatgtgctggccacgctgttgctgttcatcctgttgctggtcaccgttctattggccgcaaggcggaggcggggaggctatgaatacagtgaccagaaatcagggaagtcaaagggtaaagacgtcaatttggcagaattcgctgtggccgctggtgatcaaatgttatacagaagtgaagatatccagctcgattataaaaataacatcctaaaggaaagagccgagctagcacacagtcccctgcctgcaaagtacattgacctggacaagggatttcggaaagagaattgcaagtag

SEQ ID NO: 51658 - DNA, 1302 bp, Artificial Sequence
  Description of Artificial Sequence: Synthetic coding sequence
atgatcaggtgtgccgcaaccggctctgctgtgctgttacatagcggctccagtgtccccgctgccgcagggagctcggtcgtctcggaatctgccgttagctgggaggcaggggctagagcggtacttcgctgtcagtctccgaggatggtttggacccaggatcgtctccatgataggcagagagtgctgcactgggatttgcgcggtccgggtggcggacccgctcgcaggttgctggacctgtacagcgccggagagcagcgagtttacgaggccagggaccggggacgactcgaactttcagcctctgccttcgacgacggaaatttctccctgctcattagggccgttgaggagaccgacgccggattgtacacatgcaatttgcaccatcattattgccatctgtatgagtccctcgccgtcagactagaagttacagatggcccaccagccacccctgcgtattgggatggggagaaggaggtgctggcagttgcaagaggggctcccgcactcctgacatgtgtgaatagggggcatgtgtggaccgatagacatgttgaagaagcacagcaggtcgtgcactgggacagacagccacctggcgttccacacgatagagccgacagacttctggatctgtacgccagtggggagcgtagggcctacggtccactgtttctacgcgatcgcgtagccgttggcgctgacgcatttgagcgcggtgacttttctctaagaatcgagcctttggaagtggccgacgaggggacctatagctgtcatctgcatcatcattattgtggactccacgagcgacgggtgtttcacctgactgtggctgaaccgcacgctgagccgccaccccgtggcagcccaggcaatggatccagccactctggtgcgcctgggccagacccaaccctcgcacggggacacaatgtcatcaacgtgattgtgccagagtctcgtgctcatttttttcagcagctaggctatgtgctggccacactgctgctctttattcttctcctggttaccgtgctactcgctgccagacggcgaaggggcggttatgaatactcagaccagaagtctggtaaatccaaggggaaagacgttaacctcgcagaatttgccgtggctgctggggatcagatgctgtatcgatccgaggatatacaattagactataaaaataacattctcaaagaaagagccgaactggcccattccccgctacccgcaaagtacatcgatctggacaagggctttagaaaggagaactgtaaatag

SEQ ID NO: 51659 - DNA, 1353 bp, Artificial Sequence
  Description of Artificial Sequence: Synthetic coding sequence
atggccctccccagcagaatcctcctgtggaaactggtgctcttacagagcagcgcagtcctgctacacagcggtagcagcgtgccagctgctgcgggaagctctgtcgtgagtgaatcagccgtatcctgggaggccggtgcaagggcagtgctgcgctgccagtctccgaggatggtctggacccaggaccggctgcacgacagacagcgagtcctgcattgggaccttcgcggaccaggaggaggtccagccaggagactgctggacttatacagcgcgggagagcagagggtgtatgaggcacgcgaccgaggacgcctggaacttagcgcttcagcctttgacgacggcaactttagtctgctcattcgggcagttgaagagaccgacgctggactctacacctgcaatctccaccatcactactgccacttatacgagtcgctggccgtaagactggaggtcaccgatgggcctcccgcaactcctgcctattgggacggggagaaagaggtactggccgtcgctaggggcgcacctgctctcctgacttgtgtcaatagagggcacgtgtggacagatagacatgtcgaggaggctcagcaagtggtccactgggatcgccagcctccgggtgtccctcatgatcgagccgaccggctgctggacctgtatgcttccggagagcgtcgcgcttacggccctctattcctccgggatcgagtagccgttggcgcagatgcgtttgagaggggagacttctccttgaggatcgagcccttggaagtggccgatgaagggacatatagctgccatctccatcaccactactgcggcctacacgagagaagagtgttccacttgaccgtcgccgaaccacatgcggaaccccctccacgagggagtccgggaaatggaagcagtcactcgggcgcaccagggcctgacccaacactcgctcgcggacacaatgttattaatgttatcgtgcccgagagtcgcgcacacttctttcaacagctggggtatgtgctggctaccttactgttatttatccttctcttggtgaccgttctactggccgcacgaaggcggaggggtggctacgagtattcggatcagaagagcgggaagtccaaaggaaaggatgttaacctggctgagttcgcagtggccgctggagatcagatgctgtataggagcgaggacatccaactcgcaagttctccgcctacggactacaagaacaacatcctgaaagagagggccgaactcgcacactcaccactgcctgccaaatatatcgacctggataaggatcctagcggcctctgtccgctgggagcatag

SEQ ID NO: 51660 - DNA, 207 bp, Artificial Sequence
  Description of Artificial Sequence: Synthetic coding sequence
atgccccagaaagacccttgtcagaaacaggcttgtgagattcagaaatgtctccaggccaactcatacatggaatcaaagtgtcaggcagtcattcaagagctgcgcaaatgttgcgcacagtacccaaaaggacgcagcgtggtttgttcaggatttgagaaagaagaggaggaaaacttaacaagaaaatccgcatccaagtag

SEQ ID NO: 51661 - DNA, 207 bp, Artificial Sequence
  Description of Artificial Sequence: Synthetic coding sequence
atgccgcagaaggacccctgtcaaaagcaggcatgcgagatccagaagtgtctgcaggcgaattcatacatggagagcaagtgccaggccgtgattcaagagctgcgtaaatgctgtgcccagtacccaaaaggccgatcagtcgtctgctcagggttcgagaaagaggaggaagaaaacctgacgcggaaatccgcctccaagtag

SEQ ID NO: 51662 - DNA, 618 bp, Artificial Sequence
  Description of Artificial Sequence: Synthetic coding sequence
atgagcgcccagcggctgatctcaaacaggacgagccaacagagtgcaagtaactccgactatacatgggaatacgagtactatgaaattggccctgtgtctttcgagggcttgaaggcacacaaatattctatcgttatcggtttttgggttggccttgccgtgttcgttatcttcatgttcttcgtcctcactttgctgactaagactggagcacctcatcaggacaacgctgagagcagcgagaagagatttcgcatgaatagcttcgtgtctgacttcggccgaccgttagagccggataaagtgttttccagacagggaaatgaggagtctcgttcattgtttcattgttacatcaacgaagtcgaaaggttagacagggccaaggcttgtcatcaaaccactgcccttgactcggatgtccagttgcaggaagccatccgctcctcaggtcagcctgaggaggaactgaataggttgatgaagtttgatatccccaacttcgtgaatactgatcagaattacttcggtgaagacgatctgctcattagcgaaccacctatagtgttggaaactaagcccctgtcgcaaacatcccataaggacctggattag

SEQ ID NO: 51663 - DNA, 930 bp, Artificial Sequence
  Description of Artificial Sequence: Synthetic coding sequence
atgtcccttgagcagcgttcgttgcattgcaaaccagaggaggctcttgaggcccaacaggaagcgttaggactagtgtgtgtacaggccgcaaccagcagctcgtctcctcttgtgttgggtactttggaggaagtgcctacagctggttctacagaccccccacagagcccacagggcgctagtgccttccctaccacaatcaactttacacgccagagacagcccagtgagggatcttcttcccgagaagaggagggcccttccacctcttgtattcttgagtcgttgtttcgggctgtcatcacaaaaaaagtcgcagatcttgtgggattcctgttgttaaaatacagggcccgtgagcccgtgacgaaggcagaaatgttggaaagcgtcataaaaaattacaagcactgtttcccggaaatatttggcaaggcatcggagtccctgcagctggtgttcggcattgatgtaaaggaggccgatcccacaggacattcatatgtgctagtgacctgcctcggactttcttacgacggacttcttggtgacaaccagattatgcctaagaccggattcctaatcatcgtcctggtgatgatcgctatggaaggcggtcacgcaccagaggaggagatctgggaggagctgagcgtaatggaagtgtatgacggccgagagcactcagcctatggtgaaccaaggaagctgctgacccaagatctcgtccaggagaagtatctggagtatcgccaagtccctgattcagacccagcacgctacgagtttttgtgggggccacgggctttggccgagacgtcctacgtgaaggttctggaatatgtgataaaggtgagtgctcgggttcgattctttttcccttcacttcgtgaagctgccctccgggaagaagaagaaggggtctag

SEQ ID NO: 51664 - DNA, 4368 bp, Artificial Sequence
  Description of Artificial Sequence: Synthetic coding sequence
atgtccaagtccttgaaaaagaaatcgcactggaccagtaaagttcacgaaagcgtgattggcaggaatcccgaaggccagctcggtttcgaattgaaagggggtgcggaaaatggtcagtttccatacttaggtgaggtaaagcctgggaaagtggcctacgagtccggcagcaaactcgtgagtgaggagttgcttctggaagtgaacgagacccccgtggccggactgacgattcgagatgtgctcgccgtgataaagcattgtaaagaccctttgagacttaagtgcgttaaacaaggtggcatcgtggataaagatctgcggcactacctgaacctgagatttcaaaagggtagcgtagatcacgaactccagcagatcatccgcgacaacttgtatttgcgaactgtaccttgtacaaccaggccccacaaggaaggcgaagttcctggcgtcgactatattttcatcactgtcgaggattttatggagttagagaagtccggcgctctcctggagtctggaacatacgaggacaattactatggtacacctaagcccccagccgagcctgcccctctgctgctgaacgtgaccgatcaaatcttacccggagccaccccaagcgctgaggggaagcgtaagcggaacaagtcagtatccaacatggagaaagcctcaatcgaaccccctgaggaagaagaagaagagagacccgtggtgaacggcaatggcgtggttgtgacccccgagtctagcgagcatgaagacaaaagcgctggggcatcaggagaaatgcccagtcaaccttacccggcaccagtgtattcgcagcccgaggagctaaaggagcagatggatgacacgaagcctacgaagcccgaggataacgaggaacctgacccattgcccgataattgggagatggcgtatacagaaaagggggaggtttacttcattgatcacaataccaagacgacatcatggctggatccgagacttgctaaaaaggccaagcctcctgaagagtgcaaggagaatgagttgccatatggttgggaaaagattgatgatccaatttacggcacatactatgtcgaccacataaatcggcgaacccagttcgaaaaccctgtcctggaagccaaaagaaaattgcagcagcataatatgccacacaccgagctgggcaccaaaccgctccaagcacctgggttcagggagaagcccttatttacacgggatgcctcccagcttaagggaacttttctgtccaccacactcaagaagagcaacatgggctttgggttcactatcatcggaggggacgagcctgatgagttcctccaggtgaaatcggtgattcctgacggtcccgcagcccaggacggtaagatggaaacaggcgacgtgattgtctatatcaacgaggtttgtgtgttgggccacacacatgcagatgtcgttaaactttttcaaagtgtgccaataggccagagcgtcaatctggtcttgtgccggggttatcctctacctttcgatcccgaggaccctgccaatagtatggtgcccccactggctatcatggagcggcctcctcctgtcatggtaaatggcagacacaattacgaaacatacttggaatacataagccggacctctcagtctgtccctgatattactgacagaccaccacattcactccactcaatgccaactgatgggcagctggacggaacgtatcccccacctgttcacgacgataacgtctccatggcatccagcggggctacgcaggccgaactgatgacgctaaccattgtgaaaggagctcaggggttcggattcactattgctgactcaccaaccgggcaacgagtcaagcaaatattggatattcagggctgccccggactctgtgagggcgatctcatcgtcgagattaatcaacagaatgtacagaatctctcacatacagaagtagtagatattctgaaggactgcccaatcggtagcgagacgagcctgatcattcacagaggtggattcttcagtccctggaagacccctaaaccaattatggaccggtgggaaaaccagggatccccccagacctcgctgagcgcgccagctataccccagaatctaccgtttcccccagccctccacagatcctcctttccagatagcaccgaagccttcgacccgcgaaaaccagacccttatgagctttatgagaaatcccgagcaatttacgagagtcggcaacaggtgccaccacggacctcttttagaatggattcctcaggtcccgactataaggagttggatgtccacctacgcaggatggagtccggctttgggttcaggattctgggaggcgacgaacccggtcagcctatcctcataggtgccgttattgctatgggcagtgctgatagggacggtcgcctgcaccccggagatgagctcgtgtacgtggacggcatcccagtggcaggcaagactcacagatacgtgatcgacttaatgcatcacgcggctagaaatggccaggtgaatttgacagtgcgcaggaaggttttgtgcggcggagagccctgtcctgaaaacggcagatctccaggttccgtatccacccatcattcatctcccagaagcgactatgctacatacacgaattccaatcatgccgcaccttcatcaaacgctagcccccctgagggttttgcttctcactctctgcaaacctcagatgtagtgatacacagaaaagaaaatgagggttttgggtttgttattattagcagccttaataggccagagagcggcagcaccattacggtgcctcacaaaatagggaggatcatcgacgggtctccagccgatcgatgcgccaaacttaaggtaggtgatagaatcctcgctgtaaacggccagagcatcattaacatgccccatgccgacatcgtgaagctgatcaaggacgccggtctcagcgtcactctgcgcataattccgcaggaagagctcaactctcccacgagtgcgccttcctcagagaaacagtcccctatggctcagcaatccccccttgcacaacaatccccactggcccaaccctctcccgctacccccaactcacccatagcgcagcctgctcctccacagcccttgcagcttcagggacacgaaaacagttaccggtcggaggttaaagcgagacaggatgtgaaacctgatattcgccaacctccatttactgattatcggcagccccctttagattataggcagccacctggcggtgactaccagcagccgcctccactggattatagacagccccctctcctggactatagacaacactcccctgatactcggcagtacccattgagcgactacaggcagcctcaagatttcgattactttacagtcgacatggagaagggagccaaagggtttgggttctcgatcagagggggaagggagtacaagatggatctgtacgtgctaaggctggcggaagatggacccgcaatccgtaatgggagaatgcgggtgggcgatcaaattattgaaattaatggggagtccacaagagacatgacccacgctagagccatagaactgataaagtctgggggaagacgggtcaggctgcttcttaagaggggaactgggcaagtcccagaatacgacgaaccagcgccttggagttcccctgctgccgcagctccgggattacctgaagtgggagtaagcctagatgatggcctggcacccttctcaccgtcacaccccgctcccccatctgatcctagtcaccaaatttcgcccggtcccacctgggatatcaaacgtgaacatgacgtccgcaagccgaaggagctcagtgcttgtgggcagaagaagcaaaggttaggcgagcagagggaacggtctgcaagtcctcagagggcggcacggcctcggctcgaagaagccccaggcggtcagggaagaccagaagctggacgcccagcctccgaggcgagagcccctggcttggccgcagctgatgcggctgacgcagcacgggctggagggaaagaagcacctcgcgctgcggcaggctcagagctctgtcgaagagaggggcctggcgctgccccagcctttgcgggtccgggaggcggtggatcaggggctcttgaagccgagggcagagccggtgccagagctggacctcgccctggccctcgtcccccagggggtgctcccgcaagaaaggcagccgtcgccccaggaccctggaaagttcccggaagcgacaagcttcccagtgtgctgaagccaggtgcatccgcggcttcacggtag

SEQ ID NO: 51665 - DNA, 4326 bp, Artificial Sequence
  Description of Artificial Sequence: Synthetic coding sequence
atgagcaagagcctgaaaaaaaagtcccactggaccagcaaggttcatgaatctgtgatcggccgaaacccggaaggtcagctgggctttgaattaaagggtggggctgaaaacgggcagtttccttatctcggcgaggtaaagccgggtaaagtggcctatgagtccggctctaagctggtgagtgaagaacttttgctggaggtgaacgaaacccccgtggcaggattgacaattagagatgtcctggctgttatcaagcattgcaaggatcctctgcgcctgaaatgtgtaaaacaggggggaatcgtggacaaagacctccgacattaccttaatctgcggtttcaaaaaggttccgtggaccatgagctgcagcagatcatcagagacaacctgtacctgagaacagtgccatgtacaactagaccccacaaagaaggggaagttcctggcgtggattatattttcatcaccgtggaggattttatggagctcgaaaagtcaggcgcattgctggagtccggaacgtacgaggataactattatggtacacctaaaccacctgcagagcccgctcctctgctattaaacgtcactgatcagattttgcccggagctactccttcagccgaaggcaaaagaaagcgcaataaaagcgtgagcaacatggaaaaagctagcatagagccccctgaggaagaagaggaagaacgtccagtggtgaatgggaatggagtcgttgtcaccccagaatccagcgagcacgaagacaaatcagccggagcaagtggagagatgcctagccagccgtaccctgccccagtgtactcccaacccgaagagctcaaagagcaaatggatgataccaaacctacaaagcctgaggataatgaggagcccgatcctctgcccgataattgggaaatggcatacacagaaaaaggagaggtgtacttcattgaccacaacactaagaccacgagctggctggatcccagactggccaagaaggcgaagccacctgaggaatgtaaggaaaatgaactgccctacggatgggagaaaattgacgaccccatttacggtacctattacgtagaccatattaaccgacgcacacagttcgaaaaccctgtgctggaggcgaagcgtaagttgcagcaacacaacatgcctcatactgagcttggaaccaagcccctgcaggctccgggatttcgggagaagcctctctttacaagggacgccagtcagctgaagggcacctttctttctaccacgttaaaaaagtccaatatgggctttggatttacaatcattgggggagacgagccggacgagtttctccaagttaagtctgtgatacctgatggaccagcagcgcaggatggcaaaatggagacgggcgatgttattgtatacataaacgaagtgtgtgtcctaggccacacacacgctgatgtagtgaagctatttcaaagcgtgcccatcggccagagcgtgaacctagtgctgtgcaggggctaccctcttcccttcgaccccgaagaccccgcaaatagtatggttcctcccttggccatcatggagcgcccacccccagtcatggtgaatgggagacacaattatgaaacttacctggaatacataagccggaccagtcagtcagtgccagatataacggataggccccctcattcccttcatagtatgccgacagatggacaactcgacgggacttatcctccacccgtccacgacgacaacgtgagcatggctagttctggcgctactcaggccgaactcatgaccctgactatcgttaaaggtgcacaggggtttggattcactatcgccgactctcctacaggtcagcgggtcaaacaaatcctggacatccaaggttgccctggcctctgcgagggggacctgattgtggagataaatcaacagaatgtccagaatttgtctcacaccgaagttgtggatattttgaaggactgtccaatcggatctgagaccagcctgattatacatcgaggagggttttttagcccatggaagaccccaaaaccgatcatggaccggtgggagaatcagggcagcccacagacatctctgtccgcaccagctatcccccaaaatctgccgtttcccccagcactacacagatctagctttcctgactcaaccgaagcgtttgatcccagaaagccagatccctacgaattatatgagaaatcgcgggctatatacgaaagtcgccgtccagattataaagagctggatgtccacctcagacgaatggaatcaggctttgggtttcgcatcttggggggagatgaacctggccagcctatcctgatcggcgcagtgatagctatggggtcagcagaccgagacggaaggctacatcccggagacgagttggtgtatgtggatggaataccagttgcaggcaagacccatagatatgtgatcgacctgatgcaccatgccgcacgcaacgggcaggtaaaccttactgtccgcagaaaggtcctgtgtggaggcgagccatgtccggagaatggtagatcacctggctccgtctctacacaccactcctcgcctagaagtgattacgccacatatacaaactctaaccacgctgctccaagcagcaacgcaagccctccagagggatttgcttcccacagcctccagacatcagatgtagtaatccatcgtaaggagaacgaaggcttcgggttcgttattatttcaagtctgaaccgtcccgaatctggctctaccatcaccgtccctcacaagatagggcgtattattgacggctcaccggcagaccgttgcgccaaactaaaggtcggagaccgaatcttagccgtcaacggccagtccattatcaacatgcctcacgcggacattgtgaagctaattaaagacgcgggactctcggttactcttaggattatccctcaggaggagttaaatagtcctacttccgccccttccagcgagaagcaatcccccatggctcagcagtctccccttgcacagcaatctccgttggcccagccgagcccggcaacacccaattccccaatcgctcagcctgctcccccacagcctctgcagctacaaggtcacgagaattcttatcggtccgaagttaaggctcggcaggatgtgaagcccgatattcgccagcccccatttacggactaccgtcagcccccactcgattaccgacagccacctggcggtgactatcaacagcctccaccactggattatagacagcctcctctactggactacaggcagcacagccctgatactcgacagtatccactgagtgactaccgtcagccccaggactttgactacttcaccgtggatatggaaaaaggtgcaaagggattcgggttctcaattcggggtggacgggagtacaagatggacttgtacgtgctccggctggctgaagacggtccagctatccggaacggcagaatgagggttggcgaccagattatagaaatcaacggcgaatctactcgggatatgacccacgccagagccatcgaactgattaagagcggagggcgtagagtccggcttcttctgaaacgaggtaccggacaagtgcctgagtacgacgagcctgcaccctggtcatctcctgcggcagccgctccaggattacccgaggttggagtgtccttagacgatggacttgcccctttctcacccagtcaccctgcccctccaagtgatccctctcatcagatctctcctgggccaacctgggatattaaacgtgaacatgatgttaggaaacccaaagaactctctgcctgtggtcaaaagaagcagaggcttggggaacagcgagagaggagcgcaagcccgcagagagcagcgagacctcgcctagaagaggcccctggaggtcaaggacgccctgaagcaggcaggcccgcatctgaagcgagagcccctggtctcgccgctgcagacgccgctgacgccgcaagagccggtggaaaagaagcacccagagctgccgctggctctgagctctgcagacgggaaggtcccggagcagccccagcctttgcgggacccggtggaggcggaagtggagcactcgaggctgagggacgtgccggtgctcgagccggacctagaccgggacccagaccccctggcggagcccctgctcgcaaagctgctgtagcccctgggccatggaaggtgcctggaagcgacaagcttccctccgttttgaagccaggcgctagcgctgccagtaggtag

SEQ ID NO: 51666 - DNA, 1668 bp, Artificial Sequence
  Description of Artificial Sequence: Synthetic coding sequence
atggaattggaaaaatccggagccctcctcgaatccggaacttacgaggacaactattacggcacgcccaagcctcccgcagaaccagccccactgctcctgaatgtgacggatcagatcctccctggagcaactcccagtgctgagggaaaacggaaaagaaataaaagcgtgagcaacatggagaaggccagcattgaaccccctgaggaagaggaagaggaaagacctgtggttaatggcaatggcgtggtggtgaccccagagtcctccgagcacgaagataagtccgcaggcgcatctggcgagatgccctcacagccctatcccgcaccagtttacagccaacctgaagaattgaaagaacagatggatgacacaaagcccacaaaaccagaagataacgaggagccggatcctctccctgacaactgggaaatggcctacaccgagaagggcgaagtttatttcattgatcacaacaccaagactacctcttggctggatcctcgtctggccaaaaaagcaaaaccgcctgaggagtgcaaagaaaacgaactgccgtacggttgggagaagatcgatgatccgatctatgggacatactacgtggaccacatcaaccgccgaacccaatttgaaaatcccgtgttagaagctaagagaaagttgcaacaacacaacatgcctcatacggaattgggaacaaagccgctgcaggccccaggcttcagggaaaagccacttttcacgagggatgcgagccagcttaagggaaccttcctcagcaccactttgaagaagagtaacatgggatttggctttaccattatcggaggggacgaaccagatgagttcttacaggtcaaatcagtgatacctgatgggcctgctgcccaggacggaaagatggagacaggagacgtaattgtgtatatcaatgaagtgtgtgtactaggccacacgcacgccgacgtggttaaactgtttcagtctgtgccgataggccagagcgtgaacctggtgctgtgcaggggctatccacttccctttgacccggaggatcctgccaactccatggtgcctcccctggccatcatggagcgccctcccccagttatggtgaatggtaggcacaactacgaaacctatctcgagtatattagccggacaagccagtctgtgccagatatcacagaccggcctccacatagtctccactcgatgcctacagatggccaactcgacggtacatatcctccgcctgtacacgacgacaatgtgagcatggcttccagcggagctacacaggcagagttgatgacgctcacgattgtgaagggggcacagggcttcggattcactatcgcggacagtccaaccggccaacgggtcaaacaaatactggatatccagggctgccctggtctgtgtgaaggggacttaatcgtagagattaatcagcagaacgtgcaaaatctcagtcacaccgaagtggtagatatcctgaaagactgccccatcgggtcagagaccagcctaatcattcatcggggagggaagactaatactggcagcgcgatcaagtacgtgggaaaaattgtgggcagttttaacaacatagttaaaatgcagatttccttggaactgaatgagatcatactctag

SEQ ID NO: 51667 - DNA, 3762 bp, Artificial Sequence
  Description of Artificial Sequence: Synthetic coding sequence
atgtcaaagtcccttaaaaagaagtcgcactggacctcaaaggtgcacgaaagcgtaatcggacgcaatcctgaggggcaactcggcttcgaactcaagggcggtgccgaaaatggacagtttccatatctcggagaggtcaaacctggaaaggtcgcctacgaaagtggatctaagctagtgagcgaggaactgctcttagaggtcaatgagacccccgtcgccggactgaccatcagagatgtgctcgcagtgatcaaacattgcaaagacccactccggctgaaatgcgttaagcaagggggtatcgtcgacaaagacttacgccattacttgaacttgcggttccagaagggatcggtggaccacgaacttcaacagattatcagagataatctatacttaagaacagttccatgcactacccgccctcacaaagaaggggaggttcctggagtggattatatctttataacggtggaggattttatggagttggagaaaagcggcgcacttcttgagtcaggaacctacgaagacaactactacggcactcccaagccacctgccgagcctgcccctttgctattaaatgtgacggaccagattttgccaggcgctacaccctccgccgaggggaaacgcaagcgtaacaaatccgtgagcaatatggagaaagcgtccatcgagccaccagaagaagaagaagaagaaaggcccgtagtgaacggcaatggagtagtcgttacccctgagagtagcgaacacgaggataaaagtgccggtgcatctggcgagatgccatcacaaccctatcccgctcccgtgtattctcagcctgaggagctgaaagagcagatggacgacacgaagcccacaaaaccggaggacaacgaggagccagatccccttcctgacaactgggagatggcctacaccgaaaaaggtgaggtatatttcatagaccacaacacaaaaaccacctcctggttggatccacgccttgcgaaaaaggccaaaccacctgaggagtgcaaggaaaacgagctaccctatggttgggagaagatagatgaccccatttacgggacgtactatgtggaccacatcaatcggagaacacagttcgaaaacccggttttggaggctaaaagaaaactacagcaacacaatatgccccacaccgagttgggcactaagccccttcaggcccctggatttagggagaagcctctttttactcgcgacgcatcccaactgaagggcacattcttgtcgacaaccttgaaaaagagcaatatgggttttggattcacgatcatcggaggggacgaacccgacgagtttctgcaggtgaagagtgtgattcccgatggacccgcagcccaagacggcaagatggagacgggcgacgttatagtctacatcaatgaagtctgtgtacttgggcacacacacgcggatgttgtcaagctttttcagagcgtgcctatcgggcagagcgtgaatctggttttatgcagaggctaccctttgcccttcgatcccgaagacccagcaaattctatggttcctccgctggctataatggaaagacctccaccggtgatggtcaacggacggcataattacgagacctatctggaatatatcagccgcacctcccagagcgtgccggatattacagacaggccacctcatagcctccactccatgcctactgatggccagcttgatgggacgtatccaccgcctgtgcacgacgataacgtgtcaatggcctccagtggcgctacccaagctgaattaatgaccctgactatcgttaaaggtgcccaaggctttggtttcacaatcgcagatagccctacaggacagcgggtgaaacagatcttggatatacaaggctgtccagggctgtgcgaaggggatttgattgtcgaaattaatcagcagaacgtgcagaacctcagtcataccgaagtcgtcgacatcctcaaggattgtcccatcggttctgagacgagcctaataattcatcgaggaggcttcttttcaccgtggaagacaccaaagcctatcatggacaggtgggaaaaccagggtagtccacagacatccctgtccgccccagccatcccccagaacttaccatttcctcctgccctgcatcggagcagcttcccagacagcaccgaggccttcgacccacggaaaccagatccatacgaactgtatgaaaaatcccgagcaatttatgagagtcggcaacaggtgccaccccgaactagctttcgtatggactcttctggaccagactacaaagaattggacgttcatctgaggagaatggaatctggattcgggtttcgaatattaggtggtgacgaacccggtcagccaattctcattggtgcagttatagccatggggagcgcagacagggatgggaggctgcaccctggtgacgagctggtgtacgtggacggaattccagttgccggaaaaacccatcgatatgtcatagacctaatgcaccacgctgcccgaaacggccaggtgaatctgaccgtgaggcgcaaggtgttgtgcggcggagaaccttgccctgagaacggccgatctccaggctctgtgagcacacaccatagcagtccgagatcagactacgcgacttacaccaactctaaccacgcagcgccttcatcaaatgcgtcaccacccgaaggatttgcaagtcacagtctccagacaagtgacgtggtgatacaccgaaaggagaacgagggcttcgggtttgttatcatctccagcttgaaccgcccagagtccggctctaccataacagtgccgcataaaataggccgaatcattgatggttccccggctgatagatgcgccaagctgaaggtgggggatcggattctggcagttaacggtcagagcattatcaatatgcctcacgcagatattgttaagcttataaaggacgccggtctttcagtgaccttgcgtatcatcccacaggaggagttgaatagcccgacttcagctccctcaagcgaaaaacaatcacctatggctcagcagtcgccactggcacagcagtcacctctagcccaaccgagccccgcaacgcccaattcaccgatcgctcagcctgctccacctcaacccctccagttgcagggccatgagaatagttatagatctgaagtcaaagccagacaagacgtgaagcctgatatccgccagccacccttcacagattatagacagcctccgctggactataggcaacccccaggaggcgactatcagcagccacccccactcgactacagacagccaccgctgctggactaccgccaacattctcccgataccagacagtatcctctgtccgattacagacagccacaggactttgactattttaccgtggacatggaaaaaggggcaaagggctttgggttttcaatccgagggggaagagagtataagatggatctctacgtgctgcggctggccgaggacggccctgctattcgcaatggtaggatgagagttggtgatcagatcattgagatcaatggcgagtctactcgcgacatgactcacgcaagagccatagaactcataaaatccgggggtaggcgggttcgcctgttgcttaagagaggaaccggccaggtgcccgaatacgatccacctgccccagctcaagctgtgctgctacggtttcgcctgaccgccttctag

SEQ ID NO: 51668 - DNA, 1653 bp, Artificial Sequence
  Description of Artificial Sequence: Synthetic coding sequence
atgatttccgcccacagaaacctttgcttgcccgataactattacggcactccgaaaccaccagccgaacccgcaccactcctgctcaacgttactgaccaaatcctgcctggggcaacccctagcgcagagggcaagcggaagcgcaacaagtcagtgtccaatatggaaaaggcaagtattgagcctccggaagaagaggaagaagaaagaccagtagtgaatggcaatggagtggttgtgacaccagagagctctgagcacgaggacaaatctgctggtgccagtggggagatgcccagtcagccctaccccgcaccagtgtactctcaaccagaggagctgaaggagcagatggatgacacaaaacctaccaagccagaagacaatgaagaaccagatcctctcccggataattgggagatggcctatacagaaaagggggaagtgtatttcattgaccataacaccaagacgacgagctggctcgacccccgactggcaaagaaggccaaacccccagaagagtgtaaagagaacgagctcccctacggttgggaaaagattgatgacccaatttatggaacttactatgttgaccacatcaatagacggacgcaattcgagaatccagtactggaggccaaaagaaaactgcagcagcataatatgcctcataccgaactgggaacaaaacccctgcaggccccagggttccgcgagaagcccctgtttacccgcgacgcctcacagctgaaaggtacatttctgagtactactctcaagaaaagcaatatgggcttcggctttactatcatcgggggagatgaacccgacgaattcctacaggtgaaatcggtcattcccgatggtcctgccgctcaggatggaaagatggagacaggcgatgtcatagtgtatataaatgaggtttgcgtgctcgggcatacacacgctgacgtggttaagttatttcagtccgtcccgattggccagagcgtgaatctggtcctctgtcgcggataccctctccctttcgatcctgaggacccagccaattctatggtgcctcccctggccataatggaaaggccgcctccagtcatggtcaacgggcgacataattacgagacatatctcgagtatatctctaggacgtcccaatctgtgccggacattactgaccgacctccccacagcctccattctatgccaaccgacggtcagttagatggcacctacccgcctcctgtgcatgacgataacgtaagtatggcatcatccggagccacacaggctgagctcatgactctaacgattgtgaagggagcacagggctttggatttaccattgcagactcgcctactggccagagagttaaacaaatcttggatattcagggatgcccagggctgtgcgaaggcgacctgattgtcgagattaaccaacagaacgtgcaaaacctctctcacacagaagtggtggacatcttaaaggattgcccgataggaagcgaaacatctcttatcatccaccggggtggcaagacaaataccggtagcgctatcaaatatgtcggcaagattgtcgggtccttcaacaatattgttaagatgcagatcagcctggaattgaatgagattatcctgtag

SEQ ID NO: 51669 - DNA, 1419 bp, Artificial Sequence
  Description of Artificial Sequence: Synthetic coding sequence
atgagtccagaggaatggacctacttggttgtgttgttaatctccataccaataggcttcttgtttaaaaaggctggccctggcctgaaacggtggggagctgctgcagtaggcctagggctcacactgttcacatgtgggcctcacactcttcattcccttgttaccatcctcggcacatgggccctcattcaggctcagccttgctcgtgtcacgctctcgccctggcttggacattctcttacctgctgttctttcgcgcactgtccctgttgggactgcccaccccgactcccttcacaaatgccgtccaactcctcctgactctgaagctggtttcccttgcatctgaggtgcaggacctgcacttggctcagaggaaagagatggcctcaggattttcgaaagggccaacactgggtttgctacctgatgtgcccagcctgatggagacactaagctatagctactgttatgtcggaattatgactggcccattcttcaggtacaggacttacctggattggctggaacagccctttccaggggcagtcccgtctctgcgacccctcctccgcagagcgtggccggctccactttttggactcctcttccttctgagcagtcatctgttccccctcgaggccgttcgtgaggacgccttttatgctcgacctttgcctgctcggctattctacatgatccccgtcttttttgccttccggatgaggttctacgtcgcctggatagcagccgagtgtgggtgtatcgccgcagggtttggggcttatccagttgcagctaaagcccgagccggaggcggaccaacactccaatgtcccccaccatctagcccggagaaagctgcgtctctcgagtatgactacgaaacgatcagaaacattgattgttactctactgacttttgcgtccgggtgagagatggcatgcgatactggaacatgacagtgcaatggtggctggcccagtacatttacaagagcgcaccagcacggagctatgttctgagatctgcctggacaatgctcctaagcgcttattggcacggtctccaccccggttattatctatcatttctgactattccactatgcctcgccgcagaagggagattagagtccgccctgcgaggtcggctgtctccaggagggcagaaggcttgggattgggtgcactggttccttaagatgagagcatatgactatatgtgtatggggtttgtgcttttatctcttgcagacaccttaaggtactgggctagcatctacttctgcatccatttcctagctttggccgcactggggttgggcctggcactcggaggcggatcgcctagtaggagaaaggcagctagccaacccacatcgttagcgccagagaaacttcgtgaagagtag

SEQ ID NO: 51670 - DNA, 1200 bp, Artificial Sequence
  Description of Artificial Sequence: Synthetic coding sequence
atgggctcctccagatgtggaccaggagcccatccagtacacctctggccaccacactttgctttttctggacaccacccaagagacctaggtcctcactccggaccagccctgttagtgtctctcgctagtgaggtccaggacctgcatctggcgcagcgcaaagaaatggcaagcggtttcagtaaaggtccaacactcggcctgctgccagatgtaccctcactgatggaaaccctgtcatactcatattgctacgtgggtattatgaccggaccattttttcgctacaggacctacctggactggcttgagcagccgttcccaggggcagtgccgagtctcaggccactgctacggagggcgtggccggctccacttttcggcttattgtttctgctatcatcccatctgtttccattggaggccgtgcgagaagatgccttttacgcaagacccctgcccgctaggctgttttacatgatccccgtcttctttgctttcagaatgagattctacgttgcctggattgccgcagagtgcggttgtatcgcagccggtttcggagcttaccctgttgctgccaaggctagagcaggcggtggaccgaccctccaatgcccccctccatcatctccagagaaagccgcatccctggagtatgactacgaaactatcaggaacattgactgttactccacagatttctgcgtacgggtgcgggatggcatgcgctattggaacatgactgtgcagtggtggttggcccagtatatctataagagcgcgcctgctcggagctatgtgcttcggagcgcgtggacaatgctgctgagcgcctactggcatgggctgcacccgggatactatttgtcattcctgacgataccgctttgtcttgccgctgaaggtcggttggaatctgcgctacggggacggctgtcccccggtgggcagaaagcatgggattgggtccactggttcctcaaaatgagagcttacgattatatgtgcatgggcttcgtccttctttctttggctgacactctgcgctattgggccagcatttatttctgtatccactttctagcgctggccgctctgggcctcggacttgcactggggggaggcagcccctctcgtaggaaagcagcatcccagccgaccagccttgcccctgagaagctgagagaagagtag

SEQ ID NO: 51671 - DNA, 1035 bp, Artificial Sequence
  Description of Artificial Sequence: Synthetic coding sequence
atgagtcccgaggagtggacctatttagtggtcttgctgatctccatcccaattggcttcctgttcaagaaggctgggccaggactaaaaaggtggggggcagccgcagtgggcctcggattaactctattcacctgcggccctcataccctgcattcccttgtcaccatactgggcacatgggcccttatacaggcccaaccctgtagctgccatgctctcgccctggcatggaccttcagttatctgctgttttttagagccttaagtcttctgggcctgcccactcctacgcctttcactaatgctgtgcagctgctcctcactctgaaactggtgtcattggcatcagaagttcaggacctgcatctggctcaaagaaaggaaatggcttcggggtttagcaaaggtcccaccctcgggctgctgcccgacgtgcccagcttgatggagacactctcctactcttactgttacgtggggataatgacgggcccttttttccgttaccgcacttacctcgactggctagagcaacctttcccgggtgctgtgccaagcctcagacctctgttaagacgtgcctggcccgcacctctgtttggcctcctgttcttgctgagcagtcatttgttccccctggaggcggttcgagaagatgcattttatgccagacctttgcccgcaagactcttctacatgattccagtgttcttcgccttcaggatgaggttctatgtcgcgtggattgccgcagagtgcggctgcatcgctgccggtttcggagcatacccagttgcagcgaaggctcgggctggtgggggtccaacactgcagtgtcctcctccgtcctctccagagaaggctgccagcctggaatacgactatgagacaatacgcaacatcgactgctattctaccgacttttgtgtgcgcgtgcgcgatggcatgcgatactggaatatgacggtccagtggtggctggcgcaatacatctataaatccgcccctgcaagatcttatgttctgaggtag

SEQ ID NO: 51672 - DNA, 771 bp, Artificial Sequence
  Description of Artificial Sequence: Synthetic coding sequence
atgtcccctgaggaatggacctatttggtggtgctccttatctctatcccaatcggattcctgtttaaaaaagctggcccagggctgaagagatggggagcggcagccgttggtttggggctaaccctcttcacatgtgggcctcacacgctgcacagcctggtgaccattctcggcacttgggccctcatacaggcacagccctgcagttgccacgccctcgcactggcctggacattcagctatttgctttttttcagagcactctcattattgggattaccaactccgacccctttcaccaacgcggtgcagttgctgctgacattaaagctcgtttccttggcatcggaggtccaggatctgcacttggcacagagaaaggagatggctagtggttttagtaagggacctacccttggccttttgcccgacgtcccgtccctcatggaaaccctgagctactcatattgctatgtgggtatcatgacggggcctttcttccgataccggacctatctggattggctcgagcagcccttcccaggggcagtgcccagtctccgcccattgctgcgtcgtgcttggcccgctcctttgttcggtctgttgtttttgctttcgtcacaccttttccctctcgaggctgtgcgggaggatgcattttacgcccgaccattgcccgctcgactgttctacatgatacctgtattctttgccttcagaatgcgattttatgtcgcttggatcgcagctgaatgcgggtgctag

SEQ ID NO: 51673 - DNA, 1200 bp, Artificial Sequence
  Description of Artificial Sequence: Synthetic coding sequence
atgggtagctctcgctgcggacctggtgcgcaccccgtccacctttggccccctcactttgccttttctgggcatcatcctagagacttgggaccgcattctggtccggctttgctagtctctttagcatccgaggtgcaggacttacatttggcccagcgtaaggaaatggcctctggcttctcgaaaggccctacgctggggctgttaccagatgtccctagcctcatggagacgttgagttactcctattgctacgtcggcattatgaccgggccattttttaggtacaggacctatttagactggcttgagcagccctttcctggggcagttccaagcctgaggccactgctcagacgcgcatggcccgctccactgtttggactattgtttctcctgagctcccatctgtttcccctcgaggcagtgagagaagacgcattttacgccaggcccctgcccgctagactgttttacatgatccctgtgttcttcgccttcagaatgcgtttctatgtcgcctggatcgctgcggagtgtggatgtattgccgcaggatttggggcttatccagtcgctgccaaagcccgagcaggcggaggacccaccctgcagtgcccacctccttcatctccagagaaggccgctagcttggagtacgactacgagacaattagaaacatcgactgctattctactgatttttgcgttcgtgttcgggacggcatgcgctactggaacatgactgtgcagtggtggcttgctcagtacatttacaagagtgccccagctaggagttacgtcctcagaagtgcctggactatgcttttatcagcttactggcacggcctgcacccagggtattacctgtcatttctgaccattccactctgtcttgctgctgaaggtagactggagagcgcgctgagggggaggctcagccctggtgggcagaaggcatgggactgggtgcactggtttcttaagatgcgagcttacgattatatgtgcatgggcttcgtcctactgtccttagccgacacactgcggtactgggccagcatatatttttgcatccacttcctggctctcgcagcactgggccttgggctggcactggggggaggaagcccatcacggagaaaagcggcttcacagccgacatctctggctcccgaaaagttgcgtgaagagtag

SEQ ID NO: 51674 - DNA, 513 bp, Artificial Sequence
  Description of Artificial Sequence: Synthetic coding sequence
atgagtcccgaggaatggacttatctagtagtgttgctgataagtatacccatcggctttctatttaagaaggcaggcccaggactgaagaggtggggtgccgcagccgtggggctgggccttactctgttcacttgtggaccacacacactgcactcactggtgactatactggggacgtgggcgctgatccaggcacagccctgctcctgccatgccctggcattagcttggactttttcttatttgctctttttcagggccctgtctcttctgggactgcccactcctactccctttaccaatgctgtgcagttgctcctgaccctgaagctcgtttctttagcctccgaggttcaggacctacatcttgctcagagaaaggaaatggcctcagggttcagcaaggggccaacgttaggcctcctgcccgacgtaccatcacttatggagactttaagctattcttattgctacgttggcatcatgacgggccctttctttagatactag

SEQ ID NO: 51675 - DNA, 1740 bp, Artificial Sequence
  Description of Artificial Sequence: Synthetic coding sequence
atgaaggacttctccgatgtcattctgtgtatggaagcaaccgagagcagtaagactgaattttgtaatcctgccttcgagcctgagtcaggacctccttgccctcctcccgtcttccctgaggatgccagctactccgtgcccgctccctggcacgggaggaggccaaggggtttgagacctgattgtcgtttcagttggctgtgcgtgctgcttctatcttcactgttgttgcttctgcttgggctgttagtagctattatccttgctcagttgcaggccgctcccccaagcggagcctcccattcgccattgcccgctggaggcctcacgaccaccaccaccactcccaccatcactacatcccaggctgctggaaccccaaaaggacaacaggaatccggggtttcaccgtcaccacagtctacctgtggcggattgctgtctggccctaggggcttcttctcatctccgaactaccccgacccctatccaccaaatacccactgcgtttggcacatccaagtcgcaaccgatcatgccattcagctcaaaatcgaggccttaagcatagagtccgtggccagttgtctatttgaccgcctggaactgtcacctgaaccggagggcccactgcttcgagtctgcggcagggtgccacctcccactctgaacactaacgctagccatctactcgttgtgtttgtgtctgattcctccgtggagggcttcggcttccatgcgtggtaccaggctatggctccaggccgaggctcatgcgcgcatgatgaatttagatgcgatcagcttatatgtttgctgcccgacagcgtatgcgatggctttgcaaattgcgccgacggctctgacgagacaaattgttccgcaaagttctccggctgtgggggaaacctgactggccttcagggaaccttctccactccttcttatctgcagcagtatccccaccagctgctgtgtacctggcacatcagcgtgcccgctggtcactccatagagctgcagttccataatttttccttagaagcccaagacgaatgcaagtttgattatgtcgaagtgtatgaaacgtcctcctctggagctttcagtttactaggacggttctgtggcgctgagcccccaccacatctggtttcttcacaccacgagctggccgtgctgtttaggacagatcatgggatatcttccgggggattctccgccacatatctggccttcaacgctactgagaatccttgcggcccaagcgaactgagttgccaggctgggggttgcaaaggtgtgcagtggatgtgcgacatgtggagggattgtactgacggctcagacgataactgcagcgggcctctttttcctcctccagagctcgcctgtgaacctgtgcaggtcgaaatgtgcctcgggctatcctataacacaaccgcgttcccaaatatttgggtcggaatgataacgcaggaggaagttgtagaagttctctcaggatataagtcactgactagcctcccatgttatcaacatttccgtagactgttgtgcggactcctggtgcctagatgcacacctctgggcagtgttttacccccttgcaggtccgtttgccaagaggctgaacaccagtgtcagagtgggcttgcattgctagggaccccttggccttttaattgtaacaggcttcctgaggccgctgatctggaggcctgtgcccaaccttag

SEQ ID NO: 51676 - DNA, 1740 bp, Artificial Sequence
  Description of Artificial Sequence: Synthetic coding sequence
atgaaggacttcagcgatgtaattttatgcatggaggccactgagagctccaagacggagttctgtaacccagcttttgagccagaatctggccctccttgcccaccccctgtcttccccgaggacgccagttactccgttcctgcgccttggcacggacggcgtcctagaggtcttagacctgactgtagattttcatggctctgcgtgctgctgttaagctcactcctgctcctgctcctcggacttctggtggccattattctggcccagctacaagccgcacccccttctggcgctagtcatagcccgctccctgcaggcggtcttaccaccaccactaccacccccaccatcaccacttctcaggctgcagggactcctaaaggccaacaagagagcggggtcagcccctcaccccaatccacatgcggcggtctgttgagtggacctcggggattttttagtagccctaattaccctgatccctatcctcccaacactcactgtgtgtggcacattcaggtcgcaactgaccacgccatccagctgaagatcgaggctctgagcatagagagcgtggcctcttgtttgttcgatcgcctcgagctaagccctgagcctgagggtccccttttgcgggtgtgcggaagggtgcctcctcctacactaaatacgaacgcgagccacctgctggtggtttttgtgagcgactccagcgtcgaaggatttggcttccatgcgtggtaccaagccatggctcccggaagagggagttgtgcccatgacgagttcagatgcgaccagttgatctgcctcctccctgacagcgtctgcgatggattcgctaactgcgcggatggcagcgatgagaccaactgctccgcaaaatttagcggatgcgggggaaacctaacagggttacaagggaccttttctacaccatcctatctccagcagtatcctcaccaactgctgtgcacttggcatatctccgtgcctgctggccatagcatcgagttacagtttcataatttctctctagaagcacaggatgaatgtaaattcgactacgtcgaggtgtacgagacaagtagtagcggcgcattttctttactcggcaggttctgcggggctgagcccccaccccatctggtgtcctcacaccatgaactggctgtcctttttaggactgaccacggcatatcttctggtggcttctccgcaacttatctggcgttcaatgccaccgaaaacccctgcgggccaagtgagctctcatgccaggccggaggatgcaaaggcgtccagtggatgtgcgacatgtggcgggactgcactgacgggagtgatgacaattgcagcggtcccctctttcctcccccagaactggcttgcgagccagtgcaggtggagatgtgtctaggacttagttacaatactaccgcttttccgaatatctgggtggggatgattacccaggaagaagtcgtcgaggtgcttagtggctacaaatcccttactagcctgccctgttaccaacactttcgcaggttgctgtgtggactgttggtgccacggtgtactccgctcggcagcgtgttgcccccatgccgttcagtttgccaggaggcggagcaccagtgtcaatctggcttggcactcctgggcacaccttggccattcaactgcaatcggctgccggaggctgccgacctcgaggcttgtgcccaaccatag

SEQ ID NO: 51677 - DNA, 396 bp, Artificial Sequence
  Description of Artificial Sequence: Synthetic coding sequence
atggctccaagcctttggaaaggtctcgtggggattgggctcttcgccttggctcacgccgcttttagcgccgctcagcatcggtcttacatgagattaaccgaaaaggaggacgaatcactacctatcgatatcgtgctccagaccttattagctttcgcagttacttgctatggcatcgtccatattgccggagagttcaaagatatggatgccacctctgagctcaagaataagacattcgacactctacggaatcatccttccttctatgtgttcaaccatcggggaagagtgctgttcagacctagcgacactgccaattcgtctaatcaggatgcactgagcagtaacacgtccctgaagctgcggaagctagaatctctgagaaggtag

SEQ ID NO: 51678 - DNA, 591 bp, Artificial Sequence
  Description of Artificial Sequence: Synthetic coding sequence
atgaccccactcggaagcggtccccctcgtgaggctagcattgcccaaccttctggtttctccactactgaaacactgtgtgcacaggatttcagcgatgtcatctttctaagacgtgctgacactcgcagatggaagaagaagcagctccggagaccctccttactgctgcttggatgctgctcatttgggattatggcgccttctctgtggaaaggcctcgttgggatcgggttattcgctttagcacatgcagcatttagcgccgctcagcatagatcctatatgagactgactgaaaaagaagacgaatctcttccgatagacattgtcctgcaaacactcctcgccttcgcggtgacctgctatgggatcgtccatattgcaggagagtttaaggatatggacgccactagcgagctgaagaacaaaacattcgatacccttcggaaccatccttctttttacgtttttaaccacagaggccgtgtgctgttcaggccttccgacaccgcgaatagctctaatcaggatgccctgagttcaaacactagcctgaagctccgcaaattggaatctttgcggaggtag

SEQ ID NO: 51679 - DNA, 2139 bp, Artificial Sequence
  Description of Artificial Sequence: Synthetic coding sequence
atggagtctactagccaagatagaagggccacccacgtgatcacaatcaagcctaacgagacggtgttgacggcctttccatacaggccacactctagcttgttggacttcttgaaaggtgagccccgtgtgcttggcgcaactcagatcttactggccctaatcatcgtcggctttgggactatcttcgccctaaactacatcggattcagccaacggctgcctctggttgtcctgactggctatcccttctggggggcactgatatttatattgactgggtaccttacagtgaccgacaagaaatcgaagctcctgggacagggggtgaccggaatgaatgtgatttcatcgctggtagcgatcaccgggattactttcacaattctaagttaccgccaccaggacaagtactgccagatgccttccttcgaggagatttgtgtattttcaagaactctgttcatcggtatccttctgatcctgttaattatctcaattgccgagctgtctatctctgtgactatcgcctcatttagatcaaagtgctggacccagagcgacgaagtgctgttttttctgcctagtgatgttacccaaaatagtgagcagccagccccagaagagaatgaccagctccagtttgtattgcaagaggagttctcctccgacgatagcaccactaatgctcagtctgtcattttcggtggctatgcgttctttaagctgaccctgtcccgatccccattggtcagccagccgggaaacaaaggcagggagtttgtaccagacgagcagaagcagtctatcctgccttcacccaaattttcagaagaagagatcgagcccctgcccccaacactggagaaaaagccctccgaaaacatgagtattcaactggatagcacattcaagcagatgaaagatgaagaccttcagagcgctatcgtgcagcctagtcaaatgcagactaagctgctccaggaccaggctgcctccttacaggtgtttccatctcatagtgcgctgaagctagaagacatttcacccgaagacctaccatctcaggccctcccagtggaggggctgtcggagcagaccatgcccagtaagtcgacatctagtcacgtcaagcagtcctccaacctgaccgctaatgatttgcccccacaggggatactgagtcaagacaccagtagccaagacatgcttttccatgacatgacctctcaagacatgcagtcacttgacatgctgagccaagatacgccatcacacgcaatgcccccacaggatatcccgagccaggatatgctctcgcaggccctgagcgcacatgctatcctgccagaggcgtcaacgagtcacatcgtccagttcccggagattcagcacctgctccagcaaccacccgatctgcagccagaaaacaccgaaccgcagaaccagcaaatactacagatgtcctatcaggacatccggtcagaggtaatggaagaaaccaaggaatggaaatcagaggaggagctacaccggagaaaatcctcacgccgacatagcctgaaccaacaaactaaagcgcttcagtacttgcgcaggcactccctcgatgttcaggcaaaggggcagaagagctccaagagacactcccttgatcagcagagcaaagggtggcaatcaccgaagcaaaagtctctggatcagcagatcaaagattggcttagccctaagcgccacagcgtggataaacaagcacagctgaatcagacaaaggaacaactccctgatcaacaggccgaggaccaacaagccaagggagagcaataccccgagggtcagagtaaggatggtcaggttaaggatcagcagaccgacaaagagcagaattccaagaagcagacccaggatcagcagacggaggatcaaccggctcaggagaagaaatccccaaaaggtcagttccaaaatgtgcaggccgagggccagcaagcccaggttgagaaagtgccaaaactgctctgtcaagattccgaaagccagattcagcagtaccaattctggcaattccataaaggtaacttacaagcaggacagcccaggaccgtaaatctattagctaaaaatccactgacaggctag

SEQ ID NO: 51680 - DNA, 339 bp, Artificial Sequence
  Description of Artificial Sequence: Synthetic coding sequence
atgattgggatattccatattttcatgtggtacttcttgcttgtcctctatatggggcagattaaaggagcctttgggacttacgagcccgtcacctataagacagggtgcacgctgtggggtatcttttttatcattgccggtgtttttcttatccgcgtaacaaaatatcctactcgcagcggcaaactgggtagagaagtctcccggattctgctgtttttctacggcctagaattcagcatcgcccttacccactctatttatagctgctccaacttgtttagacgtcaaaatgatctgacaagtgttactgaggaagcggagtccaccccctag

SEQ ID NO: 51681 - DNA, 459 bp, Artificial Sequence
  Description of Artificial Sequence: Synthetic coding sequence
atgatcggaatttttcatatttttatgtggtatttcctgctggtgctttatatgggacagattaaaggcgcttttgggacatatgagcctgtcacgtataagaccggatgtaccctgtggggtatcttctttatcatagcaggggtgtttttgattagagtcaccaagtacccgacccggtctgggattatatctaccctaatcatcaatatcatttgtatcatcaccacaattactgccgttacactgactatcatagaactcagtcacttcaacagtgtgagctacagaaattatgggcaagcaaagctcggtagagaggtttccagaatcctgttattcttttacggcctggagtttagtatagcactgacccacagcatctacagttgtagcaacctgtttaggcggcaaaatgacctcacttcagtaactgaggaggccgagtccacgccttag

SEQ ID NO: 51682 - DNA, 282 bp, Artificial Sequence
  Description of Artificial Sequence: Synthetic coding sequence
atgattgggattttccacatttttatgtggtatttccttctggtgctctacatgggccaaatcaagggtgcattcggcacctacgagccggtgacctataagactggttgtaccctttggggtatcttcaagcttggaagggaggtgtctagaatcctgcttttcttttatggactggagttttcaatcgccctgactcactcaatatacagttgctcaaacctattccgacgacagaatgatcttacaagcgttacagaggaagccgaaagtacgccctag

SEQ ID NO: 51683 - DNA, 2040 bp, Artificial Sequence
  Description of Artificial Sequence: Synthetic coding sequence
atggaatctacgtcccaggatcgccgtgctacccatgtcattaccatcaagccaaacgagaccgtgttgaccgccttcccatatcgacctcacagctcattgctggacttccttaaaggcgaacccagggtgctgggggctacgcagatcctgctggctcttattattgtgggatttggcactatcttcgcactgaactatattggcttctcccagcgcttaccactcgtcgtgctgacaggctatcctttctggggcgctctgatctttatcctgactggctacttgacagtcactgataaaaagtcaaagctgttgggacaaggcgtgaccggcatgaacgtgatctcctcgctcgtggctatcacaggtataacattcacaattttgtcctacaggcatcaggataaatactgtcagatgcccagttttgaagagatttgtgtcttctcaagaacactgttcatagtcctgttttttctgccaagcgacgtgactcagaactccgagcagccggctccagaagagaacgaccagctgcagttcgtactccaggaggaattcagctcggacgattctacaaccaatgcacagtcagtgatcttcggagggtacgccttttttaaattgacactcagtcgaagtcccctcgtgtcacagcctggaaataaaggtcgagagttcgtaccagacgagcagaagcagagcatcttgccttccccgaaatttagtgaagaagaaatcgagcctctgccccctaccctcgaaaaaaaaccatctgaaaatatgagcatccagctcgatagcacttttaagcaaatgaaagacgaagacctccagtccgctatagtgcagccaagccagatgcagacaaagttgctgcaggaccaggcagcatccttgcaagtatttccctctcattctgctctcaagctcgaagacataagtccagaagacctgccaagccaggccctgcctgttgagggactatctgaacagaccatgccctccaagagtaccagctctcacgttaagcagtcttccaatctgacagccaacgacttgcctccccagggcattctcagccaagatacaagtagccaggatatgctgtttcacgacatgacttcacaggatatgcagagtctagatatgctgagtcaggacactccgtcccatgcaatgcctcctcaggacataccgtcccaggacatgctttcccaagccctatccgcacacgccatcttacccgaggctagcaccagccatatcgtgcagttccctgagattcagcacctccttcagcaacctccagaccttcagccagagaacaccgagccccagaatcagcagatactgcaaatgagctatcaggacatacgttccgaggttatggaggagaccaaggagtggaagagtgaggaagaactgcaccgcagaaaatcaagccgcagacattcgctgaaccagcaaacgaaggcactccagtatttgcgaagacactctctggacgtacaagccaagggacaaaaatcctccaagcgccactcactggatcagcagagtaagggttggcaaagccccaagcaaaagagtcttgaccagcagatcaaggattggctctcacccaaacggcactcggtggataaacaggctcagctaaaccagaccaaagagcagctccctgaccaacaggcagaagaccaacaagccaaaggcgagcaataccccgagggccagtccaaggatggtcaagtgaaggaccagcagacagacaaagagcagaattctaaaaagcagacccaggaccagcagacagaggaccaacccgctcaggagaaaaagagtcctaagggtcaattccagaatgtgcaggccgagggacagcaagctcaggtagaaaaagtgccaaaattgctgtgccaggattctgagagtcagatccagcagtaccagttttggcagttccataaagggaatctccaagcaggccaacctcggaccgtcaacctccttgcaaaaaaccctctgactgggtag

SEQ ID NO: 51684 - DNA, 177 bp, Artificial Sequence
  Description of Artificial Sequence: Synthetic coding sequence
atgaatgtgatctctagccttgtcgctataactggaataacatttacgatcctatcttacaggcaccaagacaagtattgccaaatgccttctttcgaggagatttgcgtcttctcacggacactgttcatcgattttattctcctaacaccgccacactcaagtcactttctctag

SEQ ID NO: 51685 - DNA, 1989 bp, Artificial Sequence
  Description of Artificial Sequence: Synthetic coding sequence
atggaaagcacctcccaggaccgacgagcgacccacgtgatcaccattaaacccaatgaaactgtgctgaccgcatttccttatcgacctcactcttcgctcttagatttcctgaaaggggaaccacgagtactcggtgctactcagatccttctggccctcatcatcgtggggtttggaacaattttcgccttgaattacatcgggttctcccaacggttgccgctggttgtactgactgggtatcccttttggggtgctcttatcggacagggagtcaccggcatgaatgtgatcagctcactggtcgcaataaccggtatcactttcactatcctgtcctatcggcaccaggacaagtactgtcaaatgccttctttcgaagaaatttgcgttttctcgagaacactttttatcgtcctcttctttctgcccagcgacgtcactcagaactccgagcagccagcgcctgaagagaatgatcagcttcaatttgtactccaagaagagttcagctccgatgactctacaaccaacgcccaatccgtcatctttggaggttacgcgtttttcaagctgacgctgtctcgctcaccactggtgtcacagcccggaaataagggaagggaattcgttcctgatgaacagaaacaaagcatactgcctagccccaagttttccgaagaggagattgagccactgccacccaccctcgaaaaaaagccttctgaaaatatgagcatccagctggactccactttcaagcagatgaaggacgaagacttacagtcagccatcgtgcagccaagccagatgcaaaccaagctgcttcaagaccaagctgcctcgctccaggtcttcccaagccactctgccctgaagttagaagacattagtcctgaggaccttccttcccaggccctgcccgtggagggcttatcagagcagaccatgccttcaaaatccacctcgagccatgtgaagcagtcaagcaatctgacagctaatgaccttccccctcagggaatcttatctcaggatacatccagccaggacatgctctttcacgacatgaccagccaggatatgcagtctctggatatgctctcacaggatacaccttctcatgcaatgccacctcaggacatacctagccaggacatgctgagccaggcactgtctgcccatgctattctcccagaagcttctacgtcccatatcgtccagttcccagagattcagcacctcctccaacagcctcccgacctgcagccagagaacaccgaaccccaaaaccagcagattctgcagatgtcttatcaggacatccgcagcgaagtaatggaagagacgaaagagtggaaatctgaggaggaattgcatagaaggaaaagttcccgccgacacagcctgaaccagcaaaccaaagccctgcagtatctacggaggcacagtcttgatgtgcaggcaaaggggcagaaatcttctaagagacactctctggaccagcagagtaaaggctggcaaagtcccaagcagaagtcactagaccagcagattaaagactggctctctccaaaacgccactccgtcgataagcaagcacaattgaaccagaccaaagagcagctacccgaccagcaggctgaagatcagcaagccaaaggagaacaataccccgagggacagagcaaggatggccaagtgaaagatcagcagacagataaggagcagaattcgaaaaaacaaacccaagaccagcagaccgaagaccagccagcacaagagaaaaagtccccaaaggggcaatttcagaacgtccaggccgagggccaacaagcccaggtagaaaaagtgcccaaattgctgtgtcaggattcagaatcccagattcagcaataccagttttggcaatttcacaaagggaatctgcaggctggccaacctagaacagtaaacctattggcaaaaaatcctcttactgggtag

SEQ ID NO: 51686 - DNA, 1704 bp, Artificial Sequence
  Description of Artificial Sequence: Synthetic coding sequence
atgaacgtgatcagtagtctggtcgcaattaccggtattacattcaccatcctgtcataccggcatcaggataagtattgtcagatgccatctttcgaggagatctgcgtcttcagtcggacgctgttcattgtgcttttcttcctgccctcggacgtcacacagaacagcgaacaacccgctccggaggagaacgatcagttgcagttcgtgttacaggaggaattttctagcgacgattccacaacaaatgcacaatcggtcattttcggaggctatgccttcttcaaattaaccctgagccgcagcccactggttagtcaacctggaaataagggacgcgaattcgttccggacgaacaaaagcaatcaatacttcctagcccgaagttcagcgaggaggagatcgagcctctacctccgacactggaaaaaaagccttcagagaacatgagcatccagttagactcgacctttaaacagatgaaagacgaagatcttcagtcagctattgtgcaaccctcccagatgcagactaagctgctgcaggatcaagcggcatccctgcaggtctttccgagccactctgcactgaaattagaggacatttcgcccgaagacctcccttcccaagccctgccggtggaagggttaagcgaacagacgatgcctagtaagtccacctcctctcatgtgaagcaatcttcgaacctgacggccaacgatctgcctccccaggggatattgtcgcaggacacctctagtcaggatatgctctttcacgatatgaccagtcaggacatgcagtcgctggatatgttatcccaggacactccatctcatgccatgcctcctcaagatattcctagtcaggatatgctgagccaagcactgagcgctcacgccatcctgcctgaggcatcaacttcacatattgtgcaattccccgagatccagcacctgctgcagcagcctccagatctgcaaccggaaaataccgagcctcagaatcaacagatcctacaaatgagttatcaggacattaggtctgaagtcatggaagagactaaggagtggaagtccgaggaggagctgcatcgaagaaagagttcccgccgtcactctctgaaccagcagaccaaagccctgcagtacctgaggcgccactccttggacgtgcaggccaagggccagaaatctagcaagaggcattccttagaccagcagtccaagggctggcaaagcccaaagcaaaaaagcttagatcagcagatcaaagactggctctcacctaaaagacacagtgtcgacaagcaggcgcagctgaaccagacaaaggaacagctgcccgaccagcaggcagaggatcagcaggcaaaaggcgaacaatatcctgagggtcagtctaaagacgggcaggtcaaagaccagcagacagataaggagcaaaattccaaaaaacaaacccaggaccagcagacggaggatcagcccgctcaggaaaagaagtcccctaaggggcagttccagaacgtccaagccgaggggcagcaggcccaggttgagaaggtgcccaaactgctttgtcaggacagcgagtcccagatccagcagtatcagttttggcaatttcataaggggaacctacaagcaggtcagccccgtaccgtcaatctgttagccaagaatcccctgaccggctag

SEQ ID NO: 51687 - DNA, 444 bp, Artificial Sequence
  Description of Artificial Sequence: Synthetic coding sequence
atggtcaggagggggcatgtgggcatatttttcattgaagggggtgtacctttttggggtggcgcatgttttatcatttccggaagcttgagtgtggctgccgaaaagaaccacaccagctgtctcgtgcgatccagtcttgggacaaacatcttgtcagttatggcagcctttgccggaacagctatcctcctgatggattttggcgttacaaaccgagacgttgatcgcggatacttagcggtgcttactattttcacagttctggaattttttacagctgtgatcgccatgcatttcggttgtcaggcgatccatgcacaggcctcagccccagtgatcttccttcctaacgccttctcagcagatttcaatatcccaagtccagccgctagcgcacccccagcctacgacaatgtcgcttacgcacagggcgtggtctag

SEQ ID NO: 51688 - DNA, 723 bp, Artificial Sequence
  Description of Artificial Sequence: Synthetic coding sequence
atgagcgcagctccggcttctaatggtgtattcgtggtgataccgcctaataatgcatctgggttatgtcctcctcccgcaattctgcctacctccatgtgtcagccccctggcattatgcaattcgaggagccaccactgggggcacaaacccctcgtgctacccagcctccagatctgcgtccagtagagacattcctaactggcgaacccaaggtgctgggaacagttcagattttgattggccttatacacctgggctttggaagcgttcttctgatggtgcgacggggacacgtgggcatttttttcattgaaggaggagtccccttttggggcggagcctgttttattatctccggatccctgtcagtggccgctgaaaagaaccatacaagttgtcttgtacgaagctcgctcggtacaaacatcctcagtgtcatggccgctttcgcaggcacagcaatcctcttaatggacttcggcgtaacaaaccgcgacgttgatcggggttatctcgctgtcttaaccattttcaccgttctcgagttctttacagccgtgatagctatgcacttcggctgccaggctatccacgctcaggcgagtgctccagtcatatttttgccaaacgcttttagcgcggactttaatattccatcaccagccgctagcgccccacccgcttacgacaacgtggcttatgcacagggtgttgtgtag

SEQ ID NO: 51689 - DNA, 3162 bp, Artificial Sequence
  Description of Artificial Sequence: Synthetic coding sequence
atggaggtctctggggaccccggtatcccagcattacaccgtctgtgtactagagccttaagtgcaagccctggcccaacagcgctcgggccaagtacatttctgccctgggatgtaagtgcccgtatgactagcgccaggcgtaggaccgatgttggccctcgggtcgcattcacatatccatgtacccagctgtccccaacccgggctcatagacacctgcccgtccataccgttacctatccttgtactcagctttctcctacaagagcacattcatgccaccttcctatgcacacggtcacttatccatgtacaccttcacctacccgcgctcattcatgccacctcccggtgcacacagttacttatacttgtaccctgtcaccaacacatgcctgtctgcacgcaagtaccgtatcatgtctgtgctgcattccagtccacactgtgacctatccttgtaccctttcccccacatgcgcacattgccatctgcacatgcgggcacgcacacatccacagccacatgcctgcgccgtatatctgtgcatcctgagcccaacgcgtgctcattgtcatttacacgttcatacagtgacttatatgtgtgtgccagcctgtacacattccattacgcccgttcatgcacctccagacacgagctgtgcatgggcccaagcggtgcatagatggccagtgctgtggggcagccgatcctcctcaatgagtagcggtcttaagcaaactcctatggtgggtgtgaccggcccaccctgggaccccgacgcacctgccccagctcccgcaggcacattaaccgcccacctgattcctggcgcactgcagagtagtgggctgaccctgcttctgagtcttgcagcccactgttctggtcctcaggcaaaagtgttgagccctgggggtcttgatgcatccggcgcaaacctgtgggcttccgccaattgttctcttcttcaggggttctggtgtcagccggcaagccagctcccacgggatcagctctcagctttgattcaacgcttagccctgctccaggtgcctctgcaggcatggcaagtgtctggaaaagagtgccggggtgccggtacaggcggaaggggagacgacccaacctgcggcaaacgaggaagagaagtgggcggagactggggtctgcgccctccacagaggggccgtgcgccaaccgggtgccacggagagagccgtgtaacacgcgagagacggagcgcacagctgagctgcctggccaatctcgcatctcgttgcgggctgcaggatgacttcacacttcatcccccaaacctgctgctgttctacaatctgtcccaggtccgcgaagctgattgtagagcttttatcaggcgggctgcgcagggtgacgtggaactgctttcgcacctgccggatcagcgggtggcactgtggcgggcagcagtggcctgcctggttggagcaggctggggttgggccagatgtatcgggggatccctgcccctcggtgcagacctcctcgctcttcagggcgtcgctcgactgaggctgagcgcctcagatcaacagctcctgggggctcttgtctgtgatatggatgctagctcaatcggtgcggcagatcctcatatgctcgaaaacctgcgaagatgtccaaggctgaccgcagcccagcggatcgcacttaactctctactggccggaggcaagacctctctcgggcctccaggctcatggacactggaaggcctccaggctctggggcctctggctacatatatttccccccatctgtgggcacaagttcaagaggctgtgggactgggatttttcagaagcgtggtggcgtcttgccaggtgggcagactgggtcagagagaagccagatgcttcgttacgtcttttttggaatcgaagaccaaacccgtgtccagcaggcctaggcttagcaccggaaacatcaccgcagccactctgcgcgatgacctgttcttagtgcattatgactgtgctgagctggagtcttgcctcgatgggtgcatccttcgaacgaaccttgacacacttttacaacacctgctgccaactgaatgccagcacgttgtgaaagcgaagctcgcgcagatctatccccaagggctccctgaggatcagcttcgcctgatcacatcactggtgtatctgtactcacggacagagataggtcagtggagtatcacaagccaggacacagtgatggcactgctcgctagcgatgttgcactggaaaatcagaccgaagccgtcttgcagaagttcctcgagcacaatgggaccgtgagtggcgctctccttctggccatcggtggtacaaggttgtgttggatgagcccacaccaaatccagacaattcatccccaggaactccggctggcaggggctcttgatttatcttcttgcccacagtcacgcaaagatgtcctgtatacaaaagctcatgaaacgtttgggtccagcggtacactggcagcttactatcggctgatgaggccgtatctgggcggatcaccgggaggagctcagccgcctagcccggtgcctcccggaggcgcaccggtagaagaactgagacatctcgcacacgctaatatctccatggacattgacacattcactagtctaaaccctctggaactccagagcctggatgtgggaaatgtgactgctctcttggggcataatgtgggtgaccttcagaaggccaggagccaccctactgttagagcttggctgagatccctgaattcaagcactttaggccaactgggtctggacgccagcccaacatcacccaccggtcctgcacatgggacacgaggccctccgagcacaacacaccaggtgttgcacctggtgcatacatccggtctgcccactaacgacgctcaggccagcacatctggatcactgtgggcacccctgggctatctccccctggctatggcgcttccttgcagtcttctctgcctcctgcactgggggacatgtattctggtctccgtggactccgtcgcgtccggatggctgggaagtcagggttcgggggctggcaagaccgaggtgctggactcagcaggaagaccactaggcctgaccggtcagctttag

SEQ ID NO: 51690 - DNA, 2109 bp, Artificial Sequence
  Description of Artificial Sequence: Synthetic coding sequence
atggccgcagctgttactatacctggccctcggataggagcgctgcagtccagcggcttgactctgctgttgagcctggctgcgcactgctcaggaccccaggcaaaagtgttgagccctgggggattagacgctagtggtgcgaatctgtgggctagcgcgaactgcagcctactccaggggttctggtgccaacccgcatcccagctgccacgcgatcaactgtccgcacttatacaacgcctcgctctgttacaagtcccactgcaggcttggcagctctcctgtctggcaaatctggcctccagatgcggccttcaggacgacttcaccttacaccccccaaatctccttctgttctacaatctgtcccaggtcagggaggccgattgtcgggctttcattcgtagggccgcacagggcgatgtcgagcttcttagccacctgcccgaccagcgcgttgcactgtggcgggctgcagtcgcgtgtctggtgggcgcaggcctgcgacttagcgcttcagaccagcaactcctcggggctctcgtttgcgatatggatgcgtccagtatcggtgcagctgatccacacatgttagaaaatctgcggagatgtcctagattgacagctgctcaacggatcgctttgaattcactcctcgctgggggtaaaacctctcttggaccacccggttcgtggacgcttgagggcttgcaggcattaggacccctcgcaacttacatcagcccgcacttatgggcccaagtgcaagaggcagtaggcttgggcttctttcgctcggtagtggcctcatgccaggtgggcaggcttggccaaagagaggccaggtgcttcgtgacttcctttctagaatcaaagacaaagccggtgtcctccaggccacggctgtctaccggtaacattacagccgctaccctgagagacgacctgtttttggtgcactatgactgtgcagagctggaaagttgtctagacggatgcatactcagaacaaatctggataccctgctccagcacctactacctacagaatgccagcacgttgtgaaagcgaagctcgctcaaatttaccctcagggacttccagaggatcagctgcgcctgatcacctcccttgtgtacctgtactctagaaccgaaatagggcaatggtccatcaccagccaggatacggtaatggcacttctcgcctcggatgttgccctcgagaaccagactgaagcagtgttacagaaatttcttgaacacaacggaactgtcagtggggctctgctgctcgctatcggcggaaccagattatgctggatgagtccgcaccagatccaaaccattcacccgcaggaacttcgactcgcaggtgcactggacctctcgagttgtccccagtcaagaaaggatgtcctgtacaccaaggctcacgagacatttggatcaagcgggacacttgccgcttactacaggctcatgagaccatatctggggggatccccgggaggcgcacagcctccatcccccgtcccacccggtggagccccagttgaggagctgcgacatctcgcccacgcaaatatatcaatggatattgacaccttcacctctttgaaccccctggagttgcagtcattagacgtgggtaatgtgaccgctctgctcggccataacgttggggacctccagaaagcacgttcccaccctaccgtacgcgcttggttgagaagcctgaacagttcaacgctgggccagttgggattagatgcttctcctacctcacctactggcccagctcacggcacacgcggacccccaagcaccacacaccaggtgctacatttggtgcacacctccggcctccctacgaatgatgcccaagcatcgacttcaggtagcctctgggctcctcttggttacctgccactcgccatggccctcccgtgtagtctgctgtgcctgctgcactggggtacatgtattctggtgtcagtcgacagcgtggccagcgggtggctcggaagccagggttcaggtgccggaaagaccgaggtactcgactcggctggacgacctctcggcttgacgggccagctgtag

SEQ ID NO: 51691 - DNA, 792 bp, Artificial Sequence
  Description of Artificial Sequence: Synthetic coding sequence
atgagccttgttgccgaagccttcgttagccagattgctgcggctgagccatggccagaaaacgccacactgtatcaacagttgaagggggaacagatcctgcttagcgacaatgcagcttcgcttgcggtccaagctttcctgcaaatgtgcaatctgccaataaaggttgtgtgccgtgcgaacgcagagtacatgtctccttctggcaaagtccccttcatccacgttggcaaccaggtggtatccgagctgggtcctattgtgcagttcgtgaaggctaagggtcattcactcagcgatgggttagaggaggttcagaaagcagagatgaaagcatacatggaactggttaataatatgctgctgacagcggaactctatttgcaatggtgtgacgaagccacagtgggagagatcacgcacgcgagatatggaagtccttatccctggcccctgaaccatattctggcctaccagaagcagtgggaggtcaaaagaaagatgaaggccatcgggtggggtaagaaaacgttagaccaagtgctggaagacgttgatcagtgttgccaggctctctcccagagactgggaactcaaccatacttcttcaataaacagcccactgagctggatgcactggtctttggacatttatatactatattaactacacaactgaccaatgacgaactcagcgaaaaggtgaaaaactattccaatctgctcgccttctgtaggagaatcgagcaacattatttcgaagaccgcggaaaaggtcggctgtcctag

SEQ ID NO: 51692 - DNA, 762 bp, Artificial Sequence
  Description of Artificial Sequence: Synthetic coding sequence
atgtatatcgcagccgagccatggccagagaatgccactttgtatcagcagttgaagggggagcagatacttctgagcgataatgccgcttcactggcggtgcaggcattcctgcaaatgtgcaatttacccatcaaagtggtttgccgcgcaaacgctgaatatatgtccccctccggaaaagtgcccttcatccacgttggaaatcaggtcgtgtcagagttgggaccaatagtacagtttgtaaaggccaaaggccacagccttagcgacgggctggaggaagttcagaaggccgaaatgaaggcctatatggaactggtgaacaatatgctgctcactgcagaattgtatctgcagtggtgcgatgaagccacagtcggcgagatcacccatgccaggtatggctccccatacccatggccactcaatcacatcctcgcctatcagaaacagtgggaggtcaagcggaagatgaaggccattggctgggggaagaaaaccttggaccaggtactggaagatgtcgaccagtgctgtcaggccctgtctcaaagactcgggacccagccctattttttcaacaagcagcccaccgagctcgacgctctggtgttcgggcatctctatactatcctgaccacccaactgaccaatgacgaactgagcgagaaggttaagaactatagcaacttgctagctttttgtcgaaggatcgagcaacactatttcgaggataggggtaaggggcgactctcctag

SEQ ID NO: 51693 - DNA, 477 bp, Artificial Sequence
  Description of Artificial Sequence: Synthetic coding sequence
atggctgcacccttagagctcagctgctggggcggaggctggggtctcccttccgttcactctgaatccttggtggtgatggcttatgccaagttctccggggctccccttaaggttaatgtgatcgataatacatggagggggtctcgcggtgatgtccccatacttacaacggaagacgacatggttagccaacctgctaagattcttaacttcctaagaaagcagaagtataatgccgattacgagctgtccgccaagcagggggctgatacattagcctacattgccctgctggaggaaaaactcctgcctgcggtgctgcatacattctgggtcgaatcagataactacttcaccgtgaccaaaccgtggttcgcctctcagatcccatttccactgtctttgatattgcctggaagaatgtcaaagcagatccttagctctagggccggaacacatatgctgcgaaaatag

SEQ ID NO: 51694 - DNA, 747 bp, Artificial Sequence
  Description of Artificial Sequence: Synthetic coding sequence
atggctgctccactggagctgtcctgttggggtggaggatggggtctccccagcgtgcattccgaatccttggtcgtcatggcgtacgcaaaatttagcggtgcgcctctgaaagttaacgtgatcgacaacacatggagagggagcagaggcgatgtcccaatcctaaccacagaggatgatatggtatcccagcccgcaaaaatccttaattttctgcggaaacagaagtacaacgccgactacgaactctcagccaagcaaggtgctgacacactcgcttatatagccttgcttgaagagaagcttctgcctgctgtgctgcatacattttgggtggagtcagacaactacttcacagtgacaaaaccttggttcgcatcccagatcccctttccactgtccctaattctcccaggcaggatgagcaaaggcgcactgaatcgcattttgcttacccggggacaacctcccctgtaccacctaagggaagttgaagctcagatttatcgcgatgcaaaggaatgcctgaacctgctgtcaaatcgcctcgggacatctcagtttttctttggtgatacaccttctacactggatgcttacgtgttcggcttcctggctccgctgtacaaagttcggttcccaaaggttcaactgcaggaacacctgaagcagctgtcaaacctctgtcggttctgtgacgacatcctgagtagctattttagacttagtctgggcgaaggttag

SEQ ID NO: 51695 - DNA, 747 bp, Artificial Sequence
  Description of Artificial Sequence: Synthetic coding sequence
atggcggcaccattggaactttcatgttggggcggtgggtggggccttccgtctgtccattctgagtctcttgttgtgatggcatatgcaaagttctccggggcaccactgaaggtaaacgtaatagataacacctggagaggaagcagaggcgatgtcccaatcttgacaactgaggatgatatggtaagtcagccagccaaaatcctgaacttcttaagaaagcagaagtacaacgctgactatgagctctctgccaaacagggcgctgacacccttgcctacattgcactgctggaagagaagttactgccagccgtgctgcatacattttgggtggagagtgataactatttcacagtgaccaaaccttggtttgcaagccaaatccctttccccttgtcccttattcttccgggacggatgtccaagggcgctctaaacaggatcctgctcactcggggacagccccctctgtaccatctaagggaggtggaggcccaaatctaccgggacgccaaagagtgcctgaacctcctctcaaatcgactgggaacgagccagttcttcttcggggacacccccagcaccttagacgcatatgttttcggctttttggccccactatacaaggtacgctttcctaaggtgcagctccaggaacatctcaagcagcttagtaatctgtgcagattctgcgacgatatcctttcatcatatttccgactgtccctcggggacgggtag

SEQ ID NO: 51696 - DNA, 939 bp, Artificial Sequence
  Description of Artificial Sequence: Synthetic coding sequence
atggcagcccctctcgaactctcctgctggggtggcggatggggcctgcccagcgtacactccgagtcattggtggtcatggcctacgcaaagttctcaggagcccctcttaaggtcaatgttatagataacacctggagaggctccaggggggatgtgcctatacttacgaccgaggacgatatggtttcacaaccagcaaagattctgaattttctaagaaaacagaagtataacgcagattacgaactgtccgctaagcagggagcggacacactggcgtatatcgcgctgctcgaagagaagcttttgcctgcagttcttcacaccttctgggtggagtccgacaactattttactgtgacaaagccctggtttgcctcccagattccttttcccttgagcctgattcttcccggtaggatgagtaagggcgcacttaaccgaattctccttacgagaggccaaccacctctgtaccatctgcgcgaagtggaagcacagatctatcgcgatgccaaggagtgtttgaatcttttatctaatcgcttgggtacttcccagtttttttttggtgataccccaagtactctggacgcctacgttttcggatttctggcacctctgtataaggtgagatttcccaaagtgcaattgcaagaacacttgaaacagctgagtaatttgtgcagattttgtgatgacatcctcagtagttatttcagactgagcctgggtgggatctctcctgccggtcaggagaccgtggacgcgaacttgcagaagctgacacagctggtaaataaggagtcgaatttaatcgaaaagatggacgataatctgcggcagagcccccagcttccaccgagaaagcttccaacgctgaagctgacgcctgccgaggaggagaacaactcctttcagcggctctccccctag

SEQ ID NO: 51697 - DNA, 756 bp, Artificial Sequence
  Description of Artificial Sequence: Synthetic coding sequence
atggttagtcagcctgccaaaatcctgaactttctccgaaaacagaagtacaatgctgactacgaactttctgctaaacagggcgctgacaccctcgcttacatcgccttactggaggagaagttgcttcccgctgtgctccacactttttgggttgagtcggataattatttcactgtgaccaagccctggtttgcttctcaaattcctttcccattatcactcatactgcccggacgcatgtctaaaggggctttaaaccgtattctgttgacacggggtcaaccccctctctaccatctgagggaggttgaagcccagatttatagagatgctaaggagtgcctgaacctcttgtccaatagattgggcacctctcagttcttcttcggagatacgccttccaccttggatgcctacgtttttggtttcctggcaccgctctacaaggtccgctttccaaaggttcagctccaggagcatctgaaacagttgtccaacctttgcaggttttgtgacgacattctgtcttcttatttcaggctgtccctgggaggcatatctcccgctgggcaggagacagtcgacgctaacttgcagaaattgacacaactggtgaataaagagagtaatctgattgaaaaaatggacgacaatttgaggcagtctccacagctgcccccaagaaaattgcctactctgaaactcacgccagccgaagaagaaaataacagtttccagcgcctttcaccttag

SEQ ID NO: 51698 - DNA, 1008 bp, Artificial Sequence
  Description of Artificial Sequence: Synthetic coding sequence
atggcagccccatctggcgttcatctgcttgtgaggagaggtagccatcgcatcttctcctccccacttaaccatatctatcttcacaagcagtcatcctctcaacagaggaggaatttcttctttagacgccagagagacatctcccactctatagtcttgccagctgccgtttcctccgctcacccagttcccaaacacatcaagaaacctgattatgtgacgacaggcatcgtccccgattggggggattctatcgaggtgaagaatgaagaccaaatacaagggctgcaccaggcttgtcagcttgcaagacacgtacttttacttgccggtaaatctctgaaggtggacatgacaaccgaggagattgatgccttggttcaccgggagatcatctcccataacgcttacccttctcctttgggttatgggggatttccaaagtctgtttgcacaagcgtcaataatgtgttgtgtcatggcatacctgactcaaggcctctccaggatggggatatcatcaatatcgatgtcacagtttattataacgggtatcatggagacacctctgagactttcttggtaggcaacgtggacgagtgcgggaaaaagctcgtggaagtagcacgacgatgtcgtgacgaggcgatcgctgcctgcagagcgggtgcccctttctcagtcatcggcaataccatttctcacattacgcaccagaacggattccaagtctgccctcatttcgtgggccacggaattggctcatactttcacggccatcctgagatttggcatcacgctaacgatagcgacctgcccatggaggaagggatggccttcacaattgaaccaatcattactgagggctcccctgagtttaaagtgctcgaagacgcctggacggttgtgtcactggataatcaaagatcagcccaatttgagcacaccgttcttataacctctcgtggggctcagatccttaccaagctgcctcatgaggcctag

SEQ ID NO: 51699 - DNA, 747 bp, Artificial Sequence
  Description of Artificial Sequence: Synthetic coding sequence
atgaagccagctagtataagcgaggaagagcttcttaacctcattaacaaactgaacaatgacgataacgttgacggtctgttggtgcagctccctctaccagagcacattgatgagcgccgaatttgtaatgcagtctctccagacaaagatgtggacggattccacgtgatcaacgttggccgaatgtgccttgaccaatacagcatgctccccgctacgccctggggagtgtgggaaattatcaaacggacaggtatcccaactctcggcaagaatgtggtggttgcaggtcggagtaaaaatgtaggtatgcctattgctatgctcctccacaccgatggggctcacgagcgcccaggcggtgatgcaacagtcacaataagccaccgctacacaccaaaagagcagctgaaaaagcacaccatcctcgccgatattgtgatctctgccgcaggcatccctaatctcattactgccgatatgatcaaggagggagccgctgtgatcgacgtggggatcaaccgtgtgcacgaccctgtgacagctaaacctaagcttgttggtgatgtggactttgagggcgtccgccagaaagcaggatacatcacgcctgtgccagggggtgtcggtccaatgaccgtcgctatgctgatgaagaataccattatcgcagcgaaaaaagtactgcgcctcgaagagagggaggtgttgaaatcaaaagagttaggcgtggctactaactag

SEQ ID NO: 51700 - DNA, 561 bp, Artificial Sequence
  Description of Artificial Sequence: Synthetic coding sequence
atgtgtctcgatcagtattctatgctgcccgctactccctggggcgtttgggagattattaaaaggacgggcatccctaccctcggtaaaaatgtcgttgttgccggtcgcagcaaaaatgtcggcatgcctatcgccatgctcttacacaccgatggggctcatgaacgccctggaggggacgctaccgtgactattagccacaggtatactcccaaggagcagctcaaaaagcacactatactagcggatatcgtgatcagtgccgcaggaatccctaacctgataactgcagatatgatcaaggagggggctgccgttattgacgtgggcattaatagggtacacgatccggtcaccgctaaaccaaagctggtgggagatgtcgactttgagggtgtacgccagaaggccggatacattacacctgtgcccggaggcgtggggcctatgactgttgctatgttgatgaaaaatacaattatagctgctaaaaaggtgttgcgattagaggagagggaggttctcaagagcaaagaactcggagtggccacaaattag

SEQ ID NO: 51701 - DNA, 1053 bp, Artificial Sequence
  Description of Artificial Sequence: Synthetic coding sequence
atggcggctaccagcctgatgtccgccctcgccgctaggctgttgcagcccgcacactcttgctcactgaggctgcgcccattccatttggccgcagtgaggaacgaggccgtggtgatttccggaagaaagctcgcccagcagatcaaacaagaggtgcgacaggaggtggaagagtgggttgccagcggcaacaaacggccacacctctctgtgattttggtcggagagaaccctgcctcacactcttatgtactgaataaaactcgggcagcagccgttgtaggcatcaacagtgagaccataatgaaacctgcttcaatatcagaggaggagctgcttaaccttattaataaactcaataatgacgataacgtggacggcctcctggtgcagctccccctgccagagcacattgatgaaaggcggatttgcaacgccgtgagcccagataaagacgtggatggttttcacgtgattaacgtaggacgcatgtgtttagatcaatattccatgctgcccgctactccctggggagtgtgggagatcataaagaggaccgggatcccaacacttggcaagaatgtagtagtggctgggcgttccaaaaacgttggcatgcccatcgctatgcttctacacaccgacggggcacacgaaagacctggcggagacgccaccgtaactatctcccataggtataccccgaaagaacagcttaagaaacacacaattttggcggacattgtgatctcagcggcagggattcccaatctgatcacagccgacatgattaaagagggtgccgctgtaattgacgtcggcattaaccgagtgcacgaccctgtaacggcaaagcctaagctggtgggcgatgttgattttgaaggcgttaggcagaaggcaggttacataacccccgtgcccggaggcgttggtccaatgactgtcgcaatgctgatgaagaacactattattgccgctaagaaagtcctgcgcctagaagaacgtgaagtgctcaagagcaaggagctgggagtcgcgacaaattag

SEQ ID NO: 51702 - DNA, 882 bp, Artificial Sequence
  Description of Artificial Sequence: Synthetic coding sequence
atggccaccaacgaatccgtttcaattttttcttcagcgtccctcgccgtggaatatgtggatagcttgcttccggaaaaccctctgcaagagccattcaaaaatgcctggaactacatgctgaacaattataccaaattccaaattgcaacctggggaagcctgatcgtgcacgaggctctctattttttgttctgtctgcctggtttccttttccagtttatcccttacatgaaaaaatacaagatacagaaggataagcccgagacctgggagaaccagtggaagtgtttcaaagttctgctgtttaaccacttttgcattcagttgccactaatctgtggcacgtattattttaccgaatatttcaatattccctacgattgggagcgtatgccaaggtggtacttcctgcttgcgaggtgtttcggctgcgccgttattgaagacacatggcattattttttgcaccgtctcttgcaccacaaaagaatctataagtacattcacaaagtccaccatgaatttcaggcgcctttcggtatggaagctgagtatgcccatcccctggagacactgattctgggcactggcttctttatcggcatcgttctgctgtgcgatcacgtgatcttattatgggcctgggtcactattcggcttctcgagaccattgacgtccactcaggttacgatattcccctgaaccccctcaatttgattcctttctacgccggaagtagacatcatgactttcaccacatgaacttcataggcaactatgccagtacattcacatggtgggatcggatcttcggcactgactcgcagtacaacgcgtacaatgaaaaacgcaagaaattcgaaaaaaaaaccgaatag

SEQ ID NO: 51703 - DNA, 489 bp, Artificial Sequence
  Description of Artificial Sequence: Synthetic coding sequence
atgcccaggtggtatttcctgctcgccaggtgttttggatgtgcagtcatcgaggatacatggcattactttctgcatcggcttttgcaccacaagagaatttataagtatattcacaaagttcatcatgagtttcaggctccattcgggatggaagctgagtacgcccacccccttgagacactgattcttgggaccgggttcttcatcggcattgtcctcctatgcgatcatgtcattctgctgtgggcctgggtgaccataaggcttctggaaactattgacgttcactctgggtatgatatacccctgaatcccttgaacctgatccctttttatgccggttctaggcaccatgacttccaccacatgaattttattggaaactatgctagcacgtttacctggtgggatagaatatttggtaccgatagccagtacaacgcctacaacgagaagagaaagaaatttgagaagaagacggagtag

SEQ ID NO: 51704 - DNA, 258 bp, Artificial Sequence
  Description of Artificial Sequence: Synthetic coding sequence
atggcgaccaatgagtctgtctctattttctcctccgccagcctcgctgtggaatacgtggactcactacttccagaaaatcctctccaggagccattcaagaatgcctggaactatatgctgaataactacactaaatttcaaatcgccacctggggcagtctcatagtccatgaggctttgtacttcctgttctgcctgccaggcttccttttccagttcataccctacatgaagaagtataagattcagaagtag

SEQ ID NO: 51705 - DNA, 663 bp, Artificial Sequence
  Description of Artificial Sequence: Synthetic coding sequence
atggctactaatgaaagtgtgtcaattttctcaagcgcttctctggccgtggagtacgtggattctctgctccctgagaaccctctgcaggagcctttcaagaacgcctggaactacatgctgaataattacactaaatttcaaattgcaacttggggctcactcatcgtgcacgaagcgctttacttcttgttttgcctgcccggatttctttttcagttcattccgtatatgaagaagtataaaatccagaaggataagccagaaacttgggagaaccagtggaaatgcttcaaagttctcttattcaatcacttttgcatccaactccctttaatatgcggtacctactactttactgaatacttcaatattccatacgactgggaacgaatgcctagatggtatttccttctggctcgatgcttcggctgtgctgtaattgaggacacatggcattacttcctacatcgactgcttcaccacaagcgcatttataaatatattcacaaagttcatcatgagttccaggcgccatttgggatggaagccgaatacgcccaccctttagagacacttattctcgggactggcttcttcattggaattgtgctgctgtgcgaccacgtgatccttctgtgggcctgggttactattcgttag

SEQ ID NO: 51706 - DNA, 723 bp, Artificial Sequence
  Description of Artificial Sequence: Synthetic coding sequence
atggccgctctcagacgaatgctgcaccttccttccctgatgatgggaacatgtcgtccgtttgcaggatcccttgcagattcatgcctggctgatcgctgcctgtgggatagactgcatgcgcagccacgactgggcacggtccctacatttgactggttctttggatatgatgaagtgcagggcctccttctccctctcttgcaggaagctcaggctgcgagcccccttagagtgctggatgtgggttgtggcacatccagcctgtgtacaggcctgtataccaaaagcccacaccctgtagacgtgctgggcgtcgatttctcgccagtcgccgtcgcccacatgaattctctattggaaggcggaccgggtcagacccctctgtgtccaggccaccctgctagcagtctccacttcatgcatgccgatgcccaaaacctcggagcagtggcctcatccgggtcgttccagctgcttctggacaaagggacctgggacgcagtcgccagggggggactgcctcgcgcttatcagttgctgtctgagtgcctgagggtcctgaatcctcagggcactctcattcagtttagcgatgaggatccagatgttcggctgccttgtctagaacaggggagttatgggtggaccgtaactgtacaggaactcggtccttttagagggattacctactttgcgtacttgattcaagggtcccactag

SEQ ID NO: 51707 - DNA, 657 bp, Artificial Sequence
  Description of Artificial Sequence: Synthetic coding sequence
atggctctggtaccttatgaggagaccacagaatttggtctgcagaaatttcacaaaccccttgcgacattcagctttgctaatcataccatacaaataaggcaggactggcggcatctgggcgtcgccgctgttgtctgggacgctgcaattgtgctgtcaacttatctggagatgggggcagttgagctcagaggacgctccgctgtggagctcggggcaggaactggcctcgtgggcatagtggccgcattgttaggggcacatgttactatcactgacaggaaagtcgcactggagtttcttaaatcgaacgtgcaggccaatctgccaccccacatccagaccaagacagttgtcaaagaactcacttgggggcaaaatctgggaagtttctctccaggagaatttgatctgatcctaggcgcagacatcatctatcttgaagaaactttcacagatctgctccagaccttggagcatctttgctccaaccactctgtgatcctgctggcatgccgtatccggtacgagagagacaacaactttttggctatgcttgagcggcaatttactgtacggaaggtgcactacgaccccgagaaagacgtgcacatttacgaggctcagaagcgtaatcagaaggaagacttgtag

SEQ ID NO: 51708 - DNA, 657 bp, Artificial Sequence
  Description of Artificial Sequence: Synthetic coding sequence
atggccctggttccgtatgaggagacgaccgagtttggtctgcaaaaatttcacaaacctttagcgacattctcttttgccaaccacacaattcagataagacaagactggaggcacctgggcgtcgccgcagtcgtgtgggatgcagcaattgtcctgagtacttacctggaaatgggagcggttgagctgcggggaaggtcggcagtcgaattgggagcaggcaccgggcttgtgggcatcgtcgcagccctcttgggtgcacacgtgactattacagaccgcaaagtagccttggaatttctcaagtcaaacgtgcaggctaacttgccaccccatattcagaccaaaacagtggtcaaggagctgacctgggggcagaacttaggatccttttctcctggcgaatttgatctcatacttggcgcagacattatctatctagaagagactttcaccgaccttctgcagactcttgaacatctttgttcaaatcattcagttattctgcttgcttgtcggattcgatatgagcgagacaataactttttagctatgttagagagacaatttacggtgcggaaagtgcattacgacccagaaaaggatgtgcatatctatgaagctcagaaaaggaatcagaaggaagacttgtag

SEQ ID NO: 51709 - DNA, 273 bp, Artificial Sequence
  Description of Artificial Sequence: Synthetic coding sequence
atggcactcgtgccatatgaggaaacaactgaattcggcctgcaaaagttccataagccactggccacattctcctttgctaaccacacaatacagattcgtcaagattggaggcacctcggggtggctgccgtcgtctgggacgctgctatcgtcttgagtacgtacctggagatgggtgcggtggagctgaggggcagaagcgcagttgaactgggcgcaggcactggactggtcggtatcgttgctgctctgctgggcggtggtatctag

SEQ ID NO: 51710 - DNA, 657 bp, Artificial Sequence
  Description of Artificial Sequence: Synthetic coding sequence
atggccttagttccatacgaagaaactacagagttcggactgcagaagttccacaagcctctggccacattcagttttgccaatcatacgatccaaatccggcaggattggcggcacctcggggtagccgcagttgtgtgggatgctgctatcgtcctatccacatacctggagatgggcgctgtagaactgagaggcaggtctgctgtggagcttggagccggaaccgggctagtgggaatagtggctgcactgcttggcgctcatgtgaccataactgataggaaggtggctctggagtttctgaaatctaacgtccaggccaacctcccaccgcacattcagacaaagacagttgttaaagagctcacctgggggcaaaatctcgggagcttttcccccggagaattcgacctgatcttgggagccgacataatttacctggaagagaccttcacggatctgctacagacactagaacatctctgcagcaaccatagtgtgatcttgttagcctgcagaataagatacgagagagataataactttctagccatgttggagcggcagtttacggtgagaaaggtgcattacgatcctgaaaaggatgtgcacatttacgaggcccagaagcggaaccagaaggaggacctttag

SEQ ID NO: 51711 - DNA, 657 bp, Artificial Sequence
  Description of Artificial Sequence: Synthetic coding sequence
atggccctcgtgccatacgaggagactactgagttcgggctgcagaagtttcacaagccactggctactttcagcttcgctaatcacactattcagatcaggcaggattggcggcatttaggggtcgccgcagttgtgtgggatgctgcgattgtcttgtccacttacctggaaatgggcgcagtggagttgcgaggaaggagtgccgtcgagcttggcgcaggaacaggccttgtaggaatcgtggccgcactgcttggtgcgcatgtcaccataactgaccgtaaggtcgctcttgaatttctcaagtcaaatgtgcaggccaatctgccgccacacatccagaccaagactgtggtaaaggaactcacatgggggcaaaacctggggagctttagccctggggagtttgatttgatcctgggggctgatatcatctacttggaggaaacctttacggaccttctacagactttggagcatctgtgttcaaaccactctgtaattctcctggcgtgcaggattaggtatgagcgtgacaataattttcttgcgatgttggagcgccagttcacagtgcggaaggtgcattatgatccggaaaaggacgtccacatttacgaggcccagaaacggaaccaaaaagaagatttgtag

SEQ ID NO: 51712 - DNA, 657 bp, Artificial Sequence
  Description of Artificial Sequence: Synthetic coding sequence
atggccttggtgccctacgaagaaaccaccgagttcggactgcagaaatttcacaagcccttggctactttttcatttgcaaaccatactattcagatcagacaggactggcgccacctgggggttgcggcagtcgtgtgggatgcagcgattgttctgagtacatacctggagatgggggcagtggaattgcggggacggtccgcagtcgaactgggtgcaggaacagggttggtgggaatcgtcgctgctttactcggggcacacgtcacgatcactgatagaaaggtcgctctggagttcctgaagagcaatgttcaggcaaatctgccaccccacattcagaccaagaccgtagtgaaagaactaacttggggacagaatctgggatccttttcacccggtgagtttgatctcatcctgggggctgacattatctaccttgaggagaccttcacagatcttttacagactctcgagcatttatgctctaaccactccgtgatcttactcgcctgcaggatcaggtacgagcgagacaataattttctagcaatgctagagcgtcagtttactgtgaggaaggtgcactatgatccggaaaaggacgtgcatatttatgaggctcagaagaggaaccagaaagaagacctctag

SEQ ID NO: 51713 - DNA, 273 bp, Artificial Sequence
  Description of Artificial Sequence: Synthetic coding sequence
atggccctggtgccctacgaggagacaactgaattcggacttcaaaagtttcataagcccctggctacattctccttcgctaaccacactatccagattagacaggactggagacaccttggagtcgccgcagtcgtttgggatgcagctattgttctcagtacctatctggaaatgggggctgtggaacttcgcggtaggagcgccgtggagctgggggcaggaactgggttagtggggatagtggccgctctattgggcggaggaatctag

SEQ ID NO: 51714 - DNA, 681 bp, Artificial Sequence
  Description of Artificial Sequence: Synthetic coding sequence
atggccgacccgggacctgacccggaatctgaaagcgagagcgttttcccgagggaagtaggcttgttcgccgattcttacagcgagaaatcccagttctgtttctgtgggcatgtactgacaattacccagaatttcggctccaggttaggcgtggccgctcgtgtgtgggatgcagccctctccctctgtaattatttcgaaagccagaacgtggactttcggggtaagaaagttatcgagctcggcgcaggaaccggcattgtgggaatactcgcggctctgcagggcggagatgtaacaatcacagatcttccactcgcactcgaacaaatccagggaaatgtgcaagcaaacgtgccagcaggaggccaggcacaggtgcgggcactcagttggggaattgaccaccacgtgttccccgcaaattatgatctggtgcttggcgcagatattgtatacttagaacctaccttcccccttttactgggaacgctgcaacacctgtgccggccacatggcactatatacctcgccagtaagatgcggaaagagcacggcaccgaatctttcttccagcacctgctgccccagcatttccagctagagctggcgcagcgggacgaggacgaaaatgtcaatatataccgggctcgtcatcgagaacccagacccgcttag

SEQ ID NO: 51715 - DNA, 450 bp, Artificial Sequence
  Description of Artificial Sequence: Synthetic coding sequence
atggccgacccaggccctgaccccgagagtgaaagcgaaagcgtttttccgagagaagttggtttgtttgctgactcgtattccgaaaaaagccagttctgcttttgcggtcacgtgcttaccattacccagaacttcggatcacggcttggtgtcgcggctagagtctgggacgccgctctttctctgtgtaattattttgagtcccagaacgtggactttcggggtaagaaagtgatcgagctgggcgctggtactggcatcgtggggatcctggccgctctgcaaggggcttatggacttgttagagaaaccgaagacgacgtaattgagcaagaactttggagggggatgaggggggcatgtggccatgctctgtcaatgagcaccatgacaccctgggagtccataaaaggctcttcagtgagagggggatgttaccaccactag

SEQ ID NO: 51716 - DNA, 810 bp, Artificial Sequence
  Description of Artificial Sequence: Synthetic coding sequence
gctagatgccagttctgcgcctgcgagtcactgtccccttgctcaggcctgtctagtttagcagcccgtcaaggataccatcagatatgggccttcccttttctcccttctggagccactgcaacatggccagcagcgtctcgatccagaagcctggctgcgaggtctcttcctaggtcaccggctcgccctggcccaaacgacgccctgttgggggaacatgatttcaggggacaaggagttcgcgcacagcggttcaggttctctgaggagccgggacctggggcagatggcgctgtgttagaggttcacgtcccacagataggggctggagtgtcgctccctggaattctcgccgcaaaatgcggagctgaggtcattctaagcgattcgagcgaattgccgcactgtcttgaggtatgtcgccagagttgccaaatgaacaatctgcctcatctccaggttgtggggctcacgtggggacacatatcctgggatctgctggccctgccgccacaggacatcatcctagcctcggatgtattttttgagccagaagattttgaggacatactggcaactatatattttttaatgcataaaaacccaaaggtgcagctttggtccacatatcaggtccgaagtgccgattggagtctcgaggcccttttgtacaagtgggacatgaagtgcgtacatatccccctggaatctttcgatgcggacaaagaagatatcgccgagtcaacgttgccaggtcgccacaccgttgagatgctcgttatcagctttgccaaggactctctatag

SEQ ID NO: 51717 - DNA, 573 bp, Artificial Sequence
  Description of Artificial Sequence: Synthetic coding sequence
atgtacgtttggccctgtgcagtggttctggctcagtatctctggttccatcgtagatctctccccggaaaggctatccttgaaatcggcgctggggtatctctgcccggtatactggccgctaaatgtggcgcagaagtgattctgtccgactcctcagagctgccacattgtttggaggtttgccggcagtcttgccagatgaacaacctaccacacctgcaagttgtaggactgacttggggccatatcagctgggaccttctggctctgcctccacaggatatcatcctggccagtgatgtttttttcgaacctgaagactttgaggatatcttggccaccatatacttcctcatgcataaaaacccaaaggtccagctatggtcaacttaccaggtccgcagcgcagactggtcactggaggctttactctacaagtgggatatgaagtgcgtgcacatccctttagaatctttcgatgcagacaaggaagacattgccgagtccaccctgcccggacggcatacggtagaaatgttggtgatctcttttgctaaggatagcttgtag

SEQ ID NO: 51718 - DNA, 372 bp, Artificial Sequence
  Description of Artificial Sequence: Synthetic coding sequence
atgaacaaccttccgcatctacaggtcgttggtctgacttggggacacatctcctgggatctcctagcgctgcctccccaggatatcatcttggcgtctgatgtgtttttcgaacctgaggactttgaggacatccttgccacaatttacttcctgatgcataaaaaccctaaggtccagttgtggagcacctaccaggtacgttccgctgactggtctctggaggctctactctacaagtgggacatgaaatgtgtccacatccccttggagagttttgatgctgacaaggaagacatagctgagtccacattgcctggtagacataccgttgaaatgttagtcatcagtttcgctaaggattcgctctag

SEQ ID NO: 51719 - DNA, 372 bp, Artificial Sequence
  Description of Artificial Sequence: Synthetic coding sequence
atgaataacttaccccatcttcaagttgtcggactgacgtggggacatatttcatgggacctgctggccctgcctccacaggatatcatccttgcctccgacgtgtttttcgagcctgaggatttcgaagacatattagccacgatatacttcctcatgcacaaaaaccctaaggtccaactgtggtcaacctatcaggtgagatctgctgattggtccctggaagctctgttgtacaagtgggacatgaaatgcgtgcacatcccactagaaagtttcgatgccgacaaagaagatatagccgaaagtaccctgccaggacgccatactgtcgagatgctggtgatcagctttgcaaaggactccctgtag

SEQ ID NO: 51720 - DNA, 372 bp, Artificial Sequence
  Description of Artificial Sequence: Synthetic coding sequence
atgaataacctgccacaccttcaggtggtcggcctgacatggggacacatctcatgggatctgcttgccctccctccacaagacattatactggcgtcagacgtattttttgagccagaagactttgaggatatcttggcgaccatctatttcctcatgcataagaatccaaaggtccagttgtggagcacctatcaagttcgcagcgcggattggtctcttgaggcacttctgtacaaatgggacatgaagtgtgtgcacatcccactcgaaagcttcgatgctgacaaagaggatatcgcagaaagtactcttccaggccgtcacactgtggagatgcttgtaataagcttcgcaaaggattccctctag

SEQ ID NO: 51721 - DNA, 2715 bp, Artificial Sequence
  Description of Artificial Sequence: Synthetic coding sequence
atggccgctattagagcgctacaacaatggtgtcgccagcagtgtgagggatatagagacgtgaatatttgtaacatgacgacttccttccgcgatgggctggccttctgtgctatccttcatagacatcggccagatttgatcaacttcagtgcccttaagaaagagaacatatacgagaataataaactggcctttagggtcgctgaagagcacttgggaataccagccctattggacgcagaggacatggttgcactcaaagtccccgatcgattgagtattctgacgtatgtcagtcaatactacaattattttcatggaaggtccccaatcggcggaatggccggagttaaacgtgcatctgaggattctgaggaggaaccttccgggaagaaggccccagtacaggccgcaaagttacctagtccagccccagctaggaaacccccactctctcccgctcagactaatcctgtggtacagcgcagaaacgaaggcgctggcggtccacccccaaagaccgatcaggctctcgctgggtctttagtgtcctcaacatgcggtgtttgtggaaaacacgtccacttagtgcagcgacaccttgcagatggacggctgtaccaccgctcttgcttccgctgcaaacagtgctcatgtacacttcacagcggcgcttataaggcgaccggcgagccagggaccttcgtctgtacatcacacctgcccgctgcagcatctgcaagcccaaagcttactggtctggtcccccgtcaacctggcgctatgggtgtggacagccggacaagctgctctcctcagaaagctcaggaggcaaacaaggcaaggccgtccgcctgggagcctgcggctggaaatagcccagcacgtgcctcggttcccgcagccccaaatccagccgctacctccgctaccagcgtccatgttcggagccccgcacgcccaagcgaaagccggttggcacccacacccacggaaggcaaagtccgccctagagtgacaaattctagtccaatggggtggtcatctgccgcaccctgcacagctgctgctgcctcgcaccccgctgtgcctccctcagcacctgaccctcggccagcaacacctcagggaggtggggcaccaagagtcgccgctccacagaccaccttgtccagtagttcaacatctgccgcaacagtcgacccacccgcatggaccccatcagcttcgagaacccagcaggctaggaataagtttttccagacttcggccgtccctcccggaaccagcttgagcggtaggggaccgaccccctctctggtgctgtcgaaagactccagtaaggaacaggcacggaacttcctcaagcaggccctgtctgctctagaggaggctggcgcacccgctcctggcaggccatccccagctaccgcagccgtgccctcctcccaacctaagaccgaggcacctcaggcctcccctctggcgaaaccactacaaagctcgtcacccagagttttgggcttgccgagccggatggagccccctgcacccctgtctaccagctcaaccagccaggcaagcgctcttccaccagccggacgacgcaacctggccgagtccagcggggtaggacgggtaggcgctggatccaggcccaagcccgaggctcctatggccaagggcaaatccacaactctgacacaggatatgagcacctctctacaggaagggcaagaagatggacccgcaggctggcgagccaatctgaagcccgtggatcggagatctcctgcagaacggacactgaaacctaaagaaccgcgtgctttggccgagcctagagccggtgaagctccacgaaaggtgtcaggctcttttgcgggttccgtgcacattactctgacccccgtcagaccagacaggactcccaggcctgccagcccagggccaagcttgcccgcaaggtctccatctccccctagacgcagaagacttgccgtgcctgcaagcctggacgtctgcgacaactggctgcgacctgagcccccaggacaggaggccagggtgcaatcctggaaggaggaagaaaagaaacctcatctccagggtaaacccggacggccactctcacccgcaaacgttcccgctctgcccggtgagacagtgacctctccggtgaggctccatcccgattatctgagccctgaagagattcagaggcaacttcaggacattgaaagacggctcgacgccttggagctgcgcggagttgaactcgagaaacgattacgggctgctgaaggagatgatgctgaagacagccttatggtggactggttctggctgattcacgagaagcaactactgctgcgccaggagagtgagttgatgtataagtccaaggcccagagactggaggaacagcagttagatattgagggtgaactccgcaggcttatggcaaaacccgaagccctgaaaagtctgcaggagagacggcgagagcaggagctcctcgagcagtatgtgtctaccgtgaacgatcgttcggacatcgtcgatagcctggacgaggaccggttacgggagcaggaggaggaccagatgcttagagacatgatcgaaaagcttggattgcagcgcaagaagtcaaaattccgcctctccaagatctggtcccctaagtccaagagctctccatcacagtag

SEQ ID NO: 51722 - DNA, 2079 bp, Artificial Sequence
  Description of Artificial Sequence: Synthetic coding sequence
atggctgcaatcagagcattgcagcagtggtgcaggcagcaatgcgagggctacagagacgtgaatatttgtaacatgaccacccacctcccagccgctgccagtgcttcccctaagttgaccggtctggtgcccaggcagccaggagcaatgggtgtggactctaggacttcttgttctccgcagaaggctcaggaagcaaataaagcacggccatctgcttgggagccagctgccggaaattctcctgcccgtgccagtgtgccagccgcaccgaacccagccgctactagcgcaacctctgtgcatgtacgatcccccgcacgcccttccgaaagccgactcgcacccacacctactgaagggaaagtaaggcctcgagtcaccaattcatcgccaatggggtggtcatcagccgctccttgtactgcggctgctgcctctcaccccgcagtgccgccatcggcccctgatcctcgacctgcgacccctcaggggggaggagcccctcgcgtcgccgcaccccagactaccctctcgtcatcttccacctccgcagctaccgtcgacccccctgcctggacccctagcgcttccagaacacagcaagcacgcaacaagttctttcagacaagcgccgtcccccctggcacctcattgtctggccgtggtccaacccctagcctcgtgctctccaaagattccagcaaggaacaggctaggaattttcttaaacaagctttatccgcgctcgaggaggcgggagctccggcacctggacggccatcccctgcgaccgctgccgtgccatcatcgcagccgaagacggaagccccacaggcgagccctctggcgaagccacttcagtcatcctcgccgagggttctgggattacccagtaggatggagcccccagctccactctcaacctctagcactagccaagcgagcgctttaccgccagctgggagaaggaaccttgctgaatcgtctggcgtcggcagagtgggcgctgggtcccgtccaaaaccggaggcaccaatggctaagggaaagtccaccaccttgacacaggacatgtctacttctctccaggaaggtcaggaggatggtcccgctggttggcgcgctaaccttaagccagtggacaggcggtcaccagctgaacggactcttaagcctaaggagccacgcgctctagccgaacctcgcgcaggagaagcacctcgcaaggtgagcggctcctttgctggttctgtgcacatcacactgacacctgttcgcccagatagaaccccgaggcctgcaagcccaggaccctccctcccagctcgtagcccctccccccctagaagaagacggctagctgtccccgcttcactcgacgtgtgcgacaactggctccgtcccgaacctccagggcaagaggccagggtccaaagctggaaagaagaagaaaagaaaccccacctccagggaaaaccaggcagacctctctcccctgccaatgtgccagctcttccaggcgagactgtaacgtcccctgtgaggttgcaccccgactacctgtcgccagaagagatccagaggcagctccaggacattgaacggaggctggatgcgttggagcttcggggagtagagctggaaaaacggcttcgtgcggcagagggagatgacgccgaggactccctgatggttgactggttctggctgatccacgaaaagcagctcctcctgcgccaagagtccgaactgatgtacaaaagcaaagcccagcggctcgaagaacagcagttagacatcgaaggcgagttgcgccgtctaatggcaaagccggaagcgctcaagagtctccaggaaagacgcagggaacaggagctgctggagcagtacgtctcgacggtcaacgaccgtagcgatatcgtggactctctagatgaggatcgattaagagaacaagaagaggatcagatgctgcgcgacatgatcgagaaactgggtttacagaggaagaagagcaagttccgcctatcaaaaatctggtctcctaagagcaaatccagcccttcgcagtag

SEQ ID NO: 51723 - DNA, 1230 bp, Artificial Sequence
  Description of Artificial Sequence: Synthetic coding sequence
atggaccgccttaaaagtcaccttactgtgtgcttcctcccctccgtgccgttcctgattctggtgagcacactggctacagccaagagcgtcacgaattccaccctgaatgggactaatgtcgtgctcggctctgttccggtgatcatcgccagaactgatcacatcattgttaaggagggaaatagcgccctgatcaactgttccgtctacgggatcccggatccacagtttaaatggtataacagcattggcaagcttttaaaagaagaggaggatgaaaaagagagaggcggaggtaaatggcagatgcacgattctggactcttaaacatcacaaaagtctctttctctgatcgcggaaagtatacttgcgtggcttctaacatttacggaacagtgaataacacggtcacccttcgcgttatctttaccagtggcgacatgggcgtatactacatggtcgtgtgtttagttgcctttacaatcgtgatggttctaaatatcacccgcttgtgcatgatgagctctcatctcaagaaaacggaaaaagccattaacgaatttttcagaaccgaaggcgcagagaagctccagaaggccttcgaaattgcaaagaggatccccatcattacatctgccaagacgttagaactagcgaaggttacccagttcaaaacaatggagttcgccagatatattgaagagcttgccagatccgttccactgccccctttgataatgaattgcaggactattatggaagaaatcatggaggtggtgggactcgaggagcagggccagaatttcgtgcgccacacccccgaagggcaggaagccgctgaccgagacgaggtatatacgattccaaatagcctgaaacgcagtgattctccagccgcagacagtgatgcgtcttccctgcatgaacagccgcaacagatcgctatcaaggtctctgtccacccacagagtaagaaggagcacgctgacgaccaggagggcggtcagttcgaagtcaaggatgtggaggagacagaactgtccgccgagcattcaccagaaactgcagaaccatctaccgatgtgacctcaacagaattgaccagtgaagagccgacccccgtcgaggtgcccgacaaggtgcttccaccagcatatcttgaagctactgagccggcagttacacatgataagaatacctgcatcatttatgaaagtcacgtgtag

SEQ ID NO: 51724 - DNA, 921 bp, Artificial Sequence
  Description of Artificial Sequence: Synthetic coding sequence
atgcacgattccggtctccttaatattacaaaggtgagcttcagcgaccgtggtaaatatacttgcgtagccagtaatatctatgggacagtgaataacactgttaccctccgggtgatattcacgtccggggatatgggggtttactatatggtggtgtgcctggtagcgtttactattgtgatggtccttaacattaccagactgtgtatgatgtctagccacctgaagaaaaccgaaaaggctatcaacgagttcttcaggacggaaggggcagaaaagttgcagaaggccttcgaaattgccaagcgcattcctattatcacttcagctaagacactggaattggccaaagttactcagtttaagaccatggagtttgccaggtatatcgaggagctagctcggagcgtccctctccctccactgatcatgaactgtcgcaccatcatggaggaaattatggaggtcgttggtctggaggagcagggacagaatttcgtgcggcataccccagaaggccaggaggcagcagacagagacgaggtgtatactatcccaaactctctgaagcggagcgattcccccgctgccgatagtgatgcttcctccctgcacgagcagccacaacagatcgctattaaagtgagcgtgcatccacagtctaagaaagaacatgcagatgatcaggagggaggacagtttgaggtcaaggatgtcgaagagaccgaactatctgcagaacactccccggagaccgctgagcccagtaccgacgtaacatctacggagttgaccagtgaggagcccacgcctgttgaggtgcctgacaaggtgctccctcctgcttacctggaagctaccgagccagccgtgacacatgacaagaacacatgcattatctatgagtcccacgtctag

SEQ ID NO: 51725 - DNA, 195 bp, Artificial Sequence
  Description of Artificial Sequence: Synthetic coding sequence
atgcacgattccggactcctgaacatcactaaggtatccttttcagaccgcggtaagtacacttgcgtggccagcaacatatacggcaccgtcaacaacactgtgacccttcgggtgatattcactagcggagacatgggggtttattatatggtcgtgtgtctggtggcctttaccatagtcatggtgctttag

SEQ ID NO: 51726 - DNA, 297 bp, Artificial Sequence
  Description of Artificial Sequence: Synthetic coding sequence
atggatcgactgaagtcgcatctcacagtgtgcttcctcccctccgtgccatttctgattttggtcagtaccctagccacagcgaaaagtgtcacaaacagtacacttaatggtactaacgttgtactcggaagcgtccctgtgatcattgcaagaacagatcacattatcgttaaagaggggaattcagcattaatcaactgctccgtatatggaatccctgaccctcagtttaagtggtataattcgattggtaaactgctaaaggaggaggaagatgaaaaggaacggggatag

SEQ ID NO: 51727 - DNA, 273 bp, Artificial Sequence
  Description of Artificial Sequence: Synthetic coding sequence
atggaccgccttaaatctcacctcactgtctgcttcctcccatcagtcccattcctgattctagtgtctactcttgctaccgcaaaaagtgtaaccaattcaacactaaatgggacgaacgtcgtgttgggcagtgtaccagtcatcattgcccgaacagatcacattatcgtgaaggaaggcaactcagcccttataaactgttctgtgtacgggatccctgatcctcaattcaagtggtataactcaatcggcaaattgctcaaagagtag

SEQ ID NO: 51728 - DNA, 222 bp, Artificial Sequence
  Description of Artificial Sequence: Synthetic coding sequence
atggacagattgaaatcacacctaacggtgtgtttcttaccctcagtcccgtttctaatcctggttagtacactggccacagcgaagagtgtaacaaatagtaccctgaacgggactaacgtcgtcctgggctcggtgccggtaatcattgccagaaccgaccacatcattgtgaaagagggcaactccgcactaattaactgctctgtctacggcatttag

SEQ ID NO: 51729 - DNA, 474 bp, Artificial Sequence
  Description of Artificial Sequence: Synthetic coding sequence
atgcatgattccggactgctgaacattacaaaagtgagctttagcgacagaggcaaatatacatgtgtggcgtccaatatctacggtaccgtcaacaatacggtgactttaagagtgatatttacctctggtgatatgggagtttactacatggttgtgtgtcttgtggcattcacaattgtaatggtgcttaatatcacaaggttgtgcatgatgtccagtcatctgaagaaaactgaaaaggctatcaatgagttctttcgaaccgagggggctgaaaaactgcagaaggcctttgagatcgccaaacgcatacccatcatcacatcggctaagacattggaattagccaaggtgacccaatttaagaccatggagttcgccagatatatcgaggagttggccagatctgttcctctgccgccactgattatgaactgtaggacaattatggaagaaatcatggaggtctag

SEQ ID NO: 51730 - DNA, 366 bp, Artificial Sequence
  Description of Artificial Sequence: Synthetic coding sequence
atgccttctgataggcctttcaagcaaagaagaagttttgccgaccgctgcaaagaagtccaacaaatcagagaccagcatccctccaagatcccagtgataatcgagcgctataaaggcgagaagcagcttccggttctggataaaactaaatttctggtgcctgaccatgtcaatatgtccgaattagtaaaaattataaggcgcagactccagctaaacccaacacaggccttctttttgcttgtgaaccagcacagcatggtgtctgtcagtacccccatcgctgacatctatgaacaggaaaaagatgaagatggctttctgtacatggtctacgcctcccaggagaccttcgggttttag

SEQ ID NO: 51731 - DNA, 366 bp, Artificial Sequence
  Description of Artificial Sequence: Synthetic coding sequence
atgccttccgaccggcctttcaagcagcggcgttcattcgccgacagatgcaaggaagtccagcaaattagagaccagcatcccagcaagattcccgtgataatcgaaagatacaagggcgaaaagcagctccccgtcttggataagacaaaatttcttgtaccagatcatgtgaacatgagcgagttagtgaagatcattcgcagacggctccagcttaacccaacccaggcgttttttctgctggtcaatcagcatagcatggtttcagtttctacccctatcgctgacatctatgaacaagagaaagacgaggacggctttctgtacatggtgtacgcgagccaggaaaccttcggtttttag

SEQ ID NO: 51732 - DNA, 378 bp, Artificial Sequence
  Description of Artificial Sequence: Synthetic coding sequence
atgaagatgagatttttttcatccccctgcggcaaagccgcagtggaccctgcggatcgctgtaaggaagtgcagcagatccgcgatcagcatcctagtaaaattcctgtgatcattgaaaggtacaagggggagaaacaactgcctgtgctcgataagacaaaattccttgtgcctgaccacgtcaacatgtccgagctggtgaagatcattaggagaaggttgcagctgaatccgactcaggccttctttctcttggtgaaccagcattctatggtcagcgtgtccacacccatcgcagacatctatgagcaggagaaggacgaggatgggtttctgtacatggtttacgcaagtcaggagacttttggattctag

SEQ ID NO: 51733 - DNA, 378 bp, Artificial Sequence
  Description of Artificial Sequence: Synthetic coding sequence
atgcctagtgagaagacatttaagcagagacggacatttgaacagcgcgtggaggacgtgcggttgataagagaacagcacccaaccaaaattccggtgatcattgagaggtacaagggggagaagcagttgccagtgctggacaagactaagtttctcgtgccagaccatgtgaacatgagtgaactcattaagatcatccggaggaggctgcagctgaacgccaaccaagcttttttcttgttggttaacggccactctatggtttccgtaagtacccccattagtgaggtatacgagtctgagaaggacgaagacggcttcctgtacatggtgtatgcctcccaggagactttcggtatgaagctgagcgtgtag

SEQ ID NO: 51734 - DNA, 201 bp, Artificial Sequence
  Description of Artificial Sequence: Synthetic coding sequence
atgagcgagcttatcaaaatcatcagaaggaggctccaactcaatgccaaccaggcgttctttctcctggtaaacggacactctatggtgtcggtgtcaacccccatctctgaggtgtatgagtcggaaaaagatgaggacgggttcttgtacatggtttatgccagccaggaaactttcgggatgaaacttagcgtgtag

SEQ ID NO: 51735 - DNA, 444 bp, Artificial Sequence
  Description of Artificial Sequence: Synthetic coding sequence
atgccccctcctcagaaaatcccctctgtgagaccctttaagcagcggaagagcctggcgatacgccaggaggaggttgctggcatccgagccaaatttcccaacaagatcccggtcgttgtggagagatatccacgggagacctttctgcccccattagataagactaaatttctggtccctcaagagttgacaatgacacagtttctttctataattagaagcagaatggtgcttcgtgcaacagaagctttttatcttttggtgaataataagagcctcgtgtcaatgtcagccactatggcagagatctatcgcgactacaaagacgaagacggctttgtgtatatgacctacgctagtcaagaaacattcgggtgcttggaaagcgcagctcccagggacgggagctccttagaagatcgaccttgcaatccgttatag

SEQ ID NO: 51736 - DNA, 1968 bp, Artificial Sequence
  Description of Artificial Sequence: Synthetic coding sequence
atggccgaactcggcgctggaggggacggtcataggggaggcgacggagccgttcggagcgagacggccccagacagttacaaggtccaggacaagaagaatgccagctctcggccagcctccgctatcagcggtcagaataataatcattccggcaataagcccgatccgcctcctgtgctgcgagtggatgaccggcaaaggcttgctagagagaggcgggaagaacgggaaaagcagctagacccagaccggaggagtgtgtcaaccatgaacctttccaaatatgtagaccctgttatttcaaagcggctgagcagcagctcagccactttgctgaattcgccggatcgcgctcgcaggctgcagctaagtccctgggagtctagcgttgtgaataggttgctcacaccaactcatagtttcctcgccagaagcaagtcaacagcggctctgagcggggaagctgccagttgttctcctattattatgccctacaaggccgcacattccaggaattcaatggataggccaaaactcttcgtaaccccccctgaagggagcagtagacggaggataatacacgggacagcctcttataaaaaggaacgcgagcgcgagaatgtgctgttcctgacgtcagggacccgcagggctgtgtcaccctccaatccgaaagcgaggcagcccgctaggagtaggttgtggcttccgtccaaatcgttaccccatttgccagggacccccaggccaacctcatccttaccacccggttcggtgaaggccgctcctgcacaggttcgccctcccagtcccggaaacatccgtcccgttaagagggaggtgaaagtggagcccgagaaaaaagacccggagaaggaaccacagaaggttgccaacgagccttcccttaagggtagggcccctctggtgaaggtggaggaagctactgtggaagaacgtacacccgcagagccagaggttggcccagctgcacctgccatggctcccgctcctgcaagcgctccagctcctgctagcgccccagctcctgcccctgtacccactcctgctatggtgagcgcaccatcaagcactgtcaacgcatctgcctccgtgaagacaagtgccggaacaaccgatcctgaagaggctactagactcctcgcagagaagagacgtctggccagggaacagcgtgaaaaggaggaacgagagaggagagagcaagaggaattagagcgccagaaacgcgaagagctcgcacaacgcgtggcagaagagaggactaccagaagagaagaagaatctagacggctggaggccgaacaggctcgcgaaaaagaagagcaactgcagcgacaggccgaagagagggctcttagagagagggaagaagccgagagggctcagagacagaaggaggaggaggctagagtgcgggaggaagccgagagggtgcgccaggaaagggagaagcattttcaacgtgaggaacaagaacggctcgagcgaaagaaacgcctggaggagatcatgaagcggacccggaggaccgaagccactgacaaaaaaaccagtgatcaacggaatggggatatagctaaaggtgctttaacaggcggtaccgaagtgagcgcactcccttgtactacaaatgcccctgggaacgggaaacctgtcggttcgccacatgtggtaaccagccaccagtctaaagtgactgttgagagcacaccggatctggagaagcagccaaatgagaacggggtttcagttcagaatgagaacttcgaggagattattaacctgccgatcggttcaaagccatcgcgactcgacgtgactaactccgagagtcccgagattcccctaaaccctatcctcgccttcgacgacgagggaacattaggccctctaccccaggtggacggcgtgcagacccagcagacagctgttgttatatag

SEQ ID NO: 51737 - DNA, 2250 bp, Artificial Sequence
  Description of Artificial Sequence: Synthetic coding sequence
atggcagaactgggcgcaggcggagatggtcatcggggtggcgatggcgctgtccgctccgagacagcccctgactcatataaggtgcaggataaaaagaacgctagctcgcgcccagcgagtgcgatttcaggacagaacaacaaccactcagggaataaaccagatcccccaccggtcctccgtgtggatgacaggcaacgcctagcacgcgagaggcgcgaggagagggagaaacagctggcagccagagagatcgtctggctggaacgtgaagagagggccagacagcactacgaaaagcacctggaagagagaaagaagagactcgaggaacagcgccagaaggaggagcggcgtagggctgctgtggaagagaaacgacgccagcgcctggaggaagataaggaacggcacgaagccgtcgtccggcgaactatggagagatcgcagaaacctaaacagaagcataaccgttggtcatggggcggtagcctgcacggaagcccttcgatccattctgctgaccccgaccgacggagcgtgtccaccatgaacctgagtaaatacgtcgaccctgtgatcagcaagagactgtctagctccagcgcgacccttctgaatagccccgatcgtgcaagacggcttcagctgagtccatgggagtcctctgtcgtcaaccgacttttaacccctacacactctttcttagcgagatcgaagtccactgccgctctcagtggcgaggcggcatcttgttcccctattattatgccgtacaaagccgcacactcgaggaatagcatggataggcccaagctgttcgtgacaccacctgaaggatcatcccgcagaaggataatacacggcaccgccagttacaaaaaggaacgagaacgcgaaaatgtactgtttctaactagcgggacgaggagagccgtaagcccatccaacccgaaggccagacagcctgccaggtctcggctgtggttaccatctaagtcactgccccatctccccggaactccccgacccacaagtagcctacctccaggttccgtcaaggccgctcccgcacaagtgcgacccccttcccctggtaacattcggcctgtgaaaagagaggtaaaggtggagcccgaaaaaaaggacccagagaaggagccccagaaagtggcaaatgagcccagcctcaaggggagggctccactggtgaaagttgaggaagctacggtggaagagcgcacccccgctgaaccagaagtcggtccagctgctcctgccatggctcccgcacctgcctctgctcctgccccagcctctgcgcctgcccctgctccagtccctactcccgctatggtgtccgcgccatcctcaacagtaaatgccagtgcttccgtgaaaactagcgctggcacgaccgacccagaagaagcaacgcgacttctcgccgagaaaaggaggttggcccgtgagcagagggagaaggaggaacgcgagagacgtgagcaggaagagctcgaacgacagaagagggaagaattggcccaacgagtggctgaggagagaacgacgcggagagaggaggagtcccggcgattggaggcggagcaagcgagggaaaaagaggaacaactccagcgacaggccgaagaacgggcactgagagaacgggaggaagctgagagggcccaacgtcaaaaggaggaagaagccagggtccgagaggaggccgaacgcgtccgtcaggaacgtgagaagcactttcagcgggaagagcaggaaaggctagaaaggaagaagaggctagaagagatcatgaagcgtaccagacgcaccgaggcgacagacaagaagaccagtgaccagcgcaatggcgacatagcaaagggagcattgacaggcggtactgaggtgagtgctctcccctgtacaacgaacgcaccagggaatgggaagccggtgggatcccctcacgtggtaacgtcacaccagtcaaaagtgactgttgagtcaacccccgatctcgaaaaacagccaaatgaaaatggcgtctcggtccagaatgaaaattttgaggaaatcattaacctgccaattgggtccaaaccgtcacggcttgacgtgaccaactccgaaagcccggaaattcccctcaatcctatcctcgcttttgacgacgaggggactctaggccctctgccccaggtggacggagtgcagacgcagcagaccgcagaagtgatttag

SEQ ID NO: 51738 - DNA, 1812 bp, Artificial Sequence
  Description of Artificial Sequence: Synthetic coding sequence
atggagagatcacaaaaacccaagcaaaaacacaacagatggtcgtggggcggaagcctgcatggtagcccgtcaatccactccgccgacccagatcggaggtcagtgtccaccatgaatttgagcaagtatgttgatcctgtgatcagcaagcgcctaagctcatctagcgccaccttgctgaacagtccggatcgcgctcgaaggctgcagttgagtccatgggagagcagtgtggtgaaccggctgctcaccccgacacatagcttcctggcaaggtcgaagagcacagctgctcttagtggtgaggccgctagttgcagtcctatcatcatgccatacaaggctgctcactctagaaatagcatggatagaccaaaactgttcgtaactcctcctgagggctctagccgtcgtaggattatccacggaactgcatcctacaagaaagagcgagaaagggagaacgtgctgttcttgacctccgggacccggagagccgtgtcaccaagcaacccgaaagctcgccaaccagctaggtctcgtctgtggctgccgtctaagagcctgccacacctcccgggtactcctcggccaacatcatctctccctcccggatccgttaaagctgcccctgctcaagtgcggccaccttctcccggaaacatacggccagtcaagcgggaagtgaaagtggagcctgaaaagaaggatcccgagaaagaacctcagaaagttgccaatgaaccatccctgaaaggtagggctccacttgtcaaagtggaagaggccacagtggaagagagaacgccagcagagccagaggtgggtcccgcagcccctgccatggcacccgcaccggcatccgctccagcacctgccagtgctcccgctccagcaccagtaccaacccccgctatggtgtccgcaccatcctcaacggtcaatgcatccgcctctgtgaaaactagcgctggcaccaccgatcctgaagaggccaccaggttgcttgctgagaaaaggcgcttagcccgtgaacagcgcgagaaagaggagagggagcggagagagcaggaggagctggaaaggcaaaagcgagaagagctggcacagagagtggccgaggagcggacgacacggcgtgaggaagaaagcaggagactcgaagcagaacaggcgagggaaaaggaagagcagctgcagcgacaggcagaggagagagcgttgcgcgagcgagaggaagcagagcgggcacagagacaaaaggaggaggaggctagggtgcgtgaggaagctgaaagagtgcgacaggagcgagagaagcacttccaaagggaggagcaagagcgcttagaaaggaaaaagcgtctggaggaaatcatgaagaggacccgcagaaccgaggctacagacaagaaaacaagcgatcagaggaacggcgacatcgctaaaggcgctctgactggaggtacagaagtgagcgccttaccttgtacaacaaacgcccctggtaacggcaagcctgttggctcaccccacgtggtgactagtcatcagagcaaagtcactgtggagagtacccccgacctggaaaaacagccaaacgagaatggcgtgtcggtgcaaaatgagaacttcgaggagattatcaacctgcctattggctctaaaccgtccagactggatgtgacaaactccgaatccccagagattccactgaaccccatcttggcctttgacgacgagggaacgctgggccctctgcctcaggtcgacggcgtgcagacccagcagaccgccgaggttatttag

SEQ ID NO: 51739 - DNA, 2205 bp, Artificial Sequence
  Description of Artificial Sequence: Synthetic coding sequence
atgcccggatcagcaacagccctcaggcacgaacggctgaagaagaccaacgctcgtccaatcccactggggctcttcactatcaatgaagaggacgaacagcaaaagaacgggaatagccgcaggccaaaagccccagatagctacaaagtgcaagacaagaaaaatgcaagctcccggccagcatctgccatttctggacaaaacaataatcactcagggaataagcctgatccccctccggtgctgagggttgacgaccgtcagaggcttgcaagggaaagacgggaggagagggagaagcagctcgcagccagggagattgtgtggcttgaaagagaagagcgcgcaagacagcattacgaaaaacacctagaggagcgcaagaaacgcctggaggaacaaagacagaaagaagaaagacgtagggccgctgtggaggagaagcggcgtcagagactggaggaggacaaggaaaggcatgaggcagtggtgaggagaacgatggagagaagccagaagcccaaacagaaacacaaccgctggtcatgggggggtagtctacatggctcaccatctattcatagcgctgcaaggcgccttcagctgtctccatgggaatcatctgtggtgaatagattactgacccccacacatagctttctggcacgctccaagtcaactgctgctttatctggcgaggcggcttcctgcagccccattattatgccatataaagccgctcactccaggaatagcatggaccgaccaaaattattcgtcacgcctccagaaggttccagccggcgacgcattatccacggcactgcctcttataagaaggaaagagaacgagagaatgttttgttcctgacatccgggacaaggagggctgtgtcccctagcaatcctaaggctcggcagcccgctagaagtcgattgtggctgccgtccaaatctctgcctcatttgcctggcacacctcggcctacctcatctctacctccaggatctgtaaaggctgctcccgctcaagtgcggcctccgtcacccggaaacatccgccctgtaaaaagagaggtgaaggtggagccggagaagaaagaccctgaaaaggagccccagaaggtcgccaacgaaccctcactgaagggaagagcaccactggtgaaggttgaagaagccacagttgaggagcgtacgccagctgagccagaagtgggtcctgccgcaccggctatggctcccgctcctgcgtcagccccagctcctgcttccgcgcctgccccagcgccagtcccgaccccagccatggtaagcgcgccttcaagcactgtaaatgccagcgcttcggtgaaaacaagcgccggaaccactgatccagaggaagcgacacggttacttgccgagaaaagaaggttggcgcgagagcagcgtgagaaagaggagagagaacgcagggaacaggaggaactggagagacaaaagcgggaggaactagcccagcgcgtcgctgaggaaagaaccactcgcagggaggaggagtcccggcgactggaagctgaacaggcccgtgagaaggaggaacaattgcagagacaagccgaggaaagggccctccgagagcgagaggaggcggagcgtgcccaaagacagaaagaagaggaggctcgcgtgcgagaggaggcagaaagggttcggcaagaacgggaaaaacacttccagcgcgaggagcaagaaaggttggaacggaagaaaaggcttgaagagattatgaagagaacacggcgaaccgaagcaactgataagaagacaagtgaccaacgcaacggagatatagctaaaggcgctctgacaggtggtacagaagtgagcgctttaccgtgcaccaccaatgcccctggcaatgggaaaccggtaggatcaccacatgtggtgacttcacatcaatcaaaggtgaccgtagagtccacccccgacctggagaaacaacccaatgagaacggtgtgtctgtgcagaatgagaacttcgaggagatcatcaacctgcctattggttcaaagccctcaagactggatgtgaccaactcagagagcccagaaatcccacttaaccctatacttgcctttgacgacgagggcacactgggtcctctcccccaagtagatggcgtccaaacacagcagaccgcggaggttatctag

SEQ ID NO: 51740 - DNA, 2316 bp, Artificial Sequence
  Description of Artificial Sequence: Synthetic coding sequence
atgccgggttccgccacagcactgagacacgagcggcttaagaagacaaacgctcgccctatccccctgggcttatttaccattaacgaggaggacgagcagcagaaaaatgggaatagcaggaggccaaaggctccggactcttacaaggtgcaggataagaagaatgctagcagtcggcctgcatctgctatatcagggcaaaacaacaaccatagcggcaataaaccggaccctccacccgtgctgcgcgttgacgacagacagcgtctcgccagggagcgccgtgaagaacgggaaaagcagctggccgcacgggagatcgtatggctggaaagggaggaacgagctaggcagcattatgaaaaacatctggaggagcgcaagaagcggctggaggaacagagacagaaggaagaacgcagacgggctgctgttgaagagaagcggaggcagaggctagaagaagacaaagaacgccacgaagccgtagtaaggaggacaatggaaaggtcccagaagcccaagcagaaacataaccgttggagttggggaggcagtcttcacggctcacccagtatccattcagccgaccccgacaggcggtccgtgtctactatgaatttaagcaaatacgttgatcctgtgatatccaagaggttgagtagcagttccgcaacgctactcaactcacctgaccgcgcacgacggctgcaacttagcccctgggagtctagcgtggtaaaccgcctcctgactccaacgcacagtttccttgctcggagcaagtcaactgcggctctctctggagaggcagcttcatgctcacccattattatgccatataaggctgcccactcgagaaacagtatggaccgaccaaaattgttcgtgacccctcccgaagggtcctctcggaggcgcattattcacgggaccgctagttataagaaggagcgggagagggagaacgttctattcttgacatctggcactaggagggcagtgtctcccagcaatccaaaagcacgccagcccgcacggtcccgtctgtggttgccctctaagtcactgccgcatctaccagggacgcccaggccaacgtccagtctgcccccaggtagcgtcaaagccgctccagcccaggttcggccaccaagtcctggtaatatcaggcccgtaaagagagaagtgaaggtcgaacctgagaagaaggatcccgagaaagagcctcagaaggtggccaatgaaccaagcctgaagggcagagcaccactcgtaaaggtcgaggaagctaccgtcgaggagcgaacccctgctgagccagaggtcggtcctgcagcccctgctatggctccagctcccgcttctgctcccgcacctgcgtcggcccctgccccagcgccagtgcctaccccggcaatggtctcagccccatcctctaccgtgaatgcaagtgcatcagtgaagacaagcgccggaaccacggacccggaggaggctacaagactactggcagaaaaaaggcggctggcccgtgaacagcgtgagaaggaggagagggaaaggagagaacaggaggaactggaacgtcaaaaacgcgaggagctcgctcagagagttgccgaggagcggacaacccggcgagaggaagagagcagaaggctggaggccgaacaggcaagagagaaggaagaacagttacagaggcaggccgaggagcgcgctctgagagaacgcgaggaggcagaaagagcccaacggcaaaaggaggaggaagcaagggtcagggaggaagctgagcgcgttaggcaagaaagggagaaacatttccagcgtgaagaacaggagcggttggagcgcaaaaaacgcttagaagagatcatgaagcggacgcggagaactgaggctacagacaagaagacctcagaccaaagaaacggggatattgccaagggcgcactgactggcggtactgaagttagcgcgctgccgtgtacaaccaacgctcccggtaatgggaagcctgtaggaagcccccatgtcgtgactagtcaccagtctaaggttacagttgagagcactcctgatctagaaaagcagccaaacgagaatggcgtaagtgtacagaacgaaaacttcgaagaaatcataaatttgcctataggcagcaagccctcacggctggacgttaccaattccgagagtcctgagatccccctcaacccgatcctggcctttgacgacgagggaactctcggacccctcccccaggtggatggagtccagacccaacagactgccgaggtgatttag

SEQ ID NO: 51741 - DNA, 2205 bp, Artificial Sequence
  Description of Artificial Sequence: Synthetic coding sequence
atggaggacacgaagctctattcacctgattcctataaggttcaggacaaaaagaacgcttcttcaagacctgccagcgcgatctctggtcagaataataaccattcaggaaataagcccgatcccccacctgttctgcgtgtggatgaccgacaacgattagcacgagagagaagagaagaaagggaaaagcagctcgctgctagagaaatcgtctggctcgaaagggaggagagggcgagacagcactatgagaaacatctggaggagcgcaaaaaaaggctggaggagcagcgccagaaagaggaaagaaggagagctgctgtcgaggagaagcgcaggcagcgcttggaggaggacaaagagaggcatgaggccgtggttagacgtactatggagcggtcacagaaacccaaacaaaagcacaatagatggagctggggcggatcactgcacggatctccatctatccactctgccgaccctgacaggcggtccgtgagcacgatgaatttatccaaatatgtggatcctgttatcagcaagagactaagctcctctagcgccaccctgttgaactctcccgatcgcgcaagacgattgcagttgtccccctgggaaagttctgttgtcaatcggctgctgactcctacacatagtttcctggctcgcagtaagtccaccgcagcactcagcggagaggccgctagctgttctccaataattatgccctacaaagccgcacacagtaggaactcaatggaccgccctaaactgttcgtcactcctcccgaaggtagtagccgcaggaggatcatccacggtaccgcttcgtataagaaggaacgggagagggagaacgtactgttccttaccagcgggactaggagagcggtgtctccatctaacccaaaggctcggcagcccgcaagatcccgactgtggctgccgagcaaaagtttacctcacttgccagggacaccaagacctactagcagtcttccacccggatccgtgaaagcagctcccgctcaggtgagaccacccagtcccggaaacattagacccgtgaaaagggaagtgaaggtggaaccagagaagaaagacccggagaaagagccccagaaggtcgccaacgagccatctttgaagggtagggctccacttgtgaaagtggaggaggctacagtcgaggaacgcactcccgctgaacctgaagtgggtccagctgcgcctgccatggccccagcaccggcatctgcacccgctcctgccagcgccccagctccggctccagtaccaacaccggcaatggtctccgccccttccagcactgtcaatgcttcagcctccgtaaaaaccagtgccggaaccaccgaccccgaggaggcaacccgactgctcgcagagaagcgcagattggcacgagagcaacgcgagaaggaagaacgtgaacgtagggaacaggaggaactagagcggcaaaaacgcgaagaactcgcacagagagtggccgaagagagaactaccagacgggaggaggaatcccggagattagaagcagagcaggcaagagaaaaggaggaacagcttcaaagacaagccgaggagagagccttaagggagagggaggaggccgagcgggctcagaggcagaaggaagaggaagctagagttcgagaagaagcggagcgcgtgcggcaggaaagggagaaacacttccaacgtgaagaacaagaaaggcttgaacgcaagaaacggctggaggagattatgaagcgaactcgaagaaccgaggctacagataaaaagacgtcagaccagcgcaacggcgacattgccaagggggctctcaccgggggaacagaggtctcagccctgccttgcactacgaacgcgccagggaacggtaaacccgtcgggtccccccacgtggtaacaagccatcaaagtaaggtgaccgtggaatctacacccgacttggagaaacagcccaacgagaatggggtgagtgtgcaaaacgagaacttcgaagaaatcattaatcttcccatcggcagcaagccgtccagacttgacgtaacaaattccgaatcacccgagattcctctcaatccaatcctcgcttttgatgatgaaggaacactgggtccacttcctcaggttgatggcgtgcaaacacagcagactgctgaggtcatttag

SEQ ID NO: 51742 - DNA, 3021 bp, Artificial Sequence
  Description of Artificial Sequence: Synthetic coding sequence
atgtccaattccaggaataatcgtgtgatggttgaaggtgtcggggctcgcgttgtgcgtggacctgattggaagtgggggaaacaggacggcggagaggggcacgtggggactgtgaggtcatttgagtcccccgaggaggttgtcgtggtgtgggacaatggtacggccgctaactatcggtgttctggggcatacgacctgcggattctggatagcgcacctacaggcatcaaacacgatggcacaatgtgcgatacttgcaggcagcagccaataatcggcatcagatggaagtgtgcagaatgcaccaattacgacctctgcaccgtgtgctatcacggagataagcatcacctgagacacaggttttacagaattacaaccccaggatctgaacgtgtcctcctggaatctaggagaaaatcgaagaagataacagccagaggtattttcgctggagccagagtggtgcggggagtcgattggcagtgggaggaccaagatggcggtaacgggagaaggggcaaggttacggaaatccaggactggtctgcctcatccccgcactctgccgcttatgtgctctgggataacggggctaagaacctgtatagagtggggtttgagggtatgtccgatctgaagtgcgtacaggatgctaaaggaggcagcttctacagggaccactgccccgtgctgggcgaacagaacgggaataggaaccccggagggctacagatcggtgacttggtaaatatcgatcttgatctcgagattgtccaaagcctgcagcatgggcacggaggatggacagatggtatgtttgaaacgctgaccaccaccgggacggtttgcggaattgacgaggaccacgatatcgtggtgcagtatcccagcggtaaccgctggacattcaatccagcagtactgaccaaggctaacattgtgcgttccggcgacgccgcacaaggggctgaaggcggaacaagccaattccaggtcggcgatcttgtgcaggtgtgttacgacttggaaaggattaaacttttgcagcgaggtcacggcgagtgggccgaggccatgctgcccacacttggaaaggtaggcagggttcagcagatatatagcgacagcgatctgaaggtggaggtgtgtggcactagttggacctacaaccccgctgcggtttcaaaagtggcgtctgcaggcagcgccatcagcaatgcaagcggtgagcgcctcagtcagctgctgaaaaagctgtttgagacccaagagtccggcgacctgaacgaggagctcgtgaaagcggcagccaacggcgacgtggcaaaagtggaagacctgttaaagagaccggatgtggacgtaaacggccaatgcgctggtcataccgccatgcaggcggctagccagaatggccacgtagacatactgaagttgctgctcaaacagaacgtggacgtggaggcggaagacaaagacggagatcgggctgtccaccacgccgcattcggagacgaaggggctgtcatcgaagttttacacaggggtagtgcggacttgaacgcacgtaataaacgaaggcagacccccctgcacatcgctgtcaataagggacaccttcaggtggttaagacgctgttagacttcggatgtcacccgtctctccaggactcagagggtgatacccctcttcacgatgccatcagtaagaagcgggacgatatactcgccgtcctcttagaggcgggagccgacgtgaccatcaccaataacaatggcttcaatgcattacatcacgctgccctcagaggtaacccatccgctatgcgcgtcctgcttagtaagctccctagaccctggattgtggacgaaaagaaagacgacggctatacagccttgcatcttgccgctctcaataaccacgtcgaagtcgctgagctgctggtgcatcagggcaatgcaaatctcgacattcagaatgtgaatcagcagaccgctctgcaccttgcagtagaaagacagcacactcaaattgtcagattgctcgtacgggctggagcaaaattggatatccaggacaaagatggagacactcctctgcacgaggccttacggcaccatactctctcacaactacggcagcttcaggatatgcaggacgtgggtaaggtggacgccgcatgggagccctccaagaacaccctgattatgggtctaggtacgcaaggcgctgaaaagaaatcagcagcctccatcgcatgttttttggccgctaatggtgcagatctctcaatccgcaacaagaagggccagtctccgttggatctgtgccctgaccccaacctctgcaaggccctagcgaagtgccacaaggagaaggtcagcggtcaggtgggtagcagatcgccttcaatgatatctaacgattccgagacactcgaagagtgcatggtgtgctccgatatgaagcgcgatacattattcgggccttgtggacatattgcaacatgtagtctgtgcagccctagagtgaagaagtgcctcatttgtaaagaacaggtccagagccggaccaagatcgaagaatgtgttgtatgctccgacaagaaggcagccgtactgttccagccgtgtggccacatgtgcgcttgcgaaaactgcgctaacctcatgaagaagtgcgtccaatgcagagctgtggtggagaggcgtgtgccttttattatgtgttgtgggggtaaatcctcggaggacgctaccgatgatattagttccgggaacatccccgtgcttcagaaagataaggataacaccaatgtgaatgccgacgtgcagaagctccaacagcagcttcaggatatcaaagaacagaccatgtgcccggtgtgtttggaccgactgaaaaatatgatcttcctatgtggccatggcacctgccagctgtgcggtgatagaatgagtgaatgccctatatgtcgaaaagctatcgagagacgtattctcttgtactag

SEQ ID NO: 51743 - DNA, 750 bp, Artificial Sequence
  Description of Artificial Sequence: Synthetic coding sequence
atggccaaaagtggacttcgccaggacccgcagtcaacagccgcagcaacggtgctgaagagagccgtggagcttgacagcgagtcacggtatccacaagcactggtgtgctatcaggaaggaatcgacctgctcctgcaagtgttaaaaggtactaaggataacactaagcgctgtaatctcagagagaagatctctaagtatatggaccgcgcagagaacatcaagaagtaccttgaccaggaaaaagaggatggcaaatatcacaagcagatcaaaatagaggaaaacgcgacgggtttttcatacgagtcattgtttcgcgagtatctgaatgaaacagtaactgaagtttggatagaggacccttacatccgacacacacatcagctgtacaatttcctgcgattttgtgaaatgctgatcaagagaccctgcaaagtgaagacaattcatcttctgaccagcttagatgagggcatcgaacaggtccagcagtcaagggggctgcaggagatcgaggagagcctccgctcacatggcgtcctacttgaagtgcagtactcctcttctattcacgatcgtgaaataaggtttaacaatgggtggatgattaaaatcggaagaggcctggactattttaagaagccacagtcgcggttcagcctgggatattgcgatttcgatctgcgcccttgccacgaaaccaccgtggatatcttccacaagaagcataccaagaacatatag

SEQ ID NO: 51744 - DNA, 696 bp, Artificial Sequence
  Description of Artificial Sequence: Synthetic coding sequence
ctcaagcgagccgtcgaattggactcagagagtcgctatcctcaagctctggtgtgctaccaagagggcatcgaccttctgttacaggtgttaaaaggaaccaaggataataccaagaggtgtaacctgagagaaaagatttctaagtatatggaccgagccgagaatattaagaagtacctggatcaggagaaggaggacggtaaatatcataaacagatcaagattgaggaaaacgctacaggattctcctacgagtcgctgttccgggaatacttgaacgaaacagtgacggaggtgtggatcgaagatccctacattagacatacccaccagctgtataactttttgcggttctgtgaaatgttaataaagagaccgtgtaaagtgaagaccattcacctgctgaccagtcttgacgaaggtatcgaacaggtgcagcagagtaggggcctccaggaaatcgaggagtcattacgatctcacggcgtgctcctcgaggtgcagtatagctcatcaatccacgatcgggaaattcgtttcaacaacggatggatgataaagatcggccgaggtcttgactattttaaaaagccccagtccagattttccttgggttattgcgacttcgacctccggccttgtcatgaaactacggtggatatttttcacaaaaaacatactaagaacatttag

SEQ ID NO: 51745 - DNA, 1431 bp, Artificial Sequence
  Description of Artificial Sequence: Synthetic coding sequence
atgttcagactaaactctctatcagcgctagcagaactagccgtgggcagtagatggtaccacgggggatctcagcctattcagatccggcgtcggctgatgatggtagcgttcctgggcgcatctgcagtgacagctagtacaggccttctctggaaacgagcccacgccgaaagcccgccttgtgtcgataacttaaagtccgacattggcgacaaaggtaaaaataaggatgagggggacgtgtgcaaccacgagaagaagaccgccgacctcgctccacatcctgaggaaaaaaaaaagaaaaggtccggattccgggacaggaaggtgatggagtacgagaatcgtatccgggcatacagcacgcccgacaaaatctttcgatatttcgctacattaaaggtcatctctgaacccggtgaggccgaggtgtttatgacgccggaggacttcgtcagatccattacacccaacgagaaacagcccgagcacctaggccttgaccagtacattattaagcgattcgatggtaagaaaatatctcaggaaagagagaagtttgcagacgaggggtctatattttatactctgggtgagtgtggtctaatcagcttctcagactacatatttcttacaacggtgctcagcacaccgcagcgaaactttgagatagcgttcaagatgttcgatttaaatggggacggggaagttgatatggaggaattcgagcaggttcagagcattatcaggtcccagacgagcatgggtatgcgtcaccgcgataggcctacaaccggcaacaccttaaaatccgggctgtgctcggccctgaccacttatttcttcggagctgaccttaagggcaagttgactataaaaaatttcctggagttccagcgcaagctgcaacacgacgtactgaaattagagtttgaaaggcatgaccccgtagacggacgaatcaccgagcgccagtttggcggtatgctgctagcctactccggggtgcagagcaaaaagctcactgcaatgcagcggcagctaaagaagcattttaaggaaggtaaaggtctaactttccaggaagtggaaaatttcttcacatttctgaaaaatattaacgacgttgacaccgccctcagcttttatcatatggccggtgccagtcttgacaaagtgacaatgcaacaggtagctaggaccgtggcaaaagtagaactctcagaccatgtttgtgacgttgtgttcgcgctgtttgactgtgatggcaatggagagctcagcaacaaggaattcgtttctatcatgaagcagcgtctaatgaggggtttggaaaagcctaaagacatggggtttaccaggttgatgcaggctatgtggaagtgtgcacaggagaccgcctgggactttgccctgccgaagcagtag

SEQ ID NO: 51746 - DNA, 1437 bp, Artificial Sequence
  Description of Artificial Sequence: Synthetic coding sequence
atgtttcggctgaactcccttagcgccttagccgagctcgccgtggggtcaagatggtatcacgggggtagtcaaccgattcagattcgcaggcggctgatgatggtcgctttcttgggtgcttcagcagtgactgcgtccaccggtctcctgtggaagagagcacacgccgagagccctccttgcgtcgacaatctgaagtctgacatcggcgacaagggaaagaataaggacgagggagacgtgtgcaatcatgagaaaaagaccgcagatcttgcccctcaccccgaggagaaaaaaaaaaaacgctccggcttccgcgatcgcaaagtgatggaatacgagaatcgtattcgggcatactctacaccagacaagattttcagatactttgccactctgaaggtgatctcagaacccggagaagcggaggtcttcatgacccctgaagattttgtcagaagcattacaccaaatgaaaagcagcccgagcaccttggcctcgatcagtatattatcaaacgcttcgacggaaaaaacaagaagatatcacaggagcgggaaaagttcgctgacgaggggtccattttctatacactcggggaatgcggactcatcagttttagcgactacatcttcctgacaaccgtgctgagcacacctcaacgcaatttcgagatcgcatttaaaatgtttgatctcaatggcgacggagaagttgatatggaggagttcgagcaggccatttccattatacgatcgcagactagtatggggatgcgccatcgggaccggccaacgactggcaacacacttaagagtggcctgtgttccgctcttactacctacttctttggagccgatcttaaaggaaaattgactatcaagaactttttagaattccagaggaagttgcagcacgacgtgctgaaactagagtttgaacgtcacgacccagtggacggcagaattaccgagaggcagtttgggggaatgctgcttgcctattcgggagtgcagtcgaaaaagctgactgccatgcaacgccagctgaaaaaacattttaaagaaggtaagggtctgactttccaggaagtcgagaacttcttcacctttctgaagaatattaacgatgtcgacaccgctctcagcttttaccatatggctggcgcaagcttggacaaggtaaccatgcagcaggtggccaggaccgtcgccaaagtcgaactgagcgaccacgtgtgcgacgtggtgtttgcactgttcgattgtgatggcaatggggagttgtcaaacaaggaattcgtgtctattatgaagcagcgtctcatgcgcggattagagaagccaaaggacatgggtttcactcggttgatgcaagctatgtggaaatgcgcccaggagacagcctgggacttcgcccttccgaagcagtag

SEQ ID NO: 51747 - DNA, 837 bp, Artificial Sequence
  Description of Artificial Sequence: Synthetic coding sequence
atggtgagcttgaaagcgaaactcaatcatctgagacaatccatgcttaagcagaaggcgcctcaacggaactttgaaattgccttcaaaatgtttgacctcaacggtgacggagaagtagacatggaagagtttgagcaagtccagtccatcatccgctcccagacaagcatgggcatgcgacacagggaccgccctaccaccggcaatactcttaaatcgggcctgtgctcggctctaaccacctacttttttggagccgacctgaaaggaaaactcaccatcaagaactttctagagttccagcgaaagttgcagcatgacgtcttgaagctcgaattcgaacgtcatgacccggtcgatggtagaatcacagagcgccagttcgggggaatgctactggcctattcgggcgtgcaatctaagaagctcactgcaatgcaacgacagctgaagaagcattttaaggagggtaagggcctgactttccaggaagtggagaatttttttaccttcctgaaaaatataaatgatgttgatacagctctctccttctatcacatggccggagctagtctcgacaaagtcaccatgcaacaggtcgcacgcaccgtcgccaaagtggaactaagcgatcacgtctgtgacgttgtctttgccctcttcgattgcgacgggaacggagagctgagtaacaaagagtttgtctccattatgaagcagagactcatgagaggactggagaaaccaaaggacatggggtttaccaggctcatgcaggccatgtggaagtgcgcccaggagaccgcttgggactttgccctgccaaaacagtag

SEQ ID NO: 51748 - DNA, 1431 bp, Artificial Sequence
  Description of Artificial Sequence: Synthetic coding sequence
atgttcaggctgaactctctttccgccctggcggaattagccgtcggttccagatggtatcacgggggatctcagccaatccagatccggaggcgcctaatgatggtcgccttccttggagcgtcagccgtgaccgctagcaccgggctgctgtggaagagggcccacgctgagtcgcccccatgcgtggataatttgaaatctgatattggggacaagggcaagaacaaggacgagggtgacgtgtgtaaccacgagaagaagaccgctgacctcgcccctcaccctgaagaaaaaaagaaaaaacgctcaggattccgggaccggaaagtgatggagtacgagaaccgcatcagggcttactccacgcccgataagatttttaggtattttgcaacgcttaaggttattagtgagcctggagaggccgaagtgttcatgacgccggaggacttcgtgagaagtattactccaaatgaaaagcaacctgagcatcttggcctggaccagtatattattaagcgctttgacgggaaaaagatcagccaggaacgcgagaagtttgccgacgagggtagtattttttacacgctgggggagtgcggcctgattagcttctctgattacatttttctcaccacagtgctaagcactccacagagaaactttgagatagcatttaaaatgttcgatctcaatggcgatggtgaagtcgatatggaagaatttgagcaggctatttccatcattcgcagtcagacctctatggggatgaggcatcgggatcgccctacaacaggaaatacattgaaaagcggactttgctcggcgttaactacatactttttcggggcagacctcaaggggaagctcaccatcaagaacttcctcgagttccagaggaaactccagcatgacgtgctgaagcttgaattcgagcggcacgaccctgtcgatggcagaatcactgagcgccagtttggcggaatgttgctggcatattccggagtacaatcgaaaaaactcaccgcaatgcaacggcagttaaagaagcacttcaaagagggtaagggacttacatttcaagaggtggagaatttctttaccttcctgaagaatataaatgatgtagacactgccctgtcattttaccacatggcaggcgcatctttagacaaggttacaatgcagcaagtcgctcgtaccgtcgcaaaggtcgaactttctgatcacgtctgcgacgtagtgtttgctctctttgactgtgatggtaatggagagctcagtaacaaagagtttgtaagtatcatgaagcagcgtctgatgcgcggtctggaaaagcctaaagatatgggcttcactcgactgatgcaggcaatgtggaaatgcgcccaagaaacggcctgggatttcgcactccccaagcagtag

SEQ ID NO: 51749 - DNA, 837 bp, Artificial Sequence
  Description of Artificial Sequence: Synthetic coding sequence
atgaaaaggatatacacctatcgacgtgcaaaggagatctttaaggacacccccaaggcaccacagagaaatttcgagatcgcctttaaaatgttcgatttgaacggagacggtgaggtggatatggaggagttcgaacaggtgcagagtattatccgatcccagacctccatgggcatgaggcacagagaccgccctaccaccggaaacaccctgaagtcagggttatgctccgccttaaccacatatttttttggcgctgacctcaagggcaaactgacgattaaaaacttcctggagttccagagaaaacttcaacacgacgtcctcaagctggaattcgagcgacacgatccggtggacggtcgaattacagaacgtcagttcggcggaatgttgctcgcatacagtggcgtgcagtcgaaaaaactcactgcaatgcagcgccagctgaaaaagcacttcaaggaaggtaaggggctgacttttcaggaagttgaaaatttcttcactttcttgaagaacattaatgacgtggacacagccctgtcattctatcacatggccggtgcgtcactcgataaggtgacgatgcagcaagtcgcacggaccgtcgccaaggttgagctcagtgaccacgtgtgtgacgtggtgtttgccctcttcgattgtgatgggaatggggagctcagtaacaaagaattcgtttcaatcatgaagcagagattgatgcggggactcgaaaaaccaaaggatatggggttcacacgactgatgcaggccatgtggaaatgtgcccaggaaactgcctgggatttcgccctccctaagcagtag

SEQ ID NO: 51750 - DNA, 1092 bp, Artificial Sequence
  Description of Artificial Sequence: Synthetic coding sequence
atggatggaggtagcggaggactcggaagtggagataacgcccctacgactgaggccctcttcgtcgcattgggagccggagttactgctctctcccatcctctcctttatgttaagctcttaatccaggtggggcacgaacctatgcctcctactctagggacaaatgtcctcggcagaaaggtgctttacctgcccagcttcttcacatatgctaaatatatcgttcaggtcgatggtaaaataggcctgtttcgcggactgtctccccgactgatgagcaatgccttgtccactgtcaccaggggttcaatgaagaaggttttccccccagatgaaatagaacaagtgagcaataaggacgacatgaaaacgagtcttaaaaaggttgttaaagaaacttcttacgagatgatgatgcagtgcgtgagcaggatgctagctcacccactccacgtcatttccatgcggtgcatggtgcagttcgttggcagggaggccaaatactcaggggttctttcgagcatcggcaagattttcaaagaggaagggctcctaggatttttcgtcggcctgataccacatttgttgggagatgtcgttttcttgtggggctgtaatctgctcgcacacttcatcaatgcatacctcgtagatgatagcttcagtcaggccctcgccatcagatcttatacgaagtttgtgatgggaatagctgtctctatgctgacttatccgttcctcctggtgggggatctcatggccgtcaacaactgcggcctgcaggcgggactgccaccttatagtccagtgttcaagtcctggattcattgctggaaatatctgtctgtgcaaggccagctgtttcggggttcatcctgcttcagcgctggatgccaccaagatcatgcactgccatggagtaatctaaaccatctgaagaatactgtgtctacatggcccccttgggtgcggcctgaccatctgggcacaccggctcgtcggctgcagcctaataataaccaaatgtgtagctctcccgctgggcttcagtttcacatttgtcacgtgtccgtccaaatgtgggggtag

SEQ ID NO: 51751 - DNA, 1074 bp, Artificial Sequence
  Description of Artificial Sequence: Synthetic coding sequence
atggatgggggtagcggcggtctcggatctggagacaatgcgcctacaaccgaggctctgttcgttgcactcggggctggggtcaccgcattgtcccacccactgctctacgttaagctcctaattcaggtgggtcatgaacccatgcctcctactcttggaacgaacgtactgggtcggaaagtgctctacttaccaagttttttcacatacgccaaatacatcgtgcaggttgatgggaaaattgggctgttcagaggcctgtcccctcggctgatgtctaacgccctgtccaccgttacccgaggatccatgaagaaagtgtttccacccgacgagatcgaacaggtatcaaataaggatgacatgaagacaagcctcaaaaaggtcgtcaaggagacttcctatgagatgatgatgcagtgtgtaagcaggatgctggcccatcccctccacgtcatctctatgcggtgcatggtgcagtttgttggaagggaagcaaagtattctggagttctctcctctatcgggaagatcttcaaagaagagggcctgctcgggttttttgtggggttgattccacacctcctgggcgacgttgtgtttctctgggggtgtaatctgcttgcacactttattaacgcatatctggtcgacgactctgttatccaacccggacccggacaccccgagttgtaccaggtgagggatggggattgcagtgagcacgccgaccttccacttccagcaagttggaggccccatggctgtgagcagctgcgtgccgcatcgtgggctccacccctgttacctagcgtgcaaatactggatagcctgctagaagtgcctgagtgcgcagcttgtttttcagccggttgtcaccaggatcacgcattgccctggtctaacctcaaccatctgaaaaatacagtctcgacctggccaccctgggtaaggcccgatcatctagggacaccagccaggcggctgcagcccaacaacaaccagatgtgctcctctcccgctggcctacagttccatatttgtcacgtctccgtgcagatgtggggctag

SEQ ID NO: 51752 - DNA, 561 bp, Artificial Sequence
  Description of Artificial Sequence: Synthetic coding sequence
gccgtgtgcgtgccacacgttggaccacctcctgcatgccacctgaatgcactccatgggcctgtgtgcggaacgggaggtcaggtgcagctgtcatgcggagccactattccaggcagttccgctgcaatggtgccccactttggcgtgataaacgggaagctcgcccactcaccgagactgattatgtcaggtgtgttgtctagcatcggcaagatcttcaaggaagagggcctgctcgggttttttgttggcttgataccacatcttctgggggatgtcgtattcctgtggggatgcaacttgctcgcccactttataaatgcgtatctggtggacgatagctttagccaagcattggctatcagaagttatactaagtttgtcatgggaatcgcagtctccatgctgacataccctttccttctggtgggcgatctgatggctgtgaacaactgcgggctacaagcaggcctgcccccatactctcccgtggcgtcatcttcggaggcaccagcatgcttttccgcaggttgccaccaggatcacgcactcccctag

SEQ ID NO: 51753 - DNA, 1119 bp, Artificial Sequence
  Description of Artificial Sequence: Synthetic coding sequence
atgggtgcttctgacccggaagtggctccatgggccagaggtggcgctgctggcatggcaggagctggggctggcgctggggctcgcggaggcgctgccgcaggtgtggaggcacgagcccgagaccccccacctgctcaccgggctcacccacggcaccctcgaccagctgcccagccatccgcgaggagaatggatggcggtagtggcggactgggctctggcgataacgcccctaccactgaggcactcttcgtggcattgggagctggtgtaaccgcactctcacaccctctcctatacgtgaagttactgatccaggtgggccacgagccgatgccacccacactgggcacaaatgttctcgggaggaaagtgctatacctgccctccttcttcacatatgcaaaatacatcgtgcaggtggacggaaaaattgggctgttcaggggcctctcaccccgactcatgagcaacgccctgagtaccgtgacgaggggctccatgaaaaaggtgttccctccagacgagatcgagcaggtctctaataaagatgatatgaaaacgtcgcttaagaaggtggttaaggaaacatcgtatgaaatgatgatgcaatgcgtcagtcggatgttggcccaccccctacacgtcataagtatgagatgcatggtacagtttgttggaagggaagctaagtattcgggagtgctcagttccattgggaagattttcaaagaggaaggcctcctgggcttcttcgtggggttgattcctcatctgctaggggatgtggtattcctctggggctgtaatttgctcgcccatttcattaatgcctacctagtagacgattctttttctcaggcactggctatcaggagttacaccaagtttgtgatggggatcgccgtgtcaatgctgacatatccctttctgctggtcggcgatctgatggccgtcaataactgcggtttgcaggccggtttgcccccttacagtcctgtatttaaatcttggatccattgctggaaatacctaagcgttcaggggcagctttttaggggctcctcactacttttccggagggtgagcagtggttcctgctttgctctggagtag

SEQ ID NO: 51754 - DNA, 1170 bp, Artificial Sequence
  Description of Artificial Sequence: Synthetic coding sequence
atgggggcaagtgaccctgaggtggctccgtgggcgcgtggtggagcagcgggaatggcaggggcaggagcgggagccggagctcggggtggggctgccgcaggcgtcgaggccagggcaagagacccccctcccgcacatcgggctcatccacggcatccccgtcctgccgctcaaccttctgcccgtcgcatggatggtgggtccgggggactcggctctggagataacgcccctaccactgaggccttattcgtcgcactcggtgctggagtgactgcccttagtcatcctctgctctacgtgaagctacttattcaggtgggccacgagcccatgcccccaaccctgggtactaacgttctgggaagaaaagtgctgtatctgcctagtttttttacgtatgcgaagtatatagtgcaggttgatggtaaaattggtctattccgaggactgtctccacggttaatgtctaatgcattgagtacagtaacccggggaagcatgaagaaagtgtttccacctgatgaaatcgaacaggtgagcaacaaggatgacatgaagactagcctgaagaaggtagtgaaggagacatcctacgaaatgatgatgcagtgcgtgtcccgaatgctggcacacccactgcatgttatttcaatgcggtgtatggtccagtttgtagggagagaggcgaagtattctggcgtccttagctccattggaaagatctttaaggaggaaggactcttgggattcttcgttggcctcatccctcacctgttaggggatgtggtgtttctttgggggtgtaacctgctggctcatttcatcaatgcctatctggtagacgattctgtttcagacacccctgggggactcggaaacgaccagaaccctgggtcgcagttcagccaggctcttgcgatccgcagttatactaaatttgtaatggggatagcagtgagtatgctgacatatccgttcttgctggtgggcgatctgatggcagtgaacaactgtggactccaggctggtctccccccttacagcccagtgttcaaatcctggatccattgttggaaatatctatcggttcaggggcagttgttccggggatccagcctgctttttcggcgtgtctccagcggtagctgttttgccctcgaatag

SEQ ID NO: 51755 - DNA, 606 bp, Artificial Sequence
  Description of Artificial Sequence: Synthetic coding sequence
tgagcggtctgcgtgcctcatgtagggcctccccctgcgtgtcacctcaatgctttgcacggcccagtgtgcggaactggtggtcaggtacaactgagttgtggggctacaatacctggctcatctgccgcaatggtcccccacttcggtgttataaacggaaagctggctcactcacctcgtttgatcatgtctggcgttctgtcgagcattggtaaaatcttcaaggaagagggcttgctaggctttttcgtgggcctcataccccacttattaggggatgttgtgttcctctggggctgcaatttactggcacacttcattaacgcctacctggtggacgactcctttagccaggccctggccatccgctcctacaccaagttcgtgatgggtattgctgtcagtatgctgacctaccccttcctgttggtgggggatctgatggccgtcaataactgtggattgcaggcaggccttcctccgtattctcctgtattcaagtcatggatacattgttggaagtacttatccgtgcaagggcagttgtttaggggctcctccctcctttttcgccgtgtttcttcagggtcttgctttgcctag

SEQ ID NO: 51756 - DNA, 1185 bp, Artificial Sequence
  Description of Artificial Sequence: Synthetic coding sequence
gccggtatggcgggagctggggcaggtgctggtgccagaggaggagcggctgctggcgtcgaagcaagagccagagaccctccccctgcacatcgcgcacacccaagacatccgaggccagctgcccaaccctctgctaggcggatggacggtggcagtggcggactgggaagcggcgacaacgctcctacgactgaggctctgttcgtagccttaggagcaggcgtcaccgccctctcccaccccctgctttatgtgaaactgctgatccaggtaggccacgagccgatgccaccaactctcggcacaaatgtattgggacgaaaggttctgtatctgccatcctttttcacatacgcaaaatacatcgtacaggttgacggcaaaatcgggctgtttcgcggactgagtccacgcctgatgtctaacgcactgagcacagttaccagggggtccatgaagaaagtatttcctccggacgaaatagagcaagtgtcaaataaagatgatatgaaaacatcattgaaaaaagttgtcaaagagactagctatgaaatgatgatgcaatgcgtgagtaggatgctggctcatccactacatgtgatcagcatgcggtgcatggtgcaatttgttggaagggaagcaaaatattccggggtactgagttccattgggaagatattcaaggaggaggggttgttggggtttttcgtagggcttatcccgcatcttctaggcgacgtggtgttcctgtgggggtgtaatctgctggcacacttcataaacgcctatctggttgatgattctttcagtcaggccttggcaatcagatcctataccaaattcgtgatgggcatcgccgtgtctatgttgacttatccatttctgctcgtaggagatctgatggccgtgaataattgcggcctccaggctgggttacctccctattcaccagtgttcaagagctggatccactgttggaaatacttatcagtgcaggtgtccaaacactggacagcagaggcatttcctgtgttgtgctacattctgcagctcaagtggttctgtggctgcttcatcgcatgcaaggacaagtggttccacggaattcaatactgcgaggagattctaggcatttataaagcattcaaatttagctcctatatcatctcagagcgtatttag

SEQ ID NO: 51757 - DNA, 765 bp, Artificial Sequence
  Description of Artificial Sequence: Synthetic coding sequence
atgtccaacgctctatctactgtgactcgagggagcatgaagaaagtgtttcctccagacgagatcgaacaagtctctaataaggacgatatgaagacttccctgaaaaaggtcgtcaaggagaccagctacgagatgatgatgcagtgcgtgtcacgcatgctggctcatcccttgcacgtcataagcatgcgctgtatggtgcagttcgtgggaagagaggctaaatacagcggcgtattgtctagtattggaaagattttcaaggaggaaggactcctgggctttttcgtcggtcttatacctcacctgttaggcgatgtggtttttttatgggggtgtaacctgttggcccattttattaacgcttatctggtcgacgatagtttctctcaagcattagccatcagatcttataccaaattcgtcatgggcatcgccgtatcaatgctcacctacccctttctcctggtcggtgacctgatggcggtgaacaactgtggcctgcaagcgggactgccaccgtatagtcctgttttcaagtcttggatccactgctggaagtacttatccgttcaagtgtcaaagcactggaccgcagaagctttcccagtgctgtgctacatccttcaactgaagtggttttgcggttgctttatagcctgtaaagacaaatggtttcatggcattcagtactgcgaagagattcttggcatttataaggccttcaaattcagctcctatataatcagtgaacgcatctag

SEQ ID NO: 51758 - DNA, 894 bp, Artificial Sequence
  Description of Artificial Sequence: Synthetic coding sequence
atgatggattcagaggcccacgagaaaagacctccgatcctgacctccagcaagcaagacatttctcctcatattacaaacgtcggggagatgaagcactacttgtgtggctgctgcgcagcgtttaacaacgtggcgattacattccccatccagaaagttctctttaggcagcaattgtatggtatcaaaaccagagacgctattctgcaactgagaagggatgggtttcgaaatctgtatagaggcatcctgcctcccctaatgcagaaaacgacaaccctggccctgatgttcgggttatatgaggacctcagctgccttttgcacaagcatgtgtccgctccagaatttgcaacaagtggcgtggccgctgtcctcgctggaaccaccgaggctatatttaccccattggagagagttcaaaccctgttgcaggaccacaagcaccatgacaagttcaccaacacgtatcaggccttcaaagctctgaagtgtcacggaatcggcgagtattatcggggactagtcccaatactgtttcgaaatggattgtcgaacgtgctgtttttcgggctcaggggccctattaaggagcatctccctactgcaacgacacacagtgcccatctggtcaacgactttatatgcggaggcctgctgggagcaatgctcggattcctgttcttcccgatcaacgtggtcaagacacgtatccaatctcagattggaggagagttccagtctttcccgaaggtcttccagaagatctggctggaaagggatagaaagcttatcaatttgttccgtggtgcccatctcaactaccacagaagcctgattagctggggcattatcaatgctacgtacgagtttctgcttaaagttatctag

SEQ ID NO: 51759 - DNA, 894 bp, Artificial Sequence
  Description of Artificial Sequence: Synthetic coding sequence
atgatggacagtgaagcccatgaaaaaaggccgcctattctgacttcttccaagcaggatataagtcctcacatcacgaatgtaggagaaatgaaacactatctgtgtggttgttgtgcggctttcaacaacgtcgcaataactttccccatacagaaggtattgtttcgtcagcagttatacggtataaagacacgggatgccatcctgcagctccggcgagacggcttcaggaacctgtatcggggtatcctgccccctctcatgcagaagaccacaactctcgcactgatgttcggactttatgaagacctgtcttgtttattacacaaacacgtttctgccccagaattcgccacctctggcgtagccgcagtgctggccggaacgaccgaagccatatttactcccctggagcgcgtgcagacactcctgcaggatcataagcaccacgataaatttaccaacacctaccaggcattcaaggctctgaaatgccatggcattggagagtactaccgcggactagtccctattctgttccgtaatggactcagcaacgtgcttttcttcggactccggggacccataaaggaacacctgcctacagccaccacacactccgcgcatctggtaaacgacttcatttgcggaggcctactgggcgctatgctggggttcttattcttccctataaacgttgtgaagacccgaattcagtcccaaatcggcggagaatttcaatccttcccaaaagttttccaaaagatttggctagagcgagacagaaagctcatcaacttattcaggggggcacatctgaactaccacaggagtttgattagctgggggatcatcaatgccacatacgagtttctgcttaaggtgatatag

SEQ ID NO: 51760 - DNA, 894 bp, Artificial Sequence
  Description of Artificial Sequence: Synthetic coding sequence
atgatggattcggaggctcatgagaagaggccgccaatcctgacttcgagcaagcaggatatctcaccgcatattacaaatgtcggtgagatgaaacattatctctgcgggtgctgtgcggcattcaataatgtggcaattacatttcccatccagaaggtactatttcggcagcagctctacgggatcaaaactagagacgctattctgcagctgcgcagggacggcttcagaaacctttacagagggatcctgcctcccctgatgcagaaaaccaccaccctcgcactgatgttcggtttgtatgaagatcttagctgccttctacacaagcacgtgtcagccccagagttcgctaccagcggggtcgcagccgttctagccggtaccaccgaggccattttcacccctctggagcgtgtccagacgctgctccaggaccataaacaccatgataaatttacgaatacataccaggccttcaaggcactcaagtgccatggaatcggcgaatactatcggggacttgtaccaatcctttttcggaatggattaagcaacgtgctgttcttcggcctgcgcggaccaatcaaggaacacctgccgacagctacaactcattctgcacacctcgtaaacgattttatttgcgggggtcttctgggggcaatgctcgggttccttttctttcccattaacgtggtgaagacacggatccagtctcagattggcggagagtttcaatcatttcccaaagtctttcaaaagatctggcttgagcgtgatcgcaaactgatcaatctgtttagaggggcacaccttaactatcacaggtctctgatttcttggggcatcattaatgcaacttatgagttcctcctaaaagtcatctag

SEQ ID NO: 51761 - DNA, 924 bp, Artificial Sequence
  Description of Artificial Sequence: Synthetic coding sequence
atgcctttcatgaggaagattctgtctaacatgatcgactccgaggcccatgaaaaacggcctcccattcttacttcatcaaaacaggacatttccccacatattacaaatgtgggggaaatgaagcactacttgtgtggctgttgcgccgcttttaacaatgtggccattacatatccaatacagaaagttttattcagacagcagctgtacggaattaaaacaagagacgcagtgctccaacttcggagagacggctttagaaacctatatcgaggcattctgcctcctttgatgcagaagactacaacgctggcgctcatgtttggtctctatgaagacctttcatgcctgctacgtaagcacgtaagggctccagaattcgccactcatggcgtcgcagccgtgttagctgggactgcagaggccatctttactccattggaaagagtgcaaaccctgctccagaaccacaagcatcacgacaaattcacgaacacataccaagccttcaaagcgctcaagtgccatggaatcggcgagtattatcgcggtctggtcccaatcctgttcagaaacggcttatctaacgtactgttcttcggacttaggggccctatcaaggaacatctgcccacggcaaccactcattcggcacacctggtgaacgatttcattgggggtggattactgggagccatgttagggttcctctgtttccctataaacgtagtcaagacgcggctgcagagtcagatcggaggggaattccagtcttttccaaaggtctttcagaagatctggctggagagggaccggaaactaataaacctctttaggggtgcgcatctgaattatcaccgcagtctgatcagctgggggattatcaatgccacctatgagttcctcctcaagttcatatag

SEQ ID NO: 51762 - DNA, 894 bp, Artificial Sequence
  Description of Artificial Sequence: Synthetic coding sequence
atgattgatagtgaggcccatgagaaaagacccccaatacttacaagctcaaagcaggacattagtcctcacataaccaacgtgggcgaaatgaagcactacctgtgcggctgctgtgctgcatttaacaacgtcgccattacataccccatacagaaggtattattcaggcagcaactgtacggcatcaaaacacgggacgctgttcttcaactgcgcagagatggattccgaaatctgtaccgcggtatcctcccacccctgatgcaaaagactaccactttggccctcatgtttggactttacgaggacctgagttgtctgctgcgtaagcacgtcagagccccagagtttgcgacccatggtgtggcggctgtcttggcaggcactgctgaggccatcttcacacctctggagcgtgtccaaactctcctgcaaaaccacaagcaccacgataagttcacaaatacttatcaggcgttcaaggcattgaaatgtcacgggataggggagtactacaggggtctggtccccatcctgttcagaaacggcctgtcaaacgtgttattcttcggcctgaggggtccaatcaaggaacatcttcccacagctacaactcactctgcgcatttagtgaacgattttattggtggaggactcctcggcgctatgcttggcttcttgtgtttccctatcaatgtggttaagacccggctgcaatcccaaattggaggcgaattccagtcatttcccaaagtattccaaaagatttggttggaaagagatcggaaattaattaacctgtttcgaggggctcacctcaattaccataggtccctaatttcttggggcattatcaacgccacctatgagtttttactgaaattcatttag

SEQ ID NO: 51763 - DNA, 924 bp, Artificial Sequence
  Description of Artificial Sequence: Synthetic coding sequence
atgggggagcagaatcacagccccggaaaggaactgcagcatagaacccgggctgaggccccaggtaaaaagtcttggcactcccaggcctacgcactgggtgcagtttcgaatttcatgtcaaccttccttaccttcccaatctataaagtggtgtttcggcaacagatccacgctatggccgtgtccgaggctgtccggcaactctggcacgagggccctcagtacttctacaggggtatataccctcccctgcttagcaaaaccctacaggggactcttttgttcgggacatacgatagcttgctttgtttcctgagccctgtaggccctcacaccttgggacacaggtgggccgctggcctgatgtcaggcgtcgtagaggcagtggccttatccccattcgagcgggtgcagaatgtgcttcaggatggaagaaaacaggctcggtttccttctacattttcgattttgaaagagttcaacagctatggactgtggggaaggctgtctctgggttattataggggtttctggcctgtgctagccagaaactccctgggcagtgctctgtatttttcctttaaggatccgattcaagatggtttagcagaacaaggactcccccattgggtgcctgcattggtcagcgggagtgtgaacggaaccattacttgtctggtactctacccacttatcgtccttgtggccaatatgcagtcccacattggatggcagaacatgcccagtctgtgggcttcagcccaggatgtgtggaacactcgcggtcggaagctcctcctcatctatagaggaggatccttagtgattctgcggagctccgtcacgtggggcctgaccaccgccattcatgactttcttcagaggaaatctcatagtaggaaggaactgaaaacggattag

SEQ ID NO: 51764 - DNA, 876 bp, Artificial Sequence
  Description of Artificial Sequence: Synthetic coding sequence
atggccgaaatatctaggatacagtatgaaatggaatacacagagggtatttcccagcggatgcgcgtccctgagaagctgaaggtggcgcctcccaacgctgatttggagcaaggctttcaggaaggcgtccctaatgcatcagttattatgcaggtgcccgagagaatcgtcgtcgccggaaataatgaggacgtctctttctctagacctgccgatctggaccttatccagtccactcccttcaaaccactcgcccttaaaactcccccacgagtgctgaccctgagcgagaggcccttggatttcctcgacctcgagaggccaccaacaaccccacaaaacgaggaaattagagccgtcggtagattaaaaagggagagatcaatgtccgagaatgccgttcgacagaacggacagcttgtgcggaatgactctctggtcaccccttctccccagcaggctcgggtctgcccaccccacatgctgccagaggatggtgccaatctgtcctctgccagaggtatcctctccctgatacagtcttcaacgagacgagcataccaacagatcctggatgtgctggatgagaatcgacgccctgttctcagaggcggttcggccgctgcgacgtccaacccacaccacgacaatgtccggtatggtatctctaatattgatactacaattgaggggacctccgacgacctgaccgtcgtcgacgccgcaagcttgagaagacaaattatcaagttgaatcggcgtctacagctgttggaagaggagaataaagaacgcgctaagagggaaatggtcatgtactccattacagttgctttctggctgttgaacagttggctgtggttccggagatag

SEQ ID NO: 51765 - DNA, 732 bp, Artificial Sequence
  Description of Artificial Sequence: Synthetic coding sequence
atggccgagatttcgcgaatacagtatgaaatggaatacacagaggggatttcccagagaatgcgggtcccagagaaactcaaagtggcgcctccgaatgccgacctagagcagggatttcaggaaggcgtgcccaacgcctctgtgattatgcaggttccagagcggatcgttgtggccggaaataacgaggacgtgtctttctctagacctgccgacctggatctcatccagtcaacaccgttcaaaccactcgccctgaagacaccaccacgcgtcttgacgctctctgaaaggcctttggacttcctggaccttgagcgccctcccacaaccccacagaatgaggagattagagcagttggccgacttaagcgggaacgatctatgtcagaaaacgcagtcaggcaaaacggccagctcgtccgcaacgacagcctctggcataggtcggatagtgcaccgagaaataagatttcacgttttcaagccccaattagcgcacctgaatacacctatggaatctctaacatcgatactactatcgagggcacctctgacgacctcaccgtcgtagatgccgcaagtttgcgaaggcagataatcaaattgaacaggcgcctccagcttctggaagaggaaaacaaagaacgggctaagagagaaatggtgatgtactcaattaccgttgctttttggttactcaattcgtggctgtggttccgaaggtag

SEQ ID NO: 51766 - DNA, 717 bp, Artificial Sequence
  Description of Artificial Sequence: Synthetic coding sequence
atggcagaaatttcaaggatccaatatgaaatggaatacaccgagggtatttcccaaaggatgcgagtccctgaaaagctgaaggtagcacctccaaatgctgatctggagcaggggtttcaagagggagttcccaacgcttccgtgataatgcaggtaccggagcggatcgtagtggcaggaaataatgaagacgtctctttcagcagaccagcagatctcgatctcatccaatcaacacccttcaagcctctcgccctgaaaacacctccgagagtgcttacccttagcgaacgccctttggattttctggacctggagcgacccccaacgaccccacagaacgaagagatcagagcggtcggcagacttaaacgggagagaagcatgagcgagaatgcagtccgccaaaacggacagctcgtccgaaacgattcactgccggttttgagaggaggctcggcagccgcaacatcaaatcctcaccatgacaacgtgagatatgggatatcgaatatcgacaccactattgagggaaccagcgacgatctgactgtcgttgacgcagccagtttacgcaggcagattatcaagctcaaccggagactgcaactgttggaggaggagaacaaagaacgagcaaaaagggagatggtcatgtatagcatcacagtagcgttctggctcttgaatagctggctctggtttaggcggtag

SEQ ID NO: 51767 - DNA, 1029 bp, Artificial Sequence
  Description of Artificial Sequence: Synthetic coding sequence
atgtctaaagggacgtcgagtgatactagcttgggcagggtgagcagggcagcattcccttcccccacagccgctgagatggccgaaattagccggatccagtatgagatggagtataccgagggtatctctcagcggatgagggtcccggagaagctcaaggtggcgcctccaaatgccgacctggagcagggattccaggaaggggtgcccaatgccagcgtcattatgcaggtgcctgagaggatcgtggtagcagggaacaatgaagatgtctctttttcacgacccgctgacttagacctgatccaatccaccccgttcaagcccttggcattaaagaccccccctagagtgctgaccctgtccgaacgaccactggacttccttgatctggaacggcctccaacgacaccacaaaacgaggaaattagggcagttggaaggctaaagagagagcggagcatgagcgaaaacgccgttcggcagaatggtcagctggtgcgcaatgactccctgtggcacagaagtgactctgccccaaggaacaaaataagccgctttcaggcaccaatcagtgcacccgaatatacagtcacacccagcccgcagcaggctcgggtctgtccccctcatatgcttcccgaggacggggcaaatctgagcagcgcccgtggaatactctcactgatacagagcagtacacgccgagcctaccaacagattctggatgtcttggatgaaaatcgcagacccgtccttagaggtggctctgcagcagcaaccagcaacccgcatcacgataacgtcagatatgggatatccaatattgacaccacaatcgaaggaacttccgacgatctgacagtggtggatgctgcttcactgaggcgacaaattataaagctaaatcggcgtctgcagctcttggaagaagagaataaggagcgtgccaagcgcgaaatggttatgtatagcatcaccgtcgcgttttggctgttgaacagctggctctggttcaggcgctag

SEQ ID NO: 51768 - DNA, 657 bp, Artificial Sequence
  Description of Artificial Sequence: Synthetic coding sequence
atggctgagataagccgaatccagtacgagatggaatacaccgaaggcatttcacagcgcatgcgagtacctgagaaactgaaagtggcaccccctaatgcagatctcgaacagggattccaagagggcgtgcctaacgcctctgtgattatgcaggttcctgaacgcatcgtggttgcaggcaacaacgaagatgtttctttctctaggccagcagatttggacctaattcagtctaccccattcaaaccactcgccctgaaaacacctccacgtgttttgactctgagcgagcggccactcgatttcttggatctggagcgacccccaaccactccccaaaacgaggagatccgtgcagtcgggagacttaagcgagagcggagtatgagcgaaaacgccgtgcgacagaacggacagcttgttcggaacgattcattgtacggcatctccaacattgatactaccatagagggcacctccgacgacctaaccgtggtagatgcagcaagcctgaggcgtcaaataattaaactgaaccgcagattgcagctgctcgaagaagagaataaagagcgggctaagcgcgagatggtgatgtactctattaccgtggccttctggttgttaaattcgtggctgtggttcagaagatag

SEQ ID NO: 51769 - DNA, 1029 bp, Artificial Sequence
  Description of Artificial Sequence: Synthetic coding sequence
atgtcaaaaggcaccagttctgacaccagtcttggcagagtctcacgtgcagccttcccctcaccaacagccgcagagatggcggagatcagccgcatccagtatgaaatggagtatactgagggtatcagccagaggatgcgagtgcccgaaaagctcaaagtcgcccctcctaacgcagacctcgagcaaggctttcaggaaggtgtcccgaacgcttccgtcattatgcaggtgcccgaacgcatcgtggtcgccggaaacaacgaagacgtttccttcagtcggcctgctgatctggacctgattcagtcaactcctttcaaacctctggccctaaagaccccgcctagagtgctgacgttgtccgagcggccattggatttcctggaccttgagcgccctcccacaactccccaaaacgaggagattcgcgcagttggccgacttaagcgggagcgcagcatgagtgagaacgctgtgcgccagaacggtcagttggtcagaaacgatagtctatggcatcggtccgattctgccccacgcaataagatatcgcgcttccaggccccaatttcagcgcctgaatacaccgtgactccttccccccagcaagcgcgagtctgtccacctcacatgctgccagaagacggggctaacttatcatccgcaagaggaattttgtcactgattcagagcagcacacggagagcatatcagcaaatcctagatgtacttgacgagaaccgccgtcctgtcctgagagggggaagcgccgctgccaccagtaatccacaccacgacaatgtgaggtatggaatcagcaacatcgataccaccatcgaaggcacgagcgatgatctgactgttgtcgacgcagcttccctcagacgccagatcattaaactgaacagacgactgcaactgctggaggaggaaaacaaggaaagagccaaaagggagatggtcatgtattccattacagtagccttttggctcttgaacagttggttatggttccgccgatag

SEQ ID NO: 51770 - DNA, 657 bp, Artificial Sequence
  Description of Artificial Sequence: Synthetic coding sequence
atggcggaaataagtaggatacagtacgagatggagtatactgaaggtatatcccaaaggatgcgagttccagagaagcttaaggtggccccaccgaacgccgatcttgagcagggttttcaagaaggggtcccaaatgcatccgttattatgcaagtgcctgagcgcatcgtcgttgccggaaacaacgaggatgtctctttctcccgacctgcagatcttgacttgatacagtccactccctttaaacctctcgctctgaagacaccacctagagtacttaccctgagtgagcgccctctcgacttcttggacctggaacgtcccccaacgacacctcagaatgaggagatcagagcagtcgggaggctgaagagagaacggtcaatgagtgagaacgctgtgagacagaacgggcagctcgtccgcaatgattctctctacgggatctctaatatagacactacaatcgagggaacttcagatgacttaacagtggtggacgccgcttccttgcggaggcagattattaaactcaacaggcgtctacagctgttagaggaagaaaacaaagaaagagcaaaaagagaaatggttatgtactcaatcaccgtggccttctggctgctcaatagctggctatggtttcggaggtag

SEQ ID NO: 51771 - DNA, 717 bp, Artificial Sequence
  Description of Artificial Sequence: Synthetic coding sequence
atggccgagatctcaaggatccagtatgaaatggagtacaccgaggggatctcccagagaatgcgggtgcctgagaagctcaaagtggctccaccaaatgctgatctggaacaagggtttcaggaaggagtgcctaacgccagtgtgattatgcaagttcctgaacgcatagtcgtagccggaaacaatgaggatgtgagcttttcccgtccagcagatctggatctgattcagtctaccccattcaaaccattagctctgaagactcctccaagggttctcaccctgtcagagcgtccattggattttttggatttggaaagaccacccacgacaccacaaaacgaagaaattagagcagtaggcaggctaaaacgagaacggtcgatgagcgagaatgccgtgcggcagaacggacagttggtgcgtaacgactccctgcccgtgcttagaggcggatccgccgcagccacgtccaacccccatcacgacaatgtccgctacggtatcagcaatattgatactacgattgaaggcacaagcgatgacctgaccgttgtcgacgctgcctcactgcggcgtcagataataaagctgaatcgcagactgcagctgttagaagaggagaataaggagcgcgcaaaaagggagatggtgatgtattccatcactgtggccttctggctcctaaattcttggttgtggttccgtaggtag

SEQ ID NO: 51772 - DNA, 183 bp, Artificial Sequence
  Description of Artificial Sequence: Synthetic coding sequence
atggcggagatctctcggattcaatacgagatggagtacaccgaaggcatcagccagagaatgagggtaccagagaaactgaaggtggcaccacccaatgcggatctggaacaaggctttcaagagggagtgcctaacgcttcggtgattatgcaagtgcccgagcggatcgtggtcgcctag

SEQ ID NO: 51773 - DNA, 99 bp, Artificial Sequence
  Description of Artificial Sequence: Synthetic coding sequence
atggcggagataagccgcatccagtatgagatggagtacacagagggtatttcccagagaatgcgagtgcccgaaaagcttaaggtggctccaccctag

SEQ ID NO: 51774 - DNA, 105 bp, Artificial Sequence
  Description of Artificial Sequence: Synthetic coding sequence
atgagtaagggcacgtcttctgatacctccctcggcagggtgtcacgcgctgccttcccaagcccaaccgcggcagagatggcagagatcagtcggattcaatag

SEQ ID NO: 51775 - DNA, 216 bp, Artificial Sequence
  Description of Artificial Sequence: Synthetic coding sequence
atgtcaaaaggcaccagttccgacacaagcctagggagggtgtcacgcgctgcattccctagtcctacagccgctgaaatggcagagatttccaggatacagtatgaaatggagtacactgagggtattagtcagcgaatgcgggtgcccgagaaactgaaagtcgcccctccaaacgccgacctcgagcagggatttcaagagggagtgccctag

SEQ ID NO: 51776 - DNA, 417 bp, Artificial Sequence
  Description of Artificial Sequence: Synthetic coding sequence
atggccgaaatcagtaggattcagtatgaaatggagtacacagagggcatcagccaacgaatgagagtacccgagaagctcaaagtggctcccccaaacgccgatctggaacaagggtttcaggaaggggtcccaaacgcatcggttattatgcaggttccagaacggattgtggtggctggtaacaacgaagacgtgagctttagtcgccctgcggatctcgacctcattcagtcaaccccattcaaacccctggctctcaagacaccacctcgggtcctcactctgagcgaacgcccactggacttcttggacctggaacgacccccaaccacaccacagaacgaagaaattcgagcagtgggacgacttaaacgggagaggagtatgtctgagaatgcagtacgccaaaactag

SEQ ID NO: 51777 - DNA, 159 bp, Artificial Sequence
  Description of Artificial Sequence: Synthetic coding sequence
atggccgagatctcccgaatccaatacgaaatggagtacaccgagggtatcagtcaaagaatgcgcgtgcctgaaaagcttaaggtcgcaccccctaatgccgacctggagcaaggattccaagagggcgtgcccaatgcatcagttatcatgcagtag

SEQ ID NO: 51778 - DNA, 501 bp, Artificial Sequence
  Description of Artificial Sequence: Synthetic coding sequence
atgagtgaaccgcagccgagaggagcagagcgggatctgtatagggacacgtgggtgaggtatttaggctatgcaaatgaggtgggagaagccttcagatctctggtacctgccgctgtcgtctggctgtcctatggggtggcctcctcgtacgtacttgcagatgccatcgacaaaggaaagaaggcgggtgaggtccccagtccagaggctggaaggagtgctagggtgaccgtcgcagtggttgacaccttcgtttggcaggcactggcatccgtcgcgatccccggattcaccatcaaccgtgtttgtgcagccagcctgtacgtgctgggcacggcaacacgctggcccctcgccgtgcggaaatggacaacgaccgcccttgggctcctgactatacccataattatccacccaattgataggagtgtagacttcttgctggattcctctctgaggaagctgtatcctactgtgggcaagccaagttcctcctag

SEQ ID NO: 51779 - DNA, 408 bp, Artificial Sequence
  Description of Artificial Sequence: Synthetic coding sequence
atgtccgagcctcaaccacgaggggctgagcgggatctttatagagatacctgggtgcgttacctgggctacgccaacgaggttggcgaagcattccgctcactggttcccgcagctgttgtatggctctcttatggcgtagccagtagctatgtgctggccgatgctatcgataaagggaagaaagccggagaggtgggtgggttccctcctggactgcagcccgcacaggctctgcctaattctggggaggctcaattacttcttatcatcctgtggtacctagcatgcgcctcagcatcatgctttatgtcgactagctactcgtgccaaggcatgtggacccccggatccctggtgtcaaaagatcctggaacatgggtcggcctgagttggacggaagcctag

SEQ ID NO: 51780 - DNA, 1002 bp, Artificial Sequence
  Description of Artificial Sequence: Synthetic coding sequence
atgctgggatggattaaaaggttgatccgcatggtgttccagcaggtgggggtcagcatgcaatccgtactctggagcagaaagccctatgggtcaagccggagtattgtaaggaagatcgggactaacctgtccttaattcaatgcccgagggtacaattccagattaatagccacgcgacagagtggtcgccaagccatcccggagaagacgctgtggctagcttcgcggatgtcggttgggttgcaaaggaggagggtgaatgttccgcgaggcttcggactgaagttagaagtagacctcccctccaggatgacctgctcttcttcgagaaagctccaagccggcagatctctctacccgacctcagtcaggaagaaccccagctgaagacccccgctcttgcaaatgaagaggccttgcaaaagatctgtgcgctcgagaacgaactcgcagcactgcgggcacagattgccaaaatcgtcacccagcaggaacaacagaacctcacagctggcgaccttgacagcacgacatttggcaccatccctccgcaccctccgccaccaccaccgccactgccaccacctgcgctcgggcttcatcagtccacgagcgcggtggatttaattaaagaaaggcgagagaagcgggcaaatgctggaaagacgctggtcaagaacaacccaaaaaagcccgagatgcctaatatgttagaaattctgaaagagatgaattccgtgaaactgcgaagcgtgaagcgaagtgaacaggatgtgaaaccaaagccagttgatgctacagatccagctgccctaatagctgaagctctcaagaagaagtttgcttatcgctacaggtctgatagtcaagatgaggttgagaaagggatcccaaagtctgaaagtgaggctaccagtgaaagggttctgtttgggccacacatgctgaaacccaccgggaaaatgaaagctctgatcgaaaatgtgagcgactcctag

SEQ ID NO: 51781 - DNA, 903 bp, Artificial Sequence
  Description of Artificial Sequence: Synthetic coding sequence
atgttgggatggataaaacgcttgattcggatggtgtttcagcaggtgggggttagcatgcagtccattaattcacacgcaactgagtggtcgccctcgcatcccggtgaggatgctgtggcctcgtttgcggatgtgggctgggtcgctaaggaagaaggtgagtgcagcgcacggctcaggacagaggtccggtctaggcccccactgcaagacgacctgcttttttttgaaaaggccccttcaaggcagatcagcctgccagacctgtcacaggaagagccccagctgaagacaccggctctggccaatgaggaagctctgcaaaagatttgcgcgctcgagaacgagctggcggctttaagagcacagatagctaagatagtaactcagcaagaacaacagaatctaacggcgggagacctcgactcgaccacattcggcaccattcctccacacccgcctcctcccccaccaccgctgccaccacctgccctcgggctgcaccagtctacaagtgcagtcgacctgatcaaagagcgccgagaaaagagggcaaatgcaggaaagaccctggtgaaaaataacccaaaaaaaccagagatgcctaacatgttggagatcctgaaagagatgaacagcgtcaagttgcgatcagtcaagagaagtgagcaggacgtgaagcctaaacctgtggatgcaacggacccagctgccctgatagctgaagctctcaagaaaaagttcgcgtacaggtaccggtctgactctcaggatgaggtggagaagggcattcctaagagtgagtccgaggccacctccgaacgagtgctgtttggcccacacatgctcaaacctactggcaaaatgaaggcactgatcgaaaatgttagtgactcctag

SEQ ID NO: 51782 - DNA, 1005 bp, Artificial Sequence
  Description of Artificial Sequence: Synthetic coding sequence
atgaggctgactcctcgcgctctgtgttcagctgcccaggcagcttggagagaaaactttcctctgtgtggacgggatgttgccaggtggttcccgggtcacatggccaagggactgaagaagatgcagtcatccctcaagttggtggattgcatcatcgaagtgcacgacgccagaatacccctgagtggaaggaacccgctgttccaagagacgctcggactcaaaccccatctcctcgttctgaacaaaatggatctggcggacctgacagagcagcaaaaaataatgcagcacttagaaggagaggggcttaagaatgtgatttttacaaattgcgtgaaggacgagaatgttaagcaaatcattcccatggtgactgaattgattggccgttcccaccgctaccaccgaaaagagaatctggagtactgcattatggtgatcggggtgcccaacgtaggcaagtctagtcttatcaactccttgcggagacagcacctgaggaagggaaaggccaccagggtgggaggcgaacccggaataactcgcgctgtgatgtccaagattcaggtatcggaaagaccgttaatgtttctactcgataccccaggtgtattagcaccgcgtatcgaatccgtggaaacggggctaaagctcgcactgtgtggaactgttttagatcacctggtgggggaagaaaccatggctgattatctcttatacacattgaacaaacatcagaggtttggctatgtgcaacactatgggcttggttctgcttgcgacaatgtggaacgggttctgaagtccgttgcggtgaagctcggtaaaacccaaaaggtaaaggtcctgaccggcacaggtaacgttaacattattcagcctaactatcccgcagccgcaagagacttcttacaaacttttcgcagaggactgctgggctcagtcatgcttgacctagacgtgctgcgcggacatcctcccgctgaaactctcccatag

SEQ ID NO: 51783 - DNA, 852 bp, Artificial Sequence
  Description of Artificial Sequence: Synthetic coding sequence
atgcgactgaccccaagggcgctgtgctctgcagcccaggccgcatggagagagaacttccccctgtgcggaagagatgtcgcaaggtggtttccagggcacatggcaaaaggactgaagaagatgcaatcatcactcaagctcgttgattgcatcatagaagtacacgacgccaggattccattgtccgggaggaatcccttatttcaggagacgcttggtctcaagcctcatctgttagtcttgaacaaaatggatctggcggacctcactgaacaacagaaaattatgcagcacctggagggcgagggtcttaaaaatgtgatttttaccaattgcgtgaaggacgaaaatgtcaagcagatcatccccatggtcaccgaattgataggcaggtcccacagatatcatcgtaaagaggtgtccgagcgcccattaatgtttctgcttgacacaccaggagttttggcccctagaattgaatccgtggaaaccggactcaagctggccctatgcggaacggtcctcgatcatcttgtcggcgaggagactatggctgactacctcctgtacactctgaataaacaccagcgtttcggatatgtccagcactacgggctgggctctgcctgtgacaacgtggaacgggtgcttaagtccgtcgccgtgaagctgggcaaaactcaaaaggttaaagtgctgaccggcacaggaaatgtcaacatcatccagccaaactatcccgctgccgcaagggactttctgcagaccttccgcagaggtctcctcgggtctgtgatgctggatctggacgtgctccgcggacaccctccagctgagactctaccttag

SEQ ID NO: 51784 - DNA, 681 bp, Artificial Sequence
  Description of Artificial Sequence: Synthetic coding sequence
atgcagagcagtttgaaactggttgactgtatcattgaagtgcacgacgccaggatccctctcagcggacggaacccactgtttcaggaaactctgggacttaagcctcacctactagtgttgaacaaaatggatctggccgacttgaccgagcaacagaagatcatgcaacatcttgagggagagggcctgaaaaatgttatcttcacgaattgtgtgaaggatgaaaatgtcaaacaaataattcctatggtgactgaactgatcggtaggagtcatcggtatcacagaaaagagaacctggagtattgcattatggtcatcggagttccaaacgtgggtaagtccagcctgatcaattcgctgaggaggcagcatctgaggaaaggtaaagccacacgagttggaggagaacccggaattacccgtgcagtgatgtctaagatccaggtggaaagctccggggctaggccctccaccctgtctcgagctctgcaggcaagtggtacttgtcgcccactttgcgggtttagactccttactactctccctagcccacctctttctgtgccagccgagcacccaagaggcagacactgcccgtgcccctacagtactgtggttattgtttttgcccctaacctctggggaagacacgccgtatttccaattagtaggtag

SEQ ID NO: 51785 - DNA, 237 bp, Artificial Sequence
  Description of Artificial Sequence: Synthetic coding sequence
atgagtgagagcgaactggggcgaaagtgggacaggtgcctggcagatgctgttgttaagataggcaccggatttgggctcggcattgtgttctccctgaccttcttcaagcgccgaatgtggccactggccttcggaagtggtatgggacttggcatggcatactctaattgccagcacgacttccaggccccttatctgctccacggcaaatacgtgaaggaacaggagcagtag

SEQ ID NO: 51786 - DNA, 1467 bp, Artificial Sequence
  Description of Artificial Sequence: Synthetic coding sequence
atgaattctcagaccgaagaccatgctctcgcccctgtgcgcaacacaattcagctgcctacacagcctctcaactctgaagagtgggataagctgaaggaagacctgaaggagaacaccgggaaaacttcctttgaatcttggattatttcacagatggcgggttgtcattcgagcattgatgtagccaaatctctcctggcctgggttgcagccaagaacaatggaattgtatcatacgatctcctggttaagtacctatatctttgcgtctttcacatgcagacttcagaagtgatcgacgtctttgagatcatgaaggccagatacaaaactctggagcccagggggtactccttattgatacggggtttgattcatagcgatagatggagagaggctttgctgctgctagaggatattaagaaagtgataacaccctctaaaaaaaactacaacgactgtattcagggagcattgctacatcaggatgtaaacacggcctggaacttgtatcaggagctgctcggtcatgacattgtgcccatgcttgagacacttaaggccttttttgactttggcaaggacattaaggacgacaactattcgaataagctcctggacatactgagctatctgaggaataaccagctataccctggagagagtttcgctcattcaatcaaaacttggtttgagagcgtgcctggaaagcagtggaaaggacagtttactacagtgcgtaaaagcggtcagtgctccgggtgcgggaaaacgatcgaatctattcagttgagccctgaagagtatgagtgtcttaaaggaaagataatgcgggatgtgattgatggcggagaccagtataggaaaacgactccccaagaactgaaacgatttgagaactttataaaaagccgccctccattcgatgtggtgatcgacgggctgaacgtggccaaaatgtttcccaaagttagggagtcccaactgctactcaatgttgtttcccagctggccaaaagaaatctgaggcttctcgtgctagggaggaaacacatgctgagacggtctagtcagtggtcccgagatgagatggaggaagttcagaaacaggctagctgcttctttgcggatgacatctccgaggacgatcccttcctattgtatgcaacgcttcactctggcaaccactgtcggtttataacccgggacctgatgcgggatcacaaagcctgccttccagatgcaaagacgcagaggttattttttaagtggcagcaggggcaccagcttgccattgtgaaccggttcccgggtagcaagctgacattccagaggattttgtcttatgatactgttgtgcagaccaccggagattcttggcacattccatacgacgaggacctggtggagagatgctcctgtgaagtgccaacaaaatggctgtgccttcaccagaaaacctag

SEQ ID NO: 51787 - DNA, 1704 bp, Artificial Sequence
  Description of Artificial Sequence: Synthetic coding sequence
atgaccttctatttgttcggaataagatcctttccaaaactgtggaagtcgccatacctcggactggggcctggacactcatatgtctcactttttttggccgaccgatgcggtatacggaatcagcagcgactcttcagtcttaaaactatgtccccccagaatactaaggccaccaatctgattgcaaaggcgaggtatcttagaaaggatgaaggcagtaacaaacaggtgtactctgtgccgcacttctttctcgctggggctgccaaagagaggtcccaaatgaatagccagacagaggaccacgccctcgcgccagtgcgtaacacaatccagttaccgacacagcctttgaattcggaagaatgggacaaacttaaagaggacctgaaggagaatacgggaaaaacatcgtttgaatcctggataatcagccagatggccggttgccactccagtatcgacgttgccaagagcctcctagcctgggtagccgctaagaataatggtattgtgtcttacgacttgctggtgaagtacctgtacctttgtgttttccacatgcagacctcagaggttatcgatgtatttgagattatgaaggctcgttataaaaccctggaacccagggggtactccctgcttatccggggtcttatacactcagatcgatggagagaggcactgctcttgttggaagatatcaaaaaggtcattacaccatcaaagaaaaattacaacgactgcatacagggagcgttgttacatcaggacgtgaacaccgcctggaatttgtatcaggaactcctgggccacgacatagtgccgatgctggagacactgaaggctttctttgattttggcaaagatattaaagatgataactacagtaacaagcttctggatattctgagctacttgcgcaataatcagctctaccccggtgagtccttcgcgcacagcatcaagacttggtttgaaagtgggcagtgtagtggttgcggtaaaactatcgaatcaattcaacttagccccgaagaatatgagtgcttaaaaggtaaaataatgagggatgttattgacggtggcgaccaatacaggaaaacaacaccacaggagctcaagaggtttgagaacttcatcaagagccggccacctttcgatgttgtcattgacggactgaacgtagcaaagatgttccctaaggttagggaatcccagcttttactcaacgtggtatcccagctcgcaaagcgtaacttgcgcctcctggtgcttggcaggaagcacatgctgcggagatcatcccaatggtcccgcgacgagatggaggaggtccagaaacaggcatcctgcttcttcgctgacgatatatctgaagacgaccctttccttctttacgcaaccctgcattctgggaaccattgccggtttatcactagggatttgatgagagatcacaaggcttgtctaccggatgcaaaaacccagcgattgttctttaagtggcagcagggtcaccagctcgccatagtgaacagattcccaggaagcaagttgacttttcagcgaatcctgtcttacgacactgtcgtccagactaccggggactcctggcatatcccatacgacgaggacctggtggagagatgcagctgcgaagtgcctaccaagtggctctgtctccatcaaaagacatag

SEQ ID NO: 51788 - DNA, 1752 bp, Artificial Sequence
  Description of Artificial Sequence: Synthetic coding sequence
atgactttttacctgtttggcattaggtccttccctaagctctggaagtctccttacctgggcttgggtcctggacactcctatgtttctctgtttctagccgacaggtgcggtattcggaatcagcaaagactgttttccctgaagaccatgtctccccagaataccaaagccaccaacctgattgccaaagctagatatctgaggaaggatgagggctctaacaagcaggtatactcggtacctcactttttcctggccggagcagcgaaggagcgcagccagatgaatagtcaaaccgaagaccacgctctggcgccagtaagaaacactattcagttaccaactcagcccctcaacagtgaggaatgggataaactgaaagaggaccttaaggagaatactggtaaaacctcgttcgagtcatggatcatctcacagatggcaggttgccattcttctatcgacgtcgctaagtccctcctggcctgggttgccgctaagaataatgggatcgtgtcttacgacctgctggtcaaatatctctatctgtgcgtttttcatatgcagaccagcgaggtcatcgacgtgttcgagattatgaaagcacgttacaagactctggagccacgcggatactccttgctgatccgtggcttgatacattccgaccggtggcgggaagccctgttactgctagaagatataaagaaggtgatcactccatctaagaaaaattacaatgactgcatccaaggtgctctactccaccaagacgtcaataccgcttggaatctctatcaagagctccttggacacgacattgttccaatgctggagacactcaaagccttctttgatttcgggaaggacatcaaggacgacaattacagtaataaacttctggacatcctgagctacctcagaaataatcagctgtacccaggagagtcctttgctcactcgattaagacttggttcgaatccgttcctgggaagcagtggaaggggcagtttaccacagtccggaaatctgggcagtgttccggctgcggcaaaacaatcgagagtatacaactgagccccgaggagtatgaatgtctgaagggcaagatcatgcgtgacgtaatagacggcggagaccagtacagaaaaaccaccccacaggagctgaaacgttttgaaaacttcattaaatccaggcctccctttgatgtggtgattgatggcctgaacgtcgcgaagatgttccccaaagtgcgcgagtctcagttgcttttaaacgtggtaagccagctggctaaacgaaacctgcgcctgctggtgctaggtcgaaagcacatgctgaggaggtcctctcagtggtctcgcgacgagatggaggaagtgcagaaacaggccagctgcttcttcgctgatgatatctctgaggacgaccctttcctcttgtatgccacgctccactctgggaaccattgccggttcatcaccagggacctgatgcgagatcacaaggcgtgcctgcctgacgcaaagacgcagaggctattttttaagtggcagcaaggccatcagctcgcaattgtaaatagatttcctggatctaaactaaccttccagcggatcctaagttatgacaccgtagtgcagaccactggcgattcatggcatatcccttatgacgaggatctagttgagagatgttcttgtgaggtccctacaaagtggctgtgtttacatcagaagacatag

SEQ ID NO: 51789 - DNA, 105 bp, Artificial Sequence
  Description of Artificial Sequence: Synthetic coding sequence
atgactttttacttatttgggattcggtctttccccaagctgtggaagtctccttacttaggattggggcctggccattcctatgtgagcctgttcttagcctag

SEQ ID NO: 51790 - DNA, 63 bp, Artificial Sequence
  Description of Artificial Sequence: Synthetic coding sequence
atgactttttatctgttcgggattagatcattccccaagctgtggaagtcaccctacctgtag

SEQ ID NO: 51791 - DNA, 1467 bp, Artificial Sequence
  Description of Artificial Sequence: Synthetic coding sequence
atgaactcacaaactgaggaccacgctttggctccagtgcggaatactatacagctgccaactcagcctctgaattctgaggaatgggataaattgaaggaggaccttaaggagaacactggtaagacatccttcgaatcctggattatatcccagatggcaggatgtcacagttccatcgatgttgccaaaagtctgcttgcatgggttgcagctaagaataacggtatcgtgtcttacgatttgctcgtgaaatacctatatctctgcgtctttcacatgcaaaccagtgaagtgatcgatgttttcgaaattatgaaggcacggtataaaaccctcgagccacgcggatactccctccttattcggggtctcattcattccgatagatggcgggaagccctcctgttgctggaggacattaagaaagtgatcactccatcaaagaagaactacaacgattgcattcagggcgcacttttacaccaagacgtgaacaccgcctggaacctctatcaggaactgcttgggcacgatatagtgcctatgctggagactctcaaggcatttttcgacttcgggaaggacatcaaagacgataactacagcaacaaattgctcgatattctatcctacctgcggaacaatcaactgtaccctggcgagtccttcgctcatagtataaaaacttggttcgagagcgtacccggaaaacagtggaagggccagtttaccaccgtaaggaaaagcggacaatgcagcgggtgcggtaaaacaatagagtcaattcaactcagtcccgaagaatatgagtgtcttaaagggaagataatgcgtgacgtcatagacggaggagatcagtatcggaagaccacaccccaggagttaaagagatttgagaattttatcaaaagccggcctcctttcgatgtagtcattgacggactgaatgtggcaaaaatgttccccaaagtgagagagagccagctcctcttgaatgtggtatcccaactggctaagcgaaacctgcggctgcttgtcctcgggcgtaaacatatgttgcgacgcagttcgcaatggtcccgcgatgaaatggaggaagttcagaaacaggctagctgtttcttcgctgatgacatatcagaggatgacccattcctcttatacgccaccctccacagtggcaaccattgccgatttattactagggaccttatgcgagatcacaaagcatgtctgcccgatgccaaaacacagaggttattctttaaatggcagcagggacatcagcttgccatcgtgaacagattcccgggaagcaaactgactttccagcgcatcctcagttacgatactgtggtgcagaccacaggcgattcgtggcacattccttatgacgaggacctcgtagaacgttgtagctgcgaggtccccacaaaatggctctgtctacaccagaagacctag

SEQ ID NO: 51792 - DNA, 72 bp, Artificial Sequence
  Description of Artificial Sequence: Synthetic coding sequence
atgaccttttatttattcggcataagaagttttcctaagctgtggaagtccccttatttgggcctcggatag

SEQ ID NO: 51793 - DNA, 1704 bp, Artificial Sequence
  Description of Artificial Sequence: Synthetic coding sequence
atgacgttttatcttttcggtattaggagctttcctaagctgtggaaaagcccctaccttggattaggccctggacacagctacgtctccctttttttagcagatcggtgcgggattagaaatcaacagaggctgttttcgttgaagactatgagtccccagaatacgaaggctaccaacctcatagccaaagcccgatacctgagaaaggatgagggaagtaataaacaagtatactccgtaccgcatttcttcttagcgggtgcagcaaaagagaggtcacagatgaattctcaaactgaggatcacgcccttgcccctgtccgaaatacaatccaactcccgacccagcctctgaactccgaggaatgggacaaactgaaagaggacctaaaagaaaatacaggtaaaacatctttcgaatcatggatcatttctcagatggccggatgtcatagctcaattgatgtggcaaaaagccttcttgcgtgggtcgccgcaaaaaataacggcatcgtttcctacgatttgctggttaagtacctctacctctgcgtttttcatatgcagacaagtgaagttatcgacgtgttcgaaattatgaaggctcgttataaaaccttggagcctcgcggatactcactgctcatccgaggactgatccactctgataggtggcgcgaagcacttttgctgctcgaggacattaaaaaagttatcacacccagcaagaagaattataacgactgtatacagggggctctgttacaccaggacgtgaacaccgcctggaacctctatcaggaacttttgggacatgatatagtgcccatgctcgagacactcaaggccttcttcgactttgggaaggatattaaagatgataactacagcaataaactcctggatatattaagctatctacgcaataaccagctgtatccaggagagtcgttcgctcactcgattaagacatggttcgagagcgggcagtgctccgggtgcgggaagacaattgaaagtattcaattgtccccggaggagtacgaatgcctaaagggcaaaataatgagagatgtgatcgatggaggtgatcagtacaggaaaaccactccacaagaactgaaaaggttcgagaatttcattaagtcaagaccacccttcgatgtggtgattgatggactgaacgttgctaaaatgtttcccaaagtgagggagtcacaacttctcctgaacgtcgtaagccaactcgccaaacgaaaccttagacttttagtcctgggcaggaaacacatgctccgtcgtagttctcagtggtccagagatgagatggaggaagtgcagaaacaagcctcctgcttttttgccgatgatatttcagaggatgatcccttcctgttgtatgcaacactgcattcaggcaatcactgcagattcatcacacgcgacctaatgcgagaccacaaagcttgtctgcccgatgctaaaacccagcgacttttcttcaaatggcagcagggtcaccagctagcaatcgtgaataggtttcccggaagcaagctgacattccaaagaattctgtcatatgatactgttgtccagacgactggggactcgtggcacattccatatgacgaggatttggtggagagatgctcttgtgaagtgcctacaaagtggttatgtcttcaccagaagacttag

SEQ ID NO: 51794 - DNA, 636 bp, Artificial Sequence
  Description of Artificial Sequence: Synthetic coding sequence
atgcgcgacgtgatcgacggtggagatcagtatcggaagaccacccctcaagaactcaagcggttcgagaacttcattaaatctagaccgccttttgacgtagtgatcgacggtctgaacgtggccaagatgttccctaaggtgcgggaatcccagctcttattaaacgtggtgagtcagctggccaaaagaaatcttcggcttctggtgcttgggaggaagcatatgttgaggaggtcatcacagtggtcaagggatgaaatggaagaggtgcagaagcaggcctcctgttttttcgctgacgacatcagtgaagacgatccattcttgctttacgctaccttacatagcggaaaccactgtagattcatcacgagagatttaatgcgtgaccacaaggcttgtctgccagacgctaagacacagcgcttgttcttcaaatggcagcagggccatcagctggccattgttaacagatttccaggttccaagctgacatttcaaaggatattgtcctacgataccgtggtgcagactaccggggattcttggcacataccttacgatgaggacctagtagaacgctgctcttgtgaggtgcctactaaatggctgtgtcttcatcagaagacttag

SEQ ID NO: 51795 - DNA, 633 bp, Artificial Sequence
  Description of Artificial Sequence: Synthetic coding sequence
atggccctgggactgaagtgcttccgtatggtccacccgaccttcaggaactaccttgccgctagtattcggccagtgtccgaggtgactctcaagaccgtccatgaacggcagcacggacaccgacaatatatggcctactccgcagttcccgtgcgccacttcgcgactaaaaaagcaaaaggttcactggacaagatcgcggtggttaccgccgacggaaagctggctctcaatcaaatttcgcagatctctatgaagtccccccagctaatcctggtgaacatggcctcttttcctgaatgtaccgcagcagcaatcaaggccatccgggagagcggtatgaatttgaatcccgaagtggagggaacactgattcgggttcctataccacaagtgactagagagcaccgggagatgctggtgaaactggcgaagcagaacactaacaaggctaaagactcactcaggaaagtgcggaccaatagtatgaataagttgaagaagagcaaagacaccgtgtcagaggacactatcagattaattgaaaagcagatctcgcaaatggccgacgatacagttgctgaattggataggcacctcgcagtcaaaacaaaggagctactgggctag

SEQ ID NO: 51796 - DNA, 789 bp, Artificial Sequence
  Description of Artificial Sequence: Synthetic coding sequence
atggccctgggcctcaagtgttttcgtatggtccaccccactttccgaaactatttagccgcatccatcaggccggtttccgaagtcactctcaaaacagtgcacgaaaggcagcacgggcatagacagtacatggcatattccgccgtgccggtgcgccattttgccactaagaaggctaaagccaagggaaagggacagtcacaaacaagggtaaatattaatgctgccctcgtggaggatataatcaacctggaggaggtgaacgaggaaatgaaaagcgtcatagaagccctcaaggacaacttcaataaaaccttgaacatccggacctcccctggatcattagacaagatcgccgtcgtgactgccgatggcaagctggccctcaaccaaattagccagatctcgatgaagtcacctcagcttatcctggttaacatggcatctttccctgagtgtactgccgcagccattaaggctataagggaatccggtatgaacctgaaccctgaagtggaggggaccctgataagggtccccattccacaggtgaccagggagcaccgggagatgctcgtgaagctggcgaaacagaatactaacaaagcaaaagattccttgcggaaagtccggaccaatagtatgaataaattgaaaaaatccaaggacacagtttccgaagatactattcgcttgatcgagaagcagatctcccagatggcagatgacaccgtggcggagctggatcgtcatcttgctgtcaagaccaaagaactgctcggctag

SEQ ID NO: 51797 - DNA, 606 bp, Artificial Sequence
  Description of Artificial Sequence: Synthetic coding sequence
atggctttgggcctgaaatgtttccgcatggtgcaccccaccttccggaactacctggccgcatctatccggccagtttcagaggtgactctcaagactgtgcacgagaggcaacacgggcatcgacagtatatggcatactccgcagtacccgttcgacacttcgctacaaagaaagccaaggcaaaagggaaaggccagagccagactagagttaacattaacgctgcactcgtcgaagatataataaacttggaggaagtgaacgaggaaatgaagtcggtgattgaggccctcaaggacaactttaataagaccctgaatataaggacttccccaggaagcttagataagattgccgtcgtgacggccgacggcaagctagccttaaaccaaataagccagatatcaatgaagtccccgcagctgatcctggttaacatggccagtttccccgaatgcactgcagctgctatcaaagccatcagggaatctggtatgaatctgaaccccgaggtagaaggtacacttattcgcgtgccgattccgcagtcagccaagtggcctatgacccagtggcagaattggacaggcatctggcagtag

SEQ ID NO: 51798 - DNA, 375 bp, Artificial Sequence
  Description of Artificial Sequence: Synthetic coding sequence
atggcctacagcgccgtgcccgtgcgtcactttgctacaaaaaaagcgaaggcgaaaggtaagggccagtctcaaacacgggtgaatataaacgctgctctagtggaggatattattaacctcgaggaagtgaacgaagaaatgaagtctgtgatcgaagctctgaaggacaactttaataaaaccctgaatattaggacctctccgggtagtctggacaagatagcagtggtgactgccgatgggaagctggccctcaatcaaattagtcagatctcaatgaaaagcccgcagttaattctcgttaatatggcttccttcccggaaacaatgaaacaaattaagcagtactttaacggcccaaacgtcgcctag

SEQ ID NO: 51799 - DNA, 477 bp, Artificial Sequence
  Description of Artificial Sequence: Synthetic coding sequence
atggccttaggcctaaagtgcttccggatggtgcatcccacgttcaggaattacctggccgcttcaatacgccctgtgtccgaagtaactctaaaaaccgtccatgagcgacagcacggccacagacagtatatggcctacagtgccgtccccgttaggcacttcgccacgaagaaagccaaagctaagggcaagggccagtctcaaacccgcgttaacattaacgcagcattggtggaggatatcattaacctggaggaggtcaacgaggaaatgaaatccgtcatcgaggcactgaaagataacttcaataagacactgaatatccggaccagccccggttcactagataaaatcgccgtggtcacagccgacggcaaactcgcgttgaatcagatcagccaaatatccatgaaaagcccgcaacttatattggttaacatggcctcattcccggaagtcaggtggccatgctag

SEQ ID NO: 51800 - DNA, 477 bp, Artificial Sequence
  Description of Artificial Sequence: Synthetic coding sequence
atggcgttagggctgaagtgctttcgtatggtccaccctacttttagaaactacttggccgctagtatcaggcctgtgtcagaagttacgctgaagacggtgcatgagagacaacatggacacagacagtacatggcttacagcgctgtacccgtgagacacttcgccacgaagaaggccaaggcaaaggggaaggggcagtcccagacaagggtaaacatcaatgccgctctggttgaggacatcataaatctcgaggaggtcaatgaagaaatgaagtccgtaatagaagctctgaaggataattttaacaaaacgctgaatattcggacgtcaccaggatcgcttgataaaattgctgtggtcacagccgatggaaaactggcacttaatcaaatttcccaaatttcgatgaagtccccacaactgatactcgtgaatatggcctcctttcccgaggtcaggtggccctgctag

SEQ ID NO: 51801 - DNA, 657 bp, Artificial Sequence
  Description of Artificial Sequence: Synthetic coding sequence
atggcatattccgctgtgccggtgagacatttcgcaaccaaaaaggcgaaagctaaaggcaaaggccagagccagactcgtgtgaatattaatgctgctttagtggaggatattattaatctggaagaggtgaatgaggaaatgaagagtgtcatcgaggcacttaaagacaactttaacaagacgttaaatataaggacctccccagggagcctcgacaagatcgccgtcgtgacagctgacggtaagctggccctgaaccagatcagccagatctctatgaagagcccccagctcattcttgtgaatatggcttcgttcccagagtgtacagccgcagccatcaaagccattagagagtccggaatgaacctgaaccctgaagtggagggcaccctcatccgagttccaattccacaggtgaccagggaacatagggaaatgctggtcaagttagcgaagcagaacactaataaagctaaggattcactgagaaaagtgcgcactaactcaatgaacaaacttaaaaagagcaaggacaccgtgtctgaggatacaatacgtcttatcgaaaagcagatctctcaaatggccgacgacacagtggccgagctggaccgccaccttgcagtcaagacaaaagagctgctcggctag

SEQ ID NO: 51802 - DNA, 531 bp, Artificial Sequence
  Description of Artificial Sequence: Synthetic coding sequence
atggccttggggcttaaatgctttcgaatggtccacccaacgttccgaaactatctggcagccagcatcagaccagtatcggaagtaactctaaagacagtgcatgagcggcaacacgggcacaggcagtatatggcctattcggcagttcctgtgcgccattttgccactaaaaaggccaaggccaagggcaaaggccaatcacagacacgcgtgaacataaatgcggcactagtcgaggatatcataaatctcgaggaggtaaatgaagaaatgaaaagtgttattgaggctctgaaagacaatttcaacaagacactgaacatccggactagccctggcagtctagataaaatcgctgtcgtgaccgccgacggaaagctcgccctcaaccagatatcccaaatatcaatgaagtcacctcagcttatcttggtgaacatggccagttttcccgaagaattggcctggatccgctccctccgtgttcccggtatccgctcacacttatatcaccagctggcagtgtag

SEQ ID NO: 51803 - DNA, 606 bp, Artificial Sequence
  Description of Artificial Sequence: Synthetic coding sequence
atggccctgggcttgaaatgctttcgcatggtgcacccaacctttcgcaattatttggccgcttctatccgtccagtgtctgaggtgacgttgaagaccgtacacgagagacagcatggacaccggcagtatatggcatacagcgccgtccccgtcagacattttgctacaaagaaagcaaaggctaagggtaagggccaatcacagaccagggtgaacattaatgcagcgctggtcgaggatatcatcaacctcgaagaggttaacgaggaaatgaagagcgtaatcgaggcgctgaaggacaactttaacaaaacgctcaatatcaggacctcccccggaagcctcgacaagattgctgtggtgaccgccgatgggaagctcgccctgaatcagattagccaaattagcatgaagtctccccagcttatacttgtgaatatggcttcgtttccggaatgtacagccgctgctattaaggccatcagagaatcagggatgaatttaaatccagaggtggagggcacccttattcgtgtacctatccctcaatccgctaagtggcccatgactcagtggcagaactggaccggcatttggcagtag

SEQ ID NO: 51804 - DNA, 462 bp, Artificial Sequence
  Description of Artificial Sequence: Synthetic coding sequence
atggcactggggctgaagtgtttccggatggtacaccctacgttcagaaactacttggccgctagcatccgcccagtgtcagaggtgacgcttaagacagtgcacgagcgacagcacggacacaggcagtatatggcatattctgcggtgccagtgcgacatttcgctactaaaaaggccaaagcaaaaggtaaaggccagtcgcagacacgggtgaatattaatgctgccttggttgaggatataattaatttggaggaagtgaatgaggaaatgaagtctgtgattgaggccctgaaagacaactttaataagacattgaatatccggacgagccccggttccctcgacaagatagctgtagttaccgcagacgggaagcttgccttaaatcaaatcagccaaatcagcatgaagagcccccagctcatcctcgttaacatggcctctttccccgaatag

SEQ ID NO: 51805 - DNA, 507 bp, Artificial Sequence
  Description of Artificial Sequence: Synthetic coding sequence
atggcattggggctcaagtgttttagaatggtgcacccaacatttcgaaattatctcgctgcaagtataagaccggtgagtgaggtaaccctcaagactgtgcatgaacggcagcacggccacaggcaatacatggcttacagcgctgtacctgtcaggcattttgctacaaagaaagccaaggctaaaggtaagggccagtcgcagactagggtcaacataaatgcggctctagtcgaggacatcattaatctcgaggaggtgaacgaggagatgaagagtgttatcgaggccttgaaggataacttcaacaagacgctgaacattcggacgtctccagggagcctggataaaattgcggtggtgaccgcagatggcaagttggcacttaaccagatctcccagatctcaatgaagtcccctcagctgatcttagtcaacatggccagttttccggagaccatgaaacagataaagcaatatttcaacggcccaaatgtagcttag

SEQ ID NO: 51806 - DNA, 1062 bp, Artificial Sequence
  Description of Artificial Sequence: Synthetic coding sequence
atggccctgctgtcaacagtgcggggagctacgtggggaaggttggtgacgcggcacttctcccacgcggctagacacggtgaaaggcctggaggtgaggaactgagccggctccttctggatgatttggtgcccacctctaggttggagcttttgtttggaatgaccccctgtctgttggcgctccaggccgctcgcagatctgtagcccgtctgctcctgcaggccggtaaagcaggcctccagggaaagcgggctgaactgctcagaatggccgaagctagagatatacccgtgctgagacctcggcgacaaaagcttgacacgatgtgcagataccaggtccaccagggcgtttgcatggaagtcagccccttaagacccagaccatggcgcgaagctggtgaagccagcccgggagatgacccccagcagctgtggctagtcttggacgggatccaggacccgcgaaattttggggctgtgctccggagtgcacatttcctgggtgttgataaggtgattacgtctagacgcaatagttgtcctctgacacccgtagtatccaagagcagtgccggtgcgatggaggttatggacgtattctccacagatgacctaacaggatttttgcagaccaaggcccagcagggttggctggtggcaggaacagtgggatgcccctcgacagaagatccgcagtcttctgaaatccctatcatgtcttgcctggagttcttgtgggaacggcctacgctgctagtcttagggaacgaagggagcggactttctcaggaggtgcaggccagttgtcagcttctgctgaccatccttccccgtagacagcttcctccagggctggaatctctcaacgtgtccgtggcagcgggaattctcctccatagtatctgtagccagcgcaagggatttcccaccgaaggcgaaaggcggcagctgctccaagacccgcaggaaccatctgcccgttccgaaggcttatctatggcccaacatcccggactatcctctggccctgagaaggagagacagaatgagggctag

SEQ ID NO: 51807 - DNA, 837 bp, Artificial Sequence
  Description of Artificial Sequence: Synthetic coding sequence
atggccgcactattccttaagcggcttactctccagacggtcaaatccgaaaattcctgtattcgctgcttcggaaagcatatcttgcagaaaaccgcccctgctcagctgagtccgatcgcatctgcaccgcgactcagttttctcattcacgctaaagcattctctaccgcagaagacacccaaaatgagggtaaaaagactaagaagaataagactgcgttcagtaacgttggacgcaaaatctcccagcgggtgattcacctgtttgacgagaaagggaacgacctgggcaatatgcatcgcgctaatgtgatcaggctgatggacgagagggatttgaggctggtgcagcgaaatacgtctactgaaccggctgagtaccagcttatgaccggactccagattctgcaagaacgccagcggttgcgggagatggagaaggccaaccccaagacgggcccaactctgcggaaagaactgatcctctcatccaacatcggacaacacgacctggacaccaagaccaagcaaatacagcaatggatcaaaaaaaagcatttggtgcaaattaccatcaagaagggcaagaatgtagacgtgagcgaaaatgaaatggaggaaattttccaccagatcctacagacgatgcccggtattgccaccttttcttccagacctcaggctgtgcaggggggtaaagccctcatgtgcgtgctgcgggctttcagcaagaacgaggagaaggcatataaggaaacgcaggagacacaggagcgtgataccttaaacaaagatcatggtaacgataaggaaagtaacgttctgcaccagtag

SEQ ID NO: 51808 - DNA, 837 bp, Artificial Sequence
  Description of Artificial Sequence: Synthetic coding sequence
atggccgcactgttccttaaacgtctgactctgcagaccgtcaagtccgaaaatagctgcattagatgctttggaaagcatattctccagaaaaccgcgccagcacagctcagccccattgccagcgcacctcgtctgtcattcctgatccacgccaaagcctttagcaccgcagaggatacccagaacgagggaaaaaaaaccaagaagaataaaaccgctttctccaatgtgggccgaaaaattagtcaaagggtaattcacctctttgacgagaaggggaacgatcttggaaatatgcacagagccaacgtgatccgcctcatggacgaacgtgacttgaggttggtgcaacgaaacacctcaaccgagcctgccgaataccagctgatgacaggactgcagatattgcaggagaggcagagactcagagaaatggagaaagccaaccccaaaaccggtcctacgctgcgcaaagagttgatattaagttccaacatcggacaacatgaccttgatacaaagacgaagcaaatacagcaatggatcaaaaagaagcatctggtgcagatcaccattaaaaaaggcaagaacgtggatgtgtctgagaatgaaatggaggaaatctttcatcagattctccagacaatgccgggtatcgccacattttcttccaggcctcaggctgtccagggcggtaaggctctgatgtgtgttttgagggcattctccaagaatgaggagaaggcatacaaagaaacgcaagagacacaggaaagagacacgttgaataaagatcacgggaacgacaaagaatctaacgttttacaccagtag

SEQ ID NO: 51809 - DNA, 837 bp, Artificial Sequence
  Description of Artificial Sequence: Synthetic coding sequence
atggcagctctgtttcttaaacgtttaactctccagacagtgaaaagtgagaacagctgcatccgatgcttcggcaagcacattctgcaaaaaacagccccagctcagctaagccccatcgcgtccgcaccccgtcttagctttctgatccatgccaaggccttttctaccgcagaggatactcaaaatgaaggaaagaaaaccaagaaaaacaaaacggcattttccaacgtgggcaggaaaataagccaaagggtgattcacctctttgacgaaaagggcaatgacctcggcaacatgcacagagcgaatgttatccgcttgatggacgaaagggacctgcggctcgtgcagcgcaatactagtactgaacccgcagagtatcagctgatgacaggcttgcagatccttcaggagaggcagaggctgagagagatggagaaggccaatcctaagactgggccaacactgcgcaaagaacttatactctccagcaacatcggccagcatgacttagacactaaaacaaagcaaattcagcaatggatcaagaagaagcacttagtgcagattacaatcaagaaaggcaaaaatgtggatgtctcggaaaatgagatggaagaaatctttcatcagatcctgcagaccatgccagggatcgccaccttcagcagtcgccctcaggccgttcaggggggaaaggccttgatgtgcgtgctgagggccttctctaagaacgaagaaaaagcgtacaaagaaacccaggaaacccaggagcgggacacccttaataaagaccatggcaacgataaggaatctaatgtgctgcaccagtag

SEQ ID NO: 51810 - DNA, 837 bp, Artificial Sequence
  Description of Artificial Sequence: Synthetic coding sequence
atggccgcactgttcctcaaacggttgacattgcagaccgttaaaagcgagaacagttgcatacggtgcttcggaaagcatatcttacagaagaccgcgcctgctcagttatcacctatcgcctccgccccacgcctcagtttcctgattcacgccaaggccttcagtaccgccgaggacacccagaacgaaggtaagaaaacaaagaaaaacaaaaccgctttttcgaatgtgggcaggaagatcagtcagcgggtgattcatctcttcgacgaaaaaggtaacgacctaggcaatatgcatagggcaaacgtgattagactgatggacgagcgggacctccgactggtccagaggaacacttcaacagagcctgctgaatatcagctcatgacagggctccaaatactgcaggagcgccagagactgcgagaaatggaaaaggctaatcccaaaaccgggcctacactaaggaaagaacttatactctcttctaatatcggccagcatgacctggacaccaagacaaagcaaattcagcagtggatcaagaagaaacacctcgtgcagatcactattaaaaaggggaagaatgtcgatgtgtccgagaacgaaatggaagagatcttccatcagatccttcagaccatgcctggcattgccacctttagcagcaggccacaggcagtacaggggggtaaagcactgatgtgtgttctccgcgctttttcgaaaaacgaggagaaagcctataaagagacccaggaaacacaagaacgtgacacactcaacaaagaccacgggaatgacaaagagtctaatgttttgcaccaatag

SEQ ID NO: 51811 - DNA, 681 bp, Artificial Sequence
  Description of Artificial Sequence: Synthetic coding sequence
atgaatgagaacctgtttgcatcctttattgcgcctaccattcttggccttcctgcagctgtgctgatcatcctgttccctccactgctgatccccacgtcaaaataccttataaataatcgacttataactactcagcagtggttgatcaagctgacgtccaaacagatgatgacaatgcataacacgaagggacggacgtggtcattgatgcttgtctccctgataatcttcatagccacgactaatctgctgggcctgttgccacattccttcactcccacaacccagctgagcatgaacttggcaatggccatccctctgtgggctggaacagttatcatgggctttcgttctaagattaaaaacgctctggcccattttctgccccaaggaactcctacccccctgatccccatgctcgtcatcatcgagacaatcagcctgcttatacagcctatggcacttgccgtgcgactaacggcaaatatcaccgctggccacctgttgatgcacctgatcggatctgcgaccctggccatgagcacgataaatctcccctcaacactcatcattttcacaatcttaattctgctcaccatactagagattgccgtcgcgctaatccaggcatatgtttttaccctgctcgtgtcactgtacttgcacgataacacctag

SEQ ID NO: 51812 - DNA, 1143 bp, Artificial Sequence
  Description of Artificial Sequence: Synthetic coding sequence
atgacaccaatgcggaagacgaaccccctcatgaagttgatcaatcacagtttcatcgacctgcccacaccaagcaatatatccgcctggtggaactttggttctctgctgggtgcttgcttgatcctccagataaccacaggcttgttcctggcaatgcattactctcccgatgcttccacagcctttagcagcattgcccacattaccagagacgtcaattacggctggattatcagatacttgcacgctaatggggctagcatgttcttcatttgtttatttctccacatcggtcgcggactgtattacggtagctttctgtattccgaaacctggaacattggcattattctgctgcttgctactatggccaccgcctttatgggatatgttttgccttgggggcagatgtccttctggggtgctactgtaatcacaaacctactatcagcaattccctatatcggcacagatctggtccaatggatttggggcggatactcagtcgatagccccactttaacaagattcttcaccttccatttcatcctgccattcataatcgctgccctcgccaccctgcacttactcttcttacacgagaccggttccaacaacccactgggtattacgtcacactccgacaagatcacatttcacccctactatacaataaaagatgctcttggactgcttttatttctgctgagccttatgactctcaccctctttagtcctgatcttctgggagacccagataattacacactggccaaccccctgaatactccccctcacatcaagcccgagtggtatttcctcttcgcatacacgatcctgagaagcgtgcctaataagttgggcggagtgctggcgctcctgctaagtatcctgattttggccatgattcctatactgcatatgagcaagcagcagtcaatgatgttcagaccgctcagccagtcattatactggttactggcagccgatcttcttatccttacatggatcggagggcagcctgtttcatacccctttaccataattgggcaggtggcctcagttctctattttactacaatcttaatcttgatgcccaccataagcctcatagagaataagatgctcaagtgggcgtag

SEQ ID NO: 51813 - DNA, 1542 bp, Artificial Sequence
  Description of Artificial Sequence: Synthetic coding sequence
atgttcgcagaccggtggctcttcagcaccaaccataaggacatcggtaccctctatctgctattcggagcttgggccggagtgctgggaacagccttgagcctgcttattcgcgcagaactgggccaacctggtaacttactcggcaatgatcatatctacaatgtgatcgtgacggcgcatgcatttgtcatgatcttttttatggttatgcctatcatgattggaggatttggtaattggctagtacccttaatgataggagcccctgacatggcttttccccgtatgaacaatatgtccttttggctgctgcccccatcactgctattgttattagcctccgccatggtggaggccggagcgggaactggatggacggtgtatcccccactcgccggtaattacagtcatccaggcgcatccgttgaccttacaatattttccctgcatttggccggagtatcttctatactcggcgcaattaatttcatcactacgatcatcaacatgaagccccctgccatgacacagtaccagacaccactgtttgtgtggagtgtactgataaccgccgtattgttgctgctcagcctgcccgtcctcgcggctggcattaccatgctccttactgatcggaatttaaataccacttttttcgaccctgcgggaggaggagaccccatactgtaccagcacttgttctggtttttcggacatccggaggtctacatcctgatcctccctggttttgggatgatttcccatattgttacttactactccggtaagaaggagcctttcgggtatatgggcatggtatgggccatgatgagcattggattcttaggtttcattgtttgggcacaccacatgttcactgtggggatggatgtagacactagggcttactttacatccgccaccatgatcatcgctatacccacaggggtgaaggtgttttcatggctcgccaccctccacggctcaaacatgaaatggtccgctgcagtcctctgggccctcggcttcatcttcctgttcacggtcggtggcctcaccggaatcgtgctggcgaattccagcttggacatcgtgctccatgacacatactatgtggttgcacacttccattatgtcctgtctatgggtgccgtgttcgctatcatgggtggatttatccactggtttcccctattttcagggtatactctcgatcagacctacgcaaaaatccatttcacgattatgtttattggggttaatctgacatttttccctcaacactttctgggcctctctggaatgcctcgcaggtacagcgattaccctgatgcatataccacatggaacattcttagttcagtcgggtccttcatctccctgaccgccgtgatgctgatgatcttcatgatatgggaggcatttgccagcaagagaaaggttctgatggtcgaagagccgagcatgaatctggaatggctgtatgggtgtcctcctccgtatcacacattcgaagagcccgtgtatatgaagagctag

SEQ ID NO: 51814 - DNA, 684 bp, Artificial Sequence
  Description of Artificial Sequence: Synthetic coding sequence
atggcacacgctgcccaggtgggactgcaggacgcgaccagcccaattatggaggaattgatcaccttccatgaccatgccctgatgattatttttctcatttgctttctcgtgttgtacgctctgtttctgacactcaccacaaaactcaccaacacgaacatttccgatgctcaggaaatggagactgtgtggacgatactgcctgccatcatcctggtattgattgctctcccctccctgaggatcttgtatatgaccgacgaagttaatgatccctctctgaccattaagagcataggccatcaatggtattggacttacgagtacaccgattacgggggtcttatttttaattcttacatgctgccaccccttttcctggaaccaggcgacctgcgactgctggatgttgataatcgggtcgtgctgcccattgaggctccgatcaggatgatgatcaccagccaggatgtcctccatagttgggccgttcctacattggggctgaaaaccgatgcgattccaggtagactcaaccaaacgacatttaccgcaacaagacctggcgtgtattacggacaatgctcggaaatctgcggcgctaatcattcatttatgccaattgtcttggaactaatcccgcttaagatctttgaaatgggacccgttttcactctatag

SEQ ID NO: 51815 - DNA, 786 bp, Artificial Sequence
  Description of Artificial Sequence: Synthetic coding sequence
atgactcaccaatcgcacgcttaccatatggtgaaaccaagcccgtggccgctaaccggggcactctctgccctgctgatgacttctggactggcaatgtggttccacttccacagtatgactcttcttatgctcggattgctcaccaatacactcaccatgtaccagtggtggagagatgtcactagagaaagtacctatcagggccatcacacgccccctgtgcagaaaggtctccggtatggaatgattctttttatcacgagcgaggtgttcttttttgccggattcttttgggccttctaccattcgagcctggcacccaccccgcaactcggcggtcactggccaccaacagggatcaccccactgaacccgctggaggtacccctgctgaacacgtccgtcctcttggcgtcaggggtctcaataacatgggcacatcacagcctgatggaaaataataggaatcagatgatccaggcacttctgattacaatattactcggcctctattttacactcctgcaggcttccgaatactttgagagccctttcactatctctgacggcatttacggatcaacctttttcgtggcgaccggcttccatggcctccacgtgatcattggctctacctttctcacaatatgttttatccggcagctgatgtttcacttcacatcaaagcaccactttggctttgaagccgcagcctggtactggcacttcgtcgatgtggtatggttattcctttatgtgtcgatttattggtggggaagctag

SEQ ID NO: 51816 - DNA, 957 bp, Artificial Sequence
  Description of Artificial Sequence: Synthetic coding sequence
atgcctatggccaacctgttactgttgattgtgccaatcctgatcgccatggcctttttaatgctgaccgagaggaaaattttgggatatatgcagttgaggaaaggacccaacgttgttggcccatacgggcttctgcagccatttgccgatgcaatgaaactgttcacgaaagagcccctgaagccggctaccagcacaattacactctatatcaccgcacctacactcgcccttacgattgctctgctgctgtggaccccactaccaatgcccaaccccctcgtaaatctcaatctggggctgctctttatccttgcaacttccagcctcgcagtttacagcattctgtggtccggttgggcttccaacagtaattacgccctaattggggctttaagggcagtggcgcagacaatttcctacgaggtgacgttagcaattattctgctttccaccttgttgatgagcggaagctttaatctttctacgttgatcacaacacaggaacacttgtggttgttactgccatcttggcccctcgccatgatgtggtttatatctaccctggccgagactaataggacgccattcgatctggcagagggggaatcagagctggtcagcggatttaacatcgagtacgccgcaggcccatttgccctcttcttcatggccgagtacactaacatcattatgatgaacaccctgaccactacaatatttctagggaccacatatgatgccctaagtcctgaactatatactacatatttcgtgacaaagacattgctgcttacctccctgttcctgtggattcggactgcctacccacgatttcggtacgatcaattgatgcatctactgtggaagaatttcctcccactgactttggccttgcttatgtggtatgtgtcgatgccaatcaccattagttcaatcccccctcaaacctag

SEQ ID NO: 51817 - DNA, 1044 bp, Artificial Sequence
  Description of Artificial Sequence: Synthetic coding sequence
ataaatcctctggcgcagcccgtgatatatagtactatattcgccggaaccctgatcaccgccttaagcagccattggttcttcacctgggtcgggctcgaaatgaacatgttggctttcatcccagtgcttactaagaagatgaaccctcgctccactgaagcagccatcaaatactttctgacacaggctaccgcaagtatgattctgctgatggccattctgttcaataacatgctcagtggccagtggactatgactaatacgacaaatcagtattcaagcctcatgattatgatggcgatggcaatgaagctggggatggctcctttccacttctgggtccccgaggtgactcagggcaccccattgacaagtggcctgttgttattgacatggcagaaactcgctcctatctccattatgtatcagatatcccccagtctgaatgtgtcactcctcctgacactgagtatcctcagtattatggccggttcctggggtggccttaaccagactcagctgagaaagatactggcctattcaagcatcacccatatgggctggatgatggctgtactgccctacaatcccaatatgaccatcttgaatctaacaatttacatcattctgacaactactgcttttctgctgctgaatcttaatagtagtaccacaactcttcttctgtcaaggacctggaataagctgacatggctgactcctctcatccccagcacactgcttagtctggggggactccctccgttgacgggtttcctaccaaagtgggcaattatcgaggagtttaccaaaaataacagcctcattatcccaactatcatggcaactattacgctgctgaacctgtacttctatctacgcttgatttacagcacctcaattacactactgccaatgtccaacaacgtgaaaatgaagtggcaattcgagcacacgaaacctaccccatttctcccaacactcatcgctctcacaactcttctcctgcccatttcaccttttatgttgatgatcttgtag

SEQ ID NO: 51818 - DNA, 348 bp, Artificial Sequence
  Description of Artificial Sequence: Synthetic coding sequence
atgaactttgcgctgatactgatgatcaacaccctgctagccctgctcttgatgatcattacattttggctaccccagctcaatggatatatggagaaatcaacaccatacgaatgtggatttgatcccatgagtccggcaagggtcccattctctatgaaattttttttggttgcgatcacattcctgctcttcgatctggaaattgcactgttactgcctttaccttgggcgctgcagactacaaacctgcctctcatggtgatgtctagcctcctcctgattatcatcctcgcacttagtctggcctacgagtggctccagaaaggcctggactggacagagtag

SEQ ID NO: 51819 - DNA, 1380 bp, Artificial Sequence
  Description of Artificial Sequence: Synthetic coding sequence
atgctcaagctcattgtacctaccatcatgctactcccccttacatggttatccaagaaacacatgatatggatcaacaccactacccacagtctcattataagtattattcccctgctgtttttcaaccagatcaacaataatcttttttcttgttccccaacattttcttctgatcccctcactactccactactcatgctgacaacttggctcttgccgcttacaattatggcctctcagaggcacctcagttctgagcccctgtctcggaagaagctatacctctcaatgctgattagcctacagattagcctgattatgacctttacagccacagagttaatcatgttctatatattttttgagaccacgctgatccccaccctcgccatcattactcggtggggtaatcagcccgagaggctcaatgccggaacatacttcctgttctacactctggtaggctcactgcccctcctgatcgcattaatctacacgcacaacacactcggctctctcaatatcttgttgctgacgcttaccgcccaggagctttcaaattcatgggcgaacaacctgatgtggctagcttacaccatggctttcatggtaaaaatgcccttgtacggccttcacctgtggctgcccaaggcccacgtagaggctcctatcgccggatcaatggttctggccgctgtcctgttaaagctgggcggttatggaatgatgagactgacgcttatactgaatcctctcacgaagcacatggcgtatccattcctggtccttagcctttggggaatgatcatgaccagctcgatttgtcttcgccagacagatctgaaaagccttattgcctactctagcattagtcacatggcactcgtggtcacggcaattttgattcaaacaccttggtctttcaccggtgccgtgatactgatgattgcccatggactgacatcaagcctccttttctgtcttgctaattctaactatgaacgtacccacagtcgaatcatgatactgtcccagggcctgcagactctgcttccactcatggccttctggtggctgctggcttcattggctaacctcgcacttccaccgacgattaacttgcttggagagctgagcgtgcttgtcaccactttctcttggtccaacattaccctgctgctgacagggctgaatatgcttgtcaccgcgttgtactcactgtacatgtttacaaccacacagtggggaagcctgactcaccacatcaataacatgaagccctctttcactcgggaaaacaccttaatgtttatgcacctgagccctattttactgctatctctcaaccccgacatcattacgggcttcagctcctag

SEQ ID NO: 51820 - DNA, 297 bp, Artificial Sequence
  Description of Artificial Sequence: Synthetic coding sequence
atgcctctgatctatatgaacatcatgcttgcctttactatctcccttctggggatgctcgtgtatcgctcccatctcatgagtagtttactgtgcttagaggggatgatgttgagcctgttcatcatggccacactaatgacccttaatacacactctttgctcgccaatattgtccctattgccatgctggtcttcgccgcatgcgaagccgctgtgggtctggcgctcctggtttccatttctaatacctatggcttggattacgtgcataacttgaacctgttgcagtgctag

SEQ ID NO: 51821 - DNA, 1812 bp, Artificial Sequence
  Description of Artificial Sequence: Synthetic coding sequence
atgactatgcacacaacgatgacgaccttaactctcaccagtctgattccacctattcttaccaccctggttaacccaaataagaagaactcttacccacattatgtcaaatctatcgtggccagcacgttcatcatttcattgtttcccacgaccatgtttatgtgcttggaccaggaagtgatcatctcgaactggcactgggcgacgacacagactacccaactcagcctctcttttaaactcgattatttcagtatgatgtttatccctgtggcactgtttgtcacctggtcaattatggagttttctctgtggtatatgaatagtgacccaaacattaatcagtttttcaaatacctgctgatctttttgatcacaatgctgattctggtgaccgcaaacaatctgttccagttgtttatcgggtgggaaggcgtagggatcatgtcattcttattgatatcatggtggtatgccagagctgatgctaacactgccgctattcaggcaatactctataataggatcggagatataggctttattctcgccctcgcttggtttatactacattctaacagttgggacccgcagcagatggcattgttgaacgcaaacccgtccctaacccctctcctggggcttctcctagccgctgccggaaaatcagcacaactaggactgcatccatggctgccttctgcaatggagggccctacacccgtgtcagctttgctgcatagtagcaccatggtggtggctggtatttttctcctcatacggttccatccccttgctgagaacagccctttaatccagaccctgaccctgtgtttgggcgcaataaccacactgttcgctgcagtctgcgctctgacccaaaacgacattaaaaagatcgtcgcctttagcacttccagtcaactgggtctcatgatggtcacaatcggcatcaatcagcctcacctggccttcctgcacatctgtacccacgcgttcttcaaggccatgctgtttatgtgttctgggagcattatccataatctgaacaatgaacaggatatacgtaaaatgggaggacttctcaagacaatgccattaacgtctacctcactcaccatcggttctcttgcccttgcgggtatgccttttctgaccggcttttactcgaaagatcacattattgaaaccgccaatatgagctacactaatgcatgggctctttcaataacactgattgccacctcattgaccagcgcttatagcacgagaatgattcttctgactctgaccggtcagccgaggttcccaaccctcactaacattaatgagaataaccccaccctgctgaacccaattaaacggctagcagctgggtccctgttcgccggtttcctgatcaccaacaatatctctcccgcttcccctttccaaacaaccatccctctgtatctcaagctgacagcactggccgttacattcctcggccttctcactgctttggacttgaactatcttacaaataagttgaaaatgaagtcaccgctgtgcactttttacttcagtaacatgcttggattctacccttctatcacccacagaactatcccatacttgggactgctgacctcgcagaacctgccactgctgttgctcgacctgacatggctcgaaaagctgctgccaaagactatctctcagcaccagatcagcacatctatcattacctccacgcaaaagggaatgattaagctgtacttcctctcgttttttttccccttgattctgactttgctccttatcacatag

SEQ ID NO: 51822 - DNA, 525 bp, Artificial Sequence
  Description of Artificial Sequence: Synthetic coding sequence
atgatgtacgcactcttcttgctgtcagtcggattggtaatgggcttcgtcggcttcagctcaaagcctagtccgatctacggcggacttgtgctcatcgtatccggtgtggttgggtgcgtcataatactgaactttggtggaggctacatggggctgatggtgtttctcatttaccttggagggatgatggtcgtcttcggttacacaaccgccatggccatcgaagagtacccagaggcttggggttccggagtggaggtattggtttccgtgttagtgggactggctatggaggtgggcttggtgctttgggtgaaggagtacgatggggtggtggtcgtcgtgaatttcaacagcgtcggcagctggatgatttacgagggcgaagggtctggactgatcagagaggacccaattggagcaggcgctctgtacgattacgggaggtggcttgtcgtcgttaccgggtggaccctgttcgtaggcgtttacatagttatcgagattgccagagggaactag

SEQ ID NO: 51823 - DNA, 2226 bp, Artificial Sequence
  Description of Artificial Sequence: Synthetic coding sequence
atggcagagcctgtgtcgcccctcaagcatttcgtgctggctaagaaggctattaccgcaatcttcgaccagctcctggaattcgttaccgaggggagccactttgtggaggccacttacaaaaaccctgagcttgatcgaattgcaaccgaggatgatttagtcgagatgcaggggtacaaagataaactgagtatcatcggggaggtcctgagcaggaggcatatgaaagtcgcctttttcggacggacaagttccggcaagagctcagttatcaacgctatgctgtgggataaggtgctgccttccgggatcgggcacataacaaattgttttctgagcgtggagggtaccgatggcgacaaggcatatctgatgacagaggggagtgacgagaagaagagcgtcaagactgtgaatcagctggcccacgctttacacatggacaaggacttgaaggctggatgcttggtcagggttttttggcctaaggccaagtgcgccttactgagggatgatctggtgcttgttgactcacctggaaccgacgtgactactgaactggacagttggatcgacaaattctgcttagatgccgatgttttcgtgctggtagccaactccgagtcaaccctgatgaataccgaaaagcacttctttcacaaggttaacgagaggctttctaagccaaatatcttcattctgaacaacaggtgggatgcctctgctagcgaaccggagtatatggaggacgtgcgcaggcagcacatggagaggtgcctgcactttttagtggaagagctgaaggttgtgaatgcactggaggcccagaaccgtatctttttcgtcagcgctaaggaggtgctgtccgcccgtaagcaaaaagcccagggcatgcctgagtcaggagttgcactggccgaggggttccacgcccgtctccaagagttccagaacttcgaacagatattcgaggagtgtatctcccaaagtgctgtgaagactaaattcgagcaacatactatccgtgcaaaacagatcctggccacagtcaagaatattatggattcagtcaaccttgcggctgaagataaacgccactacagtgtggaagagcgcgaggatcagattgaccggttggacttcatccgcaaccaaatgaacttgctgacattggatgtgaagaagaagattaaagaagtgacagaggaagtggcgaacaaggtgtcctgcgctatgaccgacgagatatgcaggctgagtgtactggtcgatgaattttgctcagaatttcatcccaacccagacgtgctgaagatttacaaatcagaactcaacaaacacattgaagacggcatggggaggaatctcgccgaccgatgcaccgatgaggttaacgccctcgtgctgcagacccagcaggagatcatcgagaatctgaagcctttgctgcccgctgggattcaggataagctccacaccttgattccgtgcaaaaagtttgacctgtcttacaaccttaattatcataagctgtgtagcgatttccaggaggacatcgtgtttcctttctccttgggttggagttctctggtgcacagattcttgggccctcgtaatgcccagagggtgctgctcggcttgtcagaacccattttccaattacctagaagcttagcttcgactccaaccgcacccacaactcccgctacacctgataacgcctctcaggaagagctgatgatcaccctggttaccggcctcgcctctgtcacttcacgcaccagtatgggtatcatcattgtcggtggggttatctggaagacgattggctggaaactcctcagcgtaagcctgacgatgtacggcgcattgtacctgtacgaaagactgtcttggactacccacgcaaaggagagagcattcaaacagcagttcgtgaattacgccacagagaaactccgcatgatcgtgtccagcacctccgctaactgcagtcatcaagtgaagcagcagattgcaacaacgttcgctagactctgtcaacaggtcgatattactcagaagcagcttgaggaagaaatcgccagattacctaaggagatcgatcagcttgagaagattcaaaataactctaagctgctgagaaataaggcggtccagctagagaatgaactggaaaattttacgaagcagtttctgccatcctctaacgaagagagttag

SEQ ID NO: 51824 - DNA, 1893 bp, Artificial Sequence
  Description of Artificial Sequence: Synthetic coding sequence
atggctgagcccgtgagcccactcaagcattttgtactcgccaaaaaagccataaccgccatcttcgaccaactcttagaatttgtaactgagggaagccactttgtcgaggcaacttataagaaccccgagctggacaggattgccaccgaagacgacttagtcgagatgcagggttataaagacaaactgtccattattggtgaggtcttgtcccgaagacacatgaaagtggcgttttttggcaggacttccagcggaaagtcatcagtgattaacgcaatgctctgggacaaagtgttacctagcggaataggtcatatcacaaattgctttttaagcgtcgaagggaccgacggggacaaagcctacctgatgactgagggctctgatgaaaagaaatcagtgaaaaccgttaatcagctggcccatgctctgcacatggataaggacctgaaggcgggttgtcttgtgcgagttttttggcccaaggctaagtgtgccttgctaagagacgacctcgtcttggtcgactcacccggaacggacgtcaccacagagttagattcttggattgataagttttgcctcgatgctgacgtctttgtgttggtggctaattcagagtcaacgctgatgaacacagagaagcactttttccacaaggtaaacgagagactgagcaaaccaaacatcttcatccttaacaacagatgggatgcctcagcatctgaaccagagtatatggaggacgttcgaaggcagcatatggaacggtgtctacacttcctggtggaagagttgaaggtagttaacgctctcgaggcccagaaccgcatctttttcgtatcagccaaagaggtgcttagtgccaggaaacagaaggcccaggggatgcccgagtcgggggtcgccctggccgaggggttccacgcacggttgcaagagttccagaattttgaacagatcttcgaggaatgcattagtcagtctgctgtcaaaactaaattcgagcaacacaccattcgggctaagcagattttagccactgtaaagaacattatggatagtgtgaaccttgccgcagaggataagcggcactattccgttgaggaacgcgaggatcagatcgatagattggatttcatccgcaatcagatgaaccttcttacacttgatgtgaaaaaaaagatcaaagaggtcaccgaagaagtggctaacaaagttagctgtgcaatgaccgacgagatttgcaggttaagtgtcctggtagacgaattctgttccgagtttcatccaaatccagacgtgctgaaaatctataagagtttgccgcgaagcttggcgtctacaccgaccgcacccacaacccctgctacgccagacaacgcttctcaggaggagttgatgatcacattggtgacggggctcgcttccgtaactagcaggacatctatgggaatcattatcgtgggcggagtgatctggaagaccataggatggaagttgctgagtgtgtctctgaccatgtatggggctttatatctttacgagcggttgtcctggacgacgcacgccaaggagcgggcttttaagcagcagtttgtgaattatgccaccgaaaagctgcggatgattgtttcatccacatccgccaactgctcccaccaggtcaaacaacagatcgctacaacttttgcacgtctgtgtcagcaggtcgacatcacgcagaagcaactggaagaagagatcgctagattacctaaggagatagaccagttggaaaagatccagaacaattctaaactcctgcggaataaagccgtgcaactggagaatgagctagagaatttcacgaaacagttcctgccaagcagcaacgaggaatcatag

SEQ ID NO: 51825 - DNA, 468 bp, Artificial Sequence
  Description of Artificial Sequence: Synthetic coding sequence
atggccgagccagtcagcccacttaaacattttgttctcgctaagaaggccataactgccatcttcgaccagctgctggagttcgtcacagagggcagccattttgtggaggccacctacaagaacccagaactggaccgcattgcgaccgaagacgacttggtagaaatgcaaggttataaagacaagctgtccattatcggggaagtgctgtccagacgccacatgaaggttgctttttttggcagaacctcctccggtaaatctagcgtcatcaacgccatgctctgggacaaggtcctgccaagcgggatcggtcatattaccaattgcttccttagcgtggaaggtacagacggggacaaagcatacctgatgaccgagggctcagatgagaaaaagtcagtgaagactgtgaatcagctggctcacgcccttcatatggataaagatcttaaggcgggttag

SEQ ID NO: 51826 - DNA, 2226 bp, Artificial Sequence
  Description of Artificial Sequence: Synthetic coding sequence
atggccgagcccgtttcaccactaaaacacttcgtgctggccaaaaaggctatcactgctattttcgatcagcttttagagttcgtaaccgagggttcccattttgtggaggcaacttacaaaaatcctgagcttgacaggatcgctactgaagacgacctggtggagatgcaaggctacaaagataaattgtcaattataggggaagttctgagtcggagacatatgaaggtggccttctttggcagaactagctccggaaaatcatcagtcatcaacgcaatgctttgggacaaggtactgccaagtggcatcggccatataactaactgctttctcagtgtagaaggaacagacggggataaggcctatctcatgacagaagggagcgatgaaaagaaaagtgttaaaacagtaaatcagttagcacacgctctgcacatggataaggacctcaaggcgggatgtctcgtgagagtgttctggcctaaggccaaatgcgctctcttacgcgatgatttggtcctggtagacagcccagggactgacgtaacgacagaactggactcctggatcgacaaattctgcctggacgcagacgtgttcgtactggttgctaattctgagtccactttgatgaatacagagaaacatttttttcataaagtgaatgagaggctctccaagcccaacattttcatcctgaacaatcggtgggatgcctctgcgtccgagcccgaatatatggaggatgtgaggcgtcagcacatggagaggtgcttgcacttccttgtggaggaactaaaggtcgtgaatgccctcgaagctcagaaccgcatcttcttcgtcagcgccaaagaagtactgtcagccagaaagcaaaaagcccagggtatgcccgagtctggcgttgctctggccgaaggctttcacgctcggctgcaggagtttcagaacttcgaacagatttttgaggagtgtatttcccaaagcgctgtcaagaccaagttcgagcagcacacaattagggctaagcagattctggcaactgtgaaaaacattatggactctgttaacctagcagctgaggataaacgacactatagtgtagaagagcgggaagatcagatagaccggctggactttatacggaatcaaatgaatctcttgacactggacgtaaagaagaagatcaaagaggttacagaagaagttgccaataaggtaagttgcgcaatgaccgatgagatttgcaggttgagcgtgctcgtggatgagttttgttctgaattccatcccaacccggatgtcctgaagatctacaaatcagagctcaacaagcacatcgaagatggtatgggtcgaaacctagctgaccgatgtaccgatgaagtcaatgctctagtgcttcagacacagcaagagatcattgaaaatcttaaaccactgctgcccgcaggcattcaagataagctgcatacccttattccctgcaagaaattcgaccttagttacaatttgaattaccacaaactgtgctctgacttccaagaggacatcgttttccctttttcactgggatggagctctttggtgcatcgtttcctgggaccgagaaatgctcaaagagtgctgttgggtctgagcgaacccatctttcagctgccgagaagcctagcctcaacccccactgcacctaccacccccgcaacgcctgacaacgcctcccaggaggaactcatgataacactggtgaccgggttggcctcagtcaccagccgaacttcaatgggtatcatcattgtgggtggcgtgatttggaagaccattggttggaagctcctgtctgtctcattgacaatgtatggcgcactctatctatatgagcgcctaagctggaccacccacgccaaagagagagcatttaagcagcagtttgttaattatgccacggagaagctcaggatgattgtgtccagcacttctgcgaactgctcccatcaggttaaacagcagatcgccactacattcgccaggctgtgccagcaagtggatattacccaaaagcaactggaggaggagatcgccagattgccaaaggagatagaccagctggaaaaaatacagaataattcgaaactgctgcggaataaagctgtgcagttagagaacgaactggaaaacttcacaaaacaattcctccccagcagtaacgaagagtcctag

SEQ ID NO: 51827 - DNA, 1344 bp, Artificial Sequence
  Description of Artificial Sequence: Synthetic coding sequence
atggccgagccagtttcacccctgaagcatttcgttctcgccaagaaagccatcactgcgatctttgaccagcttcttgaattcgttacagagggctcacattttgtggaggccacatacaaaaatcctgagctggatcggattgctacggaagacgatctcgtagaaatgcagggttacaaggataagctatccattatcggcgaagtgctctctcgcagacatatgaaagtcgccttcttcggcaggacgagctcagggaaatctagcgtgattaatgccatgctatgggacaaagttctacccagcggcatcgggcatattaccaactgcttcctatcggtggagggcaccgacggggacaaagcctacttaatgactgaggggagtgatgaaaagaagagcgtgaagactgtgaatcagctggctcacgccctacacatggataaggacctgaaagccggttgcttagtcagggtgttctggcccaaggccaaatgcgctttactgcgggacgatttagtactggtcgacagtccagggacagatgtgaccactgagctcgatagctggatcgataaattctgtctggatgcggacgttttcgtgctggtcgctaattcagaatctaccctgatgaacaccgagaagcacttcttccacaaggtaaacgaacgcctctccaaacctaacatcttcatcctgaataatcgctgggacgcatcagcttcagagccagaatatatggaggatgtccgtcgccagcatatggagcgttgtttacacttcctagtggaagaattgaaggtggtcaacgcgcttgaggctcaaaaccgcatcttctttgtctcggcaaaggaggttctgtcagcacggaagcagaaagcccaggggatgccagagagcggtgtggcccttgccgagggcttccacgcccgtctccaggaatttcagaattttgaacaaatatttgaggagtgtatctctcagtcagctgtgaagaccaagtttgagcagcacaccattcgcgcaaaacagatcctggcaactgtaaagaatatcatggatagtgtcaatttagctgctgaggacaaaaggcactatagtgtggaggagagagaagaccagatcgaccggctagatttcatcagaaaccaaatgaatctacttacgctggatgtcaaaaaaaagatcaaggaagtgactgaagaagtggctaacaaggtctcatgtgccatgactgacgaaatttgtcgtcttagtgtgctcgtggatgagttttgcagtgagttccatccaaacccagatgtgctcaaaatctataagagtaagaaaaaaaagtag

SEQ ID NO: 51828 - DNA, 4011 bp, Artificial Sequence
  Description of Artificial Sequence: Synthetic coding sequence
atgatggaaatccagatggacgaaggtggtggtgtagtcgtgtatcaggacgattactgtagtggcagtgtgatgtctgagagggtgagcggcctcgctggaagtatctatagggagttcgagagactgatacactgctacgacgaagaggtggtgaaggagttgatgccccttgttgtgaacgtgttggaaaacctcgactcggtcctgagcgagaaccaggaacatgaagtcgagcttgaactgttgcgcgaagacaatgaacagctcctgacgcagtatgagcgggaaaaggcgctgagaagacaggccgaggagaagttcatagagttcgaagatgctctggagcaagaaaaaaaggagctccagatacaggtggaacattacgaattccagactagacaactcgagctaaaggcaaagaattatgccgatcagatttcgcgattggaagagcgcgagagcgaaatgaagaaggaatacaatgcactacaccagcggcatacggagatgatccagacgtacgtcgagcacattgaaaggtctaagatgcaacaggtggggggtaattcacagacggaatcctctcttcctggacgcaggaaggagcggcctacctcactgaacgtgtttcctttagccgacggcactgtcagggctcagatcggcggaaagttggtccccgctggcgatcattggcacctctctgacctgggtcagttacagtcttctagcagctaccagtgtccccaggacgagatgtcagaaagcggccagagctctgccgctgctacaccatcgacaactgggactaaaagcaataccccaacatcgagcgttccaagtgcagctgttacacccctgaacgaatccctccagccacttggtgactatggagtgggatcaaagaatagcaagcgggctagggaaaaacgggactctagaaatatggaggtgcaggtgacacaagagatgaggaatgtttccatcgggatgggttccagtgatgagtggtccgatgtccaggacatcatcgacagcaccccggagctggatatgtgccccgaaacccgtctggatcgtaccggctcctccccgacccaagggatcgtaaacaaagcctttgggataaacactgactccctctaccacgaattatccacagcgggatcagaggtaattggcgatgtggacgaaggcgctgacctcttaggagaattctctgttcgtgacgacttctttggcatggggaaggaagtagggaatctactgctggagaattcgcagctgctcgaaacaaagaatgccctgaacgtggtgaagaatgatctcatcgctaaagtcgatcagcttagcggagaacaggaggtgctgagaggggaattggaggcggctaagcaggcaaaggttaaactggagaataggattaaagaactcgaagaagaactcaaacgggttaagtccgaggcgattatagcaagacgagagccaaaggaagaggccgaagacgtgagcagttatctgtgcactgagagcgataagatccctatggcacagcgccgtcggtttactcgggtcgagatggctcgagtgctcatggaacgtaaccagtataaagagagattgatggagctgcaagaagcagtaaggtggacggaaatgatcagagcatcccgggagcacccctcagtgcaggagaagaagaaaagtacaatctggcagttcttctctaggctcttctccagctcttccagccctcccccagctaaaagaccgtatcctagcgtcaacattcattacaaatctccaaccactgctggattttcccagagacggaatcatgccatgtgtccaatctccgctggatcaagaccattagagtttttcccggacgatgattgcacaagctctgcccgacgcgaacagaaacgtgagcagtaccggcaggttcgggagcacgtaaggaatgacgacggcaggcttcaggcatgcggctggagccttcctgccaagtataaacagttgtctcccaacggcggacaagaagacacccggatgaaaaacgttccggtgcccgtctattgtcgcccattggttgaaaaagatcccactatgaagctgtggtgtgccgctggggtgaatctgtcaggatggagacccaatgaggatgatgccggaaatggcgttaaaccagctccaggtagggaccccttgacttgtgatagagagggtgacggagaacccaagagtgcacacacctcccctgaaaaaaagaaggcaaaggagctacccgaaatggacgccaccagcagccgggtctggattctgacctccacactgaccacatctaaggtggtgatcatcgatgctaatcagcctggcacagttgttgatcagttcacagtctgcaacgcccacgtgctgtgtatttcctcaatccccgcagcaagtgactcggattatccccctggggaaatgttcctagacagcgatgtcaaccccgaggaccccggagccgacggggtgctagccggaatcaccctggtagggtgcgccactcgttgtaacgtgccgagaagtaattgcagtagccgcggtgataccccagttttggacaaaggacagggggaggtggcgactatcgccaacgggaaggttaacccatctcaatccacagaagaggctacagaggccacagaagtaccggaccccggtcccagcgagcccgagaccgctaccctgcgtccgggaccattgacagagcatgtttttacagaccccgcaccaacaccgagctccggcccacagcccggatctgaaaatggcccagagcctgattcttcttctacgcggccagaaccagagcctagcggggatcccaccggagccggtagctccgccgctccgacaatgtggctgggcgcacagaacggttggctctacgtccatagcgctgtggccaactggaaaaagtgcttgcactcaataaaacttaaggacagcgtcctgagtctcgtccacgttaaaggcagagtactggtggcactggccgatgggacactcgccattttccataggggtgaggacgggcagtgggatctttcaaattatcacctgatggacctagggcatccacaccacagcatcagatgtatggccgtcgtgtatgacagggtgtggtgcggatacaagaacaaggtgcatgtgatccagcccaaaactatgcagatcgagaagagctttgacgcccaccctcgccgagagagtcaggttcggcagctcgcgtggatcggggatggagtctgggtcagcattcggctcgattctacattgcgcctctatcacgcgcacacacatcagcatctgcaggatgtggacatcgagccatatgtgtccaaaatgttaggcaccgggaaactgggatttagttttgtgcggattactgctctgcttgtcgccggttctcggctgtgggtgggtacaggcaatggggtggtaatctccattcccttaacagagacagttgtactccaccgcggtcagctactcggcctgcgcgctaacaagacttcaccgacttctggggaaggagccagaccgggtgggattatacatgtgtacggagatgacagtagcgatagggccgcaagcagctttatcccgtactgctctatggcacaagcccagctatgcttccatggccaccgtgatgccgtcaagttctttgtgagcgtcccgggtaacgtgttggcaacgctgaatggaagcgtcttagatagccccgctgagggcccaggacctgctgcaccagcttctgaagtggaggggcagaaacttcggaacgtgcttgtattaagcggcggagagggatacattgatttcaggataggggatggcgaggatgacgagacagaagaaggggcaggtgatatgagccaggtaaaacctgtcttgtcaaaagcagagcgctctcatatcatagtctggcaggtgtcttataccccagaatag

SEQ ID NO: 51829 - DNA, 3993 bp, Artificial Sequence
  Description of Artificial Sequence: Synthetic coding sequence
atgatggaaatccagatggatgaaggtggaggggtggtggtctatcaagatgattactgctccggaagcgtgatgagcgaacgtgtttcgggactggcgggtagcatatatagggagttcgagcgcctgatacactgctatgatgaagaggtggtgaaagaactcatgccacttgtggttaacgtgctggagaacctggattctgtccttagtgaaaatcaggaacatgaggtcgagctggagcttctcagggaggacaatgaacagctcctgacccaatatgaacgcgagaaagcactccgacgccaggccgaagagaagtttatcgagtttgaggatgctctggagcaggaaaaaaaggagctgcagattcaggtggaacactatgagttccaaacccgacagctggagctcaaagcaaagaattacgcagatcaaatctcacggctggaggaacgcgaaagcgaaatgaaaaaagagtacaacgcactccaccagcggcatacagaaatgatccaaacctacgtggagcatattgagaggagcaaaatgcagcaggttggtggtaacagtcagaccgaatcctcgctgcccggacggagaaaagaacgtcccaccagcctgaacgtgtttccactcgctgatgggactgtgcgtgctcagattggcggtaagctcgtcccagccggagaccactggcatctgtcagacctcggccagcttcagagcagctcatcctaccagtgcccccaggacgaaatgagcgagtctggccagagcagcgcagcagctactcctagcacaaccgggacaaagtccaatactcctactagtagcgtcccatctgccgctgttacccccctaaacgagtctctgcagcctctgggggattacggcgtgggatctaagaattccaagagggcacgtgagaagcgggactcacggaatatggaagttcaagtcactcaagaaatgcgcaatgttagtataggcatggggagctccgatgagtggagtgacgtacaggacatcatcgacagtacaccagagctggacatgtgcccagaaactcgtctagatcgaacaggttcctcccccacacagggtatcgtcaataaggcattcgggatcaatactgatagtctttaccacgagctgagcacggcagggtctgaggtgatcggggatgtggatgaaggagcggaccttctgggtgagttctccggcatggggaaagaagtgggtaatctattgctggagaattcccagctactggaaaccaaaaacgcgttaaacgttgtgaagaacgacctgattgcaaaggtggaccagctttccggagagcaggaggtactgagaggagagctcgaggctgctaagcaggctaaggttaagctcgaaaacaggatcaaagaactcgaggaggaactcaagagagtgaagagtgaggccatcatcgccagacgtgagccaaaggaagaggctgaggacgtctctagctacctgtgcactgaaagtgacaagatccctatggcgcagcgacggagatttacccgggtggagatggccagagtcctcatggagcggaaccagtacaaagagcggctgatggagttgcaggaggctgtgcggtggaccgagatgattcgtgcctcccgtgaacatcctagcgttcaggaaaagaaaaaaagtaccatatggcagtttttcagcaggctgttttcttcctcctcatcccctcctcctgccaagcggccatatccttcagtgaacattcactacaaatctccaacgactgccggattttcccagcgacgcaatcatgccatgtgtccgatttccgccggtagcaggccactcgagttttttcccgatgacgattgtacaagctcagcacgtagagagcagaaacgcgaacagtaccgccaggtccgagaacacgtccggaacgacgacggcagactgcaggcatgcggatggtctctaccagccaaatataagcagctcagcccaaacggcggtcaggaggacacacggatgaaaaatgtgcccgtgcctgtctactgtcgccctctggtagagaaggatcccaccatgaagctctggtgcgcagcaggcgtgaatctttccgggtggcggccaaatgaggatgatgctggcaatggagtgaaacccgctccaggcagagatccgcttacatgcgatcgcgagggtgatggagaaccgaagtcagcccacactagccccgagaagaaaaaagcgaaagaactgcctgaaatggacgccacatcttccagggtgtggattctgacctctaccttaaccacttccaaagtagtgattatcgatgctaaccagcccggtactgtggtcgatcagtttactgtatgtaatgcccacgtgctgtgcatttcttccatacccgcagcaagtgacagcgactaccctcccggagagatgtttcttgattccgacgtaaatcctgaagacccaggcgctgatggcgtgttggcaggcataacccttgtcggatgtgctacgcgttgcaacgtgccacggtcaaactgcagctctcgcggtgatactccagtgctggacaaagggcagggcgaggtggcaaccatcgctaacggcaaggtgaacccatcccagtccacagaggaggctaccgaagcaaccgaggtcccagacccgggaccaagtgagccagaaactgctaccctcaggcctggtcctctgactgaacacgtattcaccgatcctgctccaactccctcctcgggcccacaacctgggtccgagaacgggcctgaacctgattcctccagtacaaggccagagcccgaaccatcgggcgatccgaccggggctgggtccagtgcggctcctaccatgtggctcggagcccaaaatggctggctctatgtgcactctgctgtggccaattggaaaaaatgtctccattccatcaaactgaaagacagcgttctgtccctggtacacgtaaaggggagagtactggtggctctcgcagatgggaccttggctatctttcatagaggagaagatgggcagtgggacttgagtaattatcacctgatggacttaggccacccgcaccactcaattcgatgcatggccgtggtgtacgacagagtttggtgcgggtacaaaaacaaggttcatgtgattcagcccaaaacaatgcagattgagaagagttttgatgctcatccccgaagagaatcacaggtccgacagctagcctggatcggggatggggtgtgggtatctatccgcctggattctaccctgcggctttatcacgcccacactcaccagcacctccaagacgtagacatcgagccctacgtctcaaaaatgttaggtactggaaagctcgggttctctttcgtcagaatcactgcacttctggtcgcgggaagcaggctgtgggtgggaactggaaatggagtggtgataagcattcccttgacggaaacagttgtcctgcacagaggacagctacttggcttgagagcgaataaaacgtctccaacaagcggggagggggcacgccctgggggaattattcatgtgtacggagatgatagctctgatcgggctgcatcctccttcataccctattgttcgatggcccaggcgcaattgtgctttcacggtcatagagacgccgtaaagttttttgtgagtgttccgggtaacgtcctggccacgctgaatggcagcgtgctagatagccccgcagaggggcctggacccgctgcaccagcctccgaggtagagggacagaagttgagaaatgtgctcgttctgtccggaggcgagggatacattgacttcagaatcggggatggtgaagacgacgagaccgaggagggcgcaggcgacatgtctcaggttaaacccgtgctaagtaaggccgaacgctcacatattattgtatggcaggtgtcatatacccccgaatag

SEQ ID NO: 51830 - DNA, 1569 bp, Artificial Sequence
  Description of Artificial Sequence: Synthetic coding sequence
atggccttcttggacaaccccaccatcatccttgctcatatccgccagtcccacgtcacctctgacgacaccggtatgtgtgaaatggtgcttatcgaccacgatgtggacctggaaaaaattcaccctcccagcatgcctggcgattccggatccgaaatccaaggcagtaatggcgagacacaaggatatgtgtatgcccagtccgtggacataaccagctcatgggatttcgggattcgacgcagatctaacacagctcagcgtctggagcgacttaggaaggagagacagaaccagattaagtgcaaaaacatccagtggaaagaaagaaatagcaagcagtcagcccaggaactgaaaagtttgtttgaaaaaaaatccttgaaggagaagccacccatatcgggcaaacagtccattctttctgtgaggttggagcaatgccctcttcagttgaataacccattcaacgagtattcaaaatttgacgggaaaggacatgtcgggacaactgccaccaaaaaaatcgatgtttatctgccactgcactcgtcacaagatagactcctgccaatgacggttgtgaccatggcaagtgcgagggtccaggaccttatcggactgatctgttggcaatatacatcagaggggagggagcccaagcttaacgacaatgtgtccgcctattgtctacatattgccgaggatgacggcgaagtggatacggattttccacctttagattctaacgaacccattcacaaatttggcttcagcacgttggccctcgtggaaaaatattcttctcccggactaacgtcaaaggaaagcttgttcgtccgcattaacgcagcccatggctttagcctgatccaagtggacaacacaaaagtgaccatgaaggagattttactaaaggcagtgaagcggagaaagggtagtcagaaggtctctggccctcagtacagactggagaagcagagcgagccaaatgttgccgttgacttggacagtaccctggaaagtcaaagtgcctgggagttctgccttgtgagagagaacagctcccgggctgacggcgtgttcgaggaggactcgcagatcgatattgcaaccgtgcaggatatgttgtctagtcatcattacaagagttttaaagtctccatgatccacagactccggttcaccacagacgtacagcttgggataagtggggacaaagttgaaatcgatcccgtaaccaatcagaaggcgagtaccaaattctggatcaaacagaaacccatttccatagactccgatctactgtgcgcatgtgacctggcagaagagaagtctccctctcacgcgatcttcaagttgacctacctgagtaatcatgattacaaacatttatattttgagtccgacgctgctacggttaatgagatagttctgaaggtgaactacatccttgaatctcgcgctagtaccgcacgagctgactatttcgcgcaaaaacagcgtaaactgaatcgtaggacgagctttagctttcaaaaagagaagaagtctggccagcagtag

SEQ ID NO: 51831 - DNA, 1461 bp, Artificial Sequence
  Description of Artificial Sequence: Synthetic coding sequence
atggcgttcctcgacaatcccacaataatactggcacacatcaggcagtctcacgtgacgtccgatgacaccggcatgtgtgagatggtcctgatcgatcatgatgtggaccttgagaaaattcaccctccctcaatgccaggggactctgggagcgaaatccagggctcaaatggggagacccaaggatatgtctacgctcaaagtgtggatataactagctcatgggacttcggtatccggaggagatccaatacggcacaacgactggagcgcttacgcaaagaacgccagaaccagattaagtgcaagaacatccaatggaaagaaaggaattccaaacagagcgcacaggagctcaaatcactgtttgaaaagaaaagtctgaaggagaaaccccctatcagcggaaagcaatctatcctcagcgttcggctggagcaatgtcccttgcaattgaataatccctttaacgagtatagcaaatttgacggaaaaggacatgttggaactacagcaactaaaaaaatcgacgtgtatctgcctctacactcctcccaggacaggttgctccccatgaccgtggtaacgatggcgagtgctagagttcaggatctgattggtcttatctgctggcaatatacttctgagggcagggagcccaagttaaacgacaacgtgagtgcttactgtctccacatcgccgaggatgatggggaagtcgacacagatttccccccactggactccaacgagccgatacacaaattcgggttttcaaccctggctctggtcgaaaaatacagctcccctgggctgaccagcaaggagagcctgttcgtgagaattaacgcggcacacggtttcagtctcatccaagtagataatactaaggtgaccatgaaggaaatactattgaaggcagtgaaaaggagaaaagggagtcagaaggtaagcgggagtcgcgctgacggtgtgtttgaagaggattctcagattgacatcgcaacggtgcaggacatgctcagctctcatcattataaatcatttaaggtctctatgattcataggttgcggtttaccaccgacgtgcaactgggaatcagcggagacaaagtggaaattgatcccgtgacaaaccagaaggccagcactaaattttggattaagcagaaacctatttccatcgattcagatctcctctgcgcttgcgatttggctgaagaaaagagtccctctcatgcaatcttcaagttgacatatttgtctaaccacgactataaacatctgtactttgagtctgatgccgctactgtcaatgagattgtactgaaggtgaattacatactggaatctcgagctagcactgccagagcagattacttcgcccagaagcagcgcaagctgaatcgaaggacgtcattctcattccaaaaggaaaagaagtctggccagcagtag

SEQ ID NO: 51832 - DNA, 399 bp, Artificial Sequence
  Description of Artificial Sequence: Synthetic coding sequence
atggcttttttggataaccccactattattttggcccacataaggcagagccatgtcacttcggatgatacgggaatgtgcgagatggtgttgattgaccatgacgtggacctggagaagatccacccgcctagtatgcctggcgacagtggctccgagattcaaggctcaaacgcacaaagattggagcggctcagaaaggagaggcagaaccagatcaaatgcaagaacatacagtggaaggagcgcaactcgaagcagagcgcacaggagcttaaatctctgttcgagaaaaagtcactgaaggaaaagccccctatcagtgggaaacagtccatcctctctgtgcggctcgaacaatgcccgctccagcttaataacccatttaacgagtactag

SEQ ID NO: 51833 - DNA, 708 bp, Artificial Sequence
  Description of Artificial Sequence: Synthetic coding sequence
atgacagtggtgactatggcctcggccagagtgcaggatctgatcggcctgatatgctggcagtacacctccgaagggagggagccgaagcttaagaatgccgctcatggcttttctctgatccaggtggataatacaaaagttaccatgaaggaaatcctgttgaaagccgtaaaaagacggaaaggatctcaaaaggtctccggctcaagagccgacggcgtatttgaagaggactcccagatcgatattgctaccgtgcaggatatgctgtcaagccaccactataagtcctttaaggtgagcatgattcaccgcctgaggtttactaccgacgtccaacttggcatttcgggtgataaagtggaaattgaccctgtcaccaatcagaaagcatctacaaagttttggattaagcagaagcctatttcaattgattcagacttgctatgtgcctgtgacttagctgaggagaagtcaccctcccacgctattttcaagctgacctacctcagcaaccatgactacaagcatctgtatttcgagagtgatgctgctactgttaacgaaatagtgctgaaggtcaattacatcttggaatcccgagcctcaacagcacgcgctgattacttcgcacagaagcaacggaagctgaatcgccgtacttccttctcctttcagaaggagaagaagtctggacagcagtag

SEQ ID NO: 51834 - DNA, 1569 bp, Artificial Sequence
  Description of Artificial Sequence: Synthetic coding sequence
atggcatttctggataatcccactatcatcttagctcatattaggcaatcgcatgtcacatccgacgataccggcatgtgtgaaatggtcttaatcgatcatgacgttgatctcgaaaagatccatccgccatccatgcccggtgactcaggctccgagattcagggcagtaatggcgagactcaaggctatgtctatgcacagagcgtagatatcactagtagttgggatttcggtatccgtagacgtagtaataccgctcagaggctggagcggctgcgcaaggagagacagaaccagattaaatgcaaaaacattcagtggaaggagaggaacagtaaacagtccgcccaagaactgaaatctctttttgagaaaaagagtctaaaggaaaaacctcccattagcggcaagcaatccatattgagcgtccggctcgagcagtgccctcttcagttgaataaccccttcaacgaatacagcaagtttgatggcaaaggccatgtgggaacaacagctactaaaaagatagacgtctacctccccctgcattcctcccaggatcgcctcttgccaatgaccgtcgtcactatggcatcggccagagtccaggaccttatagggctcatttgttggcaatatactagtgagggtcgcgagccgaagctcaacgacaatgtgagcgcctactgcttgcacatagccgaagacgatggcgaggtagacactgacttcccacctctggattcaaacgaacctattcacaaattcggattctccacacttgcacttgtagaaaaatatagctcccctggcttaactagtaaggaatcactatttgttcggatcaacgcagcccacggattctcgctgatacaggttgataataccaaggtcactatgaaagaaatcctgctgaaggctgtcaaaaggagaaagggcagtcagaaggtgagtggacctcagtaccggctggaaaagcaatcagagccaaacgttgcagtggatctggattccacactggagagccagagtgcatgggaattttgtctggtgcgggagaacagttctagagctgatggcgtgtttgaagaagactctcagatcgatattgctacagtccaagatatgctttcatcccatcattacaaaagcttcaaagtaagcatgattcatcgcctgcggtttactaccgatgtgcaattggggatcagtggcgacaaggtcgagatcgatcccgtcaccaatcaaaaagcttccactaagttctggataaaacagaaacccataagtatagactccgacctgctgtgcgcatgcgatctggcagaagagaaatctcccagtcacgcaatctttaagctgacatacctgtcaaaccatgactataaacacctctacttcgagtctgacgctgccactgtgaatgaaatcgtattgaaggtcaactatatactcgagagccgcgcatccaccgccagagcagactattttgctcagaaacagagaaagctgaataggcgaacatccttcagcttccagaaagagaagaagagtgggcaacaatag

SEQ ID NO: 51835 - DNA, 993 bp, Artificial Sequence
  Description of Artificial Sequence: Synthetic coding sequence
atgaccgtggtcactatggcctcagctcgggtacaagatctgattggactcatctgctggcagtacacttccgagggacgggaaccgaaactgaatgataatgtgagtgcctactgtctccatatcgccgaggatgatggagaggttgatacagatttccctcccctggattctaacgaacccatccacaagttcggattctcaacgctggcccttgtggaaaagtattcatcgcctggcctgacctcgaaggaatccctgtttgtacgcattaatgccgcacacggtttcagcctgattcaggtggacaacaccaaggttactatgaaggagatcctgctgaaagccgtaaaacggcgtaaaggtagtcagaaggtttcaggaccacagtacaggctagagaagcagagtgagcctaatgtggcagtggacctggactccacactagaatcccagtccgcgtgggaattttgcctggtgagagaaaattccagccgagccgacggagtctttgaggaagattcccagatcgatatcgcaacggtgcaggatatgctcagtagtcaccattacaaatcttttaaagtctcgatgattcatcgactcagattcacgacggatgtccagctgggtataagtggggacaaggtggagattgatccggtaactaatcagaaggcttccacgaagttctggatcaaacagaagcctatcagtatcgatagcgatctgctgtgtgcctgtgatcttgctgaagaaaaaagtccctcacacgccatttttaaactcacatacctatcaaatcacgactacaagcacttgtattttgaatccgatgccgcaaccgtaaatgagatcgtcctgaaggtgaactatattttggaatcgcgcgcttccacagcaagggcagactactttgctcagaaacaaagaaaactgaaccgaagaacctctttctcgtttcagaaggagaaaaaatctggtcagcaatag

SEQ ID NO: 51836 - DNA, 678 bp, Artificial Sequence
  Description of Artificial Sequence: Synthetic coding sequence
atgccaggggattctggaagcgaaatccagggaagtaatggcgagactcagggatatgtgtatgctcaatccgttgacattactagcagctgggactttggtatacgacgaagatccaacaccgcgcaaaggttagaaagactaagaaaggagagacagaaccagatcaagtgcaagaacattcagtggaaggagcgcaactcaaagcagtccgctcaagagctgaagagccttttcgaaaaaaaaagcttaaaggagaaacctcccatctccgggaagcagagtatactcagtgttaggctggagcagtgccctcttcagctcaataatccatttaacgagtattcaaaatttgatggcaagcactgttcctctctatgtagaatcatcatgaacaagtgtttcttgcaatccctcgcactcaactctagtctgcagcgtaaatccctcaagaccctgcagaaatcaatgaaaccacctagaaacgttgctaatagtgaaaaaggacacgtgggcacaaccgcgactaagaagattgacgtttatctgccacttcattctagccaggaccggctcttacccatgactgtggtcaccatggcgagcgccagggttcaggacctcataggcttgatctgctggcagtatacatctgagggtagggaaccaaagctgtag

SEQ ID NO: 51837 - DNA, 1428 bp, Artificial Sequence
  Description of Artificial Sequence: Synthetic coding sequence
atggcttttttggataatcctacaataatactggcccacatacgtcaaagccatgtgacctcagatgatacaggaatgtgcgagatggtgcttatcgatcacgacgtcgatctggagaagatccaccccccatctatgccaggcgattctggtagcgagatccagggttcaaacggggagacacagggatatgtatatgcccagtcggtcgatatcaccagctcatgggatttcggaataagacgtagaagcaatacagcccagagactcgagaggctgcggaaggaaaggcagaatcagataaaatgcaagaacatccagtggaaggagcgcaatagtaaacagtcagcacaagagttaaagagtctattcgaaaaaaaaagcctcaaggagaagccccctatcagcggaaaacagagtatactcagtgtcaggttggagcagtgtccgctgcagctgaataatccatttaacgaatactccaagttcgacggcaaaggccatgtgggcactaccgccaccaagaagatcgatgtttaccttcctctccacagctcccaagatcggcttctccctatgacggtagtgactatggccagcgccagagtccaagatctgatagggctgatttgctggcagtatacttccgagggaagggaacccaaactaaatgataatgtgtcagcatactgtcttcatattgcagaagacgacggagaggtggatactgatttccctccgctggatagcaatgaacccattcataaatttgggttctccaccctcgcccttgtggagaaatacagcagtcccggactgaccagtaaagagtcactcttcgtgagaataaatgccgctcacggcttctctcttattcaagtggacaacacaaaagtgaccatgaaggagattttgcttaaggcagtgaagaggcgaaagggctctcagaaagtgtccggccctcagtatcggcttgaaaagcagtccgagcccaatgtagccgttgatctcgattctaccctggagagccagtccgcatgggaattttgcctcgtccgtgaaaacagcatctcaggcgataaggtcgagatagatcctgtcacgaatcaaaaagcaagcacgaagttctggataaaacagaagcccatttccatcgactctgaccttctgtgtgcctgcgatctcgcagaggagaagtctccttctcacgcaatctttaaactgacatacctcagcaatcacgattacaagcatttgtacttcgagagcgatgctgccactgtaaatgagatcgtgttaaaggtcaattatatcttggaaagccgtgccagtacggctcgggcagattatttcgcccagaagcagcgcaaactcaaccgtagaacatcatttagctttcagaaagagaagaagtccgggcaacagtag

SEQ ID NO: 51838 - DNA, 993 bp, Artificial Sequence
  Description of Artificial Sequence: Synthetic coding sequence
atgacagttgtgacgatggcttcggccagggtccaggatttaattggattgatttgctggcagtacacctccgagggcagggagccaaagctcaatgacaatgtgagcgcatattgtttacatatagccgaggatgacggggaggtggatacagatttcccgccactggactctaatgaacctatacacaagtttggcttctccactctggcgctggtggaaaaatacagctcgcccggtctcacttctaaggagtcactgttcgtgagaattaacgccgcacatggtttcagcctgatccaggtggataatactaaggtgactatgaaggagattttacttaaagctgtcaaacgtagaaagggtagccaaaaggtatcagggcctcaatacagactagaaaaacagtcagagccaaacgtggctgtagacttggactccaccttagaatcgcaatctgcgtgggaattctgcttggtccgggagaactcctcacgggctgatggcgttttcgaagaggattcccagatcgacattgcgacggtgcaggatatgcttagcagccatcactacaagtctttcaaagtttcgatgatccacagattgcggtttaccacagatgtacagctcggcatttccggcgataaggttgagatcgacccggtcacaaaccagaaggcgtcaactaaattctggatcaaacagaaacctatcagcatagatagcgatttgttgtgtgcctgtgatcttgctgaagagaagagtccatctcacgcgatttttaaactgacatatttgagcaatcatgattacaagcatctgtatttcgagtctgatgccgctacagtgaatgagatcgtgctgaaagttaattacattctggaatctagagcctcaaccgccagggctgactattttgcccaaaagcaacgcaaactgaataggcgtacctcgttctcttttcagaaagaaaagaagtcgggacaacagtag

SEQ ID NO: 51839 - DNA, 282 bp, Artificial Sequence
  Description of Artificial Sequence: Synthetic coding sequence
atggcctttctggataatccaacgatcatattggcccacatcagacagtcacacgtgacatctgacgacacagggatgtgcgagatggttctgattgaccatgacgtggacctggagaaaatccacccaccatctatgccaggagatagtggaagtgaaatccagggtagtaacggcgagactcaaggctacgtgtacgcccagtctgtcgatatcactagtagctgggactttggaatccggaggagaagtaatacagcccagaggttggaacggttgtag

SEQ ID NO: 51840 - DNA, 285 bp, Artificial Sequence
  Description of Artificial Sequence: Synthetic coding sequence
taaaagagctttaaagtaagcatgatacaccggttgagattcaccacggatgtgcaactcggccatgccatcttcaaactgacctatctctctaatcacgactataaacacctttattttgagtccgatgcagctaccgtgaatgagatcgtcctgaaggtgaattatatcctggaatcccgcgctagtaccgccagggccgattatttcgctcagaaacagaggaagttgaaccggagaacaagctttagttttcaaaaagagaagaagagcggacagcagtag

SEQ ID NO: 51841 - DNA, 972 bp, Artificial Sequence
  Description of Artificial Sequence: Synthetic coding sequence
atggcttttctcgacaaccccaccatcattctcgcccatatccgacagagccatgtcacatcagatgataccggcatgtgtgagatggtcctgatcgaccacgacgttgatctcgaaaaaatccatcccccaagtatgcctggggacagcgggagtgagatccaagggtcgaatggtgagacccaggggtatgtttatgcacagagtgtcgatatcacatcctcttgggattttggcattcggagaaggtcgaacacggctcaaaggctcgagaggctgaggaaggaacggcagaaccagattaagtgcaagaatattcagtggaaagagcgtaattccaagcagagtgcacaggaactcaagtctctgttcgagaaaaagagcctgaaggaaaaacccccaatttccggaaaacagtcaatcctgagcgtgcgattggagcagtgcccgctccaactcaacaacccttttaacgagtatagtaaattcgatggcaaaggtcatgtggggaccacagccacaaagaagatcgacgtatatctccccctccactcctcccaggatcgtcttctccccatgaccgttgtcacaatggcatccgctcgggtgcaggacctgatcggactcatatgctggcagtatacttccgaaggacgggagcccaagttaaacgataatgtcagtgcttactgcttgcatattgccgaagacgacggagaggtggacactgatttcccccctttggattcaaatgaacctatccataaatttggtttttctaccctggccctggtggaaaaatattcctccccaggacttactagcaaagaatccctcttcgtgaggatcaatgcggctcatggtttcagtcttatccaagtcgataatacaaaggtgacaatgaaagaaatcctgttgaaggcagtgaagaggcgcaagggttctcagaaagtatctggcgcatgcgactag

SEQ ID NO: 51842 - DNA, 1008 bp, Artificial Sequence
  Description of Artificial Sequence: Synthetic coding sequence
atgaaagtggaattcgcccctctcaatatccagctagctaggagattgcaaacagttgccgtgctccaatgggtgctgaaatatttgctgttgggcccaatgtcaatcggcattaccgtgatgcttattattcataactatctgttcctgtacatcccttatctcatgtggctttatttcgattggcacacaccagaacgtggaggaagacggagcagttggatcaaaaactggaccctgtggaaacattttaaagattactttcccatccacctgatcaaaacccaggatctggacccgagccacaactatatctttgggttccatccccacggaatcatggcggtgggtgcatttgggaacttttccgttaactacagtgatttcaaggacctgttccctggattcaccagctatttgcacgtcctcccactgtggttttggtgccctgtattccgtgaatacgtcatgagcgtcggcctggtgtcagtgagcaaaaagagcgtctcttacatggtgagtaaggagggaggcggaaacatctcagtgatcgtcctgggaggggctaaagagtcactcgatgcccatcctggcaaatttaccctgtttatacgccaacgaaaaggcttcgtcaagattgcccttacccatggagcatctctcgtgccagtagtgtcattcggtgagaacgagctgttcaagcagaccgataaccccgaggggtcctggattcgaacagtccaaaacaagttacagaagataatgggctttgcattgccactcttccatgcacgaggggtgttccaatacaacttcggtctcatgacctacaggaaagccatccacactgtagtgggcagaccaattcccgtcaggcagactctcaatcccacacaggagcagattgaggagctgcatcagacatacatggaggagctgcggaagctattcgaggagcataaagggaagtatggcatccccgaacacgaaactctggtccttaagtag

SEQ ID NO: 51843 - DNA, 1005 bp, Artificial Sequence
  Description of Artificial Sequence: Synthetic coding sequence
atggtggagttcgcccctctgtttatgccgtgggaaaggcgcctgcagacactcgcagtcttgcagtttgtgttcagtttcctggcactggctgaaatctgcacggtggggtttatcgctctgctttttacgagattctggttgctcaccgtgctgtatgctgcctggtggtatctggaccgcgacaagcccaggcagggcggacgccacattcaggccatccgctgctggaccatttggaaatatatgaaggattacttcccaatctccctcgtgaaaacagctgaattggacccgagtagaaattatatagccggttttcatcctcacggtgtactcgccgtcggtgcgttcgccaacttgtgtacagagagtactggcttctctagtatattccccggaatcaggccacatctcatgatgctgactctttggtttcgagctccattctttagagattatattatgagtgctggactggtcacctccgagaaagaaagtgcagctcacatcctcaacaggaagggtggtgggaatctcctaggcatcatcgtgggcggtgcccaagaggcccttgacgcacggccaggtagcttcactctgttactgaggaatcgcaagggatttgtgaggttggcgttgacacacggtgctccactcgtaccaatcttctcctttggggagaacgacctgtttgaccagatccccaacagcagtggttcctggctgcgctatattcagaatcgcctgcagaagattatgggcatttccctgccactattccatggacgaggtgtgtttcaatacagctttggtttgattccttatcgccgacccatcactaccgtggtggggaagcctattgaagtgcagaagacactccacccatctgaagaagaggtgaatcagctacaccaaaggtacatcaaagagctgtgtaacctgttcgaggcccacaaactgaaattcaatatccctgctgatcagcacctggaattctgctag

SEQ ID NO: 51844 - DNA, 759 bp, Artificial Sequence
  Description of Artificial Sequence: Synthetic coding sequence
atgaaagattattttcccatcagcctagtaaagacggccgagctggacccaagtcgaaattatatcgctggctttcatccgcatggggttctcgccgtcggcgctttcgctaatctgtgtaccgaaagtaccggttttagctcaatattccccggtatcaggccacaccttatgatgttgacactctggttccgggctccattcttccgggactatatcatgtcagccggacttgtcacctcagaaaaggagtcggcagcacatatcttgaatcgtaagggcggagggaacttacttgggataatcgtaggcggagcccaggaggcccttgatgccagacccggtagctttactttattgcttagaaatcgaaaaggattcgtgcgacttgcgctgacccatggagccccactggtacccattttttccttcggagagaacgatctattcgaccagataccaaattccagtgggtcttggctgcggtacatccaaaacaggctgcaaaagattatgggcataagcctccccctgtttcatggcaggggtgttttccaatactcattcggtctcattccctaccggaggcctatcaccaccgtggtaggaaagccgatcgaggtccagaagaccctccaccctagcgaggaagaagtgaatcagctccaccagaggtatatcaaagagctctgcaacctattcgaagcacacaaactgaagttcaatatccccgctgatcagcacctggagttttgctag

SEQ ID NO: 51845 - DNA, 1209 bp, Artificial Sequence
  Description of Artificial Sequence: Synthetic coding sequence
atgcagatgagtcctgccctgacctgcctggtactcggattggccctcgtgtttggtgaaggatctgctgttcaccaccctccgagctacgttgcccatctggcgagcgacttcggggtgcgggtcttccagcaggtagcccaggcttccaaggaccggaacgttgtattctctccctacggcgtagccagcgtcctggccatgctacagctgacaacaggaggggagacacagcagcaaatacaggctgctatgggatttaagatagacgataaagggatggctccagctctgcggcatttatataaggagttaatgggcccttggaataaagatgagatttctaccactgacgcaatatttgtacagcgggacttgaagcttgttcagggattcatgccacactttttccgcttattccggagtaccgtcaaacaggtagacttcagcgaggtagaacgagcacgatttattatcaatgactgggtgaagacccacacgaagggaatgatttccaacctcctcggcaagggagcagtggaccagctgaccagactagttctggttaacgccttgtattttaatggccagtggaagactcctttcccagacagcagtactcacagacgattgtttcataaaagtgatggatccacagtttccgtgcctatgatggcccagaccaacaaatttaattacacagaatttactacccccgacggccactactatgacattctagagctcccctaccacggggataccctcagcatgttcatcgctgccccatacgaaaaggaagtgccactcagcgctctgaccaacatccttagcgcgcaactgatctcacactggaaaggtaacatgacacgtctgccacgcctcctggtgctacctaagttcagccttgagacagaggttgacctgaggaagccattagaaaatttgggcatgacagacatgttccgacaatttcaggcagattttacctcactcagtgaccaggagcccctgcatgtcgctcaggctctacagaaggtgaaaatagaggtgaatgagagcgggaccgtggcttcatcaagtaccgctgtcattgtgagtgccagaatggccccagaggaaatcatcatggacagaccattcttattcgtggttcgccacaaccctaccgggactgtactgttcatgggtcaggtgatggaaccttag

SEQ ID NO: 51846 - DNA, 846 bp, Artificial Sequence
  Description of Artificial Sequence: Synthetic coding sequence
atgggagtcgccacaacactgcagccacctacgacttcgaagaccctgcaaaagcagcacttggaggctgtgggagcctatcagtacgtactcactttcctttttatggggccattttttagcctgctcgtctttgtcctgctttttacttcactgtggccattttccgtgttttatttggtgtggctgtacgtggactgggatacgcctaaccaggggggtaggcggtccgagtggattcgcaatagagccatatggcgtcagctgagagattactatcccgttaagctggtcaagaccgccgaacttccaccggaccgtaattacgtgctaggagcgcacccacatggaatcatgtgcacaggttttctctgcaatttttccaccgagagcaatggattttcccagttgttccctggattgaggccttggctggcagtattagcaggattattctatctgcccgtttaccgcgactatataatgtccttcggtctctgtccagtctcaagacagagcttggactttatcttaagccagcctcagctagggcaggcggtcgtaatcatggtgggaggggctcacgaagcactctactccgtgccaggcgagcattgcctgaccctgcagaagcgcaaaggcttcgtccgcctggcccttcgtcatggtggccctccacacccccgacctcccgcaccaccccctcaccgtggaggttcccaatctctgtccaggccactgcatgacggcccaggcgcagcgcttagaggagcacagggcaaactgtgggggccacggtttcacttgccacacttgcatcttggactggcagcggcattcagatag

SEQ ID NO: 51847 - DNA, 1035 bp, Artificial Sequence
  Description of Artificial Sequence: Synthetic coding sequence
atgggagtcgccaccacactccaaccacctaccacttccaaaaccttacaaaagcagcatctggaggccgtcggggcttatcagtacgtcctcacttttctctttatggggcctttcttctctcttctcgtattcgtcctcctgtttacctcactgtggcccttttccgtgttctatctcgtgtggctgtacgtagactgggacactccaaatcagggaggccgaagaagcgagtggattaggaaccgggctatctggcggcaactccgggactactacccagtaaagttggtaaagaccgctgaactgccacccgaccggaactacgtgttgggcgcacatccacatgggattatgtgtaccggttttctgtgtaacttctcgactgagagtaatggcttttctcagttattcccgggattgcgtccatggcttgcggtgttggcgggactattttacctgcccgtatatcgtgattacattatgtcttttgggctgtgcccagtgagtcgccagtccctcgacttcatcctgagccagcctcaactggggcaagcagtcgtcattatggtgggcggtgctcatgaagccctgtattcagtgcccggagaacattgcctgacactacagaagcggaaggggttcgtgagactggccctgcgacatggggcttctctggttccagtgtattccttcggcgagaacgatattttccgtctgaaagcgttcgcaaccggaagttggcagcattggtgccagctgacttttaaaaaactcatggggttctcaccttgtatcttctggggacggggattattcagtgccacttcctggggcctgctgccttttgccgtgcccattacgacggtgggggaatgcccccctcccggaggacgtcctcctgccgcagcttgggcatctgggattccacgaccaccagtgtctttaagtctccagtgggcagctccttcacccagccccagcgcatctacaccacctcggagaaaaagcataactattaccccctcaacgtag

SEQ ID NO: 51848 - DNA, 645 bp, Artificial Sequence
  Description of Artificial Sequence: Synthetic coding sequence
atgcaccagcagaaacggcagccagaattggtggaaggcaatctgcccgtgttcgtgttccctactgaactgatcttctacgcagacgatcagtcaacgcataagcaagtgctcacactatacaatccctacgaattcgccctgaagtttaaagtgctttgcaccacccccaataagtacgtggtggttgacgctgcaggtgctgtgaaaccacaatgttgcgttgacatagtaatacggcaccgcgacgtgaggtcttgtcattacggcgtgatagacaaatttcgcttgcaggtaagtgagcagtctcagagaaaagcgcttggccgtaaggaagtggtagccacactgctcccgagtgcaaaggagcagcagaaggaggaggaagagaagcgcttgaaagagcatctcacagaatctttgtttttcgagcaaagctttcaacctggaaagaaccgtgcagttagctctggaccatctttactgactgtttttctcggtgttgtttgcatcgctgccttgatgctacctaccctgggtgacgtcgagtcactcgtgcccctgtaccttcacctgtccgtgaaccagaagctggttgcagcatacattttgggattgattactatggcgattcttagaacttag

SEQ ID NO: 51849 - DNA, 480 bp, Artificial Sequence
  Description of Artificial Sequence: Synthetic coding sequence
atgcaccagcagaaacgacagcctgaattggtcgagggaaacctgcctgtgtttgtttttccgactgaactcatcttctacgccgacgatcagagtactcacaaacaagttctcacactctacaacccatatgagttcgccctcaagttcaaagtgctctgtacaacacctaacaaatacgtcgtggtggatgctgctggagccgtaaagcctcagtgttgcgtcgacatcgtgattcggcatagggatgtacggtcctgccattacggggtcatcgacaagtttcgcctccaggtctcagagcagtctcagcggaaagctctcgggaggaaggaggtggttgccaccctgctcccctccgcgaaggaacagcagaaggaggaggaagagaaacgtctcaaggaacacctgacagagagccttttttttgagcagtctttccagccaggtctcataaccatggccattcttcggacgtag

SEQ ID NO: 51850 - DNA, 642 bp, Artificial Sequence
  Description of Artificial Sequence: Synthetic coding sequence
atgcaccaacagaagaggcagcccgagctcgtcgagggtaatttacctgtgtttgtattccccacagaattaatcttttacgccgacgaccagtccacacataagcaggtgctcactctgtacaacccatatgaattcgcactgaagtttaaggtcctttgcacaacgcctaataagtacgtggttgtggatgctgctggagccgtcaaacctcagtgttgcgtggacattgtgatccggcatcgtgacgtgagaagttgccattacggagtaattgataagtttagactgcaggtgtccgagcagagccagcgcaaagcccttggccgtaaagaggtggtcgcgaccctcttgccatcagcaaaggagcagcagaaggaggaggaagaaaaaagattgaaggagcatctgaccgagtctctgttcttcgaacagagtttccaaccagagaaccgggcagtttcgagtggaccaagcctgctgactgtgttcttgggggtggtgtgcattgccgcactgatgctacctacactaggtgacgtagagagcctggttccactctatctgcatctttccgtgaaccaaaaactcgtagctgcctacatcctgggactgatcaccatggccatcctgcgtacctag

SEQ ID NO: 51851 - DNA, 1557 bp, Artificial Sequence
  Description of Artificial Sequence: Synthetic coding sequence
atggccgaaaaccacgctcagaacaaagctaaactgatctcggagaccagacggaggtttgaagccgagtacgtcacagataagagcgataaatacgatgcacgggatgttgagcggctccagcaagatgataactgggtcgagagttacctgagctggagacacaacatagtcgacgagaccctgaaaatgctcgatgaatcattccagtggcggaaagagatttctgtgaatgacctcaacgaatcctccatcccgagatggttgctggagatcggcgtgatctacttacatggttacgacaaggaggggaataagttattctggatccgggtgaaatatcatgtaaaggaccagaaaactattctggataaaaaaaagttgattgccttctggctggagagatatgcaaaacgcgagaatggaaagcccgtcacagtaatgttcgatctgtctgaaacgggcattaatagtatcgacatggattttgttaggtttataatcaattgcttcaaagtgtattatccaaaatacctctcaaaaatagtcatctttgatatgccctggctcatgaatgccgcattcaaaatagttaagacctggctcggaccagaagccgtgtcgctgctgaaattcacaagcaaaaacgaagtgcaggactatgtctctgtggagtatttaccaccacatatggggggtactgatccctttaagtactcttatccacccttagtggatgacgattttcagaccccactttgtgagaacggccctattacctcagaggacgaaacgagcagtaaggaggacattgaatcggacgggaaggaaaccttggagactatatccaacgaggaacagacacccctcttgaaaaaaatcaatccaaccgagagcacatccaaagccgaggagaacgagaaggttgatagcaaggtgaaggccttcaaaaagccactgtcagtttttaagggacctctgctgcacattagcccagccgaagaattatatttcgggtccactgaatccggggagaagaagacactgattgtcttaacaaatgtgactaaaaatatagtggcctttaaggtgcgaactaccgctcctgaaaagtatagagtgaagccatccaacagctcctgtgaccccggagcaagcgttgacatcgtggttagtccgcacggcggtttgacagtttcagcacaggatcggtttctgattatggcagcagaaatggaacaaagttccggaactggcccagccgagctgacccagttttggaaggaagtcccacgaaataaggtgatggaacatagactgcgctgccacaccgtggaaagcagcaagccgaacactctgaccctaaaggacaatgcgtttaatatgtcagataagacaagcgaagatatctgtctgcagttaagccggctgctggagtccaacaggaagcttgaggatcaagtccagcgatgtatctggtttcagcaattgctcctgagtctaaccatgctcctcctggcgttcgtcacgtcattcttctacctgctgtattcctag

SEQ ID NO: 51852 - DNA, 2406 bp, Artificial Sequence
  Description of Artificial Sequence: Synthetic coding sequence
atggaaagactttgggggctgttccaacgtgctcagcagctgtcaccgcgaagctcccagaccgtctatcaacgggtggaaggcccaagaaagggacacctggaggaggaggaggaggatggtgaggagggagccgagactctggctcatttttgccccatggagctgcgtggaccggaacccttagggtctcgacccaggcaacccaatctcataccatgggccgcagcaggcagaagggccgctccctatctcgtcctgactgctctcttaatttttactggagcattccttctggggtatgtggcatttagaggaagctgtcaggcttgcggggactctgttcttgtggtctctgaggatgttaactacgagcctgacctggacttccatcaggggagactatactggagcgacctgcaggctatgtttttgcaattcctaggcgaggggaggctggaagacaccatcagacagacctcattgcgagagagagtggccggtagcgccggtatggcagccctgacacaggacatccgtgcagctttgagtagacagaagctggaccacgtttggacggacacccattacgttgggttgcagttccctgaccctgcacacccaaatacactgcactgggtagatgaagctggcaaggttggggagcagctgcccctggaggaccctgatgtctactgtccttattctgctatcggaaacgttacgggcgaactggtgtacgctcactacggtcgtcccgaggacctccaagatctacgtgctagaggggtggaccctgttgggcgtttgcttctggttagggttggcgtgatctctttcgcacagaaagtaacgaatgcccaggacttcggggctcagggtgtcctgatttatcccgaacccgctgatttctctcaggacccacctaagccgtcactgagctcccaacaggctgtgtatggccacgtccaccttggaacgggcgacccctacacacccggtttcccgtccttcaaccagacgcagtttcctccagtcgcctctagtggactcccgagcatccctgcccaacctatatctgccgatattgcgtcgcgcttacttcggaagttaaagggacccgtagccccacaggagtggcaggggagcttgttggggtccccgtaccacctgggcccaggacccaggcttagactggtcgtcaataatcacagaacctcaacaccaatcaataacatcttcggctgtatagagggcagatctgaacctgatcattatgtcgtcattggagcgcagagagacgcctggggcccaggcgctgccaaaagtgcagtaggaaccgccatcctgttggaactcgtcagaaccttcagctccatggtctccaatggatttcgcccaagacgcagtctcctgtttatcagctgggatggcggtgacttcggaagcgtgggttctaccgaatggttggaaggatacttgagtgtgttgcatttaaaggcagtcgtctatgtgtctttagacaacgccgtgttgggagatgacaaatttcatgccaaaacctctcctcttctaacttccctgatcgaatctgtgctcaaacaggtggacagcccgaatcactctggccaaaccctttatgagcaggtagtgtttaccaacccttcctgggacgccgaagttattaggccccttcccatggacagtagcgcctacagctttacggctttcgtcggggtccccgctgttgaattctcgtttatggaggacgaccaggcgtatcccttcctgcacacaaaggaggacacatacgaaaatctgcataaagtgctgcaaggtcggctacccgctgtcgcccaggccgtggcacagctggcaggccagttgctgatccgcctctctcacgacaggttgctgccccttgattttggacgctatggggatgtggtcctgcgccacattgggaatttgaatgaattctctggtgatctgaaagctaggggactcacactccagtgggtgtactctgccaggggcgactacatcagagcggcagaaaagttgcgtcaggaaatttactccagcgaagagcgcgatgaaaggctgacccgcatgtataacgtgcggattatgcgagtggagttctactttctgagccagtatgtgtcgccagccgatagtccttttaggcatatattcatggggcgaggtgaccataccttaggcgctctgctggaccacttgcgattactgcgctcaaactcttcaggcactcccggtgcaacgtcttccactgggtttcaggagagcaggttccgcagacagctggccctcctgacctggacactgcagggggctgcgaatgcgctatccggagatgtatggaacattgacaataacttctag

SEQ ID NO: 51853 - DNA, 708 bp, Artificial Sequence
  Description of Artificial Sequence: Synthetic coding sequence
atgcggagaggcgcacctcaggaccaggagctcgtggggccaggccctccgggtcggggttctagaggggctccacccccactaggtcccgtggtccctgtgctggtgtttcccccagatctggtctttcgggctgaccagagaagtggacctcgccaactcctgaccctgtataaccccaccggtactgctctgcggttcagagtgttatgcacggcgccagctaaatacaccgtctttgacgcagaagggtatgtgaaaccgcagtcttgcatcgacatagtgatccgccacgtggcccctatcccctctcactatgacgtccaagatcgatttaggattgagttaagtgaagaaggagctgagggcagagtggtgggacgcaaggacattacaagtatacttagggctccagcttaccccctggaacttcagggccaacccgaccctgccccacggccagggccacccgctggcacaccccctccaactgctagacacttccaggaacaccctagacaacagctcgccacttccagtttccttctcttcttgttaacgggcattgtgagcgtcgcgtttctgctgctgccactacctgatgaactcggatcccagttgcctcaagtgctgcatgtctcactgggacaaaagctggtggccgcatacgttcttggcctcttaacgatggtcttcctgcggacatag

SEQ ID NO: 51854 - DNA, 708 bp, Artificial Sequence
  Description of Artificial Sequence: Synthetic coding sequence
atgcgcaggggcgctccacaagaccaagaactggtaggtccagggcctccagggagaggatcacggggagcaccccctccgctgggcccagtcgttccagttcttgtattccccccagacctagtctttcgggcagaccagcgatcgggacctcgacaactattgaccctgtataacccaacaggtaccgccttgcgctttagggtgctgtgtactgctccagcaaaatacacagtcttcgacgcagagggatatgtgaaacctcagtcttgtatcgatattgtcatacggcacgtagctcccattccttctcactatgatgtccaggacaggtttcggattgagttatccgaggaaggcgctgagggtagggttgtcggacggaaagatataacatctatacttcgcgctcccgcttaccctctggagctccaaggccagccggacccagcacctcgccctggtccccctgccggtacaccccctccgactgccaggcattttcaagaacacccgaggcagcagctcgcaacctcctccttccttctgttcctcctgacgggcattgtttctgtcgcatttctgctgctacccctccccgatgagctggggagtcagctcccccaggtgcttcacgtttcactgggtcagaagctggtggctgcctatgtgctgggattgttaaccatggtattcctccgcacctag

SEQ ID NO: 51855 - DNA, 666 bp, Artificial Sequence
  Description of Artificial Sequence: Synthetic coding sequence
atgtctgataggcctgagcccgcttgcgctccacctcctctgggccctgtggtcccggttctcgtattccccccagacctggtgtttcgcgctgaccagaggagcgggcctagacagctgctcactttatacaacccaaccggcacagcccttcgcttcagagtcctctgcaccgcgccagccaagtatactgtctttgatgccgaggggtacgttaagcctcaatcatgcattgatatagtcattagacacgtggctccgataccgtcccactatgacgttcaggatcggttcaggatcgagctttcggaagaaggcgctgagggcagggtggtgggcagaaaagacataactagcatcctaagggcgccagcctacccactcgaactgcaaggccagcccgatccggcaccaaggcctggacccccagccggtacccctccaccaaccgctaggcacttccaggaacatcccagacagcagctggcaacatcgtcttttcttttatttctgctgaccggaatagtctccgtggccttcctcctgctccccctgcccgatgagctgggatcccagctccctcaagtacttcacgtgagtctgggccagaaactggtagctgcttacgtcctgggtttgttgacaatggtgttcttacggacctag

SEQ ID NO: 51856 - DNA, 678 bp, Artificial Sequence
  Description of Artificial Sequence: Synthetic coding sequence
atgcgcaggggtgcccctcaggaccaggagctagtggggcctggccctcccggtcggggatcgaggggcgcaccaccacctctggggcctgtcgttccagtgctggtcttcccaccagatttggtatttcgggcagaccaaaggagtgggcctcggcagctgctgacactctataatccaaccgggactgctctgcgctttcgcgttttgtgtacggccccagccaaatacactgtctttgacgcagaaggatacgttaagccacaaagttgcattgatatccattatgacgttcaggatcgtttccgcatcgaactctctgaggagggcgcagaggggagggtcgtaggaaggaaagacattacaagcatcttgcgcgcacctgcatacccacttgagttgcagggacaaccagatccagcccctcggccaggtcccccagccggaacacctcctcccaccgcaaggcattttcaggaacatcctcgccagcagctcgcaactagctcctttctcctgtttctcctgacagggatagtgtctgttgcttttctgctgctgccactcccggacgagctaggctcccaactgcctcaggtcctgcatgtgagcttaggccagaagcttgttgctgcctacgtgctaggcctcttgacaatggtgtttctgaggacctag

SEQ ID NO: 51857 - DNA, 444 bp, Artificial Sequence
  Description of Artificial Sequence: Synthetic coding sequence
atggccggatggtggcctgcgctcagcagggctgcgagacggcacccgtggccgactaacgtgctcttatatggcagccttgtgtccgccggagacgctctgcagcagcggctgcaggggagagaagccaactggcgccagacgcggagggttgccacactggtggtgacttttcacgctaatttcaactacgtttggttgcgactcctggaacgcgcactacccggtcgggctccacacgcccttctggccaagctgctctgcgatcaggtggtaggcgctccaattgctgtctctgcgttttatgtggagtggaccgatgtattagcgctctgtacagctgatcagctgcagccatgcagttgcagcatggagaatagtctcagatggagcctgtggttctccctcggacacctccacctcttctttcctgccgaatggtag

SEQ ID NO: 51858 - DNA, 591 bp, Artificial Sequence
  Description of Artificial Sequence: Synthetic coding sequence
atggccggttggtggccagcactgtcacgcgctgctcgcagacatccttggcctaccaacgtccttctgtacgggtccttggtttcggcgggagacgcactccagcaacggctacagggccgtgaggccaattggcgacagactcggagagtggcgaccttggtcgtcacttttcacgccaattttaactatgtgtggctccggctactggagcgtgctttgcccggtcgcgcaccacacgccctgctggcgaaacttctgtgtgaccaggtggttggtgcgcctatagcggtgtctgccttttatgtgggaatgtcgattcttcagggcaaggatgatatctttttggacttgaagcagaagttttggaacacttacctttcagggctgatgtactggcccttcgttcagctgactaacttctctttggtgcccgtgcagtggagaacagcttacgcaggggtctgcgggttcttgtgggccacgttcatatgcttttcacagcagagcggagatggcacattcaagtccgcgttcacaatactgtatactaagggtacttcggctacagaaggatatccaaagaagtag

SEQ ID NO: 51859 - DNA, 621 bp, Artificial Sequence
  Description of Artificial Sequence: Synthetic coding sequence
atggctaggggcggatggagacggctccgcagattactgtcagctgggcagttattatttcaaggccgagcgctactagttaccaataccctcgggtgtggggcattgatggcagcaggcgacggcgttcggcagtcgtgggaaattagggctagaccaggtcaggtcttcgaccctagaaggtccgcttcgatgttcgccgtggggtgctcaatgggaccttttctgcattattggtacctcagtctggacagactgttcccggcttccgggttgcgcggttttcccaatgtcctcaaaaaggtactggtcgaccaactggtggcttcacctttgctgggggtctggtactttctgggactgggttgcctggaaggtcagacagtgggcgaaagttgtcaggagctccgagagaaattttgggagttctataaagccgactggtgtgtctggcccgctgcgcagttcgtgaacttcctattcgtgccaccgcagtttcgagttacttacatcaacgggctgacactcgggtgggacacatacttgagttacttgaaataccgtagccccgttcctctcaccccaccaggctgcgttgcactggatacgagagccgattag

SEQ ID NO: 51860 - DNA, 354 bp, Artificial Sequence
  Description of Artificial Sequence: Synthetic coding sequence
atggagtgcctacggagcctgccatgtctactgccacgcgcaatgcgtctcccaagacgaacactctgtgctttagcccttgacgtgacaagtgtgggcccacctgtggccgcttgtggcaggagggccaacttaatcggaaggtcacgcgcagcccaactatgtggccctgacagactccgggtagctggcgaggtgcatagattcagaacttccgatgtgagtcaggccaccctagcatcagtcgcaccagtgttcacagtcactaaatttgataaacagggcaatgttacctcattcgtttttgagagctgcgacaatagtcgagtttcttcagacattagactgagctag

SEQ ID NO: 51861 - DNA, 1227 bp, Artificial Sequence
  Description of Artificial Sequence: Synthetic coding sequence
atggaatgcctgaggtcacttccttgtcttctgccgcgtgccatgaggctcccacggagaacactgtgcgctctcgctctggatgtgacctccgtgggccctcccgtggccgcatgcgggagacgggcaaacttgatcggcagaagtcgcgctgcacaactgtgcgggcctgaccgattacgagtggcaggtgaggtccatagatttcgcacctctgatgttagccaggcaactctagcctcagtggctcctgtgtttacggtcactaaatttgataaacaagggaacgtaacctcatttgagagaaagaagactgaactgtaccaagagctcggcctgcaagccagagacctacgctttcaacacgtgatgagtattaccgtccgcaataatagaattatcatgcgcatggaatatctcaaagctgtcattaccccagagtgcctgctgatcctcgactatcggaatctgaatctggaacaatggctctttcgagaactaccatctcagctgtccggggaagggcagctagtcacctaccccttaccattcgagttccgcgcaatcgaggctctgttacagtactggatcaacactctgcagggcaaattgtctattttgcagccgctaattcttgagaccctcgacgccttggtggaccccaaacattcgtctgtggacagatccaagctgcacatcctgctccagaacggcaagtcactgagcgaactcgaaactgacatcaagatctttaaagaaagcatcttagagatactggatgaagaggagcttctcgaggagctgtgtgtttccaagtggtccgatccccaggtctttgagaagagcagcgcaggcatcgatcacgccgaagagatggaacttctgcttgaaaactactatagactcgctgacgatctgagtaacgccgctagagaacttagggtgctcatagacgacagtcagtccattattttcattaatctagacagccaccgcaacgtgatgatgaggctcaacctccagctcaccatgggtacattttctttaagcctcttcggactaatgggcgtggcttttggaatgaacctggagagctccttggaagaggatcatcggatattctggctgatcaccggtatcatgttcatgggaagcggtttgatatggaggcggctgctcagtttcctgggacgccaattggaggcccctctgcccccaatggtgtag

SEQ ID NO: 51862 - DNA, 1332 bp, Artificial Sequence
  Description of Artificial Sequence: Synthetic coding sequence
atggagtgcctgcgttcccttccttgccttctgccacgtgccatgaggctccctcgcagaaccctgtgtgcactagccttagacgtcacctccgtgggtccacccgtagctgcctgcggccgaagggcaaatctcataggtcggagccgtgcggcacagctgtgcgggcctgacagactgagggtcgccggagaggttcatcgatttcggacgtccgacgtttcccaagctacactcgctagtgtggctccagtatttaccgtcactaaatttgacaaacagggtaatgtcacaagcttcgaacggaagaaaacagagctgtatcaggagctgggcctccaggccagagacctgagattccagcatgtgatgtcgatcactgtcagaaacaaccggattatcatgcgaatggaataccttaaggcagtgatcacaccggaatgcctgcttattcttgattatagaaacctgaatttggaacagtggctgttcagagagttgcccagccagctctcaggcgaaggccagctggtgacctacccactgccgttcgagttcagggcaatagaagccctactgcagtattggatcaacactctacaagggaaactttctatacttcagcctctgatcctggaaaccttggacgccctggtggacccaaagcatagcagcgtagaccgctccaagcttcacatcctgctgcagaacgggaaatcgctgagcgaactcgagactgatattaaaatttttaaagagtccatcttggaaattctcgacgaggaggaactgctcgaggaattgtgtgtcagcaaatggtccgatccccaggtgttcgaaaaatcatcggccggaattgaccacgcggaagaaatggagttgctcttagagaactactatcgacttgctgatgatctttctaacgccgcacgggaactaagggtgttgatcgacgactctcagagcatcattttcattaatctcgactctcacaggaacgttatgatgcggctgaacctgcagctcacaatggggacgttcagtttgtcgctcttcggactgatgggcgtggcatttggtatgaacctcgagagctctctggaggaggaccaccgaatcttctggctgatcaccggaattatgttcatgggaagcggactgatctggaggagacttttgagctttctaggcagacagcttgaggcccctctacccccaatgatggccagcctacccaagaagactctattagccgatcgatccatggagctcaaaaactcacttcggctcgatggtctcgggagcgggaggtcaattctcacgaatcggtag

SEQ ID NO: 51863 - DNA, 1341 bp, Artificial Sequence
  Description of Artificial Sequence: Synthetic coding sequence
atggagtgtttaaggtctctgccttgtctgcttcccagagccatgcggctccccaggcgcacgctctgcgcccttgctctggacgtcacctctgtcggaccaccggtggccgcttgcgggagacgggctaatctaatcggtaggagccgagccgctcagctctgtggacctgataggctgagggtcgccggagaagtgcatcgttttcgcacatccgatgtttcacaagccaccctggcatctgtggcccctgtgtttacagtgacaaagtttgacaaacagggtaacgtaacctcgtttgagcgcaagaaaaccgagttataccaagaattagggttacaggccagagacctgcggttccagcatgtgatgtctataacggtacgtaacaatcgtattattatgcggatggaaaaatactctttactcctggagtcagtcgctagcattctccagaacagcgtgtctttcatggagagacagacagagcagtggctgttccgcgaacttcctagtcaactctctggagaaggccagttagtcacctatcctcttcctttcgagttccgggcaattgaggcgctgctgcagtattggatcaacacattacagggaaaattaagtatcttacagcccctgattttggaaactctcgacgctctggtcgatcccaagcactctagcgtcgatcggagtaagctgcatattctgctgcagaacggcaagtccttgtctgagcttgaaaccgacattaagattttcaaggagtccatcctggaaatattggacgaggaggaactgctcgaggagttgtgcgtttctaagtggagtgatcctcaggtcttcgagaaatcaagcgccggaattgaccacgccgaagagatggagctgctgctcgagaactattatagattggctgacgatctgtccaacgctgcccgagaactgagagttctcatcgatgacagccagtccattatcttcattaacttggatagccacagaaacgtcatgatgagactgaatcttcagctgaccatgggtacattctcactcagtctatttggactgatgggcgtcgcctttggaatgaatctggagagctcactggaggaagaccaccggattttttggttgatcacgggcattatgtttatgggatcagggttgatttggaggcgtttactcagtttccttggtcggcagctggaggcgcctcttccgcctatgatggcttcactccccaagaaaacccttctcgcagaccgcagtatggaattaaagaacagccttcggctggacgggctgggatctgggagatcaattcttacaaatcgctag

SEQ ID NO: 51864 - DNA, 549 bp, Artificial Sequence
  Description of Artificial Sequence: Synthetic coding sequence
tgaagggccgcacagctgtgtggcccagatcgacttagggtcgcaggcgaggttcatcggtttcgtacgagcgacgtttcccaggccacattggcttccgtggccccagtgtttaccgttaccaagtttgataaacaaggcaatgttactagctttgagaggaagaaaactgagctgtatcaagaactggaaaccgacattaagatctttaaggaaagcatcctcgaaatcctggacgaagaggaactactggaagagctttgcgtctccaaatggtcagatccgcaagtgtttgaaaaatcatccgctggcatagaccatgccgaagagatggagctgcttctggagaactactaccgcctggccgatgacctgtctaatgcagccagggaactccgggtgctgatcgacgactctcaaagcatcatcttcatcaatctcgattctcacaggaatgtaatgatgagattgaatctccagctgaccatggggaccttcagtctgtccctttttggcctgatgggggtggcatttggcatgaatctttag

SEQ ID NO: 51865 - DNA, 1182 bp, Artificial Sequence
  Description of Artificial Sequence: Synthetic coding sequence
atggaatgcctccgctcgttaccttgcctgctgcccagagccatgcgtctgccaaggagaacactgtgtgccctcgcccttgatgtgaccagcgtcggcccaccagtggccgcatgcgggaggcgggctaatttgattggacggtctcgagctgcacagttatgcggccctgatagactgcgggttgctggcgaagtgcatcgtttccggacctccgacgtgagtcaggctactctcgccagcgtagcgcctgtcttcaccgtctatttgaaggcggtaattactcccgagtgcctcctgatcttggattaccgtaatctgaatctggagcaatggttgtttcgcgaactcccctctcagctaagtggcgagggccaactcgtgacttaccctctacctttcgaattccgggctattgaagccctgctgcagtattggattaacaccctgcagggcaagttatccattttgcagcccttaatcctggagacattagatgctctcgtggaccctaagcacagctccgttgacaggagtaagttgcacatcttgctgcaaaatggaaagtcattaagcgaacttgagactgatatcaagatcttcaaggagagcatcctggagattctcgatgaagaggaactgcttgaagagctctgcgtgtcaaaatggagcgacccccaggtatttgagaaaagttctgcgggaatcgaccacgccgaggagatggaactccttctggagaactactatcgcctagcagatgatctgtctaacgcagccagggagctgcgggtgctgatcgacgactctcagtcaatcatctttattaacctagatagtcaccgaaatgtgatgatgcgtctgaatctgcagttgaccatggggacttttagcctgagcctctttggtctgatgggcgtggcttttggcatgaatcttgagtcgagcctggaagaagatcatcgcattttttggttaatcaccgggattatgtttatgggatctggcttgatctggcgcaggctcctgtccttcctcggtagacagttagaggccccactgccaccaatgatggccagcttgccaaagaaaacccttctggccgataggtccatggaacttaaaaactcattgcgattggacgggctgggctccggtcgcagcatcctgacaaacaggtag

SEQ ID NO: 51866 - DNA, 459 bp, Artificial Sequence
  Description of Artificial Sequence: Synthetic coding sequence
atggaacttctcctggagaattattaccgactggctgacgatctctccaacgccgctagggagctgcgcgtgctgatcgatgactcgcagtctataatattcattaatctggacagtcacaggaacgtgatgatgcggctgaacctacagctcactatggggactttctccttgtctcttttcggtctgatgggggttgcttttggaatgaatcttgagagtagcctggaggaggaccataggatcttttggctgattactgggatcatgttcatgggaagtggcctgatctggcgcagactcctaagcttcctgggtcgacagttagaagctccgctgccacctatgatggcctcacttcccaagaaaacattgcttgccgaccgatccatggagcttaagaatagcctgcggctcgatggtctgggctctggtcggtccatcctaacgaaccgctag

SEQ ID NO: 51867 - DNA, 1254 bp, Artificial Sequence
  Description of Artificial Sequence: Synthetic coding sequence
atggctttatccgctcagcaaatcccccgttggttcaacagtgtgaagctcaggagcctcattaatgcggctcaactgaccaagagatttacgaggcctgcacgcacactactgcacggattctcagcgcagcctcagatatcctctgacaactgcttcctccaatggggctttaagacatatcgcacatccagcctgtggaactccagtcagagtacaagcagcagttcccaggagaataattctgctcagtcttcgttgctgcccagtatgaacgagcagagtcagaagacccaaaatatatcctcattcgattcggaactgtttctcgaggagctggacgagctcccaccactgtcgcccatgcaacccataagcgaggaagaggctattcagatcattgcagatccacccttgccccctgcatcctttaccctcagggactacgttgatcactcagaaacgttacaaaaactggtgctcttgggcgtggatctctccaagatagaaaagcacccagaggcggcaaatttgctgctacggctagactttgaaaaggatatcaagcagatgttgctttttctgaaagacgtgggcatcgaggacaatcagttgggagctttcctgacaaaaaaccacgctattttcagtgaggatctggaaaacttaaaaactcgcgtcgcctacttacactccaaaaacttctctaaggctgacgtcgcccagatggtgagaaaagcaccatttctcctgaatttcagcgtcgaacgcctggataataggctgggattcttccagaaagagcttgagctatcagtcaaaaaaacccgtgatctggtagtccggctgccgcgactgcttaccgggtctctggagcctgtgaaagagaatatgaaggtttatcgcctggaacttggatttaaacacaatgagatccagcacatgatcacacgaatcccaaaaatgcttacagctaacaaaatgaaactgaccgaaaccttcgacttcgtccacaatgtgatgtcaatcccccaccatatcatcgtaaaattcccccaagtattcaatacccgattattcaaggtcaaagagcgccatttgtttctgacctacctcggcagggctcaatatgaccccgcaaagccaaactatatcagcctggataagcttgtttctatcccggatgagattttttgtgaagagattgcaaaagccagcgtgcaagacttcgagaagtttttaaagacattgtag

SEQ ID NO: 51868 - DNA, 1158 bp, Artificial Sequence
  Description of Artificial Sequence: Synthetic coding sequence
atgctgtggaaacttctgctccggtcccagtcgtgcaggttatgtagtttccgaaaaatgaggtctcctccgaagtaccggccatttttagcttgtttcacttatacaactgataagcagtccagtaaggaaaatactcgtacggtcgagaagttgtacaaatgttcagtggacatcagaaaaattcgtcggctgaagggctgggtgctgctggaagacgagacatacgtggaggagattgctaacatcctgcaggagctcggggcagacgaaacagcagtggcatccatcctggagcgttgcccagaagctattgtgtgctcacccacagccgttaacacccaaagaaagctgtggcagctcgtgtgtaagaatgaagaagagttgatcaagttgatcgagcagtttccagagtccttcttcacaattaaagatcaggaaaatcagaaactgaacgtgcaattcttccaggaattggggctgaaaaatgttgtgatctctcgactactgacagccgcaccaaatgtttttcataacccagtggagaaaaacaagcaaatggtacggatactccaggaaagttacctggatgttggcggatcagaggccaacatgaaggtttggctgcttaaattgctgtcgcaaaacccttttatcctgctcaacagccccacagccatcaaggagacactcgaattccttcaggagcaggggtttaccagttttgaaatcttgcagcttctgtccaagctcaaggggtttcttttccagctgtgtccaagatccattcagaacagtatcagcttctcgaagaacgcctttaaatgcaccgatcatgatcttaagcagttagttctcaagtgtccggctctactgtattattctgtgcccgtgttggaagaaaggatgcaaggactgttgcgcgagggaatttctattgcacagattcgtgaaacgcctatggtgctagagttaacgccacagatcgtgcagtaccgcataagaaaattgaattcctcgggatacaggatcaaagatggccacttggctaacctcaacggcagcaagaaggagtttgaagcgaacttcgggaagattcaggccaaaaaagtcaggccactcttcaacccagtggcccctttgaacgtggaggagtag

SEQ ID NO: 51869 - DNA, 1158 bp, Artificial Sequence
  Description of Artificial Sequence: Synthetic coding sequence
atgctctggaaattgctcttacgttctcagtcgtgcagactctgctcttttcgcaaaatgcgcagtcctccgaaatatagacccttccttgcttgtttcacgtacaccaccgataagcaaagtagtaaggaaaacacacgaacggtggaaaagctctacaagtgctctgttgacattagaaagattaggagactcaagggctgggttctcctggaagatgagacttacgtggaggagatcgcgaatatattacaggagctaggggcagacgagaccgcagtggcaagtatcctcgagaggtgccccgaagccatcgtctgcagcccaacagccgtgaacactcaacgaaaactttggcaactggtgtgcaagaacgaggaagagctgatcaagttaattgaacagttccctgagtcattcttcacaatcaaggatcaagaaaatcagaagctcaatgtccagttctttcaggaactcggacttaaaaacgtagttatcagcaggctacttacagcagctccaaatgtgtttcacaacccagtggaaaagaataagcagatggtgcgaatacttcaggagagttatctagatgttggagggagcgaggcaaacatgaaggtgtggctgctcaagctgctgtctcagaaccctttcatcttgctgaactcccccactgccattaaagagaccctcgagtttctccaagagcaaggctttacctcctttgagattctgcagctcctgtcaaagctgaaaggattcctgtttcagctgtgccctaggtctatccaaaacagcatcagcttcagtaaaaatgcttttaaatgtaccgatcacgatctcaagcaattagtgctcaagtgccctgctttactgtattactctgtgccagtacttgaggaacggatgcagggcctgctgcgggagggcatctcgatcgcacagatacgcgagacaccgatggtcctggagctgaccccccagattgtccaatacagaatccgaaagctaaacagctctggatatagaatcaaggacggacacctcgctaatttgaacggttccaaaaaagagtttgaggcaaattttggtaaaatccaagcgaaaaaggtgaggcccctgtttaatcccgtggcgcctttgaacgtggaagaatag

SEQ ID NO: 51870 - DNA, 537 bp, Artificial Sequence
  Description of Artificial Sequence: Synthetic coding sequence
atgctctggaaactgctgttacggtctcagtcctgccgtctttgcagcttccggaagatgagaagcccgcctaaatataggccattcctggcatgttttacctataccaccgataaacaatcaagtaaagagaacacaagaacagtggagaagctctacaagtgcagcgtggatatccgcaaaattagacgtctgaagggatgggtgttgctggaggatgagacctacgtagaagagattgcaaatattctccaggaactgggcgcagatgagaccgcagttgccagtatactggaaagatgccccgaggctatcgtatgctcccccactgccgtgaacacccagcgcaagctgtggcaactggtctgcaagaacgaggaggaactcatcaaactgatcgaacagtttccggagtcattcttcacgattaaggatcaggagaaccaaaagctcaatgtccagttctttcaggaacttgggctgaaaaatgtcgtgatttccagactcctgaccgctgcccctaacgtctttcactag

SEQ ID NO: 51871 - DNA, 102 bp, Artificial Sequence
  Description of Artificial Sequence: Synthetic coding sequence
atgctgtggaaactactgctgagaagtcagagctgccggctctgctccttccggaaaatgagaagccccccaaaatatcgccctttcttggcttgcttttag

SEQ ID NO: 51872 - DNA, 261 bp, Artificial Sequence
  Description of Artificial Sequence: Synthetic coding sequence
atgctctggaagttactcttgcgctcacagagttgccggctgtgtagctttagaaaaatgcggtcacctccgaagtatagacctttccttgcatgtttcacctataccactgacaagcaaagttccaaggaaaacacaagaacagtggaaaaactttataaatgtagtgttgatattagaaagatccgcaggttgaaagggtgggtgctgttggaggacgagacttacgtcgaggaaatcgcaaatattttacaggagtag

SEQ ID NO: 51873 - DNA, 1158 bp, Artificial Sequence
  Description of Artificial Sequence: Synthetic coding sequence
atgctttggaaacttctgctgcgctcccagtcgtgtcggctctgttcctttagaaagatgaggtcaccccctaagtacaggccattccttgcatgtttcacatacacaacagacaaacagtcttccaaggagaacacaagaactgtcgagaaactttacaaatgttctgtggacatacgcaagatccgaaggttaaaagggtgggtgctccttgaagatgagacttatgtggaggagatagcgaacatcctgcaggaactgggtgccgatgagacggccgtggcttcgattcttgagcgttgtccagaagcaattgtttgctccccaactgctgtgaacacccagagaaaactatggcaactggtgtgtaagaacgaagaggagttaattaagctcattgaacagtttcctgaatccttctttactatcaaggatcaggaaaaccagaaattaaatgtgcagttcttccaggagcttgggttaaagaatgtggtaatcagccgcttattaacagctgcaccaaacgtattccacaaccccgtagaaaaaaacaagcaaatggtaagaatcttgcaggagtcctacctagatgtaggcggatcggaggcaaacatgaaggtgtggcttctaaagttgttgtcacagaatccgtttatcctactcaattctcctaccgccataaaggaaaccctggagtttctgcaggaacagggattcacgtcattcgagatcctgcagctgctgtctaagctgaagggatttctgttccagctgtgtccacgaagcattcagaacagcattagtttctccaagaacgcctttaagtgcaccgatcatgatcttaagcagctggtcctgaagtgccccgctttgctgtactattcagtgcccgtgctggaggaacggatgcagggactgttgcgggagggcatctcgattgcacaaatccgagaaacccccatggtgctcgagttgacaccccagatcgtccagtatcgtattagaaagctgaattcatctggatacagaattaaggatggacatctggccaatttaaacggtagtaaaaaggagtttgaagctaacttcgggaagattcaggccaagaaggtgcgtccactgtttaatcctgttgccccattaaacgttgaagaatag

SEQ ID NO: 51874 - DNA, 1701 bp, Artificial Sequence
  Description of Artificial Sequence: Synthetic coding sequence
atgaagatgcagaaaggaaatgtgctcctgatgttcggactgctgctccacctcgaggccgctaccaacagtaatgagacctctacgagcgccaataccggatcctcagtcatttcctccggcgcatctaccgctaccaattcgggaagctctgtgaccagctcaggggtttcaacagcaacaatttctggaagttcagtgacgtccaacggagtctcgattgtgactaactcagagtttcacaccacatcgtcaggaattagcacagctactaactcggaattttccaccgtgtcatccggtatctcaattgccactaactcagagtcctccacaacgtcgagtggggcatctacagctaccaactctgagtcttccaccccttccagcggcgcttccaccgccacaaattccgattccagtactacatcctcaggtgctagcacagcgacaaacagcgatagtagtacgacaagtagcgaggctagtaccgctactaacagcgagtcatctacaaccagctccggtgccagtaccgcaaccaactctgaatcgtcaaccgtgagcagtcgggcaagcactgcaaccaatagcgagtcttcaactactagcagtggggcttcaaccgctaccaatagcgaatctagaaccacatcaaacggcgcagggaccgcaacaaattccgagagttctaccaccagctcaggggcttctactgctacaaacagtgagagcagcaccccttccagcggtgctggtacagcgaccaactccgaaagcagtactacgtctagtggcgctggtacagccaccaattctgagtcgagtactgtatcttcgggaattagtacggtcacgaacagcgagtctagcacaccgagctcaggggcaaataccgccacaaattcagaaagcagcaccacatccagcggggctaacaccgctacaaattccgatagtagcacaaccagtagcggggcttccacagccacgaacagcgaaagttccacgacgagctctggtgctagcacagccacaaatagcgaatccagcaccaccagttcgggggcttccacagcaactaattccggctcaagcacaacaagttccgggaccagcacagccaccaactcagagtcctccactgtctcaagcggcgcaagcactgcaaccacctcagaatcaagcaccacatcaagcggcgcttcaaccgccactaactccgagagttcaaccgtgtctagcggggcttcgactgcaacgaactctgagtccagcactaccagcagcggagccaatacagctactaactccggtagttctgtgaccagtgctggctccggtacagccgctttgaccggtatgcacactacatctcacagcgcctccaccgctgttagtgaggctaagcctggcggttctttggtcccatgggagattttccttattactctggtgtcagtagtcgcagcagttggactgtttgcaggactgtttttctgcgtgcgcaactccctgagccttcgcaacacatttaataccgctgtttaccaccctcatggactgaatcatgggctaggaccaggcccagggggaaatcatggcgcaccccatcgacctagatggtctccaaattggttttggcgccgtcccgtgagctcgatcgcaatggagatgtccggtcggaactcaggcccttag

SEQ ID NO: 51875 - DNA, 1251 bp, Artificial Sequence
  Description of Artificial Sequence: Synthetic coding sequence
atgaaaatgcagaagggcaatgtcctgctgatgttcggacttttactacatctcgaggccgctacaaacagtaacgaaaccagcacgagcgccaacaccggctcttcagtgatatctagtggggcatctacagccacaaactccgggtctagtgtaacctccagcggcgtgagtactgccacaatcagcggaagctcggtaacctccaatggcgtatccatcgtgactaatagtgaattccataccacttctagcgggatctccactgccaccaactcagagttctccacggtttcatctggcatatccatagcgactaattcagaatcgagcaccacgagcagcggagccagtacggccaccaatagtgaatccagtactccatcttcaggtgccagtaccgccacaaacagcgactcttcaaccaccagttcaggggcaagtacggcgacaaactctgattctagtaccacttcctccgaagcttcaactgccaccaatagcgaatcatctactactagttccggtgcaagtacagctacgaacagtgagtcatcgactacctccagtggtgctagcactgcaaccaactcagagagtagcactacctcatctggcgcaagcacggccactaacagcggaagcagtaccacctccagcggaactagcactgccacaaactctgaaagtagtacggtgagctcaggcgcaagtactgccactacaagcgaatcatcgaccacctcctcaggcgcttctacagccaccaacagcgagtcgagtaccgtgagcagcggcgcatccaccgcaaccaacagcgagtctagtaccacatcctcaggcgctaataccgcaacgaacagcggctcctcagtgaccagcgcgggatcaggcacagcagctctgacaggtatgcacaccacatcccactcagcaagcactgccgtgagcgaagccaagcccggtggttctctggtgccctgggagattttcctcataaccctggtgagtgtggtggcagccgtgggactgttcgctgggttgttcttctgcgtgagaaattccctgagccttcgaaatacgtttaatacggccgtgtaccatccacatggcctaaatcacgggctgggtcccggacctggaggtaaccacggcgctccgcaccggcctcgatggtcccctaattggttctggcgcaggcctgtgagtagtatcgcaatggaaatgtccggacgcaactcgggcccttag

SEQ ID NO: 51876 - DNA, 483 bp, Artificial Sequence
  Description of Artificial Sequence: Synthetic coding sequence
atgaccctggaggagctggtggcctgtgataacgccgcacagaagatgcagacagtcactgctgctgtggaggagctgttagtggcagctcagaggcaggaccggcttacagttggcgtgtacgagtcagcaaagctcatgaacgttgatcccgacagcgtggtcctctgcctcttggccattgatgaggaggaagaagatgatatcgctctccagatccacttcacgcttatacaaagtttttgctgtgacaacgatatcaatatagttagagtctccgggatgcagcggctggcccaattactcggcgagcctgcagagactcaagggaccactgaggctagagacctgcactgtcttctcgtgactaatccccacacggatgcatggaaatctcatggattggtagaagtagcttcatattgtgaagaaagcaggggaaataatcagtgggtcccttatatcagcctccaggaacggtag

SEQ ID NO: 51877 - DNA, 888 bp, Artificial Sequence
  Description of Artificial Sequence: Synthetic coding sequence
atggattttgggcttgccctgcttctggcaggcttgctcggcctcctactggggcagtcactgcaggtgaagccactccaagttgaaccacccgagcctgtggtcgctgtggcacttggcgcaagtaggcagctgacgtgcaggctggcttgcgccgatagaggggcatctgttcagtggcgcggactggacactagcctgggggcagtgcagtcagacacaggcaggagcgtccttacagtacgcaatgccagcctgagcgccgctgggactcgagtgtgcgtgggatcttgtggtggcagaacttttcagcataccgtacaactcctagtatatgccttcccggaccaactaacggtgagtcctgcagccctcgtgccaggtgaccctgaagtagcctgcaccgcacacaaagttaccccagttgacccaaatgccttatcattttccctgctggtaggcggacaggagctagaaggcgctcaggcgctgggtcccgaagtgcaggaagaggaagaagaacctcagggggatgaggatgtactgtttcgagtgactgagcggtggaggttgcctcctctgggcaccccagtgcctcccgcactttactgccaggctaccatgcgcctacctggactggagctctctcacaggcaggctattcctgccagcaagccggcaggcgatcaactgccagctgcgctttggacatcctccgcagtactggggttgctcttgttggccctgcccacctatcacctatggaagcgctgcaggcatctcgccgaagacgacacccacccaccagcctccctccggctactgccccaggtctcagcatgggcaggcctgcgtggcacaggtcaggtggggatctcacctagctag

SEQ ID NO: 51878 - DNA, 603 bp, Artificial Sequence
  Description of Artificial Sequence: Synthetic coding sequence
atggactttggactcgccctgctgctcgccggtctgttgggccttctcctcgccttcccagaccagctgacagtctccccagctgctttagtgccaggcgatcccgaagtcgcatgtactgcgcataaggtaacaccagttgaccctaatgcgttgtccttcagcctgctcgtcggaggacaggagttagagggcgcacaggccctaggacccgaggtccaggaagaggaagaggagccccagggggatgaggacgtgctattccgcgttactgagcgctggcggttaccaccactgggcacacccgtgcctcccgctctgtactgccaggcaaccatgaggcttcctggcttagagctatcccaccgccaggcgatacctgcctcaaagcctgccggtgaccagctcccagctgctctgtggacttcctctgcagtgctcggactgctcctgctcgctctccctacttaccatctgtggaagcgctgtcgtcatctcgcagaagatgacactcaccctcctgcgtcgctgaggctactgccccaggtaagcgcttgggccggactccgtggaacaggacaggtcggcatttcaccttcatag

SEQ ID NO: 51879 - DNA, 1221 bp, Artificial Sequence
  Description of Artificial Sequence: Synthetic coding sequence
atggacttcggactggctctcctgctcgcgggattgctcggcttactactaggtcagagtctgcaggtgaagcccttacaggtggaaccgccagagccggtcgtggccgtcgccctgggtgcctcacggcaattgacctgccgcctcgcgtgtgccgatcgaggggcttcagttcaatggagaggcctcgacaccagcctcggagccgtccagtcggacactggccgttccgtgctcaccgtcagaaatgccagtctctccgccgcaggtactcgagtgtgcgtcgggtcatgtggtggtcgtacattccagcatactgtgcaactgctagtgtacgcatttcccgaccagctgacagtatctcctgccgctcttgtcccaggggatcctgaggttgcctgcacagcccacaaagtgacacctgtcgaccccaatgctctgtcattctctctcctcgtcggagggcaggagctggaaggcgctcaagctctgggtcccgaagtgcaagaagaagaggaggaaccacagggagacgaggatgttctttttagagtgaccgaaaggtggaggctgccccctctaggaacgcctgtgccgccagctttgtattgccaagccacaatgcgcctgcctggtttggagctgagtcatcggcaggcaattcctgctttacacgccctgtctaatcctgaagcacccgcagctgagtcccctcaggccccatctttgtcaactccagcctcctcccaccccacaagtcctgagccgcctgatacaacgtcaccagagtctcccgacactacctctcccgaaagccccgacaccactagccaggagccccctgacacaacaagccctgagcctccggataaaaccagccccgaacctgccccacagcaaggtagcacacacacccccaggtcccctggatctactcggacacgccgtccagagatctcccaagccggaccaacacagggggaagtcatccccaccggttctagtaagcctgcaggcgaccagcttccagccgcactgtggacctcgtccgcagtactgggtctgctattgctggcccttccaacttaccatctgtggaagcggtgtaggcaccttgccgaggacgacacacacccccctgccagccttcgtctactccctcaggtctccgcctgggccggtctgcgagggactggacaggttggcatcagccctagctag

SEQ ID NO: 51880 - DNA, 1197 bp, Artificial Sequence
  Description of Artificial Sequence: Synthetic coding sequence
atggactttggactggcgctgctgctggccggactcctgggactccttctgggccaatcacttcaagtcaaacccctgcaggtcgagcctcctgaacccgtggttgcagtcgccctgggagctagccgtcagctgacctgtagactggcgtgcgcagaccgcggtgccagtgtgcaatggaggggtttagacacatctctgggtgcagttcagtctgatacaggacgcagtgtgctgacggtcaggaacgctagcctcagtgcagccggtactcgggtgtgcgtcgggtcttgcggcggaaggacattccagcacaccgtacaactcctggtctacgccttccccgaccaactgaccgtctccccagcagcccttgtgcccggtgatcccgaggtggcctgcacggcacacaaagtgacccctgtggatccaaacgcactatctttcagcctattggtgggcggacaggaactcgaaggagcgcaagcactgggtcccgaggtacaggaggaagaagaggagcctcagggcgatgaagacgtcctatttagggtgacagagcggtggcgcctgcccccacttgggactcccgttccccctgcactgtattgtcaggccactatgcgtcttccaggattggagctgagtcatagacaggccattccagccctccacggttggctgagcccaccaccgcctcaaaataccgggccacatggaccgcacccaacctctcctgaacccccagataccacttcccccgagagccctgatactacaagccccgagtctccggataccacgagtcaggaaccgccagatactacctcaccggagccaccggataagacgtctcctgagcccgctccccaacaaggctcgacacatacaccccgtagtccaggatcaactcgcacaaggaggccagaaatcagccaggcgggtccaacccagggcgaagtaatccctacaggctcctccaaacctgccggagaccaactcccagcagccctctggactagcagcgccgtccttggattattactgctggctctcccgacttatcatctctggaagaggtgtcgccacttagcggaggatgacacccatccccctgcaagcctgcgccttctaccacaggtgagtgcgtgggcgggattgcgcggaactggtcaagtaggaatcagcccatcttag

SEQ ID NO: 51881 - DNA, 1173 bp, Artificial Sequence
  Description of Artificial Sequence: Synthetic coding sequence
atggactttggactggcactcctgctcgctggactactcggactgctcctgggccagtcattgcaggtgaaaccactgcaggtggagccacccgagcctgtcgtagctgtggcactcggcgcttccaggcagctcacatgtcgcctggcttgtgctgatagaggtgcgagtgtccagtggcggggactggacaccagcctgggtgccgtgcagagcgataccggcagaagtgtactgacagtacgcaacgcaagcctcagtgctgccggtaccagggtttgcgtcggctcgtgtggagggcgtaccttccagcacaccgtgcaattattggtgtacgcttttcccgatcagctgactgtaagccctgctgccctggtgcccggagacccggaagtggcctgcaccgctcataaggtcacccccgttgaccccaacgcactgtctttttcattgctagtgggcggtcaagagttggaaggcgctcaggctctgggcccagaggtgcaggaggaggaagaggagccacagggagacgaagacgtcctgtttcgcgtgactgagcgctggcggctgccacccctgggaacccctgtgccccctgctttatactgtcaagccaccatgaggctcccaggacttgaactctcacataggcaggccattcccgctctgcacgctctgagtaacccagaggcccctgctcccacctcacccgagccccctgacacaacaagccccgagtctcccgatactacctctcctgagagtcctgatacgaccagccaggaacccccagatacaacctctccagagccccctgacaagacaagccccgaacccgcaccccagcagggaagtacccacacaccaagatctcctggcagtaccagaacacgcaggccggaaatctcacaggcagggccaacccagggcgaagtaattccaaccgggtcgagtaaacctgcaggagatcaactgcccgctgctctttggacttccagcgccgtcctcggtctgctgcttctggctctgcctacttatcacctctggaagcgctgtcggcaccttgcagaggatgatacccatccccctgcatctttgagactgctgccccaggtctctgcttgggccggactgcgcggaacaggacaggtaggtatctccccatcgtag

SEQ ID NO: 51882 - DNA, 921 bp, Artificial Sequence
  Description of Artificial Sequence: Synthetic coding sequence
atgggcattcttgatatcgaggtctggggcaaagacaataaaaaacatgaggagcgcctcgggacctgcaaggtcgatatctcagcactgcccctgaaacaagctaattgcctggaactgccactcgactcatgtctgggggcactgttgatgctggtcactctgacaccatgtgctggcgtttcagtcagtgacttgtgcgtatgcccccttgcggatttgtctgagcgaaagcagatcactcagaggtactgcttgcagaatagtctcaaagacgtgaaggacgtgggaattttacaggtcaaagtgctgaaggcggctgacctcctcgccgcagatttctccggaaagtcagaccctttttgcctgctggagttggggaacgatcgcctgcagacacacaccgtttataaaaatttgaatcctgagtggaataaagtgtttacatttccgatcaaggacattcatgacgttttggaagtcaccgtattcgatgaggatggagataagccacctgacttccttgggaaggtagccatccccctgctctccattcgcgacgggcagccaaattgttacgttctcaagaacaaggacctggaacaggccttcaagggcgtcatctatcttgagatggatctgatctataatccagttaaagcctcaataaggaccttcacccctagagaaaaacggtttgttgaagatagccgaaagttatccaaaaagattctttcgcgagacgtcgatcgcgtcaaaaggatcacaatggcaatctggaataccatgcagttcttgaaaagctgtttccaatgggagtctacactgaggtctacaattgcatttgcccatcgaaaagaggaaccaccactgtccatgaaatgcacacttttctctggagacatcggtccatccttgtag

SEQ ID NO: 51883 - DNA, 2337 bp, Artificial Sequence
  Description of Artificial Sequence: Synthetic coding sequence
atgctcgatagttgtaagctgaaaagtgcctgcaacttaccttttatctgtaataaaaagattattaataccgctgggaccagtaacgccgaagtgccgctggccgacccaggtatgtaccagctagacatcactctgaggaggggtcagagcctggccgcacgggacaggggtggcacttccgacccatacgtgaagttcaaaatcgggggaaaggaagtgttccggagcaagattattcacaaaaacttgaacccagtgtgggaggagaaggcctgcatcctcgttgatcacctgcgcgagcccctctatatcaaagtttttgactatgatttcggattacaggacgacttcatgggctcagccttcctggacctcacacagctggagctgaatagaccaaccgatgtgacccttactctaaaagatccacactatcctgatcatgacctaggtatcattttgctgagtgtgattctcactcctaaggaaggagagtctcgagatgtgacgatgctcatgcgcaagagctggaagcggagttctaaagagctgtctgagaacgaagtggtgggaagctacttctctgtcaagagtctgttttggcggacttgtggtcgacccgctctgcctgttctgggtttctgtcgcgctgagctgcaaaacccttattgcaagaacgtgcagttccagacacagtctttacgcctgtctgacttgcaccggaaaagtcacctctggcgaggaatagtttctatcacgcttatcgaaggtcgggatctcaaggctatggattctaacggactgagcgatccttatgtgaaattcaggctcggccatcaaaaatacaaatccaaaataatgcccaagactctgaacccgcagtggcgtgagcagtttgattttcatttgtatgaggagcggggaggcgtcatagatattactgcatgggataaggatgccggaaaacgtgatgactttatcggtagatgccaagtggatctgagcgccctgtcccgcgagcagacccataagctggaattgcagctggaggaaggcgagggccacctggtgctcctggtgactcttactgctagtgctactgtgagtataagcgatctctccgtgaacagcctggaggatcaaaaagagcgggaggaaatcttgaagcggtattccccccttagaatcttccataatctaaaggatgtggggttcctgcaggtcaaagttatcagagcagaaggattgatggctgccgacgttacgggcaaaagcgaccctttttgtgttgtggaactcaataacgatcgtcttcttacacacacggtttacaagaatcttaatccggagtggaacaaagtatttacttttaacataaaagacatccactctgtgttggaggttaccgtgtatgacgaggacagggaccgctccgccgatttcctagggaaggtcgcaatcccattactctcgatccaaaacggagagcagaaggcctatgtgctgaagaacaagcaattaacagggccaaccaaaggtgtgatttatctggaaattgacgtaatttttaatgctgttaaagctagtcttaggaccctgattccaaaggaacagaaatatattgaggaggaaaaccggctctccaaacagctcctcctgaggaactttattcgtatgaagcgatgcgtaatggttttagttaatgccgcttactacgtgaattcttgtttcgattgggactccccaccgagaagtctggcagccttcgtgctattcctgttcgtggtgtggaacttcgaattgtatatgatcccgcttgtcctgctgctgctactgacgtggaattatttcctgatcatttccgggaaagataatagacaacgcgatacagtggtagaagatatgctcgaggatgaggaagaagaagacgataaagatgataaggattcagaaaagaaaggctttataaacaagatctatgctattcaggaggtgtgcgtaagtgttcagaatatccttgatgaggtggcttcattcggggaacgcattaagaacacctttaactggactgtgccctttttgagctggctggcaatcgtagcactttgcgtgtttacagccatcctgtactgtatccccctgagatatattgtattagtttggggtatcaataaattcaccaaaaaattgaggagcccttacgccattgacaacaatgaattgctcgatttcctctctagagtccctagcgacgtccaagtggtgcagtatcaggagctgaaacccgaccccagtcactccccatataagcgaaaaaaaaataaccttggatag

SEQ ID NO: 51884 - DNA, 738 bp, Artificial Sequence
  Description of Artificial Sequence: Synthetic coding sequence
atgtatcagcttgacattaccctgagaagagggcagagcctcgcggctagagatcgcggtggcacgagcgatccttatgtgaagttcaagatcggcggaaaagaggtgttccgttctaagatcatccataaaaatctgaacccagtatgggaagagaaggcatgcatactcgtggaccacttgcgggagcccctgtacatcaaagtgttcgactacgactttggcctgcaggatgattttatgggtagcgcattcctggatctaacccagctggaactgaatagacctactgatgtcacactgacattgaaagatccacactacccagaccacgatctgggaattattttgctttccgtgatcctcacccccaaagaaggcgagagccgtgacgtgacaatgctcatgcggaagtcatggaagagatcttccaagttccaaacccagagtttgcgtttgtcagacctacataggaaatcacacctttggaggggcatcgtgtcgatcacattaatagagggcagggatttgaaggccatggattctaatggactgtccgacccttacgtaaaatttcggttaggacatcagaagtacaagagtaaaattatgccaaagactttgaacccgcagtggagggagcagttcgactttcacctgtatgaagagcgatgtggcatttccccaggggaaagccaccagtcaggcagggtgaacggatgtcggaggcattggtag

SEQ ID NO: 51885 - DNA, 2079 bp, Artificial Sequence
  Description of Artificial Sequence: Synthetic coding sequence
atgctcgactcctgcaaactgaagtccgcatgtaacctgcctttcatttgtaacaagaagatcatcaataccgctggaaccagcaacgccgaggtgcccctcgccgacccaggtatgtaccaactcgatattactttaagacgcggtcagagccttgccgcacgcgatcgaggaggaacgtctgacccatatgtgaaatttaaaattggtgggaaggaggtgttccgctcgaagataatccataagaatttgaaccccgtatgggaagagaaggcctgcattctcgtcgatcacctcagggagcccctttatatcaaagtgttcgactacgatttcgggcttcaggacgatttcatgggtagcgcctttctcgaccttacacagttggagctcaacaggccaactgacgtgacgctgactctgaaagacccccactacccagaccatgacctgggcattattcttctgagcgttatcctgaccccaaaggaaggcgagtcccgcgacgtaactatgctcatgagaaagagctggaagcgatctagtaaatttcaaactcagagccttcgtctgagtgatctgcataggaaaagtcacctgtggagggggattgtttctattaccctcatcgagggacgtgacttaaaggccatggacagcaacggtctttccgacccctatgtgaaattccgattaggccaccagaaatataaatcaaaaattatgcccaagaccctgaatccgcagtggcgcgaacagttcgactttcatctatacgaggagcggggaggcgtgatcgacattaccgcctgggacaaggacgccggaaagcgggacgattttattgggaggtgtcaggtagacctgtctgctctgtcacgagagcagacacataagttagaacttcagttggaggaaggcgaggggcatttggtgctcctggtgactctgactgcaagtgctaccgtcagtatttccgacctatctgtgaattccctggaagatcagaaagaaagggaggaaatactaaagagatactcaccccttaggatcttccacaacctgaaagatgttggattcctccaggtaaaagtcattagagcggagggcttgatggctgccgacgtcaccggaaagagtgacccattttgtgtggtggaactcaataacgaccgcctcctaacccatacagtctataagaatctgaacccagagtggaacaaagtgttcacattcaatatcaaggacatacattccgtgcttgaggtgactgtctatgatgaagatagggatcggtccgccgattttcttgggaaagtggccatccctttactgagtatccagaacggcgagcagaaagcatacgtgttgaaaaataagcaactgactgggccaaccaaaggcgtgatctatcttgaaattgacgtgatattcaacgcggtcaaggcttcccttcgcacgctgatccccaaggagcagaagtatattgaggaagaaaacagactgagtaaacagcttctactacgaaatttcattagaatgaagcgttgcgttatggtgctggtcaatgcagcttactacgtgaatagctgcttcgattgggactccccacccagatctctggcagcattcgtagtggtagaagatatgctggaagatgaggaggaggaggacgacaaggatgataaggatagcgagaagaaaggattcataaacaagatctatgcgatccaggaagtatgcgtctcagtgcagaatatattggacgaagttgcatcttttggagagagaatcaagaacactttcaattggacagtcccctttctgtcttggctggccatagtggcattatgcgtgttcaccgccatcctgtattgtatcccactgcgttacatcgtacttgtgtggggtatcaataaatttacaaagaaactgcgcagcccgtacgccatcgataacaatgagctgctcgacttcctgagccgtgtaccgagtgatgtccaggtggttcagtatcaagagctcaagccagatccctctcacagcccttacaaaaggaaaaaaaataatctcggttag

SEQ ID NO: 51886 - DNA, 1548 bp, Artificial Sequence
  Description of Artificial Sequence: Synthetic coding sequence
atggattccaacggcctgtcagacccctacgttaagttcagactgggccaccaaaagtataaaagcaaaatcatgccaaaaaccctgaacccacagtggcgggagcaatttgattttcacctgtacgaggagcgaggaggagtgattgacattaccgcttgggataaggatgccggtaaaagagacgacttcatcgggagatgccaggttgatcttagtgctctaagcagggaacaaactcacaaattggagctgcagttggaggaaggggagggacacttagtgttgctcgtgacgctgactgcatcggcgaccgtgtcgatttcagacttatctgttaactccctggaggatcaaaaggagcgggaggagatcctgaagcgttattctccactgcgaatctttcataatctgaaagatgtcggctttctgcaagttaaggtgataagggcggagggcttgatggccgctgatgtgacgggaaagtcagatccattctgcgttgtggaactaaacaacgacaggcttctgacccacaccgtttataaaaacttaaatcccgagtggaacaaagtctttaccttcaacattaaagacattcattcagtgctggaagtgaccgtatatgacgaggacagggaccgtagcgcagacttcctgggcaaggtggccatcccattgctgtctatccagaacggagagcagaaagcctacgtgttaaagaacaaacaattgactggccctacaaagggggtgatctacctcgaaatagacgtgatctttaacgcggtgaaggcgagcttacggactctgattcctaaagagcaaaagtatattgaggaggaaaataggttatcgaaacagttgttacttcgcaactttatcagaatgaagaggtgcgtaatggtgcttgtaaatgctgcttattacgtgaacagttgtttcgactgggattcacctccacggagcctggccgcttttgtacttttcttgtttgtcgtatggaatttcgaactgtacatgataccgctcgtgctgctattgctactgacctggaactactttctaatcatcagtggcaaagacaaccgtcaacgtgacacagtggttgaggatatgctggaagatgaggaagaggaagatgataaggacgataaagactctgagaagaaaggatttatcaataagatttacgccatccaggaggtgtgcgtgagcgtacagaatattctggacgaagtcgcctcttttggagagaggatcaaaaataccttcaattggacagttcctttcctcagctggcttgctattgttgctctttgcgttttcacagcgatcttatactgcattcctctgcggtacattgtgctagtatggggtatcaacaaatttaccaaaaagctgcgatccccctacgctatcgacaacaacgaactgctggacttcttgtcccgcgtgcccagcgacgtccaggtggttcaatatcaggagctgaagccggacccatcacattccccttataaaaggaagaaaaataatctcggatag

SEQ ID NO: 51887 - DNA, 1803 bp, Artificial Sequence
  Description of Artificial Sequence: Synthetic coding sequence
atgcttgattcctgcaaactgaagagtgcatgtaacctgccgttcatttgtaataaaaaaatcatcaacactgcgggtaccagcaatgcggaagtgcctctagccgacccaggcatgtatcagctggatatcacgcttaggcggggtcagagcttggccgcaagggatcgtggagggacttctgatccatacgtgaagtttaagatcggcggaaaggaagtttttcgtagcaagatcattcataaaaacctaaatccggtgtgggaagagaaagcttgcattttggttgatcatctgcgggaaccactctacattaaagtatttgattacgatttcggacttcaggatgattttatggggtcggccttcctcgatcttacacagcttgagctcaaccgacccaccgatgtaaccctcactctgaaagacccccactaccctgaccacgacctcggtattatccttctcagcgttattctcactcccaaagagggtgaatctcgggatgtgactatgctcatgcgcaaatcctggaagcgttcttcaaaagagctttcggagaacgaagtcgtaggcagctacttcagcgtgaagagcttattctggcggacttgcggcagacccgcactgcctgtcctgggtttttgccgagctgagttacaaaatccgtattgcaaaaacgttcagtttcagacgcagtctctccggctgtcggaccttcaccgtaagagtcacctctggagagggatcgtttcgatcacacttatcgaaggtcgagatcttaaagccatggacagcaatggactctcagatccatacgtgaagtttaggctgggccatcagaagtacaaaagcaaaatcatgcctaagacactgaatccccagtggcgagagcagttcgactttcatctctacgaagaacggggaggggtgatcgatattaccgcatgggataaggatgccggaaaaagggacgattttattggcagatgtcaggttgatctttcggccctcagtagagaacagacccataaactggagttgcagttagaagagggagaaggtcatttagttttgttggtcaccctcactgcttcagcaacggtcagcataagtgatctgtccgtgaatagtctagaagatcagaaagagcgcgaagaaatcctgaagcggtacagcccactgcgcatcttccacaatctgaaagatgtcggctttctgcaagtcaaagttataagagccgagggactaatggcagcagacgttactggcaaaagtgaccccttttgtgtcgtcgagctgaataatgaccgccttctcacccacaccgtgtacaagaacctgaacccagagtggaacaaggtgttcaccttcaatatcaaggatatccattccgtgcttgaagtcactgtttacgatgaagatcgtgatcgaagcgcagatttcctaggaaaggtagcaatccccctgttatcaatccagaacggcgaacagaaagcgtacgtgctgaagaacaagcaactgaccgggcctacaaagggggtgatttatctggaaatcgacgtcatattcaacgccgttaaggctagtctgcggacactgatccctaaggaacagaagtatatcgaggaagagaatcgattgtcaaaacagctgttacttcgaaatttcatccgaatgaagcgatgtgtgatggtacttgtgaacgcggcttactatgtcaactcttgtttcgactgggactccccccctagaagcttagccgcattcgtggccctctatgggacttttataaatgtttag

SEQ ID NO: 51888 - DNA, 246 bp, Artificial Sequence
  Description of Artificial Sequence: Synthetic coding sequence
atgcttgacagctgtaagctaaagtctgcatgtaacctgcccttcatatgcaacaaaaaaattatcaatacagcaggaacctccaacgcagaggttccactggcagaccccggaatgtatcagctggacattaccctgcgccgtggtcaatctttagcagctcgagatcggggtgggacatccgatccatatgtcaagttcaaaatcggaggcaaagaggtttttcggtctaagataatccactag

SEQ ID NO: 51889 - DNA, 3000 bp, Artificial Sequence
  Description of Artificial Sequence: Synthetic coding sequence
atggagcctcgcgctgcagctgccggtgagcctgagccacctgcggcttcctcaagttttcaggccagattatggaagaacttacagctgggagtcggccgaagtaaagggggtggtgggggtcgagccggtgggccagaacgcagaaccgcagacaccccttcccccagtccaccgcctccagtgggcaccggaaatgctcccgcaagagggagcggggctggtagcaggtggtccgggtttaagaaaaggaagcaggtgctggaccgggtattctcatccagccagcctaacttgtgctgcagctcgccggagcctcttgagccaggcggagccggacgcgctgaacagggatccacactgcggaggcggatccgtgagcatctcctcccagctgtgaaggggcctgcggctgcctccggagcagcagggggaacaccccctggcggacgcagtccagactctgctcctagctcctcttccgccagcagctccttgtcaagttctccacagcctccacccagaggggaccgcgctagggacgaaggagcacgtcgccaagggcctggtgcccatctctgtcatcaaaagagcagtagtttgcctgggactgcgtgccttgagcagctgttggagccaccaccacccccagccgagccagcaagaagccccgcagaatcgcgggctcctgagactggagaagagcacggttctagccagaagattatcaatactgcaggaacctccaatgcggaggtgcctctggcagatcccggaatgtaccaacttgacattactctcagaagaggccagtctcttgcagcccgagacaggggcggaacatcagacccctacgtgaaatttaagataggcggaaaggaggtattcagatccaagattattcacaagaatttgaatcctgtgtgggaggagaaagcctgcattcttgtcgatcacttaagagagcccctctacatcaaggtgttcgactatgatttcgggctccaggacgactttatgggatcagcttttctcgacttgactcagctcgagttgaacagacccactgatgtgaccctgacgctgaaagatccacactacccggaccacgacctgggtattatcctgttgagcgtgatattaactccgaaagagggtgagtccagggatgtcacgatgctcatgaggaaatcctggaaacgcagtagcaaagaactgtcagagaatgaagtagtggggtcatatttttccgtaaaatccctgttttggcgaacctgcggcaggccagccctgccggttctgggattttgtagagccgaactccagaatccatactgcaaaaacgtccagtttcagactcagtctttacgcctctccgatctgcataggaagagccacctgtggcgaggcatcgtttccatcacactgattgaaggccgagacttgaaggcaatggactccaacggactaagcgacccatatgtgaagttccgcttaggccatcaaaagtacaaatctaagattatgccaaaaaccctcaatcctcaatggcgagaacagttcgattttcatctgtatgaagagcgcggaggggtaatcgacatcacagcctgggacaaagacgccggaaagagagatgattttattggcagatgccaggtcgacctctcagccttgtcccgcgagcagacgcacaaacttgagctgcagttggaagaaggggaggggcacctggtgctcctggtgactctgacggcctcggcaaccgtgagtatctcagatctgagcgtgaactccctcgaagatcagaaagagcgtgaggaaatactcaaacgttatagtccgctgaggatcttccacaatctgaaggatgttggcttcttgcaagtgaaagtcattcgggctgaggggctgatggccgcagatgtgaccggcaaatccgacccgttctgtgttgtggagcttaacaacgatcggttgcttacgcatactgtgtacaaaaacttaaaccctgagtggaataaagtgtttaccttcaacatcaaagacattcattccgtcctggaggtgactgtctatgatgaggaccgggaccggagtgccgactttctgggaaaagtggcgatcccactgctatccatccaaaatggagaacaaaaagcatatgttcttaagaataagcagcttactggccctaccaaaggggtgatctatcttgaaatagatgtgatcttcaatgctgtgaaggcctccttacgcaccctgattcctaaagagcagaaatacatcgaagaggagaacaggctgagcaaacagcttttgttaaggaactttatccggatgaaacgctgcgtgatggtgctggtcaacgctgcatactacgttaattcctgtttcgactgggattccccccctagatcattggccgcttttgtactgtttttgtttgtggtgtggaatttcgagctgtacatgatcccactggttctgctccttcttctaacctggaactatttcctaatcattagtggaaaggacaatcgacagagggataccgtggtagaagatatgttggaggacgaggaagaggaagacgacaaggacgataaagatagcgaaaagaaggggtttattaacaagatttacgcaattcaggaggtgtgcgtgtcagttcagaatatactggacgaggttgctagcttcggcgaacgcatcaaaaatacatttaactggacggtacctttcttgtcttggttggcgatcgtggctttgtgtgtgttcacagccatcctgtattgtatacccctgagatacatcgtgcttgtgtgggggattaacaaattcactaagaagcttaggtccccgtatgcgattgataacaatgagctcctagatttcctctcaagagtaccctcggatgtccaggtggtacaataccaagagctgaagcccgatccatcccactcaccctacaagcggaagaaaaacaacctcggctag

SEQ ID NO: 51890 - DNA, 921 bp, Artificial Sequence
  Description of Artificial Sequence: Synthetic coding sequence
atgggaattctggacatcgaggtgtggggaaaagacaacaagaaacatgaagaacgtcttggtacatgcaaagtcgatatctctgccctccccctgaagcaagcaaactgcttggagttaccactggatagttgtcttggggctttgctgatgctggtcaccctcaccccctgcgctggggtttctgtatcagatttgtgcgtttgtcccttggctgacctctctgagcgcaagcagatcacgcagcgatattgtctccagaactccctgaaggacgtcaaggatgtcgggatactgcaggttaaagtactaaaagccgcagatctgctggccgctgatttttcagggaagagtgaccctttctgcctcctggaactgggcaatgaccggctgcagactcatactgtttacaagaatctgaaccctgagtggaacaaggttttcacgtttccaattaaggatattcatgacgtccttgaggtgactgtgttcgatgaagatggcgacaaacccccagacttcctgggcaaagttgccatccctctcctgagcatccgcgatggacagcccaattgctatgtactcaagaataaggacctggagcaagctttcaagggggtcatctatcttgagatggacttaatttacaatccggtgaaggcatcaatccggacattcacacctagggaaaaacgctttgtggaggattccaggaagctgagtaagaagattctctcaagagacgtggatcgagtcaaaagaattactatggccatctggaatactatgcagtttttgaagtcctgttttcagtgggagagcaccctgcgatccactatcgctttcgcccataggaaggaggaaccacccctcagcatgaagtgtaccctgttttccggggacattgggccatccctctag

SEQ ID NO: 51891 - DNA, 2637 bp, Artificial Sequence
  Description of Artificial Sequence: Synthetic coding sequence
atggatctggacaaaccctctgtctgggggagcctcaaacagcggacccgcccactgttaatcaatctgagcaagaagaaagtcaagaagaatcccagcaaacctcccgacctgagagcccgacatcacctggataggaggctctccctgagcgtgccagatctgctggaagcagaagccctcgctcccgaaggacggccatattctggccctcagtctagctacacatcggtgccctctagcctgtcaacagctggcatttttccgaaatcgagttcttccagcctgaaacagtctgaggaagagctagactggtcccaggaggaggcttctcacctccatgtcgtagaaacggattctgaggaagcgtacgcctcacccgctgagcgcagacgcgtgtctagcaatggaatttttgaccttcagaagacatccctaggcggtgacgctcccgaagagcccgagaagctgtgtgggtcatcggacctgaacgcaagcatgacctctcaacacttcgaggaacaatcagtccccggtgaagcctccgatggcctgagcaacctgccctccccatttgcctatttgctgacaattcacctgaaggaggggcgaaacctggtggtgcgggatcggtgtgggacatcagatccctacgtgaaattcaagctcaacggcaaaacgctctacaaatccaaagtgatctataaaaatctgaaccctgtgtgggacgaaattgttgtgctgccaatccagtccttagaccaaaagttgcgagtcaaggtttatgaccgcgatctgactacatctgacttcatggggtccgcctttgtaattttgtctgacctcgagctgaatcgcaccaccgagcacatcttgaaactggaagatccgaatagccttgaagacgacatgggcgtgatcgtgctgaatctgaatcttgtggtaaaacagggggatttcaagaggcaccggtggtcaaaccggaagaggcttagcgcctctaagagttccctgataaggaacctgcgcctatcagaatcgcttaaaaagaatcaactctggaatggcatcatttcaatcacactgctggagggaaaaaatgtgtcaggagggagtatgacggagatgtttgtgcagttaaagctgggcgatcaaaggtacaaatccaagaccctctgtaagtctgcaaaccctcaatggcaagagcaatttgacttccactacttttctgaccggatgggaatactggacatcgaagtatggggtaaggacaacaagaagcacgaggagagactcggaacatgtaaagtagatatttccgctttgccgctcaagcaggctaactgcctcgagctgcccctggacagctgtcttggcgctctcctgatgctggtgaccttgaccccatgtgccggagtgagcgtttcagatctgtgcgtctgtcccctggccgacttgtccgaacgtaagcagatcacacaacggtattgtctgcagaactctttgaaagacgtaaaagatgtaggtattcttcaggttaaggtgttgaaggccgctgacttgctcgcagccgacttcagtgggaaatccgacccattctgcctgcttgaactgggtaacgatcggctgcagacccacactgtttataaaaacctgaatcctgagtggaacaaggtattcacatttcccattaaggacatacacgatgttctggaggtcactgtgttcgacgaagacggagacaaaccaccagatttcctgggaaaagtggcgattccgcttctgtctatcagagacggccagccgaactgttatgttctgaagaataaagatctggagcaggcctttaagggtgttatttaccttgaaatggatttaatctataaccccgtgaaggcttctatccggactttcactccgagggaaaagcgcttcgtcgaggactccaggaagctgagcaagaagatcctctctcgggacgtggatcgagtgaaacgcatcacgatggccatttggaacacaatgcagttcctgaagtcctgtttccagtgggagagcacgctgcgctctacaatcgcatttgctgtcttcctcataactgtgtggaatttcgagctgtacatgatccccctcgcgctgctgctgatctttgtttataactttatcagaccagtgaagggaaaggtctccagtattcaggattcacaggagagcactgatatcgacgatgaagaagatgaggatgacaaagagtctgaaaagaagggactgatcgagaggatttatatggttcaggatatcgtgagcacagtccagaatgtcctcgaagagatcgcctcattcggtgagagaataaaaaatacgtttaattggaccgttccttttctgtccagccttgcttgtcttattttggctgccgctacgattatactgtactttatcccattgcggtacatcatccttatttgggggatcaacaagtttaccaagaaattaaggaacccctacagtatcgataataatgagttgttggactttctgtcgcgcgttccttctgacgtccagaaagttcaatacgcagagctcaagttgtgctcatctcacagtcccctccgaaaaaagcgctccgcactctag

SEQ ID NO: 51892 - DNA, 2472 bp, Artificial Sequence
  Description of Artificial Sequence: Synthetic coding sequence
atggacttggacaaaccctctgtgtggggtagcctgaagcagcgtacgcggcctttactgatcaacctgtctaagaagaaagtaaagaagaatccgtctaaacccccagaccttcgtgctcggcaccatttagaccggagactcagcctcagtgtacctgacctcctagaggctgaagccttggcacccgaaggtcggccatactccggcccacagtcgtcgtatacatccgtcccgtccagtctgagcaccgccggtatctttcctaagtccagttcgagtagtttgaaacagagcgaagaggaactcgactggtcccaagaggaggcgtcacatctccacgttgttgagaccgattcggaggaggcgtacgccagccccgctgagcgacgacgcgtctcttcaaacggaatttttgacctgcagaaaacttctttgggcggagatgcccctgaggagcctgagaagctgtgcgggtcatccgatcttaatgcaagtatgactagtcagcactttgaggagcagtccgtgccaggagaagcctctgacggcctgagtaacctccctagccctttcgcctacctgctgacaatacaccttaaggagggtcggaatctggttgtgagggatcggtgtggcacttctgatccttatgtgaaattcaaactgaatggaaaaacgttgtataagtccaaggtaatttataaaaacctgaaccctgtgtgggacgagattgtcgtccttcccattcagagtctggatcagaaactgcgggttaaagtgtatgatcgggacctgactacttctgatttcatgggcagcgctttcgtcattctatccgatctggaactcaatcgaaccactgagcacatcctgaaattagaggatccgaactccttggaagacgacatgggagtgattgtcctcaacttgaacttggtggtgaagcaaggagacttcaagagacaccgctggagtaacagaaaacgcctgagcgccagtaaatcctcactcatccgcaatctcaggctgtccgagtccctcaagaagaatcagctttggaatggaattatctccattaccttactggaaggcaagaatgtgtctggcggttccatgactgagatgtttgttcagctcaagctcggggatcagagatacaaatccaaaaccttgtgtaaaagtgccaatccccagtggcaggaacagtttgactttcactacttcagtgatagaatggggatcctggacatcgaggtgtgggggaaggacaataaaaaacacgaggaacgcctgggcacctgtaaagtagacatcagcgccctgcctctgaagcaggccaactgtttggagctgcctctggactcctgcctgggagccttgctcatgttggttacgctgacaccctgtgccggtgtctccgtttctgatctgtgcgtgtgtccgctggcggatttatccgaaagaaaacaaatcacccaaagatactgcttgcaaaactccctcaaggacgttaaggatgtcggcatccttcaagtgaaagttttgaaagcagcagatcttctcgcagcggattttagtgggaaatccgatccgttctgccttctggaattaggcaatgacagactgcaaacccatactgtctataaaaacctgaatcccgaatggaacaaggtgtttacttttccgatcaaggacatccatgacgtgctggaagtgaccgttttcgacgaggacggggataagccccctgacttcctcgggaaggttgcaatcccattactcagtataagggacggccagcccaattgctatgtgctgaagaacaaggacctggaacaggcatttaagggagtcatctatctagagatggacttgatttacaatcccgtgaaggcctcgatccgaacatttacgcctagagaaaagcgattcgtggaggatagcaggaagttatccaaaaaaattctgtctagagacgtggaccgagtaaaacgcatcaccatggcaatctggaatacaatgcaatttctcaaaagttgcttccagtgggagtccacccttcgatccaccatagctttcgccgaatcagagaaaaagggtctgatagagaggatctatatggtgcaggacatcgtgagtaccgtccagaatgtactggaggagatcgcttctttcggcgaacgaataaagaacacctttaattggacagtccccttcctttcatcactggcttgtctgattctcgccgctgccaccatcattctgtacttcattccattacgctacattatactgatctggggaatcaataagttcaccaagaaactgcgcaatccgtactctatcgacaacaatgagctcctggactttttgtcccgggtgcctagcgacgtgcagaaggtgcagtacgcagagctgaagctctgttccagccactcccccctgaggaagaaacgctcagcactgtag

SEQ ID NO: 51893 - DNA, 1191 bp, Artificial Sequence
  Description of Artificial Sequence: Synthetic coding sequence
atggacttggataaacctagtgtgtgggggagcctgaagcaacgaaccaggcctctgctgattaatcttagcaagaagaaggttaaaaaaaatccaagcaagccccctgatctgcgcgcaagacatcatttagatcgtagactgtcactgtccgtcccagacttgctggaagccgaggctttggcccctgaggggaggccgtattctggaccccagtcttcctatacaagcgtaccttcctctttgtctaccgccggaatctttcctaaatccagctctagctcactcaagcaaagcgaggaggaactagattggtcacaagaggaggcctcacacctccacgtggtggaaacggattctgaagaggcctatgcctcaccggctgagcggcgacgtgtcagtagcaatggaatatttgacctccagaaaacttctttaggcggtgatgcccctgaggagcccgagaaactatgcgggtctagtgacttgaatgcctctatgactagccagcacttcgaagaacagagcgtgcctggagaggccagtgacggcttgtctaacctgccctctccatttgcttacttgctgaccatccatcttaaggagggccgaaacctggtcgtgagagataggtgtggcacatcggatccatacgtgaaatttaaattgaacggcaagacactgtacaagtccaaggtgatttataagaatctgaaccctgtctgggacgaaattgtggtgctgcctatacagtcgctggaccaaaaactgagagtgaaagtttacgaccgcgacttaactacatccgactttatggggagcgcgttcgttatcctatctgacctggagctgaatagaacgacagaacacatcctcaaactggaggaccccaatagtctagaggatgacatgggcgtaatcgtcttaaacctcaacctcgtggtcaaacagggcgacttcaagagacacaggtggtctaaccgaaaacgcttgtccgcgtccaaaagctctctaatcagaaatctccgcctgtctgagagtttgaagaagaaccagctgtggaatgggatcataagtatcacattgttagagggaaagaacgtgtccggcggatccatgacagaaatgttcgtccaactcaaactgggcgatcagcgatataaaagtaaagacggtcatttcggtcactag

SEQ ID NO: 51894 - DNA, 2661 bp, Artificial Sequence
  Description of Artificial Sequence: Synthetic coding sequence
atgggtatggatcttacctgtcctttcggcatctccccagcatgtggtgctcaggcctcctggtctatcttcggagccgatgccgctgaggtaccaggcacccgaggccattctcagcaggaggccgcaatgccacacatccctgaggatgaagaacccccaggcgaacctcaggctgctcaatcaccagctgggcaacaggggccacccgctgccggtgttagctgcagccctaccccaaccattgtactgactggagatgccacctctccagaaggcgagacagataaaaacttagccaaccgagtacattcacctcacaagcgactctcccaccgccatctgaaggtctcaaccgcgtcgttgacatccgtggaccctgctggccacataatcgatctagtcaacgaccaactacccgacattagtatttctgaagaagacaaaaagaagaacttggctttgttagaagaagccaaactcgtgagcgagcgattcctcactagaaggggacgtaaatcaaggtcaagtcctggagacagtccatccgccgtaagtcccaatctttccccaagtgcttcaccaaccagttctaggtcaaactccctaaccgttcccacccccccagagggagacgaagccgatgtgagctctccccatccaggcgagcccaatgtgcccaaggggcttgctgatcggaagcagaatgaccaaagaaaggtgagccagggcaggctagcgccacgaccccctcccgttgagaaaagtaaggaaatcgctattgagcagaaagaaaatttcgatccactccaatacccagagaccacccctaagggcttggcacccgttactaactcctccggcaagatggccttgaacagcccccagccagggccagtggagtccgaattgggtaagcagctgctgaagactggatgggaaggctctccgctccctaggagtcccactcaggacgccgctggtgtgggcccacccgctagccagggcaggggacctgctggagagccgatgggtccagaggcaggttccaaagcggagttgccgccaaccgtatcacggccacctcttctgcggggactgtcttgggattctggaccagaagaacccggtccccgactccagaaggtcttggctaagctcccactcgctgaggaggaaaaaagatttgcagggaaagctggtggaaagctggccaaagccccaggcctcaaggatttccaaattcaggttcagcccgtgcgcatgcagaagctcacaaagctacgggaggaacacatcctcatgcgaaatcagaatctcgtcggtctgaagttacccgatctgtccgaggccgcagaacaggaaaagggcctcccgtctgagttgagcccagctatcgaagaggaggagtccaaaagcggattagatgtaatgcccaatatcagcgacgtcctcctgaggaagctgagggttcaccggtctttgcccggaagcgctcccccacttactgaaaaggaggttgagaacgttttcgtgcagctctcgctggcttttaggaacgactcctataccctggaatcccgcatcaaccaggctgaaagggaacgaaacctgacggaggagaatactgagaaagaactggaaaatttcaaagctagcatcacctctagtgcttccttgtggcatcactgcgagcatcgtgaaacttatcaaaaattgttggaggacatagccgtgctgcacagactcgcggcacgcctcagttcaagagccgaggtagttggcgctgttcgacaagaaaaaaggatgagcaaagctaccgaggttatgatgcagtatgtcgaaaatcttaaacgaacttatgagaaagaccacgccgagctcatggagtttaagaagttggcaaaccagaacagctctcgtagctgtggcccttcagaagacggtgtgccgcgaactgcacggtctatgtccttgacactggggaagaacatgccccgaaggcgggtgtctgtcgcagtcgtgcctaaattcaacgcactgaacctgccaggtcagaccccttctagcagttccataccatccctcccagcccttagcgaatccccaaacggtaaaggtagtcttcccgttaccagcgctttgccagctctactagagaacggcaaaaccaatggagatcctgactgtgaggcgtccgcgccagctctcaccctctcatgcttggaagagctctctcaggaaacaaaagccagaatggaggaggaggcgtacagcaaagggttccaggaaggtctcaagaagactaaggagttacaggacctgaaggaagaggaagaagagcagaagtccgagagcccggaggagcccgaagaagtggaagaaactgaagaagaggagaaggggcctcgtagtagcaaactggaagagcttgtacattttctccaggttatgtaccccaagctgtgccagcactggcaggtcatctggatgatggctgccgttatgctcgtcctgaccgttgtgctcgggctgtacaattcatataactcttgtgcggagcaggccgatggacccctgggccgatcaacatgctcagccgctcaaagggactcctggtggtcttcgggacttcagcacgaacagccaacagagcagtag

SEQ ID NO: 51895 - DNA, 2712 bp, Artificial Sequence
  Description of Artificial Sequence: Synthetic coding sequence
atgggaatggatttgacatgccctttcggcatttcacctgcttgtggcgctcaagcttcctggagcatttttggggctgacgccgcagaagttcctggaacgagggggcatagccagcaggaggcagccatgccccacatccctgaagatgaagagccacccggtgagccacaggctgcccagtctcctgctgggcagggtcccccagcagcaggtgtgagctgctccccaacaccaaccatcgtgctgactggggatgccaccagcccagaaggcgagaccgataaaaatctcgccaatagagtgcacagtccacacaaacgcttgtctcacagacatcttaaggtttctacagcttcacttaccagcgtggatcccgctggccatatcatagatctggtgaacgaccagctccctgatatctcaatcagcgaagaggataaaaagaaaaacctggctttattggaagaagcgaagctcgtttccgagagattcctaacgagacggggaaggaagtccaggagtagtcctggcgacagccccagcgcagtgagtccaaacctgtcaccctctgcaagccctacctcttccagatctaattcgttgacagtgccaacaccgcctggattagacgtctgttccgggccaccatccccccttccgggtgctcctccccagaaaggcgacgaggcagacgtgagcagcccccatcctggggagccaaacgttccaaagggattggctgatcgtaagcagaatgaccagcggaaggtgagtcaggggaggcttgcccctcgacccccacccgttgagaagagtaaggagattgcaatcgagcagaaagaaaacttcgacccactgcagtatccagaaaccacgcctaaaggactggcccctgtgaccaatagctcaggcaaaatggctctgaattcaccccagccaggccctgtggaatctgagctgggaaagcagttgctcaaaacgggctgggagggctcgccactccctaggtcacccacgcaagacgctgcgggtgtgggcccacccgcaagccagggtcgcggacctgccggagagcccatggggccagaggcgggttcaaaggccgagcttccacctaccgtctcgcgaccacccctgctgaggggcctgagctgggattcagggccagaagagccgggtcccaggctacagaaggtactggctaagctgcctctggccgaagaagagaagagatttgcgggaaaggctggtggcaagctcgcaaaggcgccaggcttgaaagacttccagatccaggttcagcccgtgcggatgcagaaattaaccaaactgagagaggagcatatacttatgcgtaaccaaaacctcgttggcttgaagctgccggacctcagcgaagctgctgagcaggagaagggcttgccctctgagctgtcaccagcaattgaggaggaagagtccaaatcgggcctagacgtcatgcctaatataagtgacgtcctgctccgcaagctccgggtgcaccgcagtctccctgggagtgcccctccgttaacggaaaaggaagtggagaacgttttcgtccaactttcccttgccttcagaaacgattcatatacattagagtcacgcatcaatcaagctgaacgcgagcgcaaccttacagaggaaaacacagagaaagaactagagaatttcaaggcgagcataacatcctctgcctctctgtggcatcattgtgagcacagggagacctaccagaaattgctcgaggacatcgccgtccttcatagactggctgccagactgagctcacgggcagaggtggttggtgccgtgagacaggaaaaacgaatgagcaaagcaacggaggtcatgatgcagtatgttgagaatcttaagcggacttacgaaaaagaccacgccgagttaatggaatttaagaagctcgcgaatcaaaactcatcccgctcctgcggaccctccgaggatggagtaccacggactgcacgctccatgagtcttaccctcgggaagaacatgccacgcaggcgagttagcgttgcggtagtgcccaagttcaacgcgttgaacttgcccggtcagacgccaagctcctcatcaataccctccctgcctgcactctctgaaagtccgaacggaaagggaagccttcctgtgacatctgccctccctgctcttctcgagaatggaaagacaaacggcgaccccgactgcgaagcctctgccccagccctgacgctgagctgtctggaagaactgagccaggagaccaaagcgcgaatggaggaggaggcttatagcaagggattccaggaggggctcaagaagacaaaggaactccaggacctaaaagaggaagaagaagagcagaagtctgagagccccgaggaacctgaggaggtggaggaaaccgaggaggaagagaagggacctcggagttccaagcttgaagaactagtccacttcctccaggtcatgtatcccaaactctgtcaacattggcaggtgatctggatgatggcagccgtgatgctggtgctcacagtggtgctcggcctgtataattcttataatagctgtgcagagcaggccgacggccctctgggaagatctacatgctctgctgctcaaagggattcatggtggtccagtggccttcaacatgaacagcccacagaacagtag

SEQ ID NO: 51896 - DNA, 1794 bp, Artificial Sequence
  Description of Artificial Sequence: Synthetic coding sequence
atggcgctgaattctccgcaacccggacctgtggagagcgaactgggaaaacagctgctgaaaacgggttgggaggggtctcccctgccacgtagcccaacacaggatgccgcaggagtcgggcctccagctagtcaaggccgtggcccagcgggagaacccatgggccctgaagcaggtagtaaagccgagctaccaccaacagtgtctaggccgccactactcagagggctgtcttgggactcaggccctgaggagcccggaccaagactgcagaaagtgcttgccaagctccctttagctgaggaagaaaagcggtttgccggtaaggcaggtggtaaactggccaaggcaccaggactaaaggattttcagatccaggtccagcctgtgcgcatgcaaaagctcactaagctgcgggaagaacatattctaatgaggaatcaaaatctggtggggctaaaactgcccgatctgtctgaagcagccgaacaggaaaaaggcctgcctagcgagctctccccggctattgaagaggaggaatccaaatcagggctggacgtgatgcccaacatatctgacgtgctgcttcgaaagctgcgcgttcaccgtagcctgcctggaagtgcgccacccctgactgaaaaggaagttgaaaatgtgtttgtccagctgtccctggcctttcgcaatgacagctacacgttagagtcccgaataaaccaggcagagagggagcgaaacttgaccgaagaaaacaccgaaaaagagctcgaaaactttaaagcttcgattacctcgtccgcctccttgtggcaccattgtgagcaccgggagacataccagaagctgctcgaggatattgccgtgttacaccggttagccgctcgcttaagcagtagagcggaggttgtgggcgcagtaaggcaggaaaaaaggatgtcaaaagccaccgaagtcatgatgcagtacgtggagaacttgaaacggacttacgaaaaggatcacgccgagctgatggagttcaaaaaacttgctaatcagaattcctcaaggtcctgcggcccatccgaggatggcgtgcccaggaccgccagaagcatgtcgcttacactgggtaaaaacatgccgcgtaggcgagtctctgtggccgttgtcccgaaattcaacgccttgaaccttccagggcagacaccttcgagcagcagtatcccatcattgccagccctcagcgaatcgccaaacggaaagggttccctgccagtcaccagtgcactgccggcactgctggaaaacggcaagacaaatggagaccctgattgcgaagcttctgctccagcactgaccctaagttgtctggaggaactgtcccaggagacaaaagcccgaatggaggaggaggcttatagtaagggcttccaggagggcctcaagaagaccaaagagttacaggaccttaaggaggaagaggaagagcaaaagtcagaatcccctgaggaaccagaggaagtggaagagaccgaagaggaggagaaaggccctcgcagttccaagcttgaggagcttgtccattttctccaggtgatgtacccaaagctgtgtcagcattggcaggtgatttggatgatggccgctgtgatgctggtgctcaccgtcgtactcggcctgtataactcctacaactcctgtgccgagcaggcagacgggccactgggacgttccacatgctcggcagcgcaaagagactcctggtggagtagcggcctgcagcatgagcagccgacagagcaatag

SEQ ID NO: 51897 - DNA, 2658 bp, Artificial Sequence
  Description of Artificial Sequence: Synthetic coding sequence
atgggtatggacttaacctgcccatttggcatatcccccgcttgtggtgcccaggcatcgtggtcaatattcggcgcagatgctgcagaggtccccggaacaagaggtcattcccagcaagaagccgctatgcctcacattcctgaggatgaggagcctcccggagagccacaggccgcacagagccctgctggccagggcccaccggcagccggtgtttcttgttctccaacccctacaattgttcttaccggggatgctacttcccctgagggtgagaccgataaaaacttagctaacagagtgcacagcccacataagagacttagccaccgccacctcaaggtgtccaccgcgtctctgacaagcgtggatccggcaggacatatcatagacttggtgaatgaccagttaccagatatcagcataagtgaggaggataagaaaaagaacttggccctgctagaagaagctaaactcgtcagcgagagatttcttactcgcagagggcgaaaaagccgcagctctccaggggatagcccctccgcagtttcaccaaatcttagcccttctgcttcaccaacgtcctcacggtctaacagtctgaccgttcctactccaccggatggtgatgaggctgacgtttctagcccccacccgggagaaccaaatgtgcccaaaggcctggctgaccgaaagcaaaacgaccagagaaaggtgagccaaggaaggctggcccctcgccctccccctgtagagaagagcaaggagatcgcgattgaacagaaagagaattttgaccccctgcaataccccgagacgactccgaaaggattggcccctgtcacaaatagtagcggtaaaatggcactgaactcccctcagcccggaccggtggaatccgagctcggtaagcagcttctgaagacaggttgggaagggtctcctcttcctagatctccaacacaagatgcggcaggcgtgggaccgccagcttctcaaggcagaggacctgcaggcgagccgatgggacccgaggcaggctctaaggccgagctgccgccaaccgtcagcagacctcctctgctacgaggcttgtcgtgggattctggaccagaagagcctggccctaggctgcagaaagtattggccaaattgccattggccgaagaagaaaagcggttcgccggaaaagccggaggaaagttagcaaaggcacctggtctgaaagacttccagatccaggtgcagcccgtacgaatgcagaaactcacgaaactgagggaggaacatatattgatgaggaaccaaaacctggtgggattgaagctgcccgatctgtctgaggccgcagaacaggaaaagggattgccttccgagctctcacccgcaatagaagaggaggagtccaaatccggtcttgatgtcatgcctaatattagtgatgtcctgctgcgcaaattgcgggtgcacaggtccttaccagggtctgcacctccactcactgaaaaagaggtggaaaatgtgttcgtacagctcagcctggcatttcggaacgacagttacacactcgaaagtagaattaaccaggctgagagggagaggaatcttacagaagagaatacggaaaaggagcttgaaaactttaaagccagtatcactagttcagccagcctgtggcatcattgtgagcacagagagacctaccagaaacttctcgaggatattgcagttctgcaccgactagcggctcggctcagtagccgggctgaggttgttggcgctgtgcgtcaggagaaacgcatgtctaaggctactgaggtcatgatgcaatatgtagaaaatctcaaacgcacttatgagaaggaccacgcggagctcatggaattcaagaagctggcaaaccaaaattccagccggagttgtgggccttcagaggacggggtaccacggacagcccgaagcatgtctttgactttgggcaagaacatgccaaggcgaagggttagtgtagccgtagtgcccaaatttaatgccctcaacctgcccggacaaacacctagcagtagctcaatcccgtccctgcccgctctatctgaaagcccaaacggaaaaggctcattaccagttacatctgccctgcccgctctgttggagaacgggaagacaaacggcgatccagactgcgaggcgtctgccccagccttgacgttgtcctgcctggaagaactcagccaggagacaaaggctaggatggaagaggaagcctactctaaaggttttcaggagggcctaaagaagaccaaggaattgcaagacttgaaagaggaggaagaggagcagaaatctgaatccccggaagaacccgaagaggtggaggaaacagaagaagaggagaagggacctcgctcctcaaaactagaggagcttgtgcacttcctccaggtaatgtatcctaaactttgtcagcactggcaagtgatttggatgatggcagccgtgatgctcgtgctgaccgtagtgcttggcctctataattcatacaacagttgtgcagagcaggcagatggaccactgggacgaagcacctgcagtgccgctcagcgagatagttggtggagttcaggactgcagcacgagcagcctacagaacaatag

SEQ ID NO: 51898 - DNA, 2466 bp, Artificial Sequence
  Description of Artificial Sequence: Synthetic coding sequence
ctcaccggtgacgccacaagtcctgaaggcgaaacagacaaaaatcttgccaacagagtacactcaccacacaagaggctgagccaccgtcacctcaaagtttccacagcttccctcaccagtgttgaccctgctggacacataatcgacctggtgaacgatcaattgcctgacatctccatcagtgaagaagataagaagaagaaccttgcattgttagaggaagctaaactggtatctgagcggtttcttactcgcaggggacggaagagccggagttcgccaggcgactcaccatctgctgtgtctccaaacttgtcaccatcggcctctcccacctctagtcgctcaaattctctgacagtaccaacacctccaggccttgacgtatgctcagggcctccttcaccactgcctggcgcaccccctcaaaaaggcgatgaagcggatgtgagcagcccccacccaggagagccgaatgtacccaagggcctagctgaccgcaagcagaatgatcagcggaaggtcagccaaggacgactggccccaaggccacctcccgttgaaaaaagtaaggaaatagcaatcgaacagaaggagaattttgatccattgcagtaccctgagaccacacctaaaggattggctcctgtgaccaacagcagtggcaagatggctctgaatagcccccaaccaggaccagttgagtctgagttggggaagcagctcttgaaaactgggtgggaaggctcaccactcccacgctcccctacccaggatgcagccggtgtgggacctcccgctagtcagggcagagggcctgctggcgagcccatgggaccagaggctggctccaaggccgagctacctcccactgtctccaggccgcctttactgaggggactgtcttgggattcaggtcccgaggagcctggacctaggcttcagaaagtcctcgcaaagcttcccctcgccgaggaggagaagcgcttcgctgggaaggccggtggcaaactggccaaagcccctggcctgaaggactttcaaatacaggtgcaacccgtaagaatgcagaaactgacaaaactgcgggaggagcacatcctaatgagaaatcaaaacttggtgggccttaagctcccggacttgtccgaggcagccgagcaggaaaaaggcctcccttccgaactcagccctgctatcgaggaggaagaaagcaaaagtggcctcgatgtgatgcctaacatctccgatgtgctcctccggaagctgagggtgcacaggtctcttcctgggagcgcccctccattgacggagaaggaggtggagaatgttttcgtacagctatcacttgcctttagaaatgattcctacacattggagtccaggataaatcaggccgagcgagagagaaatctgaccgaagagaacacagaaaaggaactggaaaacttcaaagccagcattacatcctccgctagtctgtggcatcactgcgaacaccgggaaacctatcagaagctgttggaagacatcgccgttctccataggttagccgcacgactctctagtagggcagaggtggttggagcagtgaggcaagaaaaaaggatgagcaaagccacggaggtgatgatgcagtacgtggagaatcttaagcggacctacgaaaaggaccatgctgagttaatggaattcaaaaagctcgctaatcagaacagctctcgcagttgtgggcctagcgaagatggtgtccccagaacagccaggtcaatgagtttaacactcggcaagaatatgcccaggagaagggtgagtgtcgcggttgttccaaagtttaatgcccttaatctccctggccaaaccccctcaagttccagtatccctagcttgccagccctgtcagagtcacccaacggtaaaggctcgctccctgtgacttctgcactgccagcactgcttgagaacgggaaaaccaatggggaccctgattgcgaggccagtgcgccagccctcacactaagctgtcttgaggagttatctcaggagactaaagcgcgaatggaagaggaagcttattccaagggatttcaggaaggcctgaaaaagacaaaggagttgcaggacctcaaggaagaagaggaggaacaaaaatctgaaagtcccgaggagcctgaagaggtggaggagacagaagaggaagaaaagggtcctcggagttccaagcttgaagaactcgtccacttcctgcaggtgatgtatccaaaactgtgtcagcactggcaggtcatttggatgatggccgcagtgatgctggtactgaccgttgtcttagggctgtataacagctataactcctgcgcagaacaggccgacggcccattaggcagatccacttgtagcgccgcacagagggactcatggtggagtagtggcctccagcatgagcagcctactgaacaatag

SEQ ID NO: 51899 - DNA, 1794 bp, Artificial Sequence
  Description of Artificial Sequence: Synthetic coding sequence
atggccctgaattcccctcagccaggcccagtggagtcagaactgggcaaacaactgttgaagacaggctgggaggggtcacccttaccccgatcacctacccaagacgctgcaggggtgggccctcccgcatcccagggccgagggccagctggagagcctatggggccagaggcaggctcaaaagcagaactccctcccactgtatccaggccccctctcttgagaggactgtcctgggattccggaccagaagagccgggacctcgactacaaaaagtgctggcaaagctgccactagccgaggaggaaaaacggttcgctggaaaggccggaggtaaacttgccaaagcccctggcctcaaggactttcagatccaggttcaaccagttcgaatgcaaaagctcactaagctgagggaagaacacattctaatgaggaaccaaaatctcgtcgggctaaagctgcccgatctgtccgaagctgccgagcaggagaagggcctccctagcgagctgtccccagctatcgaagaggaagagagcaaatcagggttagacgttatgccaaacatttctgatgtcctcctgagaaagctgcgcgttcatcggtcactgccgggttctgcaccacctttgacagagaaggaagtcgagaatgtgttcgtgcagttgagcttagcattcaggaatgactcttacactctagagtctcgcattaatcaggccgagcgagaacgcaaccttacagaggaaaacaccgagaaagaactcgaaaattttaaggcgagcattaccagttcagcttcactgtggcaccattgcgagcaccgggagacgtatcagaagctgttagaggacattgccgttttacacagactggccgctcgtctgtcttcacgggctgaggtcgtgggtgccgtgagacaagagaaacggatgagtaaagccaccgaggtcatgatgcagtacgtggaaaatctcaagaggacctacgagaaagaccatgccgagctgatggaattcaagaagttggccaatcagaactcaagtcggtcctgcggcccaagtgaggacggagttccccgaaccgcgaggagcatgagcctcacgctgggcaaaaacatgccacggcgacgggttagcgtggctgtcgtgccaaagttcaatgccttaaacctgccgggtcagaccccaagctcatcctccataccatccttgccagcccttagcgaaagtccgaatggaaagggtagtctgcccgtgaccagcgcgctgcccgctctccttgagaacggcaagacaaacggagatccagactgcgaggcaagcgcccctgccctgactcttagttgtttggaagagctaagtcaggaaactaaggctaggatggaggaggaggcctacagcaaggggttccaagaagggctgaaaaaaacaaaagagctgcaagacctgaaggaggaagaggaggagcagaagagtgagagccccgaagaaccagaggaagtcgaagagacagaggaggaggaaaagggtccccgttcatccaaattggaagaactggtccattttctccaagtaatgtaccccaagctgtgtcagcactggcaagtgatttggatgatggccgctgtgatgctggtgctcactgtggttttggggctgtataatagttacaatagctgcgccgaacaggctgatggtccactcggcaggagtacgtgcagtgccgctcaaagagactcttggtggtcctccggactccagcatgaacagcccacagaacagtag

SEQ ID NO: 51900 - DNA, 2466 bp, Artificial Sequence
  Description of Artificial Sequence: Synthetic coding sequence
ctcacgggcgacgccactagtcctgagggagagaccgacaaaaaccttgccaaccgcgtgcatagcccgcacaaaagactcagtcacagacacctaaaagtctccactgctagccttacctccgtggatccagccggacatatcatcgatctagtgaacgaccaactgccagatatttctattagtgaagaggacaagaagaaaaatctcgctttactggaggaagcgaaactggttagcgaacgattcctgactcggcgagggagaaagagtcgcagttccccaggagacagcccttctgctgtctcccctaatttatccccgtccgccagccctacttcctcgcgatctaactctctgaccgtgccaacacctcccggactggatgtgtgctcaggtcctcccagccccttgcctggcgcacctcctcaaaagggcgacgaggctgatgtcagctctccccatcctggagaaccgaacgtgccaaaaggcctcgctgaccgcaagcaaaacgaccaaagaaaggtgtcccaaggacggctcgccccacgcccacctccagtggagaagagcaaagaaattgccatagaacagaaagagaacttcgatccgttgcagtaccccgagactactcctaagggccttgcccctgtgactaactccagcggcaaaatggcactaaactcaccgcaacctggacctgtcgagtctgaattaggcaagcagctgctcaagacaggttgggagggttcacccctacctagaagcccaacacaggatgcagcaggggtggggccacctgcatctcagggacgaggacccgcaggcgagccaatggggccagaggctggctctaaagctgaattgcctccaaccgtgtctcggcctcccctcctacggggactgtcgtgggattcggggcctgaggagcccggacctaggctgcaaaaagtcttggctaagctgcccctggccgaagaggagaagagattcgcaggtaaagccggaggtaaattagctaaagcgcctggactgaaggattttcagatccaggtacagcccgtgcgaatgcaaaaactgaccaagctgagggaggagcacatcctgatgcgtaaccagaacctcgtaggcctgaaattgccagacctgagcgaggccgctgaacaggagaaggggttgccttctgagctgtctcctgctatcgaggaagaggaaagtaaatctggtttggacgtcatgcccaatatcagcgacgttctcctgaggaaactcagagtacatagaagtctcccagggagcgcaccccctctgacagagaaagaggtcgagaacgtgttcgtgcaattgagcttggcatttcgaaacgattcctatactttagaaagtaggattaatcaggcagagagggagcgaaacttgacagaggaaaatacggaaaaggaactggaaaactttaaagccagtatcacctcctcggccagtctttggcaccactgcgagcatagagaaacataccagaaactgctggaggacattgccgtgctacaccgattagctgcgagactgtcctccagagccgaggtggtcggggcagttaggcaagaaaaaagaatgtccaaggccactgaagtgatgatgcagtacgtggaaaacctgaaacgcacatatgagaaagatcatgccgaacttatggagtttaagaaattggccaaccagaattcctctcgcagttgcgggcctagcgaagatggagttccacggaccgcacgcagcatgtccctgactttgggaaaaaatatgcctaggcgcagggtctcagtcgcagtcgtcccaaagtttaatgcccttaacttaccaggacaaacaccgtcatcctcaagcatcccgagcctaccggcactgagcgaatcaccaaacggtaagggctcgctgccagtgacttctgctcttccagccctgcttgaaaacggcaaaaccaacggagatcctgactgtgaggccagtgctcccgcactaaccctttcttgtctcgaagagctgagccaggaaactaaagcacgcatggaagaggaggcctatagcaagggctttcaggaaggactgaagaagaccaaggaactccaggacctcaaggaagaggaagaagagcaaaaaagcgaaagtcccgaagaaccagaggaggtggaggagactgaagaggaggagaagggaccccgatctagcaaacttgaggaactggtccattttctgcaagtcatgtaccctaaactctgccaacactggcaggttatttggatgatggccgctgtaatgcttgtgttgactgtcgtactgggcctgtataatagctataattcttgcgccgagcaggccgatggccctctagggagaagtacatgctcagccgctcagagagactcttggtggagctccggcctgcagcacgagcaacccacagagcagtag

SEQ ID NO: 51901 - DNA, 2466 bp, Artificial Sequence
  Description of Artificial Sequence: Synthetic coding sequence
atgactggagacgccacaagccctgagggagagacggacaagaacctggcgaaccgagttcattccccacataagcgcctgtcacacaggcatctcaaggttagcacagcatcattgacgtccgttgaccctgcagggcatattatcgatctagtgaacgatcagttgcccgacatcagcatatctgaggaggataaaaaaaaaaacctggcactgctggaagaggccaaactggtctctgagcgatttctaacaaggaggggccgtaaatcacggagcagtccaggcgacagtccttccgcagtttcccccaatctgtcaccgagcgcaagccctacaagctcacgctctaactcactcacggtgccgacaccacctgggctggatgtgtgctccggccctccgtctcccttaccgggtgcaccccctcagaaaggggatgaggctgacgtgtctagccctcacccaggagaacctaatgtccctaaggggctggctgatagaaaacagaatgatcaacgaaaggttagtcagggccgtctggcgccacgtccacccccagtggaaaagtcaaaggaaatagctatcgagcaaaaagaaaattttgacccactgcagtacccagagacaactcccaaaggactggcaccggtgacaaatagttccggaaagatggccctcaactctcctcagccaggccctgtggagtccgagctgggaaagcagctcttaaagactggctgggaaggatcccccttgcccaggagccccactcaggacgctgctggggtggggcctccggcaagccagggcagggggcctgcaggtgaacccatgggtcccgaggctggctccaaggctgagctgccacctactgtatctaggcctcctttgcttcgcggtctgagttgggacagcggacctgaggagcccggaccaagactgcagaaggttctggctaagctccctctcgctgaggaagagaaacggttcgccggaaaagctggcggaaagttggcaaaagcaccagggcttaaggattttcagattcaagtccagccggtccgtatgcagaaactgactaagctgcgagaggaacatatcctcatgcgcaatcagaacctggttgggctaaagctgcctgatctgtcggaggctgccgaacaggagaaaggattgccttcagagttgagcccggcaattgaggaggaggagtcaaaatccgggctcgatgtgatgccaaacatttcggatgttctgctgagaaaactgagggtccacaggagtctccctggctcagcccctccgctgactgagaaggaggtggaaaacgttttcgttcagctgtctctggcattcagaaatgactcttacactctagaatcccgaattaatcaggcagagcgcgaacggaacctcacagaagagaacaccgaaaaagaactcgaaaactttaaagccagtattacaagttcagcgagtctgtggcatcactgtgagcatagagaaacctaccagaagttgctcgaagatattgctgtactgcacaggcttgctgcccgtctgtcctctcgggcagaagtcgtcggagctgtacgccaggaaaagagaatgagcaaagcgacggaggtcatgatgcaatacgtcgaaaacttaaagcgtacctacgaaaaagatcacgctgagctgatggagtttaagaaactggctaatcaaaattcaagcaggagctgtgggcctagcgaggacggggtgccccgaactgccagatcaatgagcctcacgttaggcaaaaatatgccacgtcgaagagtttcagttgctgtggtacccaagttcaatgccctgaacctgcccggacagactccgtcctcctcctcaatcccaagcttgccagcactttcagagtcgccaaacggtaaaggtagcctgcccgtgaccagcgcgctaccagccctgctcgagaatggcaagaccaacggcgatcctgactgcgaagcttctgccccagctctcacactgagctgcctcgaggaactgtcccaggaaacaaaggcacggatggaagaagaggcctacagtaagggttttcaggaagggctcaagaagactaaagagttgcaggacttgaaggaagaggaagaagagcagaagtctgaatccccggaagagcccgaggaggtcgaagaaaccgaagaagaggagaaggggcctcggtcctccaagctggaggaactcgtccactttctccaggtgatgtatcctaagctgtgtcagcactggcaggtaatctggatgatggcagcggtgatgcttgtactgaccgttgtcttgggactgtataattcttacaactcatgtgctgagcaggccgacggccctttgggcaggtccacatgctccgctgcacagagagattcttggtggagttctggcctgcaacatgaacagccaacagagcagtag

SEQ ID NO: 51902 - DNA, 1794 bp, Artificial Sequence
  Description of Artificial Sequence: Synthetic coding sequence
atggcactgaactcaccccagcctggtccggtcgaaagcgaactcggtaagcaactgctgaagactggctgggagggaagtcctcttcccaggagccctacacaggatgccgcaggagtcggtccacctgcctcacagggcaggggtccagctggggaaccgatggggccagaggctgggtcgaaagccgagctgcccccaacagtgtcacgcccaccactgctccggggactctcttgggacagcggccctgaggaaccgggtccacgcctgcagaaagtccttgccaaactgcccctggccgaggaggaaaaacgcttcgccggtaaagcagggggaaagctggccaaggcccctgggcttaaagatttccagattcaagttcagccagtccgcatgcagaagctgacaaagctgagagaggagcatatcttgatgcggaatcagaatctggtcggccttaagttgcctgacttgagtgaggcagcggaacaggagaagggtctccctagtgaactgagtcctgccatcgaagaggaagagtccaaaagcggccttgacgttatgcccaacatcagcgacgtgctcctgcggaaactgcgtgttcatcgtagcctgcccggatctgcccctcccctgacagaaaaggaagttgaaaatgtttttgtccagctgagcctggcattcaggaatgacagctatacgctagagtctcggattaatcaggctgagcgtgaaagaaatctgaccgaagaaaataccgagaaagaattagaaaactttaaagcttcgatcacaagcagtgcttcattgtggcaccactgcgagcacagggagacataccagaagctgctggaggacatagccgtgttacatcgcttggccgcacggctcagcagtagagccgaagtggtgggcgctgtccgtcaggagaagcgcatgtccaaagccacggaggtcatgatgcagtatgttgagaacctgaaaaggacttacgaaaaagatcacgccgagttaatggagtttaagaagcttgcaaatcagaatagtagcagatcttgcggcccatcagaggacggggtgccccgtaccgcgagatcaatgtcccttactctcggcaaaaatatgcctcggaggcgtgtctctgtggcggtggtgcctaagttcaacgctttaaacttaccgggtcagacgccctctagcagctcaattcctagcttgcctgctctttcggaatcacccaatgggaagggcagtttgcccgttacaagcgctttgcccgcattactcgaaaacgggaagacaaatggcgaccccgactgcgaagccagcgccccagccctaactctatcctgcctggaggagctgagccaagagactaaagcacggatggaggaagaagcctactcaaagggctttcaggaaggattaaaaaaaacaaaagagcttcaagatctgaaggaagaggaagaagaacagaagagcgaaagtcctgaagagcccgaggaggtggaagagacagaggaagaggaaaagggaccgaggagcagcaagcttgaagaactcgttcactttctgcaggtcatgtaccctaaactgtgccagcactggcaagttatttggatgatggccgctgtgatgctagtactgacagtggttctcggtctctacaactcatataatagctgcgcggagcaggctgacggcccattgggacggtcgacttgttccgccgctcagagagacagctggtggtcttctggccttcagcacgagcaacccacagaacagtag

SEQ ID NO: 51903 - DNA, 2739 bp, Artificial Sequence
  Description of Artificial Sequence: Synthetic coding sequence
atggtcaaggcaccacaatccgaggagcgcctggcacgcggtggtaaagagaataactctgtcttggcttgtggagcccaggcctcctggtcaattttcggagccgatgctgctgaagtgcccggaacccgcggacattcccagcaagaagcagcaatgccacacatcccagaggatgaggaacctcctggcgaacctcaggccgctcagtctcccgctggtcagggcccacctgccgcaggggtgtcttgcagtccaactccaacgatcgtgctgacaggtgacgcaacatcacccgagggagagaccgacaaaaacctcgccaacagagttcatagccctcacaagcgcctatcccacagacacctcaaagtcagtaccgccagcctgacttcagtggatccagctggacacattatcgacttggtcaatgaccagctgcctgatatatctatcagtgaagaggacaaaaagaagaatttggctcttcttgaagaggctaaactcgtctcggaacggtttctgacccgaaggggcagaaaaagccgcagtagcccaggagattcgcctagcgctgtctctcccaacctttccccctccgcatcaccaacaagttcccgcagtaacagcctcacagtgccaacacccccaggattggatgtatgcagtggccctccatcgcccctacccggtgccccaccacagaagggagatgaagcagatgttagcagtccacatccaggggaaccaaatgtccccaagggattagctgatagaaagcagaatgatcagcggaaggtctcacagggtcgcttggccccacggccacctcctgtcgagaaaagcaaagagatcgctatcgaacagaaagaaaatttcgatcctctgcaatatcctgagacgacacccaaagggctggctcccgtgacgaactctagcgggaagatggctctaaattcaccacagcccggacctgtcgaaagtgagctggggaaacagctattgaagaccggctgggaagggtccccattacctcgctccccaacgcaggacgctgctggcgttggaccacccgcatcccagggccgtggccctgctggcgaacctatgggcccagaggctggcagtaaagctgagttacccccaacagtgtctcgaccccctctgctcaggggactgtcttgggacagtggccctgaagaacccggtccgagactgcagaaggtgctggctaaattgcctttagccgaagaggaaaagagatttgccggaaaggcaggcggaaagctggccaaagctcccggactcaaggactttcagatacaggtccagccagttcggatgcaaaagctgacgaaattgcgcgaggagcacatcctgatgcggaaccagaacctcgtgggactcaagctgcccgatctcagcgaagccgcagagcaggagaaaggattgccgagcgagttgtctcctgcaattgaagaggaggaatccaaatctggcctggatgtgatgcctaacattagtgacgtcctgcttcgaaaactcagggtccaccggtccttgccaggcagcgcgccaccactaacagagaaagaggtggaaaatgtttttgtacaactcagtctcgccttccgcaatgatagttatactttagaatccaggatcaatcaggctgagagggagcgtaacctcactgaagagaataccgaaaaggagttagagaattttaaggccagcattacgagttcggcgagcctatggcaccactgcgaacacagagagacataccaaaaactgcttgaggacatcgcagttttgcacagactggctgcacggctgtcctcacgcgcagaggttgtcggcgctgtcagacaagagaagaggatgtctaaagcaactgaggtgatgatgcaatacgtggagaacctcaaaaggacttacgagaaagaccacgccgaattaatggaatttaagaaactggcaaatcaaaacagtagtagaagttgcggcccttcagaggacggggtccctaggacagcaaggtctatgagcctcacactgggcaaaaatatgcctaggagacgagtttccgtggcagtcgtccctaaattcaatgcactcaatctccctggccagaccccgtcaagtagctctataccttccctgccggcactgagtgaaagcccgaacgggaaaggttcgctcccagtaacatcagccctccctgccctgctagaaaacggaaaaacaaatggagatcccgactgcgaagcttccgcccctgcacttaccttgtcctgcctggaggaactgtcacaagagacaaaggctcgaatggaggaggaggcctacagcaagggcttccaggaggggctgaagaaaaccaaggaactacaggacctcaaagaagaggaagaagaacagaagtccgaatcccctgaggagcccgaagaggtagaagaaacagaggaagaagagaagggccctcgttcttccaaactagaggaattagttcatttcctgcaggtgatgtaccctaaattatgtcagcattggcaggtaatctggatgatggctgctgttatgctggtcctgacagtggtgttgggtctctacaactcatataattcttgtgccgagcaggcagacgggcctctgggacggtcgacatgctctgccgctcagcgcgattcatggtggtcctccggcctgcaacatgagcaacctaccgagcaatag

SEQ ID NO: 51904 - DNA, 2715 bp, Artificial Sequence
  Description of Artificial Sequence: Synthetic coding sequence
atgggaatggacctaacttgccccttcggaatcagtccagcttgtggggcacaggctagctggagcatttttggggcagatgccgctgaagtgcctggtacgcggggacactcacagcaggaggcagcgatgccccacatccccgaggatgaagagcctcccggtgagcctcaggccgcacaatcacccgctggacagggccctcctgctgcaggagttagttgctcacctaccccaactatagtgctcacaggcgatgccaccagcccagaaggcgagactgataaaaacctggccaatagagtacactccccgcataagagactttcgcaccgtcacctgaaagttagtacagcctctctcactagcgtggatcctgccggacacattatcgaccttgtaaatgaccagctgcccgatattagcatttctgaggaggacaaaaagaaaaacttagccctcttagaggaggcaaagttagtgtcagagcggtttctcacacgaagggggcgtaaaagtaggagcagccctggcgattccccgtctgccgtctcccccaacttatctcccagtgcctctcctacatcttctcgctccaactccctgacagtcccaacaccaccagggctggatgtgtgtagcggtcccccatcacccctgcccggagccccaccgcagcagaagggagacgaagctgatgtaagcagtccccaccccggagaacctaatgtgcctaagggcctggcagatagaaagcagaacgatcaaaggaaagtctcacaaggacggctggctcctaggcctcctcccgtggaaaagagcaaggagattgccatcgaacagaaggagaacttcgatcccctgcagtacccggagacgacgccgaaaggactggctcccgtaactaatagcagcggcaaaatggccctgaatagccctcaaccgggaccggtggagtctgaactgggaaagcaacttctcaaaactgggtgggagggcagtccactgccccgaagcccaacacaggacgccgctggagtgggccctcccgcttctcagggaagaggtccggctggcgagccaatgggcccagaggccggatctaaagcagaacttccgccaactgtctcaaggccacccttactgcgcggactgagctgggatagcggcccagaagagcccggaccacgccttcagaaagtgttagcaaagctgcctcttgccgaagaggagaagcggtttgctgggaaggccggaggtaagctggccaaagcgcctggactcaaagacttccagatccaggtccagcccgtgagaatgcagaagttaacaaagctgcgtgaggagcatattttaatgagaaatcagaacctggtcggactgaagctgcctgatttatcggaagctgctgaacaggaaaaaggtttgccttcggagctgagtcctgcgatcgaggaggaggagagcaagtctggcctggacgtaatgccaaatatatctgacgttctcctacgcaagctccgcgtccaccggagtctgccaggcagcgccccacccctgactgaaaaggaagtggagaacgtattcgtgcagcttagtctcgcatttagaaacgatagctacacgctggagagccgcatcaaccaggccgaacgagagagaaatctcactgaggagaataccgagaaagaactggagaattttaaggcttccatcaccagcagtgcgtcactgtggcaccactgcgagcaccgagaaacctaccaaaagttgctggaggatatcgccgtgctgcatagactcgctgccaggctgtcctccagagctgaagtagtgggtgccgtcagacaggagaaacgaatgtcaaaagccactgaggttatgatgcagtacgtagaaaacttaaagagaacatacgagaaggaccacgccgagcttatggaattcaagaagttggctaaccagaatagttcccgcagttgtgggccatccgaagacggtgtgccacggaccgcccgatccatgtctctcactctgggaaaaaatatgccaaggcgcagggtgtcagtcgcagttgtgccaaagtttaatgctcttaatctgccgggacagacaccctccagctcatcaattccatcacttcctgctctctccgagtcgcctaatggtaaaggctctttacccgtaacttctgctctcccagcattgctagaaaatgggaaaacaaatggagacccagactgtgaggctagtgcacccgcattgacactgagttgcctggaagaactgagccaggaaaccaaagctcgcatggaagaagaggcctactcaaaagggtttcaagagggcctgaaaaaaaccaaggaactccaggacttgaaagaggaagaggaggaacagaaaagcgagtcccccgaggagccggaggaagtggaggagacagaggaagaggaaaagggtccacgcagctccaagctggaagaacttgtgcacttcttgcaggtgatgtaccccaagctttgccagcattggcaggtgatttggatgatggccgcagtaatgttggtcctgaccgtggtcctgggcctctacaactcttacaattcctgtgcagagcaggctgatggacctctcggacgttcaacgtgcagcgcagcccagagagactcttggtggtcgtcaggcctgcagcacgagcaacccacggaacagtag

SEQ ID NO: 51905 - DNA, 2121 bp, Artificial Sequence
  Description of Artificial Sequence: Synthetic coding sequence
atggtgaaggcaccccagtcagaggagagactggcacgcggtggaaaggagaataattccgtgctggcttgcggcgctcaggcttcctggagcatcttcggggctgacgctgctgaagtgcccggaacgcggggacatagtcagcaagaagctgccatgccccatatacctgaggacgaggagcccccaggggaaccacaggccgcacagagtcctgctggtcaagggcctccagccgcaggggtgtcttgtagcccaacacccaccattgtgttgacaggcgacgccacgagtcccgagggcgagaccgataagaacttggccaatcgggttcattccccccacaaacgtctgagccaccgccacctgaaggtgtcaaccgctagtctgacatcagtagacccagcaggccacatcatcgatctggtgaatgatcagcttccagatataagcattagcgaagaggataagaaaaagaacttagcattactggaagaagcaaagctggttagcgagagattccttacccggcgtggccgaaaatccagatcatccccaggtgactccccctcggccgtgagcccaaacctctcgcccagtgctagtccaacctcctctaggtccaattccctcaccgttccgacaccccctggccttgatgtgtgcagcggaccccctagccccctcccaggggcaccgccacagaaaggggatgaggcagacgtctccagccctcatcctggcgagccggaacacatcttgatgaggaaccagaacctggtggggctaaaattgccagacctatcagaggccgctgaacaggaaaagggccttccctcagaattaagccccgcaattgaggaggaagaaagcaagtccggactcgacgtaatgccgaacatcagcgacgttcttcttcgtaagctacgagtgcataggtcactgccaggatcagcaccgccactgacagaaaaagaggtggagaatgtcttcgtgcagttgagcctggcctttcgcaacgattcttatacactggaaagccggataaatcaggcggagcgtgaacgcaacttgactgaagaaaataccgagaaggaacttgaaaactttaaagcaagtattacttctagtgcctctctgtggcaccactgcgagcatagggaaacataccagaagcttctcgaagatattgctgttctccaccgactggcggcacgccttagttccagagctgaggtcgtcggagccgtaaggcaggagaagaggatgagtaaagctactgaagtcatgatgcaatacgtcgaaaatttaaaaaggacttatgaaaaggatcacgccgagctcatggagtttaaaaagctagctaatcagaattcgtctcggtcctgcggcccttcagaggacggagttccacggaccgccagatccatgtctcttacccttggcaagaacatgcccaggagaagagtcagtgttgctgtggtacccaaattcaacgccctcaacctgccaggacagacgccgtccagcagcagcattccaagcctcccggcactctcggagtctcccaacggcaagggctctcttcctgtgacttctgcgctgcccgcactgcttgagaatggtaagaccaatggcgatccagattgcgaggcatccgcgcctgctttaacgctgtcgtgcctggaggagctctcgcaggagacaaaggcacgtatggaagaggaagcatattccaagggcttccaggagggtctcaagaagacaaaagaactgcaagatctgaaggaagaggaggaagagcagaaatcggaatcccccgaagagccagaggaagtggaggagacagaggaggaagagaaaggtcccagatccagcaaattggaggagctcgtgcacttcttgcaggtgatgtatcccaagctgtgccaacattggcaagtgatctggatgatggctgctgtgatgctagtattaacagttgtgcttggattgtataattcatacaattcctgtgccgagcaggcagacggacccctcgggaggagcacatgctcggccgctcagcgagattcctggtggagctcaggattgcaacacgagcaacccacggagcagtag

SEQ ID NO: 51906 - DNA, 1731 bp, Artificial Sequence
  Description of Artificial Sequence: Synthetic coding sequence
atggccgacgcaaacaaggccgaggtgcctggcgcaaccgggggagatagcccacaccttcagcccgctgaaccaccgggagagcccagacgtgagccacatcctgcggaagcggaaaaacaacagccccagcacagctctagctcaaacggtgttaaaatggagaacgatgaaagcgcgaaggaggagaaaagcgatctcaaggaaaaatctaccgggtctaaaaaggccaaccgctttcacccctacagtaaggacaagaactcgggcgcaggcgagaaaaagggtccaaatcgtaatcgggtgtttataagcaacatcccttatgatatgaagtggcaggccattaaggatctcatgagggagaaggtcggcgaggtgacgtatgtggagttgtttaaagacgctgagggcaagagcagggggtgcggggtggttgaattcaaagatgaggagttcgttaaaaaagccctcgaaaccatgaacaagtacgatctctccgggagacctttgaacattaaagaagaccctgatggggagaatgcacggagagccctacagcgcacaggagggagtttccctggcggtcacgtcccagacatggggagcgggctgatgaacctccccccatctatcctgaataacccaaacattcctcccgaggtgattagcaatcttcaagccggtagactgggcagtacgatttttgttgccaatctggatttcaaggttggctggaaaaagctcaaagaggtcttttctatcgcaggcaccgtgaaaagagccgatataaaggaggacaaagacggtaaatcgcgtggaatgggaacagtaacattcgagcaggctatcgaggccgtgcaggccatttctatgttcaacggccagttcctttttgataggcccatgcatgtcaagatggatgacaaaagcgtcccgcatgaagaatacagatcccacgatggtaaaactccacagcttccgcgtgggttaggtgggataggaatgggcctcggcccaggaggccagcctatttccgctagtcagctcaatatcggcggtgtgatggggaatctgggccctggcggaatggggatggacggtcccggattcggcggaatgaaccgcatcggcggtggcatcgggttcggtggccttgaggccatgaatagcatgggcggattcggcggagttgggagaatgggcgaactttataggggcgcaatgacgagcagtatggagcgcgattttggccgtggggacatcgggatcaatcagggattcggcgactcttttgggaggctcggtgggggtatgggctccatgaactcagtgaccggcggtatgggcatgggcctggaccggatgagctcatctttcgatcggatgggccctgggatcggcgcaattttagagcgcagtatcgatatggacaggggttttctgtccggtcctatgggaagtggcatgcgggagagaataggcagcaagggcaatcaaatctttgttagaaacctgccgttcgatcttacatggcagaagttgaaggaaaagttcagtcagtgtgggcacgtgatgttcgctgaaattaagatggaaaatggaaaatctaaggggtgtggaaccgtgcgttttgactctccagagagcgccgaaaaagcatgtcggatcatgaacggaatcaaaatatccggacgggaaattgacgtgagattggatagaaacgcctag

SEQ ID NO: 51907 - DNA, 1803 bp, Artificial Sequence
  Description of Artificial Sequence: Synthetic coding sequence
atggcagacgccaacaaggccgaggtgcccggtgccactgggggtgactctccccatctccagcccgcagaacctccaggcgagccgagacgggaaccccaccccgcagaggcagagaaacagcagccgcaacactctagctcatcaaacggggtcaagatggaaaacgatgagagcgcgaaagaggaaaagtccgatctgaaggagaaatccaccggctctaagaaggctaatcggttccatccatacagtaaagacaagaattccggcgctggtgaaaaaaaggggcctaacagaaaccgcgtctttattagcaatataccctatgacatgaagtggcaggcaataaaagacctcatgagagagaaggtgggcgaggttacctatgtggaactgttcaaagacgccgaggggaagagtcgcggttgtggtgtggtcgaattcaaggacgaggagttcgtgaagaaggcactggagactatgaataaatatgatctgtccgggagacctctgaacatcaaggaggatccagacggagagaacgctagacgggcattgcaacgcaccgggggatcattccctggcggacatgtaccggacatgggaagtggactcatgaacttgccaccaagcattcttaacaatccaaacattccccctgaggttattagcaaccttcaagctggaagattgggctccacaattttcgtagcaaatctcgacttcaaggtcgggtggaagaagctgaaagaggtattttctatcgcaggaactgtaaagcgcgctgatataaaagaagataaagacgggaaatccagagggatgggaactgtgaccttcgagcaggctatagaggccgttcaggccatttccatgtttaatggacaatttttgtttgataggcctatgcatgtaaagatggatgacaagtctgtccctcacgaggaatatcggtctcatgatggaaagacaccgcagctccctcgaggacttggaggtatcggcatgggactgggcccagggggtcagcctatcagtgcttctcaactcaatatagggggtgtgatgggtaatttaggtcctggcggtatgggcatggatggcccagggttcgggggaatgaaccgtataggcggagggatcggctttggtggtctagaagccatgaactctatgggagggttcggcggagtggggcgtatgggcgagctttaccggggagcaatgacttcctccatggagcgtgacttcggaaggggagatattggaatcaatcagggcttcggggacagttttggcagactgggatccgctatgatcggcggtttcgctgggagaataggctcctccaacatgggtcctgtaggttccggtattagtggaggaatgggttccatgaattcagtgacaggcggaatgggcatgggcctggaccggatgtcctctagtttcgatcgaatgggcccaggaattggagccatcctcgagcgcagcatcgacatggatcgcggtttccttagtgggcctatgggcagcggcatgcgcgagaggatagggagcaaagggaatcagattttcgtcaggaacctgccgttcgaccttacatggcagaaactcaaggagaagttctcccagtgcggacacgtcatgtttgcagagataaaaatggaaaatggcaagagtaagggctgtggaactgtgagattcgatagcccagagagtgcagagaaagcatgcaggattatgaacggtattaaaatcagcgggagagaaattgacgttaggttggacaggaacgcctag

SEQ ID NO: 51908 - DNA, 567 bp, Artificial Sequence
  Description of Artificial Sequence: Synthetic coding sequence
atgaactcaatgggcggtttcggcggagtggggcgaatgggagagctctacaggggagctatgaccagctccatggagagagattttggcagaggtgacatcggtatcaatcaaggctttggtgacagtttcggaagacttgggggtgggatggggtccatgaactccgtgacaggtgggatggggatgggtcttgacaggatgagcagcagctttgatagaatgggcccaggcatcggagccatcctagaacggtcaatcgacatggatcgcggtttcctttctggtcctatgggctccggaatgagggagagaatcggatcgaagggaaaccagattttcgtgagaaacttaccattcgatctaacctggcagaagttgaaagagaagttttctcaatgcggccatgtgatgttcgccgagataaagatggagaatggcaagtcaaaaggttgcggcaccgttcgtttcgacagccccgagagcgctgaaaaagcctgtcggatcatgaatggtatcaagatcagtggcagggaaatcgatgtgcgcttagacagaaatgcatag

SEQ ID NO: 51909 - DNA, 381 bp, Artificial Sequence
  Description of Artificial Sequence: Synthetic coding sequence
tgagggttagacaggatgtctagctctttcgacaggatgggtcctggcattggagccatcctcgagcgcagtattgacatggacaggggttttctgagcggccctatgggaagcgggatgcgggaacgcattggctctaagggcaaccagatattcgtgcggaatttgccttttgacttgacctggcagaagttaaaggagaaattttctcagtgcggacacgtgatgtttgccgaaattaaaatggagaatggcaaatctaaaggttgtggaacagtgagatttgattcaccggagtccgccgagaaggcatgtcgaatcatgaatggcattaagatttcaggtcgggagatcgacgtccggctggaccgtaacgcctag

SEQ ID NO: 51910 - DNA, 810 bp, Artificial Sequence
  Description of Artificial Sequence: Synthetic coding sequence
atggctgctagcgctggagccggagccgtcattgcagcccctgacagtcgcagatggctgtggtcagtcctggctgccgcactcgggctgctaacagccggagtgtccgcccttgaagtgtacacacccaaagagatttttgtcgctaacggtacccagggcaaactaacatgcaagttcaagagcacttccactaccggtgggctcacatcagtcagttggtcttttcagcccgaaggagccgacactacggtgtcatttttccattactcccagggacaggtgtatcttgggaattaccctccatttaaggaccgcatcagctgggcgggagacctggataaaaaggatgccagtattaatatcgagaacatgcagttcatccacaacgggacctacatttgtgatgttaagaatcctccagatattgtggtccaaccaggccacatcaggctctatgtggtggaaaaggagaatctcccggtgttccccgtttgggtagtggtgggcatagtgaccgcagtggtacttgggctgactcttctgatttccatgatactcgctgtactctatcgaaggaaaaactctaaacgtgactatactggatgttcgacctcggaatctctcagtcctgtgaaacaggcccctaggaagtccccaagtgatacagaaggcctggtgaagagtttacctagcgggagtcatcagggaccagtgatctatgcgcagctagatcattctggtggacaccattccgataagattaacaagagcgagtccgtggtctatgctgatattaggaaaaactag

SEQ ID NO: 51911 - DNA, 630 bp, Artificial Sequence
  Description of Artificial Sequence: Synthetic coding sequence
atggcagcctcggccggtgccggtgctgtcatcgctgctcctgatagcaggagatggctctggtctgtgctggctgccgcactgggccttttgaccgcgggagtatctgcactagaagtgtacactcctaaggagatctttgtcgctaatggaactcagggtaaacttacttgcaagtttaagagtacctcgacaacaggtggtttaaccagcgtgtcttggtcatttcaacccgagggcgctgacacaacagtttctttctttcattattcacaggggcaagtttatcttgggaattacccaccgtttaaagaccgtatctcctgggcaggtgacctggataagaaagacgcctctattaacatcgagaacatgcagttcatccacaacggaacctatatctgtgatgtgaaaaacccacccgatatcgtggtccagccaggccacattcgcctgtatgtggttgaaaaagagaatctaccggtgttcccagtgtgggttgtggtgggtatcgttacggcagttgttttaggtctgactctgctgatttccatgatcctggccgtgttgtatcggaggaaaaatagtaagagagattataccggcgctcaaagttacatgcacagttag

SEQ ID NO: 51912 - DNA, 360 bp, Artificial Sequence
  Description of Artificial Sequence: Synthetic coding sequence
atggcagccagtgcaggggctggcgctgtaattgcagccccagactcacgcaggtggttatggagcgtcctggccgctgccctgggactcctgaccgccggtgtttctgcacttgaagtgtacacaccaaaggagatatttgtggcaaacggcacccaggggaaacttacctgcaagttcaagagcacttccacaactgggggtttaacgagcgtatcctggagctttcagcccgaaggtgctgacacaacggtgtcagggcctgttatctacgcccagctggatcactctgggggacatcactccgataagatcaataaaagcgaatccgttgtctacgccgatatccggaaaaattag

SEQ ID NO: 51913 - DNA, 6146 bp, Artificial Sequence
  Description of Artificial Sequence: Synthetic coding sequence
atgctccgtgtcattgtggagagtgcatctaacatccctaagaccaaattcgggaaaccagacccaattgtctccgtgatctttaaagacgagaagaagaaaacaaagaaagtggataacgagctgaatcctgtatggaacgagatcctggagttcgaccttcgaggtatcccattagacttctcctcttctctgggcattatcgtaaaggattttgagacaattggacagaataagctgatcggaacggccaccgtggccctgaaggatctcaccggcgatcagtcaaggtctctgccctataagttaatctcactgctgaacgagaagggacaagatacaggcgctacaatcgatttggtgatcgggtacgatccaccttccgcaccccaccccaacgatctttccgggccatccgtccctgggatgggaggcgatggagaggaggatgagggcgatgaggatcggctcgataatgctgtgagaggacctggacctaagggtccagtagggactgtgtccgaagcccagctggctcgcaggctgacaaaagtgaagaactctcggaggatgctttccaataagccacaagattttcagatccgggtacgcgtcattgaaggtaggcaactgagcggaaacaacatcaggcctgtggtgaaggttcacgtgtgcggtcagacgcaccgcacaagaatcaagcgcggaaataaccctttcttcgatgagctgttcttctacaacgtgaatatgacgcctagtgagctaatggatgaaatcatatctatacgggtctacaattcccacagtttaagggctgattgccttatgggcgagttcaaaattgatgttgggtttgtctatgacgagcccggacacgctgtgatgcgtaaatggttactcctgaatgatccagaggacactagcagcgggtccaaaggttatatgaaagtaagcatgttcgttcttggcaccggggacgagccccctcccgagagacgggacagagacaatgactctgacgacgtcgaaagcaacctgctgctgccagctggaattgccctgcgctgggtgaccttcttacttaagatttaccgagccgaggatatcccacagatggacgatgcattttcccaaacagttaaagagattttcggagggaacgccgacaaaaagaacctcgtggatcccttcgtggaggtgagcttcgctggaaagaaagtatgtacgaatataattgagaagaacgcgaaccccgagtggaatcaggtggtgaatctccaaattaaattccctagcgtgtgcgaaaagattaaacttacgatttacgattgggaccggctaaccaagaatgatgtggtggggactacctacctccatctgtcaaaaatcgctgcttccggcggagaagtggaggtgaatacaggagagaccgaggtcggcttcgtgccaaccttcggcccttgttaccttaacttatacgggagcccccgagagtataccggattcccagatccttatgatgagttgaatacaggcaagggggagggcgttgcctaccgcggacgaatcctcgttgagctggccaccttcctcgaaaaaaccccaccagacaaaaagctggaacctatcagtaatgacgatctgttggtggttgagaaatatcagaggagacggaagtactcactctcggccgtgtttcacagcgccactatgctgcaggacgtcggcgaggctatccagtttgaggtgtcgattggaaattatggcaacaaattcgataccacttgtaaacctctcgcctccaccacgcagtacagcagagccgtgttcgatggcaattactactattacctgccttgggctcatacgaaaccagtggtaaccctgacaagctattgggaggacatctcacacagactggatgccgtgaacactcttttggcgatggctgagagactgcagacaaatattgaggcactgaaatctggtatccaggggaaaatccctgccaatcaactcgctgaactgtggctcaagctaattgacgaggttatcgaagatacaaggtatacactgcctctcactgagggcaaggccaatgtaacagtccttgacacccaaattcgcaaactgagatctagatccctgtcccagatccatgaggccgcagtgcgaatgcggtctgaggcgactgatgttaaaagcaccttagccgaaatagaagactggctggataagctgatgcagcttaccgaagagccccagaatagtatgccggatataatcatttggatgatccgaggcgagaaaaggcttgcatatgctcgcataccagctcaccaagtcctctacagcacttcaggtgagaatgcaagtggcaagtattgcggaaaaactcaaacaatctttctaaagtatcctcaggagaaaaataacgggccaaaggtgcctgttgagcttcgtgtgaatatatggcttggattaagtgctgtggagaagaaattcaacagctttgcggaaggtactttcaccgtttttgccgaaatgtatgagaatcaagcactgatgttcgggaagtggggtaccagcggcttggtaggacgccacaaattttcagacgttactggaaaaataaagctcaagagggagtttttcctgcctcccaaaggctgggagtgggaaggtgagtggatagtcgatcctgagcgatctttgttgacagaagccgacgccggtcatacagagttcacggatgaagtataccagaatgagtcccggtatcccggtggcgattggaagccggcagaagatacctatacagatgctaatggagacaaagcggcaagcccatcagagttgacctgtccccctggatgggagtgggaagacgatgcctggtcttacgacattaatagggccgtggatgaaaaagggtgggagtacggaattaccatccctccagatcacaaaccaaagtcatgggtcgctgctgagaaaatgtaccacacacatcgtagacgtcggctggtcagaaaaaggaagaaggacctgacccaaacggccagctctacagcacgggctatggaggaactacaggaccaagagggctgggaatatgctagcttgatcggctggaagtttcactggaagcagaggagctcagacacattcaggaggagaaggtggaggcgaaagatggccccttctgaaactcacggggctgcagcaatctttaagctcgagggggcattaggggctgacaccacggaggacggcgacgagaagtccctggaaaagcagaagcacagcgccaccaccgtctttggagcaaacaccccaattgtgtcctgtaattttgatagggtctatatctaccatctccggtgctacgtgtaccaggccaggaacctcctggcattggacaaagattcgttctctgatccctacgcgcatatttgttttttgcatagaagcaaaaccacagagatcattcacagcaccctaaatccaacctgggaccaaactatcatttttgatgaggttgagatctatggcgagccccaaaccgtgctgcagaacccccctaaagtgatcatggagctttttgacaatgatcaggtgggaaaagatgagtttctcggacgctcaatcttcagtcctgttgtcaagctgaacagcgaaatggatattacacccaaattgctctggcatcccgttatgaacggcgataaggcatgcggggacgtgctcgtgacggccgagctgatcttgagggggaaagatgggtccaacctccccattctgccaccccagagagcgccaaacctgtacatggttccccaggggattagaccagtagtacaattgaccgcaatcgaaatcctggcatgggggctgagaaacatgaaaaattttcagatggcatcaattacctccccatcgctggtggtcgagtgtggaggcgaacgggtggagagcgttgtcatcaagaatctgaagaagaccccaaacttcccgtcaagtgtcctttttatgaaagtcttcctgcccaaagaagaactctacatgcccccacttgtgattaaggtgattgatcaccgtcagttcgggcgtaagcccgtcgtcggccagtgcactattgaaaggctggaccgcttccgatgcgatccctacgccggtaaggaggacatcgtgccacaactcaaggccagcctcctatccgcacccccatgtcgagacattgtgatagaaatggaagatactaagcccctcctggcctctaaattaaccgagaaggaagaagagatcgtggactggtggagcaaattctatgcatcgtcaggagagcacgagaagtgcggacagtatatccagaagggctactccaagttaaagatctataattgtgaacttgaaaacgtcgccgaatttgaagggcttacggatttttctgatactttcaaactttacagggggaaatccgatgaaaacgaggacccctccgtagtgggagagttcaagggctcattccgcatttacccactaccagacgacccatccgtgcccgcacctcctcgccaattccgggaactgcccgactcagtccctcaggagtgcacagtaagaatctacatcgtgagagggctagaactgcagccacaagacaacaatggactgtgtgacccctatattaagattactctcggaaaaaaagttatcgaggatcgcgaccattatatccccaacaccctgaatcctgtctttggccgaatgtatgagctgtcttgctacctcccacaggagaaggatctgaagatctctgtgtacgattacgacacattcacccgggatgagaaggttggcgagacgattatcgacctggaaaacaggtttctcagtcggtttggttcccattgtgggatacccgaggagtactgtgtcagtggcgtaaacacgtggagggaccaacttcgtcctacccaactcctgcagaatgtagctcggttcaagggctttccccagcccattctaagtgaagatgggtcacgaattcgctacggcggtcgcgattattccctggacgagttcgaggccaataaaatcctgcaccaacatctgggggctcctgaagagcggctggcactccatatactgcgcacccagggattagtgccagagcatgtggagacccgtactctgcactccacatttcaacctaatatctcccagggcaagctgcagatgtgggttgatgtgttccctaaaagcctgggcccaccaggcccaccattcaacatcaccccacggaaggctaagaagtactacttgcgcgtgatcatctggaacacaaaggacgtcattctggatgaaaagtcaataacgggggaggaaatgtctgatatttacgtgaagggatggatccccggaaatgaggaaaacaaacagaagacagacgtgcactacagatctctggacggtgaggggaatttcaactggagattcgtgttcccgttcgactacctgcccgctgaacagctgtgcatcgtcgctaagaaagaacacttttggtctatcgatcaaacagaattccgcattccgccacgactcataattcagatctgggataacgataagttctcactggacgactatttggggttcctggaactcgacctgcggcacacaataatcccggcaaagtcaccagaaaaatgtcgcctggacatgattccagatcttaaagcaatgaaccctctgaaggcgaaaactgccagtctgttcgagcagaaaagcatgaaaggttggtggccttgctatgccgaaaaggatggcgcacgagtgatggccggaaaagtggagatgacattggagattctgaacgagaaggaggccgacgaacggccagccggaaaagggcgagatgagccaaacatgaatccgaagttggacctgcccaatcgaccggagactagctttctttggtttacaaacccctgcaaaactatgaagttcatagtgtggcgtaggtttaaatgggtaattattggcttgctgttccttctaatactgctgctctttgtggccgtcctgctctactcactgcccaactacttgagtatgaagatcgtcaaaccgaatgtgta

SEQ ID NO: 51914 - DNA, 6185 bp, Artificial Sequence
  Description of Artificial Sequence: Synthetic coding sequence
atgctgagagtgatcgttgagtccgccagcaacataccaaagactaagtttggcaaaccagacccgatcgtgtctgtcattttcaaagacgagaagaaaaagacgaaaaaggttgataacgaattaaatccagtgtggaacgagattctcgagttcgatctgcgcggtattcctttagacttcagctcatcactgggtattatcgtgaaggatttcgaaacaatcggacaaaataagctgatcggtacagccacggtcgccctcaaggacttgactggggaccaatctagaagcctgccctacaaactgatttccctactcaatgaaaaaggacaggacactggagctaccatcgacctggtcattgggtatgatccaccaagcgccccacaccccaacgacctgtccggcccttctgttcctgggatgggcggtgatggcgaggaggacgagggcgacgaagacagactggataacgcagtccgcggtccagggcctaaaggacccgtgggcacggtgagtgaagcccaactggctcgacggttgacaaaagttaaaaattcccgaagaatgctgagcaataaacctcaagacttccagattagggtgcgcgttatcgagggcagacagctctcaggcaataacatccgacccgtcgtgaaggtacatgtctgtggacagacccataggactagaattaagcgaggaaacaacccttttttcgacgaactgttcttttacaacgtgaacatgacgccatcagaacttatggacgaaattatctcaataagagtgtataacagccacagtttacgcgcagactgcctgatgggagagtttaaaatcgatgtgggattcgtttacgacgagcctggtcacgccgtcatgagaaagtggttgctgcttaacgacccggaggacaccagctccggctctaaaggatacatgaaggtgtcgatgttcgtacttggaacaggtgatgagccccctccagaacgcagagaccgggacaacgactcagacgatgtggaatctaacctgttactgcctgcaggcatagccttgagatgggtcacattcctgctcaaaatttatcgcgctgaggatatcccacagatggatgatgccttctcgcaaaccgttaaagaaatcttcgggggaaacgctgacaaaaaaaatttggtggacccttttgtggaggtgtcctttgcagggaagaaagtgtgcacaaatatcattgagaagaacgctaacccagaatggaaccaagtggtcaacctacaaattaaatttccgtccgtttgcgaaaagattaagctgacaatatacgactgggataggctgactaagaatgatgtcgtgggaacgacttatttgcatctgtccaagatcgccgcttctggcggagaagtcgaggacttctcatctagcggcactggagccgcttcatacaccgtgaataccggggaaacggaggtggggttcgttcccactttcgggccatgttacctgaatttgtacgggagtccccgtgagtatactggcttcccagacccctacgatgaactcaataccggaaagggcgagggtgtcgcttatagagggagaatccttgtggagctggccacttttttggagaagactccgccagacaagaaattggaacctatctccaacgatgatctgctggtagtcgaaaaataccagagaagacgcaaatatagcctctcagcggtgtttcacagcgccacgatgctgcaggatgtcggcgaagcgatccagtttgaggtctccattggaaattacggcaataaattcgatactacctgtaaacccttggcgagcactactcaatattctcgggctgtgttcgatggcaactactattattacctgccctgggcccatacaaagccagtcgtgactctgacatcatattgggaggacatttctcatagactggatgcagtcaacacactgctcgccatggccgaaaggctgcagacaaacatagaagcccttaaatctggcatccaaggcaagatccccgctaatcagctggccgagctctggttaaagttgatagatgaggttatcgaagacaccagatatacgctaccactgacggaagggaaggccaatgtgactgtgttagatacccagattcgtaaattgcgtagccgctcactgtcccagattcatgaggccgctgtccgcatgcgctccgaagccaccgatgtgaagagtactttagctgagattgaagactggcttgataagttgatgcaactgacagaagagcctcaaaactcaatgcccgacattattatctggatgattcgcggtgagaagcgcttggcctacgctcgcataccagctcaccaggttctgtactcaacgtccggcgagaacgcttcagggaagtattgtgggaaaacacagacgatctttctcaagtacccgcaggaaaagaacaatggaccaaaagttccagtggaactgagagtgaacatctggctaggacttagtgcggtggaaaaaaagtttaatagcttcgctgagggcacgtttaccgtgttcgcggaaatgtatgagaaccaggccctgatgtttggcaagtggggcacttccgggctggtaggcaggcataaattcagcgacgtgactggcaagatcaagctcaaaagggaattctttcttccccctaagggctgggaatgggaaggtgagtggattgtcgatcctgaacggagcctgctgactgaagctgacgctggacacaccgaatttaccgacgaggtataccagaacgagagtaggtaccccggtggtgattggaaacccgctgaagacacttacactgacgccaatggcgacaaagccgcttctccgtctgaacttacctgccctcccggatgggagtgggaggatgacgcttggtcttatgatatcaacagggcagtggacgagaaggggtgggaatacggcataacaatccctccggaccataagccaaagagctgggtggctgccgaaaagatgtaccatactcacagacgcaggaggttggttcggaaacggaagaaagacttgacacagactgccagctccaccgcaagagcaatggaagagctgcaggatcaggagggatgggaatatgcctcactcatcggatggaaatttcattggaagcagcgttcttcagataccttcaggcggcgtaggtggcgtcggaagatggctccttctgagacccatggagcagccgctatcttcaaactggagggtgccctcggcgcagacacaacagaagacggcgatgaaaaatctttagaaaaacaaaaacattcggccactaccgtgtttggggctaatactccaatcgtgagctgcaacttcgatcgcgtgtatatttaccatctccggtgttatgtgtaccaggcccgaaacctgctggcactcgacaaggactcttttagcgacccatacgctcatatctgctttctgcacagatccaaaaccacggagatcattcatagtacactgaaccctacatgggatcaaactattatctttgacgaggtcgagatctacggcgagccccagaccgtccttcaaaatcccccaaaggttattatggagctttttgacaatgaccaagtgggcaaggacgagttcctcggaaggtccattttctctcccgtagtcaagctgaacagcgagatggatattacacccaaactcctgtggcaccctgtaatgaacggtgataaggcctgtggggatgtgctcgtcactgccgagctgatcttgcgcggaaaggatgggtccaatctgcccatcttgcccccacagagggcgcctaatctgtatatggttccccaaggcatcagaccagtggtccagttaactgcgatcgaaattctggcttggggcctacgaaatatgaagaattttcaaatggcatctataacaagcccttccttagtcgtagagtgcggcggagaacgggttgaatctgtggtcatcaagaaccttaaaaagacccccaacttcccatcgtctgttttgttcatgaaagtttttcttcctaaagaggagctgtatatgccaccactggtcatcaaggtgattgatcatcggcagtttgggagaaagcccgtcgttggtcaatgtactatagaacgcttagatcgttttagatgtgatccatatgcaggaaaggaagatatcgtcccccagttgaaagcaagtctgcttagcgccccaccgtgtcgcgatatcgtgatcgagatggaggacactaagcctctcctggccagcaagctgaccgaaaaggaagaagaaatagttgattggtggtctaagttctatgcaagctctggcgagcacgagaagtgtgggcagtatattcaaaaggggtactccaagctgaagatctacaattgcgaactcgaaaatgtggcagaatttgagggattaaccgatttcagtgacacatttaaattgtacagaggaaagtcagatgagaacgaagaccctagcgtggtgggtgaatttaaaggctctttccggatatatccattgcccgacgacccaagcgtgcctgcccctcccagacagttcagagagctacctgacagcgttccgcaagagtgcaccgtgagaatttacatcgttcgtggcctggagctccagcctcaggataacaatggcctgtgtgacccctacattaagatcaccttgggaaaaaaggtgattgaggatcgcgatcactatattccaaatactctcaatcccgttttcgggagaatgtacgaactgtcctgctacctgcctcaggagaaggaccttaaaatcagtgtctacgactatgacacatttactagggacgaaaaagtaggtgaaacaatcatcgatttggagaatcggttcctctcacgatttgggagccactgtggcataccagaggaatactgtgtaagcggggttaacacatggcgggatcagctgcgaccaacccaactgttgcagaacgtggccaggttcaaaggcttcccccagcccattctgtctgaagatggttcaagaatccggtacggaggcagagactatagcctggatgaattcgaggcaaacaagatcctgcatcagcacttaggggctccggaagagaggctcgctctgcacatcttgcgcacccaggggctcgtgcccgagcacgtggaaacgaggacactgcactccacctttcaaccaaatatcagccaggggaaactgcagatgtgggttgacgtgttccccaagagcctcggtccacctggacccccattcaacatcactccgcgtaaagcaaagaaatactaccttcgggtgatcatctggaacacaaaagatgtcatcctcgacgagaaatctattacaggcgaggagatgtctgacatctacgtgaaaggatggattcccggaaacgaggagaataagcagaagacggacgttcactaccgctccctggacggagagggaaattttaattggagattcgttttcccattcgactatcttccagccgagcagctctgcattgtggccaagaaagagcacttttggtcaatagaccagacagagttccgcatccctccgagattgatcatacagatctgggataatgacaagttcagcttggatgattaccttggctttctcgagcttgacctgcgccacaccattatccccgcaaaatcccccgaaaaatgccgccttgatatgataccggatctgaaagcaatgaacccgcttaaggcaaaaacggcatcgctgttcgagcagaaaagcatgaagggctggtggccttgttacgccgagaaagatggcgctagagtaatggccggaaaagtggagatgacactggagatcctcaacgaaaaagaggccgacgaaaggcctgctggcaagggcagggatgaacctaacatgaatcctaagctggacctacctaatcgccctgagacctccttcctctggttcaccaacccctgcaaaacaatgaagtttatcgtttggcgccgattcaaatgggtgataatcggcctcttatttctgctgatcctcctgctgttcgtggctgttctgctctatagcctccctaactatttgtccatgaagatcgtcaaacccaacgtgta

SEQ ID NO: 51915 - DNA, 483 bp, Artificial Sequence
  Description of Artificial Sequence: Synthetic coding sequence
atgctgcgagtcattgtggagagcgcgtctaatatccctaaaactaagttcggcaaaccagatcccatcgtttcagtgatctttaaagatgagaagaagaaaaccaaaaaggtggataacgagctgaaccccgtgtggaacgaaatcctggagtttgatctgagggggattcccctggacttcagttcgtccctggggatcattgtgaaagattttgaaacgataggccagaacaagttaattggcacagccactgtcgccttaaaggaccttaccggggaccagagccggtcactcccttacaagttgatctcccttttaaatgaaaagggccaggatacgggggcaacaatagacctggtcataggatacgatccacctagcgctcctcatccgaatgatctctccggtccttccgtccccggtatggggggaaagctgacgctgctcaaggcccagcctccccctggcggaggttgttag

SEQ ID NO: 51916 - DNA, 1338 bp, Artificial Sequence
  Description of Artificial Sequence: Synthetic coding sequence
atgctccgagtgatcgttgagtctgctagtaacatcccaaagactaagttcggaaagcccgaccctatcgtgagtgtgatttttaaagacgagaagaaaaaaactaaaaaggtcgataacgaattgaatcctgtgtggaatgagattctggaattcgatctccgaggtattcctcttgatttttcctcgtccttaggaatcatcgtgaaagacttcgagacaattgggcagaataagctgattggcactgctacagttgcactaaaagatctcaccggggaccagagccggtcactcccttataagcttatctccctgctcaatgagaaaggccaggacactggcgcaaccatcgatctggttataggctatgaccccccttcagcgccacatcccaacgacttgagcggtcctagtgtgcctggaatgggaggagacggggaagaggatgagggcgacgaggacagactggacaacgcagtgaggggtccagggcctaagggccctgtggggactgtaagtgaggcccagcttgctcggaggttgacgaaggttaaaaactctagaaggatgctgtccaacaagcctcaagatttccagattcgggtgcgggtgatcgaagggaggcaactcagcggtaataacatcagacccgtcgtcaaggtccacgtgtgtggtcagactcatcgaacccggataaaacggggaaataatcccttctttgatgaactgttcttctacaatgttaacatgacaccctccgagctcatggacgaaatcatctctatcagggtgtacaatagccatagtctgcgcgcagattgtcttatgggagaattcaagatcgatgtcggcttcgtgtacgacgaacctggccatgccgtgatgagaaagtggttgctgctgaatgatcctgaagacacttctagcggcagcaaagggtatatgaaggtatcaatgttcgtgttaggcactggagatgagccgccaccggaacggcgtgacagggacaacgactccgatgacgtggagtctaacctgctgctacccgctggcatcgctcttaggtgggtcaccttcctccttaaaatataccgggcagaggacatcccccagatggatgatgctttcagtcaaacggttaaggaaatcttcggcggaaatgccgacaagaaaaacctcgtcgacccgttcgttgaagtcagttttgcagggaagaaggtatgcacaaatatcatcgagaagaatgccaacccagagtggaatcaggtcgtcaatctgcagattaagtttccctccgtttgcgagaagataaagcttacaatctatgactggtag

SEQ ID NO: 51917 - DNA, 6185 bp, Artificial Sequence
  Description of Artificial Sequence: Synthetic coding sequence
atgttgagggtcattgtcgagtcagccagcaatattccaaaaactaagttcggcaaacccgacccaattgttagcgtgatatttaaagatgagaaaaagaaaaccaaaaaggtcgacaacgaacttaacccggtgtggaatgagattcttgaattcgatctgagagggattcccctcgacttttcttcctcgctcggtatcatagtcaaagattttgagaccataggacaaaacaaactgatcggaacggcgaccgttgccctgaaagacctgaccggggaccagtccagatcgctgccttataagttaatttctttgttgaatgagaaggggcaggatacgggggctacaatcgatttagtcatcggctatgatcctccctctgctccacatcccaacgacttgtcaggaccctccgtgcccggaatgggaggagatggcgaagaagacgagggcgatgaggacagactggacaacgccgtgagaggcccagggccaaagggcccagtcgggacagtgtccgaagctcaactcgctagacggctcaccaaggttaaaaatagtagaaggatgctgagtaataagcctcaagatttccagattcgagtgagagtgatagagggccgtcagctgagcgggaataacattaggcccgtggttaaagttcacgtttgcggacagacccacaggacaaggatcaaacggggaaataatcctttcttcgacgaactctttttctataacgtcaacatgacccctagcgagttgatggacgagattatttcaatccgcgtctacaactcccatagcctgagagctgattgtctgatgggcgagttcaaaatcgatgtgggcttcgtttatgatgagccgggtcatgccgtgatgcgcaagtggctgctactgaacgacccagaggacacaagctccgggtccaaaggatatatgaaggtcagtatgtttgtactgggaaccggtgatgaaccccctcccgaacggcgtgacagggacaatgatagcgatgacgtagagtctaatctccttctgccagcagggatcgctctcagatgggtaactttcttgctgaagatataccgggctgaagacattccccaaatggacgacgcatttagccagacagtcaaagagatatttgggggaaatgcggataaaaagaatctggtagatcccttcgtggaggtgtcctttgccggaaagaaggtgtgcacaaacataatcgagaaaaatgctaatcccgagtggaaccaagtcgtaaatcttcagatcaaattcccaagtgtgtgcgagaagattaagctcacaatctatgactgggaccggcttaccaagaacgacgttgtggggacaacctacctgcatttgtcaaaaatcgccgcaagtggaggagaggtcgaagatttctccagcagcggtacaggtgctgccagctacaccgtgaatacaggtgagaccgaagtcggcttcgtacccacttttggaccatgctatcttaatttgtatgggagtcccagggaatacacagggttcccagatccttacgacgagcttaataccggcaagggggaaggtgtagcctaccgcggaaggatcctggtcgagctggccacattcctggaaaaaacccccccagataagaagctcgagcccatcagcaatgatgatctcttagtggtggagaaataccagagacgcagaaagtactcattatcggcagtgttccactccgccacaatgttgcaggacgttggcgaggctattcaatttgaggtctcaattggaaattatggcaataaatttgatacaacttgcaagcctctcgcttccacaacccaatactcaagagctgtgttcgacgggaactactactattatttaccgtgggcacatacaaaacctgttgttacactgacaagttactgggaagacatttcacacagactcgacgccgtgaatacgctcctggctatggctgagcgtctccagaccaacatcgaggccctcaagtcgggaatccagggtaagatccctgccaaccagttggctgaactatggcttaaactgattgacgaagttatcgaggacactaggtacacccttcccctgactgagggcaaggcaaacgtcactgtgcttgacacacaaatcaggaagctacgtagcaggtccctgagccaaattcacgaggcggcagtaagaatgcggagcgaggccacagacgtcaagagtacactcgccgaaatagaggattggttggacaagcttatgcaactcacggaggagcctcagaactctatgcccgatattattatctggatgatacgcggtgagaagagactggcttacgcgagaatcccagcgcaccaggttctatatagtacctctggcgaaaacgcatccggcaagtattgtggtaaaactcaaaccatcttcctcaaatatccacaggaaaagaacaatggaccaaaggtgccagtcgaactccgagtgaacatctggttgggcctgtccgctgtggaaaaaaagtttaacagctttgccgaaggcacctttaccgtcttcgccgaaatgtacgaaaaccaggccctgatgtttggcaagtggggcaccagcggattggtgggcagacacaaattctcagacgttacaggtaaaattaagctcaagcgggagttcttcttacccccaaagggctgggaatgggaaggtgaatggatagtagatcccgagaggagcctgctgaccgaggcagatgcaggccacactgaattcacagacgaggtgtatcaaaacgaatccaggtaccctggaggagattggaagcctgctgaggacacgtataccgatgccaacggcgacaaggccgcatccccatccgagctcacctgtccccctggctgggaatgggaggacgacgcgtggtcttatgatatcaatagagccgttgatgagaagggctgggagtacgggattacgattccccctgatcacaaacccaagtcatgggttgccgctgagaaaatgtaccacacgcatagacgccgacggctggtccggaagcggaagaaggacttgacccagactgccagctccaccgcaagagcgatggaagagctgcaggatcaggaggggtgggagtatgcaagcctgattggttggaaatttcactggaagcaaaggtcatccgacacattcagaaggcggcgatggcggaggaagatggctccaagtgaaacccatggcgcagccgctatcttcaagctggagggggctctgggtgccgacaccacagaagatggcgacgaaaagtccttggaaaaacaaaaacattctgccaccacagtcttcggtgccaatacaccaatcgtttcctgtaactttgatcgggtgtatatttaccatctgaggtgctacgtttatcaggccaggaatctactggctcttgataaggactccttctcggatccctatgcccacatttgttttcttcacagatctaagaccacagagataattcatagcaccctgaacccaacttgggatcagaccatcattttcgacgaggtggaaatttacggcgaaccacaaacagtgctgcagaatccccctaaagttataatggagctgttcgataacgatcaagtcgggaaggatgagttcctcggacgctccattttttctccagtcgtaaagctgaactctgaaatggatattacacccaaactcctttggcaccctgtgatgaatggtgataaagcctgtggcgacgtgctcgtgactgcggagcttatcctgcgcggaaaggacggctccaacctacctatcttgccacctcaacgcgctccaaacttgtacatggtgccccagggcatcaggcccgttgtgcagctgaccgccatcgagattttggcctggggcctccgcaatatgaaaaattttcagatggcaagcattacatccccatccctagtggtggagtgtgggggagaaagggtcgagtcggtcgtcatcaagaatctgaaaaaaacccctaactttccgtcatcagtcctgttcatgaaggtcttccttcccaaagaggagctgtacatgccaccactggtgatcaaggtgattgaccaccgtcagttcggcagaaagcctgtcgtaggacagtgcaccatagaacgcctcgaccgttttaggtgcgacccctacgctggtaaagaggatatcgtcccgcagttgaaggccagccttctgtccgccccaccatgtagggatattgttatcgagatggaggacactaaaccccttcttgcaagcaagctggtatccatagaagaagaaatcgtggattggtggtccaaattctatgcgtcatcaggcgagcatgagaaatgtggccagtatatccaaaagggttactccaagttgaaaatatataactgcgagttggaaaatgtggctgaattcgagggcctaaccgacttctccgacacatttaagctgtataggggcaaatcagacgagaacgaggatcctagcgtggtcggagaattcaaaggatctttccgcatttacccactgcccgatgacccatctgtcccagcccctcccagacagtttcgcgagctgcccgactctgtcccacaagagtgtacagtgcgaatctatattgtgaggggactggagctccagccccaggataataacgggctatgtgacccatacatcaaaataaccctggggaagaaagttattgaagatcgagaccactacattcctaacacactaaatcccgtttttgggagaatgtacgagctatcttgctacctgccccaggagaaggacctcaaaattagtgtttatgattacgataccttcacccgcgacgaaaaagtcggtgaaaccattatcgatctcgaaaaccgcttcttatcgaggtttgggagtcactgcggaatccccgaggaatattgcgtgtctggggtcaacacgtggagagaccagctccggcctacgcagttgctgcagaatgtagcacgattcaagggtttcccccagccgatcctctctgaggatggctcacgaatccgatacgggggacgggactattcactggatgagttcgaagctaacaaaatactgcatcaacacctgggcgcaccagaagagcggttggcacttcacatcttaagaacccaggggctcgtgccggagcatgtggaaacacggacactgcattccacttttcaacctaacatctcacaagggaaattacagatgtgggtcgatgttttccccaagagcttaggtccacctggcccaccgttcaatatcacacctcgtaaagctaagaaatactacttgagggtcattatttggaatacaaaggatgtgatcctggacgaaaagagcattactggtgaagagatgagtgatatttacgttaagggttggataccgggaaatgaagaaaacaaacagaagactgacgtgcactatcgaagcctcgatggcgaaggaaactttaattggcgattcgtattcccttttgactaccttccagcggaacagctatgcattgtggctaaaaaagaacacttttggagcatcgatcagaccgaatttaggattcccccacggctgattattcaaatttgggataatgataaattttccctggacgattatctcggatttctggaattagatctgagacataccatcatccccgctaagtcaccagagaagtgtcgtctggacatgattcctgatctgaaggccatgaacccgctaaaagccaagactgccagcctgttcgagcagaaatcaatgaaaggttggtggccatgttacgccgaaaaggacggagctagggtcatggctggcaaggtcgagatgactctggagattctgaacgagaaagaagcggacgagcggccagctggtaaaggccgagacgagccaaatatgaatcctaagctggacctccccaaccgcccagagaccagcttcctgtggtttacaaacccctgcaaaaccatgaagttcattgtatggcgcaggtttaaatgggtgattatcggcctcctgttcctcttgattttacttctgttcgtggctgttctgctatactctctcccgaactatttgtccatgaaaatcgtcaagcctaacgtgta

SEQ ID NO: 51918 - DNA, 6156 bp, Artificial Sequence
  Description of Artificial Sequence: Synthetic coding sequence
atgctgcgtgtgatcgtggagtctgcctccaacatccctaaaacaaagttcggcaagccagaccctatcgtgagcgttatcttcaaggacgaaaagaagaaaaccaagaaggtggacaatgagttgaatcctgtgtggaatgaaattctcgagttcgatctgagagggatccctcttgatttttctagtagtcttggcatcattgtgaaggacttcgaaacaatcggtcaaaacaagctgattggtaccgcaacagtggcactcaaagacctcaccggggaccagtcccgcagcttaccatataagcttatcagtctgctgaacgagaaagggcaggatactggggctaccatcgacctggtgatcggctacgacccgccatccgcccctcatcctaatgacttgagcggcccttccgttcccggaatggggggagatggggaggaggacgaaggcgatgaggatcgccttgacaatgcagtgcggggacctggtcccaagggtcctgtcggaactgtgagcgaagctcagctagcaagacgtctgacgaaggtcaagaactcacggagaatgttatccaataaacctcaagactttcaaattcgcgtgcgagtgattgagggcaggcaactctcgggcaataacatccgaccagtggtgaaggtgcacgtgtgtgggcaaacacatcgaacccggatcaagagggggaacaaccctttctttgatgagttgttcttctacaacgtgaacatgactccaagtgaactgatggacgagataattagtatccgtgtttacaatagccactccttgcgggcagactgtctcatgggagaattcaagatagacgtgggttttgtgtatgacgaacctggtcacgctgtgatgagaaaatggctcttactgaacgatcctgaggatacgtccagcgggagtaaaggatatatgaaagttagcatgtttgtcctgggaacgggggacgagccaccccctgagcggcgagaccgggacaatgatagtgacgatgttgaatccaatctactacttcccgctggcatagctctgcgatgggttacgtttcttcttaagatttatagggctgaggatatcccacagatggacgatgcattctctcagacagtaaaggaaatctttggaggcaacgctgacaaaaaaaacctggttgatccattcgttgaggtgagttttgccggaaaaaaagtgtgtactaacatcattgaaaagaatgctaatcctgagtggaaccaggtcgttaatctgcaaataaagtttccctctgtctgcgagaagatcaaactgaccatttatgactgggatagactgactaaaaatgatgtcgtcggaaccacttatctacacttgtcaaaaatcgcagcctcggggggagaggtggaagacttcagctcttcaggcaccggcgctgcttcttatacagtgaacactggtgagacggaagtgggattcgtgcccacatttggcccatgctacctgaacctctacggatccccgagggaatatactggtttccccgatccttatgacgagttaaacaccgggaagggggaaggagttgcctaccggggacggattctggtggaactagcaactttcctcgagaaaaccccccctgacaagaaactagagccaattagtaacgacgacctcctcgtggtggaaaagtaccagcggcgacgcaaatactcactttcagcagtgtttcatagcgccacgatgctgcaggatgtgggggaagccatacagttcgaagtgagcattggtaactatggaaataaatttgacaccacttgtaagcctttagcatcaactacgcagtactcaagagccgtgttcgatggtaactattactactacctgccttgggcgcacactaagcctgttgtgactctcactagctactgggaggatatttctcacagactcgatgctgtgaacactctgctcgcgatggctgagcgcctgcagaccaatatcgaggcactcaaaagcggaatccagggcaaaatacctgccaaccagctggcagagctgtggctgaaattaatcgatgaagtgattgaggacacccggtacacgcttccactgacggaagggaaggctaacgtgaccgtgttggacactcaaattagaaagctgcgatctaggtctctctctcagatccacgaagccgcagttcgaatgcgcagtgaagctacagacgtgaagtccacactggctgagatagaggactggctcgataagctgatgcaattgacagaagagccccagaattcaatgcccgatataatcatatggatgatcaggggcgaaaaaaggctggcgtatgccagaatcccagcacatcaagtactctacagtaccagtggcgagaacgcatctggaaagtactgtggtaagacccagactatatttctcaagtatccgcaggagaagaacaacggtccaaaggtgccagtggaattacgggtgaatatttggctgggtctgtccgcagtggagaagaagttcaactcctttgctgagggcaccttcaccgttttcgctgaaatgtacgagaaccaggctctcatgttcggcaagtggggaacttccggacttgttggccgtcataagttttctgacgttaccggtaagataaagctgaagcgggagttttttctgcccccaaagggctgggagtgggagggagagtggatcgtggaccctgaaagaagcttgcttaccgaggccgacgctgggcacactgagtttaccgacgaggtgtaccagaatgagagcagatacccaggcggtgattggaagccagccgaagatacatatacagacgcaaatggcgacaaagcggctagccccagcgaattgacttgccctcctggctgggaatgggaggacgatgcctggagctacgacatcaacagagccgttgatgagaagggatgggaatacggtatcaccatccctcccgaccacaagccaaaatcttgggtggcagcggagaagatgtaccacacccacaggcgcagacgtcttgtacgcaagaggaagaaagacctgacacagactgcctccagcacggcccgtgcaatggaagagcttcaggatcaggagggctgggagtatgcctcacttattggttggaagttccactggaagcagcggtcaagcgacacatttagacggaggagatggaggaggaagatggcaccctcagagacccatggcgcagctgcaatcttcaagctcgagggtgctctgggagcggatacaaccgaagacggggacgagaagtctcttgaaaaacagaagcactcagcgacgacagtcttcggtgccaacacccccatagtgagctgtaacttcgacagggtctatatctatcatttgcgttgttacgtctaccaggcacggaacctgctagccttggacaaagatagcttttcagacccctatgctcatatttgttttctgcatagatccaaaacaaccgagattatacatagcactctcaaccccacatgggaccagacgatcattttcgatgaggtggagatatatggggagcctcagactgtgctccagaatccacccaaggtgatcatggagttatttgataacgaccaggtgggcaaagatgagttcctgggcagaagcatctttagcccagttgtgaagctcaattccgagatggacatcacccccaagcttttatggcaccccgtcatgaatggcgacaaggcatgtggtgatgtcctcgtcactgctgagctcatcctgagaggtaaagacggctcgaatctgccgattctgccaccgcaaagagcccctaacttgtacatggtcccccagggcattagacctgtcgtgcaactgacagcgatcgagatactggcctgggggctgaggaatatgaaaaacttccagatggcatcgatcacctccccatccctcgtggtggaatgtggcggagagcgggtggaatccgtggtgattaagaacttgaagaagacgccaaattttccgtcctcagtgctctttatgaaggtgttcctaccgaaggaagaactgtacatgccaccccttgtcatcaaagtgattgatcataggcaatttggtcgcaagcccgttgtcgggcagtgtacaattgagcgactggatagatttaggtgcgatccctatgccggtaaagaggatatagttccccagttaaaagcctccttactgtcagctccaccttgccgggatattgttattgagatggaagatacaaagccgctccttgcaagcaaatgtttatcctctatgagcactgcccttagcaaaatggcctcccctgccaccgtccatgtcttggatgaggaggaagaaatcgtcgactggtggagtaaattttatgcaagttcgggagaacacgagaaatgtggccagtatatccagaagggctactcgaagctgaaaatatataactgtgaactggaaaacgtggcagaatttgagggcttaaccgatttctccgatacctttaaactataccgagggaaaagcgatgaaaacgaagatcccagcgtggtaggtgagttcaaaggatcatttcgaatttatccgctgcccgatgacccctctgtaccggcacctcctcggcagtttcgagagctgccagatagtgtccctcaggagtgcacggtcaggatttatatcgtgcggggtctggagctgcaacctcaagacaacaacggactttgtgacccgtatataaaaatcacactgggcaaaaaggtgattgaggacagggatcattatatccctaatacccttaatcccgttttcggaagaatgtacgagctgagctgttacctgccccaagaaaaggacctgaagataagcgtgtacgattacgatactttcacacgcgacgaaaaggtcggggaaacaatcattgatctagaaaatagatttctgagtcggtttggctcacattgcgggattcccgaagagtattgtgtttccggcgtaaatacctggagggatcaactgcggccaactcaactccttcagaacgttgcgcgatttaagggattcccacaacctattttgtcggaggacggctctaggataagatatggaggtcgagattacagtctcgatgaattcgaagcaaataaaatcctgcatcagcacctaggtgctccagaagaacgcctggctttacacatactccggacacaaggcctggtccctgagcatgtggaaactcggacccttcattcaacattccagccaaacatttcccagcggtactatctccgggtcataatctggaacacaaaggatgtgatccttgacgagaaatccataaccggagaagaaatgtccgatatttacgtgaaaggttggattccaggcaacgaagaaaataaacagaaaacagatgtccactacaggtccctggacggagaaggcaattttaactggcggtttgtgttccctttcgattatcttccggctgaacagctctgcattgtggcaaaaaaagaacacttttggagtatagatcagaccgaatttcgcatacctccccgactcattattcagatctgggacaacgacaagttctctctggacgactacctcggattcctcgagctggacttaaggcatacgatcatacccgctaaatccccagagaaatgcaggttggatatgattcccgacctcaaggccatgaacccattgaaggctaagacggcaagtctgttcgagcagaaatcaatgaaaggttggtggccatgctacgctgagaaggacggagctcgcgttatggctggtaaggtggagatgactcttgaaatcctcaacgaaaaagaggctgatgagcgccctgcaggtaagggcagggacgaacccaatatgaaccctaagctggacctgcccaaccgccctgagacgtccttcctctggttcacgaacccctgtaaaacaatgaaatttattgtgtggagacgcttcaagtgggtcattatcggattactcttcttattgatattattgctctttgtcgcagtacttctgtactctctgccgaattacctctcaatgaagatagtgaagcccaacgtctac

SEQ ID NO: 51919 - DNA, 873 bp, Artificial Sequence
  Description of Artificial Sequence: Synthetic coding sequence
atgcatcctatcaacgttcgacgcgacccatcgattccaatttatggcttaagacagagcatcctgctgaacactaggctccaggattgttacgtagatagcccggcattgactaacatttggatggcacggacatgtgccaaacagaacattaacgcacctgcccctgcaactacaagctcctgggaagttgtgcggaaccctttgatagcgtccagctttagcttggtgaaattggtgctcaggaggcaattgaaaaacaagtgctgtccgccaccatgtaagttcggggagggaaaacttagcaagcggctgaaacacaaagatgatagtgtgatgaaggctactcaacaggctcgaaaacgcaacttcatctcaagcaagagcaagcagccagccggacacagacgccctgcaggtgggatccgcgagtccaaggaaagttctaaagagaagaagctgacggtaagacaggatctagaggaccggtacgcagaacatgtcgctgctacccaagctctgccacaagattccggtaccgccgcttggaaaggcagagtgctgctgccagaaacacaaaagaggcaacagttgagcgaggatactcttacgattcatgggctccctacagaagggtaccaggccctgtatcacgccgtggtcgagcctatgctctggaatccatcaggcactcccaagagatactcactggaactgggaaaggccatcaagcaaaaactctgggaagcgctctgttcccagggagccattagtgaaggtgcacaaagggaccgtttccccggtagaaagcagccaggagtccacgaagagcctgtcctgaaaaaatggccaaaactgaaatcaaaaaagtag

SEQ ID NO: 51920 - DNA, 813 bp, Artificial Sequence
  Description of Artificial Sequence: Synthetic coding sequence
atgaaggtcacggtgggtcccgatccctccttggtatatcggccagacgtggaccccgaagtcgctaaggacaaggctagctttcggaactacacgagtggtcctctgctggaccgggttttcaccacatacaaacttatgcatactcaccagacagttgacttcgtccggagtaaacacgcccagttcggcggattcagctacaaaaagatgacggtgatggaggccgtagatctgctggacggcctggtggatgagagtgatccggacgtggatttccctaactccttccacgcctttcagacagctgagggtattcgaaaagctcacccagacaaggactggtttcaccttgtcggcctgctacacgacctggggaaagtactggcgctgttcggggagccccagtgggccgttgtcggcgatacgtttcccgtcggctgccgccctcaggcgagcgtcgtgttctgtgactccaccttccaggataatccggacttgcaagatccgcgttactcaaccgagctggggatgtaccagcctcactgcggactcgaccgggtgctgatgtcatggggccatgacgagtacatgtaccaagtcatgaaatttaataaattctcacttccacctgaggccttctacatgatccggtttcacagcttttacccgtggcatacaggacgcgactatcagcagctgtgcagccagcaggacctagcgatgcttccttggcaagtccgacctcttcatcaagtccctggcccagccggacgcggtcaagctgccgcactgctgcccggtgctcactag

SEQ ID NO: 51921 - DNA, 696 bp, Artificial Sequence
  Description of Artificial Sequence: Synthetic coding sequence
atgaaggtgactgtgggcccagacccatctttggtgtaccgacctgacgtcgaccccgaggtggcaaaagataaggcgtcatttaggaactacacatctggacccctgctcgaccgggtcttcaccacatataagctaatgcacactcaccagacggtggacttcgtgcgctcaaaacacgctcagttcgggggtttcagctacaaaaaaatgaccgttatggaagcggtggacctgctcgacgggctcgtcgatgaaagcgaccccgatgtagatttcccaaattcgttccatgccttccagaccgcagagggtatccgaaaggcgcaccccgataaagtgcccaacttgccctgcccgtcccccagccagactggatcgacttcttctgggtcctgcacaacctgggggagaagctggccatgcagcggatccccatctgggctctctagcgcgaccccttcgccctctgacgctgtgagacggccaccctggttcagcgcaactccccctagtcgtaccacactcacatctaggattttagacactgctcagtcatctggatgcatctcccctaccgttggttccaccgggtcttcttgcccgggagccatgatgcaggtaaggcctctacaccaagtccccggtccagctggacgcggacaggctgcagcactgctccctggggcacactag

SEQ ID NO: 51922 - DNA, 798 bp, Artificial Sequence
  Description of Artificial Sequence: Synthetic coding sequence
ggtcctgatccctcactcgtgtatagaccagacgtagaccctgaggtcgctaaagacaaggccagcttcaggaactacacttcgggccctctgctggatcgggtgtttaccacatataagttaatgcacacccaccagaccgtggatttcgtaagaagtaagcacgcacagtttggagggttctcttataagaagatgacagttatggaagcagtggacctgctggatggcctagtcgacgaatccgatcctgacgtagactttcctaacagctttcacgccttccagacggcagagggtatccgcaaggcccatccagacaaggactggtttcacctagtaggcttactgcacgacctgggcaaggttctggcactctttggggaaccacaggccagtgtcgtgttttgtgattcgacctttcaggataatccagatctgcaagatccgaggtatagcactgagcttggaatgtatcagccccactgcggtctggatagggtactgatgagttggggccacgatgaatacatgtaccaggtcatgaaatttaacaagttcagcctcccacctgaagccttctacatgataaggttccattcgttctacccgtggcacaccggtcgggattaccagcaactgtgtagtcagcaggacctagcaatgctaccctgggtgagagagtttaataaatttgacctttatacaaagtgcccagatttgcctgacgtggacaaactgcgcccatattatcaggggctaatagataagtactgcccgggaatactgtcttggtag

SEQ ID NO: 51923 - DNA, 2823 bp, Artificial Sequence
  Description of Artificial Sequence: Synthetic coding sequence
atggaaatcgaccagtgtctcctcgagtcactacccctaggacagcggcagaggctcgtgaagcggatgaggtgcgagcagatcaaggcgtattacgaaagggagaaagcctttcaaaaacaggaaggcttcttgaaaagattgaagcatgccaagaaccctaaggttcatttcaatttaacggacatgttacaggacgccattattcaccacaatgacaaggaagtgctgcggctcctgaaagagggggctgatccccatacgcttgtgtcttctgggggttccctgctccacctgtgtgcaagatacgataacgcatttattgccgaaatattgatagacagaggcgtcaatgtaaaccaccaggacgaggatttctggactcccatgcatattgcctgcgcatgcgataaccccgatatcgtactgctgttggtgctcgccggtgctaatgtgcttctccaggatgtcaatggaaacatccccctggattatgcggttgaaggtacagaaagttctagcatcctcctcacctacctcgatgagaatggggttgacctgacgtcactaagacaaatgaaactgcagaggcctatgtctatgcttactgatgtgaaacattttttgtcatccggcggtaatgttaatgagaagaacgacgaaggagtgacccttctgcatatggcttgcgctagcggatacaaagaggtcgtctcactgatactggagcatgggggagaccttaatatagtagacgaccagtactggacacctcttcacctcgctgccaagtacgggcagaccaatcttgtgaaactcctgttaatgcatcaggccaaccctcatctcgtgaattgcaatgaggaaaaggcttctgatattgctgcatccgagtttatcgaagaaatgttgctcaaagccgaaattgcttgggaagagaagatgaaagagcccctgtccgcctccaccttggcccaggaagagccctatgaagagatcattcatgacctaccagttttgtcatcgaagctgtccccactggtgcttccaatcgcgaagcaggacagcttgcttgaaaaagatatcatgttcaaggacgcaactaagggactctgcaagcagcagagccaggattccattccagagaatcctatgatgtctggcagcaccaagccagagcaggtgaaactgatgccgccagccccaaacgatgatctggctacgctttctgagctgaatgacggcagtctcctctatgagatccagaaacgtttcggtaacaaccagatctacacgttcataggcgacattctcctgcttgtgaacccatacaaggaactgccaatatactcttcaatggtgtcccagttatacttttcatcgtccggaaaactgtgtagctccctgcccccacatctgtttagctgtgttgaaagggcattccaccagctatttagagagcagcgtccccagtgcttcatcctttccggcgaacgcggaagcgggaaatccgaagcttcgaaacagattattaggcacttgacttgtcgcgctggggcatcccgagcaactttggatagcaggttcaagcacgtggtgtgtatcctcgaagcgttcgggcacgccaaaactacgctcaacgacctgagtagctgcttcataaagtatttcgaactccaattctgtgaaagaaaacagcagttgacgggcgctcgcatctatacatatctgctcgaaaagagcagattggtatcacaaccactgggacagtccaacttcctcattttttacttgcttatggacgggctttcagccgaggagaagtacgggcttcatttgaataacctttgcgctcataggtacttaaatcaaacaatccaggacgatgcgtcgacgggcgagaggtcattaaaccgggaaaagctcgcagtgttgaagcgcgcactgaacgtcgttgggttctcctcgctggaggtagagaaccttttcgttatactggcagccatcctgcatctcggagacataagattcaccgcgcttaatgagggaaatagtgctttcgtttccgacttgcagttgctcgaacaggtcgctggaatgctacaggtctccaccgatgagctggctagcgctttaacaactgatattcaatattttaagggcgacatgatcatcaggcggcatacaattcaaatcgccgagttttttagagacctactcgctaagtcactgtattcacgcctgttttcctttcttgtgaataccatgaattcatgtcttcactcacaagacgaacagaagtcaatgcagacactggacatcggcattttagatatcttcgggtttgaggagttccagaagaacgagttcgagcagctttgcgtcaacatgacgaacgagaagatgcaccactacatcaacgaagtactgttcctccatgaacaagttgagtgcgttcaagaaggagttactatggaaaccgcctactcaccagggaatcaaaacggggtgctcgattttttctttcaaaaaccctctggcttcttgactctgctcgacgaggagagtcagatgatttggtcggtcgaatccaatttccccaagaagctacagtcactcctcgaatcctcaaatactaatgctgtgtactctcctatgaaagatgggaacggaaacgtcgccctgaaagatcatgggactgcgttcaccatcatgcattacgcgggtcgggtgatgtacgacgtcgttggagcaatcgaaaagaacaaggattctctctctcagaatctccttttcgtcatgaagcgtgggagatgcttctag

SEQ ID NO: 51924 - DNA, 5576 bp, Artificial Sequence
  Description of Artificial Sequence: Synthetic coding sequence
atggagattgaccagtgtctgctcgaaagcctccctctgggccagcgccagcgactggtaaaaaggatgcggtgtgagcagataaaagcatattatgaacgagagaaggcatttcagaagcaagaggggtttttgaaaaggctcaagcacgccaagaacccaaaggttcactttaacctgactgatatgctccaggatgctatcatccaccataacgacaaggaagtcctaagacttctaaaagaaggggcagatccacataccctcgttagttcaggcggatcactgcttcacctgtgtgcacggtatgacaacgcattcatcgccgaaattcttatcgatcggggagtcaacgttaatcaccaggatgaagatttctggactccgatgcatatcgcttgcgcttgtgacaaccccgacatcgtgcttttactagtgctggcaggagcgaacgtgctcctgcaggatgtgaacgggaatatccctctagactacgctgtcgaggggacagagtcctccagtatactgctcacatacctggacgaaaacggagtcgacctgaccagtctgagacagatgaaactacagcggccaatgtctatgctcacagacgttaagcactttctgagttcgggcggaaacgtgaacgagaaaaatgacgaaggggtcacgctgctccacatggcctgtgcctccggttacaaagaagtcgtgtccttgatcctggagcacggaggagatctgaatatagtggatgatcagtactggactcctctgcatcttgcggcaaaatatggccagacgaatctcgtgaagctcctgctgatgcaccaggccaatccccatctggttaattgcaatgaggaaaaggcctcggacattgcagcatccgagtttatcgaagagatgctgctgaaggctgaaatcgcttgggaagaaaaaatgaaggagcctctttcagcttctacactggcccaggaggagccctacgaagagatcattcacgatctgcctgttctgtcgtccaaactctccccactggtgctccccatcgccaagcaggacagtctcctagaaaaagacatcatgtttaaagacgccaccaaaggtctttgtaaacaacagtcacaagacagcatccctgaaaatccaatgatgagcggatcaaccaagccagaacaagtgaaactaatgccaccagccccaaatgacgatctggctaccctttccgagctgaacgacggtagtctgttatacgaaattcagaagcgatttgggaacaaccagatttacaccttcattggggatatcctgctcctcgttaacccctacaaggaactgccgatctacagttcaatggtgtctcagctttacttttcctccagcggcaaactgtgttctagcttgcctcctcacctgttcagctgcgtagagcgcgctttccaccagctctttcgggagcagagacctcaatgttttatcttatcgggggagcgcggatccggcaagtcagaagcaagcaagcagattatcagacatctgacgtgtagggccggagccagccgcgcaaccctggactcaaggtttaaacatgtggtgtgtattcttgaggctttcgggcacgccaagactactctaaacgacctgtccagttgtttcatcaagtatttcgagctgcaattctgcgagcgtaagcaacagctgacaggcgctagaatctacacttatctcttggagaaatccaggcttgtcagccagccactgggtcagagcaactttcttattttctatctgctcatggacgggttgagtgctgaagagaagtacggtctgcacctcaacaatctgtgtgcccataggtacctgaatcagaccatccaggacgatgcatcaacgggagagcggagcctcaaccgggagaagctcgccgtactgaagcgcgcactgaatgtggtaggcttttcctctttggaggtcgagaatctgtttgtcattctcgcagcgatcttacacctgggagatatccgtttcactgcccttaatgagggaaatagtgcattcgtttcagacctgcagctgctagaacaggtcgcgggtatgctgcaggttagcacagacgagctagcaagtgcactgacaaccgacattcagtatttcaagggagacatgataattaggagacatactattcaaattgccgagttctttcgcgacctgctggcgaaatcgctctactcacgactcttttcattcttggtgaacaccatgaatagctgtctgcactcccaagacgagcagaagagtatgcagaccctggatatcggcatactggacatatttgggttcgaagaatttcagaaaaacgagttcgagcagctgtgcgtgaacatgaccaatgagaagatgcatcactatattaacgaggtcctgtttctgcacgagcaggtggaatgtgtgcaggaaggcgtcaccatggaaacggcctactcacctggcaaccagaatggtgtcttggactttttttttcagaaaccatctggtttcctgactctgctggacgaggagtcccagatgatttggtctgtggaaagcaatttccctaaaaaactccagtctctcttggaatcctcaaatactaacgcagtgtacagccctatgaaagatggcaacggcaatgtggcactaaaggaccacggtacagcatttaccatcatgcattacgccggacgagtaatgtacgacgttgtgggtgccatcgaaaaaaataaagactcgctctcccagaaccttctgtttgtgatgaagacttccgaaaacgtggttatcaatcacctctttcagtcgaagctgagccaaaccgggtcccttgtctccgcatacccatcattcaagtttaggggacacaagagtgctctgctcagtaagaaaatgacagccagctcaatcattggtgagaacaaaaattatctggagctctccaagctgttgaaaaaaaaggggacctctacctttttgcagcggctggaacgaggagaccccgtcaccatcgcaagccagttacgcaaaagcctcatggacattatagggaaactgcagaagtgcaccccccacttcatccattgcatcagaccaaataactcaaagctgccagatacttttgacaatttctacgtttccgcgcagctgcagtacatcggtgtgctggagatggttaaaattttccgttacgggtatcccgtcagattatcattttcagacttcctttccaggtacaaaccgttggccgacacatttttaagagagaagaaagagcagagtgctgccgaaagatgccgattagtactgcagcaatgcaagctccaggggtggcaaatgggagtgaggaaggtgtttctgaaatattggcacgccgaccaactgaacgacctgtgtttgcagctgcagaggaagatcataacatgccaaaaggtgatccggggttttttggcgagacagcatctgctgcagagaatctccatccgccaacaagaggttactagcataaattccttcttgcagaacaccgaggatatgggcctcaagacctatgacgctctcgtaatacaaaatgcgtctgatattgctagagaaaatgaccggctgcggtctgaaatgaacgcaccataccacaaggagaaactggaagtacggaatatgcaggaggaagggtccaagcgaacagacgataaatccgggccacgacacttccatccctcctcaatgtccgtgtgcgcagcagtggacgggcttggacaatgccttgtgggcccttctatctggagcccaagcttgcattctgtcttcagcatggatgactcttcgagtctgccttctccaagaaagcagccaccacctaagcccaaaagggatcctaacacaaggctgtctgcctcctatgaggccgtgtctgcctgtctgagcgcggctcgggaagcagcaaatgaggcactggcccgaccgagacctcacagtgatgactatagcactatgaagaagataccacctcgaaagccaaagcggtctcccaacactaaactgagcggttcttacgaagagattagtgggtcccgaccaggcgatgcgcgtcctgccggagctcccggagccgctgccagagtgttaaccccaggcactcctcagtgtgctcttcctcccgctgcacccccaggagacgaagatgattccgaaccagtgtacattgagatgttaggccacgctgccagaccagattcgcctgaccctggagaatcggtatatgaagaaatgaagtgctgcttacctgatgacggaggcccaggagccggatctttcctgctgcacggcgcatctccccctcttcttcacagggcaccagaggacgaggctgccggacctcctggcgacgcctgtgacattccaccacccttcccaaatcttctgccccacaggccccctctcctcgtcttccctccaacccccgttacgtgcagcccagcgtctgacgagtctcccctaacacccctcgaagtcaagaagcttccagtcctggagaccaatctgaagtacccagtgcagcctgaaggctcctctccgctgagcccccagtattctaaaagccaaaagggcgatggcgacaggcctgcttctccgggattggctctgtttaacggctccggccgagcaagcccaccttccacccccccaccccctccccctccacctgggccacctccggctccctatcgcccatgcgcacatctggcattcccccctgagccggctccggtgaatgcaggtaaggccggaccgagtgccgaagctccaaaagttcacccaaaacctaatagtgctcccgtggctggtccctgcagcagcttcccgaaaattccctatagtcccgtaaaggcgacccgcgcagatgccagaaaagccggatcttccgcaagccccccagccccttatagcccaccttcatcgcgacctctttctagccccctagatgagctcgcttcactctttaactcaggccgatcagtactccgcaaaagcgccgcaggacgaaaaatccgggaagccgaggggtttgagactaacatgaatatctcttctcgagacgatccatccacttcagagattacctccgaaacgcaggaccgcaatgccaacaatcacggcatccagctgagcaattctctgagcagcgctatcactgctgagaatggaaatagcatctcaaacggtttaccggaagaggatggctactcccgcctcagcatttctggtacgggcacatctacctttcagcgacatcgagattcccacactacccaggtgatacatcagctgcggttgagtgagaacgagagtgtggctctgcaagagctgctggactggcggaggaagctgtgtgaggaaggacaagattggcagcagattctgcaccatgctgagcccagggtccccccaccaccgccttgcaagaagcccagcctgctcaagaaacctgagggcgcatcctgcaacaggctgccctcagaactgtgggataccactatcta

SEQ ID NO: 51925 - DNA, 5576 bp, Artificial Sequence
  Description of Artificial Sequence: Synthetic coding sequence
atggagattgaccagtgtctgctagaatccctgccactcggccagaggcaaaggcttgtgaaacgaatgcggtgtgagcagattaaggcctattacgaaagggaaaaggctttccagaagcaagaaggctttctgaaaagactaaaacacgctaaaaacccaaaggtccatttcaacctgaccgatatgcttcaggatgccattatccatcacaatgacaaggaagtcctacggctgctgaaggaaggcgctgacccccatacactagtgagctctgggggtagcctccttcacctttgtgccagatacgacaacgcatttattgcggagattcttattgaccgaggagtgaacgtgaatcaccaggacgaggacttctggacaccaatgcacatcgcttgtgcttgtgataaccccgatattgttctccttctggtcctggcaggagcaaacgtgctgttgcaggatgtcaatgggaacatcccgttagattatgcggtggaggggacggagtcaagctccattctgcttacctatctggacgagaatggagtagatctgactagcctcaggcagatgaagctgcagagaccaatgtcgatgttaacggacgtaaagcattttttgagtagcggtggaaatgtgaacgaaaagaatgacgagggtgtgacactcttgcacatggcctgtgcctcaggctataaggaggtggtgtcactcatcctggagcatgggggagatctcaatatcgtcgacgaccagtactggacaccactgcatctggccgcaaagtatgggcaaaccaacctcgtaaagctgctcctcatgcaccaggctaacccacaccttgtgaactgcaatgaggaaaaggccagtgatattgcagcttccgaattcatcgaagagatgttacttaaggctgaaatcgcctgggaagaaaagatgaaggagcctcttagtgcctctaccctggcccaggaggaaccatatgaggaaattattcacgacctgccagtgttaagctctaagctgtctccattagtgctacctatcgccaaacaggatagcctcctcgagaaagatatcatgttcaaggatgccacaaagggtttatgtaaacaacagagccaagattccatacccgagaaccccatgatgtctgggtctactaaacctgagcaggttaagctgatgcccccagccccaaatgacgacctcgcaacactgtccgaactcaatgatggaagtctactctacgaaatacagaaaaggttcggcaacaaccaaatctacacatttatcggcgatattctgttgctcgtgaatccatataaggaactgcctatctactctagtatggtttcccagctgtatttctcctcatctggtaagttgtgtagcagtctgcctccacacctgttctcctgcgtggaaagggcatttcatcagttgttccgcgagcaacgacctcaatgcttcatactgagcggtgaacgcggttctggaaagagtgaggcctccaagcagattatcaggcatttaacctgtcgagcaggagcctctagagccactttggacagtcgttttaaacatgtcgtttgtatcctagaggctttcggccacgctaagaccacgctcaatgacctctccagctgtttcattaaatactttgagctccagttctgtgagcgcaagcagcagcttactggtgcgagaatctacacctatctactggaaaaatctagacttgtctcccagcctctgggtcagtcaaacttcctgatcttctacctcttaatggacgggctgtcagctgaagagaagtacgggctccatttgaacaacttatgtgcccatagatacctaaaccagaccatccaggacgatgctagcacgggggaaagatctctgaacagagaaaaattggcagttcttaaaagagcgctgaatgtggtgggattctcgagcctagaggtcgagaacctgtttgtcattcttgctgctatcctacatctgggcgatatcaggtttactgctctaaacgaaggcaacagcgctttcgtcagcgacttgcagctgttggagcaggtcgcgggaatgctgcaggtatcaaccgacgagttagcgtcagctctgaccaccgatattcagtattttaaaggagacatgatcattcggaggcacacgattcagatcgctgagttttttagagatctgcttgccaaatcactatactccagattattctcctttctcgtgaatactatgaactcttgtctccactcccaggacgaacagaagagcatgcagaccctagacattggaatccttgatatctttggattcgaggaatttcaaaagaacgagtttgaacaactgtgcgtaaacatgacgaatgagaaaatgcatcactatattaacgaagttcttttcctgcatgaacaggtggaatgcgtccaggagggtgtgacaatggagacagcctatagccccggtaaccagaacggagtgctggacttttttttccagaaaccgagcggatttcttaccctgctcgacgaggagagtcagatgatctggagtgtggaatccaattttcctaagaaactgcagtccctgctagaatcttccaataccaatgctgtgtactctcctatgaaagacggtaacgggaatgttgccctgaaagaccacggtacggcattcactattatgcattatgctgggcgtgtcatgtatgacgtggtgggtgccattgagaaaaacaaagactccctatctcagaatctgcttttcgtgatgaaaacatcagagaatgtggtaattaatcacttattccagtccaagttgtcccagacaggttcgctagttagtgcctaccctagcttcaagttcaggggtcacaaatctgccctactgagcaaaaagatgaccgccagtagtataattggtgaaaataaaaactacctagaactgagcaagttactgaagaagaaaggcacaagtacctttctgcagagacttgagagaggagatcctgtcactatcgcctctcagctgcggaagtctctgatggatattattggtaagcttcagaagtgcacgccacacttcatacactgcatacgccctaataacagtaagctccctgacaccttcgataatttctacgtctctgcccagcttcagtacatcggcgtgctggaaatggtgaaaatcttcagatatggctacccagtgaggcttagtttttccgacttcctttctagatataagccactcgctgacaccttcctgcgcgagaaaaaggaacagagcgctgctgagagatgccgcttagttctccagcaatgcaagctccagggctggcagatgggtgtgagaaaagtctttctcaagtattggcatgccgatcagctgaacgatttgtgcctgcagctgcagcggaagatcatcacttgtcagaaggttatccgtgggtttcttgcccgtcagcacctgctacagcgcataagtatcagacagcaggaagtgacgtccattaattcattcctgcagaacaccgaagatatggggttgaaaacgtatgacgctctggttatacaaaacgcctcagacattgcccgtgagaacgatcgattgaggtcagagatgaacgccccataccacaaagagaaactcgaagtccgcaacatgcaggaggaagggagtaagaggactgacgataaatcaggccctagacatttccacccttcatccatgtctgtctgcgccgctgtcgatggccttggtcagtgtctggtcggaccctctatttggagcccaagcctgcattcagtcttctcaatggatgattccagttccctgccatcgcccaggaagcagccccctcctaaaccgaagcgggacccaaacacacgtctctccgccagctatgaagccgtgtccgcctgtctgagcgctgctagggaggctgctaacgaagcgctggctaggccacggcctcatagtgatgattacagcaccatgaaaaagataccccctagaaagcctaagcgatccccgaacaccaaactttctggctcatatgaagagatcagcggctctaggccgggagatgccaggccagccggtgctccaggagccgctgccagagtgctgaccccaggtacacctcagtgcgcgttgcctccagcagcccctcccggtgacgaggacgattctgagcctgtctatatagagatgttaggccatgccgcacgccctgattcacccgaccccggagagagtgtttatgaggaaatgaagtgctgcctgccagacgacgggggacctggagccggtagcttccttctccatggagccagccctcctctacttcaccgtgctccagaagacgaggccgcaggacccccaggagacgcctgcgatatccccccacctttccctaatcttctcccacatcgacctccactgctggtattcccccctacccctgttacttgctcaccagctagcgacgaaagccccctcacacctctagaagtgaagaagctgccagtgctcgaaacaaatcttaagtaccccgtgcagccagagggatcttcacctctttcccctcagtattcgaagtcccagaagggcgatggtgatcgacctgccagcccaggcctggcgctctttaacgggtccggaagagcatctccaccttccacgcccccacctccaccaccccctcccggacccccacctgccccatatcggccttgtgctcacctggctttccccccagagccagctcccgtaaatgctggcaaggcgggaccctcagctgaagcgcctaaggtgcatcccaaaccgaattccgctcccgtagcaggcccatgttcttcattcccaaagataccctattccccggtgaaggccacccgagctgatgccaggaaggccggaagttctgcatctccaccggcaccttactccccaccatcttcgcggcctctgagtagccccctcgacgaactcgccagcctatttaactcaggccgttctgttttacgaaagtcagcagctggacggaagatcagggaggccgaaggtttcgagaccaatatgaatattagtagtagagatgacccctcaacatctgaaattacttctgagacccaggacagaaacgcgaacaaccatggcatccaactcagtaattcccttagctccgccatcacggccgaaaacggcaatagtataagtaacggcttgccggaggaagatggctattctcgattgtctatcagcggaaccggaacatcaacctttcagagacacagggatagtcatacgacccaggtgatccatcagcttcggctgtctgagaatgagtccgtcgctttacaggaactgttagattggcggagaaaattgtgcgaggagggtcaagactggcagcagatcctccatcacgccgaacctagggtccccccacctcccccatgcaagaaacccagcctccttaagaaacccgagggagcctcatgcaatcgactgcctagcgaactgtgggacaccacaattta

SEQ ID NO: 51926 - DNA, 2637 bp, Artificial Sequence
  Description of Artificial Sequence: Synthetic coding sequence
atgaagcttcagcgccctatgtccatgctgaccgatgttctgcatatggcctgtgcgtcagggtataaggaggtcgttagtttaatactggagcacggtggcgatcttaatatcgtggacgaccagtactggacccctcttcatctggctgccaaatacgggcagaccaatctggtcaaactgcttctcatgcaccaggccaatccccatctggtaaattgcaacgaagagaaggctagtgatattgccgcatccgagttcatcgaggaaatgcttctcaaagccgagatcgcgtgggaagaaaagatgaaagaaccactcagcgcatccactctagcccaggaagagccttatgaagagataatccacgacctgccagtactctccagtaaactgtctccccttgttctcccaatcgccaagcaggactcactgctcgagaaggacatcatgtttaaagacgccacaaagggtctttgtaagcaacaatcacaggacagtatcccagagaaccctatgatgtccgggagcaccaagcccgaacaggtcaagctgatgcccccagcccctaacgacgatctcgccaccctgtccgaactgaatgatggcagcttgctgtatgaaattcagaaacgtttcggcaacaatcaaatctacacctttattggcgatatcctgctgctcgttaatccatataaagagctgcctatctactcctctatggtgagtcagctgtatttttccagctcaggcaagctatgttcaagcctccccccacatctgttttcgtgtgtagagcgagcatttcatcagctgtttcgcgaacaacgacctcaatgcttcattctgagtggcgaaagggggtctggaaagagcgaagcttcgaaacagatcattcggcatctcacttgcagggctggagcctccagggccaccttggactcccgcttcaaacatgtcgtgtgcatccttgaggctttcggccacgcgaagactactcttaacgatctctcgtcgtgctttatcaaatacttcgagcttcagttctgtgaaagaaaacagcagcttacgggtgctaggatatatacgtatctgctcgagaaatctcgactagtaagccaacctttgggtcagagtaatttcctcatattctacttgctgatggacggcctaagcgctgaagagaagtacggcttgcatctgaataatttgtgcgctcaccgatatctgaaccagacaattcaggacgacgcgtcaacaggcgagaggtcactgaacagggaaaagctcgccgttctcaaacgcgctcttaatgtagtcgggttcagcagcctggaggtggaaaatttattcgtgatactcgcggctatattacacttaggagacatccggttcaccgctctgaacgagggcaacagtgcgtttgtctccgacctgcaactgctcgagcaggtggcgggaatgttacaggtctcaactgatgaactggcatccgctctcactaccgacatccaatactttaagggagacatgatcatcagacgccatactatccagattgcagaattttttcgtgatcttcttgccaaaagtctttattcccggctcttttccttccttgtcaataccatgaactcgtgcctgcatagtcaggatgaacaaaagtcaatgcagacgctcgatatcggaatccttgatatctttggatttgaggagttccagaaaaacgagttcgaacagctgtgtgtaaatatgactaacgaaaagatgcaccactatataaatgaggtcctgttcctgcacgagcaggtggagtgtgtccaggaaggtgtgactatggagactgcttattctccgggtaatcaaaacggagtgttagacttcttttttcagaaacctagtggattcctgactctactcgacgaggagtcacaaatgatctggtctgtggagtcaaacttccctaagaaattacagtctctgttggaatcatctaacaccaatgctgtgtacagccctatgaaggacgggaacggaaacgtcgctctcaaagaccatggcacagccttcaccatcatgcattatgcaggacgcgtgatgtatgacgtcgtcggcgctattgagaagaacaaagattcgttgtcccagaacctactgttcgttatgaagacatctgaaaacgtggtgattaaccatctgtttcagtcgaaactctcacagaccggatcgctcgtcagcgcctaccccagctttaaattccgtggacataaatcagcccttttgtcaaaaaagatgactgcgtcaagcattataggcgagaataaaaactacctcgaattgagtaagctccttaagaaaaaaggaactagcacattccttcagagactagaacggggtgacccagtcacgattgcatctcagctcaggaaatcactgatggatataatcggcaaactccagaaatgtaccccacacttcattcattgcatcaggcctaacaacagtaagctacccgacaccttcgataacttctatgtctcagcccagctgcagtatataggggtgctggagatggtcaaaatatttcgctatggatatcccgttaggctgtctttttccgatttcttaagtaggtag

SEQ ID NO: 51927 - DNA, 2823 bp, Artificial Sequence
  Description of Artificial Sequence: Synthetic coding sequence
atggaaattgatcagtgtctgctggaaagtttgcccctgggtcagagacagcgcctcgtgaagcggatgcgatgcgagcagatcaaagcctattacgaacgtgagaaggcttttcaaaaacaggagggctttctgaaacggctgaagcacgctaaaaatcccaaggtgcactttaatttgacagacatgcttcaggacgccatcatacaccataacgacaaagaagtactgcgccttctcaaagagggtgcggaccctcacacgctggtcagttccgggggtagcttgcttcatctgtgcgcgagatacgataacgccttcattgctgaaatactcatcgatagaggcgtaaacgtgaatcatcaagacgaggacttctggactcccatgcacatagcgtgtgcatgcgacaacccagatatcgttttactgcttgtgctcgccggagcgaatgtattattacaggatgtcaacggaaatattcctctggattatgctgtggagggcactgagtccagctcaatcctcctgacctacctggacgagaacggggtggacctgacaagcctgaggcagatgaaattgcagcgcccaatgtccatgttaaccgatgtcaaacatttcctgtcatctggtgggaacgtgaacgagaaaaatgacgagggagtgaccctactgcacatggcgtgcgccagcgggtataaagaagttgtgagtctcattcttgaacacggaggtgaccttaatatagtggatgaccagtattggacacccttgcatttagcagctaagtatgggcaaacaaatctcgtcaaacttcttctgatgcatcaggctaacccgcatctagtcaattgcaacgaggaaaaagccagcgatatcgctgcttcagaatttatcgaggaaatgctcctcaaggctgagattgcatgggaggaaaagatgaaagaacctctgtccgcctcaacactggcccaggaagagccctatgaggagatcatacacgatctccccgtgctttcgagcaagctgagtccgctggtgcttcctatagcaaagcaggattctcttttagagaaggacattatgttcaaagacgcaacgaaaggactgtgcaagcagcagagccaggattctattcctgagaacccaatgatgagtggctccacaaaacctgagcaggtaaaactgatgcctcccgctccgaatgacgatctcgccactctctctgaactcaacgatggcagcctcttatatgagatacaaaagagatttggcaataatcaaatctatactttcatcggcgacatattgctgctggtcaatccatacaaggagctgcctatttattcctccatggtcagtcagctctacttcagttcaagcgggaaactctgttcatccctgccaccccatctattctcgtgcgtggaaagggcctttcatcagctgttcagggagcaacgaccacaatgcttcatcctcagcggggagaggggctctgggaagagtgaggctagtaagcagattattagacatctgacctgccgcgcaggcgcatcccgcgcaaccttggatagcagattcaagcatgtggtttgcatcctcgaggccttcgggcatgccaaaacaaccctcaacgatctctccagttgcttcattaaatattttgagctgcagttttgcgaaagaaagcagcagttgacaggtgccagaatttatacctacctcctagaaaagtcccgactggtgtcgcagccgctcggccaaagtaatttcctgatcttttatctgctgatggatgggctgagtgcggaggagaagtatggtctccacctaaacaatctatgcgcgcataggtacctcaaccaaacgatccaggacgacgcttccaccggggagcgctctctgaatcgcgagaaattagctgtactcaaacgagctctgaatgttgtcggctttagctcactggaagtggagaacctcttcgtgatattggcagcaatactgcatctgggagatattcggtttaccgcgctgaacgaaggtaacagtgcctttgtgagcgatctccagctcttagaacaggtggctggcatgctgcaggtgtccacagacgaactcgcctctgccctcacaaccgatatccagtacttcaagggagatatgattatcagacgtcacacaatccagatcgccgagttttttcgagatcttctggcaaaatccctgtattcacgcctcttttcattcctggttaatactatgaattcctgtctgcattcccaggacgaacagaagagcatgcaaaccttggatattggcatccttgatatcttcggcttcgaagagttccagaaaaacgaatttgaacagctttgcgtgaatatgactaacgagaaaatgcaccactacatcaacgaagtgctttttctgcatgagcaggtggagtgcgtccaggagggtgtgactatggaaaccgcctactcacctggtaaccagaacggggtgcttgacttcttctttcaaaaaccatcaggattcctcaccctgctggatgaagagagtcagatgatatggagcgtagaaagcaatttccctaaaaagctccaaagcttactggagtcctctaatactaatgcagtctacagtccaatgaaagatggtaacggcaacgtggcactgaaagatcacggtaccgcgttcaccataatgcattatgctggaagggtgatgtatgatgtggtgggagcgatcgagaaaaataaagattctttatcgcagaaccttttgtttgtcatgaagaacagacgctgcttttag

SEQ ID NO: 51928 - DNA, 2574 bp, Artificial Sequence
  Description of Artificial Sequence: Synthetic coding sequence
atgcgccgagcagataccagagacggggagcgaggtagtggtaaatctgaggccagtaagcagatcatccggcacctcacgtgtcgtgcaggggctagtcgagctaccctcgactcccgatttaagcatgtagtgtgcattttagaggcgttcggtcacgccaaaaccactctgaatgacctgagctcctgttttatcaagtacttcgagctgcagttttgtgagagaaagcagcagctcacgggtgcgaggatctatacttacctgttggagaaaagcagactggtgtcccagccactggggcaaagtaacttcttaatattctatctgctcatggatggtctgtctgccgaggagaaatacggcttgcacctaaacaatctatgcgctcatagatacctgaatcaaaccatccaggacgatgccagcactggcgaacggtcactcaaccgagagaagctggcggttctgaaacgtgctctaaacgtagtgggattctccagtttagaggtggagaatctgtttgtcattttggccgctatcctccacttgggcgatatccggttcacagcgttgaatgaaggcaactccgccttcgtgtcagacctgcagctcctcgaacaggtcgccggaatgctgcaggtaagcaccgacgaactggctagtgcgctcaccacagacattcagtacttcaaaggcgatatgattattcggagacacaccatccagatcgccgaattctttcgcgacctgctcgccaagtccctatactccaggttgttctcctttttagtcaatacaatgaactcctgtctgcacagccaagacgaacagaagtcaatgcagaccttggatatcggcatactggacatctttggttttgaagagtttcaaaagaatgagtttgagcaattgtgtgttaacatgaccaacgaaaagatgcaccactatataaacgaagtactgtttctgcacgagcaagtggaatgcgtgcaggagggggtgactatggagaccgcctattcccccggtaatcagaacggtgtccttgacttcttcttccagaagccgagcgggttcctgaccctacttgacgaggaaagccagatgatttggtccgtggagagcaactttccgaagaagcttcagtcactgctcgagtcttccaatactaatgccgtgtatagtcctatgaaggatggtaacgggaatgtggcgctgaaggatcacggaaccgcctttactattatgcattacgctggtagggtgatgtatgacgtggtgggggcaatcgaaaagaacaaggactctctgtcccaaaatctcctctttgtaatgaagacctctgagaacgttgtgataaatcacctgttccaatcaaagctgagccaaaccggctccctggtctcggcatatccatcttttaaattccgtgggcataagtctgctctgctttctaaaaagatgactgctagttcgataataggcgagaataagaactaccttgaactaagcaaacttcttaagaagaaaggaacctcaaccttcctccaaaggctagagcggggagacccagtgaccatcgcatctcagctgcgtaagtctcttatggatattatcggaaagctgcagaaatgtacgccgcactttatccattgcatcaggcccaacaattcaaaactgcctgacacatttgacaacttctacgtgtccgcacaactgcagtacatcggagtcctggagatggttaagattttccgctacgggtaccccgtaaggctgtcgttcagcgatttcctgtctaggtataaacctctggcagacacatttctcagagaaaaaaaggaacaaagcgccgctgaaagatgtagactcgtactacaacagtgcaaactacagggttggcagatgggtgtgcgaaaagtgttcctgaagtattggcacgcggatcagctcaatgatctgtgcttgcagctgcagcggaaaattataacgtgtcagaaggtgattcgcggtttcttagcaaggcagcacctcttgcagcgcatcagcatacgacagcaggaggtgacctctataaattctttcctacagaatactgaagacatgggtctgaagacttacgatgcccttgtcatccagaatgcctccgatatagcacgcgaaaatgaccggttacgttccgagatgaatgctccctaccacaaagagaaactcgaggttcggaacatgcaggaggaggggtccaagagaacagacgataaatccgggccaagacactttcatccatcctctatgtccgtgtgcgctgcggtggatggactaggccagtgtcttgtggggccatcaatttggagtcctagcctgcactctgtattttctatggatgattcgagctctctgcctagtccccgaaaacagccaccccctaaaccaaaacgtgaccctaatactcgcctttctgcttcatacgaagctgtcagcgcctgtttaagtgcagcaagggaagcagccaacgaagggcaaccatggggcggaacccagccaagggtacctggaagtaggatgctgtag

SEQ ID NO: 51929 - DNA, 1644 bp, Artificial Sequence
  Description of Artificial Sequence: Synthetic coding sequence
atgtctactgctagctcctcctcctctagctcatccagccaaacaccgcatccacccagtcagcgaatgcggaggagcgccgcaggaagcccacctgctgtcgccgcagcagggtccgggaatggagcagggggaggtggcggtgtggggtgcgcccctgccgctggcgcagggcgacttttacagcccattagggccaccgtgccctatcagttgctacggggtagtcagcactcgcccacaaggcccccagtggcggcagccgcagcgagcctagggtccctgccgggacctggagccgcaagaggacccagcccttcctcaccaacgccgccagcagctgccgcaccagctgaacaagcaccacgcgctaagggacgccctagaaggtcacccgagtcccaccggaggagctcttcccccgagcgccgatctcccggaagtccagtctgtcgcgcagacaaggcaaaaagtcaacaggtgaggacctcgtctactataagaagaacatcttctctggacacaattaccggcccttacctgaccggccagtggccgcgagatccccatgtccactacccctcgtgtatgaaggacaaggcaactcagaccccatcttgctgggctgaagaaggtgctgagaaaagatcccaccaacgaagcgcttcttggggctcggcagaccaactcaaagagcagatcgctaagctacgacaacagctgcagcggtccaaacagagctctcgccacagtaaggagaaggacagacagtcccctttacacggaaatcacattactatttcacacacacaggccaccggttcccggtcggtgcccatgccattgtctaatatctccgtacccaagagtagcgtgtcgagggtcccatgtaatgtcgagggcatttctccagagctggagaaagtcttcattaaagaaaacaacggtaaggaggaggtgtccaagccactcgacatcccagacggcaggcgagcccctcttcccgcacactacaggtcttcatccacgcgctctattgatacccagacaccctctgtgcaggagagatcctcttcctgctcttcccacagcccctgcgtaagccccttctgccccccagaatcgcaagatggcagtccatgtagcactgaggacctactatatgaccgcgacaaggactcagggtctagcagcccactccctaagtacgccagctcccccaagcctaacaacagttatatgtttaagcgagagccacctgaaggttgcgaacgagtcaaggtgttcgaagaaatggcatccagacaacccatctcagccccactgttctcctgtcctgacaagaataaagtgaattttatccccaccgggtccgctttctgtccagttaaacttctgggcccactcctgcccgcaagtgatttgatgctgaagaacagtcccaacagcgggcagtccagcgctttggctacgctgacggtggaacaactgtcatctagagtttcttttactagcctctctgacgacacttccacggctggctccatggaagcaagcgtgcaacaaccgtctcagcagcagcagctcctgcaggagctccagggggaggatcacatttcagcccagaactacgttatcatttag

SEQ ID NO: 51930 - DNA, 999 bp, Artificial Sequence
  Description of Artificial Sequence: Synthetic coding sequence
atgggtgctcaattcagcaagactgcagccaagggggaggccgctgcggaacggcctggcgaagcagccgtcgctagcagtcccagtaaagcaaatggccaggaaaacggacatgtcaaagtaaacggagatgcaagccctgccgctgctgaaagcggggcaaaggaggagctgcaggcaaacgggtctgctccagctgctgataaagaggagcctgccgcagccggatccggagcggcatcaccatcagctgccgagaaaggggaacccgcagcagcggctgcacccgaggccggagcatccccggttgaaaaggaggcccctgctgagggagaggctgcagagccgggaagtcctaccgccgctgaaggcgaggcggcttcagctgctagtagcacaagctcacccaaagcagaagacggtgcaacccccagtccatccaacgaaacgcccaagaaaaagaagaagcgctttagtttcaagaagtcttttaagctgagcggcttttcctttaaaaaaaacaagaaagaagcgggtgagggcggagaggcggaggccccagctgccgagggaggcaaggacgaggccgcaggcggagccgctgctgccgctgcagaagctggggctgcatccggcgaacaggcagcagccccaggcgaggaagctgcagccggtgaagaaggcgctgcagggggtgatccccaggaggctaagccccaggaagcagctgtggctcctgagaaacctcccgcttctgatgagactaaagctgctgaagagccatctaaggtcgaagaaaaaaaagctgaagaggccggagcttctgctgcagcatgtgaggccccatcggctgcaggcccaggagccccacctgaacaagaggccgctcccgcagaggagcctgctgctgccgctgcctcttcagcttgtgcagccccttctcaagaagcccagcccgagtgctcgcccgaggcaccaccggcagaagcagccgagtag

SEQ ID NO: 51931 - DNA, 978 bp, Artificial Sequence
  Description of Artificial Sequence: Synthetic coding sequence
atggccgaggtcccccctggcccatccagccttctccctcccccagctcctcccgctcctgcagccgtggagccgagatgtccgttcccggcaggcgcagcacttgcctgctgcagtgaggatgaggagcagcagcagcttaacggacttatcagtccagagcttcggcatctgcgcgctgctgcctcacttaaaagcaaggtgctctccgttgccgaggtcgcagccaccacagctacaccagacggcggtccgcgagcaaccgccactaagggcgcaggtgtgcattcgggcgaaagacccccacatagtcttagttccaacgctcgtacagccgttccaagcccagttgaggccgcagccgcatcagatccagccgctgcaagaaacggcctggcagaaggtacagaacaggaagaggaggaagaggatgagcaggtgcggctgctgtcaagtagtctgaccgccgattgtagcttgaggagcccatcagggcgtgaggtcgaaccaggcgaagaccgcacaatccgctatgtgcgctatgagagtgagctacagatgcccgatattatgagactaatcacaaaagatctgagcgaaccctatagtatttacacttataggtacttcattcacaactggcctcaactgtgcttcctcgctatggtcggagaggaatgcgtcggcgctattgtgtgtaagctggatatgcataaaaagatgttccgcagggggtacatcgccatgcttgctgtagacagcaagtatagaagaaatggcataggaaccaatctcgtgaagaaggcgatctatgctatggtggagggagactgcgacgaggttgtactcgaaaccgagattacaaataagagcgcacttaaattatatgagaatttaggtttcgttagagacaaacggttatttcgatactacttgaacggggtggacgcgctgagactgaaactttggctcagatag

SEQ ID NO: 51932 - DNA, 1089 bp, Artificial Sequence
  Description of Artificial Sequence: Synthetic coding sequence
atggctgaggttcctccaggcccatcgtcactgctgcctcctcctgcccctcccgctccagccgctgtcgaacctaggtgcccttttcccgcaggggctgcgctggcttgttgcagcgaggacgaggaagacgatgaggagcacgagggcggtggatctaggagtcccgcaggaggcgagtctgccactgttgccgctaaaggccatccttgtctgcgctgcccccagccgcctcaggaacagcagcagctaaatgggctgatcagtcccgagttacgacaccttcgtgcggcagccagcctgaagagcaaggtgctgagcgttgcggaagtggccgcaactacggcgacacctgacggcggaccccgagctacggcaaccaagggcgcaggcgtgcacagtggcgagaggcccccacatagccttagctcaaatgccagaacagcagtgccgtcccctgtcgaagctgccgctgcctccgatccagccgctgcgcgaaacggtctcgcagagggaacggagcaggaagaagaagaggaggatgaacaggtccgattgctgtccagcagcctaaccgccgactgcagcctgagatctcccagtggtcgcgaagtggaaccgggagaagataggacaattcgatatgtgagatacgagagcgagctccagatgcctgatattatgaggctcatcactaaagatctctcagaaccctatagcatatatacctatagatatttcattcataattggcctcagctttgttttcttgccatggttggggaagaatgtgtcggagcaatagtgtgcaagctcgatatgcacaaaaaaatgtttaggagaggctacattgctatgttggctgtcgactccaagtacagaagaaatgggatcggcacgaatcttgtgaaaaaagcaatttacgccatggttgagggcgactgtgatgaagtggtgttggagaccgagataaccaacaaatcagcactgaaactgtatgaaaatttgggttttgttcgcgacaagagactgtttcggtactatctcaacggagtcgacgcacttaggctcaaattgtggctacggtag

SEQ ID NO: 51933 - DNA, 2178 bp, Artificial Sequence
  Description of Artificial Sequence: Synthetic coding sequence
atggtgatgaaggctagtgtcgacgatgacgacagcggctgggagctcagcatgcccgaaaaaatggagaaatctaatacaaactgggttgacatcacccaggactttgaagaggcctgccgggagctgaagctcggagaactgttgcatgacaaactgtttggcctgttcgaggctatgtccgccatcgaaatgatggaccccaagatggatgctggaatgattggtaaccaagtcaatcggaaggtgctcaactttgagcaagctatcaaggacggaacaattaagattaaggacctgaccctgcccgaactaatcggtatcatggatacatgtttctgttgcctgatcacatggctggaaggtcacagcctggctcagacagtgttcacatgcttgtacatacataacccggattttattgaggatcctgctatgaaggcattcgcgctggggatccttaaaatttgtgacatcgcgagagagaaagttaacaaggccgctgtgttcgaagaagaggattttcagtctatgacctacggctttaagatggctaacagcgtcactgacctgcgggtcacaggcatgttaaaagatgtcgaggatgatatgcaaagaagggttaagtcaacgagaagtaggcagggagaagagcgggacccggaggtagaactcgaacatcaacaatgtctggcggtgttctctcgcgtaaagtttactcgggtgcttttaaccgtactaattgcctttactaagaaggagacctcagcagtggccgaggcacagaagctgatggtgcaagccgctgatttgctgagcgcgatccacaattccctccatcacggtattcaggcccagaacgatacaactaagggcgaccaccctataatgatggggttcgaacccctggtcaatcagaggctgttaccaccgacattccctcgctatgcaaaaattattaaacgcgaagagatggttaactacttcgccagattaatcgaccgaataaaaacggtgtgtgaggttgtcaaccttacaaacctgcactgcattctcgacttcttttgcgagttcagtgaacaaagtccatgcgtcttgagtcggagtctcctgcaaacaacattcctggtcgataataagaaggtcttcggcacacatctaatgcaggatatggtcaaggacgctctgcgttctttcgtgtccccccctgttctttcgcctaaatgctatctatacaataaccatcaggcaaaagactgtatcgatagcttcgtcacccattgcgtgagacctttctgctccctgatccagatccacgggcataaccgcgctaggcagcgagacaaactggggcatattctcgaggagttcgctactctgcaggatgaggcggagaaggtcgacgccgcactgcatactatgctcctgaagcaagaaccccagaggcaacacctagcctgtctgggtacatgggttctgtatcacaatctgcggatcatgattcagtatctactgagtggattcgagcttgaactctactcgatgcatgagtattattacatttactggtatctctccgaattcctctacgcttggctgatgagcaccctgagtcgggctgatgggagtcagatggctgaagagcgaattatggaggaacagcagaagggccgaagcagcaaaaagacaaagaaaaagaagaaagttcggccactgtcacgcgagattacaatgtcacaggcttatcagaatatgtgtgcgggaatgttcaagacgatggtcgcattcgatatggacgggaaggtccggaagcctaagtttgagctggactcagagcaggtgcggtacgaacaccgctttgcgccattcaattcagttatgactcctccacctgtgcattacctgcaattcaaagaaatgagcgacttgaacaaatacagtcctccacctcaaagccctgaactatacgtagctgcatctaagcactttcagcaggccaaaatgatcctggagaacattcccaatccagaccacgaagttaatcgcattctgaaggtagcgaagccaaatttcgtcgtgatgaaactcctggccggaggacacaagaaggagtccaaagtgcctcctgagttcgatttctcagcccataagtacttcccagtagtaaaactagtctag

SEQ ID NO: 51934 - DNA, 885 bp, Artificial Sequence
  Description of Artificial Sequence: Synthetic coding sequence
atggtcatgaaggcctccgttgatgatgatgactctggatgggagctgtcaatgccggagaaaatggaaaaaagtaacacgaactgggtagacatcacacaggacttcgaagaggcgtgtcgggaactgaaactcggtgagctgctccacgataaattattcgggcttttcgaagctatgagtgcgatcgagatgatggatccaaaaatggatgccggtatgattggcaaccaagtcaacaggaaggtgctgaatttcgagcaggccattaaggacggaactattaagattaaagacctcacactgcccgagctgatcggaatcatggatacttgcttttgttgcttgatcacttggctcgaaggccattctctcgcccaaacggtgttcacttgtctttacattcataaccccgatttcattgaggaccccgcaatgaaggcatttgccctgggcatcctcaagatatgcgatattgcgagggagaaagttaacaaggcagctgttttcgaggaagaagattttcagagcatgacatacgggtttaagatggctaattcagtgacagacctccgtgttaccggcatgctgaaagatgtggaagacgatatgcaacggagagtcaagtctacgcgaagcagacagggggaggagcgagaccccgaggtggagctggaacatcagcaatgtcttgccgtcttcagccgcgtgaagtttactagggtgcttctcacagttctgatagcatttacaaagaaggaaacaagcgccgtcgctgaggcgcagaagctgatggtgcaagccgctgatctgttaagtgctattcacaactcccttcaccacggcattcaagcccaaaacgacaccacaaaggggggtctctag

SEQ ID NO: 51935 - DNA, 594 bp, Artificial Sequence
  Description of Artificial Sequence: Synthetic coding sequence
atggtgatgaaagctagcgtggatgatgatgattccggatgggaactgtcaatgcctgagaaaatggagaaaagcaataccaattgggtggatattacccaagacttcgaggaggcgtgtcgggaactgaaactgggcgagttactgcacgataaactgtttggcttgtttgaggcgatgtccgcaatcgagatgatggaccccaagatggatgcgggaatgattggaaatcaggtgaaccggaaggtattgaacttcgagcaggcaattaaagacggcaccattaagatcaaggatctcaccttacccgaactgatcggaatcatggacacatgtttctgttgccttataacctggctcgagggccactcactggcacagacagtcttcacatgcctgtatattcacaaccctgattttatcgaggaccctgccatgaaggcgttcgctcttgggattctgaagatatgtgacattgcacgcgagaaggtgaacaaagccgctgtgttcgaggagataagcaggctcttggagctgatcgatttccacgaatacaacttcaagaatgagaacgttcagtgttggaaggaatag

SEQ ID NO: 51936 - DNA, 1857 bp, Artificial Sequence
  Description of Artificial Sequence: Synthetic coding sequence
atggttagtccccgtatgagtggcttgttgtcgcagaccgtgattctcgcattaattttcctgcctcagaccagacctgcaggagtcttcgaacttcaaatccattcatttgggccaggccctggcccaggggcaccaaggagcccttgctccgccaggctcccttgccggctctttttcagagtgtgcctcaaacccggtctcagcgaagaggctgccgagagtccttgcgctctcggtgctgctctgtccgctcgtgggcctgtgtacacagagcaacccggagcgccagctccggacttgcccctacctgatgggttgcttcaggtgcccttccgcgacgcctggcctggaacattcagtttcataatcgaaacctggagagaggaattgggcgaccagattggcggaccggcatggtccctgctggctagggtagccggaagaaggcgcttggctgccggaggcccatgggccagagacattcagcgagcaggggcatgggagctgcgctttagttaccgtgctagatgtgaacctccggctgtgggcacagcttgcacccggctctgccggccacgctcggccccaagtcgctgcgggccagggctacgtccttgcgcacccctggaagatgagtgcgaggcgcctctggtgtgtcgagcaggctgctctccagagcacggtttttgtgaacagcccggagagtgtcggtgtctggaagggtggaccggacccctttgtaccgtccccgtgtcaacctcatcctgtcttagtccgaggggtcccagctcagccactaccggctgccttgtcccaggtccgggaccttgtgacggcaacccctgtgcaaatggaggcagttgttcagaaacccccaggagctttgagtgtacctgccctcgcggattttatggtcttcgttgtgaagtgagcggagttacgtgtgcggatggcccatgtttcaacggcggtctgtgcgttggaggcgcagaccctgattctgcctacatctgccattgtccccctgggtttcaaggctccaactgtgaaaaaagggtggataggtgcagcctacagccctgccgcaacggaggattatgcttggatcttggacacgcgctgcgttgtcgctgcagggcaggcttcgccggaccacgctgcgagcatgacctggatgattgcgctggcagggcatgcgccaatggcggaacatgtgtggagggtggcggagcccaccggtgttcttgcgccctagggttcggtggcagggactgtagagagagagctgacccctgtgcggcaagaccctgcgcacacggcggacggtgttacgcccacttcagcgggctcgtgtgcgcttgtgctcccggatatatgggagccaggtgcgagtttccagtgcaccccgatggggcttctgctctgcccgctgcccctcctggtctcagacccggagatccccaacgctacctcttgcccccagccctggggttgctggtagctgccggagtcgctggtgcagcgctgctgctggtgcacgtaaggcgtagaggccactcgcaggacgctggctcgaggctgctcgcaggtacaccagagcccagcgtccacgcactgccggatgcactgaacaacctaagaacccaggagggcagcggggacggaccgtccagctctgtcgattggaatcggccagaagatgttgatccccagggaatctatgtcatcagcgcccctagcatttacgccagggaagtcgccaccccactctttccgccactgcacaccggccgagccggtcagcggcaacatctgcttttcccttaccccagttcaattttatctgtgaaatag

SEQ ID NO: 51937 - DNA, 2181 bp, Artificial Sequence
  Description of Artificial Sequence: Synthetic coding sequence
atgagcgcaattacagtggcactgctcagcctgctcttcattactagcggaactatagaaaaccataaagacctgggagggcatttcttctccacaactcaaagccccccagccacccaaggctcaactgcggctcagcgctctactgctacccagcactccactgctacccagagtagtaccgctacgcaaacgtccccggttcccctgacacccgaatcgcccctgttccagaatttttcagggtaccacattggagtgggccgtgcagattgcacagggcaggtggctgatataaacttgatggggtacggaaaatcaggccagaacgcacaggggattttgacaagactgtactctagagcatttattatggctgagcccgatgggagtaatcgtacagtgtttgtgtccattgacatagggatggtgtcccagcgcctgaggctggaggtacttaataggctgcaatccaagtacggctctctgtaccgcagagacaatgtaatcctgagtggaacccacactcactctggcccagctggctattttcagtacactgtcttcgtcatcgctagcgaaggcttcagcaaccagacctttcagcatatggtaactgggatccttaagtctattgatatcgcgcatactaacatgaaacctggaaagatcttcataaataaaggcaacgtagacggagtacaaattaacaggtctccctactcatacctgcagaaccctcagtccgaaagggctcggtattcctcgaacacagacaaggagatgatagtgctgaagatggttgatctgaacggggacgacttgggcctcattagttggttcgccatccacccggtgtctatgaacaattccaatcatctggttaatagtgacaatgttgggtatgccagctatctgctggagcaagaaaaaaataaaggctacctaccaggccaagggccttttgtggcagcttttgcatcttccaacctgggggacgtgtcccccaatatcctcggccctaggtgcatcaacacgggcgagtcctgtgacaacgcgaactccacgtgcccgatcgggggacctagtatgtgcattgccaaagggcctggacaggacatgtttgattcaacgcagattataggcagagcgatgtatcaacgggcaaaaagcaagacctgcaaacccgcactgggttattcattcgcggctggtacaatagacggggttggaggactgaacttcactcagggaaagacagaaggagatccattttgggacactatccgcgaccagattctgggaaaacctagtgaagaaatcaaggagtgccacaaaccaaagccgatcctcctgcacactggagaattgagcaaaccgcacccatggcacccggacatcgtcgatgtgcagataataactctggggagtttggccatcacggccattccgggagagttcactacgatgtctggtcggcgacttagagaggcggtgcaagctgagttcgccagccacggcatgcaaaacatgacggttgtgatcagcggactctgcaatgtctacacccactatatcaccacctatgaggaatatcaggcccagcggtatgaggcagccagtactatttatggaccccacacgttgagtgcgtatatacagctatttagaaacttagcgaaagccatcgccaccgacacggtagctaatttgtctcgcggtccggaaccaccattctttaaacagctgatcgttccactcataccttctattgtggatagggcgccaaaaggccgtacctttggcgatgttttgcagcctgctaagccagaataccgagtgggagaggttgcagaggtgatttttgtgggagctaacccaaagaactccgttcagaatcagacccatcaaaccttcctgactgtagagaagtatgaagcaacatctacttcctggcagatagtttgtaacgatgcttcttgggagaccaggttttattggcacaaaggcctgttgggcctgtccaatgcaacggtggaatggcatatcccagacaccgcccaaccagggatttacaggataaggtatttcggccacaatcggaagcaagacattctcaagcctgctgttatcctcagcttcgaggggacatcacccgcttttgaggtggtgacaatctag

SEQ ID NO: 51938 - DNA, 723 bp, Artificial Sequence
  Description of Artificial Sequence: Synthetic coding sequence
atgtccggcagaaggctgagggaggccgtacaggccgagttcgcgagtcacgggatgcagaacatgaccgtggttatcagtggtctgtgcaatgtctatacccactacattacaacttacgaggagtatcaagcccaaagatatgaagctgcctccactatctatgggcctcatacactcagcgcctacatacagctatttaggaatctggctaaggcaattgcaaccgacaccgtggctaacctgtcgagaggccctgagcctccattcttcaaacaactcatcgtgccactcatccccagcatcgttgaccgggctccgaagggcaggacattcggtgacgtattgcagcccgctaaacctgaatatagagtgggcgaggtcgctgaagtcatttttgtgggggcaaatccaaagaactctgtccagaaccagactcaccagacattccttacagttgaaaagtacgaggccaccagtaccagttggcagatagtgtgtaatgacgcctcctgggaaactagattctactggcacaaaggactgctaggtctaagcaacgccactgtggaatggcacatcccagacaccgctcagcctggtatctacagaataaggtatttcggacacaaccgaaaacaggatattctcaagccggctgttattctttcttttgaggggacttccccggcattcgaagtacctaattccggactccactag

SEQ ID NO: 51939 - DNA, 2343 bp, Artificial Sequence
  Description of Artificial Sequence: Synthetic coding sequence
atggccaagcggactttcagcaatctagaaacattcctgatcttcctgctggtcatgatgagcgccataactgtcgctctccttagcttgctgttcatcacctcgggaaccatcgaaaatcataaagacctgggaggtcactttttttccactacccagagtccacccgctacgcagggctccacagccgcacaaagaagtactgccacacagcattccacggctactcaatccagtactgcaacccagacatcccctgtgccgttaaccccggaatctcctttatttcagaatttctccgggtaccacattggcgttggccgtgccgattgcaccggtcaagtggctgatataaatttaatgggctacggcaagtccgggcagaatgcccagggtatactgaccaggctttattccagggcctttataatggctgaacccgacggatctaatcggaccgtgttcgtctctattgacattgggatggtatcgcagagactgagactcgaggttctaaacagattacagagcaagtacggcagtctctaccgtcgcgacaatgtcattcttagcggaacacacactcactccggccctgccggttactttcagtacactgtattcgtgatcgcctcagagggtttttcaaaccagacgtttcaacacatggttaccggcattctcaagtctattgatatagcacacaccaatatgaaaccagggaagatttttatcaataaggggaacgtagacggggtccagattaaccgatctccctatagttacctgcagaacccgcaatctgagcgagcccgatatagttctaacacagacaaagaaatgattgtgttgaagatggtggacctcaatggcgacgacctcggactgatttcctggtttgccattcatcccgtgtcaatgaacaatagtaaccatctcgtcaatagtgataacgtgggatacgccagctacttgctcgaacaggagaagaataaagggtacctgccgggacagggtccctttgtggccgcttttgccagcagtaacctgggcgacgtcagcccaaatatactggggcctagatgtataaacaccggagaaagctgtgataatgcgaatagtacttgtcccattggcggacctagcatgtgtattgcaaagggtccaggccaggacatgtttgactccacgcagattatcggacgcgcaatgtaccagcgggctaaagaactatatgcttctgcttctcaagaagtcactgggccactggcttctgcccaccagtgggttgacatgacagacgtgacagtgtggctgaatagtacacatgctagtaagacttgtaagcccgcattgggttattcatttgctgcgggtactattgatggagtcgggggactgaactttacccaggggaagaccgagggcgatccattttgggacacaattagggatcagattctggggaagccttccgaggagatcaaggaatgtcataagcctaaaccgatcctactgcatactggggagttgagtaaaccacatccatggcaccccgacatcgtcgacgtgcaaataatcactctcggatctcttgccatcactgccattcctggagaattcacaacaatgagcggacgtcgactgcgggaagccgtgcaggccgaatttgcatcgcatggtatgcaaaatatgacagtggtgatctctgggctctgcaacgtatacactcattatattactacctatgaagagtaccaggctcaacgctatgaggccgcatcaactatctatggaccccatacactctctgcttacattcagttgtttcgcaacctcgcgaaggctattgcgactgacacggtggccaaccttagccggggtcctgaaccacccttcttcaaacagttgattgtccccctgattccatcaattgttgacagagcaccgaagggtagaacttttggcgacgtgctgcagcctgcgaaaccagaatacagagtgggcgaagtcgcagaggtcatcttcgttggcgctaatcccaaaaactcagtgcagaatcagacccaccaaaccttcctcaccgttgaaaagtacgaggctacctcgacttcctggcagatcgtctgcaacgacgcatcctgggagacacgattttattggcataaggggcttctgggcctgtccaatgccactgtagagtggcacatccctgacaccgcacagccgggaatttaccggatcaggtatttcggacacaacaggaagcaggatatcttaaagccagctgttattctatctttcgaaggcacttcacccgctttcgaagtagtaacaatctag

SEQ ID NO: 51940 - DNA, 1869 bp, Artificial Sequence
  Description of Artificial Sequence: Synthetic coding sequence
atggattcagagaaatcaagtgaatggagaagcgatgtcttgaatcggcttcagtctaagtacgggtcactgtatcgcagggacaacgtcatcctgtccggtacccacacccatagtgggccagccggttactttcagtacactgtgtttgttatcgcctcagaaggattttcgaaccagaccttccaacatatggtcaccgggatcttgaagtctatagatattgcacataccaacatgaagcccggaaagatattcatcaataaagggaacgtcgatggagtccaaatcaatcggtccccatattcctacctccagaatccacaatctgagagagcgcgttactcttctaataccgacaaagagatgatagtgctcaagatggtggacttgaacggcgacgatctgggactgatcagttggttcgcaatacatcccgtatctatgaacaattccaaccatcttgtcaactctgacaacgtgggctacgccagctatctactggaacaggagaaaaataaagggtacctgcccggacagggaccatttgtggcagcatttgcttcatccaacttgggggacgtctctccaaacatcttgggacccaggtgtatcaacaccggagagagttgtgacaacgctaacagtacgtgccctattgggggtccgtcgatgtgcattgcgaaaggccctgggcaggacatgttcgactcgacccagatcattggcagggctatgtaccaacgagcgaaggagttgtacgcctcagcctctcaggaggtgaccggtccgttggccagcgcccaccagtgggtcgatatgacggacgtcacagtgtggctaaattctacacacgccagcaagacctgtaaaccggcactcggatattcttttgccgctggcaccatagatggcgtgggcggtctcaatttcacccagggtaagaccgagggggatcccttttgggacactatacgcgatcagatcttaggaaagccttccgaggaaataaaggagtgtcataagcccaaaccgattctgctacacaccggggagctctcaaaaccccacccatggcacccagacatagtcgatgtccagattattacactcgggtctctagccatcaccgccatacctggggagtttaccactatgtcagggaggagactccgcgaagccgtccaggctgagttcgcctcacatggcatgcagaacatgaccgtggttattagtgggctgtgtaacgtgtatacgcattatatcacaacatatgaagaatatcaggcccagcggtatgaagcagcaagcactatttacggcccacacaccctctctgcgtatatccagctgttccggaacctagcgaaggcaatcgctactgacacggtggcaaacctctctagaggccctgaacctcctttcttcaaacaattgatcgtgcctcttatcccatccatcgttgacagggcccctaagggcaggactttcggagatgtgctgcagccagcaaaacccgaataccgggttggcgaagtggccgaagttatctttgtgggcgctaatccaaagaacagtgtgcagaaccaaactcaccagacctttctgacggtagagaaatatgaagcgacctccacttcttggcaaattgtgtgcaatgacgccagttgggagacaaggttctattggcacaagggactgctgggcctgtccaacgccacagtggaatggcatattccggatactgctcagccagggatttataggattaggtacttcgggcacaacaggaagcaggacatcttgaaacctgccgtaattctgagcttcgagggcaccagcccagcattcgaagtggtgacaatatag

SEQ ID NO: 51941 - DNA, 2238 bp, Artificial Sequence
  Description of Artificial Sequence: Synthetic coding sequence
atggcgaaaagaacattttccaatctggaaaccttcttgatttttctgctcgttatgatgagtgctatcacggttgcactgctctcactcctgtttataacttctgggactattgagaatcacaaggaccttggcggacattttttttctacaacacagtcccccccagccacacagggctcgactgccgctcagcggtccacggcaacacaacattccacagctactcagtcatcgactgccacccaaacatcccccgtgccgttgactcctgagtcccccttatttcagaacttttcgggatatcatatcggcgtggggcgtgctgactgtacagggcaagtcgctgatataaatctaatgggatatgggaagagcggccaaaatgctcagggtatcctaacccggctttacagtagagccttcattatggcagaacctgatggtagtaatagaactgtcttcgtctctattgatattgggatggtgagccagcggctgaggctggaggtgctgaatcgcttacagtctaagtatgggtccctgtatcggcgtgataacgtgatcctctccgggacccacacccattcggggccagccggttattttcagtacactgtgttcgtgattgcatcagaggggtttagcaatcagacatttcaacacatggtaaccgggatcctgaaaagcattgacatagctcacacgaacatgaagcccggaaagattttcatcaataaagggaacgttgatggagtacagatcaatcgctctccgtatagctatttgcagaatcctcagtcagaacgggctagatactcatccaacaccgataaggaaatgatcgtgttaaagatggtggatttgaacggcgacgatctgggactgattagttggtttgcaatccaccccgtttccatgaataattccaatcatttagtgaacagcgataatgtgggctatgcctcctatttgttggagcaagaaaaaaataaagggtatttacctggccaaggcccatttgtcgctgcctttgcgtccagcaatctcggtgacgttagtccaaacattctggggcctcgatgcatcaataccggagaaagctgcgataatgccaattctacctgtcctatcgggggtccatccatgtgtatagcaaagggccctggacaggacatgtttgactctactcaaatcattgggagagccatgtatcagcgggctaagtcaaaaacatgtaaacccgctctcgggtattcttttgcggctgggaccattgatggcgttggcggattaaattttacgcaaggcaagaccgaaggggatcctttttgggacactattagggatcaaatcttaggcaagcccagcgaagagattaaggaatgccacaaacctaagcccatcctgttgcatacaggggagctgtctaaacctcacccttggcacccggatattgtggatgtccagataatcaccttgggatctctggccattaccgccattcccggtgagttcactaccatgagtggccgacggctgcgggaggccgtgcaggccgagttcgcctcgcacggtatgcaaaacatgactgtggtgatttctggactctgcaacgtctatactcactacattaccacctatgaagagtatcaagcacaacggtacgaagctgcctccaccatctacggtccacataccctctcggcttacatccagctgttcagaaacttggctaaggcaattgctaccgacacggtcgctaacctgagccgcggacctgagcccccattttttaaacagctgatcgtccccctcatacctagcatcgttgatagagcacccaaggggcgaacctttggcgatgtactccaacctgccaaaccagaataccgggtgggagaggtagctgaggtcatctttgtgggtgctaacccgaagaactccgtgcaaaaccagacgcatcagacttttctgaccgtggaaaagtacgaagctacctctacctcatggcagattgtgtgcaatgatgcctcgtgggagacccgtttttattggcataaggggttgttaggactttctaacgccacagtggagtggcatatccctgataccgcccagccaggcatttatagaattaggtatttcgggcataacaggaagcaggacatcctgaaaccagccgtgatcctctccttcgaagggacctcacccgcattcgaagtggtaactatctag

SEQ ID NO: 51942 - DNA, 840 bp, Artificial Sequence
  Description of Artificial Sequence: Synthetic coding sequence
atgctgcttgctgccagcaaggttctggacagactgaagccagtgatcggggtgaacacggatccagaaagatcagagggacacctgtgcttacccgtgaggtatacacattctttccccgaggctctgcagaagttttaccgcggagaattcagatggttgtggagacagaggattcggttatacttggaaggaactggaattaatccagtgccagtggacctgcatgagcagcagctctcacttaaccagcacaaccgcgcactcaacatagaacgcgctcacgacgaacggagcgaagcctccggcccacagctgttgcccgtgagggctcttaatgaggtgtttataggggaaagcctaagttcacgggcttcatattatgagatcagcgtggatgatggcccatgggaaaagcagaaatcatccggcctgaacctgtgtactggcacaggctcaaaagcctggtctttcaatataaatcgggtggccacccaggctgtcgaggatgtcctgaatattgccaagcgacaaggcaacctgtctctccccctgaatagagaactggtggagaaggtgactaatgagtataacgaaagtctcctgtattcgcccgaagaacccaagattctgttttcaattagagagcccattgcaaacagagttttttcctcaagtcggcagcggtgtttctctagcaaagtttgtgtgagatctagatgctgggacgcgtgcatggtggtagacggcggaactagcttcgaattcaacgatggagctattgcttccatgatgatcaacaaggaagatgagctgcggacagtgcttctggagcagtag

SEQ ID NO: 51943 - DNA, 1329 bp, Artificial Sequence
  Description of Artificial Sequence: Synthetic coding sequence
atgacatgttaccgtggatttctgctcggatcttgttgtcgtgtagccggaggcagagcggcagcattacgtgggcctggagcaggaggccctgccgctcggcctcgtttgggaggtgacggcggagggagacgccacctcggacagggacagccaagagaactggccggatgcggcagcagggctgatggcggattccgcccttctcgcgtggtggtagtggcaaagaccacacggtacgaatttgagcagcaaaggtacaggtatgctgagctatcagaagaagatctcaagcagctgctcgccctgaaagggagctcctacagtggactgttagagcgacatcatatacataccaagaacgttgaacatattatcgacagccttcgaaatgaggggattgaggttcggctagtgaagaggagggagtatgatgaggaaactgtacgctgggcagacgcagtgattgctgccggtggagacgggacgatgctgctggccgctagcaaggtgctggaccgtctcaagccggtgatcggggttaacactgaccctgagagatcggagggccacctctgcctacccgttaggtatacccattcttttcccgaagctctccaaaaattctacagaggcgaattcagatggttatggagacagaggatcaggctgtatttagaggggacaggtataaatcccgttccggtggacctgcacgagcagcagttgagccttaaccaacataacagggccctcaatattgaacgcgctcacgacgagaggtccgaagcctccggaccacagctgcttcccgtacgggcacttaacgaggtttttataggcgagagccttagttcacgtgctagctactacgagataagtgtagatgatggcccttgggaaaagcagaagagttccggcctgaatctttgcactgggaccgggtccaaggcctggagcttcaacattaaccgagtcgctacccaagcggttgaggatgtcctaaatatagcaaagcggcaaggaaatctctctttgcctctgaaccgggagcttgtggaaaaggttaccaatgaatataatgagtcattgctgtattcacccgaggagccaaagatcctgttctctatacgggagcccatcgcgaatagggtattttctagcagtcggcagcggtgtttcagcagcaaagtctgtgtgagatcgagatgttgggatgcctgcatggtggtggatggcggtaccagcttcgagttcaatgatggcgctattgcctctatgatgatcaataaggaggacgaattgcgaacagtgctgcttgagcagtag

SEQ ID NO: 51944 - DNA, 840 bp, Artificial Sequence
  Description of Artificial Sequence: Synthetic coding sequence
atgctgttggccgcttctaaagtgcttgataggctgaagccagtgatcggagtaaatactgatcctgagagatctgagggccatctttgtttgccggtcagatatacccactcttttcctgaggccctccagaagttctaccggggtgagttcaggtggctgtggcgccagcgaatcaggctgtacctggaaggcactggcatcaatccagtcccagtggacctccacgagcagcagctgtctctgaaccagcataacagggccctcaatattgaacgcgctcatgatgagaggtctgaggcttctggcccacagttactgccagtcagggcgctgaacgaagtcttcatcggtgaatcactgagtagtagggcctcttactatgaaatatctgtggacgacggaccgtgggaaaagcagaagagctcgggcctgaacctatgcactggaacaggttccaaagcatggagtttcaacattaacagagtggccacacaggccgtggaggacgttttgaatatcgcgaaaaggcaaggaaatctttctctccccctgaatcgtgaactggtggagaaagtgacaaatgagtacaatgagtccctgctctactctccggaggaaccgaagatattattctctatcagagaaccaatcgcgaaccgcgtcttctcttcatctaggcagagatgtttctcttcaaaagtatgtgtaaggtctcggtgttgggatgcttgcatggtggtggacggtggcacttcttttgagtttaatgacggagctattgcttccatgatgataaacaaggaggacgagcttagaactgtcctgctggaacagtag

SEQ ID NO: 51945 - DNA, 906 bp, Artificial Sequence
  Description of Artificial Sequence: Synthetic coding sequence
atgctgctggcagcatccaaggtattggacaggctgaagccagtgattggcgttaacaccgatcctgaaagatctgaaggacatctctgtctgcctgtgcgctatacccattcattccctgaagcgctgcagaagttttacagaggcgagttccggtggttgtggcgccaaaggattagactgtatctggagggcaccggcatcaacccggtgcctgtggatctccatgagcagcaactgagtctgaaccagcataacagggcactgaacattgaacgggctcatgatgagcgttccgaagctagtggcccacaactgctgcccgtgagggctctgaacgaagtgttcattggcgaaagtttgtccagtagaatgtcttatagttgggccgtggcagtagataaccttcgaaggagtatcccgacacttaaggggttggcgtcctattacgagatttctgtcgacgatggaccgtgggagaaacagaagagctcaggtctgaacctctgcaccggtacagggtccaaggcctggtcctttaacatcaaccgcgttgcaacccaggcagtcgaagacgtgctgaacattgccaagaggcagggcaatctatccttaccgctgaaccgggaactggtggagaaagtgactaatgaatacaatgagagcctgctttattcacccgaggagcccaagattctgttctcgatcagggagcccattgcaaatagagtcttctcctcatcaagacaacgctgtttcagcagcaaggtgtgcgtgaggtctagatgctgggatgcatgcatggtcgtcgatggcggaacgtcatttgagttcaatgatggggctatagcatccatgatgatcaataaagaagacgaactgcggacagttctccttgagcagtag

SEQ ID NO: 51946 - DNA, 1233 bp, Artificial Sequence
  Description of Artificial Sequence: Synthetic coding sequence
atgacatgctacaggggattcctcctgggctcatgttgccgagtagcgggtggcagggctgcagccttgcgaggtccaggagctggcggacccgcagcgaggcccaggctaggtggcgatggaggaggaaggaggcacctgggacaaggccaacccagagaactcgctggctgcgggtcaagggccgacggaggcttcaggcctagcagggtggttgtggtggctaagacaacaagatatgaattcgaacagcagagatataggtatgcagaattatccgaggaggatctcaaacagttgctggcacttaaagggtcttcttatagcggtctgcttgaaaggcaccacatccacaccaaaaatgttgagcacatcatcgattccttgcgcaacgagggcatagaagtcagactggtaaaaaggagagagtacgatgaagaaacggtcaggtgggccgacgctgtgatcgccgcaggtggggacggcacaatgctgctggcagcctctaaggtccttgaccggctgaagcccgtgataggagtcaatactgacccagagaggtctgaagggcacctgtgtcttcctgtgcggtatacacattcgtttccagaagcgctccaaaaattttacaggggggagttccgctggctttggcgtcagcgaattcggctctacctggagggcactggtataaacccagtcccagtggacctacacgagcagcagcttagcctgaaccaacacaatcgggctctcaacatagaacgtgcccacgatgagagatctgaagcttccggccctcaattgctcccagtgcgagcgctgaatgaagtattcataggagaaagcttgtcctcgcggtccttcaacattaaccgggtcgccactcaagccgtggaggatgtactcaatatcgccaaacgccagggtaatctcagtcttccattaaatcgggaactagttgagaaggtgaccaatgaatacaatgagtcactgctgtattccccagaagagcctaagatcctctttagtatccgcgagcctatagccaatcgagtcttctcttcctctcggcaacgatgtttttccagcaaggtgtgcgtccggtcgagatgctgggacgcttgcatggtagtcgatgggggaacctcattcgagtttaacgatggtgccattgctagtatgatgataaataaagaagacgaattgcgcacagttctgctcgagcagtag

SEQ ID NO: 51947 - DNA, 192 bp, Artificial Sequence
  Description of Artificial Sequence: Synthetic coding sequence
atggagctggtgcaggttctcaagcgaggcctgcagcagattaccggtcacggtggactccgtggatatttgagagtcttttttaggacaaatgacgccaaagtggggaccctcgttggggaggacaaatatggaaacaagtactacgaggataataagcagtttttcggaattgtcggatttacagtctag

SEQ ID NO: 51948 - DNA, 438 bp, Artificial Sequence
  Description of Artificial Sequence: Synthetic coding sequence
atggagctggtccaggtgttaaaaaggggcctgcaacagataacgggccatggcggactaaggggctacctgcgggtgttcttcagaaccaacgacgctaaggtggggaccctggtgggggaagacaaatacggaaataagtattatgaggataataagcagttttttgggcgtcatcgatgggtggtctacactacagaaatgaacggtaaaaacaccttttgggacgtggacggaagcatggtgcccccagagtggcataggtggctacacagcatgacagatgacccgcctaccacaaaaccactgacggccaggaagttcatttggacaaatcataagtttaatgtaactggcactcccgagcagtacgtgccctatagcacaacccggaagaagatccaggaatggatccccccttccactccttacaaatag

SEQ ID NO: 51949 - DNA, 255 bp, Artificial Sequence
  Description of Artificial Sequence: Synthetic coding sequence
atggccgcacgtgtcggggcattccttaaaaacgcatgggacaaggagcccgtgctagttgtttctttcgtggtaggcggactggcggtaattctgcctcccttgtccccatacttcaagtactctgtcatgatcaataaggcgactccctataattaccccgtcccagtacgcgacgacgggaacatgccagacgtgcctagtcaccctcaagacccacagggtccttctctggagtggttgaagaaactttag

SEQ ID NO: 51950 - DNA, 255 bp, Artificial Sequence
  Description of Artificial Sequence: Synthetic coding sequence
atggccgctcgcgtcggcgctttcctaaagaacgcatgggacaaagaaccagtgctcgtggtatcttttgttgttggcggtttagccgttattttgcctccccttagcccctactttaaatacagcgtgatgatcaacaaggctactccttacaactaccccgtcccggtccgggatgacggcaacatgcccgacgtcccttctcacccccaggaccctcaggggccttcactagaatggttgaaaaagctctag

SEQ ID NO: 51951 - DNA, 255 bp, Artificial Sequence
  Description of Artificial Sequence: Synthetic coding sequence
atggcagccagagtgggtgcttttcttaagaacgcctgggataaggaaccggtattagtggtgtcattcgtggtgggcggactggctgtaatcctgcctcccctctccccatactttaaatacagcgtcatgattaataaagctacaccatacaactacccagttcctgttagagacgacggcaatatgcccgatgtcccgagccatccccaggaccctcaaggtccctccctagagtggctcaagaaattgtag

SEQ ID NO: 51952 - DNA, 246 bp, Artificial Sequence
  Description of Artificial Sequence: Synthetic coding sequence
atgttacgacaaataattggccaggccaagaaacaccctagcttgatcccactgtttgtatttatcggcaccggcgctaccggcgcaaccctgtatctgctaaggctggccctgtttaatcctgacgtgtgctgggatcgcaacaaccctgaaccatggaataaacttggtcctaacgatcagtacaagttctatagcgtgaacgtggactactctaaactcaagaaggaacggccagacttttag

SEQ ID NO: 51953 - DNA, 171 bp, Artificial Sequence
  Description of Artificial Sequence: Synthetic coding sequence
atccccgttgccatttttattaccctggtgaatgtcttcatcggccaggcagaacttgcagagatccccgagggctacgtcccggagcattgggagtattataaaggtaagggagcgggttccgctaagattgacgcctgcgagaggcgctggacactggtcttgctgtag

SEQ ID NO: 51954 - DNA, 318 bp, Artificial Sequence
  Description of Artificial Sequence: Synthetic coding sequence
atgatttgttggcgccacccctccgccccatgcggtcgcggagaatggcaagtgccccgaagccagctaccgcttgcacgggtcgagttcccagtggcacttggtctgggcgtggccgtcggcgctgaggccgcagcaatcatggtgaacctcctccagatcgtaagagaccactgggtccacgtgctggttcccatgggcttcgtgataggctgttatcttgacaggaaaagtgatgagagactgaccgcgtttagaaacaagagcatgctattcaagagggagttacagcccagcgaagaggtgacatggaagtag

SEQ ID NO: 51955 - DNA, 177 bp, Artificial Sequence
  Description of Artificial Sequence: Synthetic coding sequence
atggtgaaccttctgcaaattgtaagagatcactgggttcacgtcctcgtgcctatggggtttgtgattggctgttatttagataggaaatctgatgaacgtctgactgccttccgaaataaaagtatgctgtttaagcgcgagctccagcccagcgaagaggtgacatggaaatag

SEQ ID NO: 51956 - DNA, 177 bp, Artificial Sequence
  Description of Artificial Sequence: Synthetic coding sequence
atggtgaatctactgcagatcgtaagagatcactgggtgcacgttctcgtgccgatgggatttgtaataggatgttaccttgataggaagtctgatgagcggctgactgctttcagaaacaagtccatgctgtttaaacgcgagctccaaccctccgaagaagtcacatggaagtag

SEQ ID NO: 51957 - DNA, 288 bp, Artificial Sequence
  Description of Artificial Sequence: Synthetic coding sequence
atggagtcccatgagcggcaacctctggtcttacacgaggagatgggcgagtgcagatcatctctctccgctggcggtggcgtgcatatcgaacctcggtaccgccagttcccacaattgacaaggtcacaagtgtttcaatctgagttcttctccggcctaatgtggttttggatattgtggaggttttggcatgacagtgaggaagtgttaggtcatttcccgtatcctgatcccagccagtggacagacgaggagttgggtatccccccagatgatgaggactag

SEQ ID NO: 51958 - DNA, 318 bp, Artificial Sequence
  Description of Artificial Sequence: Synthetic coding sequence
atgtcagctctgacccgactggccagcttcgcccgtgtcgggggaagactgttccgctccgggtgtgctaggactgcaggcgacggcggtgtgcggcacgcgggaggcggagtgcatatcgagcccagatacagacagtttccccagctgacaagatctcaggttttccaatccgaatttttttcaggtttgatgtggttctggatcttgtggcgattctggcacgactccgaggaggttcttggccactttccttacccagacccctcccagtggacggacgaggagttagggatccctccggatgacgaggattag

SEQ ID NO: 51959 - DNA, 315 bp, Artificial Sequence
  Description of Artificial Sequence: Synthetic coding sequence
tctgcacttacccgtctagcatcatttgctcgcgtgggcggacggctttttcgctccggctgtgccagaacggccggagacggtggcgtgcgacatgcgggagggggtgttcacatagagcctcgatataggcagtttccccagcttaccagatcgcaagtgtttcaatccgagtttttcagcgggctgatgtggttctggatcctgtggcgattttggcacgactccgaggaagtcctcggccacttcccctacccggatccctctcagtggacagacgaggagttggggatcccgcctgacgacgaagattag

SEQ ID NO: 51960 - DNA, 318 bp, Artificial Sequence
  Description of Artificial Sequence: Synthetic coding sequence
atgtccgcacttactcgcctcgcttcttttgccagagtgggtggacggctctttcgttccggctgtgcacggacagcaggggatggcggtgttcgccacgccggaggaggtgttcacatcgaaccccgttaccggcaattccctcaacttactcgcagccaggtgtttcaatccgagttcttctctgggctgatgtggttttggattttatggcgcttctggcacgacagcgaggaagtgctcgggcatttcccttacccagacccttctcagtggacggacgaggagctgggcatccccccagatgacgaggattag

SEQ ID NO: 51961 - DNA, 318 bp, Artificial Sequence
  Description of Artificial Sequence: Synthetic coding sequence
atgtccgcactcacaagactggcctcctttgcgagggtgggcggtcgtctcttccgctccggctgtgccagaactgcaggtgacgggggtgtaaggcacgcaggaggcggagtgcatatcgaaccccgttatcgccagtttccacagcttactcgatcacaggtgttccagtctgaatttttttctggtctcatgtggttttggatcctctggagattttggcacgactccgaggaagtgctgggtcactttccataccccgatccttctcaatggacagatgaggagctcgggattcccccagatgatgaggattag

SEQ ID NO: 51962 - DNA, 390 bp, Artificial Sequence
  Description of Artificial Sequence: Synthetic coding sequence
atgagctttcctaagtacaaaccttcctccctgagaacactacccgaaaccctcgatcccgctgagtataatattagtccagaaactcgtagagctcaggcggaacgcttggcgatccgagcccagctgaaacgtgaatacctgctgcagtacaacgacccgaaccgaaggggccttattgagaatccggctctccttcggtgggcctacgcaagaactattaacgtttatccaaactttcggccaacccccaaaaactccctgatgggggcactctgtggttttggccctctgatctttatttactatatcataaaaaccgagcgggatcggaaagagaaattgattcaggagggcaagctggatcgaacgtttcacctgtcgtattag

SEQ ID NO: 51963 - DNA, 363 bp, Artificial Sequence
  Description of Artificial Sequence: Synthetic coding sequence
atgagctttccaaagtacaagccaagcagtctgagaacactccccgagactctcgatcctgctgagtacaatatttcgccggagacccgccgagctcaagctgagcggctggcaattcgcgctcagctgaagagggaataccttctccaatacaatgacccaaaccggagggggcttatcgagaatcctgccctactgcgctgggcatacgccaggactattaacgtgtatccaaatttccgtccgacccctaagaattccctgatgggcgctctgtgcggatttggccctctgatattcatctactatatcattaagacagagagggtgagcattcagaccaggtgcctggtgttcgagtag

SEQ ID NO: 51964 - DNA, 570 bp, Artificial Sequence
  Description of Artificial Sequence: Synthetic coding sequence
atggccgcaatgtccctgctgagacgcgtgagcgtgacagcggtggccgctctgtccggcaggcctctgggcactcggttggggtttggtggcttcctcacccggggattccccaaggctgccgcaccagtgcgccacagtggcgaccacggtaaacggttatttgtaattaggccttctaggttctacgatcgcagatttcttaaactcctgcgtttttacattgcgcttacagggattccagtggctatatttattacactggtgaacgttttcattggccaggctgagctcgccgaaataccagaaggctacgtacccgagcactgggagtactataagcatcccatctccagatggatcgcccgaaacttctatgatagccccgaaaaaatttatgagagaacaatggccgtcctgcagatcgaggctgaaaaagcagagttgcgggtaaaagagctggaagtacgcaaacttatgcatgtcaggggagacggtccatggtactactacgagaccattgataaggagctgatagaccatagccctaaggccacaccagacaattag

SEQ ID NO: 51965 - DNA, 414 bp, Artificial Sequence
  Description of Artificial Sequence: Synthetic coding sequence
atggccgctatgtctctgctgcgacgcgtctctgttaccgcagtggcagctctcagcggtcgccctcttgggactcggttaggctttggtggcttcttgacccgtggtttccccaaagcagcaggccaggccgaactggccgaaatcccagaggggtacgtcccagagcactgggagtattacaaacatccaatttctcgttggatagcgaggaatttctatgatagtcccgaaaaaatttacgagcgtacaatggccgttctccagatcgaagccgagaaagccgaactgcgagtgaaagagcttgaggttaggaaattaatgcacgttcggggtgacgggccttggtattactatgagaccatagataaggaactgatcgaccactcaccaaaagctacccctgacaattag

SEQ ID NO: 51966 - DNA, 342 bp, Artificial Sequence
  Description of Artificial Sequence: Synthetic coding sequence
atgaccggctacacccccgatgagaaactaagactgcaacagttgcgcgaactgaggcgtagatggttgaaagatcaggagttgtcacccagggaacccgtgcttcctcctcagaagatgggcccaatggagaagttttggaataaatttctcgagaacaagtcaccatggagaaagatggtccacggagtatacaagaaatctatatttgtgtttactcacgtcctggtcccagtctggatcatccactactacatgaaataccatgtctcaggggataccatccttgaaaccggagaggtgattcctcctatgaaggaatttcctgatcagcatcattag

SEQ ID NO: 51967 - DNA, 291 bp, Artificial Sequence
  Description of Artificial Sequence: Synthetic coding sequence
atgatcgccagaagaaaccccgagccccttcgcttcttgccagatgaagcacgcagcctgcccccacctaaactgactgacccacgccttctatacatcggcttcctgggctattgttctggactcatcgataacttgatcagacgacggccaattgccacagctgactatctgtatgcggtgcgggaccgcgagatgttcggttatatgaagctccatcctgaggacttccccgaagaggacaaaaagacgtacggcgagatcttcgaaaagtttcaccccatccgatag

SEQ ID NO: 51968 - DNA, 267 bp, Artificial Sequence
  Description of Artificial Sequence: Synthetic coding sequence
atgatcgcaaggaggaatcccgaacccctgagattcctgccggatgaagccagaagcctgccccctcccaaactcactgacccacgcctcctgtacattgggttcctgggctactgcagcggtctcattgacaacctgatcagacggagaccgatcgccactgcgggtttgcataggcagctgctttatatcactgcctttttcttcgccggatactacctagtaaagctagaggcctacgctaacctatatgtggacaccctgtag

SEQ ID NO: 51969 - DNA, 360 bp, Artificial Sequence
  Description of Artificial Sequence: Synthetic coding sequence
atgatcgccaggagaaatccagaacctctgcgttttcttcccgatgaggctcggtctctgcccccaccaaaactcacagatcctagacttctgtacattggttttttaggctactgctctggactgattgacaacttgatccgaagaaggccaatagccactgcaggccttcacaggcagctgctgtacatcacagccttcttctttgccggatattacctggtgaaacgcgaggattacctctatgcagtcagagacagagagatgttcggatatatgaaactacaccctgaggactttccagaagaggacaagaaaacgtatggcgagatttttgaaaagttccaccccatccggtag

SEQ ID NO: 51970 - DNA, 231 bp, Artificial Sequence
  Description of Artificial Sequence: Synthetic coding sequence
atgatcgcgcgacggaaccctgaaccactcaggttcctgccagatgaagcgagatcactcccaccccctaagctgaccgacccaagactgctgtatatcggctttctaggctactgttccggattgatcgacaatctgattaggagacggcctattgccaccgcaggacttcacaggcagctgctgtacattacagccttcttttgttggatcctgtcctgcaagacgtag

SEQ ID NO: 51971 - DNA, 1032 bp, Artificial Sequence
  Description of Artificial Sequence: Synthetic coding sequence
atgtccgtactgttacggtcgggactaggtccactgtgtgcagtggccagggctgccatccctttcatttggcggggaaaatacttcagctcgggaaatgaacctgctgaaaatcctgtgacccccatgctgcggcacttgatgtacaagattaagtctacgggaccgatcacggtagccgagtatatgaaagaggttctaaccaaccctgctaaactattggggatctggttcatctccgaatggatggctacaggcaagtctacagcctttcagctagtggagctggggcctgggagaggtactctagtgggggatatactgagggtgtttacccagttgggcagcgtgctgaaaaactgtgatatcagcgtgcatcttgtggaaaaaacacctcagggctggcgagaggtttttgtcgatattgatcctcaggtcagcgataagctgagattcgtgcttgctccatccgctacgcccgcagaggccttcatccagcacgatgagacccgggatcacgtggaagtgtgcccggacgccggtgtgattattgaggaactgagccagagaatcgccttgaccggtggcgcagccctggtggcagactacggtcacgatggaacaaagactgacacttttagaggtttctgcgatcataagctacacgacgtgctcatcgcacctgggactgctgaccttacagccgacgtggattttagctaccttagacgaatggcccaggggaaagtggcttctctcggacctatcaagcagcacacttttctcaagaacatgggtattgacgtgcgcctgaaagtgctgctcgacaaaagcaatgaaccctccgtgaggcagcagctcctgcagggatacgacatgcttatgaaccccaagaaaatgggggaaagattcaacttctttgctctccttccacaccagcgcctgcaagggggtagataccagaggaatgcgagacaatcaaaaccctttgccagcgtcgtcgccggattctcggaactggcttggcagtag

SEQ ID NO: 51972 - DNA, 1452 bp, Artificial Sequence
  Description of Artificial Sequence: Synthetic coding sequence
atggccagcctgggggatttggtccgggcatggcacttgggagctcaggctgttgacaggggagactgggccagagcattacacctctttagtggggtgccagctccacctgccagactgtgttttaacgcaggctgcgttcacctcttggccggtgacccagaggcagccctgagagccttcgaccaggctgtgactaaagacacctgtatggccgtgggttttttccagaggggtgtggctaattttcagcttgccagatttcaggaggccctgtcagatttctggctcgcgctggagcagctgagaggccacgccgctattgactatacccagctgggcctgagattcaagctgcaagcctgggaggtgctccacaacgtggcctctgcgcagtgtcagctcggactatggacagaagccgcatccagcctgcgggaggctatgtcgaaatggccggagggtagcctcaacggattggactctgccctagaccaggtacagagacggggttcactacctccaagacaggtaccccgtggagaggttttccggcctcaccgctggcatttgaaacaccttgagcctgtggacttccttgggaaggccaaagtggttgccagcgccatcccagacgaccaggggtggggcgtgagacctcagcagccacagggcccaggggcaaatcacgacgcccgttcccttattatggatagcccccgtgcgggaactcatcagggtcccctggatgccgagaccgaagtgggcgctgatcgatgcactagtaccgcctaccaggagcagaggccccaagtcgaacaggtcggcaagcaagctccgcttagcccaggactgccagctatgggcggaccaggtcccggtccttgtgaggatccggcaggagcaggaggtgcaggcgctggcggaagcgagcccctggtaactgtgacagtgcagtgcgctttcaccgttgccttgcgggctcgcaggggggcagatctctcctccttgcgggcattactaggtcaggctttgccacaccaggcgcagctgggccaactatcttatctggccccaggagaggacggccattgggtccccatccccgaggaggagtctctccagcgggcatggcaggatgctgcagcctgtcctagagggttgcaactgcagtgccggggtgccggtggcaggcctgtactgtatcaagtggtggcccagcactcatatagcgctcaaggacctgaggaccttggttttcggcagggcgacacagtcgacgtgctctgcgaggaaccagatgttcctctcgcggttgaccaggcatggctggaaggacactgtgatggtcgtatcggaatatttcctaagtgtttcgtggtcccagccggtccaaggatgagtggcgctccgggaaggcttcctcggtcccaacagggtgatcaaccctag

SEQ ID NO: 51973 - DNA, 1284 bp, Artificial Sequence
  Description of Artificial Sequence: Synthetic coding sequence
atggcttctctcggagacttagtgagagcctggcatttaggagcacaagctgtcgatcggggagactgggccagggcgttacatttattcagcggtgtgcccgcaccacccgctagactatgcttcaacgccggatgtgtgcatctgctggccggtgacccagaagcagcgctgcgagcattcgatcaggcagttaccaaagacacctgcatggcagttggattctttcaacggggagtggccaatttccagctggcgagatttcaggaggccttgtctgacttctggttggccctggagcaactgcgtgggcacgccgctatcgattatacgcagctgggattgcgcttcaagcttcaggcatgggaggtattgcataacgtggcaagcgcccaatgccagctgggcttgtggactgaggccgcatcctccctcagagaagcaatgagcaagtggcctgagggctcactcaatggccttgatagtgctctcgatcaggttcaggggcctggcgctaaccacgacgcccgatctctgatcatggactcaccaagagccggtactcatcagggaccgctagatgccgagacagaagtcggagcagaccgctgcacatccactgcgtaccaggagcagcggccacaagtggaacaggtgggcaagcaggcccctctatccccagggctgcccgcaatgggcggacctggacccggtccctgcgaagatccagccggagcaggaggtgccggtgctggcggatccgaaccactcgtcaccgtaactgtgcaatgcgccttcaccgtcgcgctacgggcacgaaggggggctgatctttcttctttacgggctctgcttggccaggctcttcctcaccaggctcagctgggccaactgtcttatctcgctcctggagaggacggccactgggtgcccattcccgaagaggaatctctgcagagagcatggcaagatgccgctgcatgcccgagaggcctgcaattgcagtgccggggagcaggaggacgacctgtcctctaccaggttgttgcgcagcacagctattctgctcaggggcctgaagacctcgggttccgccaaggcgatactgtagacgtgctgtgtgaggaacctgacgtgccattggccgtggatcaggcttggctcgaggggcactgtgatggcagaataggaatttttccaaagtgctttgtggtgcccgcaggaccacggatgtcaggggcaccaggcaggctgcctaggtcacagcagggcgaccagccatag

SEQ ID NO: 51974 - DNA, 1113 bp, Artificial Sequence
  Description of Artificial Sequence: Synthetic coding sequence
atggccggaccacggtaccctgtttccgtgcagggcgctgccctggttcagattaaaaggctgcagaccttcgccttcagtgttagatggtccgatggcagcgatactttcgtgagacgctcttgggatgagttccggcagttaaagaccttgaaggaaacatttcctgtcgaggcaggcctattgcgacggtccgaccgagtgctaccaaaattactcgatgcgccattgttggggagagtgggacgaaccagtcgtgggctggccaggttgcagctactcgaaacatactcccggcgtcttctggcgacagcagagcgggtggctcggtctcccacaattaccggtttcttcgcgccacaaccgttggatctggaacccgcattgccgcctggtagcagggttatattaccaacgcccgaagagcagccactctcccgcgctgccggacgtctttctatccatagtcttgaagcacagtcactgcgttgtctccagccattctgtacccaggacacccgggacaggcctttccaggctcaggctcaagagagtctcgatgtgctacttagacacccctcaggatggtggctggtcgagaacgaagatagacagacagcctggttccctgctccatatctcgaggaggctgcacctggacagggtcgggagggaggcccaagccttggttcatcaggccctcaattttgcgcaagtagggcctatgaaagcagtcgcgcagacgagctctctgttcctgccggtgcacgtgtccgcgtgctggaaacatccgataggggctggtggctctgccggtatggtgaccgagcagggcttctgccagccgttctcctgagacccgagggcctgggcgcactgttgtccggaacgggtttccgaggcggagacgatcctgccggagaagctagggggtttccagaaccctcccaggccacagctccccctccgacggtgccgacacggccttcacctggcgctatccagtccaggtgctgcaccgttacacgccgagctctggagaggaggcctcgacgccagggcagaccacgcggttgtgtggacagcgtgccacaccccaccacagagcaatag

SEQ ID NO: 51975 - DNA, 1116 bp, Artificial Sequence
  Description of Artificial Sequence: Synthetic coding sequence
atggctggtccgcgatacccagtgtcggtccagggggcagcgctggtgcagatcaagaggctgcagacatttgcatttagcgtgagatggtcggatggaagcgacacctttgtgcgcagaagctgggatgagtttcggcagctgaagaaaaccctcaaagagacttttccagtggaagccggtctgttgagacgaagtgaccgggtgctgcctaagctgcttgacgccccactcttgggcagggtgggccgaacttctaggggtctggccagattgcagctgcttgagacttatagtaggcggctccttgctactgctgaaagggtcgctcggagcccaacaatcaccggatttttcgccccacaacccctggatttagaacccgcactgcctcccggttccagggtgatcctgcccacccccgaagagcaaccgctgagtcgggcagctggtagactcagcatacattccctcgaggcacagtcgctgcggtgcctacagcctttttgtacacaggataccagggatagaccttttcaagcccaagcccaggaaagtcttgacgtgcttctgcgccacccttcagggtggtggctggttgagaacgaagatcgccaaactgcctggttccccgcaccttacttagaagaagcagcaccgggacaaggaagggaaggaggtcccagtctcggatccagcggaccgcagttctgcgcctcgcgggcttacgagagttccagagccgatgagttaagcgtaccggcaggcgcacgggtgcgggtgctggagacatcagacagaggatggtggctctgtcgctatggcgaccgggctggtctgctgcctgccgtacttcttcgcccagaagggctcggcgcactgcttagcggaaccggcttcaggggcggtgatgatccggctggggaggcccgaggtttccctgaacccagccaggcaacggcaccacccccaacagtccctacaagaccgagcccgggagcgattcaatctcgctgttgcaccgtgacgcgcagggctctagagcggaggcctagacgccagggacgccctcggggatgtgtggattcagtcccacatcctacaacagagcagtag

SEQ ID NO: 51976 - DNA, 1131 bp, Artificial Sequence
  Description of Artificial Sequence: Synthetic coding sequence
atggcaggccctcggtatcccgtttccgtccagggcgcagccctggtgcagatcaagaggctgcaaacctttgccttctcagtccggtggtccgatggatctgacaccttcgtgagacgcagctgggacgaatttcggcaactgaaaaagactctcaaggagacattccctgttgaggccggtttgcttcggcgttccgaccgggtgcttccaaaactgcttgggcaggcttcgctggacgcaccgctgcttgggagagttggccgtacaagccgcggactggccaggctgcagcttctggagacatactcacgcaggctactggcaaccgccgagcgcgtggccagatccccgactattactggattctttgcaccccagcccttggatctagagcccgctttgcctcccggatctcgcgtgatcctgccaacccctgaagagcaaccactgtcccgcgcagcaggcagactgagcattcactcactcgaggcccaatcgctgcggtgtctacagccgttctgcacgcaggacacgcgggaccggccatttcaggcccaggcccaggaaagcttagacgtgctgctgaggcacccttccggatggtggctggtggaaaacgaggaccggcagactgcctggttcccggctccttacttagaagaggccgcaccaggccagggcagagagggaggcccttccctgggcagttcagggcctcagttctgtgcttccagggcttacgaaagcagcagggccgatgagctgagcgtgccagccggtgctagggtacgcgttctagagacgagcgaccgcggatggtggctgtgtcggtacggagacagagccggacttctccccgcagtattattaagacctgagggcctcggggctcttctttccgggactgggtttcgtggcggagatgatcccgcaggggaggcaaggggcttccccgagcctagtcaggctaccgctcctccacccaccgtccctactcggccttcgcctggggctatacagagccggtgttgtacggttaccaggcgggctcttgagcgaagaccaagacgccaggggaggccgcgagggtgtgttgactcagtgccacatcccactacagagcagtag

SEQ ID NO: 51977 - DNA, 1413 bp, Artificial Sequence
  Description of Artificial Sequence: Synthetic coding sequence
atgggcaaacttcactccaaaccagccgcagtctgtaagcgcagagaatcaccggagggggattctttcgcggttagcgcggcttgggccaggaaaggaatcgaggaatggattggccgtcagaggtgcccaggcggagtgtctggccctcgtcaactccggctcgccggaacaataggccgaagcaccagagaattagttggggacgtcctccgtgacactttaagcgaggaagaagaggacgatttccggctggaggtcgcccttcctcccgaaaagactgatggcctgggaagcggagacgagaaaaaaatggagcgggttagcgagccatgcccaggatccaagaagcagctgaagttcgaggaacttcagtgcgatgtgtccatggaggaggattcccggcaggagtggacatttaccctgtatgatttcgacaacaatggcaaagttacacgagaagatattactagcttgctgcatacgatctatgaggtcgtggactctagcgtaaaccactcccctacatcaagcaaaatgcttcgtgtcaagctcaccgtggctccagacggctctcagagtaagagaagcgttctggttaatcaggctgatctgcagagtgctcggccaagggcagagacaaagcctaccgaagatctgcgctcctgggagaagaaacagcgcgcaccgttacggttccagggcgattcccgactcgaacagagcgggtgttatcaccattgcgtcgacgaaaacatagagcgcaggaaccactatcttgatctggccggtattgagaattacacctcacagttcggacccggaagtccatcggtcgcacaaaagagcgagcttcctccacgcacctctaaccccaccaggtcgcgttctcatgagcccgaggcgatccatatcccacaccgaaaaccccagggggtggacccagcaagcttccattttctcgacacaccgatcgctaaagtgagcgagctgcagcaacggcttagagggacacaggatggcagtaaacacttcgtgaggtcccctaaggcccagggaaaaagcgtaggagttggtcatgtggcacgaggcgcaaggaataagccccctttgggacccgcaattccagctgttagtcctagcgctcacctggcagcatcacccgcattactgccctccctggcacctttggggcataaaaaacacaaacatagggcaaaggaaagtcaacaggggtgcagagggcttcaggcccctctggcctcgggaggacctgtgctcggaagggagcacctgagggagttacccgctctcgttgtttatgaatcccaagccggtcaacccgtgcaaagacacgaacaccatcaccatcacgagcatcatcatcactaccatcatttttatcagacatag

SEQ ID NO: 51978 - DNA, 1356 bp, Artificial Sequence
  Description of Artificial Sequence: Synthetic coding sequence
atgggaaagctacagtcaaagcatgccgctgctgctcggaagcggcgtgagtcccccgagggggactcatttgtggcctctgcttatgcctccggacggaaaggggctgaagaggctgagcgcagggcacgcgacaagcaggagttgcctaatggagatcccaaggaggggccatttcgggaggatcagtgcccactccaggtggcattacctgcggaaaaagcagagggccgtgagcaccctggacagctactgtcagcagacgatggcgaaagagctgcaaaccgagaaggcccacggggaccaggaggtcagaggctgaatatcgatgccctgcaatgcgacgtttccgtcgaagaagatgatagacaggagtggacttttacactgtatgacttcgataactgcgggaaagtgaccagggaagacatgtcctccctgatgcacacgatttacgaagtagtggacgcgagtgtgaaccacagctcgggttccagtaagacgctccgggtaaagctcactgtgagccctgagccctcttctaaacgcaaggaggggcctcctgcgggacaggaccgagagcccacaaggtgtagaatggagggagagctagccgaggaacccagggtagcagaccgcaggttgtccgcccatgtacgcagaccatccactgatcctcagccatgttcagaacgagggccttattgcgtggacgagaacactgagagacgaaaccactatcttgacttagctggaatcgaaaattacacaagcagatttggcccaggatctccacccgtccaggcgaagcaggagccccaggggagagcatcccatcttcaggcccgatccaggagccaagaacccgacacacatgccgtgcatcataggcgaagtcaggtacttgtcgaacatgttgtgccagcatctgagccggctgcgagggccttggatacacaaccacgtccgaaaggccctgagaagcagttcctgaaatctcctaagggatcaggaaagccacctggcgtgcctgccagctccaagagtggaaaagcattcagctactatttgcccgcagtgctgccacctcaggcccctcaggatgggcaccatctgccccagccaccccctcctccttacggacacaaacggtataggcagaaaggtagggaagggcattctccgctgaaagcccctcatgcccagccagccaccgtagaacatgaggtggtgagggacctgccacccacgcctgctggcgaaggctacgccgtccccgtgattcagcgccatgagcaccatcatcatcatgagcatcaccaccaccaccatcatcatcacttccaccccagctag

SEQ ID NO: 51979 - DNA, 507 bp, Artificial Sequence
  Description of Artificial Sequence: Synthetic coding sequence
atggccggatctgtggacaataggcagtgtggcaggcagggccgtcagtgtgggcagcagaccgtctctacagctgggtctgttgacggaaggcaggccgtctggatggcaggctctgtcgacgcctgccacagcggagcgaggggtggcgctggccctgcggctcacgcgagccgcaggggcctcagaggcgctagcgaccctgctgcccgtgcccctcctccccctagggcgccacctcctcctccgcctccccctctgccgccagttctggctccactccccagcacgcctcgatcacagcataccacggctcgcgacctgcgagccggtagccgggcagccgctggctgtgttccaatgggaagtcctgcccctacaccccacttgaggcagcaaactgcaactgactgtagatgttggcacgatggtggcggagcgccatggacccgagggcaggggcctggagctctgtgctcatctgccctggatgccacctggagatag

SEQ ID NO: 51980 - DNA, 936 bp, Artificial Sequence
  Description of Artificial Sequence: Synthetic coding sequence
atggggaagctgcagagcaagcacgccgcagccgctagaaaacgccgagaatcacctgaaggagatagtttcgtggccagcgcctacgcgtccggaaggaagggagccgaggaagccgaaagaagagcacgcgataagcaagagctgcctaacggcgatccgaaggagggacccttccgcgaagatcagtgtccccttcaagttgctttgccggctgagaaggccgaaggccgagagcatccagggcagctgctttccgccgacgacggagagagagctgccaatcgggagggccctcggggacccggaggtcagcgactaaacatcgatgcactccagtgtgacgttagtgtggaggaagatgacagacaggagtggaccttcaccctttacgacttcgataattgcgggaaggttacgcgtgaagatatgagctccctgatgcacaccatttatgaggtcgtggatgcttccgtcaatcatagcagcggatccagtaagactcttagagtcaaattgacagtctcccccgagccctcctctaagcgcaaagagggaccgccagcaggacaagatagggaaccaacacgctgtcggatggaaggtgagttggctgaggagcctagggtggccgaccgccgactgtccgcccatgtccgcagaccttctaccgatccacagccatgctccgaaaggggcccttactgcgttgatgaaaacacggagcggcgaaaccactacctagaccttgctggcatcgaaaattatactagccgattcggaccagggtctcagctgtgtgagaaacgctcaagcgcacccagaactcactcaggagacaaagccagaggggttggactgtgtagagagttgtggtcccaggcgggacacccccagtggcccggaccctttccgagcggcctggtggcagtatag

SEQ ID NO: 51981 - DNA, 936 bp, Artificial Sequence
  Description of Artificial Sequence: Synthetic coding sequence
atgggcaaactgcagagtaagcacgctgccgctgcccgaaaacggagagaaagccctgaaggcgacagtttcgtggcgtctgcatatgcgagcggccgaaaaggcgctgaagaggccgaacgccgagccagggacaaacaggagctgccaaacggcgatccaaaggaggggcctttccgtgaagaccagtgcccgttacaagtggccttgcctgccgagaaggccgaaggcagagagcaccccggacagctgttgtccgctgacgatggagagcgcgcagcaaatagagagggcccacggggtccgggagggcaacgattgaatattgacgctctgcaatgtgacgtgtctgtggaggaagacgaccgccaagagtggacttttacactctacgatttcgacaattgtggtaaagtcacacgggaggacatgagctccttaatgcatactatatatgaggtggttgatgcaagcgtgaaccatagtagtggttcatccaagaccctccgggtcaaactgaccgtgtcccctgaaccctccagtaagaggaaagagggccctcccgctgggcaagatcgagaaccaacccggtgtcggatggagggcgagttggccgaagagccaagggttgccgatcgacgactaagcgcacacgttcggcgaccctccactgaccctcaaccttgctctgagagaggaccttattgcgtggacgaaaacactgagcgtcgaaatcactacctggatctcgcgggtatcgagaattataccagtaggttcgggcctggttcccagttgtgtgagaagcgcagttcggctccaaggactcattctggtgacaaagccaggggcgtgggactatgtagggagctttggagtcaggccggtcacccccaatggcccggaccattcccgtcaggcctggtcgccgtctag

SEQ ID NO: 51982 - DNA, 438 bp, Artificial Sequence
  Description of Artificial Sequence: Synthetic coding sequence
atgcctggagtgacggtgaaagatgtaaaccagcaggaatttgtccgcgctctggctgcctttctaaagaaatccgggaagcttaaggtgccagagtgggtcgatactgtcaagctcgccaaacacaaggaactggcaccctacgacgagaattggttttatacaagagccgctagtactgcccgtcacctctacttacggggaggagcaggtgtcggtagcatgaccaagatatacggtggacgccaacgcaacggcgtgatgcctagtcacttctcccggggatccaaatcggttgcaaggagagtgttacaggcacttgaaggactgaagatggttgagaaagatcaggatgggggaaggaaactcactccccaaggccagagagatctggacaggattgcaggccaggttgctgctgctaacaagaagcactag

SEQ ID NO: 51983 - DNA, 1134 bp, Artificial Sequence
  Description of Artificial Sequence: Synthetic coding sequence
atggccgaggaggtggtggtggtggccaagtttgactacgtggcgcaacaggagcaggaactcgatattaagaagaacgagcgcctctggctgctggacgactcaaaatcgtggtggagggtaaggaacagtatgaacaagacaggatttgtaccctctaattatgtcgagcgtaaaaacagcgctagaaaggccagtattgttaaaaatcttaaagatactctcggtattggtaaggtgaagcggaaaccctccgtgcccgacagtgcatcccccgctgacgacagctttgtcgatcctggcgagagactatatgacctgaatatgccagcgtacgttaagttcaattacatggccgagcgcgaagatgaactgagccttataaagggcactaaggttatcgtcatggagaagtgttctgatggatggtggcgaggatcctataacgggcaggtgggttggttcccctctaactacgtaacagaggagggagactcaccactgggtgaccatgtggggagtctatcggaaaaacttgccgctgtggtgaacaacttgaacaccggccaggtgctccacgtggtgcaggccctgtacccattttccagcagcaacgacgaagaactgaatttcgagaagggcgatgtgatggatgtgatcgagaaacctgaaaatgatccagagtggtggaaatgtcgcaagatcaacggaatggtgggtctggtgcctaagaattacgtgacagtcatgcagaacaatcctctcacatcaggactggagcctagcccccctcagtgcgactacatacggccttccctgactggtaaatttgctggaaacccatggtactacggtaaggtaaccaggcaccaggctgagatggctctaaatgagcgcggacatgaaggagattttctcatacgagatagcgagagcagtcccaacgattttagcgtatccctcaaggcacagggcaagaataaacactttaaagtacagctcaaggagaccgtctactgtatcggccagagaaagttttccaccatggaggaactggtagaacactacaagaaagctcctattttcacctcagagcaaggggagaagctgtacctagtcaagcacctatcatag

SEQ ID NO: 51984 - DNA, 228 bp, Artificial Sequence
  Description of Artificial Sequence: Synthetic coding sequence
atggcagaggaagtcgtggtagtagctaagttcgactacgtggctcaacaagagcaggagctcgacataaagaaaaacgaaaggctttggctgttggatgactcaaaaagctggtggagggtcaggaacagtatgaataaaaccgggttcgtgcctagcaactacgtcgaaaggaagaattccgcacggaaggccagcattgtcaagaacctcaaagataccctgtag

SEQ ID NO: 51985 - DNA, 1134 bp, Artificial Sequence
  Description of Artificial Sequence: Synthetic coding sequence
atggctgaagaagtggttgttgtcgctaagtttgactacgtcgcccaacaggagcaggagttagacatcaaaaaaaatgagcgattatggttgcttgacgacagcaagtcatggtggcgcgtcaggaactcaatgaacaagacaggctttgtcccttcaaattacgtcgagcgaaaaaatagcgccagaaaggcttccattgtgaagaatcttaaggacactctagggattgggaaggtgaagagaaagccctctgtgccggatagcgcgtcaccagcagatgatagcttcgtggatccgggagagagactgtacgatttgaatatgcccgcttacgtcaagttcaactatatggcagaacgcgaggacgaactctccctcatcaaagggacaaaggtgatcgtaatggaaaagtgttccgatggatggtggcgcggatcgtacaatggccaagttggatggtttccatccaactacgtaaccgaggaaggcgacagcccactgggagatcacgtaggttcattgtctgaaaaactggcagctgttgtaaataatctgaacacgggccaagtgctgcacgttgtgcaggctttgtacccattctctagctcaaatgatgaagaattgaatttcgaaaaaggcgacgttatggacgtgatcgaaaagcccgagaacgacccagagtggtggaagtgtaggaaaatcaatggaatggtggggttggtcccaaaaaactacgtaactgtcatgcaaaataatccactgacgagtggcttagaacctagtcctccacagtgtgattacattagaccctctctcaccggtaaatttgctggaaatccctggtactacggcaaggtcaccaggcatcaggctgagatggccctcaatgagagaggacacgagggggattttctcatacgggatagcgagagcagccctaacgacttcagcgtgtcattaaaagcccagggtaagaataagcattttaaggtacagttgaaggagacggtgtactgtattggacagaggaagtttagtactatggaagaactcgttgaacactataagaaagctccgatcttcacaagcgagcaaggggagaaactctaccttgtaaaacatctatcctag

SEQ ID NO: 51986 - DNA, 348 bp, Artificial Sequence
  Description of Artificial Sequence: Synthetic coding sequence
atggccgaagaggtggtagtggtcgccaagtttgactacgtggcacagcaagagcaagagcttgacattaaaaaaaatgaacgcctgtggctcctggacgatagcaagtcatggtggcgggtgaggaattccatgaataagacagggttcgttcctagcaactatgtagagaggaaaaatagtgcacggaaagctagcattgtgaagaatttgaaagatacgttgggcatcgggaaagtgaagaggaagccttccgtgcctgatagtgcttcaccagcggatgattcatttgtggaccctggcgaaaggctttacgatttaaatatgcccgcatacgtgaagttttag

SEQ ID NO: 51987 - DNA, 390 bp, Artificial Sequence
  Description of Artificial Sequence: Synthetic coding sequence
atggctgaagaagttgtggtggtagcaaaattcgattatgtggctcaacaagagcaagaactcgatattaagaagaacgaacgactctggctgcttgacgactcaaagtcgtggtggagagttcggaatagcatgaataagactggctttgtgcccagtaactacgttgagagaaaaaattccgcccgaaaggcaagcatcgtgaaaaatctcaaggatacattgggtatcgggaaggtgaagaggaaaccttcagtgccggattccgcctctcctgccgacgacagtttcgtcgaccctggggagcggctgtatgaccttaacatgccagcttacgttaagtttaattacatggcagagcgcgaagacgaacttagcctgatcaagtag

SEQ ID NO: 51988 - DNA, 942 bp, Artificial Sequence
  Description of Artificial Sequence: Synthetic coding sequence
atggactggctgaacgttttcaaggactttttctccataggcaaggtgaagagaaaaccgtctgttccagattccgcttcccctgctgatgactccttcgtcgaccctggtgagcggctttatgatctcaatatgcctgcctacgttaagttcaactacatggcggagagagaagacgagttatccctcatcaagggaacaaaggtgatcgtgatggaaaaatgctcggatggatggtggcggggttcctacaatggacaggttgggtggtttcctagcaactatgttacagaggagggggacagcccccttggagatcacgtggggagcctaagcgaaaaactggctgccgtggttaataacttaaatacggggcaggtgctgcatgttgtccaggctctttacccattttccagcagcaatgacgaagagttgaactttgaaaagggcgatgtgatggacgtgattgagaagcctgagaacgacccagagtggtggaagtgccgcaagattaacggcatggtgggtttggtgcctaaaaactatgtgaccgtcatgcagaacaatcccctgacttccggactcgaaccaagccccccacagtgtgattatatacggccttcgctcactggaaagttcgccggaaatccttggtactacggtaaagtgacccgacaccaggccgagatggccctgaatgagaggggacatgaaggagatttcctgattcgtgacagtgagtcatcgccaaacgacttttctgtaagcctgaaggcccaaggtaaaaacaagcactttaaggtgcagcttaaggaaaccgtttattgcattggccagcggaagttttcgaccatggaggagctcgtggaacattataaaaaggcgccaatctttacaagtgaacagggcgagaaactgtacctggttaaacatctttcctag

SEQ ID NO: 51989 - DNA, 3384 bp, Artificial Sequence
  Description of Artificial Sequence: Synthetic coding sequence
atgagtttgacctccgcatatcagcacaagttagctgagaagctgacaattctgaatgatagaggacagggtgtcctcatccgaatgtacaacataaaaaaaacatgcagtgaccctaaatctaagccaccgttcctgctggaaaaaagcatggaaccgagcttgaagtacattaataagaagtttccaaacatagacgtgcggaacagtactcagcacctaggcccagtgcaccgggaaaaggctgaaattattcgattcctcacaaactattatcagtctttcgttgacgtgatggagttccgagaccatgtatacgaactcctcaatacgatcgatgcctgccagtgccattttgacatcaacctgaactttgactttaccaggtcatacctggatctgatcgtcacctacacttctgtcatcctcctcctgtctcggatagaagacagacggattctgataggaatgtacaactgtgcccacgagatgctccacggacatggagacccttccttcgccagattaggacaaatggtgttggagtatgaccatcccctgaagaagctgactgaggagttcggcccacacactaaagctgtcagcggcgctcttctgagcctccattttctgttcgtgagaaggaatcagggagctgaacagtggaggagtgctcagttactcagtctcatctccaacccacctgctatgattaatccagccaactctgatacaatggcctgtgaatatctaagtgtcgaagttatggagaggtggatcattattgggtttctgctctgccacggctgccttaactccaactcccaatgccagaaactgtggaaattatgcctgcaaggtagtttgtatattacactcattcgggaggacgttctgcaggtccataaggtgactgaggaccttttttcgagccttaaaggatacggcaaaagagtggctgacataaaggagtctaaagaacatgtgattgctaactctgggcagttccattgccagagaagacaatttctgcggatggctgtcaaagagctcgagacggttctcgctgatgagccaggcctcttggggccaaaggcccttttcgcctttatggcgttatccttcatcagggacgaggtaacgtggctggtccggcataccgagaacgtgacaaagaccaagacacctgaagattacgccgacagttctatagctgagctgctttttctactggaaggtatccggagcctggtgcgcagacacatcaaggtgatccagcaatatcacctgcaatacctggcacggtttgacgcgctggtgttatcagacattatacagaacctttctgtctgcccggaagaagagtccattataatgagcagttttgtttcgatacttagcagtctgaacctcaaacaggtggataatggggaaaagtttgaattctccggcctcaggcttgattggtttaggttgcaggcgtatacatccgtggctaaagccccactccatctgcatgaaaatcccgacctggcaaaagtgatgaacctgattgtcttccactcacgcatgttggattctgtggagaaactcctggtcgagacctctgatctgtccactttttgtttccatctccggattttcgagaagatgttcgcaatgaccctggaagaaagcgcaatgcttcggtatgccatagcatttccactcatttgtgcccatttcgttcactgcacccacgaaatgtgtccagaagaatacccccacctcaaaaaccacggactccaccactgcaactcattcctcgaggagctcgccaagcagaccagtaactgcgttctggaaatctgcgccgagcagcggaacctctccgagcaactcctacccaaacactgcgccacaacaatttcaaaagccaaaaataagaagacgcgcaagcagcgtcaaacacccagaaagggtgagcctgagcgggacaagccgggagccgaaagccacagaaaaaaccgatcaattgtcactaatatggacaaactgcaccttaacctgacagaattggctctaacgatgaaccacgtgtattccttttccgtctttgaacacacaatttttccaagcgagtaccttagcagtcaccttgaggcgaggttgaatcgcgctatcgtatggctagcagggtataacgcaacaacccaggagatcgtccgaccttctgaactgctggcaggcgtaaaagcttatatcggcttcattcagtcactagctcagtttctgggtgccgacgcttcgagggtcattagaaatgcacttttgcagcagactcagcctctcgacagctgtggcgaacagactattaccacactgtacaccaattggtacctcgaatctctgctgcgccaggcctcatccgggacgataattctgtcccctgccatgcaagctttcgtgagcctgccgcgagaaggagaacagaacttcagcgcggaggaatttagcgacatcagtgagatgcgggctctcgcggaactgctgggcccttacggcatgaagtttcttagcgagaacctcatgtggcacgtgacatcccagatcgttgagctcaagaaattagtggtggagaacatggacatactcgtgcaaataaggtccaactttagcaagccagacttaatggcttccctcctgccccaactcaccggagcggagaatgtcttaaagcggatgacaatcattggagtaatactgagcttccgggctatggcacaggaggggctccgagaagtcttctcgagccactgtccgtttctcatgggcccaattgagtgtctcaaggagttcgtgacgcctgacacagacatcaaagttactctgagtatattcgagctggcttccgcagcaggggtgggctgcgacatcgatcccgctcttgtggccgctatagctaaccttaaagccgatactagcagcccagaggaggagtataaggtggcgtgcttgcttttgatctttcttgccgtgagcctgcctcttttagccacagacccctccagcttctatagtatagagaaggacgggtacaataacaatatccattgtctgactaaagctattatccaggtgtccgctgccttgtttaccctatacaataaaaacattgagacacatctcaaggagttcttagtggtcgccagcgtctctctcctgcagctgggtcaagagactgataagctaaaaacccgcaaccgagagtccatctccttactgatgagactagtggttgaggagagtagctttctgactctcgatatgctggaaagctgctttccctacgtgctgctccgcaatgcctaccgtgaagtaagccgagcgttccatcttaactag

SEQ ID NO: 51990 - DNA, 3234 bp, Artificial Sequence
  Description of Artificial Sequence: Synthetic coding sequence
atggagccctcattgaagtatattaataagaagtttccgaatatcgatgtgcgtaactccactcagcacttggggcctgtgcatagggagaaggccgaaataatccgtttcctgactaattattaccagtcctttgtggatgtaatggagtttagggaccatgtgtacgagctactgaatacaatcgatgcgtgtcagtgccactttgacatcaatttgaactttgattttacaagaagctatctagatctaattgtgacctacacaagtgtcattctgttgctgagccgtatcgaagatcggagaatcctgattggcatgtacaattgcgcccatgagatgctgcatgggcacggtgacccctccttcgctagactgggacagatggtgcttgagtacgaccaccctttgaaaaagttaaccgaggagtttggccctcatacaaaggcagtctctggagctcttttgtccttgcactttctgtttgtcagaagaaatcagggtgccgaacaatggcgcagtgcgcaattgctctcccttattagcaaccccccagctatgatcaacccagctaactccgataccatggcttgtgaatatctctcagtggaagtcatggagcgttggatcatcatcggctttctgctatgtcacggatgccttaacagcaactcccagtgccagaagttgtggaagctgtgcttgcagggaagcctgtatattacccttataagggaggatgtgctccaggtacacaaggtgacggaggacttattctcatcattaaagggctatgggaagcgcgtggcggatatcaaggagtcgaaggagcatgtaattgccaacagcggacagttccactgccagaggcggcaattcttaagaatggctgtcaaagagctcgagacagtgctggccgatgaacccggtctcctcggcccaaaagccctgttcgcatttatggccttgagttttattcgggatgaggtgacctggctggtgaggcataccgagaatgtgactaagactaaaaccccggaggactatgcagactcctcgatagccgaactactcttcttgctcgaaggcattcgctccctagtgagaagacatattaaggtgattcagcagtatcatctgcagtacctggcaaggttcgatgctttggtcctctccgacatcatccagaacttgtcagtctgtcctgaggaagagtcaatcattatgtctagcttcgtatccatcttgtcgtctctgaatctgaaacaagtcgacaacggggagaagttcgagttttccggattacgacttgattggtttcgtttgcaggcatatacttccgtagccaaggcccctcttcatctgcatgagaaccccgacctggctaaagtgatgaatctcatcgtcttccactcacgaatgctggatagcgttgagaagctcctcgtggagacctccgacctgtctacattctgcttccatctccgcatttttgaaaagatgttcgcaatgactctagaagaatctgccatgttgaggtatgctattgcttttccgctgatatgtgctcatttcgtccactgcacgcacgaaatgtgccctgaagagtatccccacctgaagaatcatgggcttcatcattgcaattccttccttgaagaattagccaaacaaaccagtaactgtgttttagagatatgcgcagaacaacgcaacctttctgagcagctccttccaaaacactgtgctaccactatatctaaagccaagaacaagaagaccagaaaacaacgccagaccccacgcaagggcgaacccgagcgcgacaaacccggtgctgagagccaccgaaagaacagatccatcgtgacgaacatggacaaattgcacttaaacctcaccgaactcgccctaacaatgaaccacgtgtacagcttcagtgtgttcgagcacacgatcttcccaagtgagtatctctcatcccacctcgaagcacgcctgaaccgggctatagtctggctggcgggatacaacgccaccacccaggagattgtgcgcccaagcgagcttctggccggagttaaggcatatataggcttcattcagagtctagcacagttcctgggtgccgatgcttcccgagtcatcagaaatgctctgctccagcagacccaacctcttgacagctgtggcgagcagactattacaacactctatacaaactggtacctggaatccctgctacggcaggcttccagtggaacaatcatcctcagccccgcaatgcaagccttcgttagcctgccaagagagggcgaacaaaacttctcagcagaggagttcagcgacataagtgaaatgagggcacttgcagaactcttgggaccatacggcatgaaattcttgtcagaaaacctaatgtggcatgtcacctcccagatcgtggaactgaagaaactcgtggtggaaaacatggatatcctggttcagataagatctaatttctcaaaacccgatctgatggcctcactcctgcctcagcttactggagccgaaaacgttctgaaacggatgactattattggcgtcatattgtccttcagggcaatggcccaggaggggctcagagaagttttttccagccattgtccattccttatgggaccaatcgagtgtctcaaggaattcgtgacccctgacacagatataaaggtcacactgtccatctttgagcttgcctccgctgctggagtgggctgcgatatagatccagccctggttgccgctatcgctaacctcaaagctgatacaagcagcccagaggaggaatataaagtcgcctgcctcctgctgattttcttagcagtgagtctgcccctcttggcaactgatccatctagtttttacagcatagagaaagacgggtataacaacaacattcactgcttaacaaaggctatcatacaggtgagtgccgctcttttcactctgtataataaaaacattgagacgcacctgaaggaattcttggtggtggcctcagtctccctgctgcagctgggacaggagactgacaaactgaaaacccggaatcgggagagtatcagtcttctcatgcgcttagtggttgaagagtcatcctttctgaccctcgacatgttagaaagctgcttcccctatgtgttgctccggaacgcctatagagaagtttcaagagcgtttcatctgaattag

SEQ ID NO: 51991 - DNA, 2622 bp, Artificial Sequence
  Description of Artificial Sequence: Synthetic coding sequence
atgtcttttatcatgaagttacaccggcactttcagcgtaccgtcattctactcgctactttttgcatggtttcaatcatcatttccgcctactatctttactctgggtataagcaggagaacgaactgagtgagaccgcgtctgaagttgattgtggcgatctgcagcacctcccatatcagttgatggaggtgaaggccatgaagctttttgacgccagtcgaaccgaccccacagtgctggtatttgtggaatctcagtacagttctcttgggcaggacatcatcatgatactcgagtcttccagatttcagtatcacattgagattgcacccggtaagggcgacctgcccgtgctcatagacaagatgaagggcaagtacatactgataatctatgagaacatcctgaaatacattaacatggacagctggaataggtctctccttgacaagtactgtgtcgagtacggagtgggagtgatcggatttcataaaacttcggagaagagcgtgcagtcattccagttgaagggcttccctttcagtatttacggcaatctggccgtcaaagactgttgtataaacccccacagccccctcatccgggtgacaaagagttccaagctcgaaaagggatcattgcccggaaccgactggactgtcttccagattaaccacagcgcttatcagccggtgatttttgctaaagtcaaaactcctgagaacctgtcaccatccattagtaaaggggctttttacgccacaattattcatgacctaggcctgcatgatggaatccaacgggtgctcttcggcaacaacctgaatttctggctgcacaagctcatttttattgatgcaatatctttcctgtccggcaaacggcttacattgtcacttgatcgctacatactggtcgatattgatgacatcttcgtcgggaaagaaggaacacgcatgaatactaacgatgttaaggcgctgctagatacccagaatttgctgagagcacaaataacaaacttcaccttcaacttaggcttcagtgggaagttttaccacaccggcaccgaagaagaggacgaaggcgatgattgcttgctgggtagtgtggatgaattctggtggttcccacatatgtggtcccacatgcaaccgcatctgttccacaacgaatcttctcttgttgagcaaatgattctgaataaaaaattcgccttggagcatgggatcccgaccgatatgggctatgccgttgctccccaccactccggagtctatccagttcatgttcagctctacgaggcatggaagaaggtttggaacatcaagataacgtccacagaggaatacccacatctgaagccagctcgctacaggcggggttttatacacaaaaacatcatggtacttcccagacagacatgcgggctgttcacacacactattttttacaaggaataccccggaggtcccaaagagctggacaagtccattcaaggcggtgaactcttttttacagttgtgttgaaccccatcagcatcttcatgacacacctttcgaactatggtaacgatcgccttggcctgtacacattcgtaaacctcgccaacttcgtgaagtcttggaccaacctaagattgcaaacactgccgcctgtgcagcttgcccacaaatatttcgagctctttccggaccagaaggatccactgtggcagaatccttgtgacgacaaacgccatcgggacatttggtctaaagaaaagacttgcgaccgactgccaaagtttctggtgatcggaccccagaagacggggactaccgcgctgtacctgtttctggtcatgcacccttccatcttgagcaacagtccatctccaaagaccttcgaggaggtgcagtttttcaacaggaacaattaccatcggggaattgactggtacatggatttttttcctgtgccgtctaacgtgaccactgacttcctgtttgagaaaagcgctaactacttccattcggaggaggcaccgaaaagagccgcaagcctcgtaccgaaagccaaaattattacgatcctgatagacccttcagatcgggcatattcatggtatcaacaccagcgatctcatgaggatcccgctgctctgaaattctctttctacgaggtgatctccgccggtcccagggctcctagtgaactgcgcgctctgcaaaagaggtgcctagtgccaggttggtacgccagccatatcgagcggtggttggtctattttcctccgtttcaattactcattattgatggtcagcagctcagaactgacccagccactgttatggacgaggttcagaagtttcttggcgttctgccccattataactacagcgaggccctcacatttgattcccataaaggcttctggtgtcagctcttggaggaaggcaagacaaagtgcttgggtaagagcaaaggaagaaaatacccacctatggacagcgacagcaggacatttttaagctcttattaccgggaccataatgtcgaactgagtaaactgttacacaagttagggcagcccctgccatcgtggttgcgccaagagctgcaaaaagtacgatag

SEQ ID NO: 51992 - DNA, 1686 bp, Artificial Sequence
  Description of Artificial Sequence: Synthetic coding sequence
atgtcattcataatgaaactgcatcgccacttccagagaaccgtcatcctgcttgccactttctgtatggtctctatcatcatctcagcttattatctttatagtggttataagcaggaaaacgaactctctgaaaccgcctcagaagtcgactgcggtgatcttcaacacctcccctaccagctgatggaagtgaaagctatgaagctttttgatgcatctcgtacggaccctaccgtgctcgtgttcgtggagagccagtactcatcacttggccaggacattatcatgatactggagagcagtaggttccagtatcacatcgagatcgcccctgggaagggcgacttgcccgtgctcatcgacaaaatgaaggggaagtacatcctcattatctacgagaacattcttaaatacattaacatggactcctggaaccggagcttgctggataaatattgtgtggagtatggcgtaggggtgattgggttccacaagacaagcgaaaagagtgtccaaagctttcagctaaaaggctttccattcagcatctacggaaatttggctgtgaaggattgctgcatcaatcctcattcccccctgatccgagttacaaaatctagcaagctggagaaaggatctctgccaggtaccgactggacagtgtttcagattaaccatagcgcatatcagcctgtaattttcgctaaggtgaagactcccgaaaatctgtccccatcaatttccaaaggcgctttctatgccaccatcattcacgacttggggcttcacgacggaatccagagagtcctgttcggcaataacctgaacttctggctccataagctcatcttcattgacgccatttccttcttgtccggcaagagattgacactgtcactggacaggtatatcttagtggacattgacgacatctttgtgggaaaagagggcactcggatgaataccaatgacgttaaggaacatggaattcccaccgacatgggctacgcagttgctcctcaccacagtggcgtctatccagtacatgtgcaactctacgaggcctggaagaaagtctggaacatcaagataacaagtacagaagagtaccctcatttgaaaccagcccgataccggagaggctttattcacaaaaatataatggttctgccccgtcagacctgcggcctcttcacccataccattttctacaaagaatatcccggaggtcctaaagagctggataagagtatccagggaggagaactcttctttacagttgttctgaaccctattagcattttcatgacccacctgagcaattatgggaatgaccgtctagggctttatacctttgtgaacctggccaattttgtcaagagttggacaaacctacgtttgcagacgctgccacccgtccagcttgctcataagtacttcgagttgttccctgaccagaaggatcccctctggcaaaacccttgtgatgacaagcgacatagagatatctggtccaaggaaaaaacttgcgacaggctcccgaaattcctcgttatcggccctcagaaaactggaactacggccctctacctgttcttagtgatgcatcctagcatcctgagcaattccccatcacctaagacctttgaagaagtgtacgggtttctgccgtcccccatctag

SEQ ID NO: 51993 - DNA, 2619 bp, Artificial Sequence
  Description of Artificial Sequence: Synthetic coding sequence
atgaacttgattgtaaagctgcgaagatccttccgaacgctgattgtgttactcgccacattttgcctggtttctatcgtgatcagtgcttatttcctctatagcggatataaacaggaaatgacattaattgaaacaacagccgaggccgaatgcactgatatcaaaatcctcccctaccggagcatggagctcaaaaccgtgaagccaattgacacgtcaaagacggacccgactgttctgctttttgtggaatcccagtatagccaactgggccaggatataattgctatccttgaatcttcaaggtttcagtaccacatggtgatagcccctggcaagggagacattcctccgctgaccgacaacggaaagggcaagtacaccctcgtcatttacgagaatatcctgaaatatgtgtctatggattcttggaaccgtgaactactggaaaagtactgtgtggaatacagtgtctcaatcatcggcttccataaggccaacgaaaactccttgccaagcactcaactgaaaggattcccgctgaacctgttcaataatctggcactcaaggattgttttgtgaacccacagagccccctgctccatataacaaaggccccaaaggtcgaaaaagggcctctgcccggtgaggattggaccatatttcagtacaatcactctacatatcaaccagtactcttaacagagttacagacggagaagtcactgagctcactgtcttctaaaactttattcgcgactgtgattcaggacttaggtctgcatgacggaattcagcgcgtgctattcggcaataatctcaacttctggctgcacaaactgatttttatagacgccatctcctttttgagcgggaagcgactaacgctcagcctggaccgatacattctcgtggatattgacgatatctttgtgggtaaagagggcacaaggatgaatgtgaaggacgtcaaggctctcttggagacacagaatctgctgaggacccaggtggctaatttcacgttcaacttggggttttccgggaagttttaccacactggcacagaggaagaagacgaaggtgatgatctgcttctgcgaagcgtggatgaattctggtggttccctcatatgtggagccacatgcagccacacctcttccacaatgaaagctcgctggttgagcaaatgatccttaacaaggaattcgctctggaacacggcatacccattaacatgggctatgcagttgcgccacatcacagtggagtgtatccggtgcacatccagctttacgccgcatggaagaaagtctggggaattcaagtgacctcgactgaggagtacccacatctgaaacctgccaggtatcgcaaaggcttcatccacaacagcataatggtgctgccaaggcagacgtgtggcctgtttacacacaccattttttacaaagaataccccggtggccctcaagagctcgacaagtccataagaggtggagagctatttctgacgattctgctaaatccaatcagtatttttatgacccacttgtctaactacggcaacgacaggctgggactatataccttcgtcaacctagtgaactttgtgcagagctggacaaacctgaaattgcagaccctccccccagtgcaactcgcacaccagtattttgaattatttccggagcaaaaggatcccctttggcaaaacccttgtgatgataagcgccataaagatatttggtcgcgtgaaaaaacatgcgaccacttgcccaaatttctagtgatcggaccccagaaaaccgggaccacagccttatacctctttctcctcatgcacccaagtatcatctccaacctgcctagcccgaagacgttcgaggaggtgcaattcttcaacggcaacaattaccacaagggaattgactggtacatggacttcttcccaactccgtctaacaccacatctgactttctgttcgaaaaaagcgctaattattttcacagtgaagaggcccctcgccgagcagcttctttagtccccaaggccaagatcatcaccattttgatcgacccaagtgaccgcgcatattcctggtatcagcatcagagaagtcatgaggacccggctgccctgcggttcaacttctatgaggtcatctcaacgggacactgggcgccaagcgatcttaaaacgctgcaaagaagatgtctggtgcccggttggtacgcagtgcacatagagcggtggctcacctattttgcaacctcccaactgctgattattgatggacagcagctgagatcggaccctgcaacggtcatggacgaggtgcaaaagtttctaggcgtcacccccagatacaactactccgaagccctcacttttgacccacagaagggcttttggtgtcagttgctggagggcggtaagaccaaatgcctgggtaagtctaaagggaggaaataccccccaatggatcctgaatcgcggactttcctttcaaattattatagagaccacaacgtggagctcagcaaacttctgcaccggcttggacaacctctcccatcctggctgcgccaggagctccagaaagtacgatag

SEQ ID NO: 51994 - DNA, 1635 bp, Artificial Sequence
  Description of Artificial Sequence: Synthetic coding sequence
atggctactgcgccaggtcctgctggaatagccatggggtctgtgggctctctgctagagagacaagacttttccccagaggagcttcgggctgctctcgccggatcgcgcggtagcaggcagcccgacggcttactgcgtaaaggtctcgggcagagagagtttctctcctacttacatctgcctaaaaaagactcgaagtccaccaaaaacacaaagagggcgccacgaaatgaacctgcagattatgcaactctgtactatcgcgaacatagccgcgctggcgacttctctaagacctcactacccgagcggggtaggttcgacaagtgccgtatccgaccatcagttttcaaacccaccgcagggaacgggaagggctttctgtctatgcagagtcttgcctcccacaaggggcagaaactgtggcgaagcaacggcagccttcataccctggcttgtcacccaccactctccccagggcctagggccagtcaggcccgagcacagttgttgcatgcgctctctcttgacgagggagggcctgagcctgagccatccctgtccgactcctcctcagggggttcgttcggtaggtctccaggtaccgggccatcacctttctcaagcagcttgggccatctgaaccatcttgggggatccctagaccgcgcatcccaaggcccaaaggaagccggaccccctgctgtcctgtcctgtttacctgagccccctccaccctatgagttttcatgctcctcggcagaggaaatgggggctgtgcttccagagacttgcgaagaactgaagcgcggtctcggggacgaagatgggtcaaaccctttcacccaggttctggaggagcggcaacggttgtggctggctgaactcaagcgcctttatgtcgaacgactccatgaggttactcagaaggcagaaagaagcgagagaaatctccagctccagctgttcatggcacagcaggaacaaaggcgcctgaggaaagaattaagagcccagcagggcctcgcgcctgagccacgggctccgggaaccctgcccgaagcggatccctccgctcggcctgaagaggaggcacgctgggaggtgtgtcagaaaaccgcagaaattagtttgctcaaacagcaattacgagaggcccaggcggagctagcccagaaactggccgagatcttctccctgaagacacagttgcgcggatccagggctcaggctcaggctcaggatgctgagctggtcagactaagagaagccgtgagatccctgcaggaacaggctccaagagaagaagccccagggagttgtgaaacagacgactgcaagtctcggggactattgggcgaagccggtggatccgaagccagggactcagccgagcaactccgcgctgagctgctgcaggaacgactccggggacaggaacaggccctccggtttgaacaggagagaaggacctggcaggaggagaaggagcgggtcctccggtatcagcgtgagatacagggaggctatatggatatgtatagaaggaaccaggctctggagcaggagttacgtgccctcagggagcccccaactccctggtccccgaggcttgaatccagtaagatatag

SEQ ID NO: 51995 - DNA, 939 bp, Artificial Sequence
  Description of Artificial Sequence: Synthetic coding sequence
atggccgctcaaaagattaacgagggtctcgaacacctggccaaagccgagaagtacctcaagacaggattcctgaagtggaaacctgattacgactcggctgccagcgagtacggcaaggccgcagtggcttttaagaatgccaagcaatttgagcaggcgaaagatgcctgcctgcgcgaagctgtcgcacacgaaaacaatagagccctgttccatgccgctaaagcatatgagcaggccggaatgatgttgaaggagatgcaaaaactgcctgaggccgtgcagctcatagagaaggcctccatgatgtatctggaaaacgggactcccgacaccgctgcaatggcgctggagcgagccggtaaactcatagaaaatgttgaccctgagaaagctgtccagctctaccagcaaacagctaacgttttcgaaaacgaggaacggttgcggcaagctgtggagctgttgggcaaagcctctcggctgcttgttcgtggacgaagatttgacgaggccgctcttagcattcagaaggagaagaatatttacaaagagatcgaaaactatcccacctgttacaagaagaccatcgcacaggtgctggtccatctgcatcgcaacgattacgtggccgcagagcgctgcgtgcgcgagtcttattccattccaggctttaatggtagcgaagattgtgctgcgctggagcagctgctcgagggatatgatcaacaggaccaggaccaggtgagcgatgtgtgtaactcccctctatttaagtacatggataatgattatgcaaaactagggttgtccctggtggtgcccggtgggggaatcaagaaaaaatcccccgctacgccccaagccaagcccgatggcgtgacggctacggctgccgatgaggaagaggacgaatactctggcggtctgtgctag

SEQ ID NO: 51996 - DNA, 693 bp, Artificial Sequence
  Description of Artificial Sequence: Synthetic coding sequence
atgatgctcaaggaaatgcaaaagcttcccgaagctgtgcagctcattgaaaaagcgagcatgatgtatctggagaatggaacaccggacacggcagcgatggccctggagagggctggtaaacttatcgagaatgtggaccctgaaaaggctgttcagctctaccagcaaactgccaacgtgtttgagaatgaggagcggctgaggcaggccgtggaactgctgggtaaagcatccagactgttggtgcgaggtcggaggttcgacgaggcagcgctctccattcagaaagagaaaaatatatacaaagaaatcgagaattacccgacttgctacaagaaaacaattgcacaagtgctcgtgcacctgcaccgcaatgactacgtggccgctgaaagatgtgttcgagagagttacagtatccctggttttaacggctccgaagattgcgcagccctggaacagctgctagaagggtatgatcagcaggaccaggatcaggtttcggatgtgtgcaactccccccttttcaaatacatggataatgactacgccaaattaggcctgtctctggttgtaccgggaggagggattaagaagaaatctccagctaccccacaggctaagccagacggagttaccgcaaccgccgcagacgaagaagaagatgagtactctggcggtctctgctag

SEQ ID NO: 51997 - DNA, 1611 bp, Artificial Sequence
  Description of Artificial Sequence: Synthetic coding sequence
atgttacatctactagccctgtttctccattgtcttcccctggcgagcggcgactatgacatatgtaagagctgggtcaccacagatgaaggaccaacatgggaattctacgcttgtcagcccaaggttatgaggctgaaagactacgtgaaggtcaaggtggagcctagtggcatcacatgcggtgatccacccgagaggttctgctctcatgagaacccctacctgtgttcaaatgaatgtgatgcctccaatccagatctggcccatcctccacgcctcatgtttgacaaggaggaggaaggcctggcgacctactggcagtcaatcacgtggagccgttatccctcgccgttggaggctaacattactctttcctggaataagaccgtcgagctcaccgatgacgtagtaatgaccttcgagtatggacgccctacagtaatggtgttggaaaaatccctagacaacgggaggacatggcaaccgtaccagttctacgccgaagattgtatggaggccttcgggatgtcagcaaggagagcacgagacatgtcttcctctagcgcccaccgggttctgtgcactgaagagtatagccgctgggctggctcaaagaaagagaagcacgtgaggttcgaagttagggaccgcttcgcaattttcgccggaccagacctgagaaacatggacaacctgtatacccgcctcgagtccgctaagggcttgaaagagttctttacactaacggacctcaggatgcggttgctgcggccagctctggggggtacatacgttcagcgggaaaatctgtacaaatacttctatgccattagcaatatcgaagtcatcggacgttgcaaatgcaatcttcacgccaatctgtgctccatgcgcgaaggctcacttcagtgtgagtgcgaacacaataccactgggccagattgcggcaagtgtaaaaagaatttcaggacccgctcttggcgcgctggatcatatcttccccttccccatggttcaccaaatgcttgcaccgcgccatcaggaacgttctccaaggatgccttcctgcactgtgaatgttacgggcacagcaaccggtgcagctatattgacttcctaaacgtagtcacctgtgtgtcatgcaaacacaatacccgtggacagcattgtcaacattgccgattgggctattaccgaaatggctccgctgagctcgatgatgagaatgtgtgcatcgaatgcaattgcaaccagattgggtccgtgcatgatcgctgcaacgagacagggttttgtgagtgccgcgaaggagccgctggtcctaagtgtgacgactgtctgcccacccactattggcgacagggatgttatccaaatgtttgcgatgatgatcaactgttatgccaaaatgggggtacttgtctgcagaatcagagatgcgcatgtccacggggatacactggggtgaggtgcgagcagccccgatgcgatccggctgacgatgacggaggtctcgattgcgaccgtgcccctggagcagctcctagaccggctaccctccttgggtgtctgctgctgctgggtctcgccgcaaggcttgggcgatag

SEQ ID NO: 51998 - DNA, 1269 bp, Artificial Sequence
  Description of Artificial Sequence: Synthetic coding sequence
atgctacacctattggccttgtttctacattgtctgccactggcatccggagactacgatatttgtaaaagttgggtgaccaccgacgagggaccgacatgggagttctacgcctgccagcctaaagtgatgagactcaaggattatgtcaaagtcaaggtggaaccaagcgggataacctgcggggacccacctgagcggttttgttcccacgaaaatccttatctctgtagcaacgagtgtgatgccagcaaccctgatctcgcccatccgcctaggttaatgtttgataaagaggaggaagggctcgctacatattggcagtccattacttggtccagatacccttcccctttagaggctaatatcacattatcttggaacaaaaccgttgaattgacagacgacgtagttatgacattcgaatacggacggcctacagttatggtactggagaagtcattggacaacggtagaacatggcagccatatcagttctatgccgaggactgcatggaagctttcggtatgagcgcgagacgagctcgagacatgtcgtcatcttccgctcatcgagttctgtgcactgaagagtacagtagatgggctggttccaaaaaagagaagcacgtgcgctttgaggtcagagatagattcgccatattcgcgggacctgacctgcgcaatatggataacctatatacgcgactggaatcagctaagggattgaaggagtttttcaccttgacagacctgagaatgagactgctccgccctgctctgggaggcacatatgtgcaaagggagaacctgtacaagtacttctacgccatcagcaatattgaagtaatagggagatgtaaatgcaatctccatgcaaacctgtgttcaatgagggagggatccctgcagtgcgagtgtgaacataataccacagggccagattgtgggaaatgcaaaaagaacttccgcacacgttcctggcgggctggatcctatttgcctcttccccatggttctcccaacgcttgcgcgaccgcagggtcatttggcactctacagacaccgcctccagggaggtctccctctgccctgcgtggcagtagaaggggactcgctaatgtaaaggagccggcagggagcaggccccaaataagtgagatgctgctgggatgcactgtaacactccaccaaggaagtgtaggccctcatattccgccaaaattgagtctgcccgatcccggtggcccatggctgggatcccaatag

SEQ ID NO: 51999 - DNA, 1569 bp, Artificial Sequence
  Description of Artificial Sequence: Synthetic coding sequence
atgctgcacctgctggccttatttctgcattgcctccccctggcctccggcgactatgatatttgtaagtcttgggtaactactgacgagggcccaacatgggaattttatgcctgtcagccaaaagtgatgcgcctgaaggactatgtcaaggtgaaagtggaaccttctggaataacttgtggagatcccccagaacgcttctgttcacacgagaacccgtacctgtgctccaacgagtgtgatgcgagcaatcctgacctcgcacatcctccacgcctcatgtttgataaagaagaagaagggctagcgacatattggcaatccatcacatggagcaggtacccaagcccactggaagccaacatcactctctcttggaataaaactgtggaactgactgacgacgtggtaatgacctttgaatacgggaggcccacagtcatggttctggagaagtccctggacaatggtcgcacctggcagccatatcagttttatgccgaagactgtatggaagccttcggtatgtccgccagacgtgcccgtgacatgagttcttccagcgcccatcgagtcttatgcacagaggaatactcaaggtgggcgggatctaaaaaagagaagcatgtccgctttgaggtcagagatcgttttgcgatcttcgccggacccgatctgcgtaacatggacaacctgtatacacgactggagtccgccaaaggactgaaggaatttttcacactgacagacctccggatgcggctccttcgccctgcactgggaggaacgtatgttcagcgagagaacttgtacaaatatttttacgctatcagtaatatcgaagtgattggcaggtgtaagtgtaacctacacgcgaatctttgttcaatgcgggaggggagcctgcaatgcgaatgtgaacacaacacaactgggccagactgcggcaaatgcaagaaaaactttcggacccgctcttggcgagcgggatcctaccttcctctgcctcatggttctcccaacgcctactgtgaatgctatggacactccaaccggtgtagttacatcgactttctgaacgtcgtcacttgtgtgagctgcaaacataatactagagggcagcactgccagcactgccgtttgggctactacaggaatggaagtgctgagctggatgacgagaatgtttgtatcgagtgcaattgtaatcaaataggctccgtgcacgatagatgcaatgaaaccgggttttgtgagtgccgagaaggagcagctggcccaaagtgcgatgattgcctacctactcactactggaggcagggctgctatcctaacgtctgtgacgacgaccaactcctgtgccagaacggcggaacctgcctacagaatcaacgttgtgcctgcccgagggggtataccggcgttcgatgcgaacaaccaaggtgcgaccccgcagatgatgatggcggtctcgactgtgatcgcgctcccggtgccgctcctcgccctgccacactgctcggctgcttgctcttattgggcctggctgcccgtctggggaggtag

SEQ ID NO: 52000 - DNA, 1593 bp, Artificial Sequence
  Description of Artificial Sequence: Synthetic coding sequence
atgttgcacctccttgctctgtttctacattgcctgcccctggctagcggggattatgacatttgcaaatcatgggtgaccacagatgaaggacccacgtgggagttctatgcttgccagccgaaagtgatgaggctgaaggactacgtaaaggtgaaggtcgagccttccggcataacgtgtggcgacccaccagagcgcttctgttcccatgagaacccttacttgtgttccaatgagtgcgacgccagcaaccccgatctcgcccacccaccgagactgatgttcgacaaagaagaggagggacttgccacttactggcagagcattacctggtccaggtatcccagccctctggaggccaatattacactttcttggaacaagacagttgaactgacagacgacgtagtgatgaccttcgaatacgggcgacctactgtgatggtgctggagaagagtctagacaacgggcgaacctggcagccctaccagttttatgctgaggactgtatggaggcattcgggatgagcgctagaagagctagggacatgtcttcctcttccgcccatagggtgctgtgtaccgaggaatacagtaggtgggctggatcaaaaaaagaaaagcatgtgaggttcgaggtgagggacagattcgccattttcgccggaccagacctgcgcaacatggacaatctttacacccgtctggagtcggcaaagggcttgaaagagtttttcaccctgaccgatctgcgaatgcgcctgctgcgacccgctctcgggggaacctacgtacagagggagaacctgtacaaatatttctatgcgattagcaatatagaagtgatcggccgttgtaaatgtaaccttcatgctaacctttgcagtatgcgcgagggatccctgcagtgcgaatgcgagcacaacactacaggcccagattgcggaaagtgcaaaaagaactttcgcacccggagctggcgagctggctcatacttaccattgcctcacggctcacctaacgcttgtgcgactgccggatcatttggcaactgtgaatgttacggacactctaaccgctgttcgtatatcgactttttaaatgtggtgacatgtgtttcgtgcaaacacaacaccagagggcaacactgtcagcactgccgccttgggtattacaggaacgggtcagccgaattggacgacgagaatgtgtgcatcgaatgcaattgcaatcaaatcggatcagttcatgacaggtgcaatgaaacaggcttctgcgagtgcagagaaggtgccgctggaccgaaatgcgatgactgcctgccaacccactattggagacagggttgctacccaaacgtgtgtgacgatgatcaactcctgtgccagaatgggggaacatgccttcagaatcagcgctgcgcatgtcctagagggtacaccggcgtgcggtgcgagcaaccacgctgtgatcccgctgatgacgatgggggactggactgtgatagagcccctggtgccgcacctagacccgctacgctgttaggttgcctgctgttgcttggtctcgcagctaggctcggccgatag

SEQ ID NO: 52001 - DNA, 858 bp, Artificial Sequence
  Description of Artificial Sequence: Synthetic coding sequence
atggcggctgcctccgagcctgttgattcaggtgccctttgggggttagagcgaccagaacctccacctacacggttccatagagtccacggcgcaaatattcgagtcgacccctctgggacccgcgctaccagggtggaaagctttgcccatggggtgtgcttttctagggaacctctggctccaggacaggtatttttggtggagatcgaagaaaaggaactggggtggtgtggccaccttcgcctcgggttgacagctctcgacccggcaagcctggcccctgtgcctgaattctcactacctgacctggtcaacctcggtcacacctgggtgttcgccataacccgacatcataaccgggtgccccgtgaaggacgccctgaggctgaggccgctgccccaagccgcccacccactctgctggtcgagccctatctgagaatcgagcagtttaggatacctcgcgatcggctggtcgggaggtcgaggcctgggttatatagtcacctccttgatcagttgtacgagctcaatgtactgccccctaccgctaggcggtccaggctcggtgtactattctgccccagaccagatggaactgccgatatgcacatcatcatcaatggagaggatatggggccttcagccagaggcctccccgcagctcagccactgtacgctgtagtagatgtgtttgcgtctactaaaagcgtcagactggtccagctggaatacgggctcccctcactgcagaccctttgcaggctggtcattcaacgatcaatggttcaccggctggccatcgacggcctgcacctgccaaaagaactgaaggatttttgtaagtatgaatag

SEQ ID NO: 52002 - DNA, 441 bp, Artificial Sequence
  Description of Artificial Sequence: Synthetic coding sequence
atgagctcctgttccaacgtatgtggaagccgccaagctcaggccgcagccgagggcggataccagcgctatggggtaaggagctacctgcaccaattctatgaagattgcactgcatccatctgggaatatgaggacgacttccagattcaaaggtcccctaatcggtggagctccgtcttttggaagcaggaattgggatttcatacttcaagccacagccaggagtggaaccggaagctgcagcataagaactgcccacggtgctgcttcggtagcctgtcccctcccggagaggcattgttgtgcaggcactgggactggccctaccaccctaaggcacctggatgcagtgctgagcccggagggggaccattccaatcaatccccacactgttatgcggtccaaagcggggttgtttcgcttcttcagaactgtag

SEQ ID NO: 52003 - DNA, 534 bp, Artificial Sequence
  Description of Artificial Sequence: Synthetic coding sequence
atgtcctcctgttctaacgtctgcgggagtagacaggcacaagctgctgctgagggcggatatcagaggtatggcgttagaagctacctgcaccagttttatgaagattgcacagccagcatctgggagtatgaggacgatttccagattcaaagatccccaaaccgttggtcatccgtgttctggaaggtcggcctcatttcaggcacggtcttcgtgatcctgggtctgacggtactcgccgttggtttccttgtgccacctaagatcgaggcatttggcgaggcggactttgtcgtagttgacacccacgcggtccagtttaacagcgctttggacatgtataagcttgccggtgcagtcctgttttgtattggaggcacgagcatggcgggttgtctgctgatgtctgtgtttgttaagagctattctaaggaagagaaattcctccagcagaagtttaaggaacggattgccgatattaaggcccacactcagcccgtaactaaggctcctggtacccccttgtcttag

SEQ ID NO: 52004 - DNA, 441 bp, Artificial Sequence
  Description of Artificial Sequence: Synthetic coding sequence
atgtcaagttgtagcaacgtgtgtgggagccgccaagctcaggccgcagccgagggcggatatcagagatatggagtcagaagttatctccaccagttttatgaagactgcactgccagcatttgggaatatgaagatgatttccagattcagagatctccaaacaggtggtccagtgtattttggaagcaggagctgggctttcacacaagcagtcactcccaggagtggaaccgaaaactccaacacaaaaattgtccacggtgttgtttcggcagtctgtccccccctggagaggcactcctgtgtcgccattgggattggccgtaccatcctaaggctcctgggtgctccgcagagcctgggggtgggcctttccagagcatccccacgttgctatgtggacctaaaagggggtgtttcgccagctcagaactgtag

SEQ ID NO: 52005 - DNA, 588 bp, Artificial Sequence
  Description of Artificial Sequence: Synthetic coding sequence
atgagcagctgcagcaatgtctgtgggagtcggcaggctcaggcggctgcagaagggggataccagagatatggcgtccgatcctacctccatcagttttacgaagattgcacagcctccatctgggagtacgaggatgattttcaaattcagcgctcacccaatcggtggagcagcgtcttttggaaggtggggcttatctccggaaccgtgtttgtcattctcggcctgaccgtgctggccgtgggattcctggtccccccaaaaattgaggcttttggggaggccgacttcgtcgtggtggacactcacgctgtccagtttaattctgctcttgacatgtacaaactggctggcgcagtgctgttttgtatcggaggaaccagcatggcaggatgtttgttgatgtcagtgttcgtgaaatcgtattccaaggaagagaaatttctgcagcagaaatttaaagagaggatagcggatattaaggctcatacacagccagtcacgaaggcaccagggcctggtgagaccaagattcccgtcacactgagccgagtgcaaaatgtacagccattgctggccacctag

SEQ ID NO: 52006 - DNA, 498 bp, Artificial Sequence
  Description of Artificial Sequence: Synthetic coding sequence
atgatgcggtgctgtcggagaaggtgttgttgccgacagccacctcatgccttgaggcccctgcttttgctgccattagttctcctgcctcctcttgccgcagcggctgccggacccaatcgttgcgatactatttaccagggttttgcagagtgcctgataaggctcggtgatagcatggggaggggtggcgagctcgagacaatctgtcgatcttggaacgatttccatgcatgtgctagtcaggtgctgagcggatgtccagaagaggccgcagccgtgtgggagtcacttcaacaagaagcgaggcaggcccctcgccctaataatctccacactctgtgcggggctccagtacacgttcgagagagaggtaccgggtcggaaacgaaccaagagacgcttcgtgccactgcccctgccctgccgatggctccagcaccgcctctgctcgccgcagcgctggccttagcttatctgctcaggcccttggcgtag

SEQ ID NO: 52007 - DNA, 2451 bp, Artificial Sequence
  Description of Artificial Sequence: Synthetic coding sequence
atgagtcggccacagggactgctctggctgcccctgctctttacacccgtatgcgtgatgctcaacagcaacgtgcttctgtggctgactgcgctcgcaattaaatttaccctgatagatagccaggcacagtatccagtggtcaacacaaactatgggaagatccggggattgagaaccccattacccaacgagattctaggtcccgtggagcaatatctgggagtgccctacgcttccccgcctactggtgagcgcagattccaaccccctgagccaccttcatcatggactggtatcagaaacactacccagtttgccgctgtctgcccacagcatttagatgagagatccttattgcatgacatgctgcctatatggttcactgctaatctagacactctcatgacttacgtgcaggaccagaatgaagactgcctttacctcaacatttatgttccaaccgaggacgatattcatgaccagaactctaagaagcccgtgatggtttacatccatggtgggagctacatggaagggactggcaacatgattgacgggagtatcctggcatcatatgggaatgtgattgtgataaccataaactatcgactaggaatccttggcttcctgagcacaggggaccaggctgcgaagggcaactacggtttattggatcagatccaagccttgcggtggatcgaggagaatgtcggagcatttggcggagacccgaagcgggtgaccatttttgggtcgggggctggggcatcatgcgtgagcctgctgaccctctcccattactctgaggggctcttccagaaagccataattcagtccgggactgcactgtcatcatgggccgtgaactaccaacccgcaaaatacacacgcattctggccgataaagtcgggtgtaatatgctcgatactaccgatatggtcgagtgtctgcgaaacaaaaattacaaggaactgatccagcagacaatcactccagcgacctatcatatcgccttcggacccgtgattgacggcgatgtcatccccgatgatccccagattcttatggaacaaggcgagtttttaaactacgacatcatgctgggagttaaccagggcgagggcctgaagtttgtggacggaattgtcgacaacgaggatggcgtcacccctaacgactttgacttctccgttagcaacttcgttgataacctgtatggctatccagagggtaaggacactctgcgtgagactatcaagttcatgtacaccgattgggctgataaggaaaacccagagaccagacggaagacgcttgtcgctctgttcacagaccatcagtgggtcgcacccgctgttgctactgccgacttacacgcacagtacggcagcccaacctatttttacgcattctaccaccattgccagtcagagatgaagccatcttgggccgattccgcacatggggacgaggtcccatatgtgtttggtatcccaatgataggtccaactgaacttttttcctgtaactttagcaagaatgatgtgatgctgtctgccgttgtgatgacctactggactaattttgcaaaaacaggagacccaaaccagcctgtgcctcaagataccaaatttatccacaccaaacccaacaggttcgaggaagtggcgtggtctaaatacaacccgaaagaccaactctacttgcacattggcctgaaaccgagagttagggatcactatagggctacgaaggtggctttctggctcgaacttgtgccgcatctgcacaatctcaacgagatattccagtacgtgtctactactacgaaggtgccccctcctgacatgacctcctttccgtacggcacaagaaggtcgcctgctaagatctggcctacaacaaaacgccctgcgattaccccggctaataaccctaaacactctaaggatccccacaagacgggcccagaggatacgactgtgctcatcgagacaaaaagagattacagcacggagctcagcgtaaccatcgcggtcggagcctctctcctgtttcttaacatcctagcattcgccgcactctattacaaaaaggataagaggcggcatgagacccatagacgccctagcccgcagcgcaacacaactaatgacattgctcatatccagaacgaagagatcatgagtcttcaaatgaagcagttggagcacgaccatgagtgtgaaagtctccaggcacacgatacgttaagactaacctgtcctcctgattacaccctcacactgaggaggagcccggacgacatcccactgatgacgccgaacacaattactatgattccaaacactctgacagggatgcagcctcttcacacattcaatacattttccggtggacaaaacagcacaaacctgccccatggacactcgacgacccgtgtgtag

SEQ ID NO: 52008 - DNA, 2451 bp, Artificial Sequence
  Description of Artificial Sequence: Synthetic coding sequence
atgtccagaccacagggcctactgtggctccccctcctgtttacacctgtgtgcgtaatgctgaacagcaacgttctcctctggttgacagctctggctattaaatttaccctaattgactcccaggcgcagtaccctgtcgtcaacaccaactatggaaagattcgaggcctgcgcactccgcttcctaacgagatattaggcccagtggagcagtacttaggcgtgccatacgcttcacccccaacgggagaacgcagattccagccaccagagccaccgtcttcctggaccggaatccgaaacacgacacagttcgccgcagtctgccctcagcacctggatgagagatccctacttcacgacatgcttcccatttggttcacagccaatttagacacgctcatgacctatgtgcaagaccagaatgaggattgtctttacctgaacatctacgtgccgactgaggacgacatccatgaccagaattccaagaagcccgtaatggtgtatatccacggtggtagctatatggagggaaccggcaacatgatcgatggatccatattagcaagctacggaaatgtaatcgtgattactatcaactaccgactggggatactggggtttttaagcacaggcgatcaggccgctaaaggcaattatggcttactagaccagattcaggccctgcgttggatcgaagagaatgtaggtgcgtttggtggcgaccccaagcgagttaccatttttgggtcaggagccggagcatcgtgtgtgagtctcctgactctcagccactacagcgaaggcctcttccagaaggccattatccaatccgggaccgcactgagcagctgggcagtgaattaccagcccgcaaaatacacacgtattcttgccgataaagtgggttgtaatatgctagacactacagatatggtcgaatgccttaggaataagaattataaggagctaatacagcaaacaataactccagcaacgtaccacatcgcatttgggcctgtcatagacggcgacgtcatccccgacgatcctcagattctgatggaacagggagagttcctaaactacgacatcatgctcggcgtgaatcagggggagggcctgaaatttgtggacggtatagtggataacgaagacggcgtgacgccgaacgacttcgacttttctgtgtcaaatttcgtggacaatttatacggatacccggaaggaaaggacactctgcgggaaactatcaagttcatgtacaccgactgggccgacaaggaaaaccctgagactcggcgtaagactctcgtggccctattcactgaccatcaatgggtggcccctgctgtggccacagccgatctgcatgcccagtacggcagcccaacctacttctacgctttttaccatcattgccaatcggagatgaagccctcatgggcggacagcgcgcacggtgatgaagttccttatgtgtttgggattccgatgattggtcccacagaattatttagctgcaatttctcgaaaaatgacgttatgctcagcgccgtggtaatgacatattggacgaactttgcaaaaaccggcgacccaaatcagcctgtccctcaagataccaaatttatacacacaaagccaaatcggttcgaggaagtggcctggagtaagtacaatccgaaggatcaactgtatcttcacatcgggcttaagccgagggtaagagaccactacagagccacaaaggtggccttctggttggagcttgtgcctcatctacataatctgaatgaaattttccaatacgtctcgacgaccaccaaggtgcccccacccgatatgacttctttcccatatggaaccaggcggtcgcctgctaagatctggccgactacgaagcggccagccataacacccgctaacaatccaaagcacagcaaagaccctcacaagaccggtccagaggacactaccgtcctcattgagactaagcgcgactactccaccgagctgagcgtcacaatcgccgtcggggctagcctactctttctgaacattctagccttcgctgctctgtactacaagaaggataagagacgccacgagactcataggcgccctagtccccagagaaacaccacaaacgacattgcccatatccagaatgaagagataatgtcccttcaaatgaagcaactggagcatgaccatgaatgcgagtcccttcaggcgcacgacacactgagactgacatgcccccctgattacactcttacccttagaaggagcccagacgatatccctctcatgaccccgaacaccatcaccatgattcctaatacgctgacaggcatgcagcctctgcacaccttcaataccttttcgggcggacaaaactctactaatctgccccatgggcactcaacaacaagagtctag

SEQ ID NO: 52009 - DNA, 2511 bp, Artificial Sequence
  Description of Artificial Sequence: Synthetic coding sequence
atgtcccggccacaaggattgctttggttgccgttgttattcactcccgtctgtgtgatgctaaattccaatgttctcttgtggctgaccgctctcgctataaagttcacactcattgactcacaggcccaataccccgtagtgaatactaactatggaaagatcagagggcttagaaccccattgcctaacgagattctcggtcccgtcgagcagtacctgggagtaccatacgcatctccacccacgggggaaaggaggtttcagccccctgagccgccaagtagctggactgggatacgcaacacaacgcaattcgccgctgtgtgcccacaacacctggacgagaggtctctgttacatgatatgttaccaatctggttcactgctaatcttgatactctgatgacatatgtgcaagaccagaacgaggactgtttatatctgaacatatatgtacctacagaggatggagctaataccaagaaaaatgcagatgacatcaccagtaatgaccgtggagaggacgaagatattcatgaccagaatagcaagaagccagtcatggtttatattcacggcggttcgtacatggaaggcacaggcaacatgattgacgggtcaatcctcgcaagttacggaaacgtcatcgtcataacaatcaactacaggctcggcatcttggggtttctcagcaccggagatcaggccgctaagggcaactacggcctccttgatcagattcaggcccttagatggatcgaagaaaacgtaggcgcttttggcggagaccctaaacgcgtgaccatctttggcagcggagctggagccagctgcgtgagcctgttgaccctcagccactattcggaggggctatttcagaaagccatcatccagtcagggactgctctctcaagctgggctgtcaactatcaaccagcgaagtatactcggatactggccgacaaggttggatgtaatatgctcgacactaccgatatggtggaatgtctgaggaataagaattataaggagctcattcagcagactataactccagccacataccatatcgccttcggccctgtgatcgatggggatgtgatacctgacgacccacagatcttaatggagcaaggtgaattcctgaattatgatatcatgctcggcgtcaatcaaggcgagggcttaaaattcgtggacggcattgtcgataatgaagacggagtaacaccaaatgattttgacttttccgtgagcaatttcgtagataacctgtacggatatcccgagggcaaggataccctgagagaaacgatcaaatttatgtatactgactgggctgacaaagaaaaccccgagacacggagaaaaaccctcgtggccctctttaccgaccaccaatgggtggctccagctgttgcaaccgccgacctgcacgcacaatacggctcccccacatacttctatgccttctatcaccactgtcagtctgaaatgaagcctagttgggcagactctgctcacggcgatgaggtgccttacgtgttcggtatcccgatgatcggtccaacagaactgttttcctgcaatttttcaaaaaatgacgttatgctcagtgctgtcgtgatgacttattggacgaatttcgccaaaaccggcgacccaaatcagcctgtcccacaagacactaaatttatccatactaagcctaatagattcgaggaagtggcttggtctaaatataatcctaaagatcagctctatctccacatcggactgaagccccgtgtcagggaccattaccgcgctacaaaagtggcattctggctcgaactcgtgccccatctccacaatcttaacgaaatctttcagtatgtgagtaccactaccaaggtacccccaccggacatgacgtcattcccgtatggcaccagacgctcacctgccaaaatttggcccaccaccaaacgacccgcaattactccggctaacaatcccaaacacagtaaggatccccataagaccggcccagaagatactaccgtgctgatcgagaccaaacgggattattccacagaactaagcgttacaatcgcagttggggctagcctcctatttttgaacatcctggctttcgccgcactgtactacaagaaagataagagaaggcatgagacccaccgcagaccttcaccacaaagaaataccactaacgatatagcccacattcaaaacgaagagatcatgagccttcagatgaagcagctcgagcacgatcatgagtgcgagagcctgcaagctcacgatactctccgcctgacatgtccgcctgattacactctgaccttaaggcgtagcccggatgatattccactgatgacccccaataccattacaatgattccaaatactttgaccggtatgcagcctctccacacgttcaatacatttagtggcggtcagaactccacaaatctgcctcacggccattctacaacgcgggtgtag

SEQ ID NO: 52010 - DNA, 2451 bp, Artificial Sequence
  Description of Artificial Sequence: Synthetic coding sequence
atgtcaaggccccagggactgctttggctgcccctccttttcactccagtgtgtgtgatgctgaactccaacgtgttactttggctaaccgcactcgccattaagttcactctgatcgattcgcaggcacaatatcctgtggttaataccaattacggcaagatcagaggcctaagaaccccgctgcctaacgagatcttgggtcctgttgagcaataccttggggtcccctatgcctctccaccaacaggcgaaagaagatttcagcctcccgagcccccttctagttggacagggatcagaaatactacgcaattcgccgctgtgtgtccacagcaccttgatgagaggtctttattgcatgacatgttaccgatctggtttaccgctaatcttgatacactgatgacttatgtccaggaccagaatgaagactgcttgtacctcaatatctatgtgcctaccgaagacgatatacatgatcagaacagtaaaaagcccgtcatggtgtatattcatggtggatcatatatggaaggtacaggaaacatgatagacggttccattctggcatcctacggcaatgtcatagtcataactatcaactatcgcctcgggatccttggatttctatctactggtgaccaggctgctaagggcaattatggcttgttggaccagattcaggccttgcgttggattgaggaaaatgttggcgctttcggaggagacccgaagcgggtgactatcttcgggtcaggggctggcgcttcttgtgtgagccttctgaccctgtcacactactccgaaggactgttccaaaaagccatcattcagagtggcacagccttatccagttgggctgtgaattaccagcctgccaaatacaccagaatccttgccgacaaggtggggtgcaacatgctagatacaactgatatggttgagtgtctgcggaataagaactacaaggaactgatccagcagaccatcacccctgctacctatcatatagcctttggcccagtgatcgatggtgacgttatcccggacgatccccagattttaatggagcagggtgagtttctgaattatgacatcatgctgggcgtgaatcagggcgagggcctcaaattcgtcgatgggatagtggataacgaggacggagttactccaaatgacttcgatttctcagtgtcaaattttgtggataacctatacgggtatcccgaaggcaaagacacactaagagaaactattaaattcatgtatacagattgggcagataaggagaaccccgagaccaggaggaagaccctggtagccctcttcaccgatcaccagtgggtcgctccagccgtggccactgctgatctgcatgcccagtacggatcccccacttacttctacgctttttatcatcattgccagagtgaaatgaagccatcttgggctgacagcgcccacggcgacgaagttccctatgtcttcggaatccctatgatcgggccaactgagctcttttcatgcaatttctcgaaaaatgacgtcatgctgagtgcggtggttatgacctattggaccaatttcgcgaaaaccggtgacccaaatcaacccgtgccccaggacaccaaattcatccacaccaaacctaatcggttcgaggaagtggcttggtccaaatacaatcctaaagatcagctgtatctgcacatcggccttaagcccagagttcgggatcactaccgcgcaacgaaagttgccttctggctggaactggtcccacaccttcataacctcaatgagatcttccagtacgtcagtacgaccaccaaagtgccacctccagacatgacctcgtttccttatggcacaaggagatcgcccgctaagatttggcctacaacaaaacggccagccataactcccgctaataaccccaaacactcaaaggacccacacaaaacagggcctgaggacacaactgtcttaattgaaaccaagagagactacagcaccgagctgtctgtcaccatcgctgtaggggcatcgttgctgtttctgaatatcctggctttcgccgcactgtattataagaaggataagagaaggcacgaaacacatcgtcgaccatcacctcaacggaatacaactaatgacattgctcacatccagaatgaggaaatcatgtctctgcagatgaaacagctcgaacatgatcatgaatgtgagtctctgcaggctcatgacacactaagactcacttgccccccagactataccctcacccttcggaggagccccgacgatatccccctgatgacaccaaacactattacaatgatcccaaatacactcacaggcatgcagccgctgcatacatttaataccttctccggtgggcaaaacagcactaaccttccccacggtcactccacaacgagggtgtag

SEQ ID NO: 52011 - DNA, 2451 bp, Artificial Sequence
  Description of Artificial Sequence: Synthetic coding sequence
atgtcccgacctcagggcctgttgtggctgcctctactgtttacaccagtgtgtgtcatgctgaacagcaacgttctgctgtggctgaccgcacttgccataaaattcaccttgattgactcacaagcccagtatcccgtagttaacaccaattacggaaagatccgcggtctgcggacaccattgcctaacgaaattctgggcccagtggagcagtacctgggagtgccatacgccagcccgcctaccggagaacggagattccagcccccagaaccgcctagcagctggacgggaattagaaataccacgcagtttgcggctgtgtgcccgcaacaccttgacgaacggtccctattgcacgatatgctgccaatatggttcaccgccaatctggacaccctgatgacttacgtgcaggatcagaatgaagattgtctgtacctgaatatctacgtacctactgaggatgacattcacgaccaaaactccaaaaagcccgttatggtgtatatacacggcggatcatatatggaggggaccggcaacatgatcgacgggagtattctcgcgtcctacgggaacgtgatcgttataacgataaattacaggctcggtatcctggggtttctgagtaccggcgaccaggccgcaaaaggtaactacggcctattggatcagatccaggctttacgttggattgaggagaacgtgggagccttcggtggggaccccaaacgagtgacaattttcggcagcggcgcaggagcctcatgcgtctctcttttgaccctgtcacattacagcgaagggttattccaaaaagctattattcagagcggaacagctctgagttcttgggcagtgaactatcagcctgccaagtacacaaggatactcgcagataaagttggatgcaacatgctggacaccactgatatggtggaatgccttcggaacaaaaactataaggagctaatccagcagaccattacacctgcaacctatcacatcgcttttggccctgttatcgacggcgatgtgatacctgatgatccccagatactgatggaacagggtgagtttctcaattatgatattatgctgggcgtcaatcagggggaaggcctgaaattcgtggacggaatcgtcgacaacgaagatggcgtgacccctaatgactttgatttcagcgtatctaactttgtggacaacctgtacgggtatccggaggggaaggataccttgagagagacgattaaattcatgtataccgactgggccgataaggagaatcccgagacgagacgaaagaccctcgttgccctgtttactgaccaccagtgggtggccccagccgtggccaccgccgaccttcacgcgcagtacggaagtccaacatatttttacgcgttttatcatcactgccagtctgaaatgaaacccagctgggcggactcagcccacggggacgaggtcccgtacgttttcggtatccccatgattgggccaacagagctgttctcctgtaacttctctaagaacgatgttatgcttagcgccgttgtgatgacttattggactaattttgcgaagaccggcgacccaaatcaaccggtccctcaggataccaagtttattcacactaaacctaatagattcgaggaggtcgcttggtctaagtacaaccctaaggaccagctgtatctgcatatcgggttaaagcccagggtgcgagaccactaccgagcgacaaaggtagctttttggctagagctcgtgcctcatcttcacaatctgaacgagattttccagtatgtgagtaccactactaaggttccccctccggacatgacctctttcccgtacggtacacgcaggtcacccgcaaagatttggcctacaacaaaaagacccgctatcacacctgctaataaccctaaacactccaaagatcctcacaagaccggacccgaggatacaactgtgctgatagaaaccaagcgggactattccaccgagctgagcgtgaccattgccgtcggtgcgagcctgctgttcctgaatatccttgcgttcgcagccctgtattataaaaaggacaagaggaggcatgagacgcatcgcagaccttctccgcagcggaataccaccaacgacatcgctcatatccagaatgaagagatcatgtccctccagatgaaacagctggaacatgaccatgagtgcgaatctctgcaggcacacgacactctgaggttgacctgcccgccagattacactctgacactgcgacgaagccctgacgatatccctttgatgactcccaataccataactatgattccaaacactctcaccgggatgcagcccctgcacaccttcaacaccttttctggaggacagaactctacgaatctgcctcatggtcactctacaactcgggtgtag

SEQ ID NO: 52012 - DNA, 558 bp, Artificial Sequence
  Description of Artificial Sequence: Synthetic coding sequence
atggtgaaattgggtaataattttgccgagaagggcaccaagcaaccactcctcgaggacggcttcgacacgattccattgatgacccccctggacgttaaccagctccagtttccccctccagataaggtcgtcgttaagacaaagacagaatacgaaccagataggaagaaaggaaaagcacgacctccacagatcgcggagttcactgtttccattaccgagggggtgacggaaaggtttaaggttagtgttctggttcttttcgcgttggcttttctcacctgcgtggtcttcttagtggtgtacaaggtctataagtacgacagggcttgcccagacggatttgtactgaagaatactcaatgcattccagagggacttgaatcctactacgccgaacaggatagttctgctcgggagaaattctacacggttatcaaccattacaatctcgctaaacagagtattactcggagtgtctccccctggatgtccgtgctctctgaggaaaagctttccgagcaggaaacggaggcagccgagaagagcgcttag

SEQ ID NO: 52013 - DNA, 558 bp, Artificial Sequence
  Description of Artificial Sequence: Synthetic coding sequence
atggtgaagttggggaacaatttcgcagagaagggaaccaaacagccgctgttggaagacggttttgataccattccactcatgactccacttgatgtaaaccagttgcaattccctccccctgacaaagtcgtcgttaaaaccaagacagaatacgaacccgacagaaagaagggcaaggcgagaccccctcagatagcagagtttaccgttagcatcaccgagggcgtgaccgagagatttaaagtgtcagtcctggttctcttcgccctagccttcctcacatgcgtggtctttctcgtggtctataaggtgtacaagtacgatcgcgcatgccctgacggattcgtgctgaaaaacacgcaatgcatccctgaagggctcgaaagctactatgctgagcaggacagctcagctcgtgagaagttctatactgttattaatcactataacctggccaaacagtcgataactcggagcgtgtccccatggatgtctgtactctcggaggaaaaactgagcgagcaagagactgaagccgctgagaagagtgcatag

SEQ ID NO: 52014 - DNA, 558 bp, Artificial Sequence
  Description of Artificial Sequence: Synthetic coding sequence
atggtgaaactcgggaataacttcgcggagaagggtactaaacaaccacttcttgaggatgggtttgatacgatccctctcatgacacctctggatgtgaatcagctccagtttccgccaccggataaggtcgtcgtgaagacaaagactgaatacgaacctgatcggaagaaagggaaggcacgaccaccacagatcgctgagtttacagtgagcattacagagggggtaacggagagattcaaggttagtgttctggtgctcttcgccctggcgttcttgacttgtgtcgtatttctagtggtgtataaagtctacaagtatgaccgtgcgtgtcccgacggctttgtgctgaaaaatacccaatgcattcctgagggattggagagctactacgctgagcaggactcttcagctcgcgaaaaattttatactgtgatcaatcattataacctcgcgaagcaatccattactcgttctgtcagtccatggatgagcgtgctgtccgaggaaaaactcagcgagcaggagacggaagctgctgaaaaatccgcctag

SEQ ID NO: 52015 - DNA, 441 bp, Artificial Sequence
  Description of Artificial Sequence: Synthetic coding sequence
atggtaaaactcggcaataatttcgccgagaaaggtaccaaacagccattgctggaggacggatttgacactatccccctcatgaccccgctggatgtgaaccagttgcagttcccaccccctgataaggtgtcagtgctggtactatttgctctcgcattcctgacctgcgtcgtgttcctcgtggtctacaaagtgtacaaatacgacagggcttgtccggatggctttgttctgaaaaatacgcagtgcattcctgagggacttgaatcttactatgctgagcaggatagctcagcccgagaaaagttttacacggtgattaatcactacaatctagcaaagcagagtatcacaagaagcgtgagcccttggatgagcgttctttcagaggagaagctgtccgagcaagagactgaggcagctgagaagtctgcctag

SEQ ID NO: 52016 - DNA, 558 bp, Artificial Sequence
  Description of Artificial Sequence: Synthetic coding sequence
atggtgaaacttggtaataacttcgcagagaagggtaccaagcagcctttactcgaggatggattcgacactatcccactgatgacgcccttagacgtgaaccagctccaattcccgcctccagataaagtggttgtgaagactaaaactgagtatgagcctgacagaaaaaagggcaaggccagaccacctcagatcgccgagtttactgtctccattacagagggcgtgactgagcgcttcaaagtgtccgtgcttgtgctgtttgccttggccttcttaacctgcgtcgtctttctcgtggtgtataaagtttataaatatgacagagcgtgtcctgatggcttcgtgttgaaaaatactcagtgcatcccggaaggattggaatcctactatgcagaacaagacagctctgcaagagagaaattttataccgtgattaatcactataatctggctaagcagagcattacacggtctgtctctccctggatgtccgtattaagtgaagagaagttaagtgaacaggagaccgaagcagctgagaagtccgcctag

SEQ ID NO: 52017 - DNA, 558 bp, Artificial Sequence
  Description of Artificial Sequence: Synthetic coding sequence
atggtgaaactgggcaacaactttgccgaaaagggaaccaagcaaccattgctggaggatggtttcgacaccataccactgatgactccccttgacgtcaatcagctgcagtttccacctccagacaaggttgtcgttaaaaccaagacagagtacgaacccgatcgcaagaaaggtaaggcaaggccccctcagatcgccgaatttaccgtgtcaatcacagagggtgttacagagaggttcaaagtgtccgtcctggtgctatttgccttagcatttctgacatgtgtggtgttcctggtggtctataaggtatataagtatgaccgggcttgccccgatgggttcgttctgaagaatacacagtgtataccagaaggactcgaaagttactacgcagagcaggattcaagtgcgcgagaaaagttctataccgtgattaaccattataacctggcaaagcagtcaatcacaagaagtgtgtcaccgtggatgagcgttctttcagaagaaaaactttcggagcaagaaactgaagctgcagagaagtccgcatag

SEQ ID NO: 52018 - DNA, 558 bp, Artificial Sequence
  Description of Artificial Sequence: Synthetic coding sequence
atggttaagttaggtaacaattttgctgagaaaggtaccaagcagcccctgcttgaggatggctttgacaccattccgcttatgactccactcgacgtcaaccaactccagtttcctccacctgacaaggttgtcgtgaagaccaaaacagagtacgagccagatcggaagaagggcaaggccagaccccctcaaattgccgagtttaccgtttccattaccgagggtgttacagaacgcttcaaagtatctgttctggtcctgttcgctctcgcgtttttgacctgtgtggtcttcctggtggtgtataaggtctataagtacgatagagcatgtccagatggcttcgtgctaaagaacacccagtgtattcccgaaggtctggagagttattacgccgagcaggatagcagtgcaagggaaaagttttatacagtgatcaaccactataacctggctaagcagtctatcacaagaagtgtgagcccatggatgagcgtgcttagcgaggagaagctgagtgagcaggagacagaggccgctgagaagagcgcctag

SEQ ID NO: 52019 - DNA, 558 bp, Artificial Sequence
  Description of Artificial Sequence: Synthetic coding sequence
atggtgaagctcggcaataacttcgctgagaaggggaccaagcagcccctcctggaagacggctttgacaccattcccctgatgacccccttagacgttaatcaactgcagttcccaccccctgataaggtagttgtaaagaccaagacagaatatgagccggaccgaaagaaaggcaaagcaagacctccccaaatcgccgagtttacggtctctattaccgagggggtgaccgagaggtttaaggtgtctgtgctggtactgttcgcgttagcatttttaacttgcgtggtctttctggtcgtttacaaggtatacaagtatgacagagcatgtcctgatggcttcgtgttgaagaatacacagtgcattcctgaaggcttggaatcctactacgccgaacaggactcctcagccagggagaaattttacaccgtaataaatcattataacctggccaagcagagcatcactagatccgtgagcccctggatgagcgttctgagcgaggaaaaactcagtgagcaggaaaccgaggctgctgagaagagcgcctag

SEQ ID NO: 52020 - DNA, 516 bp, Artificial Sequence
  Description of Artificial Sequence: Synthetic coding sequence
atggtcaaactgaatagcaacccaagtgagaagggtactaagccaccctctgttgaggatggttttcaaacggtccccctgatcacccctctggaggtgaaccacctccagctgccggcacctgaaaaggtcatcgtaaaaactaggacagagtatcagccagaacagaaaaacaaaggcaagtttagagtgcctaaaatagctgagtttaccgttacgatactggtgagcttggcccttgcctttctcgcatgcatagtgttcctggtggtgtataaggcattcacgtacgaccattcctgtcctgaagggtttgtttataaacataaacggtgcatccctgcatcactggacgcctattactccagccaggatccaaatagccggtctaggttctatacagtaatttctcactattctgtggcgaaacagtcgacggccagggccatcggcccttggctttctgcggcagcagtcatccacgaacccaagcccccaaagacccagggccattag

SEQ ID NO: 52021 - DNA, 516 bp, Artificial Sequence
  Description of Artificial Sequence: Synthetic coding sequence
atggttaagctaaatagtaatcctagcgagaaaggcacaaagcccccaagcgttgaagatggcttccagactgttcccctgattactccactggaggtgaatcacctccagttaccagcgcctgaaaaggtgattgttaaaactcggaccgagtatcaaccagagcagaagaataagggcaaatttcgcgtgccgaagattgccgaattcaccgtcaccattctcgtgagcttggctctggcctttctggcatgcatcgtgttcctcgtggtgtacaaggccttcacctatgatcatagctgccccgagggcttcgtctataagcacaagagatgcatcccagcatcactggatgcctattatagctcgcaggatccaaactctcgcagtcgattctacactgtcatttctcactattccgtcgccaagcagagtacggccagagctattggcccatggttatcagccgcagctgtaatccatgagcccaaaccccctaagacacagggccattag

SEQ ID NO: 52022 - DNA, 441 bp, Artificial Sequence
  Description of Artificial Sequence: Synthetic coding sequence
atggttaaactcaacagtaacccctctgagaaggggactaagccaccatctgtcgaagatgggttccagacagtgcccctcattactccactggaggtgaatcacctgcagctcccagcaccagaaaaagtgattgtcaaaactagaaccgagtaccagcccgaacagaagaacaagggaaagttccgcgttcctaaaattgccgaatttaccgtaaccatacttgtgagccttgctctggcatttctggcatgcattgtctttttggttgtatataaagcattcacatacgaccattcctgccctgaggggttcgtgtataagcacaaaaggtgtattcccgcttccctggatgcttattattcgagccaagatccaaattctagatcgcgcttttatacagtcatcagccattattcggtcgccaaacagtcaacatag

SEQ ID NO: 52023 - DNA, 480 bp, Artificial Sequence
  Description of Artificial Sequence: Synthetic coding sequence
atggtgaagctaaatagcaacccgtcagagaagggaacaaaacccccatctgttgaagacggcttccaaacagtaccactcatcactcccctggaggtcaatcacttacagctacccgctcccgaaaaggtgatcgttaaaaccaggactgaatatcaaccagaacagaagaataagggaaagtttcgggttcccaaaatagcggagttcaccgtgaccatattggtgtcactcgctttggcatttctggcatgtattgtgtttcttgttgtctacaaagcctttacctacgaccatagctgcccagaaggctttgtatataagcacaagcgctgcatccctgctagcctcgacgcttactactccagccaggatcccaattctagatccaggttctataccgtcatatcacactatagcgtggcaaaacagagcaccgcccgagctatagggccatggctgtcagcagccgctgtgtag

SEQ ID NO: 52024 - DNA, 1293 bp, Artificial Sequence
  Description of Artificial Sequence: Synthetic coding sequence
atggaaggggaaccatcacagccacctaattcatcctggccgttatctcagaacggcacaaacaccgaggccacccctgccaccaatctgacgttcagctcttactaccagcataccagccctgtggccgctatgttcattgtggcatacgctttgatcttcctgctatgtatggtggggaacacactggtgtgtttcattgttctgaaaaacaggcatatgcacaccgtgacaaatatgttcatcctcaacctggccgtatctgacttgctggtgggaatattctgtatgccaaccaccctggtggacaacctaatcacagggtggccttttgacaatgccacgtgcaagatgagcggcttggttcaagggatgtctgtgtctgcaagcgtgtttactctggtggccatcgccgtggaaaggttcaggtgtatcgttcaccccttcagggaaaaactgacccttcgtaaggccctggtcacaatagctgtaatctgggccctagccttgcttatcatgtgcccatccgcagtaactctgacagttacacgcgaagagcaccacttcatggtcgacgcacgtaaccggtcatacccactgtattcgtgttgggaggcctggcccgagaaaggcatgagaagagtgtatactacagttctgttctctcacatttacctcgcgcctctggccctgatcgtcgtcatgtacgcccgaatcgccaggaagctgtgtcaagcaccgggaccagctccgggaggtgaagaagcagccgaccctcgagcctcccgcaggcgggctcgtgtcgttcatatgctggtgatggttgccctgttttttacccttagttggctcccgctgtgggctctattactcttgatcgactacgggcagctatcagcccctcagctgcacctggtgactgtctacgcgttcccctttgcacattggctcgcgttcttcaattctagcgccaatccaatcatttacggatactttaacgagaactttcggcgtggctttcaggccgcttttagggcgaggctctgcccacggccatcaggcagccacaaagaggcctactccgagcgaccgggtggcctcttgcatagaagggtgtttgtcgttgtccgcccttccgatagtggactacccagcgaatctgggccaagttcgggcgctcccaggcccggaagactacctctgcgcaacggcagggtggcccatcacggcctcccccgtgagggcccaggatgtagccacctgccccttaccattccagcctgggacatttag

SEQ ID NO: 52025 - DNA, 1287 bp, Artificial Sequence
  Description of Artificial Sequence: Synthetic coding sequence
ggcgagccaagccagcctcctaactctagttggcccctgtctcagaatggcaccaacacggaagccactcccgcaactaacctcacctttagctcatactatcaacacacctcccctgtggccgctatgtttatcgttgcgtatgcgctgatttttttgctgtgcatggtgggtaatacattagtgtgtttcatcgttctgaagaataggcacatgcacacagtaaccaacatgtttatcctcaatcttgcagtgtctgatctgctcgtggggatattttgtatgccaaccactttagtagacaacctgataactggctggccttttgataacgccacctgtaaaatgtccggccttgttcaggggatgtcggtatccgcttcggtcttcactcttgtggcgattgctgtggaacgcttccgctgcattgttcacccttttagagagaaactgaccttaaggaaagcgctcgtgaccatcgcagtgatatgggcgcttgcgctgctaatcatgtgtcccagcgcggtgaccctgaccgtaactagggaagaacaccattttatggtggacgctcggaacagatcatatccactgtacagctgttgggaggcgtggccagaaaagggaatgcggcgagtgtatactactgtgcttttcagccatatttacctggcacccttagcactgatcgtggtgatgtacgcacggatcgcccgaaagctgtgccaggctcctggacctgcacccggaggtgaggaggctgccgatcctcgagcatcacggaggcgggctagagtggtccacatgctggtgatggtggctctcttttttaccctttcgtggttaccgctttgggccctgctattgctgatcgattatggacagctttctgctccacagctgcatctggtgacggtctacgcgttcccttttgctcactggcttgctttcttcaacagctcggctaaccccattatctatgggtattttaatgaaaatttcagacgtggttttcaggctgctttccgcgctaggctgtgtcccaggccaagcgggtcccacaaggaggcttactccgaacggccaggaggtctgctccatcgccgtgtctttgtcgtagtgagacccagcgatagcgggctgccttccgaaagcgggcctagctcaggcgctcctaggcccggacgcctcccattgcggaatggcagagttgcacaccacggcctgcctcgcgaaggccctggttgttcacatttgcccctcaccattcccgcatgggacatctag

SEQ ID NO: 52026 - DNA, 1569 bp, Artificial Sequence
  Description of Artificial Sequence: Synthetic coding sequence
atgaattccttctttggaacccctgccgcttcatggtgcctgctggaatctgacgtaagcagtgcacccgacaaggaagctggacgagaacgcagggccttatcagtgcagcaaaggggtggacctgcctggagtggatctctcgagtggtctagacagagtgctggagacagacggagactcgggctcagcaggcagaccgctaagagctcctggtcacgatctcgcgaccggacctgctgctgtagaagagcctggtggatcctggtccctgccgcagacagagccagaagagagcggttcataatgaacgaaaagtgggacaccaattcctctgaaaattggcatcccatatggaatgtaaacgacaccaagcatcatctatatagcgatatcaacatcacatatgtcaattactatctacatcaacctcaggtcgctgccatatttatcatttcttattttctgatcttctttttgtgcatgatgggtaataccgttgtatgttttatcgtgatgcgcaacaagcacatgcataccgtgactaacctatttattctcaatcttgccatttctgaccttcttgtcggcatattctgtatgccaataactctcttagacaacattatagcaggttggcctttcggcaacaccatgtgcaagattagtggtctggtccagggaataagcgtggccgcttccgtctttacgctggtcgccatcgccgtcgacaggtttcagtgcgttgtgtacccctttaaacctaaactgaccatcaaaaccgcctttgtgatcataatgattatttgggtgttggcaattactattatgagtccttccgcagtgatgttacatgtgcaggaggaaaaatactacagagtacgcctcaacagccagaataagacatctccagtgtactggtgcagagaggactggccgaaccaagagatgcgaaagatctacacaactgtgttatttgctaacatttatcttgccccactatctctcattgttattatgtatgggaggatcgggatttcactgttcagagcggcagttcctcacactggaagaaagaatcaggaacagtggcatgtcgtgtccaggaagaagcagaagattattaaaatgctgctcatcgtcgcgttgctgttcatcttatcttggttacccctctggacactgatgatgctttccgattacgccgatctctcccctaatgagctgcagatcataaacatctatatctatcctttcgctcattggctggcttttggcaatagctccgtgaatccaataatatacggcttttttaacgaaaactttagacgaggcttccaagaagccttccagctgcaactgtgccaaaaacgggctaaacccatggaagcctatgcgctaaaggccaagagccacgtgctgatcaacacatccaatcagctcgtccaggaaagtaccttccaaaacccgcatggggagaccctgctgtatcgtaagtcggcagagaaacctcagcaggagctcgtaatggaggagctgaaggagaccaccaattcctctgaaatttag

SEQ ID NO: 52027 - DNA, 399 bp, Artificial Sequence
  Description of Artificial Sequence: Synthetic coding sequence
atgaactcttttttcggcacccctgccgcttcatggtgtctactcgagtcagacgtcagttcggcacctgataaggaggcaggaagagaaagaagagctctgtccgtccagcaaaggggaggtcctgcttggagcggcagcctcgaatggagccgccagtccgccggtgatcggaggagattggggctttcacgacagacagctaagtcaagttggtctcgatcccgcgatcgcacatgctgttgtaggagagcatggtggattttagtcccagcagctgatcgtgccaggcgagagaggatggcaatctggaaacacgacgtccaagaccagtggattggccctggcaacatctgtcgcagcttctccttgtacgtgagctgcaattgttgtagatag

SEQ ID NO: 52028 - DNA, 1263 bp, Artificial Sequence
  Description of Artificial Sequence: Synthetic coding sequence
atgaacgaaaaatgggatactaactcctcggagaattggcaccctatctggaatgtgaatgacacgaagcaccacttatactccgatatcaacatcacatatgtcaactactatttgcatcaaccgcaggtggccgcaattttcataatctcttactttctcatcttcttcctttgtatgatggggaacaccgtggtgtgctttatcgtaatgcgaaataagcacatgcatacggtgaccaatctgtttattctgaacctggccatttctgatctgctggtcggcatcttctgtatgccaatcacgctgttggataatataatagccggttggcctttcggaaacactatgtgcaaaatcagcggcctcgtacaaggtatatccgtagcagccagcgtctttaccctggtagctattgccgtggataggttccaatgcgttgtttacccattcaaaccgaagttaaccattaagactgcctttgtaatcattatgattatctgggtgctcgccattactatcatgagccctagcgccgtgatgctgcatgtgcaggaagaaaagtactatcgggtccgacttaatagccagaacaagacatctccggtttattggtgccgagaagattggcctaaccaggagatgcgaaaaatctacaccacagtactgtttgctaacatctacttggctcctttgtcactgattgtgatcatgtacggacgcatcggaatctctttatttcgcgcagcagttcctcacaccggccgaaagaaccaggagcagtggcacgtcgtctctcgaaagaagcagaagatcatcaagatgctgctgattgtcgccctgctcttcatcctgtcatggttgccactatggacattaatgatgctaagcgattacgccgaccttagtccaaacgaactgcaaattatcaatatctatatttatccatttgcgcactggctcgccttcggaaatagcagcgtgaacccaatcatctatggatttttcaatgaaaattttcggcgtggttttcaggaggcattccagctgcagctgtgtcaaaaaagagccaagcctatggaagcctacgctcttaaggccaagtcacatgtgctgatcaacactagtaatcagttggtccaggagtcaacctttcagaacccccacggtgagactcttctgtataggaaatcagccgagaagccgcagcaggaactggtcatggaggagcttaaggagacaaccaacagttcagagatttag

SEQ ID NO: 52029 - DNA, 1272 bp, Artificial Sequence
  Description of Artificial Sequence: Synthetic coding sequence
atgtttatcatgaatgaaaagtgggataccaatagttccgaaaattggcatcctatttggaatgtgaatgataccaaacaccatttatattctgacattaatataacatatgtcaactactatctgcaccaaccacaggtggcggcaatattcatcataagctactttctgatcttctttttgtgtatgatgggaaacaccgttgtctgcttcatagtaatgagaaataagcatatgcatactgtcacgaatcttttcattctcaacttagccatttccgacttgctggtcggaatcttctgcatgcccataactctgctcgataacatcattgccggatggcccttcggaaatacaatgtgtaaaatctctggtctagtccagggcatctctgttgcagcttccgtgtttactcttgtggctatcgctgtggataggtttcagtgtgtggtttatccatttaaacctaagctgactatcaaaaccgccttcgtgatcattatgattatctgggtgctagcaatcactatcatgtcgccgtctgctgtgatgttacatgtgcaggaagaaaagtactatcgtgtgaggctgaatagtcagaacaaaacttcccccgtatactggtgccgggaggattggccaaatcaggagatgaggaagatctacacgaccgtactttttgcgaatatctatctcgcgccactgagtttgatcgtcatcatgtacggaagaattggaatcagtttatttcgggcagctgtgcctcatacgggcaggaagaatcaagagcaatggcacgtggtgtcccggaagaagcagaaaattattaaaatgctgctgatcgtggctctgctctttatcctgtcctggctgccactgtggacgctcatgatgctttcagactacgcggatctctcccccaacgagctacagatcataaacatttatatctacccgttcgctcattggttggcgtttggtaattcaagtgttaatcccataatttatggtttcttcaatgagaatttcagacgaggatttcaagaggccttccaacttcagctatgccagaaaagagccaagcccatggaagcgtatgcccttaaggctaagagccacgtgctgattaacacgagtaatcagctcgtgcaggagtccacatttcagaatccccacggtgagaccctcctgtacagaaaatccgccgaaaaaccccagcaggagctggttatggaggagctcaaagaaactactaacagctcagagatatag

SEQ ID NO: 52030 - DNA, 1002 bp, Artificial Sequence
  Description of Artificial Sequence: Synthetic coding sequence
atgcaggcagccggacatcccgagcccctggatagtcgaggcagcttcagtctgcctacaatgggggctaacgtgtctcaggataatgggacgggacacaacgcaacattctctgaaccattgcctttcctgtacgtgctgctcccagctgtgtattcaggcatctgtgcagtgggactgaccggtaacactgcagtgatactcgtcattctcagggcccctaagatgaaaaccgtcactaacgtgtttatcctgaaccttgccgtcgccgacggccttttcacactggtgctgccggtgaatatcgccgagcatctacttcagtactggccattcggggagttgctatgcaagctagttctcgctgtggaccactataatatattctccagtatctacttcctcgccgtcatgagcgtggacagatacctagtcgtgctggcaacggtacgaagtagacacatgccatggcgcacttatagaggtgccaaggttgcctctttatgtgtttggcttggtgtgacggtgctggtgctgccttttttttcatttgccggtgtgtactcgaacgagttgcaggtccccagctgcggtctctcattcccatggcccgagcaagtgtggttcaaggcctccagagtctacaccctggtgctcgggtttgtgctcccggtgtgcactatctgtgtgctatataccgacctgctgcgtagactgcgggcagtcagacttcgatctggggctaaggccctcgggaaggcaaggagaaaagtcaccgttctggtcctcgtggtgttggctgtgtgcttactttgctggacaccatttcatctggcctcagtggtcgccctgacaactgacttgccacagaccccgctggtcatatccatgagctacgtaatcactagcctatcctatgcgaacagctgcctaaatcccttcctctacgctttcttggacgataatttcaggaagaatttccgaagcatcctgcgttgttag

SEQ ID NO: 52031 - DNA, 1578 bp, Artificial Sequence
  Description of Artificial Sequence: Synthetic coding sequence
atggctcttgagcgcttgtgttcagtgttaaaggtgctcctgatcactgtattggtggtcgaaggaatcgccgtggcacagaaaacccaggacggtcagaacatcggtatcaagcacatccccgcaactcagtgcggcatctgggtgcgcacatccaatggcggacactttgcaagccctaattatccagactcttaccctcctaacaaggagtgcatatatatcctggaagccgcacccaggcaaaggatagagttgactttcgatgagcactattacattgagcccagcttcgagtgccgcttcgaccacttggaggtgcgagatggaccctttggcttcagtccgctcatcgatcgctactgtggcgtgaagagcccaccactcatcagatcgaccggtagattcatgtggataaaattttcgtcggacgaggaacttgagggactggggttccgggcaaagtacagcttcatacctgaccccgatttcacttacctcggtggaatcctgaatcctatcccagattgccagtttgaactcagtggcgctgatgggatcgtaaggagctcacaagttgaacaggaggagaaaacgaagccaggacaggctgtggattgtatctggactatcaaagccacccctaaggccaagatttatctgaggttcctggattaccaaatggaacatagtaatgagtgtaaaagaaattttgtcgcagtctacgacggaagctcaagcattgaaaatctgaaagctaaattctgttccactgtggcgaacgacgtaatgctgaagaccgggattggagtaatccgcatgtgggccgacgaggggtcccgtctctcgagatttcgcatgctgtttacctcattcgtagagcctccctgtaccagttccacattcttctgtcactccaatatgtgcatcaacaacagtctggtatgtaacggcgtccaaaactgtgcatacccatgggatgagaatcactgtaaggaaaagaaaaaagcgggtgtgtttgaacagatcactaagacacatggtacaatcatcgggatcacttctggtatagttttggtcttactgattatctctattctcgtacaagtgaagcagcctagaaagaaggttatggcttgtaagactgcatttaataaaactggttttcaggaagtattcgacccgccacattatgaactgttcagcttgagagacaaggaaatttccgctgacctggccgatctatctgaggagctcgacaactatcagaaaatgcgccgttcatcaacagcttcgcggtgtatacatgatcatcactgcggatcgcaggcttctagtgtgaaacagtctaggactaacctgtcctccatggagctcccttttaggaacgacttcgcccaaccacagcctatgaagacctttaattccacctttaagaaaagcagctacacttttaagcagggacacgaatgtcccgagcaggctctcgaggacagggtgatggaggaaattccctgtgaaatttacgtccgcggtcgggaagactcggcccaagccagtatcagtattgatttttag

SEQ ID NO: 52032 - DNA, 1578 bp, Artificial Sequence
  Description of Artificial Sequence: Synthetic coding sequence
atggccttagagcggctgtgttctgtgctgaaggtgctgcttatcacagtgctagttgttgaaggaatcgcggtggcgcagaaaacacaggacgggcagaacatagggattaaacatatacccgcaactcagtgcggtatctgggtgcggaccagcaacggcggacacttcgcctccccaaactacccagatagctacccccctaacaaggaatgtatctacatcctggaggccgctcctcggcagcggattgagcttacctttgacgaacactactacatcgagccatctttcgagtgccggttcgatcatctggaggttagggatggccctttcggcttcagcccattgattgatcgatattgcggtgtgaagagcccccctttgattcggtcaactggtcgatttatgtggataaaattcagcagcgatgaagaactggagggtctgggcttccgtgcgaagtacagctttatccccgatcctgattttacctatcttggcggtattttgaaccctattccggattgccagtttgagctcagtggagcagatgggatcgtgaggtcaagccaggtggaacaggaagagaagaccaagcccggacaggctgtcgattgtatctggactatcaaggcaaccccaaaggctaagatttacctgcgctttctcgactatcagatggagcattccaatgaatgcaagaggaattttgttgcggtgtacgacggctcatcttcaatcgaaaacctaaaagccaagttttgttctaccgttgccaatgacgtaatgctgaaaacaggcattggagtaatcagaatgtgggcagacgagggctccaggctgagccgctttcggatgctgttcacatcctttgttgagccgccttgtacctcatccacattcttttgtcactcgaacatgtgcatcaataactccttagtatgcaacggagttcaaaattgtgcttacccttgggatgaaaaccactgcaaggagaaaaaaaaggccggagtgtttgagcaaataaccaaaacccatggcactattattggaatcacttcaggaatcgttctcgtcttattaataatctctattctggtgcaggttaagcagcccagaaagaaggtgatggcgtgcaagacagctttcaataagactgggtttcaggaggtcttcgaccccccacactatgagttgttctccctgagagataaggagatttcggccgatctagctgatctgagcgaagaactggataattaccaaaagatgcggcgttcaagcactgcctccaggtgcattcacgatcatcactgtggaagccaagcatcctctgttaagcaaagccgaacaaacctatcctccatggaattgccttttcggaatgattttgcacagccacaacctatgaagacatttaacagtacatttaaaaagagcagttacaccttcaagcagggccacgaatgcccggaacaggctctcgaagatcgggtgatggaggagatcccctgcgaaatttacgtgcgagggagggaagattctgcccaggcatctattagcattgatttttag

SEQ ID NO: 52033 - DNA, 1233 bp, Artificial Sequence
  Description of Artificial Sequence: Synthetic coding sequence
atggaaacaagctcacctagacctccaagacctagttcaaatccgggactcagcctggacgccagactgggtgtcgataccaggctgtgggcaaaagtgttgtttacggcactgtacgcgctcatttgggctctcggcgcagcgggtaatgccctatccgcccacgtggtcctgaaggccagggcagggagggctggtagactgcggcatcatgtcctgtcactggcgctagctggactcctcctcttgttggtcggtgttcctgtagagctgtatagcttcgtgtggtttcactatccatgggtgtttggtgatctgggatgccgtggctattattttgtgcatgagctctgcgcttatgccaccgttctgtccgtggccggactgtccgccgaacgctgtctggccgtgtgccagcctctgagggctcggagcctccttaccccaagaagaactcgctggctagttgccctatcttgggccgcatcgctgggcctagctttgccaatggccgttattatgggccagaaacacgaattggaaactgccgatggtgagcctgagccagcgtcaagagtgtgtacagtactggtaagccggacagctcttcaagtgttcatccaggttaacgtcctggtctcattcgtcctgcccctggctctgacagcctttttgaatggtgtgacagtgagccacctgcttgctctatgcagccaagtgccatctacgagcactcctggaagttcaacgccatcgaggcttgagttgctgtcagaggagggccttctgtccttcatagtctggaaaaaaactttcattcaaggcggacaagtcagcctggttcgtcataaggatgtcagaagaatccgttctctgcagagatccgtacaggtcctgagagccattgtggtaatgtatgtcatatgctggctcccctaccacgctaggagactgatgtattgctacgtgccagatgatgcttggacagatccgctctacaacttttatcattatttctacatggtgacaaacacgctattttacgtgagttccgctgtcacacccctgctgtacaatgcagtctcatcatcgttcagaaaactctttcttgaggctgtgagtagtctgtgtggagagcatcaccccatgaaacggctgccacctaagccacaatctcccactcttatggatacagcctctggctttggcgatccgccagagacaaggacatag

SEQ ID NO: 52034 - DNA, 1692 bp, Artificial Sequence
  Description of Artificial Sequence: Synthetic coding sequence
atgttagaggaagccggagaggtcctggagaatatgctgaaggcttcctgccttcccctgggcttcatcgtgtttctaccagcggttctgttgctggtggcgcctcccctcccagccgctgacgccgctcacgagttcaccgtgtaccgcatgcagcagtatgaccttcagggacagccctacggaaccagaaacgcagttcttaacacagaggcacgcacaatggcggctgaagtgctgtctcggaggtgcgtgttgatgaggctgcttgatttttcctacgaacagtatcagaaggcactacggcaatctgccggagctgtagtaatcatcctgcctcgagccatggctgctgtgcctcaagatgtagtgagacagtttatggagattgagccggaaatgctcgccatggaaacagcagtgccagtgtacttcgctgtagaagacgaggccttacttagtatctacaagcagacacaggcggcaagtgcgtcacagggctccgcaagcgcagcagaggtcctgctgcgaactgcgacagccaacggattccagatggtgactagcggtgtccagagcaaagccgtgtcagattggttgatcgcctctgtggagggcaggctgactggcctgggaggcgaagacctacccacaattgtcattgtggcccattacgatgccttcggtgtagctccctggctgtctttaggagccgactcaaacggatctggcgtttccgttctccttgagctggctcgactgttctccaggctttacacctacaagcgtacccacgccgcatacaatctactgttctttgcttcgggtggtgggaaattcaactatcaggggacaaaaagatggctcgaggacaatctggaccatactgactcaagccttcttcaggacaatgtcgcctttgtactgtgcctcgacaccgtcggacgcggaagctcactccacctgcatgtttctaaaccaccaagggaaggcaccctccagcacgcatttctgcgcgagctcgagacagttgcggctcaccaattcccagaggtccgtttcagcatggtccacaaaaggatcaacctcgccgaggacgttctagcgtgggagcacgaaaggttcgctatcaggaggttgcctgccttcaccctgtctcacctggaatcacatcgggacggccagcgctcgtccatcatggatgtccgctctcgcgtcgacagcaagacacttactcgcaacacaaggataattgccgaagctctgacacgcgtgatatacaacctgacagaaaaggggacgccccctgatatgcccgtttttaccgagcagatgcagattcagcaagaacagttggacagtgtgatggactggctgaccaatcagccgagggccgcacaacttgtcgacaaggattccacattccttagtacccttgagcatcatctgtctagatacctcaaagatgtgaagcaacaccatgttaaggctgataagcgggacccagagtttgtcttctacgatcagctgaagcaggttatgaatgcatatcgcgttaagcccgcagtcttcgacctgctgttggcagtcggcatagcagcctacctggggatggcatatgtcgccgtgcagcactttagcctcttatataaaactgtgcagcggttactagtcaaggctaagacacagtag

SEQ ID NO: 52035 - DNA, 1233 bp, Artificial Sequence
  Description of Artificial Sequence: Synthetic coding sequence
atgggggctcaagtaaggttacctccgggtgagccctgtcgggagggttatgtgctgtcattggtctgcccaaattcttcacaggcctggtgcgagatcacaaacgtctctcagcttctggcttcgccagtgctgtacaccgacttgaattatagtattaataacctgagcatcagcgctaacgtggaaaacaagtacagcttatacgtaggactggtgctggctgtctcgtcgtcaatttttattggaagctcgtttatcctgaagaagaaggggctgttgcagctggccagcaagggatttactcgggctgggcagggtggtcactcttatctgaaggaatggctctggtgggtggggttgctgtcaatgggagcaggggaagctgcgaactttgctgcatatgcctttgcacctgccacactcgtgaccccacttggtgccctgtccgtgctgatttctgctattctaagctcgtattttctgaatgaacatttaaacattcacgggaagattggatgtattctgagtattcttgggtccacagtgatggtgatacacgccccacaggaagaagaggttacaagcttgcatgaaatggagatgaagctgcgagacccaggctttattagttttgctgtgatcatcaccgtcatctccctggtcctgatactgatcgtcgcacccaaaaagggccaaaccaacatcttggtgtacatctctatttgcagcctgattggagccttctcagtctcctccgtgaaaggccttggaatcgccatcaaagaactcatagagtggaagccggtgtacaaacaccccctggttttcgtcctcctggctgtcctggtgctgagcgttaccacacagattaactacttgaacaaggcactcgacactttcaatacttcactcgtgactcccatttactatgtctttttcaccagcatggttgtgacatgtagcgcgatcttattccaagagtggtatggcatgactgcaggagatattatcggcacattaagcgggtttttcacgatcatcatcgggatttttttactgcacgccttcaaaaatacagacataacctggagtgaactgaccagtactgcgaagaaagaagccgtgagcctgaacgtaaacgagaataattacgtgcttctggaaaatctagaatgttcggccccaggatataatgacgatgtgactctgttctcccgcaccgacgattag

SEQ ID NO: 52036 - DNA, 1107 bp, Artificial Sequence
  Description of Artificial Sequence: Synthetic coding sequence
atggcggcagtggcaccagccggacctggagactcggcttcagccgctctggacgagctttcccttaatttcacatatggtgccccaggggcaggcaacgggagcctgtccggagattggtacagaagaaaccagatccaccttttcggagtgctgctggcaatcctcggtaatctggtgattagcatcagcttgaatattcagaagtatagtcacctccagcttgcccaacaagagcaccctagaccctactttaagagtgtgctctggtggggcggtgtcctccttatggcagtaggagagactggaaacttcgccgcttatggatttgctcccattacactgatcgcacctcttgggtgcgtgagtgtgaccggctctgccatcatttccgtgacatttctaaaagacaacttgcgagcatcagatttactgggcactacactcgcctttgccggtacttaccttctggtgaacttcgccccaaacattacccaggcaatatcagcacgcaccgttcagtactatttagtgggctggcagttcttgatctacgttatcctcgagattctgattttctgcatactcctctacttctacaagaggaaaggcatgaaacatatggtaatacttctaactctggttgccattcttgcctccctgaccgtgataagcgtgaaggctgtatccggcatgatcaccttcagcgtgatggataaaatgcagctgacctaccccattttttacattatgtttattatcatgatcgcttcatgtgtgttccaagtgaagtttctgaaccaagcaaccaagctctacaatacaacaactgtcgtcccagtcaaccacatatttttcaccatttcagctatcatagctgggatcatcttttaccaggaatttctgggcgcaccgttccttactgtgttcatctacctattcgggtgttttctgtcttttctgggcgtgtttctggtgactcgaaatcgggagaaagagcatcttcagcagtcatatattgactttgggaacattccagacaccacccccgagcgaaaggcttggcgggagactaatgtgggccaaaacaccaccaggttcacgtag

SEQ ID NO: 52037 - DNA, 975 bp, Artificial Sequence
  Description of Artificial Sequence: Synthetic coding sequence
atgttactgggggaactgggagtttttgcatcttacgctttcgctcccctgagccttattgtgcctctgagtgccgtatccgttattgcctctgcgattattggaattattttcatcaaagagaaatggaagccaaaggattttctgcgacgctatgtgttgtcttttgtcgggtgtggcctcgcagttgtaggtacatacctgttggttacctttgcacccaactctcacgagaagatgacaggcgagaatgtgaccaggcacctggtgtcctggccattcctgctgtacatgttagtcgagatcatcctgttctgtttactgctgtacttttacaaggagaaaaatgcaaacaatatcgtcgtaatcctcttgcttgtggcacttctcggctcaatgacagtcgtgaccgtgaaagcagttgccggaatgctggtgttgagcattcagggcaacttgcagcttgactaccccatcttttacgtaatgtttgtgtgtatggtagccacagccgtgtatcaggccgcttttctgagtcaggcgagccaaatgtatgacagcagcctgattgcctctgtgggatacattctcagtactacgatcgcaatcactgctggcgcaatcttctacctagactttattggcgaagatgtcttgcatatctgcatgtttgccttagggtgtctgatcgcattcctgggcgtgttcctcataacacggaaccgcaaaaagcccataccctttgaaccgtacatcagcatggacgctatgccaggcatgcagaacatgcatgataaaggaatgaccgtgcagcccgagctgaaagcttcttttagctatggcgcactggagaataacgacaacatctctgaaatttacgcgcctgctactctgcccgttatgcaagaagaacatggttccaggtcagccagcggcgttccataccgcgtcttggaacacactaaaaaagaatag

SEQ ID NO: 52038 - DNA, 1107 bp, Artificial Sequence
  Description of Artificial Sequence: Synthetic coding sequence
atggatggaagccattccgccgcactcaagctccaacaactaccccctaccagttcttcaagcgcagtctcagaggcctcatttagttacaaggagaatctgattggagcgctcctcgctatttttggccatctagtggtgtctatcgcactgaacttgcaaaagtattgccacataagacttgctggctccaaggatcccagggcctatttcaaaacgaaaacttggtggctaggcctcttcctaatgctgctcggagaactaggagtgttcgcgagctacgctttcgctccactttctctgatcgtcccattgtccgctgtgagcgttatcgcctccgcgattataggaatcattttcattaaggagaaatggaagccgaaggatttccttcgacggtacgtgttgtctttcgtcgggtgtggacttgctgtcgtgggtacttacctgttggttactttcgcacctaattctcacgagaaaatgactggcgaaaacgtcacccggcacttggtctcctggcctttcctgctttatatgcttgtggagatcatcctcttctgcttgctcctgtacttctacaaagaaaagaacgcaaataatattgtggtaatcctgttgctggtggctttactggggagcatgacagtggtgactgttaaggctgtggctggtatgttggtgctgagcattcagggaaatctccagctggactatccaatcttctacgtgatgttcgtctgtatggtggccacagccgtctaccaagcagcttttctctcccaggcttctcagatgtatgattctagcctgattgcctcagtgggatacattctgtccacgactatcgcgatcacagccggagctattttctaccttgacttcattggagaagacgtcctccacatctgtatgttcgcactgggctgtctgatcgcatttctgggcgtatttttaattaccagaaatcgaaagaagcccattccttttgaaccatatatatctatggacgcaatgcccgacagctacctacacaaccggcaactgctgttcaagcgatatagtaattccaggaatcttccacaccataacttagagtcgctatag

SEQ ID NO: 52039 - DNA, 681 bp, Artificial Sequence
  Description of Artificial Sequence: Synthetic coding sequence
atggatggttctcatagcgcggctctgaagttacagcagctgcctccaacctcaagtagctctgccgtgtccgaagcgtcattttcctacaaggagaaccttattggtgctctcttggccatatttggccatcttgtggtgtctattgcgttgaacctgcaaaagtactgccatatcaggctcgccggatctaaagatcctcgggcttactttaagaccaaaacttggtggctcgggttattcctaatgctactgggggaacttggagtgttcgcttcttacgccttcgcacctctctcccttatcgttcccctgtctgcagtgagcgtgatcgcgagtgccatcattgggattatttttatcaaagagaaatggaagccaaaagattttctccgcagatacgtgttgtccttcgtgggctgcggcctggctgtcgtgggcacttacttactcgtgacattcgcgccaaacagccacgaaaaaatgaccggcgagaatgtgactaggcatttagtgtcctggccctttttactgtatatgctggtcgagatcatcctcttctgtctgcttctctatttttacaaggagaagaacgcaaacaacatcgtcgttatcctactgcttgtcgcattgctcgtgctgctttgccaccccggatggtctgccgtggtgcaatcatag

SEQ ID NO: 52040 - DNA, 1221 bp, Artificial Sequence
  Description of Artificial Sequence: Synthetic coding sequence
atggacgggagccactcagccgctctgaagcttcagcagttacctccaaccagcagcagctccgctgtgtctgaagctagcttttcgtacaaagaaaatcttatcggcgctctcttggctattttcgggcacttggtggtctcaatcgccttgaatcttcagaaatattgccatatcaggctcgccggatccaaagacccacgggcttatttcaaaacgaaaacctggtggcttggcctctttctgatgctgctgggggagcttggagtctttgcttcctacgctttcgcgcctttgtctctgatagtccccctgagtgctgtgtctgttatcgcctcagccatcatcggtatcatctttatcaaagagaagtggaagcctaaggattttttaaggagatatgtgttgagcttcgtgggctgtggattagccgtggttgggacttacttgttggtgacatttgccccaaattctcacgaaaagatgacaggcgagaacgtcacacggcatctggtgtcttggcccttcctgctgtatatgctggttgaaatcatcctcttctgcctgctcttgtacttctacaaggaaaagaatgccaataatatagtcgttatactacttttggtcgcgctcctcggatcaatgaccgtggtgaccgtcaaagcggttgccggaatgctggtcctttctatccaggggaatcttcagctggattatcccattttttatgtgatgtttgtgtgcatggtggccactgcggtctaccaggccgctttcttaagccaagcgtcgcagatgtacgacagctcactgattgcatccgtcgggtatatcctctcaacgaccatagccataaccgctggagccatcttttatttagacttcattggtgaggatgtccttcacatctgtatgttcgcactgggttgtttgatcgccttcctcggggtttttctgatcacaagaaacaggaagaagcccatcccattcgaaccttacatttcaatggacgcaatgccagggatgcagaacatgcacgataaaggtatgacagtccaacctgagcttaaggcaagcttttcatatggtgcattggagaataacgacaatatctctgagatatacgctccggctaccctcccggtcatgcaggaggagcacggctctcgttcagcttcaggggtgccttaccgggtgctggagcacactaaaaaggaatag

SEQ ID NO: 52041 - DNA, 681 bp, Artificial Sequence
  Description of Artificial Sequence: Synthetic coding sequence
atggatggatctcatagcgcggcactcaaactgcagcaactacctcccacctcaagttcctctgccgtcagtgaggccagcttttcctataaggagaatctgataggggctctgctggccatcttcggccacttggtagttagtatcgctctcaacctgcagaagtactgtcatatccggttggccggatctaaggacccaagagcgtattttaagactaagacctggtggcttggacttttcctcatgctgttaggcgaactgggcgtgtttgcgagctatgccttcgcacctctgtctctgattgtgcccctgagtgcggtgtctgtgatcgcatccgctattattggaatcattttcatcaaggagaagtggaagcccaaggatttccttcggcgatatgtgctctcgttcgtggggtgcggactggcagttgtagggacataccttctggtgactttcgcacctaacagccatgagaaaatgacaggagaaaacgttaccagacacctcgtgagttggcctttcttgctgtatatgcttgtggagattatcctattctgtctgctcttgtacttctataaggagaaaaacgcgaacaacattgtagtaatcctgctgctggtggcattgcttgtgctattgtgccaccccggttggtcagccgtggtgcaaagttag

SEQ ID NO: 52042 - DNA, 405 bp, Artificial Sequence
  Description of Artificial Sequence: Synthetic coding sequence
tgagtagccggtatgctggtactctcaatccaaggcaatctgcagctggactatcctattttttacgtcatgttcgtctgtatggtcgccacagcagtgtaccaggcagcattttccaagactgattctagcccagctaatgagaacaatagcccatacctgagagagtcccacgaagccctcatgcgaatgagccttggcaagtgccccgtcttcgagtccagccttaccgatgtgcgcctgttatttgactgccagtgcggcctgcactcggttcataaccactgttatcattctcgttgcaatatattaccgggattgcatcggggaggccgagccgctcacttgcacgtgtgcactggcgtaccccattgtatcctggggaggcttttaaaccacgcctag

SEQ ID NO: 52043 - DNA, 4515 bp, Artificial Sequence
  Description of Artificial Sequence: Synthetic coding sequence
atggccacagcgagaactttcgggcctgaaagagaggccgaacctgccaaggaggctcgcgtcgtgggatccgaactggtggatacttacacggtgtatatcatccaagtgacagacgggtcccacgagtggaccgtgaagcatcgctacagcgacttccacgacctgcacgaaaagttagtggctgagcggaaaattgataagaacttactcccccctaagaagatcattggtaaaaattcaaggtcactagtagagaaacgagagaaagacttggaggtttatctacagaaacttctggcagctttccctggagtgaccccacgtgtacttgctcacttcctccactttcacttctatgagatcaacggcattactgctgcccttgcagaagagctctttgagaagggggagcagctgctgggcgctggagaggtgtttgccatcggccctctgcagctctacgcagttacagaacagctacagcagggcaagcctacatgcgcttcaggggacgccaaaaccgatctcgggcatatcctggacttcacgtgtcgtctgaagtatctcaaagtgtccggcacggaaggcccttttggtacaagcaacatccaggaacaactgttgccatttgacctttccatctttaagtctcttcatcaagtggagattagccactgtgacgcgaagcacattcgcggtttagtggcatctaagccaaccttggccacactgagtgtcaggttctccgccacaagtatgaaagaagtgttagtccctgaagccagtgagttcgatgagtgggagccagaaggaaccacactcgagggcccagttacagctgtgatccccacctggcaggccttgacaaccctggacctgagccacaacagtgtgtccgaaatagatgagtctgtgaagttgataccgaaaattgagttcctcgatctgtctcacaatgggctgcttgtcgtggacaatctgcagcatctgtataatctagttcacctagatctcagctataacaagttgtccagcctggaagggctgcacaccaagctcggaaatattaaaacattaaatctcgccggaaacctgctggaatccctcagtggcctccataaactgtactcactggtgaacctggacctgcgcgataacaggattgaacagatggaagaggtgagaagcatcggcagcttaccctgtcttgaacacgtttccctcctgaacaatccgttatctatcattcctgactatcgcactaaagttctcgcccagttcggcgagcgggcatccgaggtgtgcctggatgatacggtgacaaccgaaaaggaactcgataccgtcgaggtcttgaaggccatccagaaggctaaggaggtaaagtcaaagctgagtaatcctgaaaaaaaagggggtgaggacagccggctgtctgcggctccatgtatcagaccatcttcctctccccctaccgtggcccctgcatccgcaagcctcccccagccgattctttccaaccaggggatcatgtttgtacaggaggaggcgctcgcctcatctctatctagcaccgatagcctgaccccggagcaccagcctattgcccagggttgtagtgatagcctggaatcaataccagccggacaggctgcatcagatgacctccgcgatgttcccggtgcagtcggaggcgcttccccagagcacgccgagccggaagttcaggtggtgcccggaagtggacagatcatcttcctgccatttacttgtattggttacacggctacgaaccaggattttattcaacgcctaagcaccctgattagacaggcaatcgagagacagctgccggcttggatcgaagccgcaaatcagcgtgaggagggacagggcgaacaaggcgaggaagaggatgaggaggaagaggaggaagaagatgtggctgagaatcggtatttcgagatgggccctcccgacgtcgaggaggaggaagggggagggcagggtgaagaggaagaagaggaggaagaagatgaagaagctgaggaggagaggcttgctctggagtgggcacttggcgcagacgaagactttctgctggaacacattagaatcctcaaagtgctgtggtgctttctcatccatgtgcagggttccatccgccagttcgcggcatgcttggtgctgacagactttggcatcgctgtgtttgagataccccatcaagaatcacgcggaagctcccaacacattctttctagtctgcgattcgtcttttgtttccctcacggagatctaactgagttcggctttctcatgcccgagctgtgcttggtcctaaaggtgcggcattcggagaacacactgtttattatttccgacgccgctaacttgcatgaattccatgccgatctgaggtcttgctttgctccccaacacatggctatgctgtgcagccccatcctctacgggtcacacaccagcctgcaggaattcctccggcagttactgacgttctataaggtagcagggggatgccaggaacgtagccagggatgctttcccgtctacctggtatattctgacaaacgcatggtgcagaccgcggctggcgactatagcggcaatattgaatgggcttcctgcactctctgttctgccgtgcgaaggagttgctgtgcaccttccgaagcagtgaaatcagcggctataccctactggctgctcttaacgcctcaacatctcaacgtaatcaaggcagactttaacccaatgccaaaccggggtacacacaactgtcgcaatagaaacagctttaaactgagcagggtccccttgtcaactgtcttactggatccaactagaagctgcacgcagcctcgaggggcttttgccgatggacacgtactagagctgctggtgggttaccgcttcgtgaccgctatattcgtccttccacacgagaagtttcacttcttgagggtatataatcagctcagagccagtttgcaggacttgaaaacagtggtgattgccaagactcctggcacaggtggctccccacaagggtcctttgccgatggccaacccgctgaacggagggcgtcgaatgatcagagaccacaggaagtccctgctgaagcccttgcgccagctcctgctgaggtgccagcgccagccccagccgctgctagcgctagtgggccagctaagacaccagcccctgccgaagcctcgacgagcgccctcgttcccgaagaaactcctgtggaagccccagcccctcctcccgctgaagcaccagcccagtacccaagtgagcacctgatccaggcaacgagcgaagagaaccaaattccctcacacctccctgcctgtccaagccttcggcacgtcgcgtccctgcggggatctgccatcatcgagctgtttcacagctccatcgctgaggtggaaaacgaggagctacgacaccttatgtggtccagcgttgtgttttaccaaacaccaggtctggaggtcaccgcatgcgtgttactgagcaccaaggctgtgtacttcgtattgcacgatggactccgcaggtatttttctgaacctctgcaagacttctggcaccagaagaacaccgattataataactccccttttcacatcagccagtgtttcgttctgaagctgagcgacctgcagtctgtgaacgttggactgttcgaccagcacttccgcctgaccgggagcacccccatgcaggttgtgacctgcctcacgcgcgattcctaccttacccactgttttctgcagcacctgatggtggtgctttcctcacttgagcgcaccccgagccccgagccggtggataaggatttctactctgagtttgggaataagaccacaggcaaaatggaaaattatgagctaatccacagctctcgcgttaaatttacgtacccttctgaagaggaaatcggcgatcttacctttactgtggctcagaaaatggccgaacctgagaaggcccctgccttgtcaattctgctgtacgttcaggcttttcaggtcggaatgcccccacctgggtgttgcaggggcccactcaggccgaagactctgctcctgacatcttcagagattttcctgctggatgaggactgcgttcattaccctctgcctgagttcgctaaagaacccccacaaagggacaggtacagactagacgatggcagacgggtccgcgacttggacagagttttgatgggttatcagacctatccacaggctctcacactagtgttcgacgacgttcaagggcacgaccttatgggctctgtaactttagatcatttcggtgaagtgccaggcggtcccgctagggcatcccaggggcgagaagtccaatggcaagtgtttgttccatccgcagaatccagagaaaaactgatatcacttctggcacggcagtgggaggccctgtgtggtagagaactgccggtggaactgaccgggtag

SEQ ID NO: 52044 - DNA, 2457 bp, Artificial Sequence
  Description of Artificial Sequence: Synthetic coding sequence
atgggtccaccggacgtggaggaggaagagggaggaggccagggtgaagaggaagaagaagaggaggaggatgaggaagccgaggaggagaggctggcactggaatgggcactgggggcagatgaggatttcctactcgaacacatcagaatactgaaagtgctttggtgtttcctgattcatgtgcagggctccattcgacagttcgccgcatgtctagtgctgacagacttcgggatcgccgtctttgagattccacatcaggagtcccgaggaagcagccagcacatcttatcatccctgcggtttgtgttttgttttccacacggcgacttgacagagttcggattcttaatgccagagctgtgcctagtactgaaagttcgccacagcgaaaacactcttttcatcatttctgacgctgccaatctccacgagttccatgccgacctgcgttcttgctttgctcctcagcatatggctatgctctgcagtccaatcctgtacgggtcccacacatccttacaggaatttctccggcagttgttaacattttataaggttgctggtggatgtcaggagcgctcccaggggtgttttcctgtttacttggtgtactccgataaacgtatggtgcagacagctgcgggtgattactcaggcaacattgagtgggcgtcttgcacactttgctcagccgtccgacgctcctgttgtgcccctagtgaagccgtaaagagcgcagccataccttactggctgctgctcaccccccagcacctgaatgttatcaaagccgatttcaatcccatgcctaatcgcggtacccataattgtcgtaatcggaatagcttcaagctgtcacgggtacctctctctactgtgcttttagatccaaccaggagctgtacacaaccgagaggggcattcgccgatggccacgttctggaactgctagtgggatatcgattcgtcaccgcaattttcgttctgcctcatgagaagtttcactttctgagagtgtacaaccaactgagagccagcctgcaggacctgaagacagtcgtgattgccaagactcctggcaccggcggttctccccaggggtcatttgccgatggacaacccgctgagcgacgggctagcaacgaccagcgccctcaagaggtcccagcggaggccctggccccagcaccagcggaagtgccggctcccgcaccagccgctgcatcggcttccggaccggctaaaaccccagccccagcagaagccagcacctccgccctggtacctgaggagacccctgtggaagctcctgctcctcctcccgcagaggctccagcccagtacccctctgagcatcttattcaggccacaagcgaggagaaccagatcccaagtcaccttccagcctgcccttctcttaggcatgtggcatcactgaggggcagtgccattatcgagctttttcacagtagcatagcagaagtggaaaacgaggaactcagacatcttatgtggagcagcgtcgtgttctaccagactcccggattggaagtcaccgcttgcgtgctgctgagcactaaggctgtgtacttcgtcctgcatgatggcctgcgccgatatttttccgaacctctgcaggacttttggcatcaaaagaatactgattacaacaattcgcccttccatatttcacagtgctttgtcctgaagctgtccgacttgcagtcagtaaatgtggggctgtttgaccagcacttcagactcaccggctctacacccatgcaagttgtgacctgcctgacccgagatagctatctgacacattgttttctgcagcaccttatggtggtactgagctcccttgaaaggacgcctagccctgagccagtggacaaagacttttactcagagttcggaaacaagactacaggtaaaatggagaactacgagctaattcactcctcaagggtcaagttcacctatccttctgaagaagaaatcggcgatctcacattcacggttgcccagaaaatggctgagcctgaaaaggctccagctctgagtattctgctgtatgtgcaagccttccaagtggggatgcctcctcctgggtgttgcaggggccctttgcggcctaaaacgcttctgctgacctcttcagagatttttcttcttgatgaggattgtgttcattaccccttgcctgagtttgccaaagaacccccacaacgagatcgatacaggctagacgatggtcggagagtgagggacttggatcgagtgctgatgggttaccagacctacccgcaggccctgacactagtgttcgacgatgtgcaaggtcacgacctgatggggagcgcggaatcaagggagaagctaatctccctgctcgccaggcagtgggaagcgctgtgcgggagagagcttcccgttgaactgaccggctag

SEQ ID NO: 52045 - DNA, 1287 bp, Artificial Sequence
  Description of Artificial Sequence: Synthetic coding sequence
atggccactgcccgaaccttcggcccagagagagaagcagagcctgctaaggaagcgagagtggtcggctccgagctggtcgacacatacactgtgtacataatccaggtgacagacgggtctcacgagtggaccgttaaacaccggtatagcgacttccatgacctacatgaaaagctcgtggctgagcgtaaaatcgacaagaacctcctgcctcctaaaaagatcatcggaaaaaactcccgttccctggtggaaaaacgcgagaaggatctcgaagtctacctgcagaagctgctgaccgcatgtgtgttgttgtcaacaaaagccgtttactttgtgctgcatgatggattgaggcggtacttttccgaaccgctacaagatttctggcatcaaaagaacacagactataacaactccccctttcacatcagccagtgttttgttctgaaactgtccgatctgcagagcgttaacgtgggcttgttcgaccagcatttcagactcactggctcaacccccatgcaggttgtgacttgcctgactcgcgacagctacttgacgcattgcttcctgcagcatctgatggtggtgttaagctcactggaaaggacccctagtcctgaaccggtagataaagacttctattcggagttcggcaataagactactggcaagatggaaaattatgagctgatacacagctcaagggtgaagtttacctacccctccgaagaggaaataggagatctcacctttacagtcgctcagaagatggccgaacccgagaaggccccagcactgtccatcttgctctatgtccaggcattccaggttggcatgcctccaccgggttgctgtagaggcccattgcggcctaaaaccctgttgctgacatcctcggagatcttcctgttagacgaggattgtgtgcattaccccctgccagagtttgctaaggagccaccacagagagacagataccggctggacgatggcaggagggtccgtgacctcgaccgggtgcttatgggatatcagacctatccgcaggccctgaccctcgtgttcgacgatgtacaggggcatgacctgatgggctcagtgacactggaccattttggtgaagtgcccggaggccctgcacgggcaagtcaagggagagaagtacagtggcaggtctttgtgcccagtgcagagagccgggaaaagctgatttcactgctggcgagacagtgggaagccttatgcggacgcgagctgccagtggagcttacggggtag

SEQ ID NO: 52046 - DNA, 4515 bp, Artificial Sequence
  Description of Artificial Sequence: Synthetic coding sequence
atggctactgctcggacattcggacctgaacgggaggccgagcccgctaaggaagcacgggtggtaggcagtgaactcgtggacacctacaccgtgtacatcattcaggtcacagatgggagccatgagtggacggttaaacataggtactcggacttccatgatctgcatgaaaagctggtggccgagagaaaaatcgacaaaaaccttctgcccccaaagaagatcataggtaagaacagccggtccttagtggagaagcgggaaaaagatctggaggtgtatctgcaaaagctgcttgctgcattccccggtgtgacgcccagagtgcttgcgcatttccttcactttcacttctacgaaatcaacggtatcacagctgcgcttgcggaagaattgtttgagaagggtgagcagcttctcggggcaggtgaagtgtttgcgatcggtcccttacagctgtacgcagtcaccgagcagcttcagcagggaaaaccaacatgcgccagcggcgacgccaagactgacttagggcatatcctggactttacttgccgcctgaagtatttgaaggttagcggcactgaaggccctttcgggacgagcaacatccaggaacaacttcttccttttgacctgagcatcttcaaaagcctgcaccaggtggagatcagtcactgtgatgcaaaacatatccggggtcttgtggccagcaagccgaccctggcaacgttgtccgtgaggttcagtgcaaccagcatgaaagaggttctggtgccagaagccagtgaattcgatgaatgggagcccgagggtactaccttggaaggccctgtgactgccgtaatcccgacttggcaggcactgacaaccctggatctttctcataatagcgtcagcgagatcgatgagagcgtgaaacttattccaaaaatcgagttcttagacctaagccacaacggattgctcgttgtagacaacttgcagcatctttacaatttagtgcacctggatctgagttacaataaacttagctctctggaggggctccatactaaattgggaaatataaagactttgaacctcgctggcaacctgctggagagcctgagtggcctgcataaactctactcgctcgtcaatcttgacctcagagacaatcggatcgaacagatggaggaagtgcgctctatcggctctctaccatgtttggaacatgtgagtttacttaacaacccactgtctattattccagattaccgaacaaaggttttggctcaattcggcgaacgcgcttccgaagtttgtttggatgatacggttactacagagaaagaattagatacagtagaggttttgaaagccatccaaaaagctaaagaggttaaatccaagctctcaaacccagaaaagaaaggcggtgaggattccaggctatctgcggctccatgcatacgcccaagctcgagtccccctaccgtggcgcctgcatccgcctcactgcctcaaccgatcttgagtaaccagggaatcatgttcgtgcaggaggaggcgttggcctcctctttgagctcgacagacagtctgacccctgagcaccagcctatcgcccagggttgtagcgatagcctggaatccatccctgcaggtcaggccgcatctgatgatttaagggatgtgccgggagccgttgggggtgcatcccctgaacacgccgaacccgaggtccaggtggtcccagggtccgggcagattatctttctgccgtttacctgcatcgggtacacagccacaaatcaggactttattcagcgcctctccactcttatccggcaggccattgaacgccagttgcccgcatggatcgaagccgcaaaccagagggaggagggacagggggagcagggtgaggaagaggacgaagaggaggaagaggaagaagacgtcgcagagaataggtattttgagatgggacctcccgacgtcgaagaagaggaggggggaggccagggcgaagaggaggaagaggaagaggaagacgaggaggccgaagaggagcgccttgctctggagtgggccctaggggcagacgaggacttcctgctcgagcatatcagaatcctgaaggttctatggtgcttcttaatccacgtgcaaggttcgatacgacagtttgctgcttgcctcgttctgacggacttcggtattgctgtgttcgaaatccctcaccaggagagccggggatcctcacagcatatattgagcagcctgaggtttgttttttgctttccacacggagacctgactgagtttggcttcctgatgcccgagctttgcctggtgcttaaggtgcggcacagtgaaaatactttgttcataatctctgacgctgctaatctgcatgaattccacgcagaccttagaagttgtttcgcacctcaacatatggccatgctttgctcccctatcctctatggctctcacacatccctgcaggagttcctgaggcagttactgaccttctataaagttgccggaggctgccaagaacgaagccagggctgttttcccgtgtacttggtgtacagcgacaaaagaatggtgcagacagccgctggcgattatagcggcaatattgaatgggcctcctgtacactgtgctccgctgtccgccgatcttgttgcgcccctagtgaagctgttaagtctgctgccatcccatattggttactcctgaccccccagcacctcaatgtgataaaggcagatttcaacccaatgcctaacagaggaacacataattgtcgcaatcgaaattccttcaagctgtcccgagtaccattgtctacagttctgctagaccccactagatcttgtacccagcctaggggcgcatttgccgatggccatgttttagaactgctggtcgggtatcgctttgttaccgcaatcttcgtgctcccgcacgagaagttccattttcttcgcgtgtacaatcaactgcgggcatcactgcaggatctgaaaaccgttgttatcgcaaagacaccaggaacgggaggatcgccacagggtagcttcgcagacggccagcccgctgaaagacgtgcgtcaaacgatcagcgacctcaggaagtgcccgcagaggccctagctccggctccagccgaggtccccgcacccgcaccagccgctgcatcagccagtggacccgctaagacacctgcacccgctgaagcctctacttctgctcttgttccggaagagacccccgtagaagcgccagcccctcccccagcggaagcgccagcgcaatatcctagcgagcacctgattcaggccacctctgaggaaaaccaaatcccctcacatttgcccgcttgtccgtcactgagacacgtggcaagtctccgtggcagcgcaatcattgagttattccattcatctatcgccgaggtggaaaacgaggagctgcggcatctgatgtggtcatctgtagtgttctaccagacccctggtctggaggtaacagcctgtgtattactgtcgacgaaggctgtttacttcgtacttcacgatggactccgacgctacttctcagagccccttcaggacttttggcaccagaaaaacaccgattataacaacagtccctttcatatcagccagtgtttcgttctgaagctgagcgatctgcagtcggtgaacgtgggcctgtttgatcagcactttagactgaccggctcaaccccaatgcaggttgttacctgtctgacccgagactcgtaccttacccactgcttcttacaacatttgatggtggttctgtctagcctggagcgcacaccgtcacccgagcccgtagacaaggatttctatagtgaatttggcaacaaaacaacagggaaaatggagaactacgaactgatacacagctctagagtcaaattcacctacccatcagaggaggagatcggagatcttacgtttacagtagcccagaaaatggccgagccagaaaaggcccctgcactgagcattttgctgtatgtgcaggcctttcaggtgggaatgcctccaccgggttgctgcaggggaccattgcgaccgaagaccctgttgttgacctcgagtgaaatttttctgcttgacgaggactgtgtccattaccccctgcccgaatttgcgaaagagcccccacagagggacagatataggctcgacgacggacgccgagtgcgggatttagatagggtgcttatgggctatcagacctacccccaagcacttacactggtctttgacgacgtacagggacacgacctcatgggatccgttactcttgatcacttcggggaggtccctggcggaccggcaagggctagccagggcagggaagtacaatggcaggtgtttgttccatcagccgagtctcgggagaagctcatttcactcctcgctaggcaatgggaagctttgtgtgggagagagctgccagtcgaattgacaggatag

SEQ ID NO: 52047 - DNA, 1752 bp, Artificial Sequence
  Description of Artificial Sequence: Synthetic coding sequence
atggcaacggccaggaccttcggtcctgaaagagaggcagaacctgccaaagaggcacgcgtcgtggggtcggagctggtggacacgtataccgtgtacatcatacaggtaactgacgggtcccacgaatggacagttaagcacaggtactccgactttcacgatctgcatgaaaaactcgtggcagaaagaaagatcgataagaacctgcttccacctaaaaaaattatcgggaagaactcccgctcgttagtggaaaagcgcgagaaagacctggaggtatacctgcaaaagctcctcgctgcattccccggtgttacacccagggtgctagctcattttctgcatttccatttctatgagattaatggcattaccgcagctctggctgaggaattgttcgagaaaggggaacaattgttgggggctggcgaggttttcgcaatcgggcctttgcagctctatgctgtgaccgaacagctgcagcagggaaaacccacatgtgcttccggcgatgctaaaaccgacttgggtcatattttagattttacatgccgactcaaataccttaaggtgtctgggacagaaggcccttttgggactagcaatattcaggagcaactgcttcccttcgacttgtccattttcaaatcactccatcaggtggaaatctcacactgcgacgctaagcatatccgaggcctggtcgcatctaaacccaccctcgccactctgtctgtacgatttagcgcgactagcatgaaggaggtgttagtgcccgaggcatctgagttcgatgaatgggagccagaaggaaccactcttgaagggccagtcactgctgtcattcctacatggcaggctctgacgaccctggatcttagtcacaacagtgtgagcgaaatcgatgaatctgtgaagctgatcccaaagattgagtttcttgacctgtcccacaacggattgctggtggtggataatctccaacacctgtataatttggtgcacctggacttgtcatataataagttaagtagcctggaaggacttcacaccaagttaggtaacatcaaaaccctgaacctggcgggaaaccttctcgaatctctctcaggcctccataaactgtacagcctggttaacctggacctccgcgacaatagaatagagcaaatggaggaagttagaagcatagggtcactcccttgtctagaacatgttagcctgcttaacaatcccctttctataatccccgactaccgcactaaagtccttgcacagtttggtgaaagggccagcgaagtgtgcctcgatgatactgtaaccacagaaaaggaactggacacggtcgaggtcctaaaagccatccagaaggcaaaggaggtgaaatcgaagctcagcaacccagaaaagaaaggcggtgaggactcgcgtcttagcgccgcaccctgtatcagaccaagctcctcacctccgactgtcgcccctgcttctgcaagcctcccacagccaattctcagtaaccagggaaatcgcgtctgtatcttgctgctggtggagcctcattcaccggcttgggccccatggcttggatgggggtggggacgtggggcaagcacatgtttccaacagggccagacacaagggggtcagtgcctgctgcaggccggaccccgaggcggaacccacgggaggggagcttggcccgacgcatcttgctgcctgctaggggaagattcacagcttctttag

SEQ ID NO: 52048 - DNA, 2097 bp, Artificial Sequence
  Description of Artificial Sequence: Synthetic coding sequence
atgctgccggcacgtctgccattccggctgttgtccctgttcctccgtggtagcgctccgaccgccgctagacacggcttacgggagcccctgctggagcggagatgcgcagccgcaagctcattccagcattccagttcgttgggccgagaactgccctacgacccagtcgacacagaggggttcggggagggcggtgatatgcaagagagattccttttccccgagtatattcttgaccctgaacctcaacctacccgcgaaaagcagctccaagagctgcagcagcaacaagaggaggaggaacggcaacgtcagcagcgtcgagaagaaaggagacaacagaatttacgggcaagatcacgggaacaccccgtcgtgggacaccccgacccagccttaccaccttccggcgtgaactgctcaggctgcggcgctgaactgcactgccaagatgcaggagtccccggatacctgccaagagaaaagtttcttcggacagcagaggcagatgggggactcgcacgcacagtctgtcagcgatgttggctactgtcccaccatagacgcgcactacgccttcaagtgagtagggagcagtacctcgaactggtgagcgccgcactgagaagacctgggcctagtctggtcttgtatatggtagatctactggacctcccagatgccctccttccagacttgcctgcactggtgggaccaaagcaactgatcgtattggggaataaggttgacctcctgcctcaggatgcccctggatatcgtcagcgcctacgcgagagactgtgggaggattgcgccagagccggactcttgctcgctcccggtcaccaggggcctcagcgtcctgttaaggatgagccccaggatggcgagaatccaaacccccctaattggtctagaacagtcgtgcgggatgtcagattaatttccgccaaaacggggtacggtgtagaggagcttatttccgctctgcagcgctcctggcgctataggggggacgtgtacctggttggggcaaccaatgctggcaaaagcactctcttcaacacccttctggagtccgattattgcaccgctaaaggctctgaagccatcgaccgggctacaatctctccctggcctggtactaccctgaacttactaaaatttcctatttgcaacccgacaccctaccggatgttcaagcggcatcaaaggcttaaaaaagactctactcaggccgaagaggacctctctgagcaggagcagaaccagcttaatgtattgaagaaacacggatacgtcgtcggacgggtaggacgcacattcttgtacagcgaggaacagaaggataacatcccttttgaatttgacgcagacagcctcgccttcgatatggagaatgatcctgtaatgggtacccacaagagcacaaagcaggtggaacttaccgcccaggacgtgaaggacgcccattggttctacgatactcctggtataacgaaggagaactgcatcctgaatttgctcacagaaaaggaggtaaatattgtccttccgacccagagcatagttccccgtacatttgtcctcaaacccggaatggtgctgtttctcggcgctatcggcagaatcgacttcctgcaggggaatcaatctgcgtggtttaccgtcgtggcaagtaatatcttgcctgttcacattacaagcttggatcgagccgacgcgctgtatcagaaacatgcagggcacaccctccttcagatccccatgggtggcaaggagcgaatggctgggtttcctccactagttgcagaggacatcatgctcaaggagggtctgggtgccagcgaggccgtcgcagatattaagttctcatccgctgggtgggtgtctgttacacccaactttaaggatagattgcatctccgcggttatacacccgaagggaccgtgctgaccgtacgtccacccctgttgccatacattgtcaacatcaaaggacagcgcatcaagaaatcagttgcctacaaaacgaagaaacccccatctctgatgtacaacgttaggaagaaaaaaggtaaaatcaacgtgtag

SEQ ID NO: 52049 - DNA, 3669 bp, Artificial Sequence
  Description of Artificial Sequence: Synthetic coding sequence
atgctagtgggccaaggcgcagggccattgggccctgccgtcgttactgccgcagtggttctcctgttgagtggcgtgggcccagctcacggatcagaggatatcgttgtcggctgtggcggatttgtcaaatctgacgtcgaaatcaactactcacttatcgagatcaaactgtacacaaaacatggaactctgaaataccagaccgactgtgctcccaataacgggtacttcatgatccctctgtacgataagggagactttattctgaagatcgagcccccactagggtggtcattcgagccaaccacagtcgagctccatgtagacggtgtttcagatatttgtaccaaggggggagacattaacttcgtctttacaggcttctccgttaacgggaaagtgctgagcaaagggcaacctctggggccagccggagtgcaagtctccctcaggaacactggaaccgaagcaaagatccagtccacggtcacccaaccaggaggcaaattcgccttcttcaaagtcctgcctggtgattacgaaattctggccacccatccgacctgggcgttaaaggaggcaagcactacagtacgcgtgacaaatagtaatgcaaacgcagcctccccgttaatcgttgctggatataatgtttcaggctctgtccggtcggatggggagccgatgaaaggagttaaatttttgctgttctcttcgttggtaaccaaagaggatgttcttggctgtaatgttagtcctgtgccaggtttccaacctcaggacgagtccctcgtttatctgtgttacaccgtaagtagggaggacgggtcattcagcttctattcattaccttccgggggttacactgtgataccattctaccgcggtgaaagaatcacttttgatgtcgccccttcacggctggactttactgtcgagcacgactccctcaaaatcgaaccagtgttccacgtgatgggcttttccgtaactggtcgagtcttgaatgggccagagggagacggagtgccagaggcagtcgtaaccttaaacaaccagataaaagtcaagactaaggctgacgggtccttcaggctggagaatatcaccactggaacttacaccatccacgcacagaaagagcacctttactttgagaccgttaccatcaaaatagccccaaacacgcctcagcttgccgatataatcgctaccgggttctccgtttgcggccagatctccataattaggttccccgacaccgtgaagcaaatgaacaagtacaaggtggtgttgagttcacaggataaggacaaaagtctcgtgacagtagagactgatgctcacggatctttctgcttcaaggctaagccagggacttacaaggtccaggtgatggttcccgaagctgagactcgcgctggtttgacgctgaaacctcagaccttcccgctgactgtcactaacagaccaatgatggacgttgccttcgtccagttcctggccagcgtgagcggcaaggttagttgcctagacacctgcggcgacctccttgtgacattacagagccttagcaggcagggcgagaagcgctctctccaactgtccggtaaggtgaatgctatgacctttacattcgataatgtcctgccaggtaagtataagatcagcataatgcatgaggactggtgctggaagaataagagcctcgaggtcgaagtcctggaggatgatatgagcgcagtggagttccgccagactgggtatatgcttaggtgcagcttgagtcacgcaatcactctggagttttatcaagatggcaacggcagggagaacgtgggaatttataacctgtccaagggagttaacaggttttgcctgagcaagcctggtgtgtacaaggttaccccacgcagctgtcatagattcgaacaagccttttacacgtatgatacgtctagcccctccattttgacactgacggccatcagacatcatgttctgggcacaattactactgacaaaatgatggacgtgactgtaactattaaatcctccattgattcagagcccgcactagttctggggccactgaagtcagtccaggaactgcgacgcgagcagcagctggctgaaattgaagcccgaagacaggagagggagaaaaacgggaatgaggaaggggaggagcgaatgaccaaacctccggtgcaggagatggtagatgagttacagggaccctttagttacgactttagttactgggctcgtagtggcgagaaaattaccgtcaccccctctagtaaggagctgttgttttatcccccatccatggaggccgtggtgtcaggtgaaagctgtcccggtaagttgatcgaaatccacggaaaagctgggttgtttttagagggccagatccacccagagctcgagggggtggaaatcgttatcagcgaaaaaggggcatctagtccactcataaccgtcttcaccgacgataagggggcatattctgtggggcctctgcacagtgaccttgaatataccgttacaagtcagaaagaaggatatgttctgaccgccgtggaagggaccatcggagatttcaaggcttacgcattggctggtgttagttttgaaatcaaagcagaagacgatcaacccctccccggagtgctgctgtcactgtctggcggtttatttcgcagtaatctgcttacacaagataatggcattctgactttttccaatctgtcaccgggacagtactactttaagcccatgatgaaggagtttaggtttgaaccgagtagccagatgattgaggtgcaggaagggcagaatctcaaaataacaatcaccggctacagaactgcttactcttgctatgggacagtatcctctctcaacggtgaaccagaacagggagtcgccatggaagctgtcgggcagaatgactgtagcatttacggggaagacaccgtcacagacgaagaaggcaaattccgccttcgaggattactccccggatgcgtgtaccatgtgcaactgaaggcagaaggcaacgaccacatagaaagagcccttccacatcacagagtgattgaagttgggaacaatgatatagacgatgttaacataatagtttttcggcagatcaaccaatttgatctctcaggaaatgtcatcacctcctccgaatatctgcctaccctatgggtaaagctctacaagtctgagaatctggataatcctattcagaccgttagcctcgggcagagtttgttttttcacttcccgcctctgctgagggacggtgagaattatgtggttttactggacagcacgctccccagaagtcagtacgattatattctcccccaggtatcgtttacagccgtcggttatcacaaacacattaccctgatttttaatccaaccaggaagctgcctgagcaggacattgcccaggggtcatacatagcactgcctttgactctgctggtcctcctagccggttataaccatgataagctcatacctttactcttgcagctgacatccagactgcagggagtacgcgctctggggcaggccgcttccgataattccggccctgaggatgcgaagcggcaggccaagaaacagaaaactcgcagaacatag

SEQ ID NO: 52050 - DNA, 3804 bp, Artificial Sequence
  Description of Artificial Sequence: Synthetic coding sequence
atgctggtgggacaaggcgctgggccattgggcccagccgtggtgacagcagccgtagtgctgctcctaagtggcgtcggacctgcacacggcagtgaggacatcgtggttggctgtggcggatttgtgaagtccgacgttgaaatcaactattccttgatagagatcaaactgtataccaagcacggcactcttaaatatcagacggactgcgcgccaaataacggatatttcatgattccgttgtatgacaaaggtgacttcattctaaagattgaacctcccctggggtggtccttcgagcccactaccgtggagcttcatgtcgatggcgtaagcgatatctgcaccaagggtggcgacatcaattttgtcttcacggggttctctgttaatgggaaagtactcagtaaaggccagcctctcggcccagcgggtgttcaagtctcactgaggaataccggaaccgaggctaaaattcagtccaccgtgacacagcctggcggaaaatttgcattttttaaggtcctgcccggtgattacgaaattctcgcaacccacccgacgtgggcactgaaggaggcttccactaccgttcgggtgacaaatagtaatgccaacgctgccagtcccctaattgtggcgggttacaacgtctccggctccgtgcgaagcgacggcgagccgatgaagggagtgaagtttttattgttttcatccctggttacaaaagaggatgtgttgggctgcaacgtcagccccgtgccaggctttcaaccgcaggacgaatctctcgtgtacctctgttataccgtgagccgcgaggacggcagtttctccttttactcgctgccttcaggagggtatacagtcatacctttttacaggggcgagcgcattacctttgacgttgctccctcacgcctggactttaccgtcgagcacgactcactgaaaattgagcctgtgttccatgttatgggattcagcgtgactgggcgtgtccttaatggccctgaaggcgatggggtcccagaagcggtggtgaccctcaataaccagataaaggtgaagaccaaggcggatgggagctttaggctagaaaatatcacaacaggcacatatacgatccacgctcagaaggagcatctgtacttcgaaacagtgaccatcaagattgcaccgaatactcctcagctggccgatatcatcgcaacaggattcagtgtgtgtgggcaaatttccattataagatttcccgacactgttaagcagatgaataaatacaaagtggtgctctccagccaagataaggataagagtttggtcactgtggagaccgacgcccatggaagcttttgttttaaggctaaaccaggcacctacaaggtgcaggttatggtcccagaggcggagactcgcgcaggcctgacgctgaagccacaaacctttcccctgaccgtaaccaatcgacccatgatggatgtggcattcgtgcagttcctcgcaagtgtgtcagggaaggtctcctgcctcgatacgtgcggggacctgctagttaccttgcagagcctcagccgacagggcgagaagagatccctccagctctcaggtaaggttaatgctatgaccttcacattcgataatgttttgccaggcaaatataaaattagcattatgcatgaagattggtgttggaagaataaatcacttgaagtggaggtgttggaggatgatatgtcggcagtggagtttcggcagacaggctatatgcttaggtgttctctgtctcacgccattaccctggagttctaccaagatggcaacggacgagaaaacgtggggatctacaatctgtccaagggagtaaataggttctgtctcagcaaacccggagtctataaggtcacaccccgatcctgccataggtttgagcaagcgttctatacttacgatacttcctctccttccatcctcactctgactgcaattagacatcacgtgctcggaaccatcacaacagacaaaatgatggacgtaacagtgactattaagagttctatcgattctgaacccgctctggtattgggcccacttaagagtgtgcaggaactgagaagggaacagcagctcgcagaaatagaagctagacgccaggagagggagaagaacgggaacgaggagggggaggaacgcatgactaaaccgccagtgcaggagatggtcgatgagctccagggcccattcagttacgatttctcttactgggcaaggagtggagagaaaattaccgtgacaccatccagtaaggagctcctgttttatccaccttcaatggaagcagtggttagcggtgagtcatgtcctggcaaacttatagagattcacggcaaggccggtctcttccttgagggtcagatccatcccgagctcgagggagtggaaatagttattagtgaaaaaggcgctagctccccactgataacggtatttacagatgacaagggggcttactccgtaggtccgctgcatagcgacctcgagtacacagtgaccagccagaaagagggttacgtgttaacggcagtggagggaactattggagatttcaaggcctatgcactggctggagtcagcttcgaaattaaggcagaagacgaccagccacttccaggcgtgctgttatctctttcaggcggactgtttagatccaacctcttgacccaggacaacggaattcttaccttctccaatttatctcccggacaatattatttcaaaccgatgatgaaggaatttcggttcgagccatcttcgcagatgatcgaagttcaggaaggccaaaatctgaagattacaataactggctatcggacagcgtacagctgttacggcaccgtttcgtctttaaatggagagcctgaacagggtgttgctatggaagcagtcggccagaacgactgctccatctatggcgaggatacagtcactgacgaagaaggtaagttccgcttaagaggacttttaccagggtgcgtttaccacgtacagttaaaagcagaagggaatgatcatattgagcgtgcactgcctcaccatcgcgttattgaagttggaaacaatgacatcgatgatgttaatataatcgtcttccgtcagatcaaccaattcgatctctcaggcaatgtgattacatcatcagagtacctaccgacattgtgggttaaactttacaaatcagagaacttggacaacccgatacagaccgtatctctcggtcaatcccttttcttccactttcctccgctcctcagggacggagaaaattatgtagtgctgctggattcaaccctcccccgaagccaatatgattacatcctgccccaggtgtcctttaccgctgtagggtaccacaaacacattacactcatcttcaacccaacccggaaactccctgagcaggacatcgcccagggatcctacatcgccctgccacttacactcctcgtgctcctggccggttacaatcacgacaaactgatccccctgctgctccagctcacatctagactgcagggcgtacgggcattggggcaggctgctagcgacaattctgggcctgaagacgcaaaaaggcaggcgaagaaacaaaagacacgcaggactcttagactgcaaggggaatttcagctaacatggtgcctggttccctggagagggactcttggcattcacctgttttcgtccctgccattcgctagtgaaatcttgcttgagaccacggccacttgcatccactactag

SEQ ID NO: 52051 - DNA, 3303 bp, Artificial Sequence
  Description of Artificial Sequence: Synthetic coding sequence
atggcccgtttcgctttcttcaaggtgctgcctggcgattacgaaatcctcgctacgcatcccacctgggcactgaaagaggccagcaccacggttcgggtaaccaatagcaacgccaacgctgccagtcctctcatcgtggccggatacaacgtctctggaagcgttcggtctgatggggagccaatgaaaggcgtcaagttcctcttgttctcaagtctggtcaccaaggaggacgtgctgggatgcaacgttagcccggtgccgggttttcaaccccaagacgagtctctggtgtacttgtgttataccgtatcccgggaagatgggagcttttctttttattcactgcccagtgggggttacacagtaatccctttctatcgcggagagcggattacgttcgatgtggcacctagccgccttgacttcacggtcgagcatgattctctgaagatagaacctgtattccacgttatgggtttttctgtgactggcagagttttgaacggccctgagggggatggcgttcctgaggccgtcgtgactctgaacaaccagataaaagtgaagactaaagctgatgggtccttccggctcgaaaacattacgactgggacctataccattcacgcgcaaaaagagcacctgtacttcgaaaccgtaacgatcaaaatcgcacctaataccccccaactcgcggatatcattgccaccggattcagcgtttgcgggcagattagcatcatcagatttcccgatacagtaaagcagatgaacaaatataaggtcgtattgagtagccaagacaaggacaaatctcttgtgactgtcgagaccgacgctcatggttcattctgtttcaaagctaagcccggaacctacaaagtgcaggtgatggtgcccgaagccgagacgcgagccggattgactctgaagccacagacatttcccctgacggtgactaacaggcccatgatggacgtggccttcgtccagttcctggccagtgtgagtggtaaggtgagctgcctggacacttgtggagacctcctcgtcacactgcagagtctgtctagacaaggcgagaagcgatccctgcagctttccggcaaggtcaacgccatgacattcacatttgacaacgttcttccaggcaagtacaagatctctattatgcatgaagactggtgctggaagaataaatcactcgaagtggaagtgctggaagatgacatgtctgccgtcgaattcagacaaacgggctatatgctcagatgtagcctctcccatgctatcaccctggagttctaccaagatggtaatggtcgggaaaatgtggggatatataatttatctaaaggcgtgaatagattttgtctctcaaagcctggggtgtacaaagtgacacctcgatcatgtcatcggtttgaacaagctttctatacatacgacacatcttcccccagcatacttaccctgacggctattcggcaccacgtcctgggaaccattacaactgataagatgatggacgtcactgtgaccatcaaaagttccatagatagtgaacccgctttagtcctgggacccctgaagtccgtccaggagctgcgcagagagcaacagctggcagaaattgaagccagacgacaggagagagaaaagaacggtaatgaggaaggtgaagaacgaatgactaagcctcccgttcaggagatggtggatgaactccagggccctttttcatatgatttttcttactgggctagatccggcgaaaagatcactgtcacaccatctagtaaggaactgctgttctatccccctagtatggaagctgttgtatccggagagtcctgcccaggaaagctgatcgaaattcacgggaaagccggattgtttctggagggacagatacatccagaactagaaggcgtggagatcgtgatctctgaaaaaggggcatcttcccctctgatcaccgtgtttactgacgacaagggcgcatactctgtggggcctcttcattccgatttagagtacaccgtgactagtcagaaggaggggtatgtcctcaccgctgtagagggcactattggcgactttaaagcctatgcactcgctggtgtgtccttcgagattaaagcagaagatgaccagcctctcccaggagttctattgtcacttagcggtgggctgttccgctcaaacttgctgactcaagataacgggattctgacattctccaacctgagccctggccagtattatttcaagcctatgatgaaggaattcagattcgagccaagttcccaaatgatagaggtgcaagagggccaaaacctgaaaattacgatcacaggatatcggaccgcttactcttgttacgggaccgtctctagtctcaacggggagcctgaacagggagtcgcgatggaagcggtgggacagaacgattgctccatatacggggaggacactgtaacggatgaagagggaaagttccgactgagaggtctgctgcctgggtgcgtataccatgtacagctaaaggcggagggaaatgaccacatcgagcgcgcactcccacatcaccgcgtgatcgaggtgggcaataatgatatagacgacgtgaacatcatcgtattcagacagatcaaccagtttgacctgtctgggaacgtaatcacctcttctgaatacctcccaactttatgggtgaaactgtacaagagtgagaacctggacaaccccattcaaacagtgtctctcggccaatcgttgtttttccactttcccccactactgcgcgacggagagaactatgtggtcctgctcgattccacactgcctaggagtcaatatgactacatactgccccaggtgtctttcacagctgtggggtatcataagcacataactctgatctttaatccaacacgtaagctgccggaacaggacatcgctcagggttcctacatcgctctgccactgactctcctggtcctgttggctggttacaaccacgacaaacttattcctctgttgctgcagctgacatcccggttgcagggcgtgagagccctcggacaggcagcttcggacaactctggcccagaagacgctaaacggcaagccaagaaacagaagacccgcaggacgttgcggttacagggagaattccaactaacatggtgcctggtgccatggcgcggaactctcggaatacatctgttctcctcactgcctttcgcatctgagatcctgctcgagaccaccgctacatgcattcattattag

SEQ ID NO: 52052 - DNA, 3669 bp, Artificial Sequence
  Description of Artificial Sequence: Synthetic coding sequence
atgctggtcggacagggtgccggactgttgggcccagcagttgttaccgccgcagtggtcttgctccttagcggggtgggtcccgctcatggctcagaagatattgttgtgggctgcggcggatttgtgaaatcagacgtagagatcaactattccctgattgaaattaagctctacaccaaacacgggactctgaagtatcagacagattgcgctccgaacaacggctattttatgattcccctctatgataagggagacttcattcttaaaattgagccaccactggggtggtcctttgagccaacaacagtggagctgcatgtcgacggcgtgtccgatatttgcaccaaggggggtgacatcaactttgtgtttaccggattttccgtgaatggtaaggtcctcagcaaagggcagccattggggcctgcaggggtgcaggtctccctgagaaacacagggactgaggcgaagatccagtctacagttacccagccaggaggtaagttcgctttcttcaaggtcctacccggtgattatgaaatcttggccacgcaccccacatgggcattgaaggaagctagtaccaccgtcagagttaccaactccaatgcaaatgcagcttcgcccctcatagtggccggatacaacgtctctggcagcgtgcgttctgacggggagccaatgaaaggggttaaatttctcttgttctcgtccctggtgaccaaggaggatgtgctgggatgtaacgtcagtcctgtgcccggattccagccccaggatgaaagcctcgtttatctgtgctataccgtcagccgcgaagacgggtctttctccttctatagtttaccttcaggcggttatactgtgatccctttctaccggggagagaggatcactttcgacgtggccccatctagactcgatttcaccgtggagcatgatagtctgaagatcgagcccgtattccacgtgatgggatttagcgtcacaggaagagtcctgaatggtcctgagggagatggcgttcccgaagcagttgtgactttgaacaaccagatcaaagtgaagacaaaggctgatggctcgtttcggttggagaatattactacagggacctacaccatacacgcacagaaagagcatctctactttgaaaccgtcacaatcaaaatcgcgcctaataccccacaactcgctgacatcgtggcaaccggcttcagtgtctgcggaagaatctctatcatcaggttcccagatacagtgaaacagatgaataaatacaaggtcgtactttcttcccaggacaaggataagtcgctggttaccgtggagactgacgcacacggcagcttttgctttaaggccaagccaggaacatacaaagtgcaggtgatggtcccagaggcagaaaccagggcgggtctcacactgaaaccgcagaccttccccctgactgtaacagatcggccagttatggacgtggcttttgtccagttcctcgcatccgtttcaggtaaagtatcctgcctggacacctgcggcgacctgctggtgacacttcaatccctgtctaggcaaggagaaaaaaggtctttacagctctcagggaaggtgaacgccatgaccttcacgttcgacaacgttttgccaggcaaatacaaaatttccattatgcacgaagactggtgctggaaaaataagagcctggaggtggaggtcctcgaggatgatgtgtctgccgttgagtttcggcagactggctacatgctacgatgcagcttgtctcacgccataaccctagaattctatcaggacggtaacggtagggagaatgtgggaatttacaacttgagcaaaggcgtgaatagattctgcctgagcaaaccaggtgtttataaggttacacccagatcatgccaccggttcgagcaggccttttatacttacgatacttctagtccttccatcctgacactgactgcaatccggcaccacgtcctaggtacaatcacaacagataaaatgatggacgtgaccgttactattaaatccagcattgactctgagcctgcgttggtgctgggaccactcaagtcggttcaggagcttagacgggagcagcagctcgccgagattgaagctaggcgacaggagcgggagaaaaacggcaacgaagaaggtgaggagcgtatgaccaaacctccagttcaggagatggtcgatgagctgcagggtcccttctcatatgacttttcatattgggctcgatctggcgaaaaaataactgtgactccttcctccaaggagctcctgttttacccccctagtatggaagcggttgtgtcaggcgagtcttgtccgggaaagctgatcgaaatacatggcaaagcaggcttgtttttagagggtcagatccatcccgagctggaaggcgtcgagatcgttatctccgaaaaaggtgcttcctccccgctgattactgtttttacggacgacaaaggcgcatactcagtgggccctctccacagcgacctcgagtacactgttacctcccagaaggagggctacgtcttgaccgcggtagagggaaccatcggagacttcaaagcttatgctctagccggagttagctttgaaataaaggcagaggacgatcagccactgccaggcgtgttactgagcctgtctggcggactgtttagaagcaacctcctcacacaagataacgggatcctcacgttcagtaatctttcaccgggacagtactatttcaaacctatgatgaaagagttccggttcgagccctccagccagatgatcgaagttcaagaaggtcagaatctgaagattaccattactggctatcgcactgcttattcctgctacggaactgtctcatctctaaacggcgaacctgaacagggcgtggccatggaagcggtcgggcagaatgattgttcaatttacggagaggacaccgttacagacgaggaagggaagtttagactgagagggcttctccctggttgtgtctaccacgtccagttaaaggctgagggaaacgatcacatcgagagggctctcccgcaccaccgtgtgattgaggtggggaacaacgacattgatgatgtgaatatcattgtatttcgacaaatcaatcaatttgacttgtcaggcaacgtcatcactagctctgagtacttgcccaccctatgggtcaaactctacaagagtgagaacctggataatccaatacagacagtaagcctcggccagtctcttttcttccattttcctcctctcctgagagatggagagaactatgtcgtcctcctcgacagtaccctccccaggagtcagtatgactacattctaccccaggtatctttcactgctgtgggttaccataaacatataactctgatcttcaatcccactcgaaaattgccagaacaggatatcgcgcagggtagttacatcgcccttccactgactctgctggtgctactggccggatacaatcatgacaagcttatcccattactgctgcagctgacctcacggctgcagggggtgggcgctctggggcaggccgctagcgacaattctggtcctgaggacgccaagaggcaggccaagaagcagaagacgcgaaggacctag

SEQ ID NO: 52053 - DNA, 3804 bp, Artificial Sequence
  Description of Artificial Sequence: Synthetic coding sequence
atgttagtcggacaaggcgcagggctgctaggacctgctgtggtgaccgctgcagttgtgctgttattgagcggggtcggtcccgctcacggctccgaagacatcgtggtggggtgtggtgggttcgtcaagtcggatgtcgagattaattactcgcttatcgagatcaagctttatacaaagcatggcacactgaagtaccagactgactgcgcccctaataatggttatttcatgattcccttatatgacaagggcgactttatcctcaaaatcgagccgccactgggctggtctttcgagccaaccacggttgagctgcacgtcgatggagtttcggacatctgcactaagggcggagatataaactttgtgtttaccggcttcagcgtcaacggtaaagtgctcagcaaaggccagcccctgggtcccgctggtgtccaggtctcgttgaggaataccggtacagaagccaagatccagagtacagttacccagccgggaggaaagttcgccttttttaaagttctgcccggtgattacgaaattctagccacccaccccacatgggctcttaaggaggctagcaccactgtacgtgttactaactcaaacgcaaatgcagcatcccccctcattgtcgccggatacaacgtgtccggaagcgtgagatcggacggcgagccgatgaagggcgtgaagttcctgctttttagctcattggtcactaaagaagatgttttgggctgtaatgtgagtccggttcctggcttccagccccaagatgagtcgctggtgtatctttgttacactgtatctagagaagacggctccttctctttttactccctcccctctggtgggtataccgtgattcctttttatcgcggagagcgaattacattcgatgtagcaccatctcggcttgactttaccgtggagcacgactccctcaagattgagccggttttccatgtcatgggattctccgttacgggtagggttttgaacgggcctgagggcgatggggtgcctgaggccgtcgtgacattgaacaaccagattaaagtgaaaacaaaggccgacggcagtttcaggctggaaaatattacgaccggtacttacaccatccacgcccagaaagagcatctatattttgaaaccgtgactatcaagattgctcctaacacaccacagctggcagatattgtggccaccgggttctcagtttgcggccgaatatccattattaggtttcctgacacagtcaaacagatgaataaatacaaggtggttctgtcctcccaggacaaggataaatccctagttactgtagaaacggatgctcatggaagtttctgtttcaaggctaagccagggacttacaaagtacaggtgatggtgcccgaagcagaaacgcgcgcaggcctgactttgaagccacaaacatttcccttaacagtgacggaccggccagttatggacgtcgcctttgttcaattcctcgcatcggtgtctggaaaggtttcatgcctcgatacctgcggcgacctgctcgtaactcttcagtccctgtctcgccaaggcgagaagaggtcccttcaactgtccgggaaggtgaacgccatgactttcactttcgataatgtgctacccggtaaatacaagatcagcattatgcatgaagactggtgttggaagaataagtcactcgaggttgaggtgcttgaagacgatgtgtctgcagtggaattcagacaaactggttatatgctgcgctgttcgctgtctcatgccatcacgttagagttttatcaggacggtaacgggagagagaatgtgggaatctataatctcagcaagggcgtgaaccggttttgtctgtctaagcctggggtatataaggtgactccacggtcctgtcatcgcttcgagcaggcattctatacgtacgacacctcatccccctccatcctcactctgactgctattaggcaccacgttctgggtaccattacaaccgacaaaatgatggatgtcactgttacgatcaagtccagcatcgatagcgagcccgctctagttttgggtccactcaaaagcgtgcaggagttgcggagagaacagcaattggcggaaatcgaagctaggcgtcaggagagagaaaagaacggcaatgaagagggcgaggaaagaatgacaaagccccctgtgcaagagatggtggatgaactgcagggaccgttttcatacgacttcagctattgggccagaagtggcgagaagatcacggtgaccccgagcagcaaggaattgctcttctatcctccgagcatggaggctgtcgtctcaggtgaaagctgcccaggaaaattgatcgagatccacggcaaagctggtctttttctggagggccagatccacccagagctagagggtgtcgagatcgtgatatccgagaaaggtgccagttctccactcataacagtctttaccgacgataaaggtgcttattcagtgggacccctacattccgatctcgagtacacagtgacttcgcagaaggaagggtatgttctaactgctgtcgagggaactatcggcgatttcaaagcttatgctctcgctggagtgtcctttgaaattaaagcagaggacgatcaacctctcccgggagtcctgctgagtttgtcagggggactgtttagatccaatctccttactcaggataatggaatactcacttttagcaacctgtctcctggccagtattatttcaagcctatgatgaaggagtttaggtttgagccatcgtcccaaatgattgaagtgcaagaaggccaaaacctcaaaattaccatcacagggtaccggacagcttacagctgctacggcactgtaagctcccttaatggcgagccagagcagggtgtggctatggaggcggtgggccagaacgactgctcgatctatggggaggataccgtcacagatgaggagggtaagttccggctcagagggcttctgccgggatgcgtgtaccacgtgcagctcaaagccgagggcaatgatcatattgagcgagcgctgcctcatcaccgggtgattgaggtcggaaataatgacatcgacgacgtaaacattattgtgttccgccagattaatcaatttgatttgtccggaaacgtcataacaagttcggaatatttgccaacattgtgggtaaaattatacaaatctgagaatcttgacaacccaatacagactgtgagcttgggccagtccctcttcttccatttcccaccgctgttgagggacggggagaattacgtggtactactggattcaaccttaccaagatcccagtatgattacatacttccgcaggtgtccttcacggcagttggctaccataagcacataacactgatctttaaccccacacgtaagttgcccgagcaggatattgcccaggggagctatattgccttgcctctgacattactggttctcttggccggttacaaccacgataaattgatacctttgctgttacagttgacatcccgcctgcagggcgtcggtgcgctaggtcaagccgcaagtgacaattctggacccgaggacgctaagcgtcaggctaaaaagcagaagacgaggcgtacacttagattacaggaagagttccagcttatgtggtgcctggtcccatggcggggaacccttggtatacatctcttttcttccctgcctttcgcatcagaaattctgctcgagactactgcgacatgtatccattactag

SEQ ID NO: 52054 - DNA, 3303 bp, Artificial Sequence
  Description of Artificial Sequence: Synthetic coding sequence
atggctcgatttgcttttttcaaagtgctcccaggcgactatgaaatccttgctacgcatccgacctgggcgctgaaagaggcttcaacgacggtgcgcgtgacaaactcaaacgccaacgctgcttcccccctgattgtcgctggttacaatgtatcggggagtgtcaggagcgatggcgagccaatgaagggagtgaaatttttgttattctcctccctggttacaaaagaggacgtattgggatgtaacgtttcacccgttccgggattccagcctcaggacgagtccctcgtttacctctgttatactgtaagccgagaagacggatctttctcattctactctttgcccagtgggggatatacagttatcccgttttatcgcggagaaagaattacctttgacgtcgcgcctagccgactagattttacagtcgagcacgactcactcaagattgagcctgtgtttcacgtgatgggattctctgtcactggacgtgtcttaaacggtcccgaaggagacggtgtgcccgaggccgttgtaactttaaacaatcagatcaaagtgaaaactaaagctgacggcagcttccgactggaaaatattactacgggaacatacactatccatgcgcagaaggaacacttatactttgaaactgtcaccatcaagattgctccgaatacaccccagctggcagacatcgtggctacaggatttagtgtgtgtggacggatcagcattatcagatttccagacactgtcaagcagatgaacaaatataaggttgtgctctcctcccaggataaggacaaaagtctggtgaccgtggagaccgatgcccatggtagcttctgctttaaagccaaaccgggaacgtataaggtccaggtgatggttcctgaagccgaaacccgggcaggactgacgctgaaaccccagactttccctctgacggtgacagacagaccagtgatggacgtagccttcgtacagtttctcgcgagcgtaagcggtaaggtgtcatgcctggacacatgcggggatctgttagtgactctacagagtctcagcagacaaggggagaagagatccctgcagcttagtggcaaggtgaacgcgatgaccttcacatttgacaacgtgctgcccggaaaatacaagattagcatcatgcacgaggattggtgctggaaaaacaaaagcctcgaggttgaggtcctagaggatgacgtgagtgcagttgaattcagacaaacaggctatatgctgagatgcagcctctcccacgcaatcaccctggagttttaccaggatggcaacggcagggagaatgtgggtatctacaatctgtccaagggtgtgaacaggttttgtctctcaaaaccaggagtgtacaaggttaccccccgaagctgccaccgtttcgagcaagccttctacacttacgatacctcctcaccaagtatcctcacactcacggctattcggcaccatgtgctggggaccatcaccaccgacaagatgatggatgtaactgtgacaataaagagctccatcgattctgagcctgccttggtactagggccactgaaaagtgtccaggaactgagaagagagcagcaactagccgaaattgaggccaggcggcaagaaagagaaaaaaacggaaacgaggagggtgaggagcgcatgactaaacccccagtacaggaaatggtcgacgagctgcagggtcccttttcttacgacttctcctactgggcccgatcgggtgagaagataaccgtgaccccctccagcaaagaactgctgttctatcccccatctatggaggcggtcgtgtctggcgaaagttgcccaggaaagctgatagagattcatggtaaagccggtcttttcctggagggacagattcacccagaactggaaggtgtggagattgttatttctgagaagggtgcgtcaagcccactgataaccgtttttacagacgataaaggcgcatattcagtgggacccctccactcagatctggagtataccgtcacaagccagaaggagggctacgttctcaccgctgtcgagggaactatcggggattttaaagcctatgccctggctggcgtgtctttcgaaataaaagccgaagacgatcagccactacccggtgtgctgctgagcctctccgggggtctgtttcggagcaatttgctgactcaggataacggcatccttacattctccaacctctcccctggccaatattactttaagccaatgatgaaagaattccgttttgagccgtcttcccagatgatagaggtacaggagggccagaacctgaagatcactatcacagggtatagaactgcttatagctgttacggcactgtctcgagtttgaatggcgaaccagagcagggcgtagcaatggaggccgttgggcagaacgactgttccatttacggtgaagataccgtaacagatgaggaggggaaattcagactgaggggccttcttcctggttgcgtataccacgttcagctgaaggctgagggaaatgaccatattgagcgagcattgccacaccatcgggtcattgaagtaggaaacaacgatattgacgatgttaacatcatagtgttcagacagataaatcagttcgacctctccgggaacgtcatcacaagcagtgaatatcttcctacactgtgggtgaaactctacaaaagcgagaaccttgataatcccatccagactgtgagtttaggccagagcctgttcttccactttccccctcttctccgggatggcgagaactacgtggtgctcctggactccaccctcccgagatcacagtacgattacatactgccacaggtttcttttactgcagtgggttaccataagcacataacactcatctttaacccaactcgaaaattgccagaacaagacatcgcccagggttcctatatcgccctgccgctgactctgctggtgctcttggccggatataatcatgataaactaattcctctccttcttcagcttacttctaggctgcaaggtgtgggcgctttggggcaggctgcatccgacaattctggaccagaggatgcaaaaaggcaggctaaaaagcagaagacgagaagaacgctcaggttgcaagaggagtttcagctgatgtggtgtctcgtgccttggagggggaccttaggaatccacttatttagcagtcttcctttcgcttctgaaattcttctagaaacaacagctacctgtatccattactag

SEQ ID NO: 52055 - DNA, 3804 bp, Artificial Sequence
  Description of Artificial Sequence: Synthetic coding sequence
atgctggttgggcagggcgcaggccctctgggccctgcagtggtgaccgccgcagtagtgttacttctgtcgggtgtggggccagcccatggatcggaagatattgttgtaggatgcgggggattcgtgaaatcagacgtcgagattaattattcattgattgagataaagctgtacactaaacacgggactctgaaatatcagacagattgtgcacccaataatggctatttcatgattcccctctatgacaagggggacttcatccttaaaatagaaccccctttgggttggtcctttgaacccaccactgtcgaattgcatgtcgacggcgtctctgatatttgcaccaaaggcggagatatcaattttgtcttcaccggcttctcagttaacggaaaggtcctgagcaaagggcagcctttgggacccgctggcgtgcaagtgagcctgaggaatactggtacagaagcaaagatccaaagtactgtcactcagccgggtggaaaattcgcattttttaaagtgctgcctggagattacgaaatactcgccacgcatcctacgtgggcactgaaagaggcttccaccactgtgcgtgtcacaaactcaaatgcaaatgcagcgtcacccctgatcgtggccggatacaacgtttccgggagcgtccgtagtgatggcgaaccgatgaagggcgtgaaattcctgcttttctccagcctggtgaccaaagaggatgtacttggctgcaatgtcagccccgtgccaggcttccagcctcaggatgagtcactggtgtacttgtgctacacagtgtctcgggaggatgggagcttctcattctactccttgccaagcggcggttacacggtgatccccttctaccgaggcgaacgaattacgttcgacgtggccccatctaggctggacttcacggtcgagcatgatagcctgaaaatcgaacccgtttttcacgtaatgggtttttcagtgacaggacgcgtgctgaacgggcctgagggagacggcgttcccgaagccgtagtcacgctgaacaaccagattaaagtaaaaacgaaagccgatggatcgttcaggctggagaatatcaccaccggcacctataccattcacgcccagaaggaacacctgtattttgaaactgtgactataaaaatcgcaccgaatactccacagctggccgacattgtggctacaggcttcagcgtctgcggacagatctctatcatcaggtttcctgacacagtaaagcagatgaataagtataaagtcgtgctaagtagtcaggacaaagataaaagcctggtgaccgttgagactgacgcccatggttctttctgcttcaaggccaatccgggaacttacaaggtccaggtgatggtgcctgaggctgagacccgggcaggcctcacacttaagcctcagacattccccctgacagtcacagacaggcccgtgatggatgtggcgttcgtccaattcctagcctccgttagcggaaaggtgtcatgtctcgacacttgtggcgacttgctggtgaccctgcagtcattgtcccgccagggagagaagagaagtttacagctgtcaggcaaggtaaatgccatgacttttaccttcgataatgtcttgcccggaaaatacaagatctccattatgcacgaggattggtgctggaaaaataagagcctggaagttgaagtgctagaagatgatgtgtcggctgtggagtttcggcagacaggatacatgctccggtgtagcctgagtcacgccataacgctggagttttaccaggacgggaacggcagagagaacgtgggcatctacaacctgagcaagggcgttaatcgcttttgcctttcaaaacccggagtgtacaaggtgacccctaggtcatgccatcgcttcgaacaggcgttctacacatacgacaccagctccccgtcaattctaaccctgaccgccattagacaccacgtgctggggactatcacaacagacaaaatgatggatgttactgtgactattaagagttccattgatagtgagcctgccctcgttttaggccctctgaagtctgtccaagagctgcgtagagaacagcagctagcggagattgaggctaggcggcaggagcgggagaaaaatgggaacgaggagggtgaggaacgaatgaccaaaccccctgtccaagagatggttgacgagttgcaaggccctttttcttatgatttctcttactgggccaggagcggcgaaaagatcaccgtgacaccaagttcaaaggaattgctgttttatccacccagtatggaagccgtggttagtggggagtcatgccccggtaagctcatcgaaattcatggtaaagccggtctttttctcgagggacagatccatcctgagcttgagggggtggagatcgtgatctccgagaaaggcgcatcctctccattgattactgtttttactgatgacaagggagcctacagtgtgggtcctctccatagtgacctggagtacacagtgacttcccagaaggaaggctacgtgttgaccgccgttgaagggactattggcgacttcaaggcctacgcgttagccggagtcagcttcgagataaaagccgaagacgatcagcctttgcccggagtacttctgagcctgtccggtggcttgttccgctctaatttgttgacacaggataacgggatccttacatttagtaatctgtcccctgggcaatactacttcaagcccatgatgaaagagttccgctttgagccttctagccaaatgattgaggtgcaggaagggcaaaacctgaaaattaccatcacgggttacaggacggcctactcttgctacggcacggtttcaagtctgaacggcgaaccagagcagggagtcgccatggaagccgtgggacagaacgactgttccatatatggcgaggacactgtgaccgacgaggagggtaagtttcgtctcaggggactgctgcctggttgtgtctatcacgtgcagctgaaggccgagggaaacgaccatatcgagcgcgcactcccacaccatcgggtgattgaagtcgggaacaatgacatcgacgacgtcaacattattgtttttagacaaatcaatcagttcgatctaagcggaaacgttattacatccagtgagtacttacccaccttatgggtcaaactgtacaaaagcgaaaatctggataacccaatacagactgtgtcattgggacagagcctatttttccatttccctcccttgctgagggatggggagaactacgtggtcctgctggacagcacactgccgagaagccagtatgattacatcctcccccaggtaagcttcacagccgttggctaccataagcacataactttaattttcaaccccacaagaaagcttcctgaacaggatattgcccagggaagctacatcgccctgcccctcacactgttggtgctcctcgctggatataaccacgacaagctgatccccttgctgctgcagctgactagcagactgcagggcgtcggggcactggggcaagctgcttccgataacagcggcccagaggacgccaagagacaggccaaaaaacaaaaaacaaggaggacgctgagactgcaggaagaattccagctcatgtggtgtctggtgccttggcgcggaacgctaggtatacacctgttttcatccctgcccttcgcctctgagattcttctcgaaactacggcgacatgcattcattattag

SEQ ID NO: 52056 - DNA, 3669 bp, Artificial Sequence
  Description of Artificial Sequence: Synthetic coding sequence
atgctggtggggcagggcgctgggcctctggggccagccgttgtgacagccgcagttgtgctgctcctgtccggcgtcggccctgctcacggatccgaagatattgtcgtgggatgtggtggttttgttaaaagcgacgtggaaatcaactatagcttaattgagatcaagctctacacaaaacatggcactctcaagtatcagactgattgcgccccaaataacggatattttatgatccccttgtacgacaagggagactttattttgaagatcgagccccctctgggttggtctttcgagcctaccacagttgagttacacgtggacggcgtttccgacatttgcaccaagggtggggacattaatttcgttttcaccggctttagcgtgaatggaaaggtgctgagtaagggacaacctcttggtcctgccggagtgcaggtgtcactaaggaatactgggaccgaggcgaagattcaatctacggttacccaacccggaggcaagttcgcgttttttaaggtactacctggagactatgagatcctggctactcatcctacctgggcgctcaaggaggcgtcaacgactgtaagagtgaccaactcaaacgcgaatgctgcaagccctttaatcgttgctggctacaatgtttctgggtctgtccggtccgacggtgagcccatgaagggcgtgaagttcctgctattctcatctctcgttacaaaggaggacgtgttgggctgcaatgtttcacctgtcccaggcttccaaccacaagatgaatccctggtgtacctgtgctacaccgtttccagagaagacgggtcattcagtttttactccctaccatctggaggctataccgtcatacccttttacaggggagagcggatcacattcgatgtggctccctccagactcgattttaccgtggagcacgactcacttaagatcgagcccgtgttccacgtgatgggttttagtgtgacagggagagtattaaatggcccagagggggatggcgtccccgaagcagtggtcactctcaataaccagatcaaggtcaaaacaaaggctgatgggtcatttcgccttgagaacatcacaacgggaacctatacaattcatgcccaaaaagagcacctgtatttcgaaacagttactattaagatcgcccctaataccccacagctggccgacatcgtggccaccggattcagcgtgtgtggacagatcagtattatacggtttccagacacagtgaagcagatgaacaaatataaagtcgtactgtctagccaggacaaagataaaagtttggtgactgttgagacggacgctcatggatcattttgtttcaaggccaaccccggtacatacaaggtccaagtgatggtgccagaggccgaaactcgggcaggtctgacactcaagcctcagactttcccgcttaccgtgaccgatcgacctgtcatggacgtggccttcgtacagttcctggccagcgtgtccggaaaggtgagttgcctcgatacctgtggggacctgcttgtaactcttcagtcactcagcagacagggcgagaaaagatcccttcagctgagcggaaaagtgaacgccatgacattcacatttgataacgttctgcccggaaagtacaaaatttcaattatgcatgaggattggtgctggaaaaacaagagcttggaggtagaggtgctagaggatgacgttagcgcggtcgagttccgccagactggttatatgctgcgctgtagcttgagccatgccatcaccctggaattctatcaggacgggaacgggagggagaacgtagggatctacaacctgagtaaaggggtgaaccgcttctgtctgtcaaagcctggcgtttataaagtcactcccagatcctgccatagattcgaacaggcgttttatacatatgatacttcttcccctagcattctcaccctgacagcaattcggcaccatgttctgggcaccatcaccaccgacaagatgatggacgtgactgtcaccatcaagtctagcatcgattctgaacccgctctggttctcggtcccctcaagtccgttcaggagttgagacgggagcagcagctggcggagatcgaagctaggagacaggagcgagaaaaaaacgggaatgaggagggcgaagagcgcatgacaaaaccgcctgtacaggagatggtggacgagctccaaggacccttcagctatgatttttcttattgggcgagaagtggagaaaaaattactgtgactccatccagcaaggaactcttgttttatccaccgagtatggaagcagtagttagcggtgagagctgcccaggcaagctcatcgagatccatgggaaggcgggtttgtttttggagggtcagatccatcctgaactggaaggggttgagatcgtgatctcggagaaaggagcaagctcccccctgattacagtatttactgatgacaagggggcttactctgttggacctctgcattccgatctggagtacactgtgactagtcagaaagagggctacgtcttaaccgctgtagagggaaccatcggcgacttcaaggcgtatgcacttgctggcgttagcttcgaaatcaaggccgaagatgatcaaccgctccccggtgtactgctgagcctgtccggtggcctcttcaggagtaaccttctcactcaggataacggcatcctgacctttagtaatctctccccaggtcaatactacttcaagcccatgatgaaagaattcaggtttgagccttcaagccaaatgattgaagtacaggagggccagaaccttaagataaccatcaccggatatcgcactgcttattcttgttatggaaccgtgagcagtctgaatggagagcctgagcagggagtcgctatggaagcggtaggacaaaatgactgtagcatctacggggaagataccgtgaccgacgaagagggaaaatttaggctgcggggactgttgccaggctgcgtttaccatgtccaactaaaggcagagggtaatgatcatatagagcgcgctctgccccaccatagggttatcgaggtaggaaacaacgatattgacgacgtgaatatcattgtattcaggcagataaaccagtttgacctgagcggtaatgtgattaccagcagcgagtacttaccaaccctatgggtcaaactttacaagagcgagaatctggacaacccaattcaaaccgtgagccttggccagagcttgttttttcactttcctccccttctgagggatggcgagaactatgtcgtgctgttggacagcacacttccgagatcgcagtatgattacatcctgccccaggtcagcttcaccgctgtcggttaccacaagcacataactctgatcttcaatcccacacggaagctgcccgaacaggatatcgcacagggcagttacattgccctgcctctgaccttactcgtgctcctggccggttataatcatgacaaactcataccccttctgctgcaattaactagccgactacaaggcgtcggtgcacttggccaggccgcatctgataatagcgggcctgaggacgccaaaagacaggctaagaaacaaaagacaaggagaacttag

SEQ ID NO: 52057 - DNA, 3303 bp, Artificial Sequence
  Description of Artificial Sequence: Synthetic coding sequence
atggcacgcttcgcattttttaaggtcctccccggtgattacgagattcttgccacccacccaacttgggctctaaaggaagcatctactacggtacgggtcaccaacagcaacgccaacgccgcttcccctctgattgtggccggttacaacgtgtcagggagcgtgcgaagcgacggcgagccaatgaagggagtgaaattcctcttattcagcagtttggttaccaaagaggatgtcctgggatgtaatgtatcccctgtgcccggatttcagccgcaagatgagagcctcgtgtatctgtgctacaccgtgagtcgagaagacgggagtttctcattctactccctcccgagcggaggatacactgtcattcctttttacagaggcgagcggattactttcgatgtggccccatcacgcctggacttcacggtagagcacgattccttaaagattgagcctgtattccacgtaatggggttctccgtgaccggcagagtgctaaacggccctgagggcgatggcgtaccagaggccgtggttaccttaaacaatcaaattaaggtgaagaccaaggccgatggctcctttcgcctggagaacatcactaccgggacatacacgattcatgctcagaaagaacacttatactttgagaccgtcaccattaaaatcgcgccaaatacaccgcagttggcggacatcgtggcaacgggttttagcgtttgtggccagatatctataatccgctttcctgacaccgtcaaacaaatgaacaagtataaagttgtcttgtcttctcaggataaggataagagcttggtgacagtggagaccgacgcccatggctccttttgctttaaagctaatcccggaacttacaaagtacaggtgatggttcccgaagccgaaaccagagcaggactgacactaaagccccagacattccctctgaccgtaactgaccgccctgtgatggatgtcgcattcgtacaattcttggcctccgttagtggtaaagtgtcctgtctcgacacttgtggagacttgctcgtaaccctgcagtctctctctcggcagggggaaaaaagatctcttcaactctctggtaaggtgaatgccatgacttttaccttcgacaatgtcttgccagggaagtataaaatctccatcatgcacgaggattggtgttggaaaaacaagtcgttggaggtggaagttctagaagacgacgtgagtgctgtggaattccggcaaaccggttatatgttgcggtgctccctgtctcacgccattacactggaattttatcaggacggcaacggacgcgagaacgtagggatttataacctgtcgaaaggagtgaataggttctgtctgagcaagcccggagtgtacaaggttaccccacggtcctgccatcggtttgagcaggctttctacacttacgatacctcttcgcctagcatactgactctcaccgccattagacatcacgttctaggaactattaccacggacaaaatgatggatgtcaccgttacaatcaagtcctctattgattcggaacccgctctggttctcggacctctcaaaagcgtgcaggagcttcggagggaacaacagcttgcggaaatcgaggcaagacgacaggaaagggaaaagaacggtaacgaggagggcgaggaacgcatgacaaagccccctgttcaggagatggtggacgagttgcagggcccattctcctatgacttcagctactgggctcgcagcggcgaaaagatcactgttaccccaagcagcaaggagttgttattttaccctccctcaatggaggccgtcgtgtcaggagagtcttgtccgggtaagttgattgaaatccacgggaaggccggtcttttcttagagggacagatacacccagagctggaaggagtggaaatcgtgattagcgaaaagggggctagctctccactcatcacagtgttcacggatgataagggcgcttattctgtgggacccttgcattcagacttggaatacactgtgacttcccagaaggagggctacgtgctcacagccgtggaaggtaccattggtgatttcaaggcttatgcacttgcaggagtctcattcgagatcaaggctgaggatgaccagcctctgcccggagtcctgctgagcttgagcgggggactctttcgcagtaaccttctgacccaggataacggaatcctgacattttctaatctgagtcccggacagtattattttaagcccatgatgaaggagttcaggtttgaacccagcagtcaaatgatcgaagtgcaggagggtcagaacctgaaaatcaccattaccggatataggacagcttatagctgctacggtacggtatccagcctgaacggggaacctgaacagggtgtggcaatggaagccgtaggccagaatgactgcagcatatatggggaggacactgtgacggacgaagaaggcaagttcaggctgagaggcctgctccccggatgtgtctatcatgtccagcttaaggccgagggaaatgatcacatcgaaagagctctcccacaccacagggtgatcgaagtagggaacaacgacatcgatgacgtaaacattatcgtgttcaggcagatcaaccagttcgacttaagcggtaacgttatcacctcttcagaatatcttcctactctttgggtgaaactctataagagtgagaatctggacaaccctatccagacggttagtctggggcaaagcctgttttttcattttcctccactcttgcgagatggcgaaaattacgtggtactgcttgattccacgcttcctcggtcgcagtacgattacattcttccccaggtatcctttacagccgtcggatatcacaagcacattaccctgatctttaaccccaccagaaagttgccagagcaggacattgctcagggatcatacatcgcactaccactgacacttctcgtcttgctggccggatataatcatgataagttgatcccattactgctgcagctgactagcaggcttcagggcgtgggcgcattgggccaggccgcttcagataacagcggtcctgaagacgctaagagacaggcaaagaagcaaaagacccggcgaactctccgactgcaagaggaattccaactcatgtggtgcctggtgccttggaggggaactctcggaatacacctgttctcatcactcccattcgcttccgaaatccttctcgaaactacggccacgtgtatccactattag

SEQ ID NO: 52058 - DNA, 4206 bp, Artificial Sequence
  Description of Artificial Sequence: Synthetic coding sequence
atggccccacagatgtatgagtttcatctcccactttctcctgaagagctgttgaaaagtggcggagtcaaccaatacgtcgtgcaggaggtgctctcgattaaacatttgccaccccagttacgggcatttcaggcggcattcagagcccagggccctttagctatgttgcagcactttgacactatttattcaatcctgcaccatttccgaagtattgatcccggacttaaagaggatactctgcaatttctaattaaggtcgtgtcaagacactcccaagagctgcccgcaattctggacgacactacactctccggatccgatcgaaacgctcatcttaacgccctcaagatgaattgttacgcccttatacgactcctggaaagcttcgaaacaatggctagccagaccaatttagttgacttagacctcgggggtaaaggcaagaaggctagaaccaaagccgcacatggctttgactgggaggaggagaggcagccaattttgcaacttttaactcaactcctgcaactggatattagacatttgtggaatcattctattatcgaagaagagtttgtgtccctggtgacaggctgttgctatagattgcttgagaacccaactataaatcaccagaaaaatcgtcccacccgcgaggctatcacacacctgctcggagtggccctaacgcggtacaatcatatgctgtccgctactgttaaaattatccagatgctccaacatttcgagcacctggctccggtgctggttgccgctgttagtctgtgggccacagattacggaatgaagagtattgtgggagaaatcgttcgagagatcgggcagaagtgcccacaggagctctccagggatccgagcgggaccaaggggttcgcagcgtttcttaccgagcttgccgaaagggtgcctgctatcctgatgagctccatgtgtatcctcctcgatcatcttgatggcgaaaattacatgatgcggaacgctgtcctggcagccatggcagagatggtattgcaggtgctctctggggatcagttggaagccgctgcgcgagacactagagatcagtttttggacaccctacaggcccacggccatgatgtcaatagtttcgttcggagccgagtgctacagctgtttacaaggattgtccagcaaaaagccctaccactgactaggttccaggccgtggtggccttagccgttggacggcttgccgacaagtccgtactcgtgtgcaaaaatgcaatccagctactggcctcttttctggcaaataacccattcagctgtaagctctcagacgctgacctcgctgggccactccagaaggaaacacaaaagctgcaagagatgagagcgcagcgcaggactgccgcagcctctgctgtgctggatcctgaggaggaatgggaagcaatgctccccgagttaaagagcaccttgcagcagctcctgcagctgcctcagggcgaagaagagatcccagaacaaatcgcaaacaccgaaactacagaagacgtgaagggacgcatctaccagctcctggcaaaagcttcttataagaaggcaattatccttactcgcgaggcaacaggacatttccaggagtcggagccattctcacatatcgatcctgaagagagtgaggaaactaggttactgaatattttgggcctcatcttcaaaggacccgctgcatcgacccaggagaagaaccctcgggaatccaccggcaatatggtgaccggtcaaacagtctgcaagaacaaaccaaacatgtccgaccctgaggagtccagggggaatgacgaacttgtgaagcaggaaatgctggtccagtatctgcaggacgcctactctttctctagaaagatcaccgaagccatcggtatcatatctaaaatgatgtacgaaaacacaaccactgtcgtccaagaagtcatcgagttttttgtgatggtgtttcagtttggagtcccgcaggcactttttggagtaaggcgcatgctgcccttaatctggtccaaagagcccggagtaagggaagccgttcttaatgcttatcgccaactgtatctcaacccaaagggtgactctgcccgagctaaggcccaggcccttattcagaacctctccttgctgctggtggacgccagcgtaggaaccattcagtgcctggaggagatcttatgtgaattcgtgcagaaagacgaattaaagcccgcagtgacccagttgctctgggagcgtgcaaccgagaaagtagcgtgttgtcccttggagcgatgctcctcagtgatgctgctcggaatgatggcacgcggtaagccagagattgtagggagcaacttggacactctcgtctcaatcgggctggacgaaaagtttccgcaggactaccgccttgctcagcaagtctgccatgccatcgccaacatttctgatcgcaggaaacctagcctcggaaagcggcaccctccattccggctgccccaggagcaccgactgtttgagcggctgcgcgagacagtcacgaagggcttcgtgcaccccgaccctctgtggattccttttaaggaggtggcagtgacacttatctaccagcttgcagaaggccctgaggttatctgcgctcagattcttcaaggatgcgccaaacaggcactcgaaaaacttgaagagaagcggacgagccaagaggatcccaaagagagccccgctatgctgccgacatttcttctcatgaacctcctaagtttagccggagacgtcgctctgcaacagctggttcatctcgagcaggccgtatctggcgagctctgccgacgcagagtgctgagggaggaacaagagcataaaacaaaggaccctaaagaaaagaatacctcgtccgaaacaactatggaggaggagctcggtttagtgggagccaccgcggatgacacagaggctgaactgataagaggcatttgcgagatggagctgctggatggcaaacaaacgctggcagcttttgttccccttctcctgaaggtgtgtaataatccaggcttgtatagcaacccagaccttagcgcggcagcgtccttagctctcgggaagttctgcatgatttctgccaccttctgcgattcgcaacttcgtctgttattcacaatgctggaaaaaagtccactcccaatcgtaaggagcaacctcatggtcgccacgggagacctggccattcgcttccccaacctggtcgacccctggacgccccacctatacgctcgtcttcgagacccggctcagcaggtgaggaagacagccggactggtaatgacacacttaatacttaaagacatggttaaggtgaagggtcaggtatccgaaatggctgtgctcttgatcgatccggaacctcagattgccgcactagcaaagaatttctttaacgagttgtcacataaagggaacgccatttataatcttctgcccgatattataagtcggttgtctgacccagaactgggagtcgaagaagagccattccatactatcatgaaacagctgctttcttacatcactaaggacaagcaaacagagtcactggtagagaagctgtgccagagattcagaacctctagaaccgaacgtcagcagcgggacctcgcctactgcgtgtcacagctccctctgaccgaacgcggactacgaaagatgctggacaattttgattgttttggggataagctaagcgatgaaagcatttttagcgcttttctgtccgtggttggaaaattaagaagaggcgctaaaccagaagggaaagccataattgacgaatttgaacagaaacttcgggcatgccacaccagaggcttagatgggatcaaggagttagagattgggcaggccggaagccaaagggcaccatcggctaagaaaccgtcaaccgggtcccgctaccagccactggcttcgaccgctagtgacaacgacttcgtaactcccgaacctcggaggaccacccgaagacacccaaatacccaacaaagggccagtaagaagaaacctaaggtggtttttagtagcgatgagagcagtgaagaggacttgtccgcagaaatgactgaggacgagacgccaaagaagaccactcctatcctcagggccagtgctcgcaggcacagaagttag

SEQ ID NO: 52059 - DNA, 2820 bp, Artificial Sequence
  Description of Artificial Sequence: Synthetic coding sequence
atggcccctcaaatgtacgagtttcacctgccactttcgccggaagaactgctgaaatctggcggagtcaaccaatacgtcgtgcaagaagtgctgagcataaagcatctgccaccccagctacgggcttttcaggcagccttccgtgcgcagggaccgctggctatgctacagcattttgacaccatatactctattctgcatctagttaccggatgttgttaccgcctcctcgagaatcccactattaatcaccagaagaaccggccaacgagagaagctataacccatctgttaggcgtggccctcacacgttataaccatatgctatccgctaccgtgaagattattcaaatgctgcagcattttgagcacctcgcgcctgtcttggtggcagcggtctcattatgggcgacggattatggcatgaagagcatcgtcggggaaatcgtgcgggagattggccaaaaatgccctcaggaattgtctagagacccatcaggcacgaaaggcttcgccgcatttctgaccgaactggccgaaagggttccagcaattttaatgtcaagtatgtgtattctgcttgatcatctagatggcgagaattatatgatgcggaatgcagtgctggccgctatggccgaaatggtgttgcaggtactcagcggtgaccaactggaggctgccgctagggacactcgggatcagttcctagacactctgcaggcccacggtcacgatgttaactcttttgtgaggagccgggtactgcagttgttcaccaggatagtgcaacagaaagcattgcccctgaccagatttcaggccgtggtcgctctggcggttggacgactggcagataagtctgtcttagtgtgcaaaaacgcgatccagctcctcgccagttttctggcaaacaatccattctcctgcaaactcagtgacgccgacttggcgggacccctccagaaagagacccaaaaactacaggagatgagagctcagcgtcggaccgcggcagccagtgcagtgttggaccccgaggaggaatgggaagctatgttgcctgagctaaaaagtacactgcaacagctactccagctgccacagggtgaggaggagattccagagcagatcgcaaatactgaaaccacagaggacgttaagggccgaatttaccagctgttggccaaagcctcttacaaaaaagccatcattttaacacgcgaagcaaccggacacttccaagaatctgagccattctcccatatcgatcccgaggaatctgaggagacccgcctgctaaatatcttaggtctgatcttcaagggcccagctgctagtactcaggaaaaaaacccaagggagtcaacaggaaatatggtaactggccagaccgtctgtaagaacaaacctaatatgagtgaccccgaagagagtagagggaacgacgaattagtgaaacaggaaatgttagtccagtacttgcaggacgcatacagtttctcgcgtaagatcacagaggcaatcgggatcatatccaagatgatgtatgaaaatactacaacggtggtacaagaggtgatcgaattcttcgttatggtgtttcagttcggtgtcccccaggctctgttcggggtaaggcgcatgctgcccctgatatggagcaaagagcctggcgttcgggaagctgtgttaaacgcctaccgccagctgtacctgaacccaaaaggcgactctgctagggctaaagcccaggctttgatccagaatctgtcccttctattagtagacgcgtcagtgggaactattcagtgtcttgaggagatcctgtgcgagttcgtacagaaagacgaactcaagccagccgtgacgcaacttctgtgggagagagccacagagaaggtggcatgctgtcctttggagcggtgttcttcagtaatgctcttggggatgatggcccgaggaaagcctgagattgtgggctctaatctggacaccctcgtatctattggcctggatgagaagttccctcaggactacagactggcccagcaggtgtgtcacgctatcgcaaatatatccgaccggaggaagccaagcctgggcaaacggcatccgccattccgactcccacaggaacaccggctctttgagagattaagggagaccgttacgaaaggctttgtgcaccccgaccctctgtggattccattcaaagaagttgccgtcactctcatttatcaactcgcagaggggccagaagtgatatgtgctcagatcctgcagggatgtgcaaaacaagcgctggagaagctcgaggagaagcggacatcacaggaagaccctaaagagagccccgctatgctgccaacatttttgcttatgaatctcctttccctggccggagacgtagcactacagcagttggttcacctcgaacaagccgtgtcaggtgaactatgccgcaggcgggtacttcgcgaagagcaagaacacaagaccaaggatcctaaagaaaaaaatacctcctccgaaacgaccatggaagaagaactcggactggtgggtgcaacggccgacgacactgaggccgaactcatccggggaatttgcgaaatggaactgcttgatggcaagcagactctcgcagctttcgtgccactgctgctgaaggtgtgtaacaaccctggcctgtactccaacccagacctgagtgctgccgcaagtctggctctcgggaaattctgtatgatttcagccacgttctgcgatagtcaacactttgctatacccagaagggtggacaatttgaggtag

SEQ ID NO: 52060 - DNA, 4071 bp, Artificial Sequence
  Description of Artificial Sequence: Synthetic coding sequence
atgctttgtaagcgatactgcccctctaacatatttcaccactcgctggagttgtttcgcctgccctttgagctcaggggtccttggctgtgctgttctactttaatactaagcaccgctttctgcatggtctcccggcattcgcaggagttgcccgcaattctggatgatactacattgagtggttctgatcgcaatgcccacctcaacgcgctcaagatgaactgctatgccctgattaggttgttggagtctttcgaaactatggcctcccagacgaatcttgtcgatctcgacttgggcggtaagggcaagaaagctcggaccaaggccgctcatggttttgattgggaggaagaacggcaacccattcttcagttgcttactcagctgctccagctggatattaggcatctgtggaatcactccattatagaggaggagttcgtgtcactcgtcaccggatgctgttaccgcttgctggaaaaccccacgataaatcatcagaagaacaggcctactagggaggcaattacacatttgctcggcgtggccctaactagatataatcatatgctgagcgccaccgtcaaaattatccagatgctgcagcacttcgaacatctggcccctgtcttagtggccgcagtatccctgtgggccactgattatggaatgaagtctatagtcggggagatagtcagggaaattggccagaagtgtcctcaggagctttcacgcgacccaagcggtacgaaaggcttcgccgcatttctgactgaactcgccgagagagtgccagcaattctgatgtcttcgatgtgcatcctgctggaccatcttgatggtgagaattatatgatgaggaatgcggtactggctgcaatggcggaaatggtccttcaggttttgtcaggggaccagctggaggccgcagctcgggatacaagagatcagttcctggatacgctgcaggctcacggacacgatgtcaactctttcgtgagaagtcgggtgcttcagttgttcacccggatcgttcagcagaaagccctgcccctgacacggttccaggctgtggtcgccttagccgttggcaggctggccgataaatcagtgctagtttgtaagaatgctatacagctactggcttcgtttttggctaataaccccttttcctgtaaactgagcgacgcagacctagctggcccactgcagaaggagacgcagaagctgcaagagatgcgtgctcaaagaaggaccgcggctgcatctgctgtcctcgatccagaagaggagtgggaagcgatgctgcccgaattgaagtcaaccctgcagcagctcctgcaactccctcagggtgaagaggagattcccgaacagattgcaaacaccgagaccaccgaggacgtgaaggggagaatttatcaacttctagcaaaggccagctacaaaaaggcgatcatcctaaccagagaggcaacaggccattttcaggagagtgagcctttctcgcacattgaccctgaagagagtgaagagaccagattactgaatattctcggtctgatttttaagggacccgcagcatcaacacaagagaagaatccaagagagtctaccggaaatatggtaacaggccaaaccgtttgtaagaacaaacctaatatgagcgatcctgaagaatctaggggaaatgatgagctggtgaagcaagaaatgctggtgcagtatcttcaggacgcatattcattttctagaaaaattactgaagctatcggcattatctcaaaaatgatgtacgaaaatactaccaccgtggttcaagaagttatcgaattctttgtcatggtatttcagtttggcgtgcctcaagccctctttggcgtacgtagaatgcttccgcttatatggtccaaggaacccggtgtgagagaagcagtgttgaatgcctaccgccaactttacctcaaccctaagggcgattccgcaagggcaaaggcccaggccctgattcagaaccttagcctccttctcgtcgatgcgtccgtcggcaccattcaatgtctggaagagattctatgcgaattcgtccaaaaggatgagctcaaaccagccgttacacaactactttgggagagagctaccgagaaagtggcctgctgtcccttggagcgatgcagtagcgtgatgcttttggggatgatggcaagagggaagcctgagatcgttgggagtaacctagatacactcgttagcatcggactcgacgagaagtttccgcaggactacagactggctcagcaagtgtgccatgccatcgctaacatcagcgatcgacggaagccttccctgggtaagcggcaccccccatttcgtttgccccaggaacaccgcctgtttgaacggctgagagagaccgtcactaaggggtttgtgcatcctgacccactgtggattccatttaaagaagtagccgtgacattaatctaccagttagccgagggacccgaggtgatctgtgctcagatactacagggctgcgccaagcaggcgctcgagaaactggaagagaaacggacgagtcaggaagatcccaaagaatctccagccatgctgcccacctttttactaatgaatctgctttccctggcaggcgatgtggctctgcagcagctggtccatttggagcaggctgtgtctggtgaactgtgccggagacgcgtcctgagggaggagcaggaacacaagacgaaggaccctaaagagaaaaacacttcgtcagagacgaccatggaagaggaactgggactggttggggctactgccgacgacacggaagccgaactcatcagaggcatttgcgaaatggaactcttggatggcaagcagaccctggccgcttttgtgcccttactactgaaagtttgcaacaaccccggtctatactcaaatcccgacctgagtgctgctgcgagtctcgcattgggcaagttctgcatgatttcagcgacgttctgcgactcccaactgcgactcctatttactatgctggagaagagccctctacctatcgtgcgttctaatctcatggtggccacaggcgatctggcaattcggttccccaacctcgttgacccgtggactccacatttgtacgccagactccgagatcccgcacaacaggtcaggaagacggccggactggtgatgacccatttgatactcaaagacatggtaaaagtgaagggtcaggtctctgaaatggccgtcttactcatcgaccccgagccacagatcgccgcactggcaaaaaatttctttaatgaacttagccacaagggaaacgccatatacaacctgttacccgacatcatcagcaggctgtcggaccctgaactgggggtcgaagaggagcccttccataccatcatgaagcagctcctatcatacatcacaaaagacaaacagacagagtctcttgtcgagaagctgtgccagaggttccggactagcaggaccgaacggcagcagagagacctggcgtattgcgtgtctcagctcccccttactgagagaggcttgcggaagatgcttgacaattttgactgcttcggtgataagctgtcagacgagtcgattttttctgcatttctgtctgtagttgggaagctcaggcgaggggcaaagcccgagggcaaagccatcatagacgagtttgagcaaaagctgagagcctgccacactaggggtctggatggaatcaaagaactcgaaattggccaagccggaagccaaagagcgcctagcgcaaaaaagcctagtacaggatcccgctaccagccacttgcctccacagcctcagataatgatttcgtcaccccagaacccaggcgcacgacaaggagacatcccaacacacagcagcgggcaagcaagaaaaaacctaaggtggtgttcagctctgacgaatcctctgaggaggatctgtccgctgagatgacggaagacgaaacgcctaaaaagactacccccatcctgcgggcttctgctaggagacacaggagctag

SEQ ID NO: 52061 - DNA, 2382 bp, Artificial Sequence
  Description of Artificial Sequence: Synthetic coding sequence
atggattcctggttcatcctggtacttcttgggtctggactgatttgcgtatccgccaataacgcaacaaccgttgcaccaagcgtgggtattactcgcttaattaacagtagtacagccgaacccgtcaaagaagaggcaaagacttcaaacccaacttcaagtttaacttcattgagtgtcgccccaaccttcagtcctaacattactttgggcccaacctacctgacaacggtgaatagctccgactctgacaatggcaccacgagaaccgccagcaccaacagcattggcattacaataagtcccaatgggacgtggctacccgacaaccaattcactgacgcgagaactgagccatgggaggggaacagtagtacggcagctacgacacccgagacttttcccccatctgacgagacaccaattatcgcagttatggtcgcactctcatccttgcttgttattgtctttatcattatcgtactgtacatgttgcgtttcaagaagtacaaacaggccggttcgcactctaattccttccggctgagcaatggacggactgaggatgtggagccacagagcgtgcccctgctggctcgaagtccatccactaacaggaagtaccccccacttcccgtcgacaagctcgaagaggaaattaaccgaagaatggcggacgataataagctttttagagaggaattcaatgcccttcccgcatgccccattcaggccacctgtgaggctgcgtctaaagaggagaataaggagaagaatcggtatgttaatattcttccatacgatcattctcgcgtgcacctgacaccagtcgagggtgtacccgacagtgactacattaatgcttcctttattaatggctatcaagagaaaaataagttcattgccgctcagggtcctaaggaagagactgtgaacgatttctggcgcatgatctgggagcaaaacaccgctacaattgtgatggtcaccaacttgaaggagcggaaagagtgcaagtgcgcacagtactggcccgaccagggttgttggacgtatggaaatataagagtgtctgtcgaagacgttaccgtacttgtggactacaccgtgcgaaagttttgcatacaacaggtcggggacatgactaacagaaagcctcagaggcttatcactcaattccacttcaccagttggccggactttggggtgccattcacacccatagggatgttaaaattcctcaaaaaagttaaagcctgtaacccccagtacgccggagctatagtcgttcattgctccgccggagtcgggaggaccgggacctttgtggtgattgacgctatgcttgacatgatgcacacagagcggaaagtggacgtgtacggattcgtaagtcgtatcagggcccaacgatgccagatggttcagaccgacatgcaatacgtctttatttaccaggctctcttggaacactacctgtacggtgatacagagctggaggttacaagtttagaaacacatctacagaaaatttataacaaaattccagggaccagtaacaacggactggaggaagagttcaagaagctcacatccataaagattcagaacgacaagatgcggaccggcaatctgccagcaaatatgaagaagaatcgggtgctccagatcatcccgtacgagttcaaccgcgtcataatcccagtaaagagaggcgaagagaacaccgactatgttaatgctagcttcatagatggttataggcagaaggatagctatattgcctctcaaggtccgttgctgcataccattgaggacttttggaggatgatctgggagtggaaatcttgcagtatagtcatgctcacagagctggaggagcgcggtcaggagaaatgcgcccagtattggccctccgatggacttgtctcttacggcgacatcaccgtggaattgaagaaggaggaagaatgcgagagttacacagtgcgcgatctgttagtgaccaacacccgtgagaacaaatctcggcagattcggcagtttcatttccatgggtggcctgaagttggcatccctagtgacggcaagggcatgatttcgataatcgcggcagtacagaagcagcagcaacagtccggtaatcatcccatcactgttcactgcagcgctggtgcgggacgcacgggtacgttctgtgccctgagtactgtgttggaacgcgttaaggccgaggggattctcgatgtgttccagacggtcaagtcactgagacttcagcggccacacatggtgcaaaccctcgaacagtacgagttttgctataaggtggttcaagagtatatcgacgctttcagcgactacgcaaactttaaatag

SEQ ID NO: 52062 - DNA, 1119 bp, Artificial Sequence
  Description of Artificial Sequence: Synthetic coding sequence
atggccgctgagcggcaggaagccttaagggaatttgtggccgtcaccggagccgaggaagacagggcccgattcttccttgaaagcgccggttgggatctccaaattgcgcttgcgtctttctatgaggacggaggggatgaagatattgtgaccatctcccaagctactccttctagcgtctcacgtggcactgctccaagtgataatcgagtgacatcctttagggatcttattcacgaccaggacgaggatgaagaagaagaagaaggccagagagaccgattttacgccggtggtagtgagcgatccggccagcagatcgtgggcccaccacgcaagaaatctcccaacgaactcgtggacgatctgtttaagggtgccaaggaacatggggctgtcgccgtcgaacgcgttaccaagtctcccggagaaaccagtaagcctcggccttttgctggaggcggatatcggctgggcgctgccccagaggaggaaagcgcctacgtggccggagagaagcggcagcactcttcccaggatgtgcacgtggtgcttaagttgtggaagagtgggttttccttggacaatggagaattgcgcagctaccaagatccttccaacgcacagttcctggagtcaattcggaggggcgaggtgcctgcagagctccgacgtcttgcacacggcggtcaagtgaatctggacatggaggatcatcgtgacgaggactttgtcaagcccaaaggggctttcaaagcctttacgggcgagggccagaagctaggctcaacagccccacaagtgctttccacatcatcgccagctcaacaggcagagaatgaagcgaaggcttcgagcagcatcctgatcgacgaatccgagcctactaccaacatccaaattcgtttagccgatggaggccgacttgtgcagaaattcaaccacagccaccgtatctctgatatccgactgttcattgttgacgcacgaccagcaatggctgccacttccttcattttgatgacaactttcccaaacaaagagctcgccgatgagtctcaaactcttaaagaagccaaccttctcaacgccgttatcgtccagagactgacgtag

SEQ ID NO: 52063 - DNA, 1020 bp, Artificial Sequence
  Description of Artificial Sequence: Synthetic coding sequence
atggctgccgaaaggcaggaggcgctgcgggaatttgtggccgtgactggagcagaggaagacagagcacgattttttctggagagtgccggttgggatctgcaaatcgccctagcatcgttttatgaggatggaggggacgaagacattgtcactataagccaggcaaccccttcttcggtttccagagggacggccccaagcgataacagagtcacgtcctttagagatctgatacatgatcaggatgaagacgaggaagaggaggaaggccaaagattttacgctggcggttccgaaaggtctggccagcagatcgttggaccgccaaggaagaagtcacccaacgagctggtggatgatttatttaagggagctaaggagcacggcgcagtggcagtggaaagggtgaccaagtctcctggggaaacctccaagccaagagttcatgtggttttgaagctgtggaagtccggcttttcactcgataacggggaactgcgctcttatcaggacccatctaacgctcaatttctcgaatccattaggcggggtgaggtcccagcggagctcaggcgactcgcacatggcggtcaggtgaaccttgacatggaggaccacagagacgaggactttgtgaaaccaaagggggctttcaaagcatttaccggagaaggccagaagttgggaagcacagcacctcaagtccttagcactagcagtcctgcccagcaagctgagaatgaggccaaagcttctagtagcattttgatcgatgagtcagagccaacaaccaacatccagatacgacttgcggatggcggacggctggttcagaaattcaaccacagccatcggatatccgacatacgcctcttcatcgtggacgccaggcctgcaatggcggcaacaagttttattctgatgacgacattcccaaataaagagctggccgacgaatctcagacactaaaggaagctaatctgcttaatgcagttattgtgcaaagattgacttag

SEQ ID NO: 52064 - DNA, 780 bp, Artificial Sequence
  Description of Artificial Sequence: Synthetic coding sequence
atgaccaaaatgaagatgcggagaaagcgtaaagccaggggcgctaaagaacatggcgctgtagccgtggagcgcgtgacaaaatcacctggcgagacaagtaagcctcgccctttcgcgggaggagggtaccggcttggggcagctcctgaggaagagtccgcctacgttgcaggcgagaagagacagcattcgagtcaggacgtacatgtggtgctcaaactctggaaatcagggttctctctggacaatggagaacttcgttcctatcaggacccttctaacgcccaatttctggagtcaattaggagaggggaggtgcccgcagagttgcggcgactggcacacggcggacaagtgaacctggatatggaagatcatcgagacgaagactttgtcaaacccaagggagcgtttaaggccttcacaggcgagggccagaagctgggcagcactgcaccccaggtgctgagcacttcttccccagctcaacaggccgaaaatgaagctaaggcctcatcgagtatactgatcgacgaaagtgagccaactaccaacatccagattaggttggctgacgggggacggctggtacagaaattcaaccactcccataggatcagcgacattaggctgttcatagtggacgcgaggccagctatggctgcaacgtcctttatcctcatgacaacttttcctaacaaggaacttgctgatgagagccagaccttgaaagaggccaatctcctgaacgccgtgattgtccaacggttgacatag

SEQ ID NO: 52065 - DNA, 1119 bp, Artificial Sequence
  Description of Artificial Sequence: Synthetic coding sequence
atggcggctgagcgccaagaagctctccgggaatttgtagccgtgactggcgcagaggaagaccgcgcacgcttcttcctggaatccgcagggtgggacctacagatcgccctggcttccttctacgaggacggaggagacgaggacatagtgacgattagccaagccacgcccagctccgtcagcagagggaccgcgccaagcgataaccgtgtcacaagttttcgagatctcatacacgaccaggacgaggacgaggaggaggaagagggccaaagaagccgcttctatgccggagggagtgagcgatccggacagcagatcgtaggtccacctaggaaaaaatcccctaacgagctggtcgatgatctgtttaaaggcgctaaggagcatggggctgtggcggttgaacgggttactaagtctccgggagagacgtcaaagccacggcctttcgcaggcggtgggtaccgactcggcgcagctcctgaggaagaatccgcctacgtggctggcgagaagcgccaacacagtagccaggatgtgcacgtagtcctgaaactatggaaaagcgggttttcacttgataatggcgagttacgatcataccaggatccgagcaatgcgcagttccttgagtccattcggaggggagaagttcccgcagagctgcgccgtctggcacatggcggacaggtcaacctggacatggaggaccatcgcgatgaagattttgtgaaacctaagggcgcttttaaagcctttacgggggagggacagaagctgggctcaaccgctcctcaggttctgagtaccagtagtccggcacagcaggccgagaatgaagccaaagctagcagttctattctcatagatgaaagcgagccgacgaccaatattcaaatccggttggccgatggcggtcggctggttcagaagttcaatcactcccatcggatcagtgatataagattgtttatcgtggacgccaggccagctatggccgctacttcattcattctgatgaccaccttccccaacaaagaacttgcagatgagtctcagactctgaaggaggccaatctgctgaacgccgttattgtccaacggttgacctag

SEQ ID NO: 52066 - DNA, 1056 bp, Artificial Sequence
  Description of Artificial Sequence: Synthetic coding sequence
atggaagactcacaggagaccagtccctcgagtaataactcaagcgaagagttgtcttcagctctgcacctgtctaaaggtatgagtatctttttagacattctgaggcgcgctgataagaatgatgacgggaaactttcctttgaggagtttaaagcctattttgccgacggtgtactgtccggcgaggagttacacgagctgtttcatacgattgatacacataatacgaacaacctggatacagaagaactgtgcgaatatttctcgcaacacctcggcgaatatgagaacgtgctcgcggctctcgaggatctcaacttatccatcctgaaagccatgggaaagaccaaaaaggattatcaggaggcatccaatttggaacagttcgtgacaagattcctgctcaaagaaacactgaaccaactccagtccctccagaactccctcgagtgtgcaatggagacaaccgaagagcaaaccagacaggaaaggcagggccctgcaaagcctgaggtacttagcattcaatggcctgggaaaaggtctagccgccgtgttcagcggcacaatagtttctctcctaattcaccccagttcaatgtcagtggtcccggacttctcgaagaagataatcaatggatgactcagattaataggctacagaagctgatcgacagactcgagaagaaggatctcaagttggagcctcccgaagaggagatcatcgaaggcaacacgaagtcacacattatgcttgtgcagaggcagatgagcgtcattgaggaggatctggaagaattccaacttgctctcaagcactatgtcgagagcgccagcagtcaatctgggtgcctgcgaattagtattcaaaagctctcaaatgaatctagatacatgatctatgagttctgggagaacagctcggtttggaactcccacctgcagacgaattactctaaaacctttcagaggagtaatgttgacttcctggaaactccggagctcacctcaactatgcttgtccccgcttcatggtggatattgaacaattag

SEQ ID NO: 52067 - DNA, 303 bp, Artificial Sequence
  Description of Artificial Sequence: Synthetic coding sequence
atgctcgtgcagcgacagatgtcggtgatagaggaagacctcgaagaattccagctggccctgaagcactacgtggaatctgcgagctcccagagcggctgccttcggatttccatccagaaactaagcaatgagagtcgatacatgatttatgaattctgggaaaattctagcgtctggaacagccacctccaaaccaactactctaaaacattccagcggtctaacgtggatttcctcgagacccctgagctcaccagcacgatgctcgtgcctgcctcatggtggatcctgaataactag

SEQ ID NO: 52068 - DNA, 303 bp, Artificial Sequence
  Description of Artificial Sequence: Synthetic coding sequence
atgcttgtccagcgccagatgagcgtcatcgaagaagatcttgaggagtttcagttggcgttgaaacattatgtggagtctgcctcgtctcagagcggctgcctcagaatttctatacagaagttgagtaacgaatccaggtacatgatctacgagttttgggagaactcctcagtgtggaactctcatctgcaaacgaactattcaaagacctttcagaggtctaatgtggacttcctcgagactcccgagctgactagtacaatgctcgtacctgcctcatggtggatcctgaacaattag

SEQ ID NO: 52069 - DNA, 2499 bp, Artificial Sequence
  Description of Artificial Sequence: Synthetic coding sequence
atgcacaagcactataaggtccactttgctaaggatgctcaatcccctaacggccactacttctgggaccccgagctggggcatcgcaagggctgctgccaccagtggcgccaggacagtgcagccctgagggcacacggcccatgtcgcccaagcccgcaaagtcattggcagctggcttaccactctcaccaagtgggtggcagcggttggcgccgtgggctgctgccgtcagtgctgcaacagcagcggcagccgcagagtcaaccttctcccccaagccctctgaggcagaggctctgtccaatccacgaagcccaaaaagggcttcctgccacttccaccgtccctaaggagccggctagcgcgccacaggcgcctaccctccctaccaccgcacccgctatggcccgatccggccctgcacttccctctgcagctggagtactgcttaaacccagcgagcccactgacgctcgaccattgcctgctccagcagcatgtggatcctttacagcgtatagcagcgatatcctgaccgaggatgacgtgtattgttcttgtctggccaaaacgctctgtcatgtgcctgttccggtgaccgtgggattttacgctccttttgggtgtcggttgcacatgatgctagataagataacagctttaatgcaacaggaagccgcacaaagagaaagcgaggagctgcaacacgtgcagtggcgacccagagcggttagcggctggggggttccgcaactgctgtggtatctcgtcttcttgcagcccatcattaccgaagtccatttgcgccgacgaaacgtgcagttcctgtttattcggttttcggcttggcagtatgctgggactgacaaactgtgggctgggctcgtgaccactctttgtgaaggcatccggaggcactacggtgctttgccattctctgtatattctgtgctcgggaacaagccagccacacgccaagattgctgccagtccgaatggcattgccggcgacgcgtctgcctgggacttctggcactgctggctgccctcggtctgggagtgggcttgctgtatctgtcactcggaggccacgcactggggcatggaagcccaagcgggagcctgcttaaggtgttcggcggtgccgcaactaccctctcaggctcaggcttgctgatggccgtctactctgtcggcaaacatttgttcgtctctcaacggaagaagatcgaacgacttgtgagccgagagaagttcgggtcgcaactgggatttatgtgcgaagtgaaaaaagaagttgaactcctgacagactttttatgcttcctggaaatttatcagagaaggcggctacgggtggtcctggaagtgactggcctggacacctgctacccggaacgagtggttggggtgctgaatgctatcaacaccctcctgtccgacagccacgccccatttattttcatcctggtggttgaccctagtattttggcggcatgtctggagagcgcgggaaatatgaagggcacggcagataacggctacctttttctgaatcgcacggtaactcttcccttctctgtcccaataatgggtagacggaccaagctgcagtttcttcacgatgctgttcagtcaagggatgacctgctttaccgcgagatgactcgtaagccctggcttccaggcgatgctgggggagaaagcgctcagctcttggcagtgcaagcccaagccggaacagaacgcggacaagggagaatagatgacgaggctgcccgaagaatccaagaagccttgttctgcttgcatgacgagagagattgcctctatgaatacgtacccgacaacgtcgtttcaatgcgccgaattgtaaacactgttccgatcaccgtacgcttgttgcagcagcaacaacagcagggggacttcggaggaccgacacctcgtcaggctgtggcttgggtcgtgctggcaaaccagtggccatgcagattatcttgggccctccagtgcttagaagatcgacagcagacaggcggtgccccagagggcagggctaggctgtgggacgtgttccgtgacaattccagggaactacacacaatgacaaaggccctgcagaacgtgttagacctcgacggagatcctgaactgttcgagaggttcttaggcgcagacttccccttcacggtggctgaggctcagtctctgctgcggtgtactgtgaaccttgaccacagcatccgcagacgcatggggctcatacgggctgtgtcggcgctgaagccgccttctcccccaaaatcacctacccgcgacactccgcacgccgcacatagggccaactcagcttcgcgggcacctccatctggcagagctagtggccaagctggcgaggggcaccacaccggcgacctcgcccatcgtggcaagctgtggcctgtcgcctgtgctctctttagacccggtcagagcagccccggagggccatag

SEQ ID NO: 52070 - DNA, 1596 bp, Artificial Sequence
  Description of Artificial Sequence: Synthetic coding sequence
atgcaacaagaagctgcgcaacgggaatcagaggagctgcagcacgtccagtggagacctagggccgtatccggttggggtgtgcctcagcttttatggtatctggtcttcctgcagccgatcatcactgaagtacacttgcgacggcgtaacgtgcagtttctctttattcgcttctctgcttggcagtacgccggtacagacaaactctgggcgggtcttgtgacaactctttgtgaaggcatacgacgacactacggcgctctgccttttagcgtgtattcagtgttggggaacaaacctgcaactaggcaggactgctgccagagtgagtggcattgtaggagacgggtttgcctaggactccttgcgctcctcgcggctctggggctcggcgtcggtctgctctacttgtcactggggggacatgccttaggacatggcagtccttcgggttccctcctcaaggttttcggcggtgctgccactactttgagcggatccggtctgctgatggcagtctacagcgtcgggaaacacctttttgtttcccagcgaaaaaagattgaaaggcttgtgtccagggagaaatttggcagtcagcttggatttatgtgcgaagtgaaaaaagaggtggaactgctaactgacttcttatgttttctggaaatataccaacggagaagactccgcgtggtgcttgaggtgacaggacttgatacttgctaccccgagagagtcgtgggggttctcaacgctattaacacgctgctttcggattcccatgcaccatttatcttcattctcgttgttgatccaagtattctcgctgcttgcctggaatccgccggaaacatgaaggggactgctgacaacggctacttattcctcaaccgaaccgtaaccctgcctttcagcgtcccaataatggggcgacggaccaagctgcaatttcttcatgatgcggttcagtccagagacgatctactgtatagagaaatgactcgcaagccctggctccccggtgatgcaggcggagagagtgcgcagttgttggctgtacaggcacaggccggtacagaaagaggacagggtcgcattgacgatgaagcggcacgtcggatccaagaggccctcttctgcctgcacgacgaaagggattgcctctatgagtatgtgccagacaacgttgtgtccatgcgtaggatagtgaacacggtgcctattacagtacgtctgctgcaacagcagcagcagcagggagactttggtggccctaccccacgtcaagccgttgcctgggtcgtgttggccaatcagtggccgtgccgactttcatgggcactgcaatgtttggaggataggcagcagaccggaggcgcaccagaggggagggcccgtttgtgggacgtgttccgagatactccccacgccgcacatagagctaacagcgcttcacgcgctcctcctagtggacgcgcatccggacaggctggcgagggtcaccacaccggggatctggcccatagaggtaaactgtggccagtcgcttgcgccttgtttaggccaggacagtcgtccccgggagggccttag

SEQ ID NO: 52071 - DNA, 1833 bp, Artificial Sequence
  Description of Artificial Sequence: Synthetic coding sequence
atgcagcaggaggccgctcagagagagtccgaggaacttcagcatgtgcaatggcgcccacgggctgtgtcaggttggggcgtgccccaactcctttggtacttagtgtttctacagccaatcatcaccgaggtccacctgaggcgcagaaatgtgcagttcctctttataagattcagcgcttggcagtatgcaggcacggataaactgtgggccggattggtgacaacactctgtgaaggaattagaaggcactatggagccctcccctttagtgtctactcggtgcttggcaataagccagccacccggcaagattgttgtcagtctgagtggcattgccgcaggagggtgtgcctcgggcttctcgccctgctggcggctcttggactcggagtgggactgctgtatttaagtttgggaggtcatgccctcggacatggctcaccctcaggcagcctgctgaaagtgtttggaggagccgcaacaactctgagtgggagcggtttgctcatggctgtgtacagcgtagggaagcatctgttcgtctcccagagaaagaaaattgagcgtttggtctctcgtgaaaaatttggaagtcagctcggctttatgtgcgaggtgaagaaggaggtggaacttcttacagacttcctgtgttttctggaaatttaccagaggagacgactgcgagtggtgctggaagtaactggactggacacttgctaccccgagagggtagttggggtgctaaatgccatcaatactcttctgtctgactcccacgcacctttcattttcatacttgttgtggaccctagtattctcgctgcctgcctggaatctgccggtaacatgaagggtaccgcagacaacggctacctgttcctgaatcggactgtcacattgcccttttctgtgcccataatgggccgacgaactaagctccagttcctgcacgacgcggtgcaaagtagagacgacctgctctacagggagatgacacggaagccctggctgccgggtgacgcagggggagagtccgcccagctgctggcagttcaggcccaggctggtacggaaagagggcaagggaggatagacgatgaggccgcacggcgtatccaagaggctctgttctgcctacatgatgagcgggattgcctgtatgagtatgttcctgacaatgtcgtgagtatgaggcggattgttaacaccgttccaatcacagtgagactgctgcagcagcaacaacaacagggggattttgggggacccacaccccgacaggctgtcgcttgggtggtgctggctaaccagtggccatgcagattaagctgggccttacagtgcttagaggaccgccagcagaccggcggtgcccctgagggccgagccaggctgtgggacgtctttagggacaactcccgcgaactccataccatgaccaaagcgctacagaatgtgctggacctcgatggggacccagaactctttgagcgatttctgggagcagactttcctttcacagttgcagaagcccagtctctccttcgatgtactgttaacctagaccacagcatccgaagaagaatgggtctcatccgcgcagtctcagcactgaagcctccttcccctcccaaatccccgacccgcgacactccccatgccgctcacagggctaattcagcctcaagggcgccaccctccggacgcgcatctgggcaggcaggcgagggccaccacactggcgacctggctcatcggggtaaattgtggccagtcgcctgcgcactctttcggcctggacagagcagtccgggtggcccatag

SEQ ID NO: 52072 - DNA, 1062 bp, Artificial Sequence
  Description of Artificial Sequence: Synthetic coding sequence
atgcgattgaggttctggctattaatctggctcctcctcggattcatctcacaccagcctactccagtgagcttcctcaagacgatattctggtcaaggaacggccatgatggctccatggatgtccagcagagagcatggaggagcaataggtctagacagaagggtcttagatccatatgcatgcataccaaaaaaagagtgagttccttccggggaaacaaaattggcttgaaggacgtgatcaccctccggcgacatgtggagactaaggtgcgcgcaaagatcaggaagcggaaagttacgaccaaaatcaaccgccacgacaagattaacgggaaacggaagacagcccgtaagcagaagatgttccaacgggctcaagaactcaggcgtagagctgaagattatcacaagtgtaaaattcctccttctgcccgaaaaccgctttgcaactgggtcaggatggctgccgcagagcatcggcatagcagcggcctcccatattggctgtacctgaccgccgagacccttaagaaccgtatgggacgacagcccccaccaccaacacagcaacattccatcaccgacaactccttatccctgaagaccccaccagagtgcttgctgaccccactgccacctagcgtagacgataatattaaggaatgcccactcgctcctttgccccctagtcctctaccgccttcagtggacgataatcttaaggagtgtctgtttgttccccttccaccgagcccacttccgccaagcgtggatgataatctgaaggaatgtctttttgtaccactgccaccttccccattaccgccatcggtggacgataacctcaaaacgccaccattggccactcaagaagcagaggtggaaaaaccacctaagccaaaaaggtggcgcgtggacgaggtggaacagagtcccaagcccaagcggcaaagggaggcggaggcccagcagctcccaaagcccaaaagacgcagattgagtaagctgcgaaccagacattgtactcaagcgtgggcgatacgaattaacccgtag

SEQ ID NO: 52073 - DNA, 1827 bp, Artificial Sequence
  Description of Artificial Sequence: Synthetic coding sequence
atggctgagagtataatcataagggtgcaatctcctgatggtgtgaagcggatcactgcaacgaagagagaaaccgctgctacctttcttaagaaagtcgctaaggagttcgggtttcagaataacgggttcagtgtttatatcaatcgaaataaaaccggggagattacagcatcgtccaataagagtctgaatttgctgaagataaagcatggagatttgctgttcctattcccgagctccctggccggtccaagctctgaaatggaaacgtctgttcctcctggcttcaaagtcttcggtgcccctaacgtggtggaggatgagattgatcagtacctgtctaaacaggacggaaagatttacaggtctcgagatccccagctgtgccggcacggacctctcggtaagtgcgtccactgcgtgcctctcgaaccgttcgacgaagattacctgaaccacttagagcctccagtcaagcacatgtccttccatgcctatatccggaaactgaccgggggtgccgacaaaggaaagttcgtggctctggagaacataagctgtaaaatcaagtccggatgtgaaggacacctgccctggccaaatgggatttgtaccaaatgtcagccttccgccatcacactcaacagacagaagtatcggcacgtggataacattatgttcgagaatcatacggtcgcagaccgattcctggacttctggcgaaaaaccgggaatcagcactttggatacctttacggacgatacactgagcacaaagatattccacttggtatccgagccgaggtagccgcaatttatgaaccaccgcaaatcggtacccagaattctcttgaactgctggaggaccctaaggccgaggttgtagacgaaatagccgctaagctgggcctgcgcaaggttggatggatattcacggatctggtcagtgaggatacccgaaaagggacagtacgttactctcggaataaagacacatatttcctgtctagtgaagagtgcattactgctggagacttccagaacaaacatccaaacatgtgtagattgtcccctgacggtcattttggctctaagtttgtaactgctgtggccacagggggtccagacaaccaggtacacttcgaaggctaccaggtgtccaaccagtgtatggcactcgtacgggacgagtgcctcctcccctgtaaggacgctccagagttgggttacgccaaggagagttcctctgagcaatacgttcctgatgttttttacaaagacgtggacaagtttgggaatgaaatcacccaactggcgagacccctgccggtcgagtatctcattattgatatcacaaccacgttccccaaagatcctgtctataccttctccatctctcagaacccatttcctattgaaaatcgggacgtgctgggagagacacaggattttcacagtctggccacatatctgtcacagaatacaagctccgtatttctagataccatcagcgattttcatctgctcttattcctagtaaccaatgaggtcatgcccctgcaggattctattagcctgttactcgaggcggttagaacccggaacgaggagctcgcgcagacatggaagcgcagtgagcaatgggcgactatcgaacagttgtgtagcaccgtcggcggacagctccccggattacacgagtacggagctgtcggaggcagcacccacactgcaaccgctgcaatgtgggcttgccagcactgtacttttatgaaccagccaggtactggccattgcgaaatgtgcagcctacctcggacctag

SEQ ID NO: 52074 - DNA, 1851 bp, Artificial Sequence
  Description of Artificial Sequence: Synthetic coding sequence
gccgaggtggtaattattagggtacagtcaccagatggagttaaaaggatcacagccactaagcgggaaactgccgctaccttcctgaaaaaggtagctaaagagttcggattccagaacaatggctttagcgtctacatcaatcggaacaagaccggggagattactgctagctccaacaagtcactgaacctactgaaaataaagcatggcgatctgctatttctctttcctagttctctggcaggacccagctccgagatggagacaagcgtgccccctgggtttaaggtctttggggcacccaatgtcgtggaggacgaaatagatcagtacctgtctaaacaggacggcaaaatttaccggagccgggatccgcagctatgcaggcatgggccattgggaaaatgtgttcactgtgtccctctagaacccttcgatgaggattatctcaaccacctcgagccgccagtaaagcacatgtcgttccacgcctacattcggaaactgacaggcggagccgataagggtaagtttgtggccctggaaaatatcagttgtaagattaagtctggatgcgaaggccacttgccttggcctaatggaatttgcacgaagtgccagccatccgcgattacactcaaccggcagaagtaccgtcacgtagacaacattatgttcgagaaccacacagttgctgataggtttctcgacttttggagaaagactggtaatcagcactttggatacctctatggccgatacactgagcacaaggatatccctctgggtatcagggccgaggtagcagcaatttacgagcctccccaaatcgggacccaaaactctctggaactgctggaagacccaaaggccgaggtagttgacgaaatcgcggcaaagctcggcctgcggaaggttggatggatcttcaccgacttagtctcggaggacacacgaaaaggcaccgtacggtacagtcggaataaagacacctatttcctttcctcggaagagtgtattacagcaggtgatttccaaaacaaacaccccaatatgtgccgcctctcgccagacggccattttgggagtaaattcgttactgccgttgctacaggcggacctgacaaccaggtgcattttgagggttaccaggttagtaaccaatgcatggcactggtccgggacgagtgcctgctgccttgtaaggatgctcccgaattgggctacgccaaagagagctccagtgagcagtacgtcccagacgtgttctataaagacgttgacaaatttggcaatgagataacacagctagccagacctctgcccgtcgaatacttaatcattgacattacaacaacctttcccaaggaccccgtatataccttcagcatctctcagaaccccttcccgatcgagaatcgggacgtcctcggagagactcaggactttcatagcctggcaacctaccttagccagaacacaagctctgtttttctcgacacgataagtgatttccatctgcttttgtttctggtgacaaacgaagtgatgcctcttcaggatagcatcagtctgctgttagaggccgttaggacaaggaacgaagagctcgctcagacatggaaaagaagcgaacagtgggcaactatcgagcagctctgctccgaatatcctcatccattgcccagacatcctgtcgccggagcaggtgagcagcccacgttgcacagctccccgttgccagtggtgccctggatcccccatcctgcggcttcatggcaagtgcccagtgccatgcagcgggtggagactcgacctccctgtcaagccagaggtcggctgaggtag

SEQ ID NO: 52075 - DNA, 1371 bp, Artificial Sequence
  Description of Artificial Sequence: Synthetic coding sequence
atgagcttccacgcctacatccgaaaacttaccgggggagccgataaagggaagttcgtggctttggagaacattagttgtaaaatcaagtctgggtgcgaggggcatctcccttggcctaacggcatttgtacaaaatgccagcctagtgccatcacactgaataggcagaaataccgacacgttgacaatattatgtttgagaaccacacggttgctgatagattcttggacttctggcggaaaacaggaaaccagcatttcggttacctgtacggaagatacaccgagcataaggatatacccctgggaattcgagccgaagttgccgcaatctacgagcctccacagatcgggacccagaatagcttagagctcctagaagatcctaaggccgaagtggtggatgaaattgctgcgaagttaggcttgcgcaaagtgggatggatctttacggatctagtaagcgaggatacaaggaaggggacagttagatatagccgcaataaagatacttacttcctttcctccgaagaatgtataactgcgggtgatttccagaacaagcatcctaacatgtgcaggctatctcctgacggacatttcggttctaaattcgttactgctgtagcgactggcggtcccgataatcaggtccattttgaaggatatcaagtatccaaccagtgtatggctctagttagggacgaatgcctgctcccgtgtaaggatgcaccagagcttgggtacgctaaggagagctcctctgagcagtacgtgcctgacgtcttctataaggatgtagacaagtttggaaacgaaatcacccagcttgccaggcctctgccagtcgaatacctaatcattgacataaccacaacttttccaaaagaccccgtttacactttcagcatttcgcaaaatccttttccaatcgagaatcgtgacgttctgggggagacgcaggatttccactcccttgccacttacctttcccagaatacgtcaagcgtgttcctcgacactattagcgacttccatctgttgctgttcctggtaacaaatgaggtcatgcccctccaagatagcattagcttactgctggaggcagtacgcactcgtaacgaagagctcgcacagacctggaaacgcagtgaacagtgggctacaattgaacagttgtgctccgagtaccctcaccccctcccccgacatcccgtcgcaggggcaggggaacagcccacactccacagctcccctctacccgtggtgccttggataccccaccccgcagcctcatggcaggtcccttcggctatgcagcgtgtggagaccaggccaccctgccaagccaggggcaggctgcggtag

SEQ ID NO: 52076 - DNA, 2202 bp, Artificial Sequence
  Description of Artificial Sequence: Synthetic coding sequence
atggaagccagttggcgccaagtggcgggtggacgcggacgctctaggggcagggcaactgcagctcccagcggtaacggggtgcatctgcgtggagccggaggcggtcgtgagaagggctctgtgggggctgtaccgagcgggacttctccaggaggagtcgctaccaccgcagccgcaggctcacggcacagccccgctggatcccaagcactgcagaccacagccgctagtgagctgatgtcgcagaaaaagttcgaggagatcaagaaagcaaatcaggctgcggctaggaagttggtcgaagagcaattttcttccagttcagaggagggcgacgaagatttcgaagggaaacagggcaagatactggcaaatacattcattacctacactacacagaccgacggagatactcgcgagctggagcggaccaagcagtacgtgaacgaagcctttcaggcaggggctatgacctgcctgatttgcattgcgtcggtgaagagaaatcaggccgtgtggagttgctctgggtgtttctgtatttttcacatgccttgcattcaaaagtgggcgaaggattctcagttcttggtcagctctgtgactgatgatgatttcggcaaaaaggactgcccgtggccctgtcctaagtgccggttcgagtacaaacgctctgagactcccagtaggtattactgctattgtgggaaagttgaagatccaccactggacccttggctcgtcccccacagctgtggtcaggtgtgcgaaagagagtttaagcccccttgcggtcacaagtgtctgctgttatgccatccgggaccctgcccaccgtgcccaaagatggtcaccaccacctgttactgtaagaaggcaaagcctatccctcgaaggtgttctgccaaggagtggtcctgccagctcccatgtggtcagaagctgctgtgcggacaacacaagtgcgagaatccttgccacgccggatcttgccaaccgtgcccccgagtcagtcggcaaaagtgtgtgtgcggcaaaaaggtagcagaaagatcctgcgcatcccccctgtggcattgtgaccaagtgtgcggcaaaactctgccgtgtggtaatcacacatgtgagcaagtctgtcacgtaggagcgtgcggagagtgtccgcgttccggcaagaggttttgcccctgtcagaagtccaagttttcgctcccctgtacagaagacgtgcctacctgtggtgacagctgtgacaaggtgctggagtgcggcatccatagatgcagccaacgctgccaccgaggaccgtgtgaaacctgccgccaggaggtggagaaacattgtaggtgtggtaaacacactaaaagaatgccctgccacaaaccttatctctgcgagacaaagtgtgtgaaaatgcgcgattgccagaagcaccaatgtagacgcaaatgctgcccaggcaattgtccgccttgcgaccagaactgcgggagaacccttggctgtcgaaaccacaaatgtccatctgtgtgtcataggggcagttgctacccatgcccagaaacagtcgatgtaaagtgcaattgcggaaacaccaaagtcaccgtgccgtgtggccgtgaacgaacgacacggcctcccaagtgcaaagagcaatgctctcgtccaccgacttgccaccatacttcgcaggaaaaacatcgatgccacttcgggtcttgtcctccctgccaccaaccctgtcagaaagtgctagagaaatgtggtcacctgtgtcctgccccttgccacgaccaggcattgattaaacaaacaggcaggcatcagcccacaggcccatgggagcagccctctgagcctgccttcatccaaaccgcactgccctgcccaccatgtcaggtgcccataccaatggagtgtttgggcaagcacgaggtgtctcctctaccttgtcatgcggtggggccttactcttgtaagcgcgtgtgtggtcgcatactcgattgccagaatcacacctgcatgaaggagtgccacaaagtgacgaagacagacggttgcactggtaaaaacaagattggtaaactaaaattatgcgatctttccatgatcttgcaacaggagagtagtaagtcagaatctactgtgcccgatcttctcaccccaagccccatgtgctcatctactcatgtgatttag

SEQ ID NO: 52077 - DNA, 2736 bp, Artificial Sequence
  Description of Artificial Sequence: Synthetic coding sequence
atggaggccagttggaggcaggtggccggtggtcggggtaggagccgcggaagagcaacagctgccccatcgggaaatggagtacatcttagaggagccggaggtgggagggagaaaggctctgtgggggcagttccatctggaacatctccgggtggggtagccactaccgctgccgctggcagtagacacagtcctgctggcagccaggccctgcaaacgacggccgcttcagaactaatgagccagaagaaatttgaggagatcaagaaagcaaatcaggccgctgctcggaaactggtggaggagcagttctccagtagttccgaggagggcgatgaagatttcgaggggaagcagggcaaaatcctggcgaacaccttcatcacatacactacccagactgacggtgacacacgggaactggagcgtacgaagcaatatgtcaacgaggccttccaagcaggagccatgacttgccttatctgcattgcctctgttaaaagaaaccaggcggtctggtcctgttctggctgtttctgcatttttcacatgccatgcattcagaaatgggccaaagactcgcagttcttagtctcgtccgtcacagacgacgatttcggaaaaaaagattgcccctggccttgccccaaatgtcgcttcgaatacaagagatccgaaacaccctccaggtattattgttactgtggcaaagtagaggatcccccactagacccttggctggtcccgcatagttgtggtcaggtttgcgagagggaattcaagcctccttgtggacataaatgtctacttctgtgtcatccaggaccgtgcccaccctgtccgaaaatggttactaccacatgttactgcaaaaaggccaaaccaatcccacggagatgtagtgctaaggagtggtcttgccagttgccttgcggacagaaactgctttgcggtcagcacaaatgcgaaaacccctgccatgcagggtcctgccagccttgcccacgggtgtctcggcaaaaatgcgtctgtggcaaaaaagtcgctgaacgttcctgcgcatcgcccctatggcactgcgaccaggtgtgcggtaagactcttccgtgtgggaaccatacatgtgagcaggtctgtcacgtaggggcttgtggggagtgtccacgctccggcaaacgattttgcccatgtcaaaaaagcaagttttcgctaccctgcactgaggatgtgcctacttgcggcgatagctgcgataaggtgctggaatgcggtatacaccgctgttcccaaaggtgccatcgaggcccatgcgagacgtgtaggcaggaagtcgagaagcactgtagatgtgggaagcacaccaagcgaatgccgtgccataagccctatctatgcgaaacaaagtgcgtgaaaatgcgagactgtcagaaacatcagtgccgacgtaagtgttgtcctggaaactgccccccatgtgaccagaattgtggcaggacattggggtgccgaaatcataagtgtccttcggtgtgccaccgaggaagctgctacccttgtcccgaaaccgtggatgtgaagtgtaattgtggtaatacgaaggtgacggtgccatgcggaagggagaggactaccaggccacccaaatgcaaggagcagtgttcgcgtccacccacatgccaccatacctctcaggaaaaacaccggtgtcacttcggtagttgtcccccatgccaccagccctgtcagaaggtgttggagaagtgcggccacctgtgtccagcgccatgtcacgaccaggctttaataaagcaaaccgggcgacaccagccaaccggcccttgggagcagccgagcgaaccggctttcatccaaacggccctcccttgtcccccttgtcaagtccctattcccatggaatgtttaggcaagcacgaggtatctcccctcccttgccatgccgtgggcccatattcatgtaaacgggtctgtggacgcattcttgattgtcaaaatcacacttgtatgaaagaatgtcacaaggtgaccaagacagacgggtgtacagggaaaaacaaggccggacctgaatgcctgcattgtgaagaaggctgttctaaaagtagaccgttaggttgtctccatccttgcatactgcggtgccaccctggcgagtgccccccatgcgtgcagatgctgcgtatcaagtgtcactgtaagattacttccctgtacgtggaatgtcgcaaaattactaccgctgatgtgaatgagaagaaccttttgtcctgttgcaagaatcagtgtccaaaagaactgccatgtggccacaggtgcaaagaaatgtgccacccaggcgaatgccctttcaactgtaatcagaaagttaagctgagatgcccctgcaagagaattaaaaaggagctgcagtgcaataaggttcgggagaatcaggtgtcgatcgagtgtgacaccacgtgcaaggagatgaagagaaaagctagcgagataaaggaggctgaagctaaggcagctctggaggaagagaagcgccgacaacaggccgagctcgaggctttcgaaaacaggcttaagggaaggcggaaaaaaaaccgtaaaagagatgaagtggcggtggagctcagcttatggcaaaaacacaaatactacctgatctctgtgtgtggcgtggtcgtcgtcgtcttcgcctggtacatcacacacgatgtgaactag

SEQ ID NO: 52078 - DNA, 2736 bp, Artificial Sequence
  Description of Artificial Sequence: Synthetic coding sequence
atggaggcaagctggcgacaagttgcaggcggtcgcggacggtcaaggggcagagctactgcggcaccctctggcaacggggtgcacctgcgcggtgccggtgggggtagagagaaggggagtgtcggggctgtgcccagcggcacctctcccggaggggtagccacaaccgccgctgcaggctcgcgtcatagccccgcaggcagccaagcgttgcagactactgcagcctctgagcttatgtcgcaaaagaaatttgaggagatcaagaaggccaaccaggcggcagccagaaagcttgtcgaggagcagttttcatcatccagtgaagaaggtgacgaggattttgaggggaagcagggcaaaattttggcgaataccttcatcacctatactacccagactgatggagacacaagagagctggaacgcacaaagcagtacgttaatgaggcgttccaggcaggggctatgacctgcctgatttgtatcgcctccgtgaagcgcaatcaggctgtgtggtcttgcagcggctgcttctgcatctttcacatgccttgtattcagaagtgggccaaggactctcagttcctcgtgtcgtcggtgaccgacgatgattttggaaagaaggattgcccatggccatgcccaaagtgcaggtttgaatacaagcggtcagaaacaccgagtcgctattactgttattgcgggaaggtcgaggatccacccctggatccatggctggtcccacattcttgcgggcaggtttgtgagagggaattcaaacctccctgcggccataaatgtctgctcctctgtcaccccggaccttgccctccctgtcccaagatggtgacaacaacatgttactgcaaaaaagccaagcctattccgcgacggtgtagcgctaaggagtggtcctgtcagctgccatgtggacagaaactgctgtgtggtcagcacaaatgcgagaacccatgtcacgcgggatcatgccaaccctgtcccagagtctctagacaaaaatgcgtgtgcggcaagaaggtggcagagcggagctgcgcttcccccctgtggcactgcgaccaggtctgtgggaagaccctgccctgcggcaatcacacctgtgagcaagtctgccacgtcggggcttgtggtgagtgtcccagatcaggcaagagattctgtccctgtcagaagagcaagttctcccttccctgcacggaggacgtgcccacatgcggtgacagttgtgataaggtgctagaatgcggcatccacagatgcagtcagcggtgccataggggaccctgtgaaacctgccggcaagaagtggaaaagcactgccgttgcggcaagcacaccaagaggatgccgtgtcataagccatacctctgcgaaacaaagtgcgtaaagatgagggactgccagaagcaccagtgcagacgcaaatgttgtccagggaattgtcctccttgtgatcaaaactgcggccgaacactcgggtgtcgcaatcataagtgtcctagcgtgtgtcaccgcggatcttgttacccctgtccagaaaccgtcgatgtaaaatgcaattgcggaaatacaaaggtcactgtgccttgcggaagggagcgcacgacgcgacctcccaagtgtaaagagcagtgttcacgcccacctacatgccatcacacatcacaggaaaagcaccgctgccattttggctcctgccctccatgccaccagccttgtcagaaggttttagagaagtgcgggcatctatgtcctgccccttgtcacgaccaggccctaattaagcagaccggaagacaccagccaaccggaccttgggaacagccatcagagcccgctttcatccagactgccctgccctgtcctccctgtcaggtgccgatcccaatggagtgtctgggcaaacacgaggtttcacctctcccttgtcacgctgtgggcccatacagctgcaagcgcgtctgcggtcgaatcctcgactgtcaaaaccacacctgcatgaaagaatgtcataaagttacaaagaccgatgggtgcacgggcaagaataaggctggccctgagtgcctgcactgtgaagaaggttgttcgaagtcccgtcctctcggttgtttgcacccctgcatcctgcggtgtcacccgggagagtgccctccctgtgtgcagatgcttcgcattaagtgtcattgtaagatcacaagcctctacgtagagtgtagaaaaataaccaccgcggatgtgaacgaaaaaaatcttctctcctgctgcaaaaatcaatgcccaaaagagctgccttgcggacatcgctgtaaagagatgtgtcacccgggagaatgtccatttaattgcaaccagaaggtcaaactgcggtgcccctgcaagcgcataaagaaggagctacaatgtaacaaagtgagagagaatcaggtatctatagagtgtgacactacctgtaaagagatgaagagaaaggcaagcgagattaaggaggctgaagcgaaggctgccctcgaggaggagaaacggcgacagcaggctgagctggaggctttcgaaaatcgccttaagggacgtcggaagaagaaccgcaagcgcgacgaggttgctgtggagcttagcctgtggcagaagcacaagtactacctgatatccgtgtgcggcgttgtggtggtggttttcgcgtggtatataacccatgatgtcaattag

SEQ ID NO: 52079 - DNA, 5210 bp, Artificial Sequence
  Description of Artificial Sequence: Synthetic coding sequence
atgacaggctgccccgcttcctctcgcagacggggattcggactcttcttcttcttgcggctgcatagattgcttctcctatttttggtgctgcggggaaccctcgcaaacaaattgaacgtgccccaagtgttgttgccattcggacgagaacctgggcgagtgccctttcttctcgaagcacagcgtggttgttacacctggcattctactcatcacgacgccgtcactgtggaaccgctgtacgaaaatggaaccctgtgctctcagaaggccgtcctcattgcagagtcaactcaacccatacgcctttcatcaattattctggcaagagaaatcgtcactgaccacgagctgcgatgtgacgtaaaagtggacgtgattaatagcatcgagattgtttcccgggctagagaactgtacgtggacgattcacctctggagctcatggtgagggcattagacgcagaaggtaatacattctcttctcttgcaggtatgatgtttgagtggagtatcgctcaagataacgaaagtgccagggaggagctgtctagtaagatccggatcttaaagtactctgaagcggagtatgcccctccaatctacattgcagaaatggaaaaagaggaaaaacagggcgatgtgatactggttagcgggatccgcaccggagccgcagtggtgaaggtaaggattcacgagccgttttataaaaaggttgcggcagccctgatccgcctcctcgtgctggagaatatttttctcatcccctctcacgacatttatctgctagtggggacttacatcaagtaccaggtcgccaagatggtgcaggggagggttaccgaggttaaattccctctcgagcactatatactggagctgcaagaccacagggtagcactgaatggcagtcattcggagaaagtcgcgattcttgacgataagactgccatggtcacagcaagccaactcgggcagactaacctggtgttcgtgcacaagaatgtgcatatgaggagtgtatctggtttacccaattgtaccatctatgtagtggagcccggattcctcggcttcacagtccagcccggaaataggtggagcctcgaggttggtcaagtctatgtgataacagtggatgttttcgacaaatcctccaccaaggtatacattagcgacaatctgcgaatcacttatgacttccctaaggaatactttgaagaacagttgactactgttaacggtagctaccatattgtgaaggccctgaaggatggggttgtagtgataaacgcaagcttgacttccatcatctaccagaataaggacatacagccaattaaatttctaatcaagcaccagcaggaggtcaagatatatttccccattatgctgactcccaaattccttgctttccctcatcacccaatggggatgctctatcggtataaggtgcaggtggaaggtgggagcggtaactttacatggaccagctccaacgagaccgtggtgattgtgactaccaaaggtgtggtcacagcgggtcaggtacgtggaaattccacggtcctggccagagatgtacagaacccatttagatacggcgagattaagattcacgtgctcaaactaaacaagatggagctgcttccctttcatgccgacgtggaaatcggacagattattgaaatcccaatcgcaatgtaccatattaacaaagaaaccaaggaagctatggcatttactgattgttcacacttgtcattggatttaaatatggataagcaaggagtgtttacattattgaaagaaggaattcagaggcccggacctatgcattgttcctcaacgcacattgccgcaaagtctctgggacatacattagtgacagtgtctgtgaatgagtgtgacaaatatctcgagtcgtctgctacatttgccgcttatgagccccttaaggcacttaaccccgtggaggtggcgctggtgacatggcagtctgtcaaggagatggttttcgaggggggaccacgaccctggatcctcgaaccgagtaggttttttctggagctcaatgctgagaagactgaaaaaatcgggatagcgcaggtatggctgccttccaaaaggaaacagaaccaatacatatacagaatacaatgtctcgatcttggggaacaggtgttgacctttcgcattgggaatcatcctggggtactgaacccctccccggcagtggaagtgctccaagtaagattcatctgcgctcatccagcatccatgagcgtcacgccagtttacaaagtgccagccggagcccagccctgtcctctgcctcagcacaacaaatggctgatccccgtttctagactccgagacacggtgctggagttggcggtctttgaccagcatcgcagaaaattcgataacttctccagtctgatgctcgagtggaaaagttctaacgagactctggcccacttcgaggactataagagcgtggaaatggtcgctaaggacgacggttccgggcagaccaggctccacggacatcaaattctgaaggtgcaccagatcaaaggaaccgttttgatcggtgttaacttcgtgggttattccgaaaaaaagtccccaaaggagatctccaatctgccccgaagtgtggatgtggaactcctcttagtggacgacgtgacagttgtgccagagaatgcaacaatctacaaccatccagacgtgaaagagacattttccttagtggaaggatcaggatatttcctcgtgaactctagcgagcagggcgtcgtgaccattacttatatggaagcggagtcatctgtggagcttgtacctctgcatcctggttttttcaccctagaggtctacgacctgtgtctggcttttctgggcccagcaacagcacacctgagagtgtctgacatccaggagctggagctggatctgatagataaggtggaaattgacaaaacggtgctggttactgtcagggttcttggatcctccaaaagacctttccaaaacaaatactttagaaacatggagctcaagcttcagttggcctccgcaatcgttactttaaccccaatggagcaacaggacgaatactctgagaattacatactgcgcgcaactacgattggacagactaccctggtggccatcgccaaggacaagatgggtcgtaagtatacaagcacgcccaggcacattgaagtttttcccccattcaggctgttacccgagaaaatgacccttatccccatgaacatgatgcaagtgatgagcgaaggagggccacagccccagagtatcgtacatttcagtatctctaaccagacagtggccgtggtgaaccgccgaggccaggtcactggaaagatagtgggaacagctgtggtacatggaaccatccagaccgttaatgaggatactggtaaggtcattgtgttctctcaggacgaagtgcaaatcgaagtggtgcagctccgagctgtcaggatccttgccgctgccacccggctaattaccgccactaagatgcccgtttacgttatgggggtcacgtccactcagacacctttctcattttctaatgccaatcccggtctcaccttccattggtccatgagtaaacgcgatgtcttggacctggtaccgaggcactctgaagtctttctccagctgcccgtcgaacacaattttgcaatggtcgttcatacaaaggcagccggacggacctccataaaggtgacagtgcactgtatgaactctagcagtgggcagttcgagggtaatttacttgagctctcagatgaagttcaaatcctggtgtttgaaaagcttcagctgttctatcctgaatgtcagccagaacagatcttaatgcccatcaattctcagcttaagctgcataccaaccgcgagggcgctgcgtttgtgagctcccgcgtcttgaaatgtttcccgaacagcagcgtgattgaggaagatggcgaaggtcttcttaaggccggaagtatcgccggaaccgccgtgctcgaggtgacttcgatagaaccctttggggtgaaccagaccacaataaccggcgtccaggtcgctccagttacatatctccgagtctcgtcacagccgaagttatatacggcccaggggaggactctgagtgcatttcccctgggaatgtccctcactttcactgtgcaattctacaactccattggcgagaagtttcacacccataacactcagctgtatcttgcactcaatcgtgatgacctgctgcacatcggccctggtaacaaaaactacacttacatggcccaggccgttaatcgcggacttacactcgtcgggctctgggacaggaggcatccaggaatggcggattatattccagtggcagtcgagcatgccatcgagccggatacaaaacttactttcgtgggcgatatcatttgtttctccacacatctagtctcacagcacggagagcccggaatatggatgatcagtgctaacaatattctccagacagacatcgtcactggagtgggtgtggctcggagccccggaacagccatgatttttcacgatattcctggagtggtgaagacgtacagggaagtggtggttaacgcttcatcacgtctgatgctgtcctacgacctcaagacataccttacaaacactctgaacagcactgtctttaagctgttcatcaccacgggtcgaaacggtgtcaatctaaaaggattctgtacaccaaatcaggctttggccatcacaaaggtcctgctgcctgcaactttgatgctctgtcacgttcagtttagcaacactttgttggatatacctgcctccaaggtatttcaggtgcacagcgatttttccatggagaaggaccactgcgaggacagcgcaattcttaaaaggttcactggttcctatcaaattctcctactcaccttgtttgctgtgcttgccagcacagccagtatatttctggcctacaatgcctttctgaacaagattcagaccgtgcccgtcgtctacgtgccaaccctcggaacaccccagccagggttctttaattccaccagctcacctccccactttatgagtctgcagccccctctcgcccagtcacgtctacaacattggctttggtcgataagacacta

SEQ ID NO: 52080 - DNA, 2010 bp, Artificial Sequence
  Description of Artificial Sequence: Synthetic coding sequence
atgggaagaaaatacacaagtacacctaggcatatcgaggtcttccctcccttcaggctgctgcctgaaaaaatgactttaatcccaatgaatatgatgcaggtgatgtcagagggcggacctcagccgcagagtatcgttcacttctctattagtaatcaaaccgtcgccgttgtgaaccgtagaggccaagtgaccggcaaaattgtggggacggcagtagtgcacgggaccattcagacggtaaatgaagatacaggtaaagtgattgttttctcccaggacgaagttcagatagaagtggtgcagcttcgcgcagtacgcatcctagcggctgcgacacgattaatcacagcaacaaagatgcctgtgtatgtgatgggcgttaccagcactcagacccctttctccttcagtaacgcaaaccccggactgacatttcattggagcatgtctaaacgagatgtgctggatttggtccccagacacagcgaagtctttctccagctgcctgtggaacacaacttcgccatggtggtgcacacaaaggccgcaggccgaacatcaattaaggttacagtccactgcatgaacagctcatcaggccaattcgagggcaatcttctcgagttgtccgacgaagtccagattttagtctttgagaagttgcagttattctaccctgagtgtcagccggaacagatcctgatgcccataaatagccagctgaagttacacaccaatcgagagggtgctgcttttgtcagtagtcgggtgctcaaatgtttcccaaactcatccgttatcgaagaggatggcgaagggttactcaaggccggaagtatagccggaacagctgtacttgaagtgaccagtattgagcccttcggcgtaaaccagacaactattaccggcgtacaggttgcgccagtgacctacctgcgcgtgtcttcacagcctaagctttatacagcacaaggaagaacactatctgcatttcccctgggaatgagcctaacattcactgtccagttctataactctatcggggagaagttccacacccacaatactcagctgtatttggcactgaatcgcgacgatttactgcatataggccctggcaacaaaaactacacatacatggctcaggcagtaaatagaggcctcaccctggtgggattgtgggacaggcggcatcctggaatggccgactacattccagttgcagtcgagcatgccattgagcctgatacaaagctcacgttcgtgggtgatatcatatgcttctcaactcacctggttagccaacatggagagccaggcatatggatgataagtgccaacaatattctgcagacggacatagtgaccggcgtgggagtggccagatctcccggtacagcaatgatctttcacgacattcctggtgtcgttaaaacataccgggaggtggtcgtgaatgctagtagccggcttatgctcagctacgaccttaaaacataccttacaaatacgcttaactccacagtgtttaaactgttcatcactactggacgaaatggtgtcaatttaaagggattctgcacaccaaatcaggcattagcaatcaccaaagtactgctgcccgcaacgctgatgctctgtcacgtgcagttttcgaacacgctgctcgacatacctgcaagcaaagtctttcaggtgcattccgacttttcaatggagaaagaccattgtgaggacagcgcaatcctgaagcgtttcaccggatcgtatcagattttgttgctgaccttgtttgcggtactggcctctactgcctccatttttttggcgtacaatgcatttctgaacaagatacagacagtgccagtggtttatgtacccaccctcggtacacctcagccgggattctttaattcaacctcaagtccgccacattttatgtccttacagccccctttggctcagtcgagactccagcactggctgtggtcgatcagacactag

SEQ ID NO: 52081 - DNA, 5666 bp, Artificial Sequence
  Description of Artificial Sequence: Synthetic coding sequence
atgacaggatgtcccgcatctagtagacgcagaggatttggcttattctttttcctcaggttacaccgcctgctcctcctgtttcttgtcttgcggggaacactggccaacaagctgaatgtccctcaagtgcttctgccattcggtagagagcccggtagggtgcctttcttactagaggcccaaagggggtgctatacttggcacagtacgcaccacgacgcagtcacagtagagccactctatgagaatgggactttgtgctcacagaaagccgttctcattgcggagagcactcagccaattcggctgagcagtatcatactcgcacgcgagatagtgacagaccacgagcttcggtgcgacgtgaaggtggacgtgatcaactccatcgagatcgtgtcacgtgctcgggagctgtatgtcgatgactctcccctggagctgatggtgagggctctggatgcggaggggaataccttttcctctctggctggcatgatgttcgagtggtcgattgcccaggataatgagtccgcccgtgaggagctgtcttccaagatccgcatcctaaagtacagtgaggccgaatacgctcctcccatttacatcgccgaaatggaaaaggaggagaagcagggggacgtcatcctcgtgtccggcattcggacaggtgccgctgtggttaaggtccgaattcacgaacctttttacaagaaggtggccgctgctctgatcaggcttctggtgctggaaaatatctttcttatcccatcgcacgatatctatcttcttgtgggcacttacattaagtaccaggtagccaagatggtccagggccgagttaccgaggtcaaattccccctcgaacactatatactggaactccaagatcaccgcgtggcgctgaatggttcgcactcagagaaagtcgcaatactggatgataaaacagccatggttacggcttcccaacttggtcaaacgaatcttgtcttcgtgcataagaacgtgcacatgagaagcgtgtctggactgcccaactgcactatttacgtcgtcgaaccaggcttcctgggattcaccgtccagcccggaaatcgttggtccctggaggttggtcaggtttacgtgataaccgtggacgtgttcgataaaagctccacaaaggtttacatctctgataatttacgaatcacatacgatttccccaaggaatacttcgaagaacagctgacaacagtcaacggctcatatcacattgtgaaggctctcaaggatggcgttgtcgtcatcaacgcatctctcactagcataatctatcagaataaagacatccagccaatcaaattcctgattaagcatcaacaggaggtaaaaatctactttcccatcatgcttacccccaaatttctggcattccctcaccaccccatgggcatgctttacaggtataaggtgcaggtagagggtgggtccggcaacttcacctggaccagcagtaatgaaaccgtcgttatagtgacaacaaaaggcgtggttaccgccggacaagtccgagggaatagtaccgtgctcgccagggatgtgcagaatccatttagatacggagagatcaaaatccacgtgcttaagcttaacaagatggagttgctgccattccatgctgatgtggagatcgggcagataattgagatcccaatcgccatgtatcacattaacaaagagactaaagaagctatggccttcaccgactgtagccatctctcattggatcttaacatggacaagcaaggcgtttttacccttttgaaagagggaattcagcgacctggtccaatgcattgcagttcaacccatatcgctgccaagtccctaggccatactttggtgactgtctctgtaaatgaatgcgacaaataccttgagagcagtgccacatttgctgcctatgaaccactcaaggcactgaaccccgttgaggtggctcttgttacctggcagagtgtcaaggaaatggtgttcgaagggggacccaggccttggatactggagccatcccgattctttcttgagctgaacgcggaaaaaaccgagaagatcggtatagcccaggtctggttaccctcgaaaagaaaacagaaccagtacatctatagaatccagtgcctcgatttgggagaacaggtgctgacctttcgaatcggaaatcaccccggtgttctgaatccctctcctgccgtggaggtgcttcaggtgcggtttatctgtgcacaccccgcaagcatgtctgttaccccagtgtacaaagtacccgctggcgcacagccttgccccctaccacagcataacaaatggttgatcccagtgagtcggctgcgggacacggtactcgaactcgcggtgtttgaccagcacaggagaaagtttgacaacttttcatcccttatgttggaatggaagagctccaacgaaacattagcccactttgaggattacaagagcgtcgagatggttgccaaggacgacgggtcgggacagacgaggctacatggccatcagattttgaaggtccatcaaatcaagggaactgttctgattggcgtgaactttgtgggttacagcgagaagaaaagcccgaaggaaatcagcaatctgccaagaagtgtcgacgttgaactcctactggtggacgatgtaacagttgtcccggagaacgccaccatttacaatcacccagacgtgaaagagactttctcccttgtagaagggagtggatatttcctagtaaattcctctgagcaaggcgtggtgaccatcacctacatggaggcagaaagtagcgtggaactcgtgccattgcaccccggattttttaccctcgaagtctatgacctgtgtctcgctttcctcggtccagccacagcacacctgcgggtcagcgacattcaggagctggagctcgacctgatcgacaaggttgagattgataagactgtcctcgttacagtacgagtacttggctctagcaaaaggccctttcagaacaaatatttccgaaacatggagctcaaacttcaacttgcatcagccattgtgacactgacgcctatggagcagcaggacgagtattcagaaaactacattctgcgagccactacaatagggcagactacgctggtggccatcgccaaagacaagatgggcaggaagtatacatccacaccaagacacatcgaggtgtttcctccttttcggctgctgcccgaaaagatgactcttatccccatgaatatgatgcaggtgatgtcagaaggcggtccacaaccccagtctattgtccacttctcgatcagtaatcaaacagtagcagttgtgaatcgcagagggcaagtgaccgggaagatcgtcggaactgccgtggttcacggaactatccaaaccgtcaatgaggacacgggaaaagttatcgtcttttcgcaagatgaggtgcagatcgaggtagttcagttgagggccgtccgcatccttgcagccgctaccaggttgataacggcgacaaaaatgccagtatacgtcatgggagtgacaagcacgcagaccccattcagcttctcgaatgccaatcccggtcttactttccactggtctatgagcaagcgggacgtccttgacctcgtcccccgtcattcagaggttttcctccagcttccagtggagcacaacttcgccatggtagtgcatactaaggccgctggacgtacctccattaaggtgaccgtgcactgcatgaatagctcatccggccagtttgaggggaacctgctggaactgtccgacgaggtccaaattctggtttttgagaagctgcagttattctaccctgaatgtcaacccgagcagatcttgatgcccattaactctcaacttaagttacacacaaatcgtgaaggcgctgcctttgtgagtagtcgggtactgaaatgctttccaaattcatctgtaattgaggaagatggcgaggggctgcttaaggccggaagcatcgccggaactgccgtgctggaggtgacctctatagaaccattcggcgtcaatcagaccactattactggggtacaggtagcacccgtgacctacctcagggtgagtagccagcccaaactgtacaccgcacaaggacgcactctgtctgcgtttccactcggaatgtccttgaccttcacggtccaattttacaatagtataggcgaaaagtttcacacccataacacccaactgtatcttgccctcaacagggatgacttgcttcatatcgggcctggcaacaaaaactatacttacatggcacaggctgttaaccggggactgacactggtgggtttgtgggatcgtaggcaccccggaatggcagactacatccctgttgccgttgaacatgcaatcgagccagatacaaagcttacctttgtcggcgatatcatctgcttctccactcacttggttagccagcatggcgagcctggcatctggatgatcagtgcaaataacatactccaaaccgatatcgtcacaggtgtcggggttgccaggtcaccgggaactgcaatgatttttcacgacattccaggggtggttaagacctatagagaggtcgtggtgaacgccagttcgcgcctgatgcttagctatgatctcaagacctacctcacaaacacacttaattcaaccgtatttaagttgtttattactactggacgcaatggagttaatctgaaaggattctgcacaccaaaccaagccctcgctattaccaaggttcttctgcctgccaccctgatgctttgtcacgtgcagttctcaaatacgctcctagacattcccgctagcaaagtgttccaagtccacagcgattttagtatggagaagggcgtgtacgtttgcatcatcaaagtacgtccacaatcagaagaactcctgcaggccctgtctgtggcagatacgagcgtgtacgggtgggcaacgttagtgtccgagaggtccaagaatggtatgcaaaggatccttatccccttcatcccagccttttacatcaatcagagtgaactcgtgctgagtcataaacaagacattggggagatccgagtcttgggggtggacagggttctgagaaagctcgaagtgatctcttcatcccccgttcttgtggtggcgggacacagccactcacccctaaccccaggcctggctatctactccgtgcgagtggtgaatttcacttccttccagcaaatggcctcacccgtcttcatcaacataagctgtgtcctcaccagccaatccgaggccgtcgtcgtccgcgcaatgaaggacaagcttggtgccgaccactgcgaagacagcgctatcttaaagagattcactggctcctaccagatactgctcttgactctattcgccgttctcgcctctaccgcctccatctttcttgcgtataatgccttccttaataagatacagaccgttcccgtggtgtacgtccccacacttggaactccccaacccggattctttaacagtacctcatcaccaccccactttatgagcctgcaaccaccattagcccagagtcggctccagcattggctgtggtccattagacacta

SEQ ID NO: 52082 - DNA, 639 bp, Artificial Sequence
  Description of Artificial Sequence: Synthetic coding sequence
atggcaagtttgtttagcgggcgtatcctgattaggaacaattccgatcaggacgagctggacactgaggctgaagtgagtcgccgtctggagaatcgactggttctcctatttttcggagcgggagcatgtccccaatgccaggccttcgtaccaatactcaaggacttcttcgtgcggctgacagatgagttttatgttttacgggcagcccagctggctctagtgtatgtgtctcaggatagcaccgaagaacagcaggatctctttctgaaggacatgccaaaaaaatggctttttctgccttttgaagatgacctgcggagagatctggggaggcagttttccgtagagaggctgcctgccgtggtggttctgaaacctgatggcgatgtccttacccgtgatggtgctgatgaaattcagagactgggaaccgcctgttttgccaactggcaggaggctgccgaggtgctggaccgcaactttcagctgccggaagatctggaagaccaggagcctcgcagcctgactgagtgcctgaggaggcacaagtaccgggtagagaaggccgcaaggggtggaagagaccccggaggtgggggtggagaagagggcggtgctggtggccttttctag

SEQ ID NO: 52083 - DNA, 423 bp, Artificial Sequence
  Description of Artificial Sequence: Synthetic coding sequence
atgcttcccgactgcctgagcgctgagggtgagctgcggtgtcgaagacttcttgccggagctaccgcgcgactgcgcgcacgcccagcttctgccgctgtcctggttcccctctgctctgttcggggtgtacctgccttgttatacacactgagaagctcacggttaacggggcgacataagggtgacgtttccttccctggaggaaagtgtgaccctgccgatcaggacgttgttcatactgcattgcgcgagaccagggaggagctgggtttggcagtaccggaagagcacgtctggggactcttgagacccgtctatgacccccagaaggccaccgtggttcctgtattggcaggagtcggacccctggatcctcagagtttgagacccaattctgaagaggtttcctgggggatctag

SEQ ID NO: 52084 - DNA, 711 bp, Artificial Sequence
  Description of Artificial Sequence: Synthetic coding sequence
atgctgccagattgcctcagcgccgagggagagcttaggtgtagacggctgcttgctggcgctacagccaggttacgcgctaggcccgcttccgccgctgtcctagtcccgctgtgcagcgttaggggcgttcccgcactgctctatactctgagaagctcaagactgacagggcgacataaaggggatgtctcttttcccggtggtaagtgtgaccctgcagatcaagatgtagtgcacactgctctgagggagacccgggaggagctggggctggcagtgccggaggagcacgtgtgggggctcctacgccctgtctacgaccctcagaaggcaaccgtcgtgcccgtcctggcgggtgtcggcccactcgatccccagtctctgcgccctaattcagaggaggtggacgaggtgttcgcgttacctctcgcacatctgcttcagactcagaatcaggggtatacccatttctgtaggggagggcactttcgatatactttgccagtattcttgcatggccctcaccgtgtctggggtctgacggccgtgattacggaatttgcgctgcagttgcttgcccctggcacttatcagcccaggctcgccggtctcacttgttccggggctgagggactggcacgcccaaaacagccactggcctcaccatgccaagcgagtagcactccagggctcaacaaaggtttgtag

SEQ ID NO: 52085 - DNA, 1053 bp, Artificial Sequence
  Description of Artificial Sequence: Synthetic coding sequence
atggcaggcaggctgctggggaaagccctagcagccgtaagcttatctctcgcgctggcctccgtgacgattagatcctctagatgtagaggcatccaggcgttccggaacagcttttccagctcttggttccacctcaacaccaatgtgatgagcggctccaatgggagcaaagagaactcacataacaaagcccgaacgtccccctaccctgggagcaaggtcgagaggtcccaggtgccaaacgaaaaggtggggtggctggtcgagtggcaggactataaaccggtcgaatacacggcagtatctgtactggccggacctagatgggcagatcctcagatttcagagagtaacttcagccctaaatttaacgaaaaggacggccacgtcgagagaaagagcaagaacgggctctacgagatcgagaatggcaggccacgcaatccagccggtaggaccggactggtgggcagagggttactggggagatggggtcctaaccacgcagcggatcccatcattacgaggtggaagcgggatagcagcgggaataagatcatgcacccagttagtgggaagcacatcctccaattcgtagctataaagcgcaaggactgtggagagtgggctatacctgggggtatggtggatccgggagagaaaatctctgccaccttgaaacgagagttcggagaggaggcccttaacagtctccagaaaactagcgccgaaaagcgggagatcgaggaaaagctgcataagctattttctcaggatcacctggtaatctacaaggggtacgtcgacgatcccagaaatacagacaatgcttggatggagacagaggccgtcaactatcacgatgagacgggcgagatcatggataacctaatgttggaggccggtgacgatgccggtaaggtgaaatgggtagatatcaacgataagctgaaactgtacgcaagtcactcacagtttattaaactggtggcagaaaagcgcgacgcccactggtctgaggactccgaagcagactgccacgcgctgtag

SEQ ID NO: 52086 - DNA, 903 bp, Artificial Sequence
  Description of Artificial Sequence: Synthetic coding sequence
atgtctggaagtaatgggtccaaagaaaatagccacaacaaggccaggactagcccctaccctggaagtaaagtcgagcgcagccaggttcccaacgagaaagttggctggctggtggaatggcaagattacaagcccgttgaatataccgctgtgtctgttctggctgggcctcggtgggctgatccgcagatctcagagagtaactttagtcccaagtttaacgaaaaagacgggcacgtggaacgaaagtcaaaaaatggtctctacgaaatagagaatggcaggccacgcaatcccgcaggcagaacggggctggtgggtcggggtctgctcgggcgatggggaccaaaccatgccgctgaccctatcatcacacgctggaagcgcgatagtagcggaaataagattatgcacccagttagtggcaagcacatcctacaatttgtggccattaagaggaaggactgcggagaatgggccattccaggcggaatggtagatcccggagagaaaatttcagccactttaaagcgagagttcggtgaagaggcgctaaacagcctccagaagacttctgctgaaaaacgcgaaatcgaagaaaaattgcataaactatttagtcaggaccatctggtgatctacaagggctatgtggacgaccctcgaaacacggacaatgcctggatggagacagaggccgtcaactatcacgatgagacaggtgagattatggataacttgatgctcgaagctggtgacgacgctggtaaagtgaagtgggtggatatcaatgataaattaaaactatacgccagccactctcagttcataaagctggtagccgaaaaacgggatgctcactggagcgaggattcagaggcagattgccatgctctgtag

SEQ ID NO: 52087 - DNA, 621 bp, Artificial Sequence
  Description of Artificial Sequence: Synthetic coding sequence
atgtctggatctaacggtagtaaggaaaattcccacaacaaagcaagaactagcccttatcctggatccaaagtcgagaggtcccaggtgccaaacgagaaggttggatggttggttgaatggcaggattataaacccgtggaatacactgctgtgtcagtcttagcgggtcctcgctgggccgacccacagatttctgaatctaatttctcccctaagttcaacgaaaaggatggccatgtggagaggaaaagcaaaaacggcctttacgagatcgagaatggaagacccaggaaccccgctggccgaaccgggcttgtaggccgaggactgctgggcagatggggacctaatcacgctgccgatcccatcataaccaggtggaagcgcgactcttccggcaacaagattatgcacccagtgtccggcaagcacatattacaattcgtggctataaagcgcaaagactgcggagaatgggcgatccctgggggtatggtcgaccccggagaaaagataagcgccaccctgaaacgtgaatttggagaagaggctctgaacagtctgcagaagacatctgccgagaaaagggagattgaggagaaattacacaagctgtag

SEQ ID NO: 52088 - DNA, 789 bp, Artificial Sequence
  Description of Artificial Sequence: Synthetic coding sequence
atggcacctgcgttacttttgatccccgcagcccttgccagcttcattctggctttcggaaccggcgttgagtttgtaaggttcacgtccctccggcctctgcttggtgggatcccagaaagcgggggacctgacgcccgacaagggtggctggctgccctccaggacaggtcaattctggcacctttggcctgggatctgggcttgcttctcctgttcgtcgggcagcacagcctgatggctgctgagagagtgaaggcttggacctcccgctacttcggggtgctgcagagaagtctgtacgttgcttgcacggccctggcattacagttggtaatgagatactgggagcccatccccaaaggaccagtcctgtgggaagcacgtgccgaaccctgggccacatgggtacccttattatgttttgtattacatgtcatctcttggctgttgatcttttccattctgctcgtctttgactacgctgagctgatgggccttaaacaagtgtactatcatgtactaggcctcggcgagccactggccctgaaatccccgcgtgccctcaggttgttttcacacctgagacatccggtttgtgtagagctgctgacagtcctttgggtggtgcccactttaggaaccgataggttattgctggcattcctgcttaccctgtatctggggctcgcccacggcctggaccagcaggatttacgctatctgcgagcacagctgcagagaaagttgcacttactgagccgaccacaggatggtgaggccgaatag

SEQ ID NO: 52089 - DNA, 612 bp, Artificial Sequence
  Description of Artificial Sequence: Synthetic coding sequence
atggctccggctctgctgctaattcccgctgcactggcatcattcatcctggctttcggtaccggggtcgagttcgtccgttttactagccttcggcctctgctgggtggtatcccagaatcgggcggacccgacgctaggcagggctggctggcggcactacaggatagaagcatactagctcccttggcatgggatcttggcctgctcctcctttttgtgggacaacacagcctcatggctgctgagagggtcaaagcatggacctctaggtactttggcgttctgcagcgaagcctgtacgtagcttgcaccgccttggcactgcaggtctattaccatgtgcttggactgggcgagcccctggccctaaagtctcctcgcgcattaagacttttctctcacctgagacatcctgtatgcgtcgaactcctgactgtgctgtgggtcgtgccgactctcggcactgatagactgctattagcatttttgctaacactgtacctcggtctggcccacggcctggatcagcaggacctacggtatctgagagcccagctccaacggaagttacaccttcttagtagaccccaggacggagaagccgaatag

SEQ ID NO: 52090 - DNA, 789 bp, Artificial Sequence
  Description of Artificial Sequence: Synthetic coding sequence
atggcgcctgctctgctgctgatcccagctgcgttggccagcttcattctggccttcggaaccggggtggaatttgtcaggttcacgagcctcagacctctgctcggcggtatccccgagtctggtggtcccgacgcaaggcaaggatggcttgctgctcttcaggaccgttcaattctagcaccacttgcctgggatctgggcttgctccttctgtttgtgggacagcattccctgatggccgcagaacgggtgaaagcatggacatcccgttacttcggcgtcctgcagcgcagtctgtacgtggcctgtactgctctggccttgcaactcgtgatgagatattgggagcccatccccaaggggccagtgctgtgggaggccagggctgaaccatgggctacatgggtgcctttgctctgcttcgtgctacatgtgattagctggttgctcatcttctcgatcctgctggtgttcgattacgccgagctgatgggcctaaaacaagtttactatcacgtgctcggccttggcgagcccctcgcattgaaatcgccacgagcattgcggctcttctcacacctgaggcatccagtctgcgttgagctgctcactgtgctgtgggtggtgccaacgctcgggacagatagattgctcttagcgtttctgctgactctctacctcggtctggcgcatggtctggatcagcaggatctcagatacctgagagcccaattgcagcgtaagttgcacctgctgtcccgcccacaggatggtgaggccgagtag

SEQ ID NO: 52091 - DNA, 612 bp, Artificial Sequence
  Description of Artificial Sequence: Synthetic coding sequence
atggctcctgccctgctgttgattccagccgcattggcctcatttatcttggccttcggcaccggtgtcgagtttgtgcgcttcacctccctgcgaccactgttgggaggcatccccgaatctggtggccctgacgccagacagggatggcttgctgccctccaagaccggagtatcttggcgccactcgcctgggacctaggactgcttttactcttcgtcggccagcattccctgatggccgctgaacgcgtcaaagcctggacctcccgctacttcggtgtcctgcagcgatcactatacgtcgcatgtactgcactggctctgcaggtctattatcacgtgctggggctcggggagccccttgccctcaagtccccgcgtgcattacggctcttctcacatctaaggcaccccgtgtgcgtcgaactattgacagttctttgggtggtgcctacgctcggtaccgataggcttctcctggcattcttgctgactctttatctgggcctcgcccacggattggaccagcaagacctgcggtacctgcgggctcagctccagaggaaattacatctcctgtcaaggccacaggatggcgaagcggaatag

SEQ ID NO: 52092 - DNA, 789 bp, Artificial Sequence
  Description of Artificial Sequence: Synthetic coding sequence
atggcacccgcactgctgctcattcctgccgcacttgctagctttattctcgcattcgggacaggggtcgaatttgtgcgcttcacctcgcttcgcccactgctcggtgggattcctgagtccggaggacctgatgccagacagggctggctcgcagccctgcaggatcgatcaatcttagctcctcttgcttgggaccttggccttctgctgctatttgtcgggcagcactcattgatggctgccgagagggtaaaagcttggacttcacggtacttcggtgtgctccagcgctccttatacgtggcatgtacggccctagcgctgcagctggtcatgcggtactgggagcccatccctaaaggcccagtgctgtgggaggcccgagcagaaccctgggccacttgggtgccactcttgtgctttgtcctgcacgtgatctcttggctgttaattttcagcatcctgctggtttttgactacgccgaactgatgggcttaaaacaggtgtattatcatgtcctgggactcggagagcccctggcgctgaagagtcctagagccctgcgcctcttttctcaccttcgtcacccagtctgtgtagaacttctcacagttctgtgggttgtgcctacattgggaacagacaggctgctgctggcttttctcttaacattgtacctgggcttggcccacggacttgatcaacaggacctgcgatatctgagggcgcagctgcagcgaaagctgcacctgctttcccgtcctcaggacggggaggccgagtag

SEQ ID NO: 52093 - DNA, 789 bp, Artificial Sequence
  Description of Artificial Sequence: Synthetic coding sequence
taggaatccggcagggaagccaccggggagggcgacctcagttcgaagctggggactcagggcctggagttctggagaggcggtcgcgtgcggactgagggcgctgaaaagggaggagatagatcgatcttaaatgcacggcagggctggctcgccgcactgcaagatagaagcattctggctcccctagcatgggacctgggcctgctcttacttttcgtggggcagcactctttaatggcagcagagagggtaaaggcctggactagtcgttactttggcgtcctgcagagaagcttatacgtggcatgtacggccctcgccctgcaactggtgatgcgatactgggaacccatccctaaaggtccggttctatgggaggctcgcgcagagccctgggccacgtgggtgccattgctctgcttcgtgctgcatgtgatatcttggctgctgatattttccatactgctcgtcttcgactatgccgaactaatgggactgaaacaagtgtattaccatgtgcttggactcggcgaacccctcgccttaaagagccctcgagcattgagactgtttagccatctccgccatcctgtgtgcgtggagctgctgacagtgttgtgggttgtaccaacactgggaacagatcggcttttattggctttcctgttgacactgtatctcggcctggcccacggtctggaccagcaggatttacggtatttgagggcccaacttcagcggaaactgcacctgctaagccgacctcaagatggagaggccgaatag

SEQ ID NO: 52094 - DNA, 789 bp, Artificial Sequence
  Description of Artificial Sequence: Synthetic coding sequence
atggcaccagccctcctgctgatccccgctgcgttggcttcgtttatcttggcatttgggaccggagtcgagttcgtgaggtttacctctctgaggcctctcctgggcggtatccctgaatccggaggccctgacgctcgccagggctggcttgcagctttacaggaccgatctatattagcaccactggcctgggacctgggattgcttctcttattcgtgggccagcactcccttatggctgccgagagggtgaaggcgtggacatcaagatactttggggtgcttcaaagatctttgtacgtggcatgtactgccctggcgttgcaactggttatgagatactgggaacccattcctaaaggtcccgtcctgtgggaagcgagagctgagccttgggctacttgggttcctctcttgtgcttcgtgctacatgtgataagctggcttctaattttctcgatcctactggtattcgattatgctgaacttatgggtctgaagcaggtgtactatcacgtgcttgggctgggcgagccgctggctttaaaatccccacgggctctcaggctgttcagccacctgaggcaccctgtatgtgtagagctgctgaccgtattgtgggtcgtgcctactctcgggaccgatcggttgctactcgccttcctgctgacactctaccttggtttggcccacggacttgatcaacaggacctgcgataccttagagcgcaactccaaagaaaactgcacctgctctctcgaccccaagacggcgaagcagaatag

SEQ ID NO: 52095 - DNA, 612 bp, Artificial Sequence
  Description of Artificial Sequence: Synthetic coding sequence
atggcacctgcgctgttgctgatcccggcagccctggcaagcttcatcctcgcctttgggaccggggtcgagtttgttcggttcactagcttgcggcctctgttgggaggcatcccagaaagtggtggcccagatgcaagacagggttggctggctgctttgcaggaccgaagtatcctggcgccacttgcatgggacttgggattactactgctgtttgtggggcagcattccttaatggctgcagaacgcgtaaaagcatggacctctcgttactttggggtcctacagcgatccctgtatgttgcatgtaccgcgctcgccctgcaggtttactatcacgtgctcgggttgggagagccactggccttgaaaagtcccagggcactgaggctattcagccacttgcgccacccagtatgtgtggaattgctgacagtattgtgggtggtgccaacactcggtactgacagactgcttctggcgtttctattgactctctacctgggattggcccatggcctggaccagcaggatttgcgctatctgcgggcacagctgcagaggaagctacatctgcttagcaggcctcaggacggagaggcggagtag

SEQ ID NO: 52096 - DNA, 789 bp, Artificial Sequence
  Description of Artificial Sequence: Synthetic coding sequence
atggcccctgccttattgctcattccagccgctttggccagttttattctggccttcggcactggtgtcgaatttgtaaggttcacgtctttgcggccactgctgggtggtattcccgagtccggcggtccagatgcacggcagggttggttagccgcacttcaagatcgaagcatcttggcgcctttagcatgggacctgggattacttctgttgttcgtgggccagcactccctcatggctgcagaacgcgtgaaagcttggacctcgagatacttcggggtactccaacggtctttgtatgttgcttgtaccgctctcgcccttcagcttgtgatgcggtactgggaacccatcccaaagggcccagtgctgtgggaggcgagagctgagccctgggccacatgggtccccctgctttgcttcgtcttacacgttattagctggctgctgatttttagcattctgttagtcttcgactatgctgagctgatggggctaaagcaggtgtactatcatgtcctggggctcggagaacccttagccctgaagtctccccgagctcttaggttgttttctcatctccggcaccctgtctgcgtcgaactgctaactgtcctgtgggtcgttcccaccctgggaactgataggctgttgctggcctttctgcttaccctctatctgggcctggctcacgggctcgaccagcaggatctgcggtacttgcgtgcccagctgcaacgcaagctgcacttgttatcacgtccacaagatggcgaggcagaatag

SEQ ID NO: 52097 - DNA, 789 bp, Artificial Sequence
  Description of Artificial Sequence: Synthetic coding sequence
atggcacctgctcttctcctgatcccagccgcactagcgtccttcatcctggctttcggcacaggggtggagtttgttcgattcacatcacttagaccactgctcggtggtattcccgagagcgggggaccagacgctagacagggctggctggctgcactgcaagaccgctcgattctggccccactcgcctgggaccttggactgttattactcttcgtgggccagcactccttaatggccgctgagagagtcaaggcatggacatcgcgctactttggggtactccagcggtccttgtatgtcgcatgcactgccctcgccttacagctcgttatgagatactgggaacccatccctaaaggtcctgtcctctgggaggctcgggctgagccatgggctacctgggtaccactgctgtgttttgtgctgcacgtgatttcctggcttctaattttcagcatcctgttggttttcgattatgccgagctgatgggcctcaaacaagtctactatcatgtcttaggattgggcgagcctctcgcactgaagagtcctcgcgcactgagattgttttcacacttgaggcaccccgtgtgtgtggagcttctgaccgtactatgggtggtaccaacgttgggaacagacagactgctgctggcgttcctcctcacactgtacctcggtctggctcacgggctcgatcaacaggacctgcgttatttgagagcgcaactccagagaaagttgcatttactctcacggcctcaagatggggaggctgaatag

SEQ ID NO: 52098 - DNA, 789 bp, Artificial Sequence
  Description of Artificial Sequence: Synthetic coding sequence
tgagagtccggacgcgaagctacaggcgagggggatttgtcgtccaagctgggcacacaggggctggaattttggagaggagggagggtacgtaccgagggcgctgagaaaggaggcgaccgaagtatacttaacgctcgccagggttggctggctgccttgcaggacagatctattctggcacccctggcatgggacctgggtctgctgctgttgttcgtggggcagcactccctaatggcagcagagagagtgaaagcctggaccagccgttacttcggtgtcttgcagcggtccttgtacgtggcctgtacagctctggctctgcagctcgttatgagatattgggaaccaattcctaagggcccagtcctatgggaggccagagcagagccatgggccacctgggtgccccttctttgctttgtgttgcacgtgatttcctggctgttgatcttttctattctcttggtttttgattacgctgagctgatgggcctcaagcaggtatattaccacgttctgggtttgggagagcccttggctcttaagagccccagggccttgcggctcttctctcacctgcgccacccagtatgcgtcgagctcctgactgtgctatgggttgtaccaacactgggtacggacaggctccttctagcattcttactcacactgtatctagggctggcgcacggcctggaccaacaagacttaaggtacttgagggcacaacttcagaggaagctgcatctgttgtctagaccccaggatggcgaggcagaatag

SEQ ID NO: 52099 - DNA, 789 bp, Artificial Sequence
  Description of Artificial Sequence: Synthetic coding sequence
atggctcccgctctgctgctcatccccgctgctttggccagttttattcttgcattcgggactggggtggagttcgtgcgattcaccagtctacgcccactgctggggggaatccccgaatctgggggacctgacgccagacagggttggctggctgccttgcaggacaggagtatcctcgctcctctagcatgggacctggggctgctgctcctgtttgtaggccagcacagccttatggcagcagagcgggtgaaggcgtggacttcgcgttactttggggtattgcagcgaagcctgtacgtggcctgcaccgccctggctcttcagctggtgatgcgctattgggagccaatccccaaggggcctgtgttatgggaagcacgggctgagccatgggccacctgggtgcccctcctgtgctttgtgctgcatgtcattagctggctacttatcttcagtatcctcctggtgttcgattacgcagagttgatggggctcaaacaagtgtattaccatgtgctcggtctgggcgaacccctcgccctgaagtcccccagggctttgcggctgttctcccatttgcggcacccagtttgcgttgaattgctgaccgtgttgtgggtcgtgcccacacttggtaccgatcggctcttgctagcttttctcctgaccctgtatctgggactagcgcatggtctggaccagcaagatttgcgctacctgcgcgcacagcttcaacgaaaacttcatcttctctcaaggccccaagatggggaagctgagtag

SEQ ID NO: 52100 - DNA, 789 bp, Artificial Sequence
  Description of Artificial Sequence: Synthetic coding sequence
tgagagtcaggtcgtgaagcaacgggtgaaggcgacctttccagcaaactgggcactcagggtctggagttctggcggggtggtagggtcaggactgaaggcgctgaaaagggcggtgatcggtcaatcctcaatgccaggcagggttggttggccgcactgcaggatcggtctatcttggcacccctcgcctgggacctgggcctcctgctgttgttcgtcggccagcattctctgatggccgctgagagagtgaaagcttggaccagcaggtatttcggagtcctgcagcgaagtttgtatgttgcgtgtactgcactagcactgcaacttgtgatgaggtactgggagcccatccccaagggtcccgtgttatgggaagcccgagcagaaccttgggctacatgggtgccgctgctgtgtttcgtgttgcacgtgatctcttggctgctcattttctccattctattggtgttcgactatgccgagctaatgggactgaagcaggtatattatcacgtcctcggattgggagaaccgctcgccctcaagtccccacgcgctttacgcctattctcacacttaaggcatccagtgtgcgtagagttgctgactgtgctctgggtggtgccaacccttggcactgacagactgttattggccttccttctaaccctctatttaggactggcacacggtctcgaccaacaggatctgcggtacctgagggcccagttgcagagaaaactgcacctcctttcgagaccccaggacggagaggctgagtag

SEQ ID NO: 52101 - DNA, 789 bp, Artificial Sequence
  Description of Artificial Sequence: Synthetic coding sequence
tgagagtcagggagggaagctacgggggaaggtgatttatccagtaagttggggacacagggtctcgaattttggcggggtggaagggtgagaacggagggagctgaaaagggcggtgacaggagcattcttaacgctcggcagggttggctcgccgctcttcaagacagaagtattcttgcgccactggcttgggacttagggcttcttctcctcttcgtgggacaacatagcctgatggcagccgagagagtgaaggcatggacctcccgctattttggcgtgcttcagcggtcactgtacgtcgcttgtaccgctctcgccctgcagctggtgatgcggtactgggagcccataccaaagggcccagtgttgtgggaggccagagccgagccttgggcaacgtgggtgcctctgctctgctttgtcttacacgtgatcagctggctgttgatttttagtattctcctagtctttgactacgctgaactcatgggcctgaagcaggtttactatcacgtgctaggcctcggtgaacccctcgccctgaaatctccgagagcactgcggttgtttagtcatctgcgccacccggtgtgtgtggagcttttaaccgtgctctgggtcgtacccacactcggtactgaccggcttttactggcctttctgctgacgctctacttggggttggcccacggtttggaccagcaggacttgaggtatctgcgcgctcagttgcaaagaaaacttcacctgctgagccgtccacaggatggggaagccgagtag

SEQ ID NO: 52102 - DNA, 789 bp, Artificial Sequence
  Description of Artificial Sequence: Synthetic coding sequence
atggcgcctgctctgctacttataccggctgcacttgcttcgtttattcttgctttcggcacgggagtggagttcgtgaggtttacctcactcaggccactgctaggtggcattcccgaatccggcggacctgatgctcgccagggatggttggcagcactacaggatcgcagtatattagcaccactggcctgggatcttggtttgctcttactgttcgttggacaacactctcttatggcagcggaaagggttaaggcttggacttcccgttacttcggtgttctgcagagaagcttgtatgtggcgtgcaccgcattagcgctgcagctcgtcatgaggtactgggaacctatccccaagggacccgtgctttgggaggccagagcggaaccatgggccacctgggtcccattgctgtgtttcgtccttcacgttattagctggctccttatattttccatcctgctggtcttcgactacgccgagctaatgggcttgaagcaggtctactaccacgtcctaggtcttggggaaccacttgcacttaaaagcccacgagccctgcggctgttcagccatctgcgccacccagtttgcgtggaattgttgacggtgttgtgggttgtgcctacactcggaaccgaccggctgctgctcgccttcctactcaccctgtaccttgggctagcgcacgggctcgaccagcaggacctacggtatctgagagctcagctgcagcggaaactgcacctgctttctcgccctcaagacggcgaagctgaatag

SEQ ID NO: 52103 - DNA, 789 bp, Artificial Sequence
  Description of Artificial Sequence: Synthetic coding sequence
taagagtccgggagggaagccactggtgaaggagacctttcatcaaaacttggcacacagggactggagttctggagagggggtagggtgaggactgagggtgccgaaaaaggaggggatagatcaatccttaacgccaggcaggggtggctagctgctctgcaggaccgcagtatcttagccccattggcctgggacctaggtctactgctgttattcgttggacagcactcgctcatggcagctgagagggtgaaggcatggacttcacgttactttggtgttctgcagaggagcctttatgtggcgtgcacagctctagctctccaattagtcatgcggtattgggaaccaatacccaaaggaccagttttgtgggaagcaagggccgagccatgggccacctgggtccccctgctgtgctttgtgctccacgtgatcagttggctgctaattttttctatcctactcgtctttgattacgccgagttgatgggactgaagcaggtgtattaccacgtgcttgggctcggagagcccctcgcgctcaaatcgcctagggccttacggttatttagtcacttacggcatcccgtgtgtgtggaactccttacagttctatgggtcgtccccactttggggacagaccggctactcctcgctttcttgttgactctgtaccttggccttgcccatggcctcgaccagcaagaccttcgttatcttcgagctcagcttcagagaaagctgcacttactgagtcgaccacaggatggcgaagcagagtag

SEQ ID NO: 52104 - DNA, 789 bp, Artificial Sequence
  Description of Artificial Sequence: Synthetic coding sequence
taagaatccgggagggaagccactggggagggagatctgagctctaaattgggaactcaggggctagaattttggaggggcggaagagtccggacggagggcgctgaaaagggaggggacaggagcatcttaaacgctcgacagggctggcttgccgcactgcaggacaggagcatcctggcccctcttgcttgggacctgggacttttgctgctgttcgtggggcagcatagcctgatggccgctgaacgggtgaaggcatggacatctagatacttcggcgtactgcagaggagcctttacgtggcctgtaccgccctagctttgcagctggtgatgaggtattgggagcccatcccgaaagggcctgttctttgggaagcccgagcggagccttgggccacttgggtgccacttctgtgctttgtgttgcatgtgatatcttggctactgattttctctattcttctcgtgtttgactacgcggagctgatggggctcaagcaggtgtactatcacgtgctgggactgggagaacctctggccctgaagtcccctcgggctttgcgccttttcagccacctgagacatccggtgtgcgtggagctgctcactgttctttgggtggtgcctacactgggcacagacaggctgctgctcgctttcttgcttacactatacctggggctagcgcacggtttagatcagcaggatctccgttatctgagagcacaactccaacgaaagctccatctgcttagccgcccacaggacggcgaggcagagtag

SEQ ID NO: 52105 - DNA, 612 bp, Artificial Sequence
  Description of Artificial Sequence: Synthetic coding sequence
atggcgcctgccctactccttatcccggctgcactggcttctttcatcctggcctttggcacgggagtcgagtttgtcagatttacgtccctgcgtcccttactcggcggaattccagaaagcggaggccctgatgctaggcaggggtggctcgcagccctgcaagaccggtctatcctcgccccactggcttgggatctggggctgcttcttctcttcgttggccaacactccctgatggcggcagagagagtgaaggcatggactagtcgttattttggcgtgctgcagagatctctgtacgtggcctgtacagccctggctctgcaggtgtattaccatgttcttggactgggagaaccactggcactgaagtctcccagagctcttcgtctctttagtcacctccgccatccagtgtgtgtggaactcttgacagtgctgtgggtggtacctaccctgggaactgatcggcttctgctggcattcctgctgacactgtaccttgggctggctcacggccttgatcagcaggatctaagatatctacgagcccagctgcagcggaaactacatctcctgtcacggccacaggatggtgaggccgagtag

SEQ ID NO: 52106 - DNA, 789 bp, Artificial Sequence
  Description of Artificial Sequence: Synthetic coding sequence
tgagagagtggcagggaggccactggagagggagacctaagcagcaaactgggcacacaggggctggaattctggcggggtggcagagtcagaacagaaggggctgagaaggggggtgatcgctctatcctcaatgcgaggcaggggtggctggccgcactgcaggatcgaagtatcctggcccctctcgcttgggacctgggattgttactgctatttgtggggcagcacagcctgatggccgcagagcgtgtgaaggcttggacatcacgatactttggcgtgctgcagagatcactttacgttgcctgtacagctcttgcccttcaattggtcatgagatattgggagccaattcctaagggtcccgttctgtgggaggctagggcagagccttgggccacttgggtgcctcttctctgtttcgtcctgcacgtaatatcttggttgctgatctttagtatacttttggtgtttgactatgccgagcttatgggactgaagcaagtgtattaccatgtgttaggactgggcgagcctctggctctgaaatcaccgagagccctacgcctcttcagtcatttaagacaccccgtgtgcgtcgaactgctgacagttctgtgggtggtgccgactctgggaacagacaggctattgctcgcattcttgctcactttgtacctgggccttgcccacgggctggatcagcaagacctacgatacctccgggctcaacttcaacgaaaactacacttgctcagtcgaccacaggatggggaagcagaatag

SEQ ID NO: 52107 - DNA, 612 bp, Artificial Sequence
  Description of Artificial Sequence: Synthetic coding sequence
atggcacctgccctgctcctgataccagccgctctagctagcttcattctggcattcggaaccggtgtagaatttgtgcggtttacaagcctgcggcctctactcggagggataccagagagcggtggccctgacgccaggcagggttggctagccgctttgcaagaccggtcgatcttggcccctcttgcatgggacctaggtctgctcctcctgttcgttggccagcactctctaatggctgcagaacgcgtgaaggcttggaccagtcggtatttcggagtgttgcaacgatcactctatgtggcgtgtactgcccttgccctgcaagtgtactatcatgtgcttggcctcggtgagcctttagcattaaagtcccctcgtgccctaagactctttagccacctgagacaccctgtttgtgtcgagctgctgaccgtgctatgggttgtcccaaccctcggaacagatcgtcttttgttggcgttcttgcttaccctgtatctcggtctcgcccacggattggaccagcaggatctccgatacctcagggcgcagctgcagcggaagctgcaccttttgagtcggccacaagacggagaggccgagtag

SEQ ID NO: 52108 - DNA, 612 bp, Artificial Sequence
  Description of Artificial Sequence: Synthetic coding sequence
atggcccctgccctgctgttaattcctgcagccctggctagcttcatcctcgcctttgggacgggagtcgaattcgtaagattcacaagtttgcggcctctgttggggggtattcctgaaagtggtgggccagacgctagacaaggatggcttgcagccctgcaggatagaagcattctagccccactggcctgggacttagggctccttttgttatttgtaggccaacactcgctgatggccgcagaaagagttaaagcctggacaagccgatactttggtgtcctccagcgctccctttacgtggcctgtacagctctcgccctccaggtatactaccatgtattgggactcggtgaaccactggccctcaagtcgcctcgcgctctcagactgtttagtcacttgagacaccctgtttgtgtggagctattgaccgtcctttgggtcgtgcccacccttggaacggataggctcctgcttgcatttttacttaccttgtaccttgggctggcacatgggcttgatcagcaggacttgcgatatcttcgggcacagttgcaaaggaaactgcaccttcttagtagaccccaggacggggaagcagagtag

SEQ ID NO: 52109 - DNA, 612 bp, Artificial Sequence
  Description of Artificial Sequence: Synthetic coding sequence
atggcccctgcgctgcttctaattcctgcggcattggccagttttatccttgcattcggaacaggggtggaatttgtgcgatttaccagcctcaggcccctgctggggggtatcccagagagcgggggtccggacgctcgccagggctggctcgcggctctccaagaccgaagtatcttggcgccactggcctgggatctcggattactgcttctatttgtgggccaacactctctgatggccgctgagcgagttaaagcgtggacaagcaggtatttcggcgtgctacagcgctcactctacgttgcctgcaccgcgctggcgcttcaggtctattaccacgtgctggggttgggagaacctctggcactgaaaagtcctcgagccttaagattattctcccacttgcgccatcccgtatgcgtggaactactcactgtattgtgggtagtacccacactgggcacagacagactgttactagctttcttactcaccctgtacctcgggctggcccatggcctggaccagcaagacttgagatatttaagggcgcagttacagagaaagctacacctgctgtccagacctcaagacggcgaggcagagtag

SEQ ID NO: 52110 - DNA, 750 bp, Artificial Sequence
  Description of Artificial Sequence: Synthetic coding sequence
atggcaatgctgagagttcagccagaagcacaggccaaggttgatgtcttcagggaggatctttgcacgaaaacagagaatctgcttggcagttacttcccgaaaaagatttccgagcttgacgcttttcttaaagagccggcactgaacgaggccaatctctccaatctaaaggcacccctcgacattcccgttcccgaccctgtgaaggaaaaggaaaaagaggagagaaagaagcagcaagagaaagaagataaggatgagaagaaaaaaggagaagacgaggacaaggggccaccgtgtggaccagtcaattgtaacgagaagatcgtggtactgctgcagcgacttaagccagagattaaggacgttattgaacagctgaatttagtcaccacatggctccagttacaaattccgcgaatcgaggatggaaacaactttggcgtggcggtgcaggagaaagtgttcgagctgatgacctccctgcacactaagctggagggattccatactcagatctctaagtattttagcgaaaggggagatgcggtcaccaaggcggctaaacagccccacgttggggattatagacaacttgtccacgagctagacgaggccgagtacagagacataagattgatggttatggaaatccggaatgcctacgctgtgctttacgacataatactgaagaatttcgagaagcttaaaaaaccaaggggggagacgaagggaatgatatattag

SEQ ID NO: 52111 - DNA, 5696 bp, Artificial Sequence
  Description of Artificial Sequence: Synthetic coding sequence
atgctgctgtcagggggtgaccccccagcccaggagtggttcatggtacagactaaatccaagccaagagttcagcggcagagactgcaggtacaaaggatttttagagtgaagttgaatgcattccaaagtcgtcccgatacgccgtatttctggctgcaactggaagggcctcgggaaaacatgggcaaagcaaaggagtacctgaagggcctttgcagccctgagctctggaaggaagtgcggtatccacctatcctgcattgcgccttcctaggcgctcagggacttttcctcgactgcctgtgttggagcacactagcctaccttgtgcccggacccccaggctccctgatggttggtggcttgacagagtcatttataatgacccagaactggttggaggaattggtgggtagattgaggtgggggcctgcaccacttttgacccctaggggtatctgggaggctgaggtgacccgggctttcggtgccctcgtctggatacggggagaccagcatgctggggatttgttgcagctccccccagccgtgcaggagctactgttgtccctcgtccgggacgctgctggaaaagaggacattattgagtggcttagtcggttcgggatctccgattcccattctgatccagaggtcttgatttgccctccacagcagcagaaggaggccccagccatggtgagcgtaggagagtcccccggtccgttcgtcgacatgggaaccttgcagaatcgtggcccagaaaattccaaaaggcttagctccctgggcgcaacaggcagtctgataacagctcagagcacacctcaagaagccgctaatcagctggtgcgcgtgggctccaataaccaggatggtatggactcagcccaggaagaaggaactgtccaggcgactagttcacaagactctactaatcacacacaggccctgctgaaacagcggcaggtccaaaagattgaggacaagctgctgtttcagcctcctgtctcagccttgggggtctgtcctccttggaaagcttggacccccggacccgcattcggacccctgtggccaggggctatagcagccaccttctggaggattaatgagctgcacagcctgcacctcgcttggctcctgagccaagcttgcttcaactttccgttctggcagagacccctaggcccaatccagcttaagttaccgggacagaatcccttgcctctcaacttagagtggaagcagaaggagctggcgcctttgccaagcgctgagtcacccgctggtcgcccagacggtggcctcggaggagaggccgctctgcaaaattgtcccaggcctgagatctctcctaaagtgaccagcttactcgttgtgcctgggagctccgatgtgaaggataaagtgagctccgacttaccgcaaatcggcccacctcttacctccaccccacaacttcaggccggaggggaaccaggggaccagggcagtatgcaactcgacttcaaggggctggaggaaggtcctgctccagttctgcctaccgggcagggtaaaccagtggcccaggggggtttaaccgaccagtctgtgccgggagcccagactgtccctgagacactgaaagtgccaatggcagcggctgttccaaaagcagaaaatccgagcaggacacaggtgccttcagctgcacctaagcttccaacctctaggatgatgttggctgtacatacagagccggcagccccagaagtcccgttagctcctaccaagccaacagcccaactcatggccaccgcccagaagactgtggttaatcagccagtgctcgttgcgcaggttgaacctaccacccccaagaccccccaggcccaaaagatgcccgtggccaagacctcgccagcagggccaaagactccgaaggcacaagcaggcccagccgcaacggtcagcaaggctcctgccgctagcaaggctcccgctgcccctaaagttcctgtgactccccgagtctcccgtgctcccaaaaccccagccgctcagaaggtgcccaccgacgccggacccacactggacgtggcgcgtttactgtccgaggtgcaacctacctctagagcgagcgtttctctcctgaagggtcaggggcaggcaggtaggcaagggccacaaagtagcgggacactggccctctcctccaagcaccagtttcagatggaggggttgctgggggcatgggaaggagccccaagacagcccccacgccatctccaggccaatagcacagtaaccagtttccagcgttaccacgaggcccttaatacacccttcgagttgaatctcagcggcgagccgggtaatcagggactacgaagggtggtgattgacggttcaagcgtggctatggtccatggtttgcaacacttcttttcttgcagagggattgccatggccgtacagtttttctggaaccgcggtcaccgcgaggttacggtattcgtgccaacttggcagttaaaaaagaatcggcgagtgcgagagagtcactttctcactaagctgcattccctcaaaatgttaagcatcactccctcacaactggagaatggaaagaagataactacatatgactatagatttatggtgaaactggccgaggagaccgatggaatcattgtcaccaatgagcaaattcatattttaatgaactctagcaaaaagctgatggtcaaagacaggttgctgccattcacatttgcgggaaacctgtttatggttcctgatgatccactaggacgggacggcccaactcttgacgagttcctgaagaaacctaacagattggatacagacattgggaatttccttaaagtgtggaaaacgctgcctcctagttccgctagtgtcactgaattatcggatgacgctgactcaggacccctcgaatctctgcccaatatggaggaagttcgagaagaaaaagaggagcggcaggacgaagaacaaagacagggacaagggacccagaaagcagccgaagaggacgatctggattcttcccttgccagtgtgtttcgtgtagagtgcccctccctctcagaggaaatccttcgctgtctttcacttcacgacccccctgacggggctctggacatcgatcttttgcctggtgccgcttccccatacctggggataccctgggacggcaaagccccttgtcagcaggtcctggcccatctggcccagcttaccatcccatcaaattttaccgctctctcgttttttatggggttcatggactctcatagagacgccatcccagattacgaggcactcgtcggccctcttcactccttgctgaagcaaaaacccgactggcagtgggaccaagagcacgaagaggcttttttagctctgaagcgagcactggtctctgctttgtgtctcatggcaccaaattctcagctgccctttaggctcgaggtcactgtgtcgcatgtggcgttaactgcgatcctccaccaggagcactccggacggaagcaccctattgcatacacatctaaaccactgcttcccgatgaggaaagccagggaccccagtccggtggcgattcaccgtacgccgtggcatgggctttgaaacattttagccggtgtatcggagatactcccgtcgtgcttgatttatcctacgccagcaggaccactgcggacccggaagtgagggaaggccgacgagtgtccaaagcatggttgattcgttggtctctgctggttcaggacaagggtaagagagcgctggaacttgccttgctgcaaggactcctgggcgaaaaccgtctcttgacccctgctgcatccatgcccagattttttcaggtactccctcctttttctgatttgtcaaccttcgtgtgcattcacatgagcggatactgcttttacagagaggatgaatggtgcgcagggtttggactgtatgtactgtcccctacgtctccaccggtatctctgagtttctcgtgttcaccttacacgccaacctacgctcaccttgctgccgttgcctgtggactggaaaggtttggacaatcccctctccctgttgtgtttctaacccactgcaattggatctttagcttactgtgggagctgctccccctgtggcgggctcgtggattcttgagctccgatggcgcaccccttccacatccctctctactatcatacattatttcactgacaagcggcctaagctctctgccatttatctatagaacctcttatagaggatccctgttcgcagttacagtggacactctggccaagcagggcgctcaaggcggaggacagtggtggtctttgcccaaagacgtccccgctccgaccgtatcccctcacgctatgggaaagcgccctaacctactggcattgcagctgagtgactctactctggctgacatcatcgcacggttacaggcgggtcagaaactctcaggatcttctccatttagctccgccttcaacagcctgagcctggacaaggagagcggcctcctcatgtttaaaggcgataaaaaaccgcgtgtttgggtggtgccaacccagttgcgcagagacctgatattctctgtacacgatattccgctcggcgctcatcagcggcctgaagagacctacaagaagttgcgactgctgggctggtggcctggtatgcaggagcacgtgaaggactattgcagatcatgccttttttgtatccccaggaaccttatcggatctgagctgaaggttatcgaatctccctggcccctccgtagcactgccccttggagtaatctgcagatcgaagtggttggtcctgtgaccatttccgaggaggggcataagcatgtactcattgttgctgatccaaacacaaggtgggtagaggcctttccccttaaaccttatactcacactgcagtggcccaggtactgctccagcacgtcttcgcgagatggggggtgccagtgagactcgaggcggcacagggcccacaatttgcgcgtcacgttctggtgagttgtggcctggcgctgggtgcccaggtagcgagcctgagccgcgacctgcagtttccttgcctgacgagttcaggagcttactgggagttcaaacgcgcattaaaagaatttatttttctccacggcaaaaagtgggcagccagcctgcctcttctgcacttggccttccgagccagcagcaccgacgcaactcccttcaaagttctgacagggggtgagagccggttaacggaaccactgtggtgggagatgtcttcggcgaacatagaaggtcttaaaatggacgtgtttcttctgcaattggtgggtgagttactcgagctgcactggcgtgtggctgacaaagcgtccgagaaagccgaaaaccggaggtttaagagggagtcccaggagaaggagtggaacgtgggcgatcaggtgttactactcagtctgcctagaaacggttcaagtgcgaagtgggtcggtcctttctacatcggcgaccgtcttagcttatcactgtaccgaatctggggctttcccacccctgagaagctgggttgtatttatccttcctcgctgatgaaagccttcgccaaaagtgggaccccactcagttttaaagtgttggaacaata

SEQ ID NO: 52112 - DNA, 7796 bp, Artificial Sequence
  Description of Artificial Sequence: Synthetic coding sequence
ggcaggcccataccccctacctcaagcccgtcccttcttcctagcgcacaacttccctcttctcataaccccccacctgtctcgtgtcagatgcccctcctggactcgaacacctcacaccagattatggacacaaaccccgacgaagagttcagccccaactcgtatcttctgcgagcgtgcagcggtccacagcaggcaagcagttctggacctcccaatcatcactcccaaagtacccttcgacccccactacctccccctcacaatcataccctgtcccaccaccattcaagcgccaactccctcaatagaaatagcttgactaatcgtagatctcaaatccatgccccagccccagcccctaatgacctggctactacacctgagagcgttcagctgcaggatagttgggtgctcaactctaatgtccctctggagaccaggcatttcttgttcaagacttcctccggcagtacccctctgttctcgtcttccagtcctggctatcccctcacatctggcacagtgtatacaccccctcccagactgctcccacggaacacattctcacgaaaggcattcaaacttaaaaaaccaagcaaatactgctcctggaagtgtgcagccctgagtgctatcgctgctgccctgctactggccatcctgctggcttacttcatcgcgatgcacttactgggcctaaattggcagttgcaaccagcagatggccatacttttaataacgggattagaaccggactccctggcaatgacgacgtagctacgatgccctcaggaggcaaagtcccgtggagtctgaagaatagttctatcgatagcggggaagccgaagttggaagaagagtaacccaggaagtgccacccggagtcttctggagatcacagatccacattagccaacctcagttcctgaaatttaatatctctctgggcaaggacgctctgttcggcgtgtatataagacggggtcttccaccctcccacgcccagtacgacttcatggagaggctagacgggaaggagaaatggagcgtggtagaatcaccgagggaacgaagaagtatccagactttggtgcagaacgaggcagttttcgttcagtacctcgatgtcggcctgtggcacctggcattctataatgacgggaaggataaagaaatggtgtcattcaacacagttgtcttagactcagtccaagattgtccccgtaattgccacggcaatggagagtgtgtctccggagtctgccactgttttcccggattcctgggggcagattgcgcaaaagctgcctgtccggtcttgtgcagcggaaatggccagtatagcaagggcacttgccagtgctactcagggtggaagggtgccgagtgcgacgtgcctatgaaccagtgcattgacccctcctgcggcggtcacggatcgtgcatcgatgggaactgtgtgtgcagtgccggatacaagggggaacattgtgaggaagtggactgcttggaccccacatgttccagccacggagtttgtgtgaacggagagtgtttatgttcccctgggtggggaggtctgaactgtgaactggcacgtgtgcaatgccctgaccagtgttcagggcacggaacctacctgccagatacaggactgtgttcctgcgatcctaactggatgggtccagactgctcagttgaagtctgttccgttgactgcggcacgcacggcgtctgcataggcggtgcttgtagatgtgaggagggatggacaggagccgcatgcgatcagcgggtctgtcatccccgatgtatcgagcacggcacctgcaaggacgggaaatgcgagtgtagagaaggatggaatggagagcactgcaccatagacggctgccctgacctgtgcaacggaaacggtcggtgcaccctcggccagaactcgtggcagtgtgtctgccagactggctggagagggccaggatgcaacgtggccatggaaactagctgtgctgacaataaggacaacgagggtgatgggctggttgattgcctggacccagattgctgtctacaatctgcctgccagaattctctgttatgccgcggaagtcgggatcccctcgatatcattcagcaaggacagacggactggcccgcagtcaagtctttttacgatcgtattaaactcctagcaggcaaagacagcactcacattatccctggggagaacccattcaacagttcattggtgtccctgattcgcggacaagtcgtcaccactgatggaacaccactcgtcggcgttaacgtgtcctttgtgaaatacccaaagtacggctacacgattactaggcaagacgggactttcgatcttattgccaacggaggtgcaagcctcaccctccactttgaacgagcccctttcatgtcccaggaaaggaccgtgtggctgccatggaatagcttttacgccatggacacgttagtgatgaaaaccgaagaaaacagcataccttcatgtgaccttagtgggtttgttagacccgatccaattataattagctcccccctgtccacgttctttagcgcagcccctggacagaatcccattgtgcccgaaacccaggttttacacgaggaaatagaactccccggaagcaatgtcaagctccggtatctgagtagccgtaccgcaggctataaaagccttttaaagatcaccatgacccagtctacggtccctcttaatctcatccgagttcacttgatggtggccgttgaaggtcatctcttccagaagtccttccaagcctccccaaacctggcatacactttcatctgggacaagaccgacgcttatggccagcgagtgtacggcctgtccgatgctgttgttagtgtgggctttgaatatgaaacgtgccctagtcttatcctgtgggaaaagcgcactgccttattgcagggcttcgaactggacccaagtaatttagggggatggtccctggacaaacaccacatactgaacgtgaagtccggtatcctgcacaaggggacgggcgaaaatcagttccttacccaacagccggcaatcattactagcattatggggaatggtagacggcgaagcattagttgtccatcttgtaatgggttagctgaaggcaataaattgctggcacctgtcgcattagccgttggcatagacggctcgctgtacgtcggagatttcaactacattagacgtatctttcccagcaggaatgtaacatctattctggagttgcggaacaaggagtttaaacactccaataatcccgctcacaaatattatttagctgtagaccccgtcagtgggtcactgtacgtgtccgataccaacagccgccgaatttatcgggtcaagtccttgtctggaactaaagacctggcaggaaattctgaagtggtggccggtactggagaacagtgtcttcccttcgatgaggccagatgcggagacgggggaaaggctatcgacgctacactgatgagcccaagaggcatcgcagtagataagaatggcctgatgtacttcgtggatgccacaatgatccggaaagtggaccagaacggcatcatttcaacgttgctcggttctaacgatctgaccgccgtgcggccactgtcttgcgacagtagcatggacgtagcccaagtgaggctggaatggcccaccgatctcgctgtgaatccgatggataattcattgtatgtgctggagaataatgtgattttgagaataacagaaaaccaccaggtgagcattatcgccggtcggccaatgcactgtcaggtcccaggaatcgattattccctgtctaaacttgcaatccactccgccctcgagagtgcctccgctatagccatcagtcataccggtgtgctgtacatcaccgagaccgatgagaagaagataaaccgattgagacaagtaacaactaatggtgaaatctgcttgttagctggcgctgcgtccgattgtgattgcaaaaatgacgtcaactgtaactgctactctggtgacgacgcctatgcaactgatgcgatcctgaattctcctagttctcttgctgtcgcacccgacggaaccatatacatagccgatctggggaacatacgaattagagccgtttctaagaataagccagtgctcaacgctttcaatcaatacgaggcggcatcgccaggggaacaagaattgtatgtcttcaatgccgacggaatccaccagtataccgtttcactggtgactggagaatatttatacaattttacctactccacagataacgatgtgacagaactcattgacaataatggcaactccttaaaaatccggagggatagcagtgggatgcctcgacacctgttgatgcccgacaaccagatcattactcttaccgtcggaaccaatggcggactcaaagtagtatctacacagaacctggagctcggactgatgacctatgatggcaacaccgggcttctggcaaccaaatcagatgagaccggatggacaacgttctacgactatgaccacgaggggcgactgacaaacgtcacccgtccgaccggagttgtgactagcttgcaccgcgaaatggagaagtccatcaccattgacatcgagaatagcaaccgcgacgacgatgtgacggtcattacgaacttgagcagcgtagaggctagctacaccgtggtgcaggaccaggtgcgcaacagctaccagctgtgcaataatggcaccctgcgcgtcatgtacgccaatggaatgggaatcagctttcattcagagccgcacgtgctggccggaaccatcacacctacaattggacggtgtaatatctccctcccgatggaaaatggactcaactctatcgagtggaggctgcgaaaggagcagattaaggggaaggtaaccatcttcggtcgaaagcttcgggttcacggacgcaatctcttaagtattgattatgatcgaaacattaggaccgagaagatctacgacgatcatagaaaattcacccttaggattatctacgatcaggtgggtcggccattcttgtggctcccttcttcaggcctggcagcggtcaacgtttcctatttcttcaatggaaggctggcgggattgcagagaggagcaatgagcgaacggactgatattgataagcaggggaggatcgttagccggatgttcgccgatggaaaggtgtggtcatactcctaccttgacaagtccatggtactactgctacagagccaacggcagtacatttttgaatatgactcatccgatcggttactcgccgtaacaatgccaagcgtggccagacactcaatgtctacccatacgagtatcggctatatcagaaacatctacaacccgccagagagcaatgcatcagtgatcttcgactacagtgacgacggacgcattctgaaaacctctttcttggggaccggcagacaggttttttataagtatggaaaactgagcaaactatccgaaatcgtgtacgactctactgctgtgacgtttggctatgacgagacaaccggcgttctgaagatggtcaacctgcagtctggtggtttctcctgtacgattagataccgcaaaatcggcccactagtggataagcaaatctatagattctccgaagagggtatggtgaatgctaggttcgactacacgtaccacgacaatagcttccggatcgccagtatcaaacccgtaatttcggagacacccctgcctgtagatctgtataggtacgatgagatcagcggcaaggtcgaacatttcggcaagtttggcgtcatatactacgacattaatcagattataaccaccgccgtgatgacactcagcaagcacttcgatacccacgggcgaatcaaagaagtgcagtatgaaatgttccggtcactcatgtattggatgacagtgcaatatgatagtatgggacgggtcatcaagcgggaactgaagctcgggccttatgctaatactaccaaatatacgtacgactatgatggtgacgggcaactgcagtctgtcgccgtgaacgaccgccctacctggcgctactcctacgatctgaacggtaatctgcatctgctgaaccccggtaactccgtaagactaatgcctttgagatatgatctgagagatcggattacccgcctgggggatgtccaatacaagattgacgacgacggatacctctgtcagaggggttcagatatattcgagtacaacagtaagggactgctgaccagggcgtacaacaaggcatccgggtggtctgtgcaataccgatatgatggcgtcggccgtcgggcaagctacaagacaaatcttgggcatcacttgcagtatttctattccgacttacacaatcccacccggatcactcatgtctacaatcactctaactctgagataacctcactctattatgacctccagggtcacttatttgcaatggagagcagctccggtgaggagtactacgtagcttcagataacaccgggacccctctcgcagtcttctccattaacgggctgatgatcaaacaactccagtacacggcatatggtgagatttattatgattccaacccagatttccagatggtgattggtttccatggagggctctatgatccacttacaaaactcgtgcacttcactcaacgggactacgacgtactcgccggacgatggacttccccggactacaccatgtggaaaaacgttggcaaagagccagctccatttaatctatatatgttcaagtctaacaaccctttaagcagtgaattagacttaaagaattacgtcaccgacgtgaaatcctggctagtgatgttcggattccagctgtctaacataattcctgggttcccacgggctaagatgtacttcgtgccacctccctatgaacttagtgagagccaggcttccgaaaatggccagctgatcacaggagtccaacagacaactgagagacataatcaggccttcatggccctcgagggacaagtcatcaccaaaaagctgcatgccagtatacgggagaaagcagggcattggttcgccactactacacccatcatagggaaggggataatgttcgctatcaaagaagggcgagtgacaacgggcgtttccagtatcgctagcgaagactcccgcaaggtggcttctgtccttaacaatgcatattacttggataagatgcattacagcatcgaagggaaggatactcactactttgtaaaaattggatctgccgacggggatctggtcacactgggcacaaccattgggaggaaggtccttgagtcaggtgtgaatgtgaccgtgtcacagcctaccttactggttaatggacggacgaggcgattcaccaatattgaattccagtacagtacgctcctgctgtcaatacgatatggcctgacccccgatactctggacgaggagaaggccagggtgctcgaccaggcaagacagcgagctttgggaactgcctgggctaaggagcagcagaaggcaagggacggccgtgaggggtccaggctgtggaccgagggcgagaagcagcaattgctttctacggggcgtgttcagggctatgaaggttactacgttctgcccgtagagcaatatcctgagctggcagattcttcttccaacatccagttcctcaggcaaaacgagatgggcaaaaggta

SEQ ID NO: 52113 - DNA, 8324 bp, Artificial Sequence
  Description of Artificial Sequence: Synthetic coding sequence
atggacgtgaaagaccggaggcaccgatctcttaccaggggcaggtgtggaaaagaatgccggtacacttcctcatcccttgattccgaagactgtagggtgcctacgcagaagtcttacagcagtagcgagacactgaaagcatacgaccacgacagcagaatgcattatgggaaccgagtgaccgatctcattcatcgggaaagcgacgagttccccagacagggaacaaattttaccctggctgaactgggtatttgcgaaccaagccctcataggtccggatactgctccgatatggggatccttcaccaaggctactctttatctacagggtctgacgcagacagtgacaccgagggcggaatgagtcccgagcatgccatccggctgtggggcaggggcattaagagcagaaggtcctcagggctatctagcagggaaaactctgctctcaccttaacagattccgacaatgagaataaatcagatgacgagaacggcaggcccatcccgcctactagctccccttcgcttctgccatccgcgcagctcccgtcctctcataacccgcctcctgtctcctgccagatgccactgctggacagtaatacatcccaccaaatcatggataccaatccagatgaggagtttagtcctaactcgtacctgcttcgagcctgctcgggtccgcagcaggccagtagcagcggccctccaaaccaccactctcaatccacactcaggccacccttacctccgccacacaaccataccctgtcccatcaccacagctcagccaacagcctgaacagaaattccctgacaaatcgaagaagtcaaatacacgcccctgccccagccccaaacgacctcgctaccacccctgagtctgtccagcttcaggactcttgggtgctgaattccaatgtccccctggagaccaggcattttcttttcaaaaccagtagcggaagtacacccctattcagctcaagctctccagggtatccactgactagcgggaccgtttataccccaccgcctcgacttctccctagaaatacatttagccgcaaggcttttaagctcaagaagccctctaagtactgctcctggaaatgcgccgcactctcagctattgccgctgcactgttgctggccatactgctcgcctacttcattgccatgcatctgctcggcctgaactggcaacttcagcccgcagatggacacacctttaataatggaattagaacaggattgccaggcaatgacgacgtcgcaactatgccttcgggcggaaaagtgccctggagtctgaaaaacagttctatcgactctggagaggcggaggtgggacgccgagttacgcaggaagttcctcccggagtgttctggcggagccagatccacatttctcagcctcaatttctcaagtttaacatctcgctgggcaaagatgctcttttcggggtatatattcggaggggactgccgccatcccacgcgcaatatgacttcatggaaaggctcgatggaaaagagaagtggagcgtggtcgagagtccccgagagcggcgaagtatccagaccctcgtgcaaaacgaagcagtgttcgtccagtacctcgacgtgggactttggcatttggccttctacaatgatggcaaagacaaggaaatggtgtccttcaacaccgttgtcttagatagcgttcaagactgtcctagaaattgccacggcaacggggagtgtgtatctggcgtgtgtcattgctttcccggttttctgggagctgactgcgcaaaggcagcttgccccgtcttgtgttccggcaatggccagtattccaaagggacatgccagtgttattctggttggaagggtgcggagtgcgacgtccccatgaatcagtgtattgacccatcttgcggaggccacggttcgtgcatcgatggtaactgcgtgtgtagtgccggttacaaaggcgaacactgtgaggaagtagattgcttagatcccacatgcagtagccatggcgtatgtgttaatggggagtgtctgtgtagcccgggttggggaggacttaactgtgaacttgccagggtccagtgtcctgatcagtgctctggccacgggacatatttaccggatacaggattatgtagttgcgatcccaattggatgggcccagactgttcggtggaagtctgcagtgtggactgtggaacccatggagtgtgtatcggtggcgcttgtagatgcgaggaaggctggaccggcgctgcctgcgatcagagggtctgccatcctcggtgtatagagcacggcacttgtaaagacggaaagtgcgaatgccgagaaggatggaatggcgaacactgtaccattggcaggcagacagctgggacagaaacagacgggtgccccgatctttgcaatgggaatgggaggtgtactctcggtcagaatagttggcagtgtgtttgccagaccggttggaggggtccaggatgcaacgtggccatggaaacaagttgtgcagataataaggataatgaaggcgacggcctcgtagactgtctcgacccagattgttgtctgcagtctgcctgccaaaattcactgctctgccgagggagccgggaccccctcgatatcatacagcagggacagacggactggcccgcagttaagagtttttacgacagaatcaaactgttggctgggaaggattcaacccatattatccccggtgagaacccattcaattcatctttggtgagtctaataaggggacaggtcgtgacaacagacggcacccctctggtaggtgtgaatgtcagtttcgtgaagtaccccaaatacggctataccataactcgccaggatggcaccttcgatctgattgctaacggaggagcctcgctcacactgcacttcgagagggcacccttcatgagtcaggaaagaacggtctggctgccatggaacagcttctatgcaatggatactttggttatgaagactgaggagaattcaatcccttcttgtgacttgagcgggttcgtgaggcccgatcccatcatcatcagctcgcccctaagcactttcttctcagcagccccagggcagaacccaatcgtccccgagacacaggtcttacacgaagaaatcgaactgccaggctccaacgtgaagctcagatacctgagttccagaactgcgggatataagtccctgctcaaaataaccatgacgcagtctactgtgccactgaatctgattcgggtacacctgatggtcgccgtcgaggggcacctatttcagaaaagcttccaggcaagccccaatcttgcctacacctttatttgggacaagactgacgcttacggccagcgcgtttatggcttgtccgatgctgtagtgtcagtaggctttgagtatgaaacctgtccatccctgatcctctgggagaaaaggaccgcactgctgcagggtttcgaactagatcccagcaacctggggggttggagcctggataaacaccacattctgaacgtcaagagcggtatcctccacaaaggcactggcgaaaaccagtttttaactcagcagcctgcaatcatcacttccatcatgggaaacggacggaggcggagtatttcatgtccgagttgtaatggtttggccgaagggaacaagctgctggctccggtggccctggctgttggcattgatggaagcttgtatgtgggtgactttaattatatccggagaatcttcccgtcacgaaatgtgactagcatacttgagctccgcaataaggaatttaaacattcaaataacccagcccacaagtactaccttgccgtagaccccgtgtcaggaagcctttatgtcagcgacacgaactcacgcagaatctacagagttaaatctctgagtggcacaaaagacttggcgggaaattccgaagtggtggccggtacgggcgagcagtgtttgccgttcgacgaagcaaggtgtggcgacggcggtaaggccatcgacgctacattgatgtcacctcgcggaatagcagttgacaagaatggactcatgtatttcgtcgacgctaccatgattaggaaagttgaccagaatggaattatatcgacccttctagggtctaatgatcttactgccgttagacccttaagctgtgatagctcaatggacgttgcccaggttagattggaatggcctaccgatctagcggtcaaccctatggataactccctctacgttctggagaacaacgtcatcctaagaatcaccgaaaatcaccaggtctctattatcgccggtagacctatgcactgccaggtgcccggaatcgactatagtctcagcaagctcgccattcactcagccctggaaagtgcctcagcaatagcaatatcccataccggcgtcctttatataaccgaaaccgacgaaaaaaaaattaacaggttacggcaagtcactactaacggcgagatatgcctgttagccggtgcggcatccgactgtgattgtaagaacgatgtgaactgtaattgctactctggagatgacgcatacgccacagatgctatccttaactccccttcaagccttgctgtagccccagatgggacaatttacatagccgatttaggaaatattcgcattagggctgtgagcaagaataaaccagtcctaaatgcgttcaatcaatatgaggccgcatcccccggagagcaagagctctatgtattcaacgctgacggaatccatcagtacactgtgtcactcgtcaccggtgagtacctgtataacttcacatactctaccgacaacgatgtcacagagcttatagacaataatggcaattcgctcaagatccgacgggacagcagtggtatgcctcgacacctgctgatgccagataatcaaatcataactctgaccgtcggaacaaatggtggcctgaaggtggttagtacccaaaatttagagctgggactcatgacttacgacggaaatactggcctgctcgccacaaaatcagatgagaccggatggactaccttctacgactatgaccacgagggtagattaaccaacgtcacaaggcccactggggttgtgacctctttacatcgcgagatggaaaagtccattaccatcgacatagagaactccaatagggatgacgacgtgacagtaattacgaatctaagctcagttgaagccagttacactgtcgtccaagatcaggtgcggaactcttaccaattgtgtaacaacgggacactgagggtgatgtatgctaatggaatggggatctcattccactccgaacctcacgtgctcgccggaaccatcaccccaactattggcagatgcaacatcagcctccctatggaaaacgggctcaactcaatagaatggcggttgagaaaagagcagattaagggcaaagtgaccatcttcgggcgaaaactgcgagtccatggcaggaacctgttgtcaatcgattacgatagaaatatccggaccgagaagatctatgatgatcatcgcaaatttaccctaagaattatttatgaccaggtaggacggcctttcttgtggctgccgagctctggtttggccgctgtcaatgttagctattttttcaacggaagactggcagggttacagaggggtgctatgagtgaaaggaccgacattgataagcagggaaggatcgtctctagaatgttcgctgacggtaaggtctggtcctatagctatctggacaagagcatggtcctgctgctccaaagccagcggcagtatatctttgagtatgattccagcgatagactgctcgcagttacaatgcccagtgtcgccagacattcaatgtccacacatacgtcaatcggttatattcgaaacatctataacccccctgagtctaacgcttcagtcatctttgattactctgatgacggacgcatcctgaagacatctttcctgggcacagggcgacaagtgttctataagtatgggaaactcagcaaactgagcgagatcgtctatgattctaccgccgtcactttcggctatgatgagacaaccggcgtgctgaagatggttaatctgcaatctggtggcttttcatgtaccattagataccggaagatcggtcccctggtggacaagcagatttatcgcttctctgaagaaggaatggtgaatgcaaggttcgactatacctaccatgacaattccttcaggattgcttctatcaaacccgtgatctcagaaaccccactgccagtagatctgtacaggtacgacgagatatcagggaaagtcgaacatttcggaaagttcggcgtcatttactatgacatcaaccagataattacaaccgccgttatgactcttagcaagcacttcgacacccatgggaggataaaagaggtccaatatgagatgttccgctccttgatgtactggatgacagtgcagtacgactccatgggcagggtgatcaaaagagagctcaagctgggcccatacgctaataccacaaaatacacctatgactacgacggtgacgggcagctccagtccgtggccgtgaacgaccgcccaacatggcgatactcctacgacctaaacggcaatcttcatctccttaatcccggtaacagcgtgagactcatgcccctcagatatgacttgcgcgacaggatcaccagactgggcgacgtgcaatacaagattgacgacgatggctacctatgccaacgcggatctgacattttcgaatacaactctaaaggcttgctcactagagcttataacaaggcctctggttggtccgtgcagtatcggtatgatggtgtgggcaggcgggcttcctataagaccaacttggggcaccatctgcagtacttctatagtgacctgcacaaccctactagaatcacacacgtgtataatcatagcaactccgaaatcactagcttgtactacgatttgcagggccatctttttgccatggagagcagctctggcgaagagtattacgtggcaagcgacaatactggaaccccccttgcagtattctccattaacggtctgatgatcaaacagctgcaatacactgcctatggagagatctattacgactcaaacccagatttccagatggttatcgggtttcatggtggtctgtacgatccactgactaaactcgtgcacttcacacagagagactatgacgtgctggccggacgctggacctcccctgattacaccatgtggaaaaatgtcggaaaagagcctgctcctttcaatctttacatgtttaaatccaacaatccattgtcctctgaactcgatctaaaaaactacgtaacagatgtgaaatcctggttagttatgttcggattccagctttctaacatcatcccgggattccccagagcgaagatgtattttgtgccccctccttatgagctgtcagagtcacaggcttccgaaaacggacaattaatcacaggggtgcagcagacgacggagaggcacaaccaggcattcatggccttggaaggtcaggtgatcaccaaaaaactgcacgccagcattagagagaaggccggtcattggttcgcaacaaccaccccaattattggaaagggtatcatgtttgccatcaaggagggtagagtgaccacgggggtgagtagcattgcatcagaagattccagaaaagttgcatctgtcctgaacaatgcgtactacttagacaagatgcattattcaatcgagggaaaggacactcattatttcgtgaaaattgggtctgctgatggtgatctggtcaccctgggcactacgatagggcgtaaggtgctggaaagcggcgtgaatgtgacagtgagtcagcctacgcttctcgtcaacggtaggactcgcaggttcacaaatatcgagtttcagtactctaccctactgctgagcattagatacggtctcactccggacaccctcgacgaggaaaaggcacgtgtgctggatcaggctcggcagcgcgctctaggcaccgcttgggccaaagagcagcagaaggctcgcgatggcagagaagggtctagattgtggactgaaggtgaaaaacagcagctgttatccactggtagagtgcagggctatgaaggctattatgtactccctgttgagcagtacccggaactggccgatagtagctcgaatatccaatttctgcgtcagaacgagatgggcaagcgcta

SEQ ID NO: 52114 - DNA, 8321 bp, Artificial Sequence
  Description of Artificial Sequence: Synthetic coding sequence
atggacgttaaggatcgaaggcaccgctctctgactcggggacggtgcggtaaggagtgccgctacacatccagctccctggactccgaggactgccgagttccaacacagaaaagctactccagctccgaaacactaaaagcgtacgaccacgactcaagaatgcattacggcaatagagtgactgacctcatccatcgtgaatctgatgagttcccccgtcaggggacaaacttcaccctagcggagttaggaatttgtgagccttctccccaccgctcgggttactgttctgacatgggcatactgcatcagggctactcgctgtccacaggctccgacgcagattctgacacggaaggaggcatgtcgcccgagcatgctattcgactttggggcagaggtattaaaagcagaagatctagtgggttgagcagtcgtgagaattcagccctcactctgaccgactccgacaatgagaacaagagcgatgacgaaaacggtcgacctattcctcccaccagtagccccagtctgctgcccagcgcacagcttccatcgtcacacaaccctcccccagtgtcctgtcaaatgccgctgctggattcaaacaccagccatcagatcatggacactaacccggacgaagagttttcacctaattcctacctcctgcgagcctgctccgggccacaacaagccagtagttccgggccaccgaatcatcactcacagtcaactctacgaccgcctctccctcctccccataaccacacactctcccatcatcatagtagcgcgaactcattgaaccgaaatagcctgacaaataggaggagccagattcacgcaccagcccctgcaccaaacgacctcgccactactccagaatccgttcagctgcaggactcctgggttctgaactcaaatgtgcccctggagacacggcattttcttttcaaaacatccagtggatcgacgcctttgttctccagttcctctcccggatatcccctcacgtctgggaccgtctataccccaccgccacgattactgccgcgaaatactttctctcgcaaggcctttaaactgaaaaaaccttcgaagtattgtagctggaagtgcgctgcgttgtctgcgatcgctgctgcgctgctgctggccattctgctggcgtatttcatcgccatgcatctgttaggattgaattggcaactccagcccgctgacgggcataccttcaataatgggataagaacaggtctgcctggtaatgatgatgtggctaccatgccatcagggggtaaagtgccctggagtttgaaaaattcttctatagatagtggagaggccgaggtcggccgtcgggtcacccaggaggtcccacctggtgtcttctggaggagccagattcacattagccagccgcagtttttgaaattcaatatctctctgggcaaagatgccttgtttggagtgtatatacggaggggtttgcctccgtctcacgctcagtacgactttatggaaagactggacggcaaagaaaagtggagcgtggtggagagtccccgagaacgtcggagcatccagacactggttcagaacgaggccgttttcgtccagtatctggacgtgggcctgtggcatctggctttttataacgatggcaaagacaaagaaatggtttcgtttaataccgtcgtgctggacagcgtccaggattgtcccagaaattgtcacggcaatggtgaatgtgtcagcggagtttgtcattgtttccccggatttctcggcgcagattgcgcaaaagcagcttgtcccgtgttgtgctcaggaaatgggcagtatagtaagggaacctgccagtgttattctggctggaagggcgctgaatgcgacgtgcccatgaatcaatgcatagatccaagctgtggcggtcacgggtcttgcatcgacggcaactgtgtctgctcagctggatacaaaggggaacattgtgaggaagtggattgtttggatcccacatgttctagtcacggggtctgtgttaacggcgaatgcctgtgttcacccggatggggtggcttgaactgcgagcttgcccgagtccagtgcccggaccagtgctccgggcacggtacatacctgccagacaccggtctctgcagctgcgaccctaattggatggggcctgattgtagcgtggaagtatgttcagtggactgtggaactcatggtgtgtgcatagggggtgcatgccgatgtgaggagggctggacgggggctgcctgcgatcaaagagtgtgccaccccaggtgtattgagcatgggacatgcaaagacggtaagtgcgaatgccgtgaaggatggaacggagagcattgcaccattgtgcgcgaaacgatcggtggagagtgctacgggtgtccagacctatgtaacggtaacggaagatgtaccctgggccagaactcttggcagtgtgtgtgccaaacgggatggagaggcccagggtgcaatgtggcaatggaaacaagctgtgcggacaacaaagacaacgagggggacggactcgtagattgcctggatcctgattgctgtctgcaaagcgcatgtcagaatagtctgctctgcaggggcagtcgggatccactcgatatcatccagcaaggtcagaccgactggcccgctgtgaaatcattttatgacagaattaaactgttggcgggaaaagactcaacgcacattatccccggagagaacccttttaactccagcctggtgtctctcattcgcggacaggtggtgactaccgatggcactcctctggtgggcgtgaacgtcagctttgttaaatatcccaaatatggttacactatcacccgacaggacggcaccttcgatcttatcgctaatggaggagccagtctgactttgcatttcgaacgggctccatttatgtctcaagagcgaactgtgtggctgccctggaactccttctacgctatggacacactggtcatgaaaacagaagagaatagcattccttcgtgcgaccttagtggcttcgtccggcctgatcccattatcatctcaagccccttatctactttcttttccgctgcccctggtcaaaatccaatagtgcctgagacacaggtgctccacgaagaaatagagctgcctggttcaaacgttaaactgcgctacctaagcagccgtacagcagggtacaagagcttactgaaaatcacaatgacccaaagcacagtccccctgaacctgataagggttcacctcatggtggctgttgagggccatcttttccagaagtcctttcaagcaagcccgaatctggcttatacgttcatttgggacaagacagatgcctacggccagagagtttacggccttagtgacgcagtcgtgtccgttggatttgagtacgaaacatgccctagcctgatactttgggaaaaaaggacagccctcctccagggctttgagctcgacccctctaatttgggaggatggtcccttgacaagcatcatatcctgaacgtgaagtcgggtatcctacataagggcaccggagagaatcagttcctaacgcaacagcccgcaatcattactagtatcatgggtaatggccgaagacggtcaatttcctgtccctcgtgcaacggtttagccgagggaaacaaactcttagcccctgtagccctggccgtgggtattgacggctctttgtacgtgggtgattttaattatattcggaggatctttccctcaaggaacgtgacgtccatccttgaactgagaaacaaagaattccacaacaacaatcccgctcacaagtactatctggcagtggatcctgtgtcaggctctctctacgtgagcgacactaatagccgacgcatatacagggtcaaaagtctcagtgggactaaagatctggcaggcaactccgaggtggtggccggaaccggagagcaatgcctcccgtttgacgaggcccgttgtggagatggcggtaaagctattgatgcaacactgatgtcccctagggggattgcagtggataaaaatggcctgatgtatttcgtagacgcaaccatgattagaaaagtcgatcaaaacggtatcattagcacactgctgggcagcaatgacttgacagcagtacgccctctctcatgcgattccagcatggacgtggcccaggtcaggctggagtggccaactgatctggctgtcaacccaatggataactcgctatatgtgcttgagaataatgttattctgagaataactgagaatcatcaagtcagcattattgctggcagacctatgcattgtcaggtgccaggtattgactactcgttgagtaaacttgccattcatagcgccctggagtccgcaagcgcaatcgccatctcccataccggggtgctgtacattaccgagacagacgagaagaagattaatcggttgaggcaggtgaccacgaatggagaaatttgtttactagccggtgctgcatctgattgcgactgcaaaaatgacgtgaattgcaattgctattccggggatgacgcatacgctaccgacgctattctgaactcaccaagctcccttgccgtggcccctgatggtacaatctacatcgcagacctgggcaacattagaattcgggcagtgagcaaaaataagccagttctcaacgcatttaatcagtacgaagctgctagcccaggagaacaagaactgtacgtgttcaacgcagacggcatccaccagtacactgtgtcactcgtcaccggggaatatctgtataacttcacatactctacagataacgacgtgactgaactaatagataacaatggaaacagcctgaagatccgtagggactcttcaggtatgcccaggcatttgttaatgcctgacaaccagatcattacactcacagtaggcacaaacggaggacttaaggttgtcagcacccagaatctcgagcttggcctgatgacatatgatggcaataccgggctgctcgcaaccaagtctgacgagaccggctggactacattctacgattatgatcacgaaggacggctcactaatgtgacccgtccaaccggagtcgttacctccctccaccgcgaaatggaaaagagtattactatcgacatcgagaattcgaacagagatgacgatgtgactgtaataactaatttaagctcagtggaggcttcttacaccgttgtgcaggaccaggttcggaatagctatcagctgtgcaacaacggtacactacgggtcatgtatgccaacgggatgggaatttcatttcactccgagccacatgttttggccggaaccatcacccctaccattggcagatgtaacatcagtctaccgatggagaatggcttaaacagtatagagtggagactccgtaaagagcaaatcaagggaaaggtcacaatttttggtaggaaactgcgagtgcacggcagaaacctactctcaatcgattacgaccggaacatacggaccgaaaaaatttatgatgatcacagaaagttcacacttcgtatcatttatgatcaagtgggccgtcctttcctttggctcccctcttcaggtctcgctgcagtaaatgtgagttactttttcaatggaaggctggcaggcctacagcgcggagccatgtctgaacgcacagatatagacaaacaggggcgaattgtgagccggatgttcgccgatgggaaagtgtggagctacagctacctggacaagtctatggtgctgctgctacaaagccaaagacagtatatttttgagtacgatagctcggaccgattgcttgccgtaaccatgccctccgtggcgcgacattctatgtccacccatacctcgattgggtatatcaggaacatctacaatccccctgagagtaacgcctcagtgatttttgattactctgatgacggccgaattctgaaaacatcttttttagggacaggaagacaggtattctataaatacggcaaactgagtaaattaagtgaaatcgtctacgatagtaccgcagttacctttggatacgacgaaacaaccggcgtgcttaaaatggtgaatctgcagtccggcggttttagttgtaccattcgatataggaagattggtcccctcgtggataaacagatctataggttctcagaagaaggtatggtcaacgcgagattcgactatacataccatgataatagctttcgaattgcatctatcaagcccgtgataagcgaaactcctctccccgtggacctataccggtatgatgagatatccggcaaagtcgaacactttggcaaattcggcgttatctattacgacataaaccagataatcaccactgctgtcatgaccctctccaagcacttcgatactcatggacggatcaaagaggtgcagtacgagatgttcaggtctctcatgtattggatgacagtgcagtacgatagtatgggtcgcgtgattaagagagaattgaagctgggaccttacgctaacactaccaagtacacatacgattatgatggagatgggcagctccaatcggttgcagtcaatgaccgccctacgtggcgctactcttacgacctgaacggtaatctgcacctgctgaatcccggaaattccgttagactgatgcccctgcgttatgatctgagggaccgcataacaagactgggagacgtacagtacaagattgacgatgatggctacttatgccagcgaggctcagatattttcgaatacaattctaagggcctgctgacccgggcatataataaggcatccgggtggtctgtgcagtatcgttacgatggcgtaggacggagggctagctataagaccaatctgggccaccacttgcaatatttctactcggacctccataaccccactaggattacacacgtttacaatcacagtaatagcgaaataacatctctgtattacgacctacagggacacctgttcgccatggagtcttcgagcggggaggagtactatgtcgctagtgacaacaccggcaccccgctcgcagtatttagtatcaatggccttatgataaaacagttgcagtataccgcatatggggagatctattatgatagcaaccctgattttcagatggtgattggtttccacggaggtctgtatgacccactcactaaactggttcattttacccaaagagactatgatgttctggctgggagatggacctctcccgattataccatgtggaaaaacgttggtaaagagcccgcacccttcaatctctacatgttcaaatcaaataatcctctgagcagtgaacttgatctgaagaactatgtgaccgacgtgaagagctggctggttatgtttggctttcagctcagcaatatcatcccgggtttccctagagcgaagatgtacttcgtgccaccaccttatgagctgtccgaaagccaggccagtgaaaacggccagttaatcaccggggtgcagcagacaacagaacggcacaatcaagcattcatggcgttggaaggacaggtgattacaaagaagctgcatgccagcatcagagaaaaggccggtcactggtttgccacgactactcccatcataggcaaaggcataatgttcgccatcaaggaaggacgggttaccacaggtgtttcatccattgcaagcgaggacagcagaaaggtggccagcgtgttgaataacgcgtactacttagacaagatgcactattctatagagggcaaggatacgcactacttcgtaaagatcgggtccgctgatggggatctcgttaccctgggcaccacgatcgggcgaaaggtgcttgagagtggcgtcaatgttacagttagccagcctacgttgctggtaaatggccgtactagacggttcacaaacatcgaatttcagtacagcactctattactcagtatcaggtatggcctgaccccagacaccctcgacgaagaaaaagcccgtgtgttggaccaggctaggcagagggcacttggcacagcctgggctaaggaacagcagaaagctagggatggcagagagggcagccggctttggaccgagggggaaaagcagcagttgcttagcactggcagggtgcagggttacgagggctattatgtactcccagtcgagcagtatccagagctggcagatagttcctctaacattcaattcctgcgtcagaatgagatggggaaacgcta

SEQ ID NO: 52115 - DNA, 8099 bp, Artificial Sequence
  Description of Artificial Sequence: Synthetic coding sequence
atggatgtgaaggagcgtcggccatattgcagtctgaccaagtcacggagggaaaaggaacgcaggtataccaactctagtgctgataacgaagagtgccgcgttccaacccagaaatcatactcgtcaagtgaaacattgaaggcctttgaccacgactcctctcgccttctatatggcaaccgtgtcaaggacctggtacatcgcgaggctgacgagtttacaaggcaaggccagaattttaccctgcggcagttgggcgtgtgcgagccggctacacggagaggactggctttttgtgccgagatgggtctcccccaccgcggttactctatttccgccggatcagacgcagacacagagaacgaagcagttatgagtcctgagcatgccatgcggttgtggggccgaggggtcaagagcgggagaagtagttgcctctcttcaaggtcaaattccgccctaactctcacggacaccgagcacgaaaacaagtcagatagcgaaaatgagcagccggcatccaaccagggtcagtccactcttcagcccctgcctcccagccacaaacagcatagcgctcagcaccatccctctataacgtccctgaaccgaaacagcttaactaatcgtagaaaccagagccccgcaccacccgctgccttgccagccgaacttcagacgaccccagaaagcgtgcagctacaagacagctgggtccttggatcgaatgtacccctcgaaagtagacattttctgttcaagacaggtactgggacaacccccctgttcagtactgcgacgccaggatacacaatggcctccggctcagtgtatagtccccctaccagaccactgccacgtaatactctttctaggtcagcattcaagttcaagaagtcctcaaagtactgttcatggaagtgcaccgcactctgcgctgtaggcgtgtctgtccttctggccatcctcctcagttattttattgcgatgcacctcttcggacttaactggcaattacagcaaacggagaacgatacatttgagaatggtaaggtgaactctgacacaatgcctaccaatacagtctcccttccttctggcgataacgggaagctggggggatttactcaggagaataacactatcgattccggcgagttggacatcgggagaagagctatccaggaaatccctccaggtatcttctggcggtcgcaactgtttatcgaccagccccagtttctgaaattcaatatctctctgcagaaggatgccctgatcggcgtgtatggcaggaagggcttgcctccttcccacacgcagtatgactttgtcgaattactggacggttctcgattaattgctcgcgagcagaggtcgctcctggaaacagagcgcgcaggacgccaggccaggtccgtctccctccacgaggccggattcatacaatatttggacagcggcatttggcatttggccttttacaatgatggtaaaaacgcagagcaggtgagtttcaatacaatcgtcattgagtccgtggtggaatgtccgcgaaattgccacgggaacggcgaatgtgtcagtggcacatgccactgctttcccggatttctgggccctgattgctcacgcgctgcttgccccgtgctctgcagcggaaacggacaatattccaaggggaggtgcctttgcttctcaggctggaaagggacagagtgcgacgtgcccaccacccagtgcatcgaccctcaatgtggcggaaggggcatctgcattatgggttcatgcgcatgcaacagcggctacaaaggggagagttgcgaggaggcagactgcattgatcctgggtgctctaaccatggagtctgcatccacggcgagtgccactgttccccaggctggggaggctccaattgtgagatcctgaaaactatgtgcccagaccagtgctcgggccatgggacttacctgcaagaaagcggctcttgcacttgtgaccccaactggacggggcctgattgctcaaacgagatctgctcagtagattgcggcagccacggggtctgcatgggtggaacctgtcggtgtgaggaggggtggaccggtccggcttgtaatcagagggcctgccacccacggtgtgcagaacacggcacctgcaaggatgggaaatgtgaatgctcccaggggtggaacggagaacactgcacaatcgaaggttgtcccggtctctgcaattctaacggtcgctgcacgctcgatcagaacggctggcactgtgtctgccagcctggatggcggggagctggttgcgatgtggccatggagacactttgcacggacagcaaggataacgagggggatggcctcatcgactgtatggacccagactgttgtctccagagctcatgccaaaaccagccctactgccgcggattgcctgacccgcaagacatcataagtcaaagcctccagtctcccagtcaacaagcggcaaagtccttctatgatcgaatttctttcctaataggatccgatagcacgcacgtgattcccggtgagtcccctttcaacaaatccctggcctcagttatccgcggacaagtccttaccgcagacggaacgcctctgattggagtgaacgtatccttcttccattatcccgagtacggctacaccattacaaggcaggacgggatgttcgatttagtagcgaatggcggagcctctttgaccctggtgttcgagcgtagtccattccttacacagtaccatacagtgtggatcccttggaacgtgttctatgtgatggacaccctcgtgatgaagaaagaggagaatgatatccctagttgcgatttgtccggattcgtgagacccaaccccatcattgtatccagccctcttagcacattttttcggtcttcgcctgaggacagcccaataatccccgaaacccaggtgcttcacgaggaaactacgattccgggaaccgatctcaaactgtcatatctctcgtcccgggctgctggatataaaagcgtcctcaaaataacgatgacacagagtatcattccattcaacctcatgaaagtccacctaatggtcgctgtggtgggccgtttgttccagaagtggtttccagccagtccaaatctcgcctacaccttcatatgggacaagactgatgcttacaaccagaaagtgtatggtttgtcagaagcagtggtgtcagtgggctacgagtacgagagttgtctagacctgactctgtgggagaagaggacagctatattgcagggatatgagctggacgcctctaacatggggggatggacactcgacaagcatcacgtcctcgacgtgcaaaacgggatcctgtacaaaggaaacggcgagaatcagttcataagccagcaaccacccgttgtaagctctatcatgggaaatggtaggcggcgaagcatatcgtgcccaagctgtaacggtcaggcagatgggaacaaactgttggcccctgtcgccctagcttgtgggattgacgggtcactgtatgtgggcgactttaactacgttcggagaatctttccctctggaaatgtgactagcgtgctcgagttatctagtaatccagctcacagatactacttggccaccgacccagtgactggcgatctgtatgtgagcgataccaatacgcgacggatataccggcctaaaagcctgactggcgctaaagatcttacaaaaaatgctgaggttgtagccggaactggtgaacagtgcttaccgtttgacgaggctcgttgtggtgatggcggaaaagcagtggaagctacactcatgtccccaaagggaatggccgtggataaaaacggtttgatatacttcgtcgacgggacgatgatcagaaaggtggaccagaacgggattatctccacacttttaggatcaaatgacctgacctcagccaggccactgacctgtgacaccagcatgcacatctctcaggtccggcttgaatggcccacagacctggccatcaaccccatggacaatagcatatatgtcctggataacaatgtggtcctgcagatcactgaaaatcgacaggtgcgcattgcagctggtcggcctatgcactgtcaggttccgggtgtcgaataccctgttgggaagcatgctgtgcagactactctggaatctgctactgcgatcgcagtctcttacagcggagtgctgtatatcaccgaaaccgacgagaagaaaatcaaccgcatacgacaggttactacagatggcgaaatctctctagttgccggaatcccgagtgaatgcgactgtaagaatgacgcaaattgcgattgctatcagagtggggatggttatgcgaaagatgcaaagctgagtgcgccttcgagccttgctgcatcaccagacggcacgttatatatcgccgacctggggaatatccggattcgagccgtatccaagaataaacccctcctcaattcaatgaatttttacgaagtcgccagtccaacggaccaggaactgtatatctttgatatcaacggcacacaccaatacaccgtcagtctggtgaccggcgactacttgtacaacttctcctattctaatgataacgatatcaccgccgtaaccgactccaacggcaacacactaaggatccgccgtgacccaaataggatgccggtccgtgtggtgtctcccgacaatcaggtgatttggctgactatcgggaccaatggttgtttgaagagcatgactgctcaagggcttgagctcgtgctgttcacctaccacgggaattctggtctgctcgctactaagagtgatgaaacgggttggaccacattcttcgactacgattccgaagggaggctcacaaacgttacctttcctaccggcgtggttaccaacctccatggtgacatggataaagccattaccgtggatatcgagagcagcagcagagaggaggatgtgagtatcacgagtaatctcagctcaatcgatagcttctatacaatggtgcaggatcagctacgaaactcctatcaaatcggctatgacggaagccttcgtattatctacgcctcagggcttgactcacactaccagacggaaccacatgtcctggccggaactgcgaaccctacagtggccaagcggaacatgacgctccccggtgagaatggtcagaatttagtcgaatggcggttcaggaaggaacaagctcaggggaaggttaatgtctttggccgaaagctgagggtgaatgggaggaacctgttgagcgtggatttcgataggacaacaaaaactgaaaagatctacgacgatcaccgtaaattcttactccgaatcgcctatgataccagcggacatcctaccctctggctgccctcctccaaattgatggccgttaacgtgacctactcgagcaccgggcagatcgcttcgattcagcggggaactactagcgagaaggtcgactacgatggtcagggcaggatcgtgagccgggtctttgcagacggtaaaacgtggagctatacttatttggagaaaagcatggtgctccttttgcattcacaaaggcaatatatattcgagtatgacatgtgggatagactgtctgccatcactatgccgtccgtggctcgacatactatgcagactatccgatccattggatattacagaaatatctataaccctcctgaaagcaacgcttctattatcacagattataatgaagaggggcttcttttacagacagccttcctcggcacctccaggagggtactatttaaataccgtcgtcagactcgcctgtcagagattctatatgactctactagagtctcctttacttacgacgaaacagctggggtgctaaagacagtcaatctgcaatccgatggcttcatctgtactattcggtataggcagattggccctctgattgacaggcagattttcaggttctcagaggatggcatggtcaacgcccgttttgactactcctatgacaacagctttagagtcacaagcatgcaaggtgtcattaacgagacaccgctgcccattgacttgtaccagtttgatgatatatctgggaaagtagagcagttcggcaaatttggggtcatttactacgatatcaaccagatcatctcaacggccgtcatgacttacacaaaacatttcgacgcacacgggagaatcaaggagatccagtacgagatcttcaggtctctcatgtactggattactatccagtacgacaatatgggcagagtgacaaagagagagattaagattggaccctttgcaaatactactaagtatgcttacgagtacgatgtggatgggcagctgcagaccgtatatctgaacgaaaagataatgtggcggtataactacgatttgaacggcaacctgcacctgcttaatccgagcaactctgccagattaacccctttgaggtatgacctccgcgaccgcatcacgagattaggtgatgtccagtacagactggacgaggatgggttcttgagacagagaggtactgaaattttcgaatatagctctaagggcctgctgacccgcgtgtattcaaagggatccggctggaccgtgatctacagatacgacggcttggggaggcgcgtgtcctccaagacttccctggggcagcatctgcagttcttctacgcagacttgacataccccacaagaatcacgcatgtgtacaaccactcatctagcgagatcactagcctctactacgacctccagggacacctgtttgctatggaaatcagctccggcgacgagttctatatcgcttccgataatactggcacgcctctggccgttttttctagcaatggtttgatgcttaagcaaattcagtatactgcatacggtgagatttatttcgattcaaacatagattttcagctggtcatcggtttccatggcggactttacgatccccttacgaagctgattcacttcggcgagagagactacgacatccttgcgggtcgctggactaccccggatattgaaatctggaagaggatcgggaaagaccccgctccattcaatctctatatgtttagaaataacaacccggcaagtaagatccatgacgtcaaggattatatcacggatgtcaactcatggctcgttactttcggattccatctgcacaacgccatccccggattcccggtgcccaagtttgacctcaccgaacccagctacgaattagtgaagtctcagcagtgggacgacatcccccctattttcggggtgcagcagcaggttgcgcgacaggccaaggctttcctgtctttggggaaaatggctgaggttcaagtcagccggagaagggcagggggtgcccagtcttggctatggtttgcgactgtcaagagcctaatcggaaagggcgtgatgctcgctgtgtctcaaggccgagtgcaaaccaacgttttgaatattgcaaatgaggactgtattaaggttgcggctgtccttaataacgccttctacctggaaaacctccactttactatcgagggtaaggatacccactacttcatcaaaaccacaacccccgaaagcgacttggggacactgagattgactagcggaaggaaagcccttgagaatgggatcaacgtcactgtctcacagtcaactactgtggtcaatggtcggactcgaagatttgccgatgtggagatgcagttcggtgctttagcactgcacgtcagatatgggatgactcttgatgaggaaaaggctcggattctggagcaagcaagacaacgggctcttgccagagcctgggctcgtgaacagcaaagggtccgtgacggagaggagggagctcggctttggacagagggtgaaaagcggcagctcctgtctgcagggaaggtgcagggctacgatggctattatgtgttgtcagtggagcagtatcctgagctggccgattcagccaataatattcagtttctgagacagtcagaaatcggcaggagata

SEQ ID NO: 52116 - DNA, 8099 bp, Artificial Sequence
  Description of Artificial Sequence: Synthetic coding sequence
atggacgtgaaggagcggaggccttactgcagtttgaccaaatcacgccgagaaaaagaacgacggtatacaaattcctccgctgacaatgaggaatgccgggtccctacgcagaagtcgtacagcagttcggagacccttaaggcctttgaccacgattccagtcgtctcctctacggcaatagggtcaaagaccttgttcaccgcgaggcagatgaatttacaaggcagggccagaatttcacactccggcagctgggggtatgtgagcccgcaactcggaggggattagctttctgcgcggaaatgggacttccgcatagggggtacagcataagcgccggaagcgacgcagacacagaaaatgaagctgtgatgtcacctgagcacgcaatgagactctggggtagaggtgtcaaaagtgggcgaagctcatgtttgagtagtaggtcaaatagtgctttgactcttacagatacagaacacgagaacaagtcagactcagagaacgagcagccagcaagtaaccaggggcagagcacgctgcaacccctcccccctagtcacaagcagcactccgcccagcaccatccgagcataactagcctgaataggaatagtctgacaaatcgccgtaaccagtcacctgccccacctgccgctttgccagccgagctccaaactaccccagagtctgtacagttgcaggactcctgggttctcggctccaacgttcccctggagtcacgtcattttttgttcaaaaccggaaccgggacgactcccttattttcaaccgcaacacccggatacaccatggcctctggaagtgtctactcaccacctaccagacccctgcctcggaacacattaagtcgctcagcatttaagttcaaaaagagcagcaagtattgctcctggaagtgtacagccctctgtgccgtgggcgtgagcgtcttgctcgctatcttgttaagctatttcatcgctatgcacctctttggcctcaactggcaactacagcagaccgagaatgatactttcgaaaacgggaaggtgaacagcgatactatgcccactaacacagtgtctcttccttctggtgacaacggaaagttggggggattcacccaggagaacaatacaatcgactcaggcgaactcgatatcggccgaagggctatacaagaaatccctcccggaatcttttggaggtcccaactctttatcgatcagcctcagtttttgaagttcaacatctcattgcaaaaagacgcactcataggtgtctacggaagaaagggactgccacctagtcatacccagtatgatttcgtagagctgctcgatgggagtagactgattgcccgtgaacagcgctcactgttggaaacagagcgcgcaggcagacaggctagatccgtgagcctgcacgaagcaggatttatacagtacctcgatagcggaatatggcatctggctttttacaacgacgggaagaatgccgagcaggtgagtttcaatacaatcgtgattgaaagtgtcgtcgaatgccctaggaattgccacggcaacggcgaatgcgtgtctggaacgtgtcattgctttccagggttcctgggaccggactgttctagagctgcatgtccagtgctctgttcaggcaatggacagtacagcaaaggaagatgcttgtgtttctctggttggaaagggactgagtgtgatgtgcccacaacacaatgcattgaccctcaatgcggtggtaggggaatttgtattatggggtcatgcgcctgcaattccgggtataagggagagagctgcgaggaagccgattgcattgaccccggatgctccaaccacggagtgtgcatccacggggagtgtcactgctcccctggctggggcggaagcaactgcgaaatcctgaaaacaatgtgccccgaccagtgttccgggcacggcacatatctgcaggagagcgggagctgcacatgtgatcctaactggactggacctgactgttctaatgaaatttgctccgttgactgcggcagtcatggtgtgtgtatgggcggaacatgtagatgtgaagagggttggactggcccagcgtgcaatcagagggcctgtcaccccagatgcgctgagcatggaacctgtaaggacgggaaatgcgaatgttcccagggatggaatggagaacattgtacaatcgagggttgcccgggattgtgcaattccaacgggaggtgtacactggaccagaacggttggcattgcgtctgtcaacctggatggcgcggtgctggttgcgacgtggcgatggaaaccctgtgcaccgactctaaagataatgaaggggatgggcttatcgattgcatggatccagactgctgtctgcaatcttcatgccagaatcagccctattgtagggggttgccggaccctcaagatatcatctcccagtctctgcagtcacccagccagcaagctgccaagtcgttctacgacagaattagttttttgatcggaagcgactccacccacgtaatccccggagaatcccctttcaacaaaagcctggcttccgttatccgcggacaggtgctcaccgcagacggtactcccctcattggggttaacgtatcattcttccactacccagagtatggctacacaattactcggcaggatggaatgtttgatctcgtggcgaatggtggggctagcctcactctagtgttcgaacgaagtcccttcttaactcaataccatacagtatggatcccatggaatgtgttttatgtgatggataccttagtcatgaaaaaagaagagaacgatataccttcatgtgatttatcaggatttgtgaggcctaatcctattattgtgtctagccctctgtctacgttttttagatcgagccctgaggactctccaatcataccagagactcaagtgctccacgaggagaccacaataccaggtacagacctcaaactgtcctatctcagcagcagagccgcaggctataagtctgtgctgaaaatcactatgacgcagagcattatcccatttaatctaatgaaggtgcacctaatggtagccgtcgtcggaagactttttcagaagtggttccccgcttccccgaatcttgcatacacgtttatttgggataagacggatgcttataaccagaaagtttatgggctctccgaggctgtggtttctgtgggttatgagtacgagtcatgcctcgatctcacactttgggagaaacgcactgcaatcctacaggggtatgaattggatgcttctaatatgggcggatggacactggataagcaccacgttctggacgttcaaaacggcatcttatataaagggaatggagaaaaccaatttatttctcagcaacccccagttgtatcctccataatgggaaatggtcgcaggcgaagcatcagttgcccttcctgcaatggccaagcggatggcaacaaactcctagcccctgtagcattggcatgtgggattgacggcagcttatatgtaggggatttcaactacgtgcggagaatattcccctccgggaacgttacatccgtgcttgaactgagcagcaatcccgctcacaggtactatctggcaacagatccagtcactggggacctttacgtaagcgatactaatactagaaggatctaccggccaaaaagcctgactggcgctaaggacctgaccaagaatgcagaagttgtcgccggtacaggtgaacagtgcctgccatttgacgaggcaaggtgtggagacggcggaaaggcagtagaagccacacttatgtcacccaaaggcatggccgtggataaaaatggcctcatttacttcgttgacggtactatgataagaaaggttgaccagaacggaataatttcaactctgctggggagcaatgacctgacctctgctaggcctctgacctgcgacacaagcatgcacatcagccaggttagactcgagtggcccaccgatcttgccatcaatccaatggacaactctatatatgtgcttgacaataacgtggtgcttcagatcaccgagaatcgacaggtgagaattgcagcgggtcggcctatgcactgtcaggttccaggcgtggagtacccagtgggaaaacatgctgtgcagaccactctggagtcagccaccgccattgcagttagttatagcggggtgctctacattacagagacagacgaaaagaagatcaacaggattcggcaggtgacaaccgacggggaaatctcactggtcgcaggaatcccaagcgaatgcgattgcaagaacgacgccaactgtgattgctatcagtccggtgacggctacgctaaggatgcgaagctgtcagccccaagtagtttggcggctagccccgatgggacactttacatagctgatctaggcaatatcagaattagggccgtgtccaagaataaaccccttctgaattccatgaatttctacgaagtggcctctcccactgaccaggagctttatatctttgacatcaacggtacccaccagtacaccgtatcactggtcactggcgattacttgtacaacttttcatactctaacgataacgatattaccgcagtcaccgacagcaacggaaacacattaaggattcgcagagatccaaatcgaatgcctgtgagggtagtgtctcccgataatcaagtgatatggctcaccattggcaccaacggctgcctgaagagtatgacagcacagggacttgagcttgttctcttcacataccacggaaactccgggttgctggcgacaaagagcgacgaaaccggttggacgacctttttcgattacgactctgaaggtcggctcaccaacgttaccttccccacgggggtcgtgacaaatctgcacggtgacatggataaggccatcacagttgacattgaatcatccagtcgcgaggaggacgttagtatcacttccaacctgagttcaatcgatagtttttatacaatggtgcaggaccagctccggaattcttaccaaataggctacgatggcagtctcagaattatttatgcctccgggctagattcccactaccagacggagccccatgtgctcgcgggaaccgccaatcccaccgtagccaaacggaacatgaccctgccaggcgagaacggtcagaatctggtcgagtggcgattcagaaaggagcaagcccaggggaaagttaatgtgttcggcagaaaacttcgggtgaacggccgaaacctgctctctgtggactttgacagaaccactaagacagagaaaatctatgacgatcacagaaaattcctgctgcgaattgcctatgataccagtgggcaccctaccctctggctgccctcctccaagttaatggctgttaatgtgacttacagttccactggacaaatagctagcatacaacgtggaacaactagcgagaaggtggattatgatggtcagggcaggatcgtgtctcgagtctttgcggatggcaagacatggagttatacttatctagaaaagtccatggtgctcctgttgcactcccagagacaatatatctttgagtatgacatgtgggacagactctccgctataaccatgcctagcgtggcgagacacacaatgcagacaattcgcagcatcggatactatagaaacatttataacccccctgagtccaatgctagtattattactgactacaatgaggagggcctgctcttgcagacagctttcctgggcactagtcgcagggttctttttaaataccgaaggcaaacaaggttaagcgaaattctgtacgactccacgagagtgagtttcacttacgacgaaactgctggagtgctgaagaccgtcaacctgcagtcggatggcttcatatgtacaattcggtacaggcagatcggtccactgatagaccggcagatcttccgcttttccgaggacgggatggttaacgcacgctttgattactcttacgataatagcttccgcgtaacttcgatgcagggcgtaattaatgagacccctctaccgatagatctgtatcagtttgatgatatatccggcaaagtggagcaattcgggaaatttggcgttatctattacgacatcaatcaaatcatcagcaccgcggtgatgacttacaccaagcatttcgacgctcacggcaggattaaggagatccagtatgagatcttccgttctctcatgtactggatcacaatccagtacgataacatgggcagggttacaaaacgtgaaatcaaaattggacctttcgctaatactacaaagtacgcatatgagtacgatgtggatggccagctacagaccgtctatctgaacgaaaagatcatgtggcggtacaactacgacctcaacggcaacctgcacttgctgaatccatcgaactccgcgaggctcaccccccttaggtatgacctgcgcgaccggattacgcggctgggggatgtgcagtaccgtctggacgaggacggattcctgagacagaggggaacggaaatattcgagtatagctcaaaggggctactcacccgcgtatactctaagggcagtgggtggaccgtgatctaccggtacgacggattaggcagacgggtgagcagcaagaccagtctgggtcagcaccttcagttcttttatgcagatctcacctatcccacaagaatcacacatgtatacaatcattcctcctctgaaataacttcactatattatgatcttcaagggcatctgtttgctatggagatcagtagcggcgatgaattctatattgccagcgacaacacaggtacccctctggcagttttcagctctaacggcctgatgctgaaacagatacaatataccgcctatggggagatttacttcgactcaaacattgacttccagctcgtaatcggcttccacggcggactctacgaccccctgactaaactgattcatttcggggagcgcgattacgatattctagctggtagatggactacccctgatatcgaaatttggaaaaggattggcaaggatccagcaccctttaatctatacatgtttaggaacaataaccctgcttcaaagattcacgatgttaaagactacatcaccgatgtgaactcgtggcttgtcactttcggttttcatctgcacaatgctatccccggttttcccgtgcctaaatttgacctgaccgagcccagttacgaactcgtcaagtcccaacagtgggacgatatcccgcctatcttcggagtgcagcagcaggtcgcgaggcaggccaaggccttcctgagcctgggcaaaatggccgaggtccaggtgagccggagacgtgctggcggtgctcagtcttggctttggtttgcgacagtcaaatccctcataggaaagggggtcatgctggccgtcagtcaaggacgggtgcagactaacgtgctaaatatcgccaacgaggactgtatcaaggtcgccgctgtcctgaataatgccttctacctcgagaacctgcactttactatcgaaggcaaggacacgcactacttcatcaagacaacaaccccagaatccgacctaggcacactgagacttacgagtggaagaaaggcactcgaaaacggcatcaacgtgacggttagccagagtacaactgtggtcaatggtagaactaggaggtttgcggatgtcgagatgcaatttggagctctagccctgcatgtgcgctatggaatgacgctggacgaggagaaagccaggatcctagagcaagccaggcaaagggccttagcacgtgcctgggctagggaacagcaacgggtaagagatggagaggagggcgctcggttgtggacggaaggggagaagcggcagctgctcagtgcgggtaaagtccagggttacgatggttactatgtgttgtccgtagagcagtacccagaactggcagattcagctaataacatccagttcctgcggcagtccgaaataggacgcaggta

SEQ ID NO: 52117 - DNA, 513 bp, Artificial Sequence
  Description of Artificial Sequence: Synthetic coding sequence
atggacgttaaagagcgccgtccctactgttccctgaccaaaagcaggcgggaaaaagaaagaagatacacaaacagtagcgcagacaacgaggagtgtcgcgtacctactcaaaagtcctacagctctagcgagaccttaaaagccttcgatcatgattcctctcgcctactctacggcaatagggtgaaggatcttgtccatcgggaggccgatgagtttactaggcagggacaaaactttacgctcaggcagctgggagtctgcgaacctgcgacacgtcggggacttgctttttgtgcagagatgggcctgccacacagaggctactccatctcagccggttcagacgccgataccgaaaacgaagccgtgatgtctcccgagcatgctatgaggctctggggcaggggagtcaagagcggaaggtcttcttgtctgtcttcgcggtccaattctgctctgacgttgactgacactgagcatgagaacaagtctgattctgaaaattag

SEQ ID NO: 52118 - DNA, 981 bp, Artificial Sequence
  Description of Artificial Sequence: Synthetic coding sequence
atgtgtcctctgactctgcaggtcaccgggttaatgaacgtgtccgaacccaactcttccttcgcatttgtgaatgaattcatcctccagggattcacctgcgagtggacgatacagatatttctgttttcccttttcacaacaacctacgccctaacaattacaggcaatggtgctattgcctttgtcctatggtgcgactggcgactgcacacccccatgtatatgttccttggcaactttagcttcctggaaatctggtacgtcagtagcacagttcccaaaatgctggttaattttctgtcagaaaaaaagaacattagtttcgctggatgtttcctccagttctatttttttttttccctgggaactagcgagtgtctgctactgaccgtgatggccttcgaccagtaccttgcgatttgccgacccctcttgtaccctaacattatgaccggacacctttgcgccaaactagtgatcctgtgctgggtgtgcggattcctttggtttttaatcccgatcgtgctgatttcccagatgcctttctgcgggccaaatatcatcgatcatgtggtatgtgatcccggaccaaggttcgctctcgactgtgttagcgccccaaggatccagctattctgttataccctctcctcactggtgattttcggcaactttttattcatcatcgggtcctatactctggttctgaaagccgtgctggggatgccctcctccaccgggagacataaggctttctctacctgcggatcccatctcgcggtggtgagcttgtgctattccagtttaatggttatgtacgtgtctcctggcctcggccactctactggaatgcagaagatcgaaactctcttttatgccatggtgacgcccctgttcaaccccctgatatacagcttacagaacaaagagatcaaagctgctctccggaaggtactgggctcatccaacattatctag

SEQ ID NO: 52119 - DNA, 960 bp, Artificial Sequence
  Description of Artificial Sequence: Synthetic coding sequence
atggaaccgggaaatgatacccagataagtgagttccttctgctgggattttcccaggagccaggtctccaaccattcctgtttgggctgttcttgagcatgtatttagtgaccgtgctcggaaatctcctgatcattctagcaacaattagtgacagccacctgcacactcccatgtactttttcctgtccaacctctccttcgccgatatttgcgtcactagcacaaccatccccaagatgctgatgaatatccagacacagaataaagtgatcacctacattgcatgcctgatgcagatgtactttttcattctgttcgccggatttgaaaattttcttctcagcgtaatggcctatgaccgatttgtggcgatctgtcacccgctccactacatggtgattatgaatccccacctctgtggtttgctcgtcctggcttcatggacaatgtctgcactatattcgctactccagattctgatggtggttagactaagcttttgcaccgctctcgagatcccccattttttttgtgagttaaaccaggtgatacagcttgcatgctctgatagcttcttgaaccacatggtgatttatttcactgtggcgcttctggggggaggaccattgacaggcattctgtatagttattccaaaatcatcagctccattcacgctatctcctccgctcaggggaaatataaggccttcagtacttgtgccagtcacctctctgtcgtgagtctgttttatggcgcaatcctgggagtttacttgtccagcgccgctacgagaaattcccattctagcgcgaccgctagcgtgatgtacaccgtggttacacctatgctcaatccctttatttattccttaagaaataaggacattaaacgcgcattggggattcacctgttatggggtacgatgaaggggcagttctttaagaaatgtccttag

SEQ ID NO: 52120 - DNA, 930 bp, Artificial Sequence
  Description of Artificial Sequence: Synthetic coding sequence
atgagggagaataaccagagctcaactttagagttcattctcctgggggtgacgggccagcaggagcaagaggactttttctatatcctgtttctattcatctacccaatcaccctcattggaaacctgctcattgtactggctatctgttccgatgttaggctgcataaccctatgtactttctgctagccaacctatcactggtagatatttttttctcatctgtcacaattcccaagatgctggcgaatcatctcctgggttcaaagtccatctcatttgggggatgccttacccagatgtatttcatgattgccctgggaaacacggatagctacatcctcgcagcaatggcttatgatcgcgcagtggcaatcagccgacccctacactacaccacaattatgagtccaagatcctgcatctggcttattgcgggatcgtgggttattgggaacgccaacgcgcttccacatactcttcttactgcctccttaagtttttgtggcaatcaggaggttgccaacttttattgcgacatcactccccttctcaagctgtcatgttctgacatacatttccatgtgaagatgatgtacttgggagtcggaatcttttccgtgccactgctttgtataattgttagttatataagggttttttctacagtatttcaggtgccttccacaaaaggcgttctcaaagccttttcaacctgcggatcccatctgacagtcgtgtccctttattatggcaccgttatgggcacctacttccgaccactgactaattattccctgaaggatgccgtaatcaccgttatgtacactgcagtgacccccatgcttaaccccttcatctattctctgagaaatcgcgacatgaaggccgctctaagaaagcttttcaacaagcggattagcagttag

SEQ ID NO: 52121 - DNA, 930 bp, Artificial Sequence
  Description of Artificial Sequence: Synthetic coding sequence
atgaaaaaggagaatcagtcgttcaacttagatttcatcctgctgggcgtaacctcccagcaggagcaaaacaacgtctttttcgtgatcttcctctgcatctaccctatcacgcttacaggaaacctgctcattatccttgccatttgtgccgacattcgccttcataatccaatgtacttcttgctggccaatctctccctcgttgatattattttttcctcagtaaccatcccaaaggtcctggccaatcatctgcttggaagcaaatttatttcttttgggggatgcctcatgcagatgtactttatgatcgcccttgctaaggcggactcctatacgctggccgcaatggcctacgatcgcgcagtagcgattagctgtcccttacattacacaaccatcatgagccctcggtcctgcatactactaattgccggatcctgggtgatcggcaataccagcgctctgccccataccctgctgaccgctagtttgtcattttgcgggaatcaggaggtggcgaacttctactgcgatattatgccccttctgaaattgagttgttctgatgtgcacttcaacgtcaagatgatgtatttgggcgttggcgtcttcagcctgccactcttgtgtattattgtcagctacgtacaggtattctcgacggtgttccaggtgcccagcacgaagagtctttttaaggcattttgtacgtgtggctcccacttgacagtcgtgtttctctactatgggacaactatggggatgtacttccggccattgacctcttattctcccaaagatgctgtaattacggttatgtacgttgcagtcacccccgctctgaaccctttcatctactctcttcggaattgggatatgaaggccgcactccagaaactcttctcaaagcggatcagctcctag

SEQ ID NO: 52122 - DNA, 957 bp, Artificial Sequence
  Description of Artificial Sequence: Synthetic coding sequence
atgatgagtttcgccccaaacgcttctcacagccctgtgtttctgcttctggggttttctcgagctaacatcagctacacgttgctttttttcctttttctcgctatctatctgacaaccatccttggaaacgtgacccttgtgctgcttattagctgggacagcaggctccattctccaatgtattatctgcttcgaggactgtctgttatcgatatgggtctgtcgaccgttacattgccacaactccttgcacacctcgtgtcacactaccctaccatccccgcagcccgttgcctcgctcagtttttctttttctatgcattcggtgtcacggacaccctagtgatcgccgtgatggccctggacaggtacgtcgcaatctgcgacccattgcattacgccttggtcatgaatcaccagcggtgcgcctgcctgcttgctctttcttgggtggtctctatcctgcacacaatgttacgggtcggcctggttctacccctctgctggaccggtgatgcaggtgggaacgttaacttaccacattttttctgtgaccaccgacccctcttaagagcatcctgttccgatattcactccaacgagctggccatttttttcgagggaggatttttaatgctcggcccttgtgccttaattgtcctttcttatgtgaggatcggcgctgctatcttgaggcttccgagcgcggctggaaggcggagggccgtgtccacctgtggcagccacctcaccatggtggggttcctgtacggcacaatcatttgcgtctactttcagcctccattccagaatagtcagtaccaggatatggtagcttccgtcatgtatacagctataacaccactggctaatccgtttgtgtactcacttcataataaagatgtgaagggtgcattgtgcagactgctggagtgggtgaaggtggacccttag

SEQ ID NO: 52123 - DNA, 945 bp, Artificial Sequence
  Description of Artificial Sequence: Synthetic coding sequence
atggagaagaggaatctcacagtagtgagggaatttgtgctgcttggattgccctctagcgctgagcagcagcacctcctaagtgtgttatttctgtgtatgtacttggccaccaccctcgggaacatgctgatcatcgccacaatcggatttgactcccacctccattcccctatgtacttctttcttagcaatcttgccttcgtcgacatttgctttacttcgactactgtcccccagatggtggtgaatatcctgactggcaccaagacaatcagcttcgctggatgcctgacccaactgtttttcttcgtgagctttgttaacatggactccttgctgctatgcgtgatggcgtacgatcggtacgtcgccatctgccacccactccattatacggctcggatgaatctctgcctctgcgttcaacttgtcgctgggctgtggctggtgacatatttgcatgctctgctccatactgtgctgatagcccagctcagtttctgcgctagtaacattatccaccacttcttctgtgacctcaatccactcttgcagctaagctgcagtgacgtatcattcaacgtcatgattatcttcgcggtggggggtttgctcgcactcacacctctcgtctgcattctggtatcatatggattgatcttcagtacagtcctaaaaatcacaagcacacagggcaagcaacgtgcagtcagtacttgcagttgccatctttccgtcgtcgtcctcttctacggaacagccatcgccgtgtactttagcccctcctctccacacatgccagagagtgacacgctttcgactattatgtatagtatggtggcccctatgcttaaccccttcatttacactcttcgaaacagagacatgaaacgcggacttcagaaaatgctccttaagtgcaccgtgtttcaacagcagtag

SEQ ID NO: 52124 - DNA, 945 bp, Artificial Sequence
  Description of Artificial Sequence: Synthetic coding sequence
atgatgggacaaaaccagaccagtatcagcgattttctgttactcgggctccccattcagcccgagcagcagaatctgtgttatgccctgtttctggccatgtacctgacaacgttgctaggtaacctgctgatcatcgtcttgattaggctggatagtcacctgcacactcctatgtatttgttcctgagtaatctctcctttagcgatctgtgctttagttcagtgacaatcccaaagctcttacagaatatgcagaatcaggatccatccatcccttatgccgattgtctcacacagatgtacttctttcttctgttcggcgatctggaatcctttttgcttgtagcaatggcttacgatagatatgtagccatctgctttcccttgcactatacagccattatgtccccgatgctctgcctggccctggtggctctgtcatgggtgctgacgacgtttcatgcaatgctccacaccctcctgatggccaggctgtgcttttgtgccgacaatgtaatcccacattttttctgcgacatgtctgctctgttaaagttggccttttctgatactagggtgaatgaatgggtcattttcataatgggaggtttgatcctggtgatccctttcctgctaatactagggtcttacgcgaggatcgtgagctcaatcctaaaggttccgtcttcaaaagggatttgtaaggcctttagtacctgtgggagccacctgagcgtggtttctctgttttacggtaccgttatcggcctgtacctgtgttccagtgccaacagctcaacattaaaggacactgtaatggccatgatgtacactgttgtgacccccatgctgaatccatttatctactccttgaggaacagggacatgaagggcgctctctctcgggtgatccaccaaaagaagaccttttttagcttgtag

SEQ ID NO: 52125 - DNA, 972 bp, Artificial Sequence
  Description of Artificial Sequence: Synthetic coding sequence
atgatgggccagaaccaaacctccatctctgacttccttctgttggggctgcccatccagccagagcagcagaacctgtgttatgctctgtttcttgcaatgtacttaacaaccctgctaggcaatctgctaattatagtgctgatccgcctggactcccacttgcatacccccgtctatctattcctgtcaaatctgagtttttcggatttgtgtttttcttcggttacaatgccaaaactccttcagaatatgcagaaccaggacccgagcatcccttatgcagactgtctgacacaaatgtattttttcctgtatttcagtgatctggagtctttcctgctggtggccatggcctacgaccggtacgtcgctatctgcttccccatgcactatacagctatatgcttcttgctccattatacggcgatcatgtcaccaatgttgtgcctctccgtagttgcactgtcatgggtgctcactactttccacgcaatgctccacaccctcctgatggccagactgtgtttttgtgccgataatgtcatcccccacttcttctgcgacatgtcagctctcttgaaactggcttgtagcgatacacgggtcaacgaatgggtcattttcataatgggcggactgatcttagtcattccgttcctgctgatcctgggctcttacgcgcgaatagtgtctagtatcctgaaggtgcccagcagtaaaggaatttgcaaagcgttcagcacctgtggctcccacctgtccgtcgtctccttattctacgggacggtgataggtttgtatctatgtccatcggccaattctagcactctgaaggacaccgtaatggctatgatgtatacagtggtgacgcccatgctgaccccatttatctacagccttaggaaccgggacatgaaaggagcactcgagagggtgatatgcaaaaggaagaacccttttcttctgtag

SEQ ID NO: 52126 - DNA, 942 bp, Artificial Sequence
  Description of Artificial Sequence: Synthetic coding sequence
atggagggcaaaaatctcaccagcatttcggagtgcttcctgttgggcttctccgaacaattggaggaacaaaaaccactcttcgggtcctttctctttatgtatcttgtcacagttgccggaaatctactgatcattctggttatcattacagatacgcagcttcacacacccatgtactttttcctggccaatctgagtctcgccgatgcttgtttcgtgtctactaccgtgcctaagatgttggccaacattcaaatccagtctcaagccatatcatactccggctgtcttctccagctttacttctttatgctgttcgtgatgctagaggcttttctgctcgccgtgatggcctacgactgctacgtggccatctgtcaccccctccactacattctgatcatgtctcctggattgtgcatttttctggtgtctgccagttggataatgaatgcgctgcactcgctgctacacaccctgttgatgaatagtctgtccttctgtgccaaccacgaaatcccccatttcttctgtgatatcaacccgctgctgtctctttcatgtacagacccattcacgaacgagctagtgatattcattacaggtggccttacaggcctgatctgcgtcctctgcttaatcatctcatacacaaatgttttcagcacaattctaaagattccatctgcacagggtaaacgcaaggctttcagtacatgctctagtcacctttctgtggtgagcctgttctttggtactagcttctgcgtggattttagcagcccgtccactcactctgcacagaaagacacagttgcaagtgtcatgtacaccgtggttaccccaatgctgaatccctttatctatagtctgaggaatcaagagataaagagctctttacgcaagctcatttgggtgagaaagatccacagcccttag

SEQ ID NO: 52127 - DNA, 1611 bp, Artificial Sequence
  Description of Artificial Sequence: Synthetic coding sequence
atggctgaacatgcccctcgccgttgttgtctgggctgggacttttcgacccaacaggtaaaagtcgtcgccgtggatgccgaactgaacgttttctacgaagaaagcgttcatttcgacagggacctccccgagtttggaacacaggggggtgtacatgtccacaaggatgggctgacagttacaagccccgtactgatgtgggtgcaagctctggatataattcttgaaaaaatgaaggccagcggttttgatttttcccaagttctcgccctgtcaggtgcgggtcagcaacacggcagcatatactggaaggcgggagcacagcaagctctcacaagccttagccctgatctgcggttacaccagcagttgcaggactgtttcagcatttcagattgcccagtctggatggatagtagcacgaccgcccaatgtcgacagctcgaggctgcggtgggaggcgctcaagcactgagctgtctgaccggctcccgggcatacgaacgtttcacaggtaatcaaattgcgaaaatttatcaacagaatcccgaggcctactcccatacagagagaatcagcctcgtttctagttttgccgctagccttttcctgggaagctactcccccattgactatagcgatggatccgggatgaacctactgcagatccaagataaagtttggagccaagcttgcctgggtgcttgtgcccctcacctcgaggaaaagctctcgcctccagttcccagctgttccgttgtcggagcaatttcatcctactacgtgcagcgttacgggtttcctcccggatgtaaagtagtggcatttacaggtgacaacccagctagtctggcagggatgcggttggaggagggagacattgctgtgagtttagggacatcagacaccctgtttctgtggttacaggaaccaatgcccgctttggaggggcacatcttttgtaacccggtggactctcagcattacatggccttgctttgctttaagaatgggtcattgatgagggagaagatccggaacgagagtgtaagccgttcctggtctgactttagcaaagccttgcagtccacggagatgggtaatggaggaaatctggggttttatttcgacgttatggaaataaccccggaaattatagggaggcatcggtttaataccgaaaaccacaaagtggccgcattccctggggacgtggaggtccgagccttaattgaaggtcagtttatggcaaagaggatccacgctgaaggactgggttaccgcgtaatgagcaagactaagattctggcgacggggggagcctcacacaatcgcgaaattctacaagttctggccgatgttttcgacgccccagtgtacgtgatcgataccgcgaattcagcctgtgtcggatcggcctacagggcctttcacgggctggctggcggaactgacgtccccttcagtgaagtcgtcaaacttgctcccaatcccagacttgcagccaccccgagccctggagcttcacaggtatacgaggctcttctgccccagtacgcaaagctcgagcagagaatcctctcccagaccagaggccctcccgagtag

SEQ ID NO: 52128 - DNA, 969 bp, Artificial Sequence
  Description of Artificial Sequence: Synthetic coding sequence
atgtctccagaaaaccagtcatccgtttctgaatttctcctgctaggtctgcctattcgaccggaacagcaagcagtctttttcgccctgtttcttggtatgtatttaaccacagtgctgggaaatctgctgatcatgctactgatccagcttgactcccatcttcatacacctatgtatttctttctctcccatttagcactgactgatatcagcttcagctcagtgacagtgcccaaaatgttgatgaacatgcagacgcagcatctagccgtattctacaaggggtgcatctctcagacatatttcttcatcttcttcgctgacctggactcgtttttgattacatcaatggcttatgacagatatgtcgcaatctgccaccccctgcactacgcaactattatgactcagtcacagtgcgtcatgctggtggccggaagttgggtcattgcctgtgcatgtgcattgctccacactctcctgctggctcagctaagcttctgcgccgatcacattattccgcactacttctgcgatttgggggcactcctcaaactgtcatgttctgacacctccctgaatcaattggctatcttcactgctgctctgactgctattatgcttcccttcctgtgcatcctggtttcttacgggcatataggggtgactattctacagatcccatccacgaagggcatttgcaaggcccttagcacatgcggtagtcatctctctgtggttacgatttactatcgcacaattatcggcctgtacttcttacctccctcgtctaataccaacgacaagaacataattgcaagcgtgatctacactgctgtgaccccaatgctgaatcccttcatttacagcctgaggaacaaagacataaaaggcgcactgcgcaaactactgagcagaagcggcgctgtcgctcatgcgtgcaatctgaacacgttgggcggatag

SEQ ID NO: 52129 - DNA, 942 bp, Artificial Sequence
  Description of Artificial Sequence: Synthetic coding sequence
atgtcacctgagaaccagagctccgtctccgagtttctgcttctgggactacctataaggccggaacaacaggctgtgttcttcaccctgttcctcggcatgtacctgacgaccgttctgggaaatctgctcatcatgcttctcatccagcttgattcccacttgcacaccccaatgtatttttttctttcccatcttgctcttacagatatttcattcagctctgtgaccgtaccgaagatgctcatggacatgcgcacaaaatacaagtctattctgtacgaagaatgtatttcccagatgtatttcttcatctttttcaccgatctagactccttcctcattacctctatggcttacgatcggtacgtcgccatttgccacccactgcactacaccgttattatgagggaggaactttgtgtattcttggtggccgtaagttggatcctctcctgtgccagtagtctgtcccacaccctgttgctaactaggctgagcttctgcgctgcaaacaccattcctcatgtgttttgcgacctagccgctcttctaaaactgagttgctcggacatcttcctgaatgagctcgtcatgtttacagtgggggttgtggttattactctgccattcatgtgtattctggtgagttacggttacattggcgcaacgatcctgcgggtgccaagcaccaaagggatccataaagccctttcgacatgtgggagccatctgtctgttgtatcgctgtactacggatcgatattcgggcagtacttgtttcctactgtttcttctagcatcgataaggacgtaattgtagccttgatgtataccgtggtgacccctatgctcaatccattcatctatagcctgcgcaaccgggatatgaaggaagctttaggtaagctgttctcacgtgccacgtttttctcatggtag

SEQ ID NO: 52130 - DNA, 942 bp, Artificial Sequence
  Description of Artificial Sequence: Synthetic coding sequence
atgtctcccgagaatcagtcttccgtttccgaatttttgctactgggcctgcctatccgccctgagcagcaggcggtgttcttcaccttgttcttaggcatgtatctgactactgtgctcggtaacctcctgatcatgttgttaatccagctcgacagccacctgcacacccccatgtatttttttctctcccatctcgcgctcaccgacattagcttttctagtgttacagtcccaaaaatgctcatggacatgagaaccaaatacaagtctattctttacgaagagtgcatttcccagatgtacttttttatttttttcactgacctggatagcttcctgattacaagtatggcctacgataggtacgtggctatctgccacccattacactacactgtgattatgcgggaggagctgtgcgtctttctggtagctgtctcttggatcctgtcttgtgcgtcctccctgagccacacattgttgctgaccaggttaatgaagcgcgagaatcagtcttcggtgtccgaatttctgctgctcgatctgcctatctggccggaacagcaggcagtgttctttacactgtttctgggcatgtacttaataacagtcctgggaaacctccttatcattcttcttatacgcctggacagtcacttacacacccctatgttcttcttcctctcacacctggctctaacagatatatctctctcgtccgtgacagttccaaagatgcttctttccatgcagacacaggaccaaagcatcctatatgctggctgcgtgacccagatgtactttttcatctttttcacagatttggataattttctcctcacttcaatggcctacgacagatatgtcgccatctgccatccactgcgctatacgacaattatgaaagaggggctttgcaatctgctggttacagtttag

SEQ ID NO: 52131 - DNA, 942 bp, Artificial Sequence
  Description of Artificial Sequence: Synthetic coding sequence
atgaaaagggagaatcaaagctccgtctccgagtttctgcttcttgaccttcctatttggccggaacaacaggcagtttttttcactctgtttctcggcatgtacctcattaccgtgctggggaacctgctcattatcctcttaatccgattggattcccatttgcatacacccatgttcttctttctgtcgcacctagccctcacagatatatccctgtcatcagttaccgtcccgaaaatgcttctgtctatgcagactcaggaccagtcaatcctgtacgcgggatgcgtgacacagatgtactttttcattttcttcaccgatctcgataatttcttgctgacgagtatggcttatgatcgctacgtcgcgatctgccaccctctacggtatacaactataatgaaagagggcttatgcaaccttctggtaacagtctcctggatcttaagctgcaccaatgcactatcgcataccttactgctcgcccagttgtctttctgtgccgataatacaattccccattttttctgcgatctggtagctctgcttaagttaagctgctccgatattagcctcaacgagctggtaatcttcaccgttgggcaggctgtcatcacacttcctctcatatgcattctcattagttatggacacatcggcgtgacaatcctgaaagctcccagcacaaagggcattttcaaagctctgtctacttgcggctcgcacctgtctgtggtgtcactgtactacggaaccatcatcggtctgtattttttgccctcctcctccgccagctccgataaagacgtcatcgcctctgtcatgtacaccgtgataacaccactgctgaatcccttcatttacagtctccgtaatcgggatattaagggtgcgctcgagcgtctatttaacagagctaccgttctgtcccagtag

SEQ ID NO: 52132 - DNA, 951 bp, Artificial Sequence
  Description of Artificial Sequence: Synthetic coding sequence
atggaggccgcaaacgagtcctcggaggggattagctttgtcctactggggttgaccacatcgccgggacagcagagacctctgttcgtgttgtttctgttactgtacgtggcgagtctcttaggaaacggtctgatagttgccgctatccaggcctctcctgccctgcacgctcccatgtactttctccttgcacacttaagtttcgctgatctgtgcttcgccagcgttaccgtgcccaaaatgcttgctaaccttctggcgcacgaccattcaatatcgctggctggctgtttgacgcagatgtattttttctttgccctgggagtaacagactcctgtttactggcggctatggcctatgactgttacgtggccatccgccatccccttccttatgctaccagaatgagccgggctatgtgcgccgctctggtcgggatggcttggctcgtctcccacgtgcatagcctactgtatatcctgctcatggcacgcttgagcttttgcgctagccaccaagtaccccatttcttctgcgaccaccagccactgttacgtttatcatgcagcgacacgcatcatatccagctcctaatctttaccgaaggggctgctgtcgtggtgactccgtttctgctgattcttgcgagttatggcgctatcgctgctgctgtcttgcaactgcccagcgcatcaggacggctgcgagctgtgtcgacttgcgggtctcacctggccgtggtctcactgttttatggaacagtgatcgccgtctatttccaggcgactagccgcagagaagccgagtggggacgtgtggctactgtgatgtacactgtggtgactcctatgttgaaccccatcatctattccttgtggaaccgggatgtacaaggggctctcagggcgttgcttatcggcagaagaatctctgcatcagactcatag

SEQ ID NO: 52133 - DNA, 933 bp, Artificial Sequence
  Description of Artificial Sequence: Synthetic coding sequence
atggggaggaacaatctaactaggccctctgagtttatcttattaggcctaagctcccgtccagaggaccagaaaccgctgttcgctgtctttctgcctatctatcttatcactgtgatcgggaatctcctaatcatcctggctatcagaagcgatactaggctgcagacacccatgtacttttttctcagcattttgtcattcgtggacatatgttatgtgaccgttattatccctaagatgctggtgaactttttgtcggagaccaaaactatctcctacagcgagtgcctgacccaaatgtatttttttttggcctttggaaacaccgactcttatctgctcgccgcaatggccattgaccggtacgttgccatctgtaatcctttccactacattaccataatgtctcaccgatgttgtgtgctgctgctggtcctgtctttctgcattcctcattttcactctcttcttcatatattacttaccaaccagttgattttctgcgcctccaatgtcatccaccactttttttgcgatgatcagccagtcttaaagctctcctgttcctcacacttcgtgaaagagatcactgtaatgacagaaggactggcagttataatgactccgttcagctgcatcatcatctcctatctaagaattctgatcacggtgctcaagatcccttcagcggcagggaagaggaaggccttctcaacatgcggtagccacctcacagtagttactcttttttacggaagcataagctacctctactttcagcccctgtccaattacaccgtcaaagatcagattgcaaccatcatttacacagtcctgaccccaatgttgaacccatttatttatagtttgaggaacaaagatatgaagcagggacttgccaaactgatgcatcggatgaagtgccagtag

SEQ ID NO: 52134 - DNA, 1083 bp, Artificial Sequence
  Description of Artificial Sequence: Synthetic coding sequence
atggagcgcaatcacaaccctgacaattgtaacgtacttaattttttctttgctgataagaaaaataaacggaggaactttggacagatagttagcgatgtgggcagaatttgctattcagtgtcactctctcttggtgaaccaaccaccatgggcagaaataatctcactaggcctagcgagtttatcctcttgggcttgagctcccgccctgaagatcagaaacctttgttcgctgtattcttgcctatttacttgattacagttatcgggaatctcttaattattctggctatacgctcggacacccggcttcagacgcctatgtattttttcctgtctattctctcctttgttgacatatgctatgtaacagtgataataccgaaaatgcttgttaactttttatctgaaacgaaaaccatctcttactcagaatgtctgacgcagatgtactttttcctggctttcgggaatacggatagttatctgctggcagcaatggccattgaccgttacgtggctatctgcaatccctttcactacatcacaataatgtcccataggtgctgtgtgttacttctggtactttctttctgtatccctcattttcattccctcctgcatattctactgaccaatcagcttatcttctgtgccagtaacgtgattcaccattttttctgcgatgatcagcccgtgctgaaactatcttgcagcagccacttcgtgaaggagattaccgttatgacagagggactagccgtgataatgacacccttttcctgtattatcatctcctacctccggattctcatcacggttctgaaaatcccctctgccgcaggaaagaggaaagccttcagcacttgcgggtcccatctgaccgtggtgacattattttacggcagcatcagttacctgtactttcagccactgtctaattataccgtgaaagatcagattgccaccatcatctataccgtcctgactccaatgctcaatcctttcatatattctctgagaaacaaagatatgaagcaaggactggcaaaacttatgcaccgcatgaaatgtcagtag

SEQ ID NO: 52135 - DNA, 975 bp, Artificial Sequence
  Description of Artificial Sequence: Synthetic coding sequence
atgggtatgagcaatctgaccagactgtctgagttcatactattgggcctgtcctcacgctccgaagatcagcgaccgttattcgccctctttctcatcatatacctggttactctgatgggaaacttgcttattatccttgctatacacagtgatcccaggctgcagaatccaatgtatttttttctcagcatactgagtttcgcggacatctgctacacaacagtgattgtacctaagatgctggtgaactttttatctgagaaaaagacaatctcttacgcagaatgccttgctcaaatgtattttttcttggtctttggtaatatagattcctacctcctggccgcaatggccataaatcgatgtgtggccatatgcaacccttttcattatgttaccgtcatgaatcgtcggtgctgtgttctcctactggctttccccatcacattctcttattttcacagtctgttgcacgtgcttctggtgaaccggctgacattctgcacgtccaacgtgatacaccatttcttctgcgatgtgaatcccgtgctcaaattgtcatgctctagtacattcgttaatgagatcgtcgccatgactgagggtcttgcatccgttatggctccttttgtttgcatcattatctcctacctccgtatccttattgcagtgctcaagattccttcggctgcaggaaagcataaggcatttagcacatgctcttcccatttgaccgtggtcatcctgttttacggaagcatttcctacgtttacctgcaacccctgagcagttatactgttaaggatcgcatagctaccatcaactataccgtgctgaccagtgtgctgaatccctttatctactcactgaggaacaaggacatgaagcggggattgcaaaagttaataaacaagatcaagtcacagatgtcacgcttctccacaaaaacaaataaaatatgcggcccatag

SEQ ID NO: 52136 - DNA, 936 bp, Artificial Sequence
  Description of Artificial Sequence: Synthetic coding sequence
atggagactaaaaactactcaagctctacaagcggttttattctgcttggcctgtcctcgaatccaaagctgcagaagccactgttcgcgatttttctgataatgtatcttctgacggctgtgggcaatgttctgatcatcctggccatatactcagatccaaggctgcacactcccatgtacttttttctgagcaatttatcttttatggacatttgctttactacagtaatcgtccctaagatgctggtaaatttcctgtccgagacaaagatcattagttacgtggggtgtctcatacaaatgtattttttcatggcatttggcaatacagacagttacttgcttgcttctatggcaatcgaccgcctcgtggcaatttgcaacccactgcattatgacgtggtaatgaagccttggcattgtctgctgatgctcttggggtcctgtagcataagccatttgcatagtctgtttcgagtgttgctgatgagcaggctgagtttctgtgcatcccatataattaagcactttttctgtgatacccaacccgtattgaaactttcatgttctgatacctcctcctctcagatggtagtgatgacagagacactggccgtcatcgtgacaccctttctgtgtaccatcttttcttatctgcagatcatcgtgacggttttacgcatcccctctgcagctggcaaatggaaggcttttagcacctgcggctcccatctaactgtggttgtgttgttctacggtagtgtaatatatgtctactttagaccattatctatgtattcagtcatgaaaggtcgggtggctaccgtgatgtacacagtggtgacccccatgctgaacccgtttatctactccctgcgcaataaagacatgaagcgagggcttaagaagctaaggcaccgaatatactcatag

SEQ ID NO: 52137 - DNA, 936 bp, Artificial Sequence
  Description of Artificial Sequence: Synthetic coding sequence
atggagataaaaaactatagctcgtccaccagcggatttatcctcttaggactgtcaagcaatccccagttgcagaagccactgttcgcgatattcctgattatgtaccttcttgctgccgtaggcaatgtacttatcataccagcaatctacagcgaccccagactccacactcccatgtattttttcctgtccaatttgtctttcatggacatatgctttactacagtgatcgtccccaagatgctcgtgaatttcctttctgagactaaggtgatctcatacgtggggtgtctggctcagatgtactttttcatggccttcggcaataccgactcctacttgttagccagcatggctatagacagattggtggccatttgcaaccctttgcactatgatgtcgtgatgaaacccagacactgcttgctgatgctccttggcagctgctcaatcagccacttacactcattatttcgagttctgctgatgtctcgtctgagcttttgcgcgtctcacattataaaacacttcttctgtgacacccaacctgtcttaaaactgagctgctccgacacatcgagttcccagatggtggtaatgaccgaaacactcgcagttattgtgaccccgtttctatgtattatttttagttatctgaggataatggtgacagtgttgcgcattccctctgcggctggcaaatggaaggctttctctacctgtggttcacatctcacggccgtggccctcttctatggatctatcatttacgtgtactttcgaccgctgtcaatgtactcggtggttcgggacagggtagccaccgtaatgtacaccgtggtgacacctatgctcaaccctttcatctattcccttagaaacaaagatatgaagaggggcctgaagaagctccaggatcgtatctatcgatag

SEQ ID NO: 52138 - DNA, 1044 bp, Artificial Sequence
  Description of Artificial Sequence: Synthetic coding sequence
atgagttacttttatcgcctcaagctgatgaaggaggcagtgttggtgaagctgccgttcacttcattgcccctcctcctacagacattatcacggaaaagtagagacatggaaatcaagaactatagttctagcacctccggtttcatcctgctcggcttgtcatctaacccacagctacagaagccgctttttgccatctttctgatcatgtaccttctggccgctgtcgggaacgtgctgataattccagccatatactccgatccgaggttacacactcccatgtatttcttcctgagcaatttatcgtttatggatatatgctttactaccgtgattgtaccaaaaatgctagttaactttctctctgagactaaggtgatctcctacgtggggtgcctggcccaaatgtacttcttcatggcatttggtaataccgattcatatctgctggcttccatggccatcgatcgcctggtggccatctgcaaccccctacactacgatgtggtcatgaaacccaggcattgtctccttatgcttctgggatcttgttctatcagccatctccactctctcttccgtgtcttgctcatgagtaggctttcattctgtgcctcccatatcatcaagcatttcttttgcgatactcagcctgtgcttaaactatcttgcagtgacactagcagctcccagatggtggtcatgactgaaacgctggcggttattgtcactccttttctttgtatcattttctcatacctgagaatcatggtgaccgtgcttaggataccatcagccgctggcaagtggaaagctttttccacctgcggaagccacctgaccgccgtagccttgttctatgggtcaatcatttatgtttactttaggcctcttagcatgtatagtgtggtgagagacagggtggctaccgtaatgtacaccgtcgtcactcccatgctcaatccgttcatctactctctccgaaataaagatatgaagagaggccttaaaaaactgcaggatagaatctataggtag

SEQ ID NO: 52139 - DNA, 930 bp, Artificial Sequence
  Description of Artificial Sequence: Synthetic coding sequence
atggagcgcatcaaccatacatcctcggtgtctgagttcattttactggggctatcctcaagacctgaagatcagaagacattgtttgtgctgtttctgattgtctacctggttacgattactggaaatttactcataattttggccatcagattcaacccacacttgcaaacccctatgtacttttttctctcctttctgtctctgactgatatttgttttacgacgtctgtagtacctaagatgctgatgaatttcctctccgagaagaagaccatcagctacgccggatgtttgacacaaatgtatttcttgtatgcactcggcaatagcgactcttgcctgctggctgttatggcattcgatcgctacgtggccgtttgcgacccatttcactacgtgaccactatgtcccatcaccattgcgtgttacttgtcgcattctcatgttcgtttcctcaccttcacagcctcctccacacattgctgttgaacagactcaccttttgcgattccaatgtaattcatcacttcctgtgtgatctttcccctgttctcaaacttagctgctcaagtatcttcgtgaatgagatcgtgcaaatgacagaagctccgattgtgctggttacaaggtttctatgtattgcattctcatatatccgcatcctgactactgttctcaagatcccttccacttccggcaagcgtaaagctttttctacctgtggcttctacctgactgtagtgacactcttctatggttcaatattctgcgtttaccttcagccgccttctacctacgccgtgaaggaccacgtggctacaatagtttatacggtactatcctccatgcttaacccctttatttactcacttcggaacaaggacttgaagcaaggtctgagaaaactcatgtccaagagatcatag

SEQ ID NO: 52140 - DNA, 951 bp, Artificial Sequence
  Description of Artificial Sequence: Synthetic coding sequence
attacacccatggaaccgagaaatcagacgagcgcatctcagttcattctcctcgggctgtctgaaaagcccgagcaggaaacactcctgtttagtttgtttttttgtatgtacctagttatggtggtggggaatctgctgatcatacttgcgatctctatcgactcacatttgcatacacccatgtacttttttttggcaaacctttctcttgtggatttctgtctggctaccaatactattcccaaaatgttggtttctctgcagaccggcagtaaggccatctcttacccgtgttgcttaattcagatgtattttttccatttctttggcatcgtagactcagtgatcatcgccatgatggcctatgatagatttgtcgccatttgccaccctctgcattatgcaaagatcatgtcacttagactgtgtcgactgctggttggcgctctgtgggcgttttcttgcttcatctctctgacgcatatattactgatggcccgattagtattctgcgggagccacgaggtaccccactatttttgcgacctgacgcccatcttaaggctgagttgcacagacacatccgttaatcgaattttcatcttaatcgtggccggaatggtaatcgcaacccccttcgtttgcattctggcttcttacgcccgaatacttgtggctatcatgaaagtcccatcagcaggagggaggaaaaaggcattctccacctgtagctcacatctgagtgtggtggctcttttttacggaacaacgataggcgtgtacctgtgtcctagttccgtgttaacaactgtcaaggagaaggccagcgccgtcatgtacaccgcagtcacaccaatgttaaatccattcatatattcactgcgcaaccgcgatctcaaaggtgcactgagaaagctcgtaaataggaagatcacaagctcctcctag

SEQ ID NO: 52141 - DNA, 942 bp, Artificial Sequence
  Description of Artificial Sequence: Synthetic coding sequence
atggaaccaagaaatcagaccagtgccagccagtttattctcctgggcctaagtgagaagccagaacaggagacactgctattcagcctgtttttttgcatgtatctcgtgatggtagtagggaacttgctcatcatcctcgctatttcaatcgattcccacctgcacacccccatgtacttcttcctggcgaacctgtctctcgtggatttttgcttggctacaaatacgatcccgaagatgctcgtgtcgcttcagaccggctccaaggcgatcagttatccctgttgtcttattcagatgtattttttccatttttttggcatcgtagactcagtcataatagcaatgatggcttacgacagatttgtggcaatatgtcatcccctccattacgctaaaattatgagcctgcggctgtgtagactactggtgggcgcactgtgggctttcagttgttttatctccctcacccacatactgctaatggccagactggttttctgtggcagccacgaagtgccgcactatttttgtgaccttactcccattctcaggctgagctgcacagatacatcagtcaatcgaatttttattcttatcgtggccggtatggttatcgctacccccttcgtgtgtatactggccagctacgctcggatccttgtagcaattatgaaggttccctctgcgggtgggaggaagaaggctttctcgacatgttcgtcccatctcagcgtagtagcactgttttacggcacaactatcggcgtttatctttgtccctcgtcagttctcactaccgtgaaggaaaaggcttcagcagttatgtataccgcggtgacacctatgttgaatccctttatctattcactgcggaatcgcgatctgaaaggggctcttcgtaagctcgttaacagaaaaatcacttcatcatcgtag

SEQ ID NO: 52142 - DNA, 936 bp, Artificial Sequence
  Description of Artificial Sequence: Synthetic coding sequence
atggagaaccagagcagtatctccgagttcttcttacgtggaatctcggcccctcctgaacaacagcaatccttgttcggcatcttcttatgcatgtatcttgtgacccttaccggcaatttactcatcatactggcaatcggatcagacctccacctgcacacccctatgtactttttcctcgctaatctgagttttgtggacatgggtctgactagctccacagtcaccaagatgctagtcaacatccagactcggcatcataccatttcatacaccggctgtctaacacagatgtatttctttctaatgtttggggatttggatagcttcttcctggcagccatggcctacgaccggtacgtggccatctgtcaccctctctgctacagtactgtgatgcgccctcaggtttgcgctctcatgttggccctgtgctgggttctgacaaacattgtggccctgacccataccttcctgatggcacgactgagtttttgcgtgacaggcgagatcgctcacttcttctgtgacataacccctgtcctgaagctgtcttgctccgatacccatataaacgagatgatggtcttcgtcctagggggaactgtgctgattgttccctttctctgtatcgtcacaagttatatccatatcgtgccggctatcctgcgggtgaggactcgtgggggagtcgggaaagccttttcaacctgctctagccacctctgtgtggtttgcgtcttttatggcacactattcagtgcctatttgtgcccaccctctatcgcttctgaagaaaaggacatcgccgctgcagcaatgtacacaatcgtgacgcccatgctcaatccattcatatactccttgcgcaacaaagacatgaaaggtgctcttaagcgtcttttctcacaccggtcaatcgtttcctcctag

SEQ ID NO: 52143 - DNA, 993 bp, Artificial Sequence
  Description of Artificial Sequence: Synthetic coding sequence
atggaagggttctacctaaggcgttcccacgaattgcaggggatgggaaagcctggccgagttaaccaaacaacggtaagcgatttcctgctgctgggcttaagtgaatggcccgaggaacagcctctgctttttggaatttttctgggcatgtatctggtcacaatggtcgggaatctgctcatcatcctggctatttcctcagacccacatttgcatacacccatgtacttcttcctggcaaatctgtctctcacagacgcatgcttcacgtccgcctcgataccaaagatgctcgccaatattcatacccaaagccaaattattagttacagcggatgtctcgcacagttgtactttctgctaatgttcggcggactcgacaattgtttgctcgcggtcatggcgtacgatagatacgtggctatctgccaacccttgcactactccacctcaatgtcacctcagctgtgcgccttaatgctgggagtgtgttgggtcctgacaaattgtcccgctctaatgcacacacttctgctcactcgcgttgctttctgcgcgcaaaaagctatcccacacttttactgcgatccgtctgccctgctgaagcttgcctgcagcgatacccacgtcaacgagctaatgataataaccatggggctcttgttcctcacagtccctctgctcctgatagttttttcctacgtgcgcattttctgggcagtgttcgtgatcagtagccctggcggacggtggaaagcattctctacctgtgggagccacctgactgtcgtgttactcttttatgggtcccttatgggggtctacctgctccccccatctacttacagcacagaacgcgagtccagggctgccgtgctgtacatggtcatcatcccgactctgaacccattcatctacagcctgcgtaatagagacatgaaggaggcactcggaaagctttttgtcagcgggaagacatttttcctgtag

SEQ ID NO: 52144 - DNA, 945 bp, Artificial Sequence
  Description of Artificial Sequence: Synthetic coding sequence
atggataatagcaactggacaagcgtgtcccactttgttctgctcgggataagcacacaccctgaagaacaaatacctctatttctggtgtttagcttgatgtacgctattaacatcagcggaaatctggctataatcaccctgattctctccgcgccaagactgcacattccaatgtatatcttcctatctaatctcgccctgaccgatatctgctttactagtaccacagtgccaaaaatgctgcagatcattttcagtcctactaaggtgatatcttataccggttgtctagcccagacatacttctttatatgcttcgcagtgatggagaatttcatcctggccgtcatggcctatgaccgatatatagctatctgccacccctttcattatacaatgattcttacccgtatgttgtgcgttaaaatggtcgtgatgtgtcacgccttatcccatctccacgctatgctccacaccttcctgatcggtcagctgatcttctgtgcagataaccggatcccgcatttcttctgcgatctttacgctctgatgaaaatctcctgtaccagcacttatttgaacacactgatgatccacaccgaaggagccgtggttatctcaggcgctctcgcttttataactgcctcctacgcctgtattattctggtcgtcctgcgcatcccctctgctaaggggagatggaaaactttttctacttgtggctcacatctcaccgtggtagctatcttctatggcaccctctcctgggtctacttccgacctctatcctcctattcagtgacaaaggggaggatcatcactgttgtctacacagtcgttacgccgatgcttaatcccttcatttatagtctgcggaatggcgacgtcaagggagggtttatgaagtggatgtctagaatgcagacattcttctttaggtag

SEQ ID NO: 52145 - DNA, 978 bp, Artificial Sequence
  Description of Artificial Sequence: Synthetic coding sequence
atgaaaactttcagtagtttcttgcagattgggaggaacatgcaccaggggaatcaaactactatcaccgagttcatcctcctgggatttttcaaacaagatgagcatcagaacttgctgtttgtgctctttctggggatgtacctggtgacagttatcggcaatggcctgatcatcgtggctatctccctcgacacctatctgcacaccccaatgtacctcttcctagccaaccttagcttcgcagatataagcagcattagcaacagcgtgccgaagatgctagtcaacattcagactaagtcccaatcaatctcctatgagagctgcatcacacagatgtacttttccattgtgtttgtcgtgattgacaatctgctgctggggacaatggcgtacgatcactttgtcgcgatctgccacccactgaattatacaatactgatgaggccacgatttgggatcctgctcaccgtgatatcttggttcctttcaaacattattgctctgacccacaccttgttgctcattcagctactgttctgtaaccacaacactttgccccactttttttgtgacctggccccactgctaaagctgagctgttctgataccttgatcaatgagctggttctgtttatcgtgggcttgagcgtcattatcttcccattcaccctgtctttcttcagctacgtgtgcatcatccgtgccgtgcttagggtgagttctacacagggcaaatggaaagcattttccacctgtgggtcacacttgaccgttgttcttttgttctacggaaccatcgtaggcgtgtacttctttccttcctccactcaccccgaggacaccgacaagatcggcgctgtgctgtttaccgtggtcactcccatgatcaaccctttcatatatagtctgcgaaataaggatatgaaaggtgctttgcgcaagttgattaacaggaagatcagcagtctgtag

SEQ ID NO: 52146 - DNA, 978 bp, Artificial Sequence
  Description of Artificial Sequence: Synthetic coding sequence
atgaagactctgtgcagctttctccagattagccgaaacatgcaccaggagaatcaaacaacaattactgaatttatactcctgggccttagcaatcaggccgaacaccagaacctgctctttgtgctgttcctaagcatgtacgttgttaccgtggtcggtaatggtttaataattgttgcgatatccctcgacatttatctgcacacgccaatgtatttgttccttgcctatcttagtttcgctgatatcagctccatttccaactccgtgccaaaaatgttggttaacatccagactaattcgcaaagcatctcatacgagtcctgtatcactcagatgtatttcagtatagttttcgtggtgaccgacaacctcttactgggcacgatggctttcgatcacttcgtcgccatatgtcatcctttgaactatactacatttatgagggctaggttcggaacgctgctcacagtgatcagctggttcctgagcaatattatagctctgacacacacactgctgttgatacagctgcttttttgcgaccacaataccctgccacactttttttgcgacctggcaccattacttaagctcagttgcagcgacacgatgattaacgagctcgtactctttatcgtcggtctgtcggtgatcatctttccctttgtactcatctttttctcgtacgtttgtattattagggccgtgcttggagtgagctcaacacaggggaaatggaaggcatttagcacttgtggatctcacctgacaatcgcgttgctgttctatgggacgaccgtcggagtttacttctttccatcaagtactcaccccgaggatacagacaagattggcgctgtgctttttacggttgtcaccccgatgatgaacccatttatatatagtctgcgaaacaaggatatgaaaggtgctctgcgaaagctcatcaacagaaagatatcctctttatag

SEQ ID NO: 52147 - DNA, 912 bp, Artificial Sequence
  Description of Artificial Sequence: Synthetic coding sequence
atgtctttcagctcacttcccactgaaatccaaagtctcctcttcctgacatttctgactatctatctcgtaacactgatgggcaattgtctgattatcctggttaccctcgccgacccaatgcttcactctcctatgtacttcttcctgagaaatcttagtttcctcgagattggttttaaccttgttattgtccccaagatgctcgggaccttactggctcaggacactaccattagttttctcgggtgtgccacccagatgtatttctttttcttttttggcgtggccgagtgctttctgctggccaccatggcttatgatagatatgtcgcgatctgtagtcctctgcactaccctgttataatgaaccaacggacacgggctaaactcgctgctgcatcgtggttccccggtttccctgttgcaaccgtgcagactacttggctttttagttttcctttctgcgggactaataaggtaaaccacttcttctgcgacagcccaccagtcctgcgtctagtgtgtgccgacactgccctattcgaaatttatgcaattgttggcaccatcctcgtggttatgatcccttgtctgcttattctctgtagttacacccacattgccgcagctatcctgaaaataccctccgcaaaggggaagaacaaggctttctcaacctgcagcagtcatctgctcgtggtgagcctcttttatatatctctgagccttacttactttagacccaagtctaacaacagcccggaagggaagaaactgttgtccctgagttacactgttatgacacctatgttaaacccaatcatctactccctgcgtaacaatgaggtgaagaatgctttgtctcggaccgtgagcaaggccctcgcactccgcaactgtatcccatag

SEQ ID NO: 52148 - DNA, 945 bp, Artificial Sequence
  Description of Artificial Sequence: Synthetic coding sequence
atgaagcgccagaaccaatcttgcgtggtcgagttcatcttactgggcttctcaaatttcccagaactccaggtccagctgttcggagtgttcctggtgatttatgtggtgactctgatgggaaacgcgattatcaccgtgatcatttcactcaatcagtctctacacgtgcccatgtatctcttcctgttgaatctgtccgtagtggaggtgtctttttcagccgttataacaccggagatgctggttgtgctcagtacagagaaaactatgatctcattcgtggggtgcttcgcacagatgtattttattttgctttttggcggaacagagtgtttcctactcggggcaatggcgtacgaccggtttgctgctatatgtcaccccctaaattacccagtgatcatgaaccggggagtgtttatgaagctcgttattttttcatggatcagcgggattatggtggccactgtccagactacatgggtattcagctttccattctgtgggcctaacgagattaaccacctgttttgcgagaccccgccagttctcgagctcgtctgtgcagatacgtttctattcgagatctacgccttcaccggaaccatactcatagtgatggtcccttttctgctcattctcctctcctatatcagggtgctattcgccatcttgaaaatgccatctacaacgggcaggcagaaagctttctctacgtgtgccagccatctgacaagcgtaactttgttttacggcactgctaacatgacttatttacagcccaaatcgggctacagtccagagacaaaaaagctcatttccctggcctacaccctactgactccgctcctgaatccgctcatatacagcctacgcaattctgaaatgaaacgtaccttaatcaaactgtggaggaggaaggtgatcctgcacactttttag

SEQ ID NO: 52149 - DNA, 948 bp, Artificial Sequence
  Description of Artificial Sequence: Synthetic coding sequence
atgatgtgggagaattggactatagtttccgaattcgttctcgtgtcgttctctgccctgtcaactgagctgcaggcactcctgttcttactttttctcactatttatctggtcactctaatggggaatgtactcatcattctggtcactattgctgacagcgcattgcagtcacccatgtatttttttctccgtaatttgagcttccttgaaatcggcttcaacttggtgattgtccccaagatgctggggaccttaataattcaggacaccactatctcttttctggggtgcgctacccagatgtacttttttttcttcttcggcgctgctgagtgttgtctgctggcaactatggcttatgacagatacgtggccatctgtgatccattacactaccccgtgataatgggacacatatcatgtgctcagctcgccgcagccagttggttctccggattttcagtggccacagtccaaaccacctggatcttctcctttcccttttgtggccctaatagagtgaatcattttttctgcgattccccaccagtcattgctctggtgtgcgccgacacttctgtgttcgaacttgaggcactcactgccactgtgctgtttatccttttccccttcctgctaatactggggagttatgtgcgcattctttctacaatctttcggatgcccagtgcagaaggcaaacaccaggcatttagtacatgtagcgcacaccttttggtcgttagcctattttacagcaccgcaattctgacgtattttagacctcagtcatcagctagctccgaaagcaagaaactgttgtccctgagctctaccgtcgtcacacccatgctcaaccctatcatttacagcagcaggaacaaggaggtgaaagcagcactgaaacgcttgattcatcggactcttggcagccagaaactgtag

SEQ ID NO: 52150 - DNA, 954 bp, Artificial Sequence
  Description of Artificial Sequence: Synthetic coding sequence
atggctatcggcaactggaccgaaatctcagaattcatactgatgtccttttctagtctgcccaccgaaattcagagcttgctctttctgactttcctgactatctatctggtaacgctgaaaggaaattcactcatcattctggttacattggcagaccctatgttacactcccccatgtacttttttctgaggaatctgtcctttctggaaatcggatttaacctggttatcgtgcccaagatgttgggcactttgctggctcaagatacaaccatatcctttctgggttgcgcaacgcagatgtacttcttcttcttctttggagtagctgaatgcttcctcttggccacaatggcctacgatagatatgtggctatctgttctcccctgcattaccctgtgatcatgaaccagagaacacgggctaaacttgcagctgcttcttggtttccagggttccccgtcgccaccgttcaaactacatggttattttcattccccttttgcggaaccaataaggttaatcacttcttttgcgactcaccaccggtgctaaaacttgtgtgcgcggacactgcactgtttgagatttatgcaatcgtcggaactatccttgttgttatgattccttgtctgttgatcctttgcagctatacccggattgctgctgcaatactgaaaattcctagcgcaaaggggaaacacaaagcattctccacctgctcctcacatctgcttgtcgtgtctctattctatattagttcctccctcacatatttctggccaaagtccaacaactccccggagtcaaagaagctactgtcactatcctacacagtggtgactcctatgctgaatccgatcatttacagcctacggaactcagaagttaagaacgctctgagcagaacgttccataaggttctggcactgcgaaattgtattccttag

SEQ ID NO: 52151 - DNA, 966 bp, Artificial Sequence
  Description of Artificial Sequence: Synthetic coding sequence
atgcctatccttatggccattggcaattggacagaaatctccgaattcatcctgatgtctttttcttctcttccgactgaaatccaatccctcctgttcctcaccttcctcactatatacctggtgacattgaaaggtaatagtttgatcatcctagtgactctggccgatcccatgctgcattccccaatgtatttctttctacgcaacctctcctttctcgagattggattcaatttggtgattgttcccaaaatgttgggcactctgctggctcaggacacaactatctcatttctcgggtgcgcaactcagatgtattttttcttcttcttcggcgtggctgagtgcttccttctagccactatggcttatgatcggtacgtcgccatttgttcccccctgcactatccggtaatcatgaatcagaggacaagggccaagttggctgccgcaagctggtttccgggtttccccgtggctacagtgcagaccacatggcttttcagtttccccttctgtggcaccaacaaagtgaatcacttcttctgcgactccccgccagtactgaaactggtctgtgccgataccgctctattcgagatctatgctatagtggggactatattggttgttatgatcccctgcttactgattctgtgctcatacactcgaatcgccgcagccatcttaaagatcccgagcgccaagggtaaacacaaggccttttctacgtgttcatcgcacttgttggtggtgtcattattctacatctcatcttccctcacgtatttctggcccaagtctaataacagtccagagtcaaaaaagctccttagcttatcttatacagtggtgaccccaatgctgaacccaattatctacagtctgcgaaattccgaggtgaagaatgccctgtcccgcacctttcacaaagtgcttgcgctccgcaactgtattccgtag

SEQ ID NO: 52152 - DNA, 945 bp, Artificial Sequence
  Description of Artificial Sequence: Synthetic coding sequence
atggaaagacagaaccagtcttgtgtggtggagttcattctacttgggttcagcaattatcccgagctccagggtcagttattcgtggcattcctcgtgatttacctggtcacccttatcggtaatgccattattatcgtgatcgttagcctggaccaatcgctgcatgtaccgatgtatctctttctccttaatctgtccgtggtggacctcagttttagtgctgtgatcatgccggaaatgctggtggttctgtccaccgagaagactacaatttcctttggcggatgcttcgcccaaatgtattttatcctgttgttcggaggcgctgaatgctttctgctcggagccatggcttatgaccggtttgctgcgatctgccaccctctaaactaccagatgatcatgaataagggcgtgtttatgaagcttattattttttcctgggctctgggctttatgcttgggactgttcagaccagttgggtcagcagttttcctttctgcggtctgaacgagattaatcacataagctgtgaaacaccggctgtcttggagcttgcttgtgccgacaccttcctgtttgagatatatgcgtttaccgggactttcctgattattctcgttccatttttgctcatcttgctcagctacattagagtgctctttgcgattttgaagatgccctcaacgaccggaagacagaaagcattctctacttgcgcagcccacttgacaagtgtgaccttgttctacgggaccgctagtatgacctacctgcagccgaagagcggctatagtccagaaactaaaaaagtcatgtctctgagctattcactgctaacccctttgctgaatctattaatatatagcctccgaaacagcgagatgaagcgcgctttgatgaagctgtggagacgacgtgtggtcctgcatactatatag

SEQ ID NO: 52153 - DNA, 951 bp, Artificial Sequence
  Description of Artificial Sequence: Synthetic coding sequence
atgatttgcgaaaaccataccagagtgacagagtttattctgctcgggtttaccaataaccctgagatgcaagtaagtctgttcatttttttcctagctatttatactgtgactcttcttggtaactttctcatcgtgacggtcacctcagtcgacctggctctgcagacacctatgtacttcttcttgcagaacttgagcctgctggaagtgtgctttaccctcgttatggtgccaaaaatgctggtggacttggtgtctcctagaaaaataatctcgtttgttggctgcggtacgcagatgtatttcttcttctttttcgggagttctgaatgctttctgctgagtatgatggcttacgatcggttcgtggccatctgcaatccgcttcactattccgtgattatgaacaggtcattgtgtctttggatggcaattggctcatggatgtccggggtccctgtctctatgctacagaccgcttggatgatggcccttccattttgtggaccaaatgccgtggatcacttcttctgcgatgggccacccgttctgaagttggtgaccgtggacactacaatgtacgagatgcaggccctggctagtacactcctgttcatcatgttccccttttgtctcatccttgtaagctacactcgtatcatcatcactattttacgtatgtcttctgcgactggcaggcaaaaggctttttctacatgctcctcacatctaattgtggtttctctgttttatggaacagcatctctaacatatctgcgaccaaaaagtaaccagtctcccgaaagcaaaaaattggtgagcctttcctacacagtaattacacccatgctgaatccaataatctacgggttgcgaaataacgaggtcaaaggcgctgtcaagcgcactatcacacagaaggtgcttcagaaactagatgtgttctag

SEQ ID NO: 52154 - DNA, 1020 bp, Artificial Sequence
  Description of Artificial Sequence: Synthetic coding sequence
atggaaaaacgcgagatcaattcagcattcggggtgaaatcgaggtacagatatctcggcccactgtacgtcatctatacgtactaccatatcaggatcatcctgttattcacccaggccccagacctggacctgttcccagccgcaaatgttagtattatgggcgctattaaactgtcacataatcttcatacacctatgtactttttcctgtgtggcctttctttttctgaaacatgcactacagtcgtcgtgatcccgaggatgttggttgactttctcagcgaatctaaaaccattagtctaccggaatgcgccacacagatgttcttcttcctggggtttgcttctaacaattgcttcatcatggccgcaatgtcctacgatcggtacactgcaatccacaacccccttcagtaccataccctgatgacccggaaaatctgcctgcagatgatgatggcttcttggatggtagggttcctattttccctgtgcattatcgtaaccgtctttaatctgagtctatgcgatctgaatacgattcagcactatttctgcgacatctctcctgtcgtatccctagcctgcaattacaccttctatcatgagatggcaatcttcgtcctcagcgccttcgtgctggtgggctcctgcatcctcataatgatttcatacgtttttatagtgtttattgtaatcaagatgcccagtgccaaaggacgcagtaaagcattttctacctgcagctcacatctgaccgtcgtgagcattcactacggcttcgcttgctttgtctacctgcgaccaaaaaattcaaactcctttgacgaggacatgctgactgccatgatatatacaattctgatgcccctgctaaatcctatcgtctattctctgcgaaacaaggagatgcaaatcgcgctgagaaaaaccctgggcagcgtgttcggagtctttcctcagaaaactaagaaggagcctgaacatttgaaaaaactgcatagcatcgataagtag

SEQ ID NO: 52155 - DNA, 954 bp, Artificial Sequence
  Description of Artificial Sequence: Synthetic coding sequence
atgctgagaaacgggtcaatcgtgaccgaattcatattggtgggattccagcaatctagtacaagcaccagggcgctcctttttgcgctgtttttggctctatacagcctgactatggccatgaacggcttgatcattttcattactagttggaccgaccctaagttaaatagtcccatgtactttttcttgggacatctgtcactgttggatgtttgcttcattaccacaacaataccacaaatgttgatccatctcgtggttcgagatcacatagtgagctttgtgtgctgcatgacccagatgtatttcgtcttctgtgtgggagtagccgaatgcattttgttggccttcatggcatatgaccggtacgtcgctatctgttacccactgaactacgtgcctattataagccagaaggtatgtgttcgactggtcggtaccgcctggttcttcggactgataaacggaattttcctggagtacatatcctttcgcgaaccttttcgccgagacaaccacattgaaagtttcttttgtgaggctcccattgtaatcggactgagttgcggcgatccgcagttctcactgtgggctattttcgccgatgctatagttgttatcttatccccaatggttctaacagtcacttcttatgtccacatcctcgctaccatcctctctaaagcttcaagtagtgggcgaggaaagacttttagcacctgtgctagccacctgaccgtggtgatctttttatacaccagtgctatgttcagttatatgaacccacacagcacccatggccctgataaggataaaccattctcactgctttacactatcattactccgatgtgtaatcctatcatttactccttcaggaataaggaaatcaaagaagcaatggttcgggctcttggcaggaccagactagcccaacctcagtccgtgtag

SEQ ID NO: 52156 - DNA, 906 bp, Artificial Sequence
  Description of Artificial Sequence: Synthetic coding sequence
atggaattcgtcctgttaggattctctgacatccctaatcttcattggatgctgttcagcatcttcttgctgatgtatctgatgatcctgatgtgcaatggcataattattctcctcatcaaaattcatcctgctctacagactcctatgtacttcttcttgagcaatttttctctccttgagatttgctatgtcaccattatcatacccaggatgctgatggatatatggactcagaagggcaacatttcactgtttgcatgcgcgacacagatgtgtttcttcttgatgcttggcggaactgagtgcctcttgctcactgttatggcatacgatagatacgtggccatatgcaagcccttgcagtatcctctggtcatgaaccacaaggtctgcattcagctcatcatcgccagttggactatcactatcccagtggtgattggtgagacttgccaaatttttctgttaccattctgcggcactaacacaattaatcacttcttctgcgatatccccccaattttgaaactcgcatgtggcaatatcttcgtcaacgaaattactgtacacgtcgtcgctgtggtttttatcactgtaccctttttactgatagtggtttcctatgggaaaattatttctaacatcttaaagttgagttctgctaggggtaaagccaaagctttcagtacctgcagctctcacctgattgtggtaatcctcttcttcggcgctgggacaattacctacctacagccgaagccacatcagttccagagaatgggtaaactcattagcttattctatacaatattaattccgacccttaaccccatcatctatactttgagaaacaaagacatcatggtggctctacgtaaattgttggccaaattactgacttag

SEQ ID NO: 52157 - DNA, 939 bp, Artificial Sequence
  Description of Artificial Sequence: Synthetic coding sequence
atgtcggcgaatactagcatggtcacggaattcctgcttctcggcttcagccatctggctgaccttcaggggctcctcttctctgtatttcttaccatctacctgctgactgtggccggaaattttttgattgtggtgttagttagcacagatgccgcacttcagtcgcctatgtacttttttctgcggaccctctctgccctggagattggatacacctctgtaacagtgccgctcttgctgcatcacttacttacagggaggaggcatatctccagaagcgggtgtgctctccagatgttcttcttccttttttttggagccaccgaatgctgtctgctagccgcaatggcctacgaccgttatgccgcaatctgcgaaccactacggtacccactcctcctttcccaccgggtctgtctgcagctggcgggaagtgcttgggcatgcggagtcctggtcggcctgggccataccccatttatcttctctctcccattttgtggaccaaatactatcccccaattcttctgcgagattcagcctgtcctccagctggtttgtggagatacttctctgaatgagctgcagattatcttggctacagctcttctcatcttatgtccatttggcctcatcctgggcagctatggacgaatactcgttaccatttttcgcatccccagcgtggccggaaggcgaaaagcctttagcacgtgtagttcccacctcattatggtcagtctcttttacggaaccgccctgtttatctatattaggcctaaggctagctacgaccccgctaccgatccactggtgagcctattctatgccgtggtcactcccatcctgaatcctattatttactctttacgcaacaccgaggtgaaggccgcactcaagcggactatccagaagaccgtgcctatggagatatag

SEQ ID NO: 52158 - DNA, 939 bp, Artificial Sequence
  Description of Artificial Sequence: Synthetic coding sequence
atgagtgccaatacctccatggtgacggaattcctgctgctgggattctcccatttggccgaccttcagggcctgctgttctcggtgtttttgactatctacctgttaactgtagcgggaaatttcctcatcgtcgttctagtgtctacagatgccgctctgcaatctccgatgtacttttttctgcgaaccttaagtgcgcttgaaatcgggtacacctcggttactgtccccctcttacttcatcacttgctgacaggacgcagacatatttctcggtctggctgcgcactgcagatgttttttttcctattctttggtgctaccgaatgttgtttgttggctgccatggcctacgatcggtatgctgccatctgtgagccacttaggtacccactcctattgtcacaccgtgtttgcctccagcttgccggaagcgcctgggcatgtggagttctggtcggcctggggcacaccccatttattttcagtctcccattctgtggcccaaataccattccacagttcttctgtgagattcagcccgtgttgcagctggtctgtggagacacgtctctgaatgaactccaaattatactcgcgaccgccttgctgatcctgtgccccttcggcttgattttgggtagttatggaaggatcctcgttacgatattccgaatccccagtgttgccggacgaagaaaagcattctccacatgttcttcacacctgattatggtctcgctgttttatggaacagctctcttcatctatatccggccaaaggcttcatacgatcccgctactgaccccctcgtatcattattttacgcagtcgttacaccaattctgaatcctatcatctacagtttgagaaataccgaggtgaaagcggctctgaagagaactattcaaaagacagtcccgatggagatctag

SEQ ID NO: 52159 - DNA, 939 bp, Artificial Sequence
  Description of Artificial Sequence: Synthetic coding sequence
atgtcagccaacaccagcatggtcacagaatttctgctgctggggttctctcacttagccgacctacagggattgctcttttccgtgttcctcactatttatctcctcacagtagcaggaaacttccttatcgtagttctcgtgtccactgatgcagcgctgcagtcccccatgtacctttttctgagaacgctgagtgctctggagatcgggtacactagcgtgactgtgccgctgctgttgcatcaccttctaactggcaggcggcacatatcccgaagcggttgtgctttgcaaatgttcttcttcctgttttttggagctactgaatgctgcctcctggctgcgatggcttacgataggtacgccgctatctgcgaaccgctccggtatccactgctcctgagccacagagtttgcttgcaactcgctggtagcgcgtgggcttgcggtgtcctggtcggcctgggccacactccgtttatctttagtcttccattctgcggacccaacacaattcagcagttcttctgtgagattcagccggtgctacaattggtctgtggggatacatccctgaacgagttgcagataattcttgccaccgccctactgatcctgtgtccattcgggttgattttaggcagttacggacgcattctggtgactatttttcgcattcccagcgtggcaggcaggagaaaggcgttctcgacctgcagttcccatctgatcgtagttagtctcttttatgggaccgcgctatttatatacatcaggccaaaggcatcttacgatcctgcaacagacccccttgtatctctgttctacgctgtggtgacgccgatcttaaaccccatcatctattctctccggaacacagaagttaaagccgcactgaaaagaacaatacagaagactgtccctatggaaatctag

SEQ ID NO: 52160 - DNA, 939 bp, Artificial Sequence
  Description of Artificial Sequence: Synthetic coding sequence
atgtctgccaatacaagtatggtaactgaattcctcttgctcggattctcccatctcgcagacctgcaaggtttactcttctcggttttcctgaccatttacctgctgactgtggcaggtaattttctcatcgtcgtgctggtctctacagacgctgcgctccaatccccaatgtacttctttcttcgcacactttctgctctggaaatcggttacaccagcgtcactgtcccactcctgttgcaccatttactgacagggcgtcgacacattagccgctcaggttgtgcgcttcagatgttctttttcttatttttcggcgcaaccgaatgttgtctcttagcagctatggcttatgaccgatacgctgccatttgcgagcccttaagatatcctctcctgttgtcacaccgggtgtgtctccagttagctggctctgcctgggcatgcggtgtgctagtgggcctgggacacacccctttcattttctctctgcccttctgtggtcccaacacaattccacaattcttctgcgaaattcagcctgtgctccagctggtgtgtggcgatacttccctcaacgaattgcagattattttagctaccgccttacttatcctctgtccattcggacttattttgggatcttacgggagaattttagttaccattttcaggatcccatcagttgcagggaggcgtaaagccttctctacttgcagtagccacctgatcgtggtcagcctgttctacggtaccgccctcttcatttacataaggcctaaggctagttacgatcctgccaccgatccactggtctctctgttttacgcagtggttacaccgatcctgaaccctatcatctactcactcagaaataccgaagttaaggccgcacttaagcgaaccattcagaagaccgttcctatggaaatctag

SEQ ID NO: 52161 - DNA, 939 bp, Artificial Sequence
  Description of Artificial Sequence: Synthetic coding sequence
atgagcgctaatacatccatggtgactgagttcctcttgctggggttcagccatctcgcagatctccaaggtctgctgttttcagtgtttttaacaatttacctgctgaccgtcgctggcaacttcttaatcgtcgtgctggtatcaaccgatgccgcactgcaatccccaatgtacttctttttacggaccctctccgcgctggagatcggctacacgagtgtcactgtgccgctgctgttgcatcacctcttaactggaagaaggcacatttctcgttcagggtgcgccctccagatgttctttttcttgttttttggtgctactgaatgttgtctgcttgcggctatggcttatgaccgttacgctgctatctgcgagccactccgctatccattattgctgtctcaccgtgtgtgtttgcagctggccggtagcgcctgggcctgcggagtccttgtcggactcggccataccccattcatttttagcttaccgttctgtggccctaacaccatcccacaattcttctgcgagatccagccagtgctacagctggtctgtggcgacacatctttgaatgaactgcagataatattagccaccgctctcctgatcctttgtcccttcggtttgatcctgggatcttacgggagaatactggttaccattttccgcatcccaagtgttgccggtcgacgtaaggcatttagcacctgctcctcccatctcattatggtgagccttttctacggaactgctttgtttatttacatccggccaaaagcctcatacgatcctgccacggatccattagtgagcctgttctatgcagtagtaactcccatcctgaacccaataatctacagcctgagaaacacagaggtgaaggcggcactcaagagaaccatccaaaaaactgtacctatggaaatttag

SEQ ID NO: 52162 - DNA, 939 bp, Artificial Sequence
  Description of Artificial Sequence: Synthetic coding sequence
atgtcagctaacactagcatggttaccgagttcctgttgttaggttttagccacctggctgacttacagggactgctcttcagcgtcttcctcacaatttacttgctcaccgttgccggtaacttcttgatcgttgtcctagtgagcaccgacgccgctctgcagtctcctatgtacttttttctgagaactctgagtgcactggagatcggctatacatccgtaacagtgcccttactcctccatcatcttctgactggcaggagacacataagccggagtgggtgtgccctccagatgtttttctttcttttcttcggagcgacggaatgctgcctgctcgccgctatggcatacgaccgctacgccgcaatctgtgagccactgaggtacccattgctgctcagccaccgagtgtgtctccaactcgctggcagcgcctgggcttgtggcgtgttggtcggattgggtcataccccctttattttcagtctcccattctgtggaccaaatacgatacctcagtttttctgtgaaatacagcctgtgttgcagctcgtatgtggcgacaccagtctcaacgagctccagataattttagccaccgccctgttgatcttatgtccgtttgggctgatcctgggaagctacggacgtatcttggtgaccatcttccggatcccctccgtggcgggacggagaaaagcattttcaacctgcagtagtcacctgattgttgtgtcactgttctacggtaccgccctgttcatctatattcgcccaaaggcctcatacgacccagcaacggacccattggtgtccctgttctacgccgtagtgacaccaattctgaacccaataatctacagcctcagaaacacagaagttaaggcagcactgaagcgcactatccaaaaaaccgttccaatggaaatctag

SEQ ID NO: 52163 - DNA, 939 bp, Artificial Sequence
  Description of Artificial Sequence: Synthetic coding sequence
atgagtgcgaacacttctatggttacggagttcttattacttggcttttctcatcttgccgatctgcagggactcttgttcagtgttttcctgaccatttatctcctgacagtggcagggaacttcctgatcgtggtactggtctccactgatgccgcactccagtccccaatgtacttcttcttgcggacactttcagcactggagatcgggtacacttctgtgactgttcctctgttattgcaccacctgcttactggccgtaggcacatatccaggagcggctgtgctttgcagatgttcttcttccttttctttggggctacagagtgttgccttctcgcagcaatggcgtacgacaggtacgcagctatctgtgagcctctccggtatccactgcttctgagccatcgggtgtgcttgcaactcgccggtagtgcttgggcatgtggagttctggtgggtttaggccacacgccctttatctttagtctaccgttttgcgggccaaacacgatcccacagttcttttgtgagatacagcctgttctgcagttggtgtgtggagacacatccctgaatgagctgcaaattattcttgctacagcactgctgattctgtgccctttcggcctgatcctggggtcttatggcaggattcttgtgaccatctttcgcattccatccgttgcaggtaggagaaaagcattttcgacctgcagctctcaccttatcgtggtgtccctattctatggcactgccttatttatttatatccggcctaaagcaagctacgaccctgcaacggatcccctggtcagtctattctatgccgtggttaccccaatcctaaatcccattatttacagccttcgcaacacggaggtgaaggctgctcttaaacggaccattcaaaaaaccgtgccgatggagatctag

SEQ ID NO: 52164 - DNA, 939 bp, Artificial Sequence
  Description of Artificial Sequence: Synthetic coding sequence
atgtcggccaatactagtatggtcacagaattccttttgctcgggttcagccatcttgccgacctgcagggactactattctctgtgttcctcaccatctatctactgactgtggcaggaaatttcctcatcgtagtgcttgtctctacagacgctgccctccagagccccatgtatttctttctgcggactttgtctgcgctagagatcggttatacatctgtaacggtgccacttctcctccaccacttgttgacaggcagaagacacattagtagaagcggttgcgccctccagatgtttttcttcttattttttggagctactgagtgttgtctgctggccgctatggcctacgaccgttacgccgcaatttgtgaaccgctgagatatccactcctgctgtcacacagagtgtgcttgcagctggcaggctcagcgtgggcatgcggtgtgttggttgggttgggccacaccccgtttatcttttctttgcctttctgtggcccaaacacaattccccagtttttctgcgagatacagcctgtgctgcaactggtttgtggagacacctcactgaatgaacttcagatcattctggccaccgcattgctgatcctctgccccttcggattaattttgggcagctacgggcgaatactcgtcaccatattcaggatcccaagtgtcgccggacggaggaaagcgttttcaacttgcagctcccacctgattgtcgtatccctcttttacggcaccgcactgtttatctatattcggcctaaggcatcttacgatccagctacggatccgcttgtgagtttgttttacgccgtggttaccccaatccttaatcccatcatctattcactgagaaacaccgaggtgaaggctgccctgaaaagaacgattcagaagaccgtgcctatggaaatctag

SEQ ID NO: 52165 - DNA, 888 bp, Artificial Sequence
  Description of Artificial Sequence: Synthetic coding sequence
agcgtgacagaattcctgctgttgggggttaccgacatccaggagcttcaaccatttttattcgtggtcttcctaacgatctattttatcagcgtggctggcaacggcgctatccttatgatagtgatttccgatccacgcctgcatagccccatgtacttctttctcggcaacctcagttgcctcgacatatgctattccagtgtcaccttgcccaaaatgcttcaaaacttcctgtctgctcacaaaatatcgaggtcaggctgtgcacttcagatgttctttttcttgttcttcggagcaacagagtgttgcctgctggccgcaatggcgtatgaccggtacgcagccatttgtgagccactccgctatcctctccttctgagccatagggtgtgcctccagctggcgggatcagcgtgggcctgcggcgtcctggttggactgggccacacccctttcatcttcagcttgcccttctgcggccctaataccatcccgcaatttttctgtgagatacaacctgttctgcagttggtgtgcggtgacacctcgctgaatgagctgcagatcattttagctactgccttgctgatcctttgccccttcgggctgatcctggggtcttacggtcggatcctggtcacaatattccgtattccatccgtagcgggacggaggaaagcctttagtacctgcagcagtcacctgattatggtttcgttattctacgggacagctctgttcatctacataaggcccaaggctagctatgaccctgcaaccgatcctctcgtttcattgttctatgctgttgtaactccgattcttaacccaatcatctactcacttcggaacacagaagttaaggctgcactcaagaggtag

SEQ ID NO: 52166 - DNA, 888 bp, Artificial Sequence
  Description of Artificial Sequence: Synthetic coding sequence
tcagtgacagagttcctgttgttgggcgtgacagacatccaggaactccaacctttcctcttcgtcgtattcttgacgatttacttcatttctgttgccggtaacggcgctatcttaatgatcgttataagcgatcctcggcttcacagccccatgtatttctttctgggcaacctctcctgtctggatatttgttacagtagtgtgacattgcctaaaatgctgcaaaattttctatctgctcataaaatcagtaggagcggctgcgcactgcaaatgttcttctttctgtttttcggcgcaaccgagtgctgcctcctcgctgcgatggcctacgacagatacgcggctatttgcgagcccctccgctacccactgctgctttcacatcgagtttgccttcagctcgcaggtagtgcttgggcatgcggggttcttgtgggcttgggccacaccccttttattttttctctcccattttgcgggccaaacaccatcccccaattcttctgcgagatccaaccagtgctgcagcttgtgtgcggggacacatcactgaacgagctgcagatcattctagctaccgctctgctcattttgtgcccattcgggttgattctcggatcatacggcaggattctggtgactatcttcaggatccctagtgttgctggccgacggaaagcattctcgacctgtagcagccacttaattatggtgtctctattctatgggaccgcactcttcatctacattcgaccaaaggcctcttacgatcctgcaaccgatccccttgtctccttattctatgctgtggtgacccctatactgaacccgatcatctacagcctgcggaatactgaagtgaaagcagcacttaaaaggtag

SEQ ID NO: 52167 - DNA, 888 bp, Artificial Sequence
  Description of Artificial Sequence: Synthetic coding sequence
agtgtgaccgagttcctgctcctgggagttaccgacatccaggagctccaacccttcctttttgtagtttttctgacaatctatttcatctccgttgccggaaacggggctatactcatgatcgtgatttccgatcctaggctgcacagtccaatgtacttcttcctgggtaacctttcctgcttagacatctgctattcgtccgtaaccctccccaaaatgctgcagaacttcctgtcagcccacaaaataagtcgctcagggtgtgccttgcagatgttctttttcctgttctttggagcgaccgaatgctgcctcctggctgctatggcatatgatcgctacgccgcaatttgtgagcctcttaggtacccgctgcttttatcacatcgggtgtgcttgcaactagccggatccgcgtgggcttgcggcgttttggtaggactgggtcacacgccttttattttttccctacctttttgtgggcctaatactattcagcaattcttctgcgaaatccagccggtgctgcagttggtgtgtggggatacatctctgaacgaactgcagatcattctagccaccgcattgcttatcctgtgccctttcggactgattttgggctcctacggcagaattcttgtgacaatcttccggatcccatccgtcgccggaaggcgaaaggccttctctacttgctctagccacttgatcgtggtgtccctgttctatgggaccgctttgttcatctatatccgaccaaaagcgagttacgatccagccaccgaccctctggtgagccttttctacgccgtggtcacccctattcttaacccaatcatatattctctccgcaataccgaagtgaaggccgcactgaagcgctag

SEQ ID NO: 52168 - DNA, 888 bp, Artificial Sequence
  Description of Artificial Sequence: Synthetic coding sequence
tctgtgacagagttcctattgttgggagtaacagatatccaggagttgcaaccgtttttatttgttgtcttcttgacaatctacttcatatccgttgcaggtaacggagccattttaatgatcgtgatcagtgatccacggctccactcacccatgtactttttcctgggaaacttatcctgccttgatatatgctacagtagcgtgacacttcccaagatgctacaaaactttctgagcgcccacaagattagtcgctccgggtgcgccctacaaatgttcttctttctgtttttcggagcgactgagtgttgtctgttagccgcaatggcatatgaccggtacgccgcaatctgcgaaccattaagatatcctctgttactgagccatcgagtgtgtctgcaattggcgggatccgcttgggcctgtggggtgctggtcggcttggggcatacgccctttatcttctccctgcctttttgcggaccgaacacgattccacaattcttttgtgagatccagccagttctgcagttggtgtgtggggacacttcgttgaatgagcttcaaattatcctcgccaccgcgcttcttatcctttgcccgttcgggctcatactcggctcttatggaagaattctcgtgaccatatttcggatcccaagcgtggccggaagacggaaggctttctccacttgtagctcacatctcatcgtggtgagcttattctatggaactgcactgtttatatacattcgacctaaggcctcatacgatcctgccaccgatccccttgtctcccttttttatgcagttgtgacgcctatactaaatccaatcatctattctctgagaaacacagaagttaaggcagcacttaaacgctag

SEQ ID NO: 52169 - DNA, 915 bp, Artificial Sequence
  Description of Artificial Sequence: Synthetic coding sequence
gaaaggatgtccgcaaacacaagtatggtgacggaattcctgctgctaggtttctctcacttggcagaccttcaaggcttgttattctctgtatttctgactatttatttactcaccgtcgcagggaacttcttaatcgtggtgctagtgagcaccgacgccgctcttcagtctcccatgtactttttcctgagaaccctgagcgcactagagatcggatacacttctgtgaccgtgcctctgctcctgcatcatctgttaacaggcagaagacacatctcccggagtgggtgcgcactgcaaatgtttttctttcttttctttggagctactgagtgttgtctactagccgctatggcctatgatcgctatgccgcaatctgcgaaccccttcgttatccactcctcctgagccatagagtctgtctgcagctggccggatctgcctgggcctgtggggtgttggtcgggcttggccacacccctttcattttctccttacccttctgtggcccaaacacaatcccacagttcttctgcgagatccagcctgtgctgcagctggtttgcggagacacctccctgaacgaactgcagattatcctggctaccgccttacttatcctgtgtcccttcggtttgatcctgggcagctatggtcgaatcctcgtaacaatctttcgcattccatccgtcgccggtcgccgtaaagcattcagcacctgttcatcacacctcattgtcgtctcattgttctacgggactgctctgtttatttatattagaccaaaggccagctacgacccagcaaccgatccgttggtcagccttttctacgccgtcgtgactcccatattgaatcctattatctattctctgcgcaacaccgaagtcaaggctgccctcaagagatag

SEQ ID NO: 52170 - DNA, 888 bp, Artificial Sequence
  Description of Artificial Sequence: Synthetic coding sequence
tcagtgaccgaattcctgctgttaggagtcacagatattcaggagctgcagccctttttattcgtggtgttcttgacgatatactttataagcgttgcagggaacggcgctatactgatgatcgtaatatccgaccccagattgcacagtccaatgtattttttccttggaaatcttagctgtctggatatttgctactcaagcgtgacattacccaagatgcttcagaattttctcagtgctcacaagatcagcagatcggggtgcgctctccagatgtttttctttcttttcttcggcgctactgaatgctgtctcttggccgcaatggcgtatgatcgatacgctgcgatctgtgaaccgttgcgctaccctctcctgctgtctcatcgggtgtgcctgcagctagccggatctgcctgggcatgcggcgtgctcgtcgggctcggacacacgcctttcatctttagtctccctttctgcgggcctaacaccattccacagttcttctgcgaaattcagcctgtcctgcaactagtgtgtggggacacctctctcaacgagttgcaaatcattctcgctactgccttgcttatcctgtgtcctttcgggttgatacttggctcttatggcaggattctggtcaccatattcagaatcccaagcgtggctggcagacgaaaagctttttcaacttgctcctcccatctcatcgtcgttagcctcttctatggcacagctttatttatctacattaggcctaaagctagttatgatccagctactgatccacttgtgtcccttttctacgctgttgtcacaccgattctgaaccctattatctactcgttaagaaatacagaggtaaaggccgcactcaaaaggtag

SEQ ID NO: 52171 - DNA, 888 bp, Artificial Sequence
  Description of Artificial Sequence: Synthetic coding sequence
tctgttacagagtttctgctgttgggggtgactgatatccaggagctacaaccatttttgttcgttgttttccttaccatctactttatatccgtcgccggaaacggtgctatcctgatgattgttatctccgatccaagattacactctccgatgtattttttcctcggtaatctgagctgcctcgacatatgctattctagcgtgactctgcccaaaatgctgcagaacttcttatctgctcacaagattagccgatctgggtgcgcactgcaaatgtttttctttcttttcttcggcgctacagaatgttgcttattagctgctatggcttatgatcgttacgcagctatctgcgagcctcttcgctaccctctcctgctgtcccacagagtgtgtctacagctggcaggcagcgcctgggcctgcggcgtgcttgttggactcggccatacccccttcattttttccctacctttctgtggaccgaacactattccccagttcttttgtgagatccagccagtgctgcaactagtatgcggtgatacctctcttaacgagttacagataatcctcgcgactgctctgttaatcctgtgtccctttggattaatcctgggcagttacgggagaattctggtgactattttccggatccctagcgttgcagggagacggaaggcttttagtacctgttcatcccatctgatcgtagtgagtctgttctatggaaccgccctttttatctatatcagacctaaggcctcatacgatccggctaccgaccctctggtgtccctcttttatgcagtggtgaccccaatcctaaatccaatcatatacagtttgaggaatacagaagtcaaagcggctcttaaaagatag

SEQ ID NO: 52172 - DNA, 939 bp, Artificial Sequence
  Description of Artificial Sequence: Synthetic coding sequence
atggaggtcaagaactgctgcatggtaaccgagttcattctcctggggattcctcatacagaggggcttgaaatgaccttatttgttctcttcctgccgttttacgcctgcacgttactggggaacgtttccatacttgtagctgtgatgtctagtgccagactccacactcccatgtattttttcctcggaaacttgagcgtgttcgacatgggcttctcatctgtgacgtgccctaagatgctcctatatcttatgggactgtcaagactaatttcgtacaaagattgcgtctgccagttgttcttttttcatttcctcggatcaatagaatgcttcttgttcacagtgatggcatacgatcggtttacagccatttgctatcctctgagatatactgtaataatgaatccgcgaatttgcgtggccctggctgtggggacatggttacttggatgcatacattcaagtatactaacaagcctcacattcacacttccttattgcggccctaatgaagttgatcatttcttttgcgacatcccagccctcctccctctggcctgtgccgacacttccctggcacagagggtgtccttcaccaatgtcgggctgattagtttggtgtgctttttgttgatcttgctgagctatacccgcatcacaattagtatcctgagcatacgcacaacagaaggtcggagacgcgctttctccacatgcagtgcacatttgatcgccatcttgtgcgcctatggacccattatcacagtgtatctgcagcccacaccaaacccaatgctagggactgttgtacaaatcctcatgaacctggtgggccctatgctgaaccccttgatatataccctgagaaacaaggaagtgaagactgccctgaaaacaatcctgcaccgaaccggccatgtgcccgaatcgtag

SEQ ID NO: 52173 - DNA, 933 bp, Artificial Sequence
  Description of Artificial Sequence: Synthetic coding sequence
atgggtaaaactaagaacacttccctggatgccgtcgtgacagacttcatcctattgggcctttcacaccccccaaaccttcgatctctgctttttctggtttttttcatcatctatattctgacccagctgggaaacctgttgatcctgttgaccatgtgggctgacccaaagctttgtgcccgtccaatgtacatcctgctgggcgtgctcagcttcctggacatgtggttgtcatctgtgaccgtgcctagacttatattggacttcacacccagcataaaggctatcccattcggtggttgcgtggcccagctttacttcttccacttcctgggctccacccagtgtttcttatacacgttgatggcatacgaccgctacctggccatttgccaacccttgcattatcctgtactcatgaacggcaggctctgcaccgttctcgttgctggtgcatgggttgcaggttccatgcatggcagcatccaggccactctcaccttcagactcccatactgtggcccaaaccaggtcgactatttcatatgcgatattagagctgtcctgcgcctagcctgtgccgacactactgtaaacgagctggtgacattcgtggacgtacgggtcgttgctgcttcctgtttcatgctcattctgttgtcatatgcgaatatcgtacatgcgatcctgaaaataagaacagcggacggacgcagaagagcattctctacatgcggatctcatctgatcgtggtgaccgtgtattacgtgccttgcatctttatctatctgagagctgggtccaaggatcccctcgacggtgcggcagcagtattctacacagttgttactcctttgcttaacccccttatctacaccctgcggaaccaggaagtgaaaagcgcgctcaaacggatcaccgccggttag

SEQ ID NO: 52174 - DNA, 942 bp, Artificial Sequence
  Description of Artificial Sequence: Synthetic coding sequence
atggagcggatcaactccacccttctgaccgcctttatactgaccggtatcccataccccctacgcttaagaaccctgttcttcgtgttcttcttcctcatctatatcttgacacaacttggcaatcttctgatcctaattacagtgtgggccgatccaagattacatgcacgcccaatgtacatttttctcggggtgctatctgttatcgacatgtctatttctagcattattgtgccacgactgatgatgaactttacactaggagtgaagcccatccctttcggtggatgtgtggctcagctatatttttaccactttctcggatctactcaatgctttctttataccctgatggcttacgacaggtacctagcaatttgtcagcccttgagatatcccgttctgatgactgcaaaactgtcagccctgctggtcgctggcgcatggatggccggatcaatacatggcgctcttcaggcaattcttaccttcagattaccgtattgtgggcctaaccaagttgactattttttttgcgacatccctgcagtgctgcgtctggcctgcgccgacacaaccgtgaacgaactggttacattcgtcgacatcggggtagtggtagctagctgcttcagccttatactgctgagctacattcaaataattcaagctatcctgcggattcacaccgcagacggacgcagacgcgctttctcgacctgtggagcccacgtgactgtcgtaaccgtctactatgtcccctgtgctttcatctatctccgtcctgaaaccaacagtccgctggatggtgcagcagctctagtccccaccgcgatcacccctttcttaaatcctctgatttatacactgcgcaatcaagaagtgaagctcgcgctcaaacggatgttgcggagcccgagaacaccctccgaggtttag

SEQ ID NO: 52175 - DNA, 936 bp, Artificial Sequence
  Description of Artificial Sequence: Synthetic coding sequence
atgtcaaatgctagcctggtcactgcgtttattcttacggggctgcctcacgcacctggacttgacgctctgctgtttggcattttcctcgtggtctatgtcctgactgtgctgggaaacttacttatcctgctggtgattcgagtcgactcccatttgcacacccccatgtactatttcctgaccaacctgtcattcatcgacatgtggtttagcacagtaaccgttcctaagatgcttatgacactggtatctccctcaggacgagccatatcctttcactcttgtgtcgcccagctttatttttttcacttcctcgggagtactgaatgcttcttgtacactgttatgtcttacgaccggtatcttgctattagctacccgttgcgctacacttctatgatgagcggatctcggtgtgcactgctcgccacaggcacctggttgagtggctccttgcattcagcggtgcagaccattttgactttccaccttccttactgcggaccgaatcagatacagcactacttctgtgatgcgccacctattctcaaactcgcctgcgctgacacttcagctaacgttatggtgattttcgtggacatcggcatcgtggctagcggctgtttcgtattgatagtcttaagctatgtgagcattgtatgtagtatactgcgtataagaacatcagacggtagacgccgtgcctttcaaacatgtgcctcgcattgcatcgtggtgctatgtttctttgtcccttgcgtggtgatttaccttagaccagggagcatggatgctatggatggtgttgtggccattttctatactgtgctgacaccgctgttgaatcccgtggtgtacacactgaggaacaaagaggtgaagaaagcagtgttaaaactgcgagacaaggtggcacacccacagcgcaagtag

SEQ ID NO: 52176 - DNA, 936 bp, Artificial Sequence
  Description of Artificial Sequence: Synthetic coding sequence
atgtccaatgcgaccctccttacagcctttatcttgaccggcctaccccacgctcccggactcgacgcccctctgttcgggatctttttagtggtctatgtactgaccgtgttgggaaatctcctgattctgctcgtgatcagggtggacagccatctgcatacgccgatgtactatttcctgactaacttgtcctttatagatatgtggttttccaccgtgactgtgcctaagatgctaatgactctggtgtctcccagcggtagaaccatcagttttcactcttgcgtggcccagttatatttcttccactttcttgggtctactgagtgctttctgtacacggtcatgagttacgatcggtatctcgcgatatcataccccttacggtatacaaatatgatgactggacgcagttgcgctctcttggccacaggtacatggttgtcaggctccctgcacagcgccgtccagaccatcctgacatttcatctgccttattgtggccctaaccagattcaacactacttctgcgatgccccacccattctgaagttggcttgcgctgacaccagtgccaacgaaatggtgatcttcgttaatattgggctggtggctagtggctgcttcgtgttgattgtgctcagctacgtatctatagtatgctccattctacggatccgtacatctgagggaagacatcgggcattccagacatgtgccagccactgtatcgtcgtactctgtttcttcggacccggactcttcatctacctacggccaggatctcgtgacgccctccacggtgtggtggcagttttttataccacactgacccctctttttaatcctgtcgtgtacaccctcagaaataaggaggtgaagaaggctctcctgaagctgaagaatggttccgtatttgctcagggggaatag

SEQ ID NO: 52177 - DNA, 936 bp, Artificial Sequence
  Description of Artificial Sequence: Synthetic coding sequence
atgtccaatgctagcttgctgaccgcatttattctgatgggcctgccacatgccccagccctcgacgcaccgctgttcggcgtgttcctggtggtttacgtgctgaccgttctgggaaatctactgattttacttgtaatacgtgtagacagccacttgcataccactatgtattattttctcactaacctgtctttcattgacatgtggttctctaccgtgaccgtcccaaagctgcttatgacattggtgttcccttctggccgtgctatcagctttcattcctgcatggcacagctctacttcttccactttctcggaggaaccgaatgttttctttaccgggtgatgtcatgcgacaggtatctggctatctcctatcccttgcgttacacatcaatgatgactgggaggagttgcactctactggctacttccacctggctgagcgggtctctgcactccgccgtgcaggcaattctgactttccacttaccgtactgcggccctaattggatccaacactatttgtgcgatgcaccccctatcctaaagctggcctgcgccgacacaagcgcgatcgagactgtgatctttgtaactgtggggattgtagcaagtgggtgctttgtcttaatcgttttgtcatatgttagtattgtctgtagcatcctgaggatacgtacgagtgaaggtaagcaccgtgcttttcagacttgcgcgagccactgcatagttgtcttgtgcttcttcgggcctgggctctttatttatttgaggccgggatcaagaaaggcagtggacggcgttgtggccgttttttacacggtcctcacccctcttcttaatccagtggtatacaccctccgaaataaagaagtgaagaaggccctgctcaagctgaaagacaaggtggcacactcacagagcaagtag

SEQ ID NO: 52178 - DNA, 936 bp, Artificial Sequence
  Description of Artificial Sequence: Synthetic coding sequence
atgagcaaaacttcattggtgaccgcatttattcttacaggcctgccacatgctcccggtttagacgccccactttttggcatatttcttgtcgtctacgtgctgaccgttctgggaaatcttttgatcctgttggtcattagggtggactcacatcttcatacgcctatgtattatttcttgactaatttgtcatttattgacatgtggttcagcacagtgactgtgccgaaaatgcttatgactctcgtctcaccatcaggcagagctataagtttccacagttgcgttgcccagctgtactttttccacttcctgggatcaactgaatgtttcctctatacggtgatgtcatacgatagatatctggcgatttcttatcctctcaggtacacctcaatgatgtccgggtctcgatgtgccctcctcgccacatccacatggctctccgggtcattacacagcgccgtccaaaccatcctgacgttccatctaccatattgcggccctaatcaaatccagcattacctctgtgatgccccacctattctgaagctcgcttgtgcagatacaagtgccaatgagatggtgatctttgttgatataggtctcgtcgcttccggctgtttcctgttgattgtactatcatacgtgtccatcgtctgttctatactgcggattcatacatctgagggacgacaccgcgcattccaaacctgcgctagccattgcattgtggtgctgtgcttcttcgtcccgtgtgtcttcatctacctcaggcctgggagcagggatgtggtcgacggggttgtcgctattttttacactgtcctgacccccctcctgaacccagtggtgtacacgttacgcaataaagaagtgaagaaagcagttctgaagctgcgggataaggtcgcgcatagccagggcgagtag

SEQ ID NO: 52179 - DNA, 957 bp, Artificial Sequence
  Description of Artificial Sequence: Synthetic coding sequence
atgcagagggcaaaccattctacggtaacccaatttatcctcgtaggattctctgtgtttccacatctccagctgatgctattcctgctgttccttctaatgtacctgttcacattactggggaacctgctcataatggcaacagtctggtctgaacggagcctgcacacacctatgtacctgtttctttgtgccctgtcagtgtctgaaattctttataccgtggccatcataccacgcatgctggctgacctgctatccactcagcgctccatcgccttcctcgcctgtgcatcacagatgttcttctcattctcattcggatttactcacagctttctgctcactgtgatgggatatgataggtacgtggctatctgtcacccgctgcggtataacgtgcttatgtcacccagaggatgcgcttgcctggtaggctgttcttgggcagggggattggtgatgggcatggtggtcacaagcgctattttccaccttgcattttgtggccataaggagatccaccactttgcctgccatgtgccccctcttcttaagctggcatgtggcgatgatgtgctcgtcgtcgctaaaggtgtcggccttgtgtgtatcactgcccttctaggctgtttcctcttgattcttctgtcttacgcattcattgtcgcagcgatattgaaaatcccaagtgctgagggcaggaacaaggcattctcaacctgcgctagccacctgacagtagtggtggtacattacgggtttgccagcgtgatctatctgaaacccaagagccctcagagcctggaaggcgatacactcatgggaattacctacacagtactgacgcctttcctctcaccaatcatcttcagtctgcgcaataaagagctcaaagtcgccatgaaaaagaccttttttagtaagctgtatcctgaaaaaaatgtcatgatgtag

SEQ ID NO: 52180 - DNA, 948 bp, Artificial Sequence
  Description of Artificial Sequence: Synthetic coding sequence
atgcttggcttgaaccatacaagcatgagtgagtttatcctagtggggttttcagcttttccccacttacagctgatgttattcctgctgtttttattgatgtatctgttcacccttctaggaaatctattgataatggccaccgtgtggtccgagaggagcctccacaccccaatgtaccttttcctgtgcgtactctccgtttcagaaatcctatacaccgtcgctatcataccgaggatgctggctgacctgttgagcacgcagaggtctatcgcctttttggcctgtgcatcccagatgtttttcagcttttccttcgggtttacacatagcttcctgcttacggtgatgggctatgatagatacgtagccatatgccacccgctgcggtacaacgtcctgatgtcccccagagggtgcgcctgcttggtcggctgttcctgggcaggcggttccgtcatgggtatggtggttacttctgcaatcttccagttgacgttttgcggctcccatgaaatccaacattttttgtgccacgtgcccccactgttaaaactggcatgcggcaacaacgtgcccgctgtggcgctaggagttggactggtgtgcatcatggcactcctcggatgcttcctgcttatactgctaagctacgcatttatcgttgctgacatcctgaagattccgtccgccgagggcagaaataaagccttctcaacatgcgctagccatctgatcgttgttatcgtgcactacgggtttgccagcgttatctaccttaaaccgaagggaccccacagtcaggagggcgacaccctcatggccaccacatatgcagtgctgaccccttttctttccccaatcatcttcagcctgcggaataaagaactaaaagtcgcaatgaaacgcacttttctgtccactctgtattcaagcgggacctag

SEQ ID NO: 52181 - DNA, 951 bp, Artificial Sequence
  Description of Artificial Sequence: Synthetic coding sequence
atgccagggcagaattaccggacaattagcgagtttatcttgagcggctttagtgcattcccacaacagctgctgccggtgctgttcttgctatacctattgatgttcctgttcaccctgttaggcaatcttctgatcatggctaccgtgtggatagagagaagactacatacacctatgtatctttttctctgtgctctgtccatcagcgaaatcctgtttaccgttgcaataaccccacgcatgctagctgaccttcttttcacccaccgttccatcaccttcgtagcatgtgctatccagatgttcttctcctttatgttcggctttacacactcctttctgctgatggttatgggctacgatcactacgtgactatctgtcaccccttgcactacaatatgctcatgagtccacggggttgcgctcatcttgtggcctggacttgggccggtggatctgtgatgggaatgatggttaccatgatggtgtttcatttgaccttctgcggatccaatgtgatacaccacttcttatgtcatgtcctaagtttattgaagttggcctgcggatcaaagacatcctcagttataatgggggtcatgctcgtatgtgtgactgctttgattggatgtctattcctaatcatcctgtccttcgtgttcatagtggccgcaatcctaaggatacctagtgcagagggcaggcataaaaccttctctacatgtgtctcgcacctgacagtggtggtgatgcactattccttcgccagtctgatatatttgaagccaaagggcctgcacagcatgtattcagacgcgctaatggccactacatacactgtctttaccccctttctgtctccaatcatctttagcctacgcaataaagagctgaagaacgcaataaataagaacttttgcaggcgattctgtcctctcagttcctag

SEQ ID NO: 52182 - DNA, 951 bp, Artificial Sequence
  Description of Artificial Sequence: Synthetic coding sequence
atgccaagccaaaattactccatcatctctgagtttaatctgttcggtttctctgcctttccgcagcatcttctgcctatactctttttgttgtacctgctcatgttcctgtttacacttctggggaacctattgattatggctactatttggatcgagcacagactgcatactccgatgtatctcttcctctgtaccctgagtgtgtcagaaatattatttacagtggcaatcacccccaggatgcttgcagacctcttaagcacacatcatagtatcacgttcgttgcttgtgccaaccaaatgttcttttcattcatgtttggtttcactcacagttttcttctgctcgtgatggggtacgatcgctacgtcgctatatgccaccctctaaggtacaatgtgctgatgtctccccgagattgtgctcatctggtggcctgcacatgggccggaggcagcgttatgggaatgatggtgactaccatcgtcttccacctcaccttctgcggcagtaacgtgattcatcacttcttctgccacgtgctgagtctgctcaaattggcctgcgaaaataagacatcctccgtaatcatgggcgttatgctcgtgtgcgtcaccgccctaatcggctgtcttttcctcatcatcctgtcctacgttttcatagtggcggctatcctcaggataccctcagccgaaggcagacacaagactttcagcacctgtgtttctcacctcacagtggttgtaacgcattacagttttgcatctttcatctacctgaagcccaaagggctgcattctatgtactccgacgcactcatggcaactacctacaccgtgtttacacctttcttatcccccattatcttttctctgcggaacaaagaattgaaaaatgccatcaataaaaacttttaccgtaaattttgcccaccttcctcctag

SEQ ID NO: 52183 - DNA, 948 bp, Artificial Sequence
  Description of Artificial Sequence: Synthetic coding sequence
atgcaggggcttaatcacacctcagtgtctgaattcatcctggtgggattttccgcattccctcatttgcaactgatgttgtttctgctgtttctgttgatgtatttattcacactgctaggcaacctgctgattatggcaaccgtttggtccgagcgaagccttcatatgcccatgtatctcttcctctgcgctcttagcatcacagagattctctataccgttgctataattcctcgcatgcttgccgatctcctaagcacccaacgctccatcgcgtttctggcatgtgctagccaaatgttttttagtttctcttttggttttacccactcttttctactcacggtgatgggctatgacagatatgtcgctatttgtcaccccttacggtataatgtgctgatgagtctgcgtggatgtacttgccgcgtcggctgctcttgggccggaggtctggtaatgggaatggtggtcaccagcgcgatatttcaccttgctttttgcgggcacaaggaaattcaccattttttttgccatgttccgccactgttgaagctggcctgtggggacgacgtcctcgtggttgcaaagggggtgggccttgtctgcattacagctctgctgggatgctttctcctgatactgctgtcttacgctttcattgtcgctgccatccttaaaatcccatctgccgaagggagaaacaaagctttctccacatgcgcatcccacctcacagtcgtggttgtgcactacggatttgcctcagtcatttacttaaagcctaagggccctcaatcccccgagggggataccctcatgggaatcacatatacagttttgacacctttcctgtcccccattatcttttcactccggaataaggagctgaaagtcgcaatgaagaaaacttgttttaccaaactgtttccacaaaattgttag

SEQ ID NO: 52184 - DNA, 963 bp, Artificial Sequence
  Description of Artificial Sequence: Synthetic coding sequence
atgctgctgtgttttagattcggaaaccagagcatgaagcgtgagaactttacattaatcacagactttgtgttccaaggcttttcaagtttccacgagcaacagatcacactgtttggggtcttcctagccctttatatccttactctggcgggtaacatcatcatcgtgacgattatccggatggatctgcacctccatacccctatgtactttttcctctctatgctgtcaacatccgagaccgtgtacactctggtgattttgcccagaatgctatcctcactggtggggatgagccaaccaatatcccttgcgggatgcgctactcagatgtttttcttcgtgacattcggaatcacgaattgctttttgttgacagctatgggttacgacaggtacgtggccatctgcaaccctctcaggtatatggtgatcatgaacaagcgccttcggatccaactggtcttaggtgcctgcagcattggcctgatagtcgctatcacccaggtgacctctgtcttccgacttccattttgcgctcgtaaagtccctcacttcttctgcgacatccgccctgtgatgaagctgtcatgcatcgatactacagtgaatgagatacttacacttatcatctctgtcctcgtcctggtcgttcccatggggcttgtcttcatttcatacgtcctgattatctcaactattctcaagattgcctctgtcgagggcagaaagaaggcctttgccacttgcgccagccacctcacagtcgtgattgtgcactattcctgcgcatccatagcgtacctgaagccaaagagtgagaacaccagagagcacgaccaactgatctccgttacctatacggtgatcactcccctcctaaatccagtcgtgtataccctgcggaataaggaagttaaggacgcactgtgccgagctgttggcggaaaatttagttag

SEQ ID NO: 52185 - DNA, 990 bp, Artificial Sequence
  Description of Artificial Sequence: Synthetic coding sequence
atgccgaaactaaattctacctttgtgaccgagttcctattcgagggattcagctcattcagacggcagcacaaactcgtctttttcgttgtgtttttaaccctttaccttctgaccctctccggaaacgtgattatcatgactatcatcaggttagatcaccaccttcatactcccatgtatttttttttatgtatgctctccatcagtgagacttgctatacggtggcgatcattccgcatatgctgagcggactgctcaacccccatcagccaatcgctacgcaaagctgcgctacacagctctttttctacctgaccttcggcatcaacaattgctttctgttaacagtcatgggctatgacaggtacgtcgccatctgtaatcctctccgctattccgtcatcatggggaaacgagcctgtattcaattggcttctggaagcctgggtattgggctaggaatggccatcgtgcaggttacaagcgtcttcggtctcccattttgcgatgccttcgtgatttctcattttttctgcgatgtgaggcacttactgaaactggcctgtaccgacaccaccgtaaacgaaatcataaattttgtggtgtcagtttgcgtgctcgtgcttcctatgggactggtgttcatcagttacgtgctcatcattagcacaattttaaagatcgcttcagccgaggggcagaagaaggcctttgccacttgtgcatcccatctgacagttgttattatacattacgggtgtgcttccatcatctatcttaagcctaagtcacagtcgtccctcggacaggatcgcctgatctcagtaacatatacgcatcactcccccaccgagccttgctgtgtccagcccgaagagcagggcggacagagatgttccgcacaatcaagaggggctaaaaacagtgtgtctttgatgaagaggggatgcgagggtttttcgtttgcattcataaatatgtactag

SEQ ID NO: 52186 - DNA, 930 bp, Artificial Sequence
  Description of Artificial Sequence: Synthetic coding sequence
atgaagagaaaaaattttaccgaagtgtccgaattcatcttcctggggttttcaagtttcggcaaacaccagatcacattgttcgtggtgtttctgacggtgtacattctaacgttggttgcaaacattattatagtcacaatcatatgtattgatcaccacctccacacaccgatgtacttctttctgtctatgctggccagcagcgagaccgtctacactctggttatcgtgcctcgaatgcttctgtcgttgatcttccataaccagccaatctcactcgctggttgcgccacgcagatgttcttctttgtcatcctggcaactaacaattgcttcctgctgaccgccatggggtacgatcggtacgtggctatttgtcggcctctgcgatatactgtcattatgagtaaagggctctgcgcacagctggtttgcggctcgttcgggatcgggttgactatggccgtcttacatgtcaccgccatgttcaatctccccttctgtggcaccgtggtggatcattttttttgcgatatatatcccgtgatgaagttatcatgcatcgacaccactatcaatgaaatcatcaactatggtgttagcagctttgttatattcgtgcccataggccttatcttcatcagctatgtactggtgatttctagtattctgcagatcgctagcgctgagggccgtaagaaaacttttgccacctgtgtgtcacatctcaccgttgtgatcgtgcattgtggctgtgcatccatagcctatcttaagcccaaatctgaatcatccattgaaaaagacctggtcctatctgtgacctacaccatcattactcctctgctgaatccagtggtatactctctcagaaataaggaagttaaggatgcactctgccgggtcgttgggagaaatatcagttag

SEQ ID NO: 52187 - DNA, 942 bp, Artificial Sequence
  Description of Artificial Sequence: Synthetic coding sequence
atggaacaggtaaacaagaccgtggtgcgggagttcgtcgtgctcggcttttcatcactggccaggctccagcaattattgttcgttatctttctgctcttatatctgttcaccctgggaacaaatgccataatcatcagcaccatcgtgctggacagagcgctacacacacccatgtatttcttcctcgctatactcagctgttccgagatttgctacaccttcgtcattgtcccgaagatgctggttgacttgctgtcacagaaaaagaccatcagcttcctggggtgcgcgatccagatgttcagttttctgtttttcgggagctcacactcttttctgctggcagctatgggatacgaccggtatatggcgatatgtaatcccctcaggtatagcgtcctgatggggcacggggtctgtatgggcctcatggcagctgcctgtgcctgcggattcacagtttcactggtgacaacttcccttgtctttcatctgccgtttcattcaagtaatcagctgcaccacttcttttgcgatatctcccccgtgctgaagttagcctcccagcattcagggtttagccagctcgtgatatttatgctgggcgtctttgccctcgtgatcccattattactgatcttggtctcctatatccgaataatctctgctattttgaagatcccaagctcggtgggcagatacaaaacgttcagtacatgcgcaagccacctcatagtggttaccgtgcattactcatgcgcgagcttcatctaccttaggccaaagacaaattataccagttctcaggacaccttgatttccgtctcttacacgattctcacgccactgttcaatccgatgatttattctctgaggaacaaagaattcaagagcgcactgcggagaacgattgggcaaaccttttatcctctctcttag

SEQ ID NO: 52188 - DNA, 939 bp, Artificial Sequence
  Description of Artificial Sequence: Synthetic coding sequence
atggaacgggtcaacgaaacagttgtcagagaggtcatcttcctggggttctcctcattggcacggctgcagcaattacttttcgtcatcttcctgctcttatacttgttcaccctggggaccaatgctatcatcattagcaccattgtcctggacagggccctccacataccaatgtatttctttctggctatcctcagttgttcagagatttgttataccttcataatcgtgcccaagatgctcgtcgacctactttctcagaaaaagaccatctcctttctgggctgtgctattcagatgttttctttcctttttctcggctgtagccatagctttctgctcgctgtcatgggctacgatcggtacatcgcaatttgcaatcccctaaggtatagtgtgctgatgggccacggcgtgtgcatgggcctcgtggcggcagcctgcgcgtgtggctttaccgtggcccagatcatcacatcccttgtttttcacttgccattctatagctcaaatcaactgcatcactttttttgcgacatcgccccagtactcaaactcgcctcccaccacaatcacttttctcagatcgtcatctttatgttgtgcacactcgtgctagcgatacccttgctactgatccttgtgagttacgtccacatactgagcgctattctgcagttcccctccacactcgggagatgtaaggccttcagcacatgtgtgagtcacctgatcatcgtgaccgtgcactacgggtgtgccagctttatttatctgagaccacaatccaattactcttcatcccaggatgccttgatcagtgtttcatataccatcatcacaccattattcaaccccatgatttactcgctaaggaataaggagttcaagtctgccctatgtaaaatcgtgcgcaggactatctctcttttgtag

SEQ ID NO: 52189 - DNA, 942 bp, Artificial Sequence
  Description of Artificial Sequence: Synthetic coding sequence
atggcaggcgaaaatcacaccacactgcccgagtttctgctcctgggcttctctgatcttaaggccctccaaggacctctgttctgggtcgtactcctggtatacctggtgactctactcggaaactcactaatcatattgctcacacaggtgagccccgctctccactccccaatgtacttctttctgcgccagctgagcgttgtcgagttattttatacaacggacattgttcctagaaccttggcgaatctcggctctcctcacccacaggccattagctttcaggggtgcgccgcacagatgtatgtgttcatcgttttggggattagcgagtgctgcctcttgaccgccatggcctacgaccgttacgtcgcaatttgtcaaccgctgagatacagtacgcttctgagccctcgcgcatgtatggcgatggttggaacctcctggctgacagggatcatcaccgccaccactcatgcgagcctgattttcagtctgccctttaggagccatcctatcattccgcacttcctttgcgacatcctgccagtcctgaggctcgcttctgccggaaaacatcgctctgagatatcagtgatgacggcaaccattgtcttcattatgatcccattctcgctgatagttacgtcatacatcagaatcctgggcgctatccttgcaatggcctcgacccagtctaggcgcaaggtgttttcaacatgctcttctcacctgctcgtagtgtcccttttcttcggaaccgcctcaatcacatatattcgccctcaagccggtagttcagtaacaacggatagggtattaagtctgttctatacggtgataacacccatgctgaatccgattatatacacccttaggaacaaagatgtgcggagggctctccgacacctggtgaagcggcagcgaccaagcccatag

SEQ ID NO: 52190 - DNA, 960 bp, Artificial Sequence
  Description of Artificial Sequence: Synthetic coding sequence
atgcctgttggtaagctggtatttaatcagagcgagcctaccgaattcgtgtttagagcttttacaacagccactgagttccaggttctcctcttcctgctcttcttactcctctacctgatgatactgtgtggcaataccgccatcatctgggtagtgtgcacccactccactctcagaactccgatgtatttcttcctctcaaatctgtcctttttggagctttgttacacaactgtggtcgtgccactcatgttgtccaatatcctcggagctcaaaaacctataagcctggccggatgcggtgcgcagatgttcttctttgtaacgctcgggtcaaccgattgcttcttattggccattatggcttatgatagatatgtcgccatttgtcatccactgcattataccttaatcatgactcgggaactgtgtacccagatgttaggaggtgcgcttggactcgcccttttcccgagtttgcagcttaccgctctaatcttcactctgcctttttgcggccaccaccaggaaattaaccacttcctgtgcgacgttcctccggtcctccggctagcatgtgctgatatacgcgtgcatcaggcagtactgtacgtagtgtctatcctggtgctgactattccctttctgctgatatgcgtttcctatgtgtttataacatgcgccatcctgagcatccgctcggctgagggcaggagaagagcgttctctacctgcagctttcatctgaccgtggtcctgctgcagtatggttgttgcagcctggtctacctgagaccacggagttcaaccagtgaagacgaagactcacagattgccctggtgtacaccttcgtaactcccctgctgaaccccctcctatattccctgcgcaacaaggacgtgaaaggggctctgcggagcgccatcatccgcaaagccgctagtgacgccaattag

SEQ ID NO: 52191 - DNA, 1008 bp, Artificial Sequence
  Description of Artificial Sequence: Synthetic coding sequence
atgccccagatcctaatattcacctacctaaatatgttttattttttcccgcctctacagattctggcagagaatctgactatggtgaccgagttcctgctgctcggctttagtagtcttggagagattcaactcgccctgttcgtcgtgtttttgttcctgtacctcgtgatcctttcaggcaacgtgactattatttccgtcatccacctcgacaaatccttgcatacaccaatgtacttcttcttaggaatcctcagcaccagcgaaaccttttatacctttgtgattcttcctaagatgttgataaatctgttgtccgttgccaggaccatcagtttcaactgttgcgcgctgcagatgttcttttttttaggcttcgcgataactaactgtctgcttttgggggtaatggggtatgatagatacgccgcaatctgtcatccactacactatcccacgctcatgtcatggcaagtgtgtggaaagctggccgctgcctgcgccatcgggggtttcctggcttccttgactgtggtgaacttggtgtttagcttgccgttctgctcagccaacaaggttaatcactatttctgcgatatctcagccgttatacttctggcatgcacaaacaccgacgtaaatgagttcgtcattttcatttgtggagtgctggtactggtcgttccctttctctttatctgtgtgtcatatctgtgcattctccggacaattcttaagataccatctgccgaggggagacggaaggccttcagcacatgcgccagtcacctcagcgttgttattgttcattatggctgtgcatctttcatttacctgagacccacagccaattatgtgtctaacaaagaccggctggtgacagtcacctataccatcgtgacaccgctcctgaatccaatggtgtacagtctgaggaataaggacgtccagctggcgatcaggaaagtactgggcaagaaaggcagtttgaagttgtacaattag

SEQ ID NO: 52192 - DNA, 996 bp, Artificial Sequence
  Description of Artificial Sequence: Synthetic coding sequence
atgacttcccgttctgtctgcgaaaaaatgaccatgactaccgagaatccaaaccagaccgtcgtatcacatttcttcttggagggattgaggtacacagcaaaacatagtagtttgttctttttattgttcctgttgatctattccattacagtggctggtaacctgttgatcctcctcaccgtgggtagtgattcccacctatccttacctatgtaccattttcttggccatttgtcatttctggacgcctgcttgtccaccgttactgtgccaaaagtcatggccggactgctaaccctggacggaaaggttatcagctttgagggatgcgccgtacaactgtattgctttcacttcttagcatctacagagtgtttcctgtacaccgtgatggcctacgaccggtatctcgccatttgtcagccgctgcactatcctgtggcaatgaaccggcgtatgtgtgccgagatggccggaatcacttgggctatcggggctacacacgccgcaattcataccagtctgacctttagactgctgtattgtggaccatgtcacattgcctactttttttgcgatatccctccagtcctcaagcttgcctgcaccgacaccactattaatgaactggtaatgttggcctctattggtatcgtggccgcaggatgtctgatacttattgtcattagctacatctttatagtggcagctgtgctccgaatccgcacagcccaaggaaggcagagggccttctccccatgtactgcacagttgaccggcgtccttctctactatgtgcctccagtgtgcatatatctgcagcccagatcctcggaggccggtgctggtgccccagccgtgttctatacaatcgtcacacctatgctgaaccccttcatctataccctgcgcaacaaggaagtgaaacacgcactgcagcggctcttgtgctcatcattcagggagtccactgcaggtagtccccctccttag

SEQ ID NO: 52193 - DNA, 945 bp, Artificial Sequence
  Description of Artificial Sequence: Synthetic coding sequence
atgcgcggtttcaacaaaacgacagtagtgacccaatttatacttgtgggattcagttcattgggggaactgcaacttctgttgtttgtgatctttctgctgctctacctgacaatcctggtggccaacgttacgattatggcagtaataaggttcagttggacactccacacccctatgtacgggttcctttttatcttaagtttcagcgagagctgttacaccttcgtcatcattcctcagctgttggtccacctgttaagcgacaccaagacaatctccttcatggcatgtgctacccagctgtttttcttccttggttttgcatgcaccaattgccttctcatcgccgtgatgggctacgatcgatatgtggccatctgtcatcccctgagatacacgctcattattaacaaaaggcttgggctggaactgattagcctgtctggcgctacaggctttttcatcgcgctggtagccacaaatctgatatgcgatatgcgattttgcggcccaaaccgtgtgaaccactacttttgtgatatggcccctgtgatcaagttagcctgtacagatactcacgtcaaggaactcgccttgttttccctttctattctagtgattatggtgccatttctgctgattctaatttcctatggtttcatcgtgaatactattttaaaaatccctagtgctgagggtaagaaagcctttgtgacctgtgctagtcatctgactgtcgttttcgtgcactacggatgtgcttcaataatctacctgcgtcccaaatccaagtccgctagcgataaggaccagttggtagccgtcacttacacagtggtgacgcccctgttaaatcctctggtttactctttaaggaacaaagaggtgaagacggccctcaagagagttctcgggatgcctgttgctactaagatgtcctag

SEQ ID NO: 52194 - DNA, 930 bp, Artificial Sequence
  Description of Artificial Sequence: Synthetic coding sequence
atggaggggatcaataaaactgccaagatgcagttcttcttcagacccttttccccagatccggaagtccagatgctgatcttcgtagtctttctcatgatgtacctgactagcctaggtgggaatgcaaccatagctgtaatagtgcagattaaccatagtcttcacacacctatgtatttttttcttgctaatttggccgtcctggagatattttacaccagcagcatcacccccctggcgttggccaatctcctgagcatgggtaaaacccccgtgtctatcactggctgtggtacccagatgttcttttttgtgttcctggggggagccgactgcgttctcctggtggtgatggcgtatgaccagttcatcgcgatctgtcatccactgaggtatagactgatcatgtcttggagtctttgcgtggaactcctcgtggggtcgctggttcttggctttctgctttccctcccgctgaccatactaatctttcacctacccttttgtcacaacgacgagatttatcacttctattgcgacatgcccgcagtcatgcggctggcatgtgctgatacccgcgtgcacaaaacagcactttacatcatttcattcattgtgctcagcattccactcagcctcatcagcatctcatacgtgttcattgtagtcgccattctcagaattcgctctgccgagggccgacaacaggcgtattccacatgtagttctcacatattagttgtgctgttacagtacgggtgtaccagttttatttatctcagcccgagctcatcctattcaccagagatgggaagggtggtgtccgttgcctatacattcattacgccaatcctgaatcccctgatttatagtttgaggaataaagaactgaaagatgccctgagaaaggccctcagaaagttctag

SEQ ID NO: 52195 - DNA, 918 bp, Artificial Sequence
  Description of Artificial Sequence: Synthetic coding sequence
atggagtttgtatttctggcatatccaagttgtcccgagctccacattcttagcttcttgggagtcagcttagtgtacgggctgatcatcaccggaaatattttgatagttgtgagtattcataccgagacttgtctatgcacgagcatgtactatttcctgggttcactgtcaggtattgagatatgttatacagcagtggtagtccctcatattttggccaacaccctccagtccgagaagacaataactctcctgggctgcgcaactcagatggccttcttcatcgcactcggaagcgcagactgctttctgctggccgctatggcttatgatcgttacgtcgctatatgtcatcccctgcagtaccccctgctgatgacactgaccttgtgtgttcatctggtggtagctagcgtgatatccggcttattcctgtcactgcagttggttgcttttatcttctcattgcccttttgccaggcacaggggatcgaacattttttctgtgatgtgccccctgtgatgcatgtggtgtgcgcacagtcccacatccacgagcagtccgttctggtagccgctatcctggccatagctgttccatttttcctgatcaccaccagctacacgtttatcgttgccgcactattaaagatccatagcgcggctggaagacacagagcgttcagcacttgctcttcccatctcactgttgttctgctgcaatatgggtgctgcgcctttatgtacctctgtccctcgagcagttacaatccaaagcaggaccgattcatctcactggtgtataccttagggaccccattacttaaccccctcatctacgccctccggaactctgagatgaaaggggctgtgggaagggtgctgacccgtaattgtctgtctcagaatagctag

SEQ ID NO: 52196 - DNA, 981 bp, Artificial Sequence
  Description of Artificial Sequence: Synthetic coding sequence
atggtacttaatgtctattgctgctttttccagatctccgacattcagactatgaagatcaatcagaccatcctcaaggagttcatcctggtgggcttctccgtttaccctcatgtacagaccttcctctttgtcgtcttcttctgtctgtatcttctgaccctcgcgggaaatcttattattatggggcttacctgggtggacagaagccttcacacgcctatgtacttgtttctctccgcactctccttttcagaaacgtgttataccttgactatcgtgccaaagatgctcgaggacttactggctaaggaccgctctattagtgtcacgggctgtagtttacagatgtgcttctttcttgggctcgggggaactaattgcatcatcctgacactgatggggtacgaccgttttctcgccatatgtaatcccctacgctaccccctcttgatgacgaatattgtttgtggccagcttgtggcctcagcctgtaccgcgggtttcttcatctcactgacagagactgcactcatcttcagggacagcttctgccgaccaaatctggtgaagcatttcttctgtcacatgcttgccgtcatcagactgtcatgcatcgactccaaccataccgaatttattattaccctaatcagtgtgtcgggcttgctaggaacgctgcttctgatcatcctgaccgacgtttttatcattagcacagttcttaggatcccctcagcagagggaaaacaaaaggcttttacgacttgtgcctcgcatctgactgtagtcattattcatttcgggtttgcaagtattgtgtacctgaaaccagaggcgtctggcgatgacaccctgatagctgtgccctataccgtgattacaccgttcctctcccccataatcttctcattgcgaaacaaggatatgaagaacgcctttaggcggatgatggggaacactgtggccttaaaaaagtag

SEQ ID NO: 52197 - DNA, 942 bp, Artificial Sequence
  Description of Artificial Sequence: Synthetic coding sequence
atgggtcaaaccaatgtgacttcgtggagagactttgtttttctggggtttagctcgtcaggagaattgcaattactgctgttcgccctcttcttatcgctttacctcgtcaccttgacttccaatgtattcattattatcgccatacgactggactcgcatctccatacccccatgtacctattcttgtcgttcctgagtttcagtgagacctgctataccctggggattatccccaggatgctgtctggcctggccggaggggaccaggccatatcctatgtggggtgcgccgcacagatgttcttttctgccagttgggcctgcacaaactgtttcctcctcgcagctatggggtttgacaggtatgtcgctatttgtgctcccctgcattatgcttcccacatgaacccgacactgtgcgcacagcttgtgattacatcctttttgactggctacctatttggattagggatgacactggtgatttttcacctctcattttgttcttctcatgagattcaacattttttctgcgatacgccacctgtgcttagcctagcatgcggcgatacgggtccgtctgagctgaggattttcattttaagtttgcttgtgctactggttagctttttcttcattaccatcagctacgcttatattctcgcagcaatccttcgaatcccatctgcagagggccagaagaaagccttctctacgtgtgcctctcacttgactgttgtgattatccattacggatgtgctagtttcgtgtatctccgacccaaggcctcctatagtctcgaaagggatcagctgatcgctatgacgtacaccgtcgttaccccattgctaaatcccattgtgtatagtttgcgcaatagagctatacaaacagccttgagaaatgccttcaggggccgactgttaggaaagggctag

SEQ ID NO: 52198 - DNA, 39 bp, Artificial Sequence
  Description of Artificial Sequence: Synthetic coding sequence
gtgaccccgcagaagctgtctttttgcagctctcattag

SEQ ID NO: 52199 - DNA, 948 bp, Artificial Sequence
  Description of Artificial Sequence: Synthetic coding sequence
atggaaattgtgagtacaggaaatgagactattactgaattcgtattgctggggttctatgatattcccgaactgcatttcctgttctttatcgtgtttactgccgtttacgtcttcattatcatcggcaatatgctcattattgtggccgttgtcagttctcagagattacataagcctatgtacatcttcctcgcgaacctcagcttcctggacatcttatatacaagtgccgttatgcccaagatgcttgagggcttcctgcaggaagctaccatctcagtcgcaggctgtctgctgcagttctttatttttggctcattagccacggctgaatgcctgctcctcgccgtgatggcctacgataggtacctggcgatctgctatccactccattaccccctgctgatgggccctcgtcgttatatggggctcgtggtcactacatggctgagtggctttgtggtggacggcttggtagtggctctcgtggctcaacttcgcttttgcgggccaaaccatatcgatcagttctattgcgacttcatgctgttcgtcgggttggcctgcagtgatccgagagtcgcgcaggtgacgaccctgatcctttcggtgttctgcttaaccattccgtttggactgatcctaacaagttacgcaagaatagtggtcgcagttttgcgcgtaccagcaggagccagccgaaggcgcgcattctctacttgttccagccatctcgctgtggtaaccacattctatggcactttaatgattttctacgttgctcctagcgccgttcactcccagctgctgtctaaggtgttctcactattgtataccgtggtaaccccactctttaacccagtgatctataccatgcggaataaggaggtgcatcaggccctgcgtaagatattatgtattaagcaaacagaaacactcgactag

SEQ ID NO: 52200 - DNA, 948 bp, Artificial Sequence
  Description of Artificial Sequence: Synthetic coding sequence
atggagatcgtctcaacagggaacgagacaattacagagtttgttcttctggggttctacgatattccagaactgcatttcctttttttcatcgttttcaccgctgtctatgtgttcattatcattggcaatatgctgataattgtcgccgtcgtctcgtcccagcggctgcataagccaatgtatatcttcttagcgaatctcagctttctggatattctctatacatccgccgtaatgccgaagatgctcgaaggttttctgcaggaggcgactatttctgttgccggatgcttgttgcagttcttcatctttggtagcctggccaccgctgagtgtcttctgctcgccgttatggcatacgaccggtaccttgcgatttgttatccactccactaccccctgctgatgggccctaggaggtacatgggactcgtggtcacaacctggctgtcaggctttgtggtagacgggctggtagtagctcttgttgcccaacttcgattctgcggcccaaatcacatcgaccagttctactgtgattttatgctgttcgtgggcttggcttgctccgaccctcgggtcgcgcaggtaacaactctgattttatcagtgttttgtctcaccattcccttcggactgattctgacctcctacgcacggattgttgttgccgtgctgagagtgccagccggtgcaagcagacgcagagcattttcaacatgctcatcccacctggccgtcgtgactaccttctacggcacactaatgattttttacgtcgccccaagtgcagtgcacagtcagttgctgtctaaagtgtttagcctcctctatacggtggtgacgccccttttcaatccagtgatctatactatgagaaataaggaagttcaccaagcacttaggaagatcctgtgcattaaacagaccgaaacccttgactag

SEQ ID NO: 52201 - DNA, 948 bp, Artificial Sequence
  Description of Artificial Sequence: Synthetic coding sequence
atggagatagtctcaaccggcaatgaaaccatcaccgagtttgtacttctggggttttatgatatcccagagctccacttcctcttctttattgtctttactgctgtgtatgtatttattattatcggtaatatgctgataatcgtcgcggttgtctcttctcaacgactgcataaaccaatgtacatattcctggccaacctttcattcctggacatattatatacttcagccgtgatgccaaaaatgctcgagggcttcctgcaagaagccaccatctctgtggccggatgcctgttgcagttcttcatttttggctccctcgccacagcagaatgccttcttttggctgtgatggcctacgataggtatttagccatctgttatccgctccattaccccctactaatgggcccacggagatatatggggctggtggtcaccacatggctcagtggattcgtggttgacggcctggtggtggcactcgtagcacagctccgtttttgtggaccaaaccacatagaccagttctactgtgacttcatgcttttcgtggggctcgcttgcagtgatccacgcgtggcacaggtaacaaccctcatcctgtctgtgttttgtcttacgattccgtttggtctaatcttgacatcgtacgcaagaatcgtggtggccgtgcttcgggtccctgcaggcgctagccgcaggagagctttctccacctgttcctcacacctggctgtcgtgacaactttctatggaaccctgatgatcttttatgtggcgccttcggccgtccactcccagctgctttccaaggtattctccctcctttatacagtcgtgacacccttgttcaaccccgtcatttatacaatgcgcaataaggaagtacatcaagcacttaggaagatcctgtgcattaagcagactgagacactggactag

SEQ ID NO: 52202 - DNA, 948 bp, Artificial Sequence
  Description of Artificial Sequence: Synthetic coding sequence
atggagattgtctctacgggcaatgaaactatcactgagtttgtattattggggttctacgatatacctgaactccactttttgttcttcatcgtgttcaccgccgtgtacgttttcataatcatcggcaacatgctgatcatcgtcgctgtggttagctcccagaggctccacaaaccaatgtatatcttcctggcgaatctgagttttctggacatcctgtatacctcagcagtcatgcctaaaatgttggaaggatttttacaagaagcaacaatcagtgtggcgggatgcctactgcaattctttatatttgggagtctggctaccgcggaatgcctccttttagccgtgatggcctatgaccggtacctggcaatctgctatccactgcactaccctctgcttatgggacccaggcgctacatgggcctggttgtgaccacatggttgtccggcttcgtggttgacggtctcgtagtggccctggtggcacagctcaggttctgtgggccaaaccacatcgatcagttctactgcgattttatgctatttgtggggctggcttgttcagacccacgggttgcacaagtcaccactcttatcctgagtgtcttttgcctcactattccttttggcctaatcctgacaagctacgcccgaatagtagtggccgtgttgcgggtgcccgctggcgcttcccgcagacgcgctttcagcacctgttcctcacacctggctgtagtgactaccttttacggtaccttaatgatcttctatgtcgctcctagcgctgtccatagccagctcctttctaaagtgttctctctgctgtacacagtcgtgactccgctgttcaaccccgtgatctacaccatgcgcaataaggaggtgcatcaggctctgcgcaagatcctttgcatcaaacaaaccgaaaccttggactag

SEQ ID NO: 52203 - DNA, 948 bp, Artificial Sequence
  Description of Artificial Sequence: Synthetic coding sequence
atggagatcgttagcaccggaaacgagaccataacggaatttgtgcttttaggtttctatgacatccctgaacttcattttctgttctttattgttttcaccgctgtttacgtgttcatcattatcggaaacatgctcattatcgtggccgtggtgagttcccagaggcttcacaaaccgatgtacatatttctcgccaaccttagctttctggacatcctgtatacaagtgctgtcatgcccaagatgcttgaaggatttctgcaggaagcgactatctcggtcgccggatgtttgctgcagttcttcatttttgggtctctcgccactgcagagtgtctgctgctggctgtgatggcatacgatagatacctggctatctgttatccactccactacccccttctgatggggccacggaggtacatggggttggtggttactacctggttgtctgggtttgtggtagatggcctagttgtggcgttagtcgctcagctgaggttttgtggccctaatcacatcgaccaattctactgcgacttcatgctgtttgtgggcttagcttgctcggatccacgagtcgctcaagtaactacactgatattatcagtgttctgtctcacaatcccttttggcctcatcctaacctcctacgcacggatagtggtagcggtgctgcgggtccccgctggagcttctcgaagacgggcattctctacatgttcctcacatctggcggtggttacaacattctatggtactcttatgattttttatgtggcgcctagcgcagtgcactctcagctgttgtccaaggtgttttcgctactgtacacagtggtaactccattatttaacccagtgatttacactatgcgcaataaagaggttcaccaggccctacgcaagattctgtgcatcaagcagaccgagacactagactag

SEQ ID NO: 52204 - DNA, 948 bp, Artificial Sequence
  Description of Artificial Sequence: Synthetic coding sequence
atggagatcgtatcgactgggaacgagacaattaccgagttcgtgcttctgggtttttatgatatcccagagctgcactttctttttttcatagtcttcacggctgtctatgtattcatcattatcggcaacatgctcattatcgtcgcagtagttagttcacaaagacttcacaagcctatgtacatctttctggccaacctcagcttcctcgacattctatacacttccgcagttatgcctaagatgttagagggtttcctccaggaagcgaccattagcgtggcagggtgccttctccagttctttatttttggctctctggccaccgccgagtgtctgctgctggctgtcatggcatacgatagatatttagccatctgttatcctttgcattatcctctgttaatgggtccaaggcgttatatggggctcgttgtaacgacatggctgagcggcttcgtcgtggacggcttagttgtggcgcttgtagcacagttacggttctgcggccctaatcacatcgatcagttctattgcgactttatgctgtttgtcgggctagcctgttctgatcccagagtagcacaggtgaccaccctcatcttatccgtcttctgtctgaccatcccattcggattaattctaacctcatatgctcggattgtagtggccgtactaagagtgcccgcaggagcgtcccggagacgcgcatttagcacatgctcatcacacttagctgttgtgacaactttctacgggacactaatgatattctatgtggccccttctgctgtgcatagtcagcttctgtcaaaagtattttccttgctgtatactgtcgtaacaccactcttcaatcccgttatttacactatgcggaacaaagaagtccatcaggctctgaggaagatcctgtgcatcaagcagacagaaactttggattag

SEQ ID NO: 52205 - DNA, 948 bp, Artificial Sequence
  Description of Artificial Sequence: Synthetic coding sequence
atggagattgtttctaccgggaatgagaccatcacagaattcgtcctgctgggcttctacgacattcccgaactccactttctgttcttcatcgtctttaccgccgtgtacgtgtttattatcatcggcaacatgctcataatcgtggctgtggtgagcagtcagagactccacaagccgatgtacatcttcctggccaacctgagctttttggacatactgtacaccagcgcggtcatgccaaagatgttggagggcttcctgcaggaggcgacaataagcgttgctgggtgtctcttacagttctttatatttggctctctggccactgccgaatgcttactgctggccgtgatggcttacgatagatacttggccatctgttatcccctgcactatccactgcttatgggccctaggcgatacatgggtctggttgtgaccacctggctgtccggttttgtggtcgatggtcttgtggtggccctggttgcccaactgcgattttgtggcccaaaccatattgaccaattttactgcgactttatgctatttgttgggctggcctgttcggatccaagagtggcacaggtgactacactgattctgagtgttttttgtcttaccatcccttttggcctcatactgacatcttacgcaagaatcgtagtggccgtcctgcgagtgccggctggcgcatcccggagacgtgcctttagtacttgtagctcacatctggcagttgtgactactttttacgggacactcatgatcttttacgtcgcgccttccgctgttcatagtcagctgttgagtaaagtattctcactcctgtatacagttgtcactcctctatttaatcctgttatttacaccatgcgcaacaaggaagtgcatcaggcactccgaaagattctatgcataaagcagacggagaccttggactag

SEQ ID NO: 52206 - DNA, 948 bp, Artificial Sequence
  Description of Artificial Sequence: Synthetic coding sequence
atggagattgtgagcactgggaatgaaaccattacagagttcgtgttgctcggattctatgatattcctgagttacactttctgttctttatcgtctttaccgcggtgtacgtgtttatcattattggtaacatgctgatcattgtcgccgtagtgtcctcccagcgcctgcacaaacctatgtacatctttctggctaatttgagtttcttggacatcctctacaccagcgctgtgatgcctaagatgctggagggcttcctgcaggaggcaaccatatcggtggcagggtgtctcttgcagttcttcatatttggatctcttgcaactgccgagtgcctgcttctagctgtgatggcgtacgaccgctacttggccatctgctacccactgcattatcctctgctgatggggccacgcaggtacatgggtctcgtggttacaacttggctcagcggctttgtcgtagacgggttggtggttgccctcgtggctcaattgcggttctgcggaccaaaccacatcgaccagttttattgcgattttatgttgtttgtggggctggcctgctctgacccacgcgtcgcccaagtcacgacattgatcctaagtgtgttctgtctgacgattccctttggcctcatcctcacatcctacgccaggatcgtggtggcggttctgagagtccccgctggggcttcccggcgaagggcatttagcacttgctcctcacacctggccgtcgtgacgacgttttacgggactttaatgattttttatgtggccccttcagcagtgcactcccagttgttaagcaaggtgttctctctgctgtacaccgtagtgacaccactgtttaaccctgtgatctataccatgcgaaataaagaagtgcaccaagccctgagaaagatactttgcatcaagcagacagagactctcgactag

SEQ ID NO: 52207 - DNA, 948 bp, Artificial Sequence
  Description of Artificial Sequence: Synthetic coding sequence
atggaaatagtctcaaccgggaatgaaactatcacggagtttgtgttacttggattctacgatatcccggagctgcacttcctcttcttcattgtatttactgccgtctacgtttttattattataggaaacatgctgattattgtggctgtggtttcctcccaacgactgcacaagccaatgtatatattcctcgctaatctgtctttcttggatatcctgtatacctctgcggtcatgcccaaaatgctggagggatttcttcaggaagccaccatctccgtggcgggatgtctcctgcagttctttattttcggaagtctcgctacggctgaatgtctgttgctagcggtgatggcttatgatcgataccttgcaatctgttatccgctgcactaccctctcctcatgggtccacgcagatacatgggtctggtggttacaacttggctgtcaggcttcgtggttgacggcctggtcgtcgcgttggtagcacagctacggttttgcgggcctaaccacatcgatcagttttactgcgacttcatgttgtttgtcgggttagcctgttccgatccaagagtagcccaggttacaacactgattctgagcgttttctgcctcactattccatttggcctaatcttgaccagctacgcacggatagtcgtggctgtgctgagagttccggcaggagcctcgcgacgccgagcttttagcacttgctcttcccacctggcggtcgtaacgactttctacgggacattaatgatcttctacgtggcacccagcgccgttcatagtcagctgctaagcaaggtgttcagtttattgtacacagtggttacacccctattcaaccccgtaatttatactatgcggaacaaagaggttcaccaggctctgagaaaaattctctgtataaaacagacggagactttggattag

SEQ ID NO: 52208 - DNA, 948 bp, Artificial Sequence
  Description of Artificial Sequence: Synthetic coding sequence
atggaaatagtgagcactggaaatgagactattacagagttcgtcttgctgggtttttacgacatcccagagcttcattttttgttcttcatcgtgttcacagccgtgtatgtgtttattattatcgggaacatgctgattattgttgcggtcgtgtcgagccagcgtctgcacaaaccaatgtacatcttcctcgcaaacttgtcttttcttgacattctgtacacatccgcggtaatgcccaagatgcttgagggcttcctgcaggaggccaccattagtgtggccggatgtcttctgcaatttttcattttcgggagcctggcaactgcagaatgcctgctcctagccgtcatggcgtacgataggtatttagctatttgttatcccttacattaccctcttcttatgggtcctcggagatatatgggactggtggtaacaacatggctgtccggcttcgtcgttgatgggctggtcgttgctctggtggcacagcttagattttgcgggccaaaccatatcgaccagttctattgcgactttatgcttttcgtcggccttgcctgctcagatccacgcgtggcgcaggtaaccacacttattttaagcgtgttctgcttgactatccccttcggcctaatcctgacgtcctatgctcggatcgttgtggctgtactgagggtgccagctggggcttccaggcgcagagccttttctacctgcagctcccacctcgccgtcgtcacaacattttatgggaccctcatgattttttatgttgcccctagcgccgtgcactcgcaacttctctccaaggtattctcacttctttataccgtggttacccctctttttaaccccgtgatctacaccatgcggaacaaagaggtgcaccaggctcttcgcaaaatcctgtgcataaagcaaacagaaaccctcgattag

SEQ ID NO: 52209 - DNA, 948 bp, Artificial Sequence
  Description of Artificial Sequence: Synthetic coding sequence
atggagatagttagcacaggtaacgagacaatcaccgagtttgtactgttgggcttctacgacattccagagcttcatttcctgttcttcatcgtgtttacagccgtttatgttttcattatcatagggaatatgctgataatagtggccgtggtaagttcccagcgacttcacaagccgatgtacatttttctggctaacctgtccttcctagacattttatacacttcagccgttatgccgaaaatgctggaggggttcctccaggaagcaactatctctgtcgcaggctgcctcctccaattctttattttcggctctcttgcaacggcagagtgtcttctgttagccgtgatggcttatgacaggtacctagccatttgttacccacttcactaccctctccttatggggccacgccgatacatgggactcgtggtcacaacctggttgagcggattcgttgtggacggactagtggtcgcacttgtggctcaacttagattttgtggcccaaatcacattgatcagttttattgcgacttcatgctgtttgtggggcttgcctgttcagacccaagagtcgctcaggtgacaaccctgattctgtctgtcttctgtttgacgattccttttggccttatccttacaagctacgcacgtatcgtggtcgccgtgttgcgcgtgccagcgggtgcctcccggagacgcgcattttctacttgttctagccacttggctgtcgtcacaacattctacgggaccctgatgatcttctacgtagcaccttcggcggtgcactctcagctgttgagtaaggtcttctccctgctctacaccgtcgttactccactgttcaatccagtcatctatacaatgcgaaacaaagaagtgcaccaggccctgaggaaaatcctgtgcattaaacagaccgaaacactggattag

SEQ ID NO: 52210 - DNA, 948 bp, Artificial Sequence
  Description of Artificial Sequence: Synthetic coding sequence
atggaaatcgtgtcaactgggaacgagacaattacagagtttgtgctgcttggtttctacgatatccctgaattgcattttctcttcttcattgtgttcacagccgtctacgtattcattatcatcggaaatatgcttatcattgtggctgtcgtgagttcgcaaaggctgcacaagcccatgtacatttttctggccaatctttctttcctggacatcctatatacttccgcggttatgcccaagatgctggaaggcttccttcaggaagccaccataagcgtggccggttgcttgttgcagttcttcattttcggcagcctggcaactgccgagtgcttactgttggccgtgatggcttacgacagatacctggctatttgctaccctttacactacccattgctgatgggcccacggagatatatgggcctcgtggtcactacttggctgtccggttttgtggtcgacggactggtggtggccttagttgcccaacttcgtttttgtggccctaatcacatcgatcagttctattgtgacttcatgctgttcgtgggtctggcctgtagcgatccaagagtggcgcaagttactaccctcattttgtctgttttttgtctcaccatcccatttggcctgattctgacgtcgtatgcccgaatcgtcgtggccgttctccgagttccagcaggcgcaagcagaaggagggcgttcagtacctgcagcagtcatctggccgtcgtgaccaccttctacggaaccctgatgatcttctacgtcgcccctagtgcagtgcactcccaactcctgagcaaagtattttctctgttgtatactgtggttacccctttgttcaatcccgtgatttatactatgcgaaacaaggaagtccaccaagctctcaggaaaatcctgtgtatcaagcagaccgagacactcgactag

SEQ ID NO: 52211 - DNA, 948 bp, Artificial Sequence
  Description of Artificial Sequence: Synthetic coding sequence
atggagatcgtgtccactggcaatgagaccattacagaattcgtgctgctaggattctacgacatacccgaactgcactttcttttcttcatcgtgttcacagctgtgtacgtgttcatcatcatcggaaacatgctcattatcgtggccgtagtcagcagccagcggctgcataaacctatgtacatttttttagccaatttgagcttcctggatattctctatacaagcgcagtcatgcctaagatgttagaaggattcttgcaggaagctacaatctctgtcgccggatgtctccttcagttctttattttcggtagtttagctacagctgagtgcctgctgctggctgtgatggcttacgatcggtatctcgccatttgttatcctctgcattaccctctgttgatgggtcctagaaggtacatgggattagttgttacaacctggttgagtgggttcgtggttgatggtttggtagtcgcattggtggcgcagctcaggttctgcgggccaaaccacatagaccaattctattgcgactttatgctattcgtcggtctcgcgtgctctgatcctcgggttgcccaagtcactacactgatcctaagtgtcttctgcctgacaatacccttcggactgattctcacatcctacgccagaattgtcgtggccgtgctccgggtccccgctggtgcatccaggcgccgtgctttctccacatgctcctctcatctggcggtggtgacaaccttctacggcactctgatgatcttttatgttgctcccagtgcggtacactctcagctgctgtctaaagttttcagccttttatacacggtagtaactcctttgttcaatcccgtgatttacaccatgcgcaataaagaggtgcaccaggccctgcgcaagattttgtgcattaagcagaccgaaacccttgattag

SEQ ID NO: 52212 - DNA, 948 bp, Artificial Sequence
  Description of Artificial Sequence: Synthetic coding sequence
atggagatcgtgtctactgggaatgaaaccatcaccgagtttgtccttcttgggttttacgatatacccgagctccatttcctgttcttcatcgtctttaccgccgtctatgtgttcatcataattggcaacatgcttatcatcgtggccgttgtcagcagccagaggcttcacaaaccaatgtatatatttctggccaatctgagctttctggacattctatatacatctgcagtgatgccaaagatgttggagggctttctgcaagaagcgacaatcagcgtggccggatgtttgctgcagttctttatcttcgggagcctggctacagccgaatgtttgctgctggccgtcatggcctatgataggtatctggccatttgctaccccctgcactatcccctgctcatgggaccaaggaggtatatgggccttgtcgtcaccacttggctgtctggcttcgtagttgacggattggtcgtcgcattggtagcgcagctgcgcttctgtggtcctaaccacatcgaccaattctattgtgatttcatgctctttgtgggtctggcttgcagtgaccctagagtcgctcaggtgacgacgctcatactcagcgtgttttgcctaacaattccctttggtttgatactgacgtcttatgccagaatcgtggtcgccgtgctgcgcgtgccggctggggcatcgaggcggagagctttctccacctgttcttcccatctggctgtggtgaccactttttacggcacattaatgatcttttatgtcgccccatccgctgtgcatagtcagctgttaagcaaggtcttcagtctgctgtatacagtggtgacacctctgttcaacccggtgatctatactatgcgcaacaaagaggttcaccaggccctgcggaagatcttgtgtattaaacagacagagactttggattag

SEQ ID NO: 52213 - DNA, 948 bp, Artificial Sequence
  Description of Artificial Sequence: Synthetic coding sequence
atggaaattgtctctaccggcaacgagaccattaccgagttcgtactgctcggcttttacgacatccctgaactgcacttccttttctttattgtgttcacagccgtgtacgtattcattatcatcggaaatatgttgatcatcgtcgccgtggtctcttctcagaggctgcacaagcccatgtacatatttctcgctaatctcagttttctggacattctttacacctcagctgtcatgcccaaaatgttagagggcttcctgcaggaggccacaatttcagtcgctgggtgtctgcttcagtttttcatttttggcagtctcgctactgccgagtgtctcctgttagctgtcatggcgtatgaccggtatctggcgatctgttatcccctgcactatcctctcttgatgggtcctaggagatacatgggcctggtggtcactacctggctcagcggcttcgtggttgatggtcttgttgttgctctcgtggcgcagctgcggttttgcggccctaaccacatcgatcagttctactgcgactttatgttattcgttggcctggcctgctccgaccccagagttgcacaagtcaccacactaatactgagcgtgttttgtctgacaattcccttcgggctgatacttactagttacgccagaatcgttgtggctgtgctgagagtcccagccggagcttccagacggagggccttctccacctgttctagccatctggccgtggttacaacattttacggaacgctcatgatcttctatgtggctccatccgccgtgcacagtcagcttctgagcaaggtattctcactcctctacaccgttgtcacacccctgttcaatccagtaatatacactatgagaaacaaggaagtgcatcaagctctgagaaagatactctgcattaaacagactgaaacccttgattag

SEQ ID NO: 52214 - DNA, 948 bp, Artificial Sequence
  Description of Artificial Sequence: Synthetic coding sequence
atggagattgtatccacaggcaatgagactataaccgagtttgtgcttctgggattctatgacattccagagctgcattttctgttttttatcgtgtttacggctgtgtacgtctttatcattatcgggaatatgttgataatagttgcggtggtctccagtcagagactgcacaaacctatgtatatatttctggccaacctcagtttcttagatatcttgtatacaagcgcagttatgccgaagatgttagaagggttcctgcaggaggctactatctccgtggcaggatgcctcctacagtttttcatctttggcagtctggccaccgccgaatgcctgctcttggctgtgatggcatatgatcgctatctagccatctgctaccccctccattaccctcttttgatgggtccacggcgatatatgggattggttgttaccacatggttatccggctttgtggtagacgggcttgtggtggcgctggtggctcagctgcgattttgcgggccaaaccacatcgatcagttttactgcgacttcatgctgttcgtggggctggcatgttcagatcccagggtcgcccaggtcacgacactgatcctgtctgtattctgcctaacaatcccattcggtcttatccttacatcttacgctagaatcgtggttgctgtgctgagggtgcccgctggagcatcccggcgtagagcctttagcacctgcagctcccacctggctgtcgtgaccaccttctatggcaccctgatgattttttacgtggcgccaagtgcagttcactctcaactgctgtccaaggtgttctccctgttatacaccgtggtgacgccattgtttaacccagtcatctacaccatgcggaataaggaggtgcaccaggctttgcggaagattctctgtattaagcagaccgagacacttgactag

SEQ ID NO: 52215 - DNA, 948 bp, Artificial Sequence
  Description of Artificial Sequence: Synthetic coding sequence
atggagattgtctccacaggcaacgaaaccatcaccgagttcgtgctgctggggttctatgatataccggaactacatttcctgttctttattgttttcactgcagtgtatgtgtttatcatcataggcaatatgctcatcatcgtggctgttgtgtctagtcagaggttgcataaaccaatgtatattttcttggcaaatctttcctttttagacatattatacacatccgccgttatgcctaaaatgctagaaggatttttgcaggaagcaaccataagtgtcgctggatgcctcctgcagttctttattttcggttctctcgctacagccgagtgtttgttgctggctgtgatggcctacgatagatatctggccatctgctatcccttgcactaccctcttctcatgggccctaggcggtatatgggcctcgttgtgaccacatggcttagcggattcgtggtagacgggttggtcgtcgctttagtggcgcaattacggttttgtggaccaaaccatattgaccagttctattgcgactttatgttgttcgttggacttgcatgttctgaccctcgggtggctcaggtgacgactctaatcttatcagttttttgtctgacgatcccattcggtttgattttgacctcatatgccagaatagtagttgcggttctgagagtgcccgctggggcatctcgcaggcgtgcttttagcacctgttcttcgcatctggcagtggtgacaaccttctatggcacattaatgattttttatgtggcccctagtgccgtgcacagtcagctgctgtccaaggtctttagtctactctacacagtcgtaacccccctatttaacccagtgatctataccatgcgtaacaaagaggtgcaccaggccctgcggaaaattctgtgtataaaacagaccgagacattggactag

SEQ ID NO: 52216 - DNA, 948 bp, Artificial Sequence
  Description of Artificial Sequence: Synthetic coding sequence
atggaaatcgtgtccacaggcaatgagactattacagagttcgtactcttgggcttctacgatatcccagaactgcacttccttttttttattgtcttcacagctgtgtacgtcttcataattatcggaaacatgctgatcatcgtggcggtggtgagctcccagaggctgcataaaccaatgtatattttcctcgccaatctgtccttcctggacattctctacacctcggctgtgatgcctaagatgttagaagggttcttgcaagaggcaaccattagcgtggcaggatgtctgctccaatttttcatcttcggcagcctggcaaccgctgagtgcctgttactagcagtgatggcttacgacagatatctggctatctgctacccccttcactatcccttacttatgggcccaagacggtatatgggcctggtcgtgacgacttggctctctggttttgtcgttgacggcctggtcgtggccctcgtcgcccagcttcgattttgtggacctaatcacatcgaccaattctattgcgattttatgctctttgtggggctggcatgcagtgatcctagagtggcccaggtgaccacgttaatcctgagtgtattctgcttgacaatccccttcggactgattctaacctcctatgccagaatcgtcgtggccgtcctgagagttccggctggcgcatcacgtagacgggctttcagcacctgctcctcacacctggccgtcgttacgaccttttacggtaccttgatgattttctacgtggctccatccgccgtgcatagccaactgctcagcaaagtctttagcctgctatataccgtagtcacccccctttttaatccagtaatttacaccatgcgcaataaggaagtacaccaggccttgcggaagattttatgcatcaagcagacagagacactggattag

SEQ ID NO: 52217 - DNA, 948 bp, Artificial Sequence
  Description of Artificial Sequence: Synthetic coding sequence
atggagatcgtgagcacaggaaacgagaccatcactgagttcgtacttctgggattttatgatatccccgaattgcatttcctcttcttcatagtcttcacagctgtctacgtgttcatcatcattggcaatatgctcatcatcgtggccgtagttagctctcagaggctgcataaaccaatgtacatttttctcgccaacctctcttttctcgacatattatacacgagcgcagtgatgccgaaaatgcttgaggggttcctccaagaagctactatttccgtcgctggctgcctcctgcagtttttcatttttggaagcctggccaccgctgaatgcctgctgctggccgttatggcgtacgacaggtaccttgctatttgctatccactgcactatccactgctcatgggcccacgcaggtacatgggactggtggtcactacgtggttgagtgggttcgtggtagacggcctggttgtggcgctggtggcacaactgcggttctgcgggcctaatcacatcgaccagttctattgcgattttatgctgtttgtgggattggcctgttcagatcccagagtggctcaggtaacaaccttgatcctgagtgttttctgtctgactattcctttcggccttatcctgacatcttacgctcggatagtggtggctgtgttaagagtgcccgcaggggcttccagaagacgagcctttagtacttgttcctcccaccttgctgtcgttaccacattctatggcaccctaatgatattttacgtcgccccatctgcagttcatagtcaactgctgtctaaggttttttccctattgtacacagttgtcactcccctgttcaacccagttatttacaccatgcgaaacaaggaggtgcatcaagcgctccgaaagatcctttgtatcaagcaaacggagactctcgactag

SEQ ID NO: 52218 - DNA, 948 bp, Artificial Sequence
  Description of Artificial Sequence: Synthetic coding sequence
atggaaatcgtctctacaggaaatgaaactattactgagtttgtcttgctgggattttatgacatccccgagttgcattttctgttttttatcgtgttcactgcagtctatgtctttatcatcataggtaatatgctgatcattgtggcggtcgtctcctctcaacgcctccacaagcccatgtatatttttctcgcgaatctgagcttcctggatattctctacaccagtgcagtcatgcccaagatgttagagggttttttgcaagaggctaccataagcgttgctgggtgcctgcttcagttttttatctttgggtctctcgctactgctgagtgtttgctgttggccgttatggcttacgaccggtacttggccatctgctaccccctccactaccccctgctgatgggacccaggcgatacatgggactggtggtgacaacttggctgtctgggttcgttgtggacgggcttgtggtggccttggtggctcaactgcgcttctgcgggcctaatcatatcgaccagttctactgtgacttcatgctcttcgtcggtctagcctgttccgaccccagagttgcccaggtaaccacccttattctctcagtgttctgtctcaccattcctttcgggctgatccttacaagctatgccagaattgtagtcgccgttctgcgcgtccctgcgggtgctagcaggcgacgggcatttagtacttgctccagccacctcgccgttgtcaccaccttctacggtacactcatgattttttacgtggctccttccgctgtccactcccagctgctgagcaaggtgttttccctgctgtataccgtggtcacccctcttttcaatccagtcatttatacaatgcgcaacaaagaagtacaccaggcactccgcaagatcctctgcattaagcagaccgagaccttggattag

SEQ ID NO: 52219 - DNA, 948 bp, Artificial Sequence
  Description of Artificial Sequence: Synthetic coding sequence
atggagatagtgtctaccggaaatgaaaccatcactgagttcgtcctgttgggcttttatgacattccagagcttcactttctttttttcatcgtctttaccgccgtctacgtgttcattatcatcggtaatatgctgattattgtggcagtggtgtccagtcaacgcttgcataaacccatgtatatttttctcgccaacctgtcattcctggatattttgtatacaagcgctgttatgccgaaaatgcttgaagggttcctgcaggaggccaccataagtgtcgccggttgtttactccaattctttatattcggatccctggcaaccgctgagtgtcttcttttggcggtaatggcatatgatcggtacctggctatatgttatccattacactacccgttactgatgggaccaagacgatatatggggctcgtagtgaccacttggctttcaggattcgtggtggatggactggtggtagctctggtggcccagctgcgtttttgcggtccaaatcatattgatcaattttattgcgactttatgctgttcgtaggactagcatgctcggaccccagggtggcccaggtcaccaccctcattctgtccgttttctgcctcaccattccattcggtttgattcttacgtcctacgctcgaatcgttgtggcagtattgcgggtgccagctggcgcttcacgacgcagagcattctcaacctgcagttcccacctcgctgtggtgacaactttctacgggaccctgatgatattctacgtcgctccatcggctgtgcactcacagctcctgagcaaggtgttttcgctcctgtacaccgttgtgacaccactttttaaccccgtcatctacactatgaggaataaggaagtgcatcaggcgcttcggaaaatactgtgtattaaacaaactgaaacgctggattag

SEQ ID NO: 52220 - DNA, 1038 bp, Artificial Sequence
  Description of Artificial Sequence: Synthetic coding sequence
atgcacttcctgtctcagaacgacctgaacatcaacctaattccacatttgtgtctccatcggcacagcgtgatcgctggagcctttacaatccaccgtcacatgaaaatctttaatagcccgagcaatagttccaccttcaccgggttcatattactcggtttcccctgccccagagaaggtcaaattttgctctttgtgctctttacagtcgtgtacttgcttaccctgatgggcaatggctctatcatttgcgccgtacattgggaccagagactgcacgcaccaatgtatatcctgctggctaatttttccttcttagagatatgctatgttacctccactgtgcccagcatgctcgcaaatttcttatccgataccaagattatcagcttctcgggatgctttcttcaattttacttctttttcagcctggggtcaaccgagtgctttttcctcgcagtgatggcctttgacaggtacttagccatatgcaggccactgcgataccctacgatcatgacccgacggctgtgcaccaacctcgtggtaaactgctgggtgctagggtttatatggttcctgatccctatcgttaacatttcacaaatgagcttttgcggctctaggatcattgaccacttcctctgtgacccggcaccgttgctgacactaacatgtaagaagggtcccgtgatcgaactggtattcagtgtgctctctccactccccgtgttcatgttgttcctctttatcgtggggagttacgccttggttgtacgtgcggtgctacgggtcccctctgctgccggacggagaaaagctttctctacgtgtggtagtcaccttgcggtggtgagtctgttctatggtagtgtcctggtaatgtatggaagtcccccttcaaagaatgaagccggaaagcagaagactgtgacacttttctattcagtcgtgaccccactactcaatcccgtaatatacagccttcggaacaaggatatgcggaaagccctgaaaaagttctggggcacttag

SEQ ID NO: 52221 - DNA, 981 bp, Artificial Sequence
  Description of Artificial Sequence: Synthetic coding sequence
atgtgtccattaacgctgcaggtgaccggcctgatgaacgtaagcgagccgaattcatcgttcgcattcgtcaatgaatttattttacaaggcttctcttgtgagtggaccatccagatattcttattctccctgttcactacaacctatgcactcacgattaccggaaatggcgctatcgccttcgtgctgtggtgtgaccgcagactgcacactcctatgtatatgttcctaggaaactttagcttcctcgagatctggtacgttagctcaactgttcccaaaatgctggtaaacttcctgagtgaaaaaaagaacatcagttttgccggttgctttttgcagttctactttttcttctctctcgggactagcgagtgtttgctgctgactgtcatggccttcgaccagtaccttgctatttgcagaccccttctgtaccccaacatcatgacaggccatctgtacgccaaactcgtgattctgtgctgggtgtgtggatttctatggttcctcatccctatcgttttgatcagccagatgcccttctgcggtcccaacatcattgaccatgtagtctgtgacccaggtccacgtttcgctctggattgcgtatccgcacctcgcatccagctgttctgctacactctgagtagccttgtgatctttggcaacttcctcttcatcattgggagctataccctggttctcaaggcaatgcttgggatgccctcatccactggcaggcacaaggcattcagcacttgtggatctcacctcgccgtcgttagcttatgttacagtagcctgatggtcatgtacgtgtcgcctggcctgggacatagcacaggaatgcagaaaatcgaaacattattctatgctatggtgaccccgttgtttaatcctttaatctatagccttcagaataaggaaattaaagctgcccttaggaaggtgctaggctcctctaacatcatttag

SEQ ID NO: 52222 - DNA, 975 bp, Artificial Sequence
  Description of Artificial Sequence: Synthetic coding sequence
atgtcattctttttcgtagaccttaggccaatgaatcgtagcgcaactcatatagttactgagtttattctgctgggctttcccggatgttggaagatccagatctttctgttttcgttgttcctggtaatttacgtccttaccctgctaggaaacggggcaatcatctacgcggttagatgtaatccgctacttcacactccaatgtacttcttacttggtaatttcgcatttctggaaatctggtatgtgagtagtaccatcccaaatatgctagtcaatatcttgtccaagaccaaggccattagcttctcaggctgctttctccagttctacttctttttttccctaggaacaaccgaatgcctgttcctagccgtgatggcgtacgatcgatatcttgctatatgccatccactacaatatcctgcgattatgaccgtccggttttgtgggaagctggtgagtttctgttggcttattggctttttgggctatccgatccccatattttacatctcacaactgcctttctgtgggccaaatatcattgaccattttctgtgtgacatggacccgctcatggcgctctcatgcgccccagcaccgatcactgagtgcatcttttacactcagtcgtccttggtcctctttttcacatccatgtacattcttagaagctacatcctactgttaacagcggtatttcaggtaccgtccgccgcaggtcgaaggaaagcattctcaacttgcggatctcacctcgtagttgtttctctcttttacgggaccgtcatggtaatgtacgtgagccccacatacgggatccccacgttgctgcagaagattcttaccttagtttactctgtgaccactcccctctttaatcccttaatatatacgctgaggaataaggatatgaaactcgccctgaggaacgtgctgtttggaatgcgcatcagacagaactcctag

SEQ ID NO: 52223 - DNA, 993 bp, Artificial Sequence
  Description of Artificial Sequence: Synthetic coding sequence
atgttcttcataatacacagtttggtcacttccgtgttcctgacagccttgggaccccaaaacaggaccatgcattttgtgacagaattcgtcttgttggggttccatggccaacgcgagatgcagtcttgtttctttagcttcattctcgtgctctacctgttgacactcctcggtaatggagctatcgtctgcgctgtgaagctggacaggagacttcacactcccatgtatatcttgctcgggaatttcgcgtttctggagatttggtacatatcttctacagtcccaaatatgcttgtcaatatactgagcgaaatcaaaactatcagttttagtggatgctttttgcagttctacttcttctttagcttggggaccactgagtgtttcttcctatctgttatggcatatgaccggtacctggctatttgtagacctctgcactacccaagcatcatgactgggaagttttgcattatccttgtctgtgtctgctgggtcgggggatttctttgttatcccgtgcctatcgtccttattagccagctcccgttctgcgggccaaatatcatcgaccatttggtgtgtgatcctggcccactgttcgcgctggcttgcatcagcgccccttcaactgagttgatttgttacaccttcaactctatgatcatatttggcccttttctgagtattctcggctcctatactctggtgataagggctgtactctgcatccctagcggggcaggcagaacgaaggcgttcagtacctgcggatctcacttgatggtggtttcgctgttctatggcaccttgatggtgatgtatgttagtcccacgtcgggtaaccctgccggaatgcaaaaaataatcaccctggtgtacactgcaatgacccccttcctgaatccattaatttactctctgaggaacaaagacatgaaagatgctctgaagcgagtgctgggtcttacagtaagccagaattag

SEQ ID NO: 52224 - DNA, 969 bp, Artificial Sequence
  Description of Artificial Sequence: Synthetic coding sequence
atggaacctcagaacacttccaccgtgaccaacttccagttgctgggcttccagaacctgcttgagtggcaggcattgctattcgtcatcttcctcctaatttattgtctcacgattatcggcaacgttgtgataattaccgtggtctctcaggggctgcgactgcattctccgatgtatatgttccttcagcatttaagtttcctcgaggtttggtacaccagcacaacagtgcccttgttgcttgcaaacctcctctcctggggccaggcaatctccttttccgcgtgcatggcccagctctacttttttgtgtttctcggggcaaccgaatgctttctgctcgcctttatggcgtacgatcggtaccttgccatctgtagtcctcttcgataccccttcctcatgcatcgcggtttgtgcgccaggctcgtggtggtgtcctggtgcaccggagtgagcactggcttcctgccttctctgatgatcagccggttagatttttgcggtagaaaccagattaaccacttcttttgcgacctgcctcccctaatgcaactgagctgctctcgtgtatacattaccgaggtcactatcttcatactgagcatagcagttttatgcatttgctttttcctcaccctgggcccttacgtattcattgtgtctagcatattaagaattcctagcacttctggaaggcggaagaccttcagtacctgcggatctcatttagccgtggtgaccctgtactacgggaccatgatatctatgtatgtttgtccctctcctcatctacttccggagattaacaaaattatcagtgtgttctacactgtcgtgacacccttactcaatccggtgatctattctctgagaaacaaggactttaaagaggcagtgagaaaggttatgcgtcgcaaatgcggtattttgtggtccactagtaagagaaagtttctgtactag

SEQ ID NO: 52225 - DNA, 924 bp, Artificial Sequence
  Description of Artificial Sequence: Synthetic coding sequence
atgctgaacactacgagcgtcactgaattcctgcttctgggcgtgactgacatacaagagctgcaaccatttctgttcgttgtgtttctgactatttattttatttcagtgactgggaatggggcagtgttgatgattgtgatttccgatcccaggttgcattctttaatgtacttttttctgggcaaccttagctacctggatatttgttatagcacagtgactctgcctaagatgctgcagaattttctgagcacacacaaagcaatcagctttctcgggtgcattagccaattgcacttcttccactcactgggctctactgaatctatgctgttcgcagtgatggcatttgacctgagcgtggctatatgcaagccacttcgttacacagtaatcatgaaccctcagctgtgtacacagatggcgataactatctgggtcatcggctttttccatgctctcctgcattccgtgatgacatcaagactgaacttctgcggttctaatcgaatccatcattttctgtgtgatataaagcccctgttgaaattggcttgcggtaacactgagctcaaccagtggctccttagcactgtgaccggaacaattgccatgggtccctttttccttacgttactgtcatatttctacatcattacgtatttgtttttcaagacccgcagttgctccatgctgtgcaaagcgttgagcacctgtgcctctcactttatggtggtaatcctgttctacgctccagtgctgtttacgtacattcacccggctctcgaatcgttcatggaccaggacaggattgtggctattatgtataccgtcgtgacgcctgtgctcaaccccctgatttacacactcagaaacaaagaggtcaagggggcactcggcagagtgattcggagattgtag

SEQ ID NO: 52226 - DNA, 924 bp, Artificial Sequence
  Description of Artificial Sequence: Synthetic coding sequence
atgctgaatactaccagcgttacagaatttcttctgctgggagtcactgacattcaggagctgcagccatttctctttgtggtgttcctgacaatttactttatcagcgtcacaggcaatggggctgtactgatgatctttatctcggacccccgactccattctcccatgtatttctttttgggcaacctgtcttacctagatatctgttattccaccgtcacactgcctaagatgctgcagaactttctgtcaacacataaagcgatttctttcctggggtgtatctctcaactgcactttttccatttcttgggcagtacagagtctatgctgctggccgtgatggcctttgatagaagcgtcgccatctgcaagccactgcgatacaccgtgatcatgaatccccaactatgcacccagatggcaataactatttgggtgatcggcttctttcatgcgcttctgcattccatcatgacatcacgcctgaacttctgcggatcaaaccgcattcaccatttcctgtgcgacattaagcctctgctcaaactcgcatgtggcaacacagagctgaaccagtggctcctttccactgtgactggaaccatcgccatggggccatttttcctgactctgctttcatatttttacatcatcacctatcttttcttcaagaccagatcctgttccatgctatgtaaagccctatccacttgtgcaagtcactttatggttgtgatcctgttctatgcccctgtgctattcacctacatccatccagccttggagagcttcatggatcaggatcgaattgtggctattatgtacacagtggtcacaccagtcttgaacccactcatctacactttacggaacaaagaggtgaaaggggcactgggacgagtcataaggcgcctttag

SEQ ID NO: 52227 - DNA, 924 bp, Artificial Sequence
  Description of Artificial Sequence: Synthetic coding sequence
atgttgaacacgacgtcagtgaccgagtttctgctacttggtgttaccgacatccaggagttgcagcctttcctctttgttgtgtttctcactatatactttatctcagtgaccggcaacggcgctgtgctgatgatctttatctcagatcccagactgcattctcctatgtacttttttctcggcaatctgagctatcttgacatctgctacagcaccgtgactttacctaaaatgctgcagaattttctctcaacacataaggcgattagctttttgggctgcatcagccagctccactttttccatttcctgggttccaccgaaagtatgctgctggcggtgatggcgtttgatagatgtgtcgccatctgcaaaccattgcgttatacagtgataatgaaccctcagctctgcacccagatggccattactatttgggtaataggcttttttcacgcacttctgcatagtattatgaccagtcggttgaatttctgcggcagtaatcgcattcaccactttttatgtgacattaagcctctgctgaagctcgcatgtggtaatacagaactgaatcagtggctgctgtcaacagtcaccggtactatcgcaatgggtccctttttcctgaccctcctctcgtacttctacatcatcacgtacctcttctttaagacacgcagctgcagcatgctgtgcaaagccctcagcacatgtgcttcccacttcatggtcgtgattctattctacgcacctgtgcttttcacatatatccatccggctctggaaagttttatggaccaggaccgtatcgtcgcaatcatgtatacagtggtgacgcctgtgttaaatcccctcatctacactctcagaaacaaggaggtgaaaggtgctctgggtcgcgtcatacggcgtctgtag

SEQ ID NO: 52228 - DNA, 951 bp, Artificial Sequence
  Description of Artificial Sequence: Synthetic coding sequence
atggaaaatgtgacaactatgaacgaattcttactgttgggactgactggagtgcaggagcttcagccgttctttttcggtatcttcctgatcatctacttgattaacttgataggaaacggcagcattttagtgatggtagttctggagccccagctccatagtccaatgtacttctttctgggcaacctgagctgcctcgacatttcctatagcagcgtaaccctccccaagctgctcgtcaatctggtttgttcaagaagagccattagttttctcggctgtattacgcagttacatttcttccatttcttaggcagtacagaggcgattttgctggctattatggcttttgacaggttcgtggccatctgcaatcccctgagatacaccgtcataatgaatccacaggtgtgcatcctcctcgccgctgccgcatggctgatctcatttttctacgcgctcatgcacagcgttatgactgcccaccttagcttctgcgggtcccagaaacttaaccattttttctacgacgtgaaaccactgcttgaactggcctgcagcgataccctcttaaatcagtggctgctgtcaattgtgacaggctctatctctatgggtgccttcttcctgactttgctcagttgcttttatgttatagggtttttattgtttaaaaacaggtcctgccggatactgcacaaggctcttagcacttgtgccagccactttatggttgtctgcttgttctatggccctgtggggtttacatacattcgcccagcctctgcaactagcatgatccaggaccgcatcatggctatcatgtacagtgcggttacgcctgttttaaaccccctaatctacacacttagaaataaggaagtcatgatggctctgaaaaagatcttcggaaggaaactattcaaggattggcaacaacaccattag

SEQ ID NO: 52229 - DNA, 951 bp, Artificial Sequence
  Description of Artificial Sequence: Synthetic coding sequence
atggaaaatgttaccaccatgaatgagttcttgctgttgggattaacaggagttcaggagctgcaacctttcttctttggcatctttctgatcatatacttaattaacttgatcggcaacggaagcattctcgtcatggtggtgctggaacctcagctgcatagccctatgtacttctttcttggaaatctgtcttgcctcgacatttcttattcctcggtaacattgccgaagctgctcgtgaatctggtgtgctctaggagggctataagcttcctgggctgtataacacaactacactttttccactttcttgggtcgaccgaggccatactgttggctatcatggcctttgaccgcttcgtggccatttgtaacccacttcgctacaccgtgattatgaatccccaggtctgtattctgttggccgcagcagcctggctgatcagtttcttttacgctttgatgcacagcgtaatgaccgcccacctctctttttgtggcagccagaaactgaatcactttttctatgatgtgaaacctctgcttgagctggcttgctcagatacacttttaaaccagtggctgctgtccatcgtgacaggctccatttcaatgggggcattcttcctgactctgctcagttgcttttacgtgattggttttctgttatttaagaacagaagctgccggatcctgcataaagccctcagcacctgcgcatcccactttatggtggtttgtctgttctacggaccggtgggctttacctacatacgtcccgcttctgctacatccatgatccaggatcgtataatggcaatcatgtactctgcagtgactccggtgctcaatcctctgatctatactctgcgcaacaaagaagtgatgatggcacttaaaaagatattcggcaggaaactctttaaggattggcaacagcaccattag

SEQ ID NO: 52230 - DNA, 951 bp, Artificial Sequence
  Description of Artificial Sequence: Synthetic coding sequence
atggagaacgtgacaactatgaatgagttcctgttactgggcctaacaggcgtgcaggagctccaacccttcttctttggaatctttctgataatttacctgattaatttaataggtaatgggagtatcctggtaatggttgtgttggagccccagttacatagtcctatgtactttttcctgggaaatctgagttgtctcgatatctcctacagcagcgtaactctccccaagctcctggtcaatttggtgtgcagtcgcagggccatcagcttcttgggctgtattacgcagttgcacttcttccacttccttggctctactgaagccatcctcttagctatcatggccttcgatcgcttcgtggccatctgcaatcccctgcgatacacagtgattatgaatccccaggtatgcattctgctcgcggcagctgcttggctgataagtttcttttacgccctcatgcattcagtgatgaccgcccacctatccttttgtgggtcacagaagttgaatcattttttctatgatgtgaagccgctgctcgagctcgcttgctcggacactttgctcaatcagtggctgctgagcattgtcacgggaagcatatccatgggggcattcttcctgacattactgagctgcttctacgtcataggattcctgttgttcaagaatcggtcttgtcggattctacataaggccctttcgacgtgcgccagccactttatggtagtgtgtctgttctacggccctgtcggtttcacatacattcgccctgcaagtgccacgtccatgatccaagaccggatcatggccatcatgtattcagccgttacccctgtgctgaaccccttgatttacactctgcgaaacaaggaagtgatgatggcacttaaaaagatttttggtcggaagctctttaaagattggcagcagcaccattag

SEQ ID NO: 52231 - DNA, 951 bp, Artificial Sequence
  Description of Artificial Sequence: Synthetic coding sequence
atggaaaatgtcacaactatgaatgagttcctgctgctgggccttacaggggtacaagagctgcagccgttctttttcggaatttttctaataatctacctgattaacttgatcggaaatggaagcattttggtgatggtcgtactggagccgcagctgcactcccctatgtatttctttttgggaaacttgtcatgtcttgacatcagctactcatccgtcacccttccgaaattactcgtgaatttggtatgtagtcgtagagccatctccttcttgggctgcattacccagttgcacttttttcacttcttggggtctacagaggccattctattagcaataatggcgtttgatagattcgtcgccatctgcaatccattgcgctatactgtcataatgaacccacaggtctgcatcctgttggccgcagcggcatggttaatcagcttcttttacgcacttatgcactctgttatgacagcgcatttatccttctgcggctcacagaagttaaatcacttcttctacgatgtcaaacccctgctggagttagcctgctcagacaccctgcttaaccagtggctcctttctatcgtcaccgggagtatttctatgggtgctttttttctaactctgttgtcctgcttctatgtgataggcttccttctgttcaaaaaccgctcctgcaggattttgcacaaggcactttcaacatgcgccagtcactttatggtggtgtgcctgttctatggccctgtgggatttacatatatccgcccagcctccgccacatctatgatccaggataggatcatggctatcatgtatagtgctgttacccctgtcctgaatccattgatctacaccctgagaaataaagaggttatgatggcactgaagaagatattcgggaggaagcttttcaaggattggcagcagcatcattag

SEQ ID NO: 52232 - DNA, 951 bp, Artificial Sequence
  Description of Artificial Sequence: Synthetic coding sequence
atggagaatgtcactacaatgaacgaatttctgctcctgggcctgaccggagttcaggagttacaaccctttttttttggcatatttttaattatttacctgatcaacctgattgggaacggctccattctcgtgatggtggtccttgagccccagctgcactccccaatgtacttctttttgggtaaccttagttgcttggacattagctactctagtgtcaccctcccaaaactgctcgtcaacctcgtctgttctcgtcgcgctattagcttcctgggctgcatcactcagctccatttttttcactttctggggagtactgaagccatcctgctagccattatggctttcgaccggtttgttgccatatgtaacccactcaggtacactgtcataatgaatccgcaggtatgtattctactagctgctgcggcatggctcatatccttcttctacgccttgatgcattcggtgatgacggcccatctctccttttgcggtagccagaaacttaatcatttcttttatgacgtcaaacctttgttggagctggcctgttcagacacattactgaatcagtggctcctgtcgatagtgaccggatcaatctctatgggcgcattcttcttaaccctactctcgtgtttttacgtgataggctttctgctcttcaaaaacaggagctgccggatcctccacaaagctttgtccacctgtgcctcacactttatggtggtctgcctcttctacggtccagttggtttcacctacatacgccctgccagcgcaaccagcatgatccaggacaggattatggcaatcatgtactcggcagtcacaccagtgttgaaccccctgatatatactctgaggaacaaagaggtgatgatggccttgaagaaaatcttcggcaggaaactttttaaagactggcagcagcatcattag

SEQ ID NO: 52233 - DNA, 951 bp, Artificial Sequence
  Description of Artificial Sequence: Synthetic coding sequence
atggagaacgtgactacgatgaacgagtttttactcctcgggctcaccggcgtacaggagctgcaaccctttttcttcgggatttttctgatcatttacctcatcaacctcataggcaatggaagtattttggttatggtggtgctcgagccgcaactccattctccgatgtatttcttcctcggtaacctttcttgcctggatatctcctattccagcgtgacgctgccgaagctgctggtgaacttggtgtgctcgagacgggctatctcctttctggggtgtataacacagctccacttcttccatttcctcggctccaccgaagccatactgcttgccattatggcctttgacaggttcgttgccatttgtaacccattacgatatactgtgattatgaacccccaggtttgcatactgctggcagctgccgcttggcttatttcttttttttacgctcttatgcattcagtgatgactgcccacctgagtttttgtgggagccagaagctgaaccatttcttttacgacgtcaagcccctactggaactggcttgctctgacacgctccttaaccagtggcttctatctatcgtcacagggagtatttctatgggcgctttctttttgacactgttatcttgcttttacgtgatcggcttcctcctctttaaaaatcgaagttgccggatcctgcacaaagctctctcgacttgtgcttcccactttatggtggtgtgcctcttttatggaccagttggctttacctacatcaggcccgcttccgcaacatctatgattcaggatcggataatggctatcatgtacagcgcagtcaccccagtcctgaatcccctcatttacactctacgcaataaggaggttatgatggcgttaaagaaaatttttggcagaaaattatttaaggactggcaacagcatcactag

SEQ ID NO: 52234 - DNA, 951 bp, Artificial Sequence
  Description of Artificial Sequence: Synthetic coding sequence
atggagaacgtaactactatgaacgaatttctactgctcgggttaaccggagttcaagagctccagcctttcttcttcggaatcttcctcattatttaccttattaacctgatcggcaatgggagtattctggtgatggttgtcctggaaccacaacttcattctccaatgtactttttcttggggaatctgtcatgcctggacatctcttattcatccgtgacactaccaaagttattggtaaacctggtgtgtagtcggagggccatctcatttttgggttgtatcacccaactgcacttttttcatttcttaggatctacagaagccatcttgctggccattatggccttcgacaggttcgtcgccatctgtaatcccctgaggtacacagtcatcatgaacccacaggtctgtatcctgcttgccgctgccgcttggctgatttcatttttctatgcactcatgcattccgtaatgacagcacatctgtccttttgcgggtcacagaaacttaaccatttcttctatgatgtcaagcccctgctggaactggcatgctcagataccctgctgaaccagtggctgctcagtatcgtcaccggctcaatttctatgggggcattctttttgactctgctaagttgtttctatgttataggattcctcctcttcaaaaataggagttgcaggatcctgcataaggcgctctcgacctgtgcttcccattttatggtggtatgcttgttctatggacccgtggggttcacatatattaggcccgcatcagccacctctatgattcaagacaggattatggctatcatgtactccgctgtcacccccgtccttaatccactaatttatactctgaggaataaagaagtgatgatggcgcttaagaaaatttttggacgtaagttgttcaaagactggcagcagcaccattag

SEQ ID NO: 52235 - DNA, 951 bp, Artificial Sequence
  Description of Artificial Sequence: Synthetic coding sequence
atggaaaacgtgaccacgatgaacgagtttctgctgttaggtctcactggtgtccaggagctgcagccctttttcttcgggatttttttgatcatttatttaatcaacctgatcgggaacggctcaattcttgtgatggtcgtcctcgagccacaactacacagccccatgtacttttttctgggaaatctgtcttgtctcgacatcagttacagcagcgtgacccttccgaaattgttggtcaatctcgtgtgtagccgcagagccattagttttttaggctgtataactcagctccatttcttccatttcctcggcagcacagaggccatcttgctggccatcatggcctttgacaggttcgtggcgatctgcaaccctcttcgctatactgttattatgaatcctcaggtgtgtattctgctggctgctgccgcatggcttatcagcttcttttatgccttgatgcactctgtgatgacagcgcacctttccttttgtgggtcccagaagttaaatcatttcttctacgacgtcaagcctctcctcgagttggcttgcagcgatacgctgttgaatcaatggctcctgagcattgtgaccggatcaatttccatgggagcatttttccttacgctgctgagttgcttctacgtcattggtttcctcctgttcaaaaaccggtcatgcaggatccttcataaagcattaagcacatgcgcctcccacttcatggtggtgtgcctgttctatgggcctgtgggatttacctacatcagacctgcctctgctacttctatgatccaagatcgaattatggccataatgtactccgccgtgacccctgtcctaaaccctctgatttacacgctcaggaataaggaagtgatgatggccctgaagaagatcttcggcaggaaactgtttaaagactggcagcagcatcattag

SEQ ID NO: 52236 - DNA, 987 bp, Artificial Sequence
  Description of Artificial Sequence: Synthetic coding sequence
atgaaactgtggatggaaagtcacttaatcgtgccagagacacgtcctagtccccgaatgatgagcaaccagaccctagtcaccgagttcatactgcagggtttctcagagcacccggaataccgggtcttcctgttctcatgctttctcttcctgtactccggggcactgaccggtaatgttttaattacactcgccattacgtttaacccaggcctgcatgcaccaatgtatttttttctccttaatctcgccaccatggacattatatgcacaagctccatcatgccgaaggcactggcaagcttggtgtcagaggagtcatctatttcctacggcggatgcatggcacagctatattttctaacctgggccgcatcttcggagctcttacttttgacggttatggcgtatgaccgttacgcagcaatttgtcacccactccactatagctccatgatgtccaaggtattttgctccggactcgcaaccgctgtgtggctgctctgcgctgtcaacacggcgatccacaccggcttgatgttgaggctggacttttgcggtcccaacgtgatcattcactttttttgcgaggtgccacctctgctactgttgagctgcagctccacttacgtaaatggcgtgatgatagtcctggctgacgccttttatggaatcgtgaattttctgatgacaatcgcctcatacggatttatcgtatccagcatcctaaaggtgaaaaccgcttgggggaggcagaaagccttttcaacctgtagttcgcatctcaccgtggtgtgtatgtactacacggcagtgttctacgcctatatctctcccgtaagcggttacagcgccggaaagagtaagctggcgggattactatacaccgtactgagtccaactttaaaccccctcatctataccctccgcaataaggaggtaaaggcagccctgcggaagcttttcccattcttccgaaattag

SEQ ID NO: 52237 - DNA, 987 bp, Artificial Sequence
  Description of Artificial Sequence: Synthetic coding sequence
atgaagctatggatggaaagccacctgattgttcctgaaacacgcccaagccctaggatgatgtccaatcagacacttgtgaccgaatttattctccagggattctcggagcacccggagtatcgggtgttcctgttttcctgcttcttatttctttattcaggagctctcaccggaaatgtcctgatcactctcgcaatcacgttcaatcccggtctccacgcgcctatgtacttcttcctcttaaaccttgccactatggatatcatctgtacatccagcattatgcctaaggccctcgcatctctggtctctgaagagtcttcaatctcctatggcggatgtatggcacagctgtattttctgacatgggcagcatctagtgaactcctcctgctgactgtcatggcatacgaccgctatgccgcaatttgccacccccttcactatagctctatgatgtcaaaggtcttttgctctggcctcgctacagcggtgtggcttctctgcgcggtgaacactgccatccataccggtctgatgttgcggttggacttctgcggccctaacgtcatcattcacttcttttgcgaggtccctccactgttattactgagctgttcctctacatacgtgaatggtgtgatgatcgtcttggcagacgccttctacggaatcgtgaattttctgatgacaatagcgagctacgggttcatcgtatcaagcatcctcaaagtaaagactgcgtggggacgccagaaggcgttctccacctgctcctctcatctgaccgtggtgtgcatgtattacaccgcagtcttctacgcttacatcagtcctgtctccggatattcggctggaaagtccaagctggccggtctcctgtataccgtgctaagccctacccttaatccattgatctataccctgagaaacaaagaagtgaaggcggctctgcgtaaactcttcccatttttccggaattag

SEQ ID NO: 52238 - DNA, 987 bp, Artificial Sequence
  Description of Artificial Sequence: Synthetic coding sequence
atgaaattatggatggaatcccaccttattgtgcccgaaacccggccttctcctagaatgatgagcaaccagactttagtcacggagtttatactgcaggggtttagcgagcacccagagtatcgcgtctttctgtttagttgtttcctctttctgtattccggtgcccttactgggaacgttttgattacattagctataaccttcaaccccggactgcacgccccaatgtacttctttttgctaaatctcgccacaatggatataatatgtacttcatctatcatgcccaaagcactggcatcccttgtatctgaggagagctcaatctcctatggaggctgcatggctcaactgtactttttgacttgggctgcgagcagtgagctgctcttattgaccgtcatggcctatgaccgctacgccgctatatgccatccccttcattattcctctatgatgagcaaggtcttctgcagcggtctggctactgctgtctggctgctctgcgctgtcaataccgctattcacaccgggctgatgctgaggttggacttctgtgggcctaatgtgattatccacttcttctgtgaagtgcccccactgctgttattgtcctgttctagcacttatgtcaatggagtgatgatcgtcctcgcagacgcattttacggcatcgtgaacttcctaatgacaattgcatcctacgggttcatagtgtcaagtatcctgaaagtcaaaacagcttggggcaggcagaaagccttttctacatgttcttcccatttaactgtagtctgtatgtactacaccgctgtgttttacgcctacattagccctgtgtccggatattccgcgggtaagtcaaaattagccggactgctctatacggtactctccccaaccctcaaccccttgatatacaccctgcggaataaggaagttaaggctgcccttcggaagctcttcccattttttaggaactag

SEQ ID NO: 52239 - DNA, 957 bp, Artificial Sequence
  Description of Artificial Sequence: Synthetic coding sequence
atggagtgggaaaatcatacgatacttgtggagtttttccttaagggtctgagtgggcatcctcgcctcgagctgctctttttcgtattaattttcatcatgtacgtggtcatccttctcggcaacgggacgctcattttgatctcaatcctggatcctcatttgcatacgcccatgtacttcttcttgggcaatctgtctttcttagacatttgttatacaacaacaagcatcccttctactctggtctcatttctcagtgagagaaaaacaatctccctgtcaggatgcgcggtccaaatgttcctggggttagcaatgggaacaaccgagtgcgtgctgctcgggatgatggctttcgatcgctacgtcgccatatgcaaccccctgagatatccgattataatgagtaaagacgcttacgttcctatggcagccggttcctggatcatcggtgctgtgaattctgctgtgcaatctgtgtttgtggtgcagcttccattttgccgtaataacattatcaaccacttcacatgcgagattctcgccgttatgaaactggcttgtgcagacatctccgacaacgagttcatcatgttggttgcaacaactttgttcatactgacaccgctactgttaatcatcgtctcctatacgctaatcattgtgtcaatctttaagatctcctcctctgaagggaggagcaaggcatccagcacctgcagcgcccacctaactgtggtgattatcttctacggaacgatactgttcatgtatatgaagcccaaatccaaggagactctcaactcagatgaccttgacgcaaccgacaagatcatctctatgttttacggcgtcatgacaccaatgatgaaccccttgatatattctctgaggaataaggatgtgaaggaggccgttaagcacctccttaatcggcgattcttttccaagtag

SEQ ID NO: 52240 - DNA, 1044 bp, Artificial Sequence
  Description of Artificial Sequence: Synthetic coding sequence
atgatcgtacaattgatttgcactgtgtgtttcctggcggtgaacacctttcatgtacgatctagcttcgattttctgaaggctgatgatatgggcgaaatcaatcagaccctggtatctgaattccttctgctgggcttgtccggctaccccaagattgaaatagtgtacttcgccttgatccttgtaatgtatctggtcatactcataggcaatggcgttttgatcatcgcatctatcttcgattctcactttcacacgcccatgtatttttttctgggtaatctttccttcctcgatatctgttatacatcatcatctgtgccatcaacgctggtgtctttgattagcaagaaaagaaatatatcatttagtggctgtgccgtccagatgttttttggattcgccatgggatcaacagaatgtttactactgggcatgatggcatttgatagatacgtggctatctgcaatccactgaggtatcccatcatcctgtcaaaggtggcctatgtgctcatggcctccgtgtcctggctgtcaggtggcattaactcagccgtgcagacactgctcgccatgcgtttaccattttgtggtaataacattattaaccacttcgcgtgtgagattttagcggtcctgaagctggcctgtgcggacatctcactgaatatcataactatggtcatcagcaacatggcctttctggtgctgcctctgatggttatcttcttctcatacatgttcatactctatacgattttgcagatgaactctgccaccgggaggcgcaaggcctttagtacttgcagcgcacacctgactgtggttattatcttctacggaactatcttctttatgtacgctaagccgaaaagtcaggacttgattggagaggaaaaattacaggctctggataagcttatatccctcttttacggtgtggtaacgcctatgttgaaccctattctgtatagtctccgcaacaaggacgtgaaggccgcagttaaatatctactgaacaagaaacccatccactag

SEQ ID NO: 52241 - DNA, 957 bp, Artificial Sequence
  Description of Artificial Sequence: Synthetic coding sequence
atggacaaaattaaccaaacatttgtaagggaatttatcctgttgggactcagcggctatcccaaacttgaaataatcttctttgcgctgattctggtgatgtacgtcgttatcttgattggcaacggtgtgttgattatcgcctcaatcctggatagtcgcctgcatatgcccatgtatttctttctgggtaacctctcatttctggacatttgctacaccacatcgtctattccaagcactcttgtgtccctgattagcaagaagcggaacatctcatttagtggctgcgcagtgcagatgttttttggtttcgctatgggtagtaccgagtgctttctgcttggaatgatggccttcgatcgatatgtcgcaatatgtaatcccctgaggtatcctatcatcatgaacaaagtcgtttatgtccttctgacatcagtctcttggttgagcgggggtattaacagcacagtgcagacctcccttgccatgagatggccattttgtggaaataatataattaatcattttctgtgcgaaatcctggccgtgctgaaactggcttgcagcgatatctccgtgaacatcgtaactctggctgtatctaacatcgcctttctggtgttacccttgcttgtcatctttttttcctatatgtttatcctgtataccatactgcgaaccaacagcgcaactggtcggcataaagcctttagcacctgctctgcacatctgactgtggttatcatcttttacggaactatcttcttcatgtatgctaagcccaaaagccaggacttgctgggtaaagacaatctgcaagctacagaggggcttgtgtctatgttctatggcgtggtgactcccatgctgaatccaattatttacagcctgcggaacaaggatgtgaaagccgctataaaatatctccttagtaggaaggccattaatcagtag

SEQ ID NO: 52242 - DNA, 1041 bp, Artificial Sequence
  Description of Artificial Sequence: Synthetic coding sequence
atgttcatccaggtgattttctatatctgctgcctagctgtaaagatcctttatatcggaagcagttttgggatactcaaagccgacatggacaagatcaatcaaacgttcgtccgtgaattcatccttctgggcctgtctggttacccgaagctggagataatctttttcgcattaatcctggtgatgtatgttgtcattctcatcggtaacggtgtcttgattattgctagtatcctcgacagtcgactacatatgcctatgtacttctttcttggcaacttatctttcctggacatctgctataccacttccagcattcctagcactttggtaagtcttatcagcaagaaaaggaacatctcattcagtgggtgcgctgtgcaaatgttcttcggttttgctatgggttcaacggaatgcttccttttgggaatgatggccttcgaccggtacgtggctatatgcaaccccctgcggtatccgatcattatgaataaagtcgtctacgtcttgctgacgagtgtctcatggttgagtggcggaattaattcgaccgtgcagacttctctcgctatgcgctggcctttctgtgggaataacattatcaaccacttcctgtgcgaaattctggctgtcttaaagttggcctgttcagacattagcgtaaacatcgtgaccctggccgtctctaacattgcattcctggtgctccccctgctcgtgatctttttcagctacatgttcatcctctacacaatcctgcgcacaaactcagccaccgggagacacaaagctttctccacgtgttccgctcacctaactgtggtcatcatcttctacggcaccattttcttcatgtatgctaagcccaaatctcaggacctcctgggaaaagataatctccaggctaccgagggactggttagtatgttttacggcgtcgtgacccctatgttgaacccgattatctattctctcagaaataaagacgtcaaagctgctattaagtatttgttatctcgcaaagctataaattag

SEQ ID NO: 52243 - DNA, 957 bp, Artificial Sequence
  Description of Artificial Sequence: Synthetic coding sequence
atggagtgggagaatcatacgattctggttgagtttttcctcaaggggttgagtggccacccacgcctggaactgctcttctttgtcctcatcttcatcatgtatgtggtgatcctgctcgggaacggaaccctgattctgatctccattctggaccctcacctccatactccgatgtatttttttcttggcaaccttagttttctggatatatgttacactacaacctctatcccaagcacactcgtgagcttcctgagcgagcgcaaaacaatttcgctgagtggctgtgctgttcagatgttccttagcctcgccatgggaaccacagaatgcgtgcttctgggcgtcatggctttcgatcggtacgtggcaatatgcaaccccctgcggtaccccattatcatgtcaaaagatgcttacgtgcctatggccgcaggttcttggatcatcggagctgtgaacagcgccgtccagaccgtcttcgttgtacagctgccgttttgccgtaataacatcatcaaccacttcacctgcgagattctggccgtcatgaaactcgcctgcgccgacatcagcggcaacgaattcattcttctggtgacgacaactctcttcttgttgacgcctctccttctgataatagtttcatacaccctcataatattgtctatttttaagatctcttcatccgaaggcagatctaagccatcttctacctgctccgctagactcaccgtcgtaatcaccttctgcggtactatcttcctgatgtatatgaagccaaagtcccaagaaactcttaattcggacgacctcgatgccacagataaactgattttcattttttaccgagtaatgacccccatgatgaaccccctgatttacagcctgcgcaacaaggacgtgaaggaggctgtcaagcatttgcttcggcgtaaaaatttcaacaaatag

SEQ ID NO: 52244 - DNA, 963 bp, Artificial Sequence
  Description of Artificial Sequence: Synthetic coding sequence
atggagcggacgaatgattcaacaagcacagagttcttcctggtgggcctgtctgcacatcccaaactccagacagtgttcttcgtgctgatactctggatgtatctcatgatcctgctggggaacggcgttttgattagcgtaattatatttgacagccacctgcatactccaatgtactttttcctgtgcaacctgtcatttctcgacgtttgctatacttcaagtagcgtccccttaattcttgcctcattcctcgccgtcaagaagaaggtatccttctctggttgtatggtccagatgtttatctcttttgccatgggagccactgaatgcatgatcctcggaaccatggcactggatagatacgtcgcgatctgctacccactccggtatcctgtgatcatgtcaaagggggcatacgtggcaatggccgctggctcttgggtgactggactggtggacagtgttgtccaaactgcgttcgcaatgcagttgcctttttgcgcaaacaatgtgatcaagcacttcgtttgtgagatactggccatcctcaagctcgcctgtgctgacatcagcatcaatgtcatcagcatgacaggctctaacctgattgttctggtgatccctcttctggtgatctccatctcctatatctttattgtggcaactattctgcggattccctcaactgaaggaaagcacaaagcgttttccacctgctcagcccatctcactgttgtgattatattctatggcactatctttttcatgtatgcaaaacccgagtctaaagcttccgtagactctgggaacgaagacattattgaggccctcatctctttattctatggggttatgacccctatgctcaaccctctgatttatagtctccgcaacaaagacgtgaaggccgctgtgaaaaacattctgtgtcggaaaaatttcagtgacggaaaatag

SEQ ID NO: 52245 - DNA, 957 bp, Artificial Sequence
  Description of Artificial Sequence: Synthetic coding sequence
atggagtgggagaatcagaccatcctggtagagttcttcttaaagggccacagcgtccatcctcggctggagctactgttttttgtccttattttcattatgtatgtcgtgatcctgctaggaaatggaacgctgatcctcatcagcattctagacccacacctccacactcctatgtatttctttctgggtaatttgagttttcttgatatctgctacacaacgacctccatcccctcgacactcgtatccttcctgtctgagaggaaaacaatatctttctctggctgcgcagtacagatgttcctggggttggctatgggcaccactgaatgcgtattgctcgggatgatggccttcgaccgctatgtggccatctgcaatcctctaaggtacccaatcatcatgagcaagaatgcatacgtcccaatggctgtaggttcctggtttgctgggatcgtcaattctgccgtgcagactacatttgtggtccagttgcctttctgtcgaaaaaacgttattaaccatttctcttgcgagattcttgccgttatgaagttagcctgcgcagatattagcggcaacgagttccttatgttggtggccacaatactgtttacactcatgcccctgcttctgattgtaattagctatagcctgatcatctcatctattttgaagattcactcctctgagggcaggtcaaaggcatttagtacatgtagcgcgcacctgactgtagtgatcattttttatggtaccatcctttttatgtacatgaaacccaagtccaaagagaccctgaatagcgacgatctagatgccactgacaaaatcattagcatgttttacggggttatgactccaatgatgaaccccctcatatacagtctgaggaacaaagacgtcaaagaagccgtgaagcatctccccaaccggagatttttctccaagtag

SEQ ID NO: 52246 - DNA, 1041 bp, Artificial Sequence
  Description of Artificial Sequence: Synthetic coding sequence
atgtacagatttaccgattttgatgtgtcgaatatctcaatctacttaaaccacgtcctgttctatacaacccagcaagctggtgacctggaacatatggagacaaggaactatagcgccatgaccgagtttttcctggtgggactctcacagtaccctgaattacagttatttctttttttactatgcctcatcatgtacatgattatcttacttggcaactcgctactaatcatcattactattctggattcccgactgcacactcccatgtatttttttctgggcaatctgtcctttttggacatatgctacacatcgtcctctattcccccaatgctgataatcttcatgagtgaacgaaaatccatctcttttataggttgtgccctgcaaatggtcgtgagcttgggtcttgggtccacggaatgcgtgctgctggcggttatggcatacgatcactatgtggcaatctgcaatccattgcgatatagtattataatgaacggggtcttgtacgtccagatggccgcttggagttggattatcgggtgcctgacctccctgctccagactgtgctcaccatgatgctcccgttctgcggaaacaatgtcattgaccacatcacctgcgaaattctcgcacttctgaagctcgtgtgctccgacatcaccattaacgtcctgattatgactgtcactaatatcgttagcctggtcatcctgctcctgctcattttcatatcttatgtgttcatattgagctctatcttgagaatcaactgcgccgaaggtagaaaaaaagcattttctacatgtagtgcgcattcaatcgtagtaattctgttctatgggtcagcgctcttcatgtacatgaaaccaaagtctaagaatactaacacctccgacgaaatcattggcctctcttacggtgtagtgtccccgatgctcaatcctatcatttacagccttcggaataaggaggtcaaggaggcagtcaagaaggtgctgagcagacatctccacctgctgaagatgtag

SEQ ID NO: 52247 - DNA, 960 bp, Artificial Sequence
  Description of Artificial Sequence: Synthetic coding sequence
atgttccctgcgaattggaccagcgtgaaggtattcttttttctcggttttttccactaccctaaagtgcaagtgatcatatttgccgtctgcttgctgatgtacctgattacactccttggaaacatatttttaatatccataacaatcctggattcacacctccatactcccatgtacctgttcctgtccaacctgtcctttctcgacatatggtactccagctccgcactgtcgcctatgctcgctaatttcgtctctgggagaaacactattagctttagcgggtgcgctacacaaatgtacctgtccctggctatgggcagcacagaatgcgtcttgctgcctatgatggcctacgatcggtacgtggctatttgtaacccccttcgctatccagtgattatgaacaggaggacctgcgtccaaattgcagccggtagctggatgactggttgtctgaccgccatggtcgagatgatgtctgtccttcctttgtctttgtgtggtaactccattattaatcatttcacatgcgagatcttggcgatcctcaagttggtctgcgtagacactagcctggttcagctcatcatgctagtaatctcagtgctactgctgccgatgcccatgttgctgatatgcatcagttacgcttttatcctcgcctcaattctgcgaatctcttctgttgaggggagatctaaggcattctctacatgcacggcccacctgatggtagtggttctgttctatggtacagctctgtccatgcacctgaagcccagcgctgtggatagtcaggaaattgataagtttatggctttggtttacgctgggcaaactccaatgctgaacccaattatttactcactccgaaacaaagaggtgaaagtcgccctgaaaaaactgctcatccgcaaccactttaacacagccttcatctctatcctgaaatag

SEQ ID NO: 52248 - DNA, 927 bp, Artificial Sequence
  Description of Artificial Sequence: Synthetic coding sequence
atggccatggataatgtcaccgctgtcttccagttccttttgatagggatctcaaactatccacagtggagagacacattctttacgttggtgctgattatctacctgagcaccctgctggggaacggtttcatgatcttccttatccacttcgaccctaacttacacacccccatttatttttttcttagtaacctgagctttttggatctgtgctacggaaccgcttcgatgcctcaggccctggtgcattgtttctctacgcacccctatctgtcttacccccgatgtctcgctcagaccagtgtatcgctggcactcgccaccgccgaatgcctactgctggcagctatggcctatgaccgggtagtggctattagcaatccgttgagatactcagtcgtaatgaacgggccagtctgcgtgtgcttggtggccacctcctggggcacatcgctggtgctgactgcgatgttgattctttcccttcgactccatttttgcggagccaatgttataaatcacttcgcttgcgaaattttgagtttaatcaaattgacctgttctgacactagcctcaacgaatttatgatcttaattacttccattttcacactgctcctcccctttggcttcgtacttttaagttatatcaggattgccatggctattatccgtatccggtctctccagggcaggctgaaggctttcacaacctgtgggtctcacctgacagtcgttacaattttctacggctccgccatttctatgtatatgaagacacagtccaagtcatacccagatcaggataaatttattagcgtgttctacggtgccctgacccctatgctgaatcctctgatctattctctgaggaagaaggacgtgaaacgggcaataagaaaagtcatgttgaagcgcacctag

SEQ ID NO: 52249 - DNA, 939 bp, Artificial Sequence
  Description of Artificial Sequence: Synthetic coding sequence
atggaaccgttgaacaggacagaagtctctgaattcttcctgaaagggttctccgggtatccagcacttgaacatttgctgtttccactatgttccgctatgtacctcgtcactctgcttggaaataccgccattatggcggtgtcagtcttggacattcatctgcacacacctgtctatttttttctgggcaacctgtcaactctcgatatctgttacacccccacatttgtgccgcttatgcttgtgcacctgctgtcatcccgcaagacaatcagcttcgcagtgtgtgccattcagatgtgcctctcattgagcacagggtcaacagagtgtctgctattggctattacagcctatgaccggtacctggctatttgccaaccactcaggtaccacgtgttaatgtctcaccgcctttgcgttctgctcatgggtgccgcttgggtgctctgtctactcaaaagtgttaccgagatggtgatttctatgcgtctgccattctgtggacatcatgttgtgtctcacttcacctgcaaaatacttgccgtgctcaaattggcctgtggtaacaccagtgtgtctgaggactttctattagccggttctattctgctgctgcccgtgcccctggcattcatttgtctgtcatacttgcttatactggccactattctgcgagttccctccgcagcgagatgttgtaaggctttcagcacctgcttagcacatctggccgttgtgttgctcttctacgggactattatcttcatgtatctgaagcccaaatccaaggaggctcatatatctgatgaagttttcacagtgctgtacgctatggtgacaacgatgttgaatcctacgatttattccctgcggaacaaggaagttaaggaagcagcccgtaaagtctggggtcgcagcagagcaagcagatag

SEQ ID NO: 52250 - DNA, 930 bp, Artificial Sequence
  Description of Artificial Sequence: Synthetic coding sequence
atggccaatctgaccatagtgaccgagtttatcctgatgggattttcaacgaataaaaacatgtgcattttgcattccatcctgtttcttctcatttacctctgcgctctgatgggaaacgtactaatcatcatgatcaccacactcgaccaccacctccatactccggtatacttctttctgaagaacttgtcttttctggacctgtgtctcataagtgtgaccgccccaaagtcaatcgctaattctctgatccacaacaacagtattagtttccttggatgcgtgtctcaggtgttcctgctgttgtcttctgctagcgccgaattgctgctccttaccgtgatgagcttcgatcggtacactgccatttgccacccccttcactatgacgtcatcatggaccgttcaacctgtgtacagcgggcaacggtgtcctggctctacggcggtttgatagccgtgatgcatacagctggcacatttagcctgtcctactgcggttctaacatggtacatcaattcttttgcgacatccctcaactgctggcaatctcctgtagtgaaaacctgatccgcgaaatcgccctgattctgattaacgttgtcctggatttctgttgcttcattgtaatcataataacctatgtgcacgtattcagcactgtgaaaaagataccctccaccgagggccagtcaaaggcctatagcatttgcctgccccacctgctggtggtcctcttcctttccactggctttatagcttacctgaagcccgcaagtgagagtccctccatactggacgctgtgatctctgtgttttatactatgctgccgcctacattcaatcctataatctattccctgagaaacaaggccatcaaggttgcattggggatgttgattaaaggcaagctaacaaagaagtag

SEQ ID NO: 52251 - DNA, 945 bp, Artificial Sequence
  Description of Artificial Sequence: Synthetic coding sequence
atggccaatgtcaccctggtgaccggattccttctcatgggcttcagtaacatccagaaactgcggatcctatacggagtgttgttcctgttgatctacctggcagccttgatgtcaaacctattgatcatcaccttgatcactcttgatgtgaagctgcagacacccatgtatttctttctgaagaatttgagctttcttgatgttttcctagtgtctgtgccaattcctaaattcatcgtgaataatcttactcataacaactccatcagtatcctgggctgcgcttttcagctgcttctgatgactagtttctccgccggagagatattcatcctgacagctatgagctacgatcggtatgtagctatctgctgtcccctcaactatgaggtgatcatgaatactggggtctgtgttcttatggcctctgtttcatgggccattggtgggttgttcggaacagcttatacagctgggacttttagtatgccattctgtggatcctcagtcatccctcagtttttctgtgatgttccatcattactgagaatctcatgctcagaaacccttatggtgatttacgcaggcatcggcgtgggtgcatgcttgtctattagttgcttcatctgtatcgtcatctcctatatctatatcttcagcaccgtgctgaagatccccacaactaagggccagtctaaggccttcagtacctgtttccctcacctcactgtgttcacagtattcatcatcaccgcttactttgtctacctgaagccgccaagcaacagcccttctgtcattgataggttactgtccgtaatctacaccgtgatgcccccagtgttcaacccagttacttattcgctccggaacaacgatatgaaatgtgctctcattagactcctccaaaaaacctacgggcaggaagcctactttatatag

SEQ ID NO: 52252 - DNA, 939 bp, Artificial Sequence
  Description of Artificial Sequence: Synthetic coding sequence
atgccaaactcaacaaccgtaatggaatttctcctgatgcggttcagcgatgtgtggaccctccagatcctgcattctgcgtccttttttatgctctacctggttacacttatgggcaatattttaatcgtgacagtgacaacatgcgatagctctttgcacatgcccatgtactttttccttcgcaatttgtccattctggacgcctgctatatctcagtgacggtaccaaccagctgcgtgaactccttactggattcaacgacgatatcaaaggcagggtgtgtagcccaggtgtttcttgtggtgttcttcgtatacgtggagctactcttccttactatcatggctcatgaccgctacgttgccgtgtgccaacctttgcactatccagttatagtcaattcaaggatctgcattcagatgacactggctagccttctgtcagggctggtgtacgctgggatgcacacaggctcaacttttcagctgcctttctgccgaagcaacgtgatccaccaatttttttgcgacatcccttccctcttgaagctttcctgcagcgacacatttagtaacgaggtcatgatcgtagtctctgctctgggagtgggcggaggttgcttcatcttcatcattcgaagttatatccacattttcagtacagtgttgggatttccaagaggggctgataggactaaagcgttttcaacgtgcatcccacatatactggttgtttctgtgtttctaagctcttgcagctcggtctacctgcgccctcccgcaatccctgctgccacccaggatcttattctcagcggcttttactctatcatgcctcctttatttaaccccatcatctatagtctccgcaacaaacaaattaaggtggcgattaagaaaatcatgaaacgcattttctactcagaaaacgtttag

SEQ ID NO: 52253 - DNA, 3666 bp, Artificial Sequence
  Description of Artificial Sequence: Synthetic coding sequence
atgatgtttaggtcagaccgcatgtggagttgccactggaagtggaaaccatccccacttctgttccttttcgccttgtacatcatgtgcgttccccatagtgtgtggggatgcgccaactgtagagtggtgctcagtaatccgtccggaacgtttacatcaccgtgctacccaaatgactatcctaactcccaggcatgtatgtggactctgcgagcacccacagggtacattatccagataacattcaacgacttcgatatcgaagaggccccaaactgtatctacgacagcctgtccctggacaacggcgagagtcagaccaagttctgcggagccacagcaaagggcctcagcttcaacagttcagccaatgaaatgcacgtttccttctcctctgacttcagcatccagaagaaaggattcaacgcaagttacatccgtgtggctgtgtcattgcgaaatcagaaggtgatcctgccccagaccagtgacgcataccaggtttcagtggcaaagtcaatctctattccggagttgtctgccttcacactgtgctttgaagccacaaaagtgggccatgaagatagcgattggacggcctttagctatagcaacgcaagctttacacagctgttgtcatttggcaaggcgaagtccgggtactttctgtctatcagcgattctaagtgtctgttgaacaacgctctcccggtgaaggaaaaggaagacatttttgcggaatcattcgagcaattatgtttagtgtggaataatagtttaggttctattggcgttaatttcaagcggaactacgagacagtgccctgcgactcaactatttctaaagtgatccctggcaacgggaaactacttctggggtcgaaccagaatgaaatcgtgtctctgaagggagatatatataattttcggctttggaatttcaccatgaatgccaagatactatcgaacctgtcttgcaatgtaaaaggcaacgtggtggattggcagaacgatttctggaatatccctaacctcgcactgaaagccgaatctaacctgagctgcgggagttacctgatccccctgcctgcagctgagctcgcatcttgtgctgacctgggcactctgtgtcaggccaccgtcaactcacctagcacgaccccgccaactgtcacaacaaacatgcccgtcacaaaccgtattgacaagcagagaaacgatggcataatttaccgcatctcagttgttattcagaacatactaagacaccccgaagtgaaagtccagagcaaagtagccgagtggctgaattcaacatttcagaactggaattatacagtgtatgtggtgaacatatcatttcacctgtccgcaggggaggacaagattaaggtgaaacgatcactcgaggatgaaccacggctggtgctgtgggccctcctggtctataacgctacgaacaataccaacctggaaggaaagataatacagcagaaactgctgaagaataatgaatcactggatgaggggctccggttgcacactgtgaacgtgcgacagctgggtcactgcttagccatggaggaaccgaagggatattactggccatctatacagccctctgagtacgttctaccttgtcctgacaagccagggtttagtgccagcagaatatgcttctacaacgcaacaaaccctctcgtgacttactggggccctgtcgatattagcaattgcctcaaggaggcaaacgaagtggcaaaccagatactgaatctgaccgcggatggacagaacctgacatccgccaatataacaaacattgtggagcaagtgaagcgtatcgtgaacaaggaagagaatatagacattactctaggatccaccctgatgaacatcttttctaatatcttatcctcctccgattccgatctcctagagagttcctccgaggctctgaagaccatagatgaactggcgttcaaaatcgatctaaatagcaccagccacgtgaatatcacaacacgaaacctcgctctgtcagtttcctctctgctccccggaactaatgctattagcaactttagcattggtttaccgtcaaataacgagagctacttccagatggacttcgagtctggccaggtcgatccactggccagtgtcatcctccccccaaatttattggagaatctctcacctgaggacagcgtcctggtgcgtcgcgcacagtttacgttcttcaacaaaactggcctgttccaggatgttggaccacagcgcaagacactcgttagctacgtgatggcgtgctcaattggcaacatcacaatccaaaatctgaaagatcctgtgcaaatcaagatcaaacataccagaacccaggaagttcatcatcccatttgtgcattttgggacctaaacaaaaacaaaagttttggtggatggaataccagcggatgcgtggcccaccgggattcggacgcatcagagacggtatgcctgtgcaatcacttcactcactttggagtcctgatggaccttcccagatcagcctctcaactggacgccagaaatacgaaggtcctcacctttataagctatatcggatgtggcatcagtgccatcttttctgccgcaacactgctgacctatgtggcgtttgagaagctgcgcagggattatcccagcaaaattttaatgaatctgtctactgccttactgtttctgaacttgctgttccttcttgatggctggattactagctttaacgtggatggcctttgcatcgccgtggccgtgctccttcactttttcctgttggccacatttacgtggatgggcctcgaagcaattcatatgtacattgccttggtgaaagtttttaacacttatattcggaggtacatcctcaaattctgtataataggatggggcttacctgcattggtggtgtcagtggtcttggcctcccggaacaacaacgaggtgtacgggaaggaatcatatgggaaggagaaaggagacgaattttgctggatccaggatcctgtgattttctacgtgacgtgtgcaggatactttggagttatgttttttttgaacatagccatgttcatcgtggtgatggtacaaatttgtggacgcaatgggaaacggagtaacagaacccttcgagaagaggtgctgcgaaacctgcgctctgtggtgtcactgacgttcctgctagggatgacgtggggctttgccttctttgcctgggggcctctgaacataccttttatgtatctcttctccatctttaactcactccagggcctcttcatctttatcttccattgcgctatgaaggaaaatgtccagaagcagtggcggcaacatctgtgctgcggaaggtttaggctcgcggataattccgactggagcaaaactgccaccaatattattaagaagtcctccgacaatctgggcaagtctctttcttcctcttcaatcggttctaactcaacatatcttacgtctaagtctaaatcgtcttcaactacatatttcaagcggaacagtcatactgataatgtgagttacgagcactctttcaacaaatccggttccttacgacagtgcttccatggacaggtcttagtgaaaacagggccttgctag

SEQ ID NO: 52254 - DNA, 966 bp, Artificial Sequence
  Description of Artificial Sequence: Synthetic coding sequence
atggtgaacctgaccagtatgtcgggcttccttcttatgggtttttccgatgaacggaagttacagatactacacgcgcttgtgttcttggtgacatatctcctcgcactcaccggtaacttgctgattatcactatcatcaccgtggatcgaagactccatagccccatgtactactttctgaaacacctgtccctgctcgatctgtgttttattagtgtgaccgttcctcagagcatagcgaatagcctcatgggtaatggatacatcagtctggtgcagtgcattctacaggtgttctttttcatcgcactggcctccagtgaagtggctatcctgacggtgatgtcttacgataggtacgcagcaatctgtcagcccctgcactatgagacaattatggaccctagggcatgcagacacgctgtcattgccgtgtggatcgctgggggactgtccgggctgatgcacgccgctattaattttagcattcccctatgtgggaagcgagtgattcatcagttcttctgcgatgtaccccaaatgctgaagctagcttgcagctatgaatttatcaatgagatcgcactggccgctttcaccactagtgcggctttcatctgcctgatctctatagtgttgtcctatatcaggatattctctacagtgttgcgtataccgagcgccgaggggagaacaaaggttttctcaacctgcctgccgcatttattcgttgctaccttctttctcagtgccgcaggctttgagttcctgcgtttgcccagtgattcgtcatccacagtcgatctggtgttcagcgtcttttacaccgtaataccacccaccttaaacccagtgatttactcgctccggaacgacagcatgaaggccgctttaagaaagatgctgagcaaggaggaactgccccagagaaagatgtgtcttaaggctatgtttaagctgtag

SEQ ID NO: 52255 - DNA, 966 bp, Artificial Sequence
  Description of Artificial Sequence: Synthetic coding sequence
atggtgaacctcacctctatgtccggctttctgctcatgggtttctccgacgagagaaaacttcagatactgcacgcactggtcttcttggttacatatctacttgctctaacaggaaatttgctaatcataacaatcatcacagtggatcgcagactgcatagtcccatgtattacttcctcaaacatctctccctgctggatctctgcttcatctccgtgactgttcctcagtctattgctaattcccttatgggcaacgggtatatttcactggtccagtgcatcctccaggtatttttcttcattgcattggcttccagcgaggtggcaatacttaccgtgatgtcttatgaccggtacgcagctatctgccaaccactccactatgagactatcatggaccctagggcatgccggcacgccgtaattgccgtttggatcgctggcggtctaagtgggttgatgcatgctgcaattaactttagtatccctttatgcgggaaacgggtgattcatcagtttttttgtgacgttccacagatgctcaagctggcttgtagctacgagttcatcaatgagatagcgcttgccgctttcaccacctccgccgctttcatctgtctcatctccatcgttctgtcctacatcagaatcttcagcacagtcctgaggatcccaagcgccgaaggtaggaccaaggtgttttcaacgtgtctgccacatctatttgtggctacattttttttgagcgccgctggcttcgagtttctgaggttaccttccgattcctctagcaccgtggatctggtgttcagtgtgttttacactgtcattcctcccacccttaatccagtgatctattccttgagaaacgatagtatgaaagcggcactgcggaaaatgctgagtaaagaagaacttccccaaaggaaaatgtgtctcaaagctatgtttaagctttag

SEQ ID NO: 52256 - DNA, 945 bp, Artificial Sequence
  Description of Artificial Sequence: Synthetic coding sequence
atgacgaaccagacccaaatgatggagtttctgctggttcgcttcacagaaaactgggtgctgcttaggcttcacgccctgctcttctctttgatctacctcacagctgtgctaatgaatctcgtaatcattttactgatgattcttgaccatcgactccacatggctatgtacttttttctacgccatctgtcgtttttggatctctgtctgatctccgctactgtaccgaaaagcatcctaaactctgtagcaagcacagattcgatatcattcctgggatgcgttttacagctattcttagttgtgctgctggctgggagtgaaatcgggattctgacagctatgtcctacgatagatacgccgcaatttgctgccctctgcattgtgaagctgtgatgtccagggggctctgcgtacaactaatggcactcagctggctaaataggggagccctgggactgctgtacactgccggtacgttctcgctcaatttctacggatctgatgagctgcaccagttcttctgcgacgtccccgctctactgaagctgacctgttctaaagagcacgccattatatctgtgtcagtggccatcggagtttgctacgctttttcctgcctcgtctgcattgtggtcagttacgtgtatatcttctcggctgtgctgcggatctctcagcggcagagacagtccaaggcctttagtaactgcgtgccccacttaattgttgtcaccgttttccttgtaaccggagccgtagcatacttgaagccaggatccgatgccccatcaattttagacttattggtatcggtgttctactctgtggccccaccaactctcaaccccgtgatctattgtctgaaaaacaaagatataaagagcgccctatctaaagtgctgtggaacgttaggtctagcggagtcatgaagcggtag

SEQ ID NO: 52257 - DNA, 933 bp, Artificial Sequence
  Description of Artificial Sequence: Synthetic coding sequence
atgggagaaaatcagacgatggtgacagagttcctgttacttgggttcctgctcggccctcggattcagatgcttttatttggtctgttttccctgttctacatatttaccctgctgggcaacggagccatacttggtctcatctccctggacagccggctgcacacgccaatgtacttttttttatcccaccttgccgtcgttgatatcgcttatacccgcaacaccgtgccccagatgctggcaaacctgctgcacccggcaaaacctatatcttttgccggttgcatgactcagacctttctgtgtttaagcttcgggcattcagagtgcttactgctcgttcttatgtcctacgatagatacgtggctatatgccaccctctcagatacagcgtgattatgacctggagggtttgtatcactctggcagtgacatcctggacctgtggcagtttgttggccctcgctcacgtggtgttgattctcaggctgccattctctggcccacatgagatcaatcacttcttctgcgagatcctgtctgtcctgcgcctggcctgtgcagatacatggctcaaccaagtcgtcatcttcgccgcttgtgtctttttcttggttggacctccctctttggtcttagtgtcctacagccatatcttagccgctattttgcgaattcagagcggagagggacggcgtaaggcattttcgacttgcagtagccatctctgtgtggtagggttattctttggcagcgccatcattatgtacatggcccctaagtctcgccaccccgaggagcagcaaaaggtgttctttttgttctatagcttctttaaccccacactcaaccctttgatttattccctccgcaacggggaggtgaagggcgcactgcgtagagcactgggaaaagagtctcactcttag

SEQ ID NO: 52258 - DNA, 933 bp, Artificial Sequence
  Description of Artificial Sequence: Synthetic coding sequence
atggagtccaaccagacttggatcaccgaggttatactcttgggatttcaggttgaccctgccttagaactgttcctctttggattcttcctgctgttctattctcttacattgatgggaaatggcattatcttagggttaatttacctggacagtcggctgcatacacccatgtacgtctttctgagccaccttgccatagtagacatgtcatatgcaagctcgacagtaccaaaaatgcttgctaacctcgtcatgcataagaaggtgatttcgtttgccccttgtatactgcaaaccttcctctatctggcgtttgcgattacagagtgtctcattctcgtcatgatgtgttacgatcgatacgtcgccatctgccaccctcttcagtataccctcattatgaattggagagtgtgtaccgtgctggcttccacatgctggatcttctcattcctgctggctcttgtgcatatcactctgattttgcggctgcctttctgtgggccacagaagataaaccacttcttttgccagatcatgtccgttttcaagctggcttgtgcagacacccgcctcaaccaggtcgttcttttcgcgggatccgcctttatcctggtcgggcctctgtgcctggtcttggtttcatacctgcacatacttgtcgcaattctgcgaatccagtccggggaggggaggaggaaagctttctccacttgtagcagtcatctttgtgtcgttgggctgttttttggaagcgccattgtcatgtacatggcgcctaagtctagtcacagtcaggaacgacggaaaatcttgagtctattctactcacttttcaatccaattctgaatccgctgatctattccctccggaacgctgaagtgaaaggcgctttaaaaagggtcctgtggaaacagagaagcatgtag

SEQ ID NO: 52259 - DNA, 933 bp, Artificial Sequence
  Description of Artificial Sequence: Synthetic coding sequence
atggaggggaacaagacatggatcacagacattacgttaccaaggtttcaggtgggaccagctctggagatattgctctgcgggcttttctctgccttttacactctgaccctcctagggaacggtgtcatcttcggcattatttgtcttgattgtaagctccatacacccatgtatttctttttaagtcacctggcaatcgtggacatcagttacgcttctaattacgtcccgaagatgctgacaaacctcatgaaccaggagagcactatatctttcttcccttgcataatgcagacctttctgtatctggcttttgcccacgtggagtgcctcattttggtggtcatgtcttacgataggtacgccgacatctgtcatccgctcagatacaatagcctaatgagctggagagtctgcactgttctggcagtggcatcgtgggtgttcagcttcttgctggccctggttccactcgtgctcatcttgagtttgccgttctgcggaccccatgaaattaatcacttcttctgtgagatcctcagcgtgttaaagctggcctgtgccgatacctggctgaaccaggtggttattttcgctgcgtgtgtgttcattctggtcgggccactgtgcctggttctagtctcatacttaaggatactggcagcaatcctgaggatccaatcgggagagggacgcagaaaagcgtttagcacttgtagcagccacctctgtgtcgttggcctcttttttggttcggccattgtgacctacatggcaccaaaatcaaggcatcctgaagaacaacaaaaagtgctgagccttttttattcattgttcaatcccatgcttaatcctttaatctacagcttgcgcaacgccgaggtgaagggcgcattgagacgcgctttgcggaaagaacgactcacatag

SEQ ID NO: 52260 - DNA, 957 bp, Artificial Sequence
  Description of Artificial Sequence: Synthetic coding sequence
atggaggggaatcaaacatggatcacagatatcaccttgctcgggttccaggtggggcctgccctggctatcctgctgtgtggactgttttcggtgttctacacactgaccctcctgggcaacggagtgatattcggcattatctgtctggactcaaaacttcatacccctatgtatttcttcctttcccatctcgccattattgatatgtcatatgcttcaaacaatgtccccaaaatgctcgcaaatctcatgaatcagaagcgtacaatctctttcgtaccctgtatcatgcaaacgtttctttacttggcctttgcagtgaccgagtgccttatcctggtcgtaatgtcttacgaccgctacgtagccatatgccacccgtttcagtacactgtaatcatgtcttggcgtgtatgcacaatccttgtactcacttcatggtcttgtgggttcgctctgagcctcgtacatgagattttactgctgcggctgcctttctgtggccctagagatgtgaatcacttattctgcgagattctctctgtgcttaagctggcctgtgcagacacctgggttaaccaggtggtgatttttgcaacatgcgtgtttgtgcttgtaggtccattgtcacttattctagtgtcttacatgcatatcctcggcgctatcttgaagatccagaccaaggaaggcagaatcaaggctttcagtacctgttcctcacatctgtgcgtggttggacttttctttggcatcgccatggtcgtgtacatggttcccgactctaatcagagagaggaacaggagaagatgttgagccttttccattcggtcttcaaccccatgctgaatcccttgatttattctctgcggaacgctcagttgaagggagcgttgcatcgggctttgcagaggaagcgctcaatgcggacagtgtatgggttgtgtttgtag

SEQ ID NO: 52261 - DNA, 933 bp, Artificial Sequence
  Description of Artificial Sequence: Synthetic coding sequence
atgggcggaaatcaaacttctataacagagtttctccttcttgggttcccgatcggtcccagaattcagatgttgctgtttggactattcagtctgttttatatatttattctgcttggtaatgggactattctgggcctcataagtcttgacagccggctccacacacccatgtacttttttctatctcacttggccgtagtggacatcgcatgtgcgtgtagcactgtgccacagatgctcgtcaacctcctccaccctgccaagcctatttctttcgcaggttgcatgacccaaatgttcctgtttctgagtttcgcccatactgaatgcttgctgctggtggtcatgtcctatgacaggtatgtggcaatctgtcacccactccggtattcgactattatgacctggaaggtctgtattaccctagctctcactagttggatactgggagttctccttgccctagttcacttggtgctgctgcttcccctcagtttctgtggaccgcagaagttaaaccacttcttctgcgaaatcatggctgttctcaagctggcctgcgctgatacacacatcaatgaagtgatggtgctcgccggagcggtctctgtgctggtaggagcgttttttagtaccgtcatctcatatgtgcatattttgtgcgcaattctcaaaatccagtctggcgaaggctgtcagaaggcattttcgatttgttcttctcatctctgcgtggtggggctgttctacggtactgcaattatcatgtatgttgagccacagtacgagagtccaaaggaacagaaaaaatacttacttctgttccactcacttttcaaccctatgctgaatcccctaatctacagcctgagaaataaggaagtgcagggcaccttgaagagaatgttagaaaaaaaacgtacttcgtag

SEQ ID NO: 52262 - DNA, 933 bp, Artificial Sequence
  Description of Artificial Sequence: Synthetic coding sequence
atgggagacaacatcacaagcattcgggaattcctgctgttgggtttccccgtgggacctcgcattcagatgttgcttttcggcctcttcagcctcttctatgtgttcaccctgctaggcaacggaacaattctcggattgatcagtctagacagcagactacatgcacctatgtacttttttctcagccacttagcggtcgtagatatagcatacgcttgtaataccgtgccacggatgcttgtgaacttgttgcatcccgctaagcctatctcattcgctggcaggatgatgcaaaccttcttgtttagcaccttcgcagtgaccgagtgtctcctgctggtcgtgatgtcctatgatctctacgtagctatctgccacccgctgaggtatctggctatcatgacctggcgcgtctgtatcactctggcggtcaccagctggactacaggcgtgctgctctcgctcattcatctcgtgctactgcttccgctccccttctgccgtcctcagaagatataccacttcttctgtgaaatcctcgccgtcctaaaattggcatgcgccgacacccacattaacgagaatatggtccttgctggcgctatctccggactcgtgggtccactgagtaccatagtcgtctcatacatgtgtatcttgtgtgcaattctgcagatacagtccagggaggtccaacgcaaggcctttagaacctgctttagtcacctttgcgtgatcggactcgtttatgggacagccatcattatgtatgtaggaccacgctatggcaaccctaaagagcagaaaaagtatctgctgctattccactccctgttcaaccctatgttgaatccgctgatctgtagtctgaggaattcagaagtgaaaaacaccttaaagcgggtgctcggagtcgaaagggccctgtag

SEQ ID NO: 52263 - DNA, 933 bp, Artificial Sequence
  Description of Artificial Sequence: Synthetic coding sequence
atgggcgagaatcagaccatggtgaccgagttcttgttgctaggattcctcttgggacctcggatccagatgctcctcttcggcttgttttctctgttctacatatttaccctactggggaatggcgcaatcctgggtctcattagcctggacagtcgactgcacacgccaatgtatttctttctatcccacctggccgttgtagatattgcgtacactcggaatactgtgccccagatgcttgccaacctgctccaccccgcaaagcctatttcttttgccggatgcatgacacaaacctttttgtgcctcagctttggacacagcgaatgtctgttgctcgtgttaatgtcctatgaccggtatgtcgctatctgccacccattaaggtattccgtaatcatgacatggcgggtgtgcattactctcgcagttactagctggacatgtggcagcctactagccttagcccacgttgtgttaattttaaggttgccattctcaggccctcacgagattaatcacttcttctgtgaaatcctttctgttctcaggctggcatgcgcggacacttggctgaaccaggttgtgatttttgcggcttgtgtgtttttcctagtcgggcctccctccctcgtgctggtctcatacagccatattttggctgcgatcctcagaatccagtccggagagggtaggaggaaagccttttctacgtgttctagtcatctttgcgtggtgggcttgttctttggatcagctataatcatgtacatggcacctaaatcccgccatcctgaggagcagcagaaggtcttctttcttttctattctttttttaaccctacccttaatccgctgatttacagcctgaggaatggcgaggttaagggggctttgcggagggcactgggtaaggaatcccacagttag

SEQ ID NO: 52264 - DNA, 936 bp, Artificial Sequence
  Description of Artificial Sequence: Synthetic coding sequence
atgaccaagaaccagacctgggtgacagaatttatcctgttggggttccctctgagtttaaggatccagatgcttctatctggtttgttctcattgttatatgtgtttactctgctggggaatggtgccatccttgggctgatctggctggactccagactgcatacacctatgtacttttttctgtcccacttggctatcatcgatatttcatatgcgtccaataatgtcccaaagatgctgaccaacctgggcttgaacaagcggaagactatttctttcgtgccctgtaccatgcagacattcctgtacatggcctttgcccatactgagtgcctgatcttggtgatgatgtcatatgacaggtatatggcgatatgccatcccctccagtactctgtcattatgcgctggggtgtctgtactgtgctggccgtaactagctgggcctgtggttccctattggccctggtccacgtggtgttaatcctgcgcctccctttctgcgggccacatgaaatcaaccattttttctgcgagattctcagcgttcttaagcttgcttgtgccgatacatggttgaaccaggtcgtcatttttgctgcatctgtgtttatccttgtggggccactgtgcttggtgctggttagttacagccgcattctcgcagcgatcctgcgcatacagagcggagaggggaggcgaaaagccttctccacttgttcttctcacctgtgcatggtgggactgtttttcggctccgctattgtgatgtatatggcccctaagagccgccaccccgaagagcaacagaaggttcttagcctcttctatagccttttcaatcctatgctgaatcccctgatctactccttgagaaatgccgaggtaaagggagcccttaaaagagtcctctggaaacagcgctcaaaatag

SEQ ID NO: 52265 - DNA, 933 bp, Artificial Sequence
  Description of Artificial Sequence: Synthetic coding sequence
atgggtgacaatatcacgtcaatcaccgagtttctcttgttaggattccccgtggggcctcggatacaaatgctgctgttcggtctcttctcactgttctatgtatttacccttctcgggaacgggaccatactaggcctgattagtctcgatagccgcctccatgcacctatgtacttctttctttcccatcttgctgtggtagatatcgcatatgcctgtaacaccgtccctaggatgctagtgaacttgcttcatccagcaaaacccataagcttcgctgggcgtatgatgcagactttccttttcagtacctttgcagtcacagaatgtttactactggtcgtgatgagctacgacctatatgtggccatctgccacccactgcggtatctggctatcatgacctggagggtctgcataactctggcagtgacaagctggacaactggcgtccttctctcactgattcacctggtattgcttctacctcttccgttctgcagacctcagaagatttaccattttttttgcgagatattggccgtgctgaagttagcgtgtgcggacacgcatatcaatgagaacatggtgctggccggtgccatcagcggcctggtgggacccttgtcgaccatcgtcgttagctacatgtgtatactttgtgcaatactgcagatacagagtagggaagtgcaacggaaagccttctgcacgtgtttttcgcatttatgtgtgatcggacttttctatgggaccgctatcattatgtatgtcggccctcgatacggtaaccccaaggagcagaaaaagtatttgttgctctttcactccctgtttaatcctatgctcaaccctttaatctgttctttgcggaactctgaggttaagaacaccctgaaaagggtattgggagtagagcgagccctgtag

SEQ ID NO: 52266 - DNA, 972 bp, Artificial Sequence
  Description of Artificial Sequence: Synthetic coding sequence
atgtggcagaagaaccagacaagcctggcagactttattttggagggcctctttgatgactcgttgacgcatctttttctcttttcacttactatggtcgtcttcctgattgcagtgtctggcaacacactaacaatcctcctgatctgcattgacccccagctccacacgcccatgtacttcctgttgtcacaactctccctgatggatttgatgcacgtcagcactatcatccttaagatggctacaaattacctctccggcaaaaaatcaataagcttcgtagggtgcgcaacccaacactttctgtacctgtgcttggggggtgctgaatgctttctccttgctgttatgtcttacgatagatatgttgccatctgtcatcctctgagatacgctgtcttaatgaataaaaaggtgggtctcatgatggcagtgatgtcatggttaggcgcaagtgtgaacagtctcattcatatggcaattttaatgcactttccgttctgcggcccacggaaagtatatcacttttactgcgagttcccagcagtggtgaagctcgtgtgcggcgacatcaccgtctatgaaaccacggtgtatatctctagcatcttactgctgctgccaatttttctgatatccacttcgtacgtgtttatcttgcaatctgtcatccaaatgaggagcagcggcagtaaacgaaacgcatttgccacctgcggatcacacctgaccgtagtgtcactgtggtttggagcttgcatcttcagctatatgcgcccacgaagccagtgcacacttctgcagaataaggtgggatctgtgttctattccattattaccccaacgctcaactctctgatctatactctgcgaaacaaggacgtcgccaaagccctcagaagagttctccggagggatgtcatcacacaatgtattcagcgtctacagctgtggctcccaagagtgtag

SEQ ID NO: 52267 - DNA, 951 bp, Artificial Sequence
  Description of Artificial Sequence: Synthetic coding sequence
atggagctttggaactttacactaggatctggcttcatactcgtaggcattcttaacgatagtggctccccagaacttctatgcgccactattacaatcttatacctactcgcactgatctcaaatggcctccttctccttgctatcacaatggaggcacggcttcacatgccaatgtatctcctcttgggccagctcagcctgatggaccttctattcacatccgtcgttaccccaaaggcactagcagacttcctgaggcgcgagaacactatatctttcggcggttgtgccttgcagatgttcttggcactcacaatgggcggtgcagaagacttactgctcgcattcatggcctacgacagatatgtggcaatctgtcacccgctgacatacatgacgcttatgtcttctagggcatgttggctgatggtggcgacaagctggattctcgctagtctatcagcgctgatctacacagtgtatacaatgcactatccgttctgcagagctcaagaaattagacacttattatgtgaaatccctcatctccttaaggttgcctgcgctgataccagccgatatgagctgatggtgtatgtaatgggtgtgacgttccttatccccagtcttgccgcaatccttgcctcctacacccagatcctcctcactgtcttacacatgcccagtaacgaaggcagaaaaaaggctcttgtgacttgttcgtcccacctaactgtggtgggcatgttctatggcgcagctacttttatgtatgtcctccctagctccttccactcaacacggcaggataatatcatctccgtgttctacacaatcgtgaccccggcactcaaccctctcatttattcccttcgtaacaaggaggtcatgcgtgccctgcgtagagtgctcggcaagtatatgctgccagcacacagtactctgtag

SEQ ID NO: 52268 - DNA, 987 bp, Artificial Sequence
  Description of Artificial Sequence: Synthetic coding sequence
atgggtcaccagaaccatacttttagttctgatttcatcttgctgggcctattctcctcctcccccacctccgtggtgttttttctggtgctgttcgttatctttatcatgagcgttactgagaacacactcatgatcctcctaatcagaagcgattctagactgcacacacccatgtactttctgctgagccaccttagtctgatggatattctgcacgtttccaatatagtcccaaaaatggtaaccaacttcctgtccggatccaggacgatctcatttgcaggatgtggctttcaggtattcttgagcttgacgctactagggggagagtgtcttctgctggcggcaatgtcttgtgacagatatgtagcaatttgccaccctctcagatatcctatactcatgaaggagtacgcctcagcactcatggcgggtggatcctggctgatcggcgtgttcaacagcaccgttcatacggcatatgctcttcagttccctttctgcggcagtagggccatcgaccatttcttctgcgaggtgcccgctatgttaaaactgagctgcgccgacacaacacggtacgagcggggagtgtgcgtgtccgccgtcatatttctgctgatcccgttctcgctgattagcgcttcgtatgggcaaattattctgacggtgcttcagatgaagtctagtgaagccagaaaaaaatccttcagcacgtgctccttccatatgatcgtggtcacgatgtactacggacccttcatctttacctatatgcgccctaagagttatcatacccctggacaggataaattcctggccatcttttacactatcttaaccccaacccttaatccgtttatttactcctttcgaaacaaagacgtactggcggtcatgaaaaatatgctgaaatctaacttcctccacaaaaaaatgaatagaaaaatccccgagtgcgtgttttgcttattcctgtgctag

SEQ ID NO: 52269 - DNA, 1008 bp, Artificial Sequence
  Description of Artificial Sequence: Synthetic coding sequence
atgaacatttccgatgtgattagcttcgatatcttagtgagcgccatgaagaccggcaaccaatcatttggaaccgatttcttgctggtgggtttgttccagtatggatggataaatagtctgttgtttgtggtgattgctactttgtttactgtcgcccttactggcaacatcatgctgatccaccttatacggctcaacacacgactccacacgcccatgtactttctcctaagccagctgtcgatcgtggacctgatgtatatatccacaactgtccctaagatggcagtctcctttctctcacagtcaaaaacgatacgttttttgggctgtgaaatccagacttacgtttttctggcgctgggtggcacagaggccctgctcttaggctttatgtcgtacgatcggtatgtggcgatctgccacccattacactatcccatgctcatgtccaaaaaaatttgctgtctgatggtggcttgtgcgtgggctagtggctcaatcaacgcttttatccacactctatacgtgttccagctacccttttgccgtagcaggctgatcaaccactttttttgtgaggtgcctgctctgctgtccctggtttgccaggatacttcccagtacgagtacacagtcctgttgtccggcttgattatcttgctgctgcctttccttgctatccttgcctcttatgcccgtgtcctcatcgttgtctttcagatgagcagtggaaagggacaagcaaaggccgtcagcacatgctctagccacctgatagttgcctcattgttttatgcaaccactttattcacttatactaggccacatagcctgcgtagtccctcaagggacaaggccgtagctgtgttctatacaattgtgacgccactgctcaatccctttatatactcactgcgtaataaggaggtgacaggggctgtaaggcgtctattagggtattggatctgttgtcggaagtacgactttcgcagcctctattag

SEQ ID NO: 52270 - DNA, 930 bp, Artificial Sequence
  Description of Artificial Sequence: Synthetic coding sequence
atgaagaataagactgtcttgaccgaatttatccttttggggttgacggatgtgcccgaattgcaagtcgccgtgttcacgttcctgttcctggcatatctgctctcaattttgggcaatctaacaattctaatcctgacgttactggacagtcacctgcagacacctatgtacttctttctgaggaattttagttttctggagatctcttttacaaacattttcattcctagagtgctgatatctatcacaaccgggaataaatctattagctttgcagggtgctttacccagtacttctttgccatgtttctcggtgccaccgaattttatcttctcgctgcaatgagttacgaccgctatgtcgccatttgtaagcccctccattacacaactattatgagttctcggatttgcattcagctgatcttttgctcctggctgggcggactgatggcaattatcccgactatcacgctgatgtcacaacaagatttttgcgcaagcaatcggctaaaccattacttctgcgattacgagccattgttggagctgagttgtagtgatacaagcttgatcgagaaggtcgtcttccttgttgcatctgtgacactggtcgtgacgttggtcctcgtcatcctaagttacgcctttattatcaaaactatcctcaaattgccgagtgcgcaacagcgaacgaaggctttcagtacgtgttcctcacacatgatagtgattagcttgagctacggctcttgtatgttcatgtacataaacccctccgcgaaggaaggggacacgttcaacaagggcgttgccctcttgattaccagcgtcgctcctttgctcaatccttttatctacacgctgcggaaccagcaggtcaagcaacccttcaaagatatggtaaagaaactcctgaatctatag

SEQ ID NO: 52271 - DNA, 963 bp, Artificial Sequence
  Description of Artificial Sequence: Synthetic coding sequence
atggatgccaccgcttgtaacgagtccgtggacgggagtccggtcttctacctgctgggaatacccagtctcccagaaaccttttttctgcctgtcttttttatcttcctcctgttctatctgctgatactcatgggcaatgctctcattctggtggccgtggtcgccgaaccttcactccacaagccaatgtacttctttttaatcaacctgtccacgctggatatccttttcactacaactaccgtccccaagatgctgtcactttttctgctaggagatcggttcttgtccttctcgtcctgtcttctacagatgtatttgttccagtccttcacatgcagcgaggcattcatcttggtagtgatggcatatgacaggtatgtcgccatctgccaccctttgcactaccctgtgctgatgaatcctcagaccaatgcaaccctggccgcatccgcttggctaacagcgcttctactaccgataccggcagtggtgagaacttctcagatggcctataactcgatagcatacatctaccactgtttttgtgatcacctagcagtagtgcaggcatcatgtagtgataccactccgcagacgctgatggggttctgcatcgctatggtggtgagttttcttcccttgttactggtgctgctgtcgtacgttcacatccttgctagcgtgctgcgtatttcttctctggagggccgtgccaaagctttctctacttgttcgtcacatcttctagttgtgggcacatactacagttcaatcgctatcgcctacgtggcttaccgggctgacttaccgttggattttcatatcatggggaacgtggtctacgctatcctgacccccatacttaacccattgatatacactctccggaatagagatgtcaaggccgctatcaccaagattatgtcccaggaccctggctgtgatagatctatttag

SEQ ID NO: 52272 - DNA, 954 bp, Artificial Sequence
  Description of Artificial Sequence: Synthetic coding sequence
atgaagagtgacaatcactcttttctgggagactcgccaaaggcctttattctgctcggcgtgagcgacaggccatggctggagctgcctctttttgtggtcctcctgctgtcctacgtattagccatgctcggcaatgtcgccattatcctggcgtccagggtggaccctcagctccactccccaatgtatatcttcctgtctcacttgtctttcctcgatctctgctacaccacgaccaccgtgccccagatgcttgttaacatgggatcctctcagaagaccatatcgtatggtggttgcaccgtgcaatacgccgttttccactggttgggttgtactgagtgcatcgtccttgcggcaatggctctggataggtacgtcgcaatctgcaaaccactccattacgcagtgttgatgcatcgcgctttgtgtcaacagctcgtggctctagcctggttgagcggatttggaaattcatttgtacaggtggtcttaaccgtgcaattaccattctgtggacgccaggttctgaacaattttttctgtgaggtgcccgctgtaattaagttatcatgcgcagacactgcggtgaacgacacaattctggcagtgctggtggcattttttgtcctagtgcccctggcgcttattttactgtcatatgggtttattgctagagccgtccttaggatacagtcatctaaaggcagacacaaagcctttggaacctgctcctcacacctcatgattgtgtcactgttctacctgcccgctatctacatgtacctccaacccccttcgagctacagccaggaacagggtaagtttatttcactgttttattctataattacaccaacccttaatccttttacctacaccttgagaaataaggacatgaaaggcgctctgcgccgactcctcgccagaatctggagactgtgtggctag

SEQ ID NO: 52273 - DNA, 1074 bp, Artificial Sequence
  Description of Artificial Sequence: Synthetic coding sequence
atgaactgggttaacaaaagcgtgccccaggagttcattcttttagtgttttctgaccagccttggttggaaattccccctttcgtaatgtttctgttcagctatattctgaccatttttggcaatctcactattatcctagttagccacgtcgactttaaactgcacacccctatgtacttttttctgtcaaacttatccctcctggatctgtgttataccacaagtacagttccccagatgctggtgaatatctgcaatacccgcaaggtgatctcctatggcggatgcgttgctcagctctttatcttcctggcactagggtctacagagtgtctgctactggccgtaatgtgttttgatcgcttcgtggcaatctgcaggcctttgcattacagcatcatcatgcaccagagactatgttttcaacttgctgccgcaagctggataagtgggttctctaactcagtcctgcagtctacctggacactgaaaatgcccctctgtggccataaagaagtcgaccatttcttttgcgaggtgcctgcactgttaaagctgtcctgtgtcgataccactgcaaacgaagctgaactcttcttcatcagtgttctgttccttctgattcccgtcaccctgattttaatctcgtacgctttcatcgttcaagccgttctgagaatccaatcagccgaaggccaaaggaaagctttcggcacttgcggatcacacctgatagtggtatccctgttttatggcactgctatatctatgtatttgcagccacccagcccgtccagcaaagacaggggaaaaatggttagcctgttttgcggaattattgcccctatgctcaatccactcatttatactttgcgtaacaaagaggtcaaagaagctttcaaacgactcgtagcgaagtctttactgaatcaggagattcgaaatatgcagatgataagctttgccaaagacacagtcttaacatatctaaccaacttttctgcctcttgtcctatctttgtgatcaccatcgaaaactattgcaacctgccccaacggaaatttccttag

SEQ ID NO: 52274 - DNA, 942 bp, Artificial Sequence
  Description of Artificial Sequence: Synthetic coding sequence
atgaactgggaaaacgagagttcccccaaggaatttattttgctcggcttttctgacagagcctggttgcagatgcctctatttgtcgtgctgctcatatcatacactataacaatttttggaaatgtgtcgattatgatggtctgcatactggaccctaagttgcacacacccatgtatttctttctcacaaatctaagtattctggatctgtgctacacaaccacaactgtccctcatatgctggttaatattgggtgcaacaagaagacaatcagctacgctggttgcgtggctcatttaatcatattcctggccctcggcgcaactgagtgtttgctgttagccgtcatgtctttcgacaggtatgtggccgtgtgcaggcccttgcattatgttgtgatcatgaattattggttttgccttcgcatggcagccttctcttggcttatcggtttcggcaatagtgtactccaaagctccctgacattgaatatgccacgatgcggccatcaggaggtagatcacttcttttgtgaggtgcccgcattactgaaactgagttgtgctgacaccaaacctatcgaagctgagttgtttttctttagcgtccttatcttgctgattcccgtcacgctcatattgataagctacggattcatcgcacaggctgttctcaagatcaggtctgcagaaggacggcagaaagcattcggcacttgtggaagtcacatgattgtagtgtccctgttctatgggacggctatttacatgtatctgcagcccccatcaagtacgtctaaggattggggtaagatggtgtctctcttctatggcataattacctctatgctgaactccctaatttacagccttagaaacaaggatatgaaggaggcattcaagcggctgatgcctagaatctttttttgtaagaaatag

SEQ ID NO: 52275 - DNA, 942 bp, Artificial Sequence
  Description of Artificial Sequence: Synthetic coding sequence
atgaactgggaaaacgagtcaagtcccaaggaattcatcctactgggcttcagcgatcgcgcatggctgcagatgcctttattcgtggtgctcctgattagctacacaatcaccatcttcggtaatgtgtctattatgatggtatgtatccttgatcccaaactgcacacaccaatgtactttttccttaccaacctcagtatcttggatctgtgttatacaaccactaccgttccacatatgctagtaaacatcggttgtaataagaagactatttcttacgctgggtgcgtggcacatctcataatttttctggctctgggcgcaacagaatgcctgcttcttgccgtgatgtcgttcgaccgttatgtggcagtttgcaggccactgcactacgtagtgataatgaattattggttctgcctgagaatggctgcttttagctggttgattggctttggaaattctgtgctgcagagtagcctcaccttgaacatgccacgctgtgggcaccaggaggtggaccattttttttgcgaggtacctgctcttctgaagctgtcatgtgcagatacaaaacctatcgaggctgaactgttcttcttttccgtgctgatcttgctaatccccgtcacgttgattctcataagctatggcttcatcgcacaggccgtgctgaaaattcgttccgctgagggacggcagaaagcattcggtacctgcggatcccacatgatcgttgtaagcctgttctacggaaccgccatttacatgtatctgcaaccaccgtccagcacctctaaagactggggtaagatggtaagtctcttttacggaatcatcaccagcatgctgaactcgctgatttacagccttcggaacaaagatatgaaggaagcattcaagcgactgatgcctcgcatattcttctgcaaaaagtag

SEQ ID NO: 52276 - DNA, 942 bp, Artificial Sequence
  Description of Artificial Sequence: Synthetic coding sequence
atgaattgggagaatgaaagttctccaaaggagttcatcctattggggttctctgaccgcgcatggctgcagatgcctctgtttgttgtcttacttatttcatacacgattactatttttggcaatgtctccatcatgatggtctgcatcctcgacccaaaactccacacccctatgtactttttcctgactaatctgagtatcctggacctctgctatactactaccacagtgccacatatgctcgtgaatattggctgtaacaagaaaacaatcagttatgccggatgcgtggcccatctgatcatctttttagctctcggagccacagagtgtctccttctcgccgtgatgtcattcgatagatacgtcgcagtctgccgtcccctgcactacgtggtcattatgaattattggttctgcctcaggatggctgccttcagctggctgattggttttggtaacagtgtgctccaatcaagccttacactgaacatgccaaggtgcggtcaccaggaggtcgaccactttttttgcgaagtgcctgctcttttgaagctgtcatgtgctgacaccaaaccgatagaggcggaactgttttttttctctgtccttatcctgctcatacctgtaacattgatcttgatctcctacgggtttatcgctcaagcagtgcttaagatacggtcggctgagggcagacagaaggcattcggaacatgtggatctcacatgatcgtggtatctctgttctatggcaccgccatctacatgtatttacagcccccatcgagtaccagtaaggattggggcaagatggtgtcattattttatgggattatcactagcatgctaaactctctcatttatagcctgcgaaacaaggatatgaaggaggctttcaaaagactgatgccacgtatttttttctgcaagaaatag

SEQ ID NO: 52277 - DNA, 942 bp, Artificial Sequence
  Description of Artificial Sequence: Synthetic coding sequence
atgaattgggagaatgaatctagtccaaaagaatttatactgctgggattcagcgatcgggcatggcttcagatgcccctgttcgtagtgttacttatcagctatacaattactatattcggcaacgtttcaattatgatggtttgtatcctggaccctaagctgcatacccccatgtatttcttcctcaccaacctatcgattttggacctgtgctatacaacaaccaccgtgccacacatgctggtgaatataggctgcaacaagaaaaccatctcatacgccggttgtgtggcacacctgatcatttttttagccctcggagcaactgagtgtttgctcctagccgtaatgtctttcgacagatacgtggccgtttgtcggcctctgcactacgtggtaatcatgaactactggttctgtctgcgtatggccgctttttcatggctcattggtttcggaaactctgttctgcagagtagtttgactctcaatatgcctaggtgtgggcaccaggaagtggatcacttcttttgcgaagtgccagctttactgaaactttcctgcgcagatacgaagcctattgaagcggagctgttcttcttcagcgtcctgatccttctgatacctgtcactctgatcctcatttcatatggatttatcgctcaggccgtactgaaaatcaggtcagccgaaggacggcagaaagctttcggcacttgtggaagtcacatgatagtcgtgtcgctcttttatgggaccgcaatttatatgtacctgcagcctccaagctcgacctcaaaagactggggcaagatggtgagtctcttttatggcattattactagcatgctcaatagcctaatctactctttaagaaacaaggacatgaaagaagctttcaagcgactgatgcctaggatctttttctgtaaaaagtag

SEQ ID NO: 52278 - DNA, 942 bp, Artificial Sequence
  Description of Artificial Sequence: Synthetic coding sequence
atgaattgggaaaatgagagctccccgaaggagtttattctcttggggttctccgacagagcgtggctgcagatgccgctgtttgtcgttctactaatatcttatacaattaccatctttggtaacgttagcattatgatggtatgcatcttagatcccaaactgcacacaccaatgtacttcttcctcacgaatctgtccatcctggacctgtgttacacaacaactaccgtgccacacatgctcgtaaacatcggctgcaataaaaaaactatctcctatgccggatgtgtggcgcacctcataatctttctggcactgggcgctacagagtgtcttctcctggcagtgatgagtttcgatcggtacgtggccgtgtgccggcctctccactacgtcgttatcatgaattactggttttgcctgagaatggctgctttcagctggctcatcggcttcgggaactcggtattgcaatcctctctgactctgaatatgccccgttgcgggcatcaagaagttgatcatttcttctgtgaggtccctgctctgctcaaactatcttgtgccgataccaaaccaattgaggcggaattgttcttcttttccgtgcttattctgctgattcctgtgactctgatcctgattagctacggtttcattgctcaggccgtactgaagatacgttccgccgaaggcagacaaaaagcttttgggacttgcggatcacacatgatcgtggtgagtcttttctacgggaccgccatttacatgtacctccagccacccagttcaactagcaaggattgggggaagatggtttccctgttctacggaatcatcacctctatgctgaactccctgatctacagcctgcggaataaagacatgaaagaggctttcaagcgccttatgccacggatcttcttctgtaagaagtag

SEQ ID NO: 52279 - DNA, 942 bp, Artificial Sequence
  Description of Artificial Sequence: Synthetic coding sequence
atgaactgggagaacgaatccagcccaaaagaattcatcttgctggggttttcagatagggcttggcttcagatgcccctatttgtcgtgctgctaattagctacaccattaccatcttcggaaatgtgtccatcatgatggtgtgcatcctggatcctaagttacacacacctatgtatttcttcctgaccaacctgagcatcctggatctgtgctacacaactaccaccgtaccgcatatgctcgtgaacatcggatgtaataaaaagaccatcagttatgcagggtgtgtggcccacctcatcatcttcttagccctgggggctactgaatgcctcttactggccgttatgtccttcgatcgctacgtggccgtatgtcggccattgcattacgtggtcatcatgaactattggttctgtctacggatggccgcatttagctggttaattggtttcggcaattccgtgctgcagtctagcctgactcttaacatgcccagatgcggtcaccaggaggttgaccacttcttttgtgaagtgcccgctctgttgaagctgtcatgtgctgacactaagcctattgaagcagaactgttttttttctccgtgctgatccttttaatccctgtgaccctgattctcatcagttatggcttcatagcgcaggcagttctgaagatacgatctgcggagggacggcagaaagccttcgggacctgcggttctcacatgattgtggtctccctattttacggcactgctatctatatgtatctgcagcccccatcatcaaccagcaaggactggggcaagatggttagtctgttttacggcatcatcacaagcatgcttaactctctgatctatagtctgcggaacaaggatatgaaagaggcctttaagaggctgatgcccaggatcttcttctgtaagaaatag

SEQ ID NO: 52280 - DNA, 942 bp, Artificial Sequence
  Description of Artificial Sequence: Synthetic coding sequence
atgaactgggagaatgaatcttcccctaaggaatttatactcctggggttcagtgatcgagcttggttgcaaatgccactctttgtagtgctgctcatttcctacactatcacgatctttgggaacgtctcaattatgatggtttgcatactggacccgaagttacacaccccaatgtacttttttctgacgaatctctctatcctggacctttgctacacgacaactacagttccacatatgttggtgaacattggctgtaataaaaagacaattagctacgcaggatgcgtggcacacttgataatcttcctcgcccttggcgcaaccgagtgtctgctcctggctgtgatgtctttcgacagatacgtcgccgtgtgccgccctttacactacgtggtgattatgaactactggttctgcttacgcatggccgcattctcttggttgatcggcttcgggaactcagtcctgcagtcctcccttacgctgaacatgcctcgctgcggtcaccaggaggtggatcacttcttctgcgaggtgcctgctctgcttaaattgagctgtgctgacaccaagccgattgaggcagagctattttttttttcagtgctgatcctcctaatccccgtgactctgatcctgatcagctacggctttatcgcccaggctgtgctcaaaatcagaagcgctgaaggcaggcagaaggcgttcgggacctgcggcagtcacatgattgtcgtctcgttgttttacggcacagccatctatatgtacctgcagccgccttccagcacatctaaagactggggaaagatggtgagccttttctatggcatcattacttcaatgctcaactctctgatctattctctaaggaacaaagacatgaaagaggcgttcaagcgccttatgccccgtattttcttctgcaagaagtag

SEQ ID NO: 52281 - DNA, 942 bp, Artificial Sequence
  Description of Artificial Sequence: Synthetic coding sequence
atgaattgggagaatgagtcttctcccaaagaatttatccttctcggattcagtgaccgtgcttggctacaaatgcccctgtttgtggtgttgctgatatcctataccattacaatcttcggcaacgtgagcataatgatggtatgtatactggatccaaaactccacacgcccatgtacttctttctaacgaacctgagtattttggacctgtgttacacaacaactactgttccgcatatgctggtgaatatcggatgtaacaagaagactatcagttatgcgggttgcgtagcacacttaatcatctttctcgctctgggggctacggagtgtctccttctggccgtgatgtcttttgaccgttacgtggctgtgtgtagacccctccactatgtggtgatcatgaactactggttttgcctccggatggcagccttcagttggctgataggttttggcaattccgtgctccagtcctcactaaccttgaatatgcctcgctgcggacatcaagaggttgaccattttttctgtgaggtgccggcactgttaaaactgtcgtgcgcagataccaagcctattgaggccgaactattttttttcagtgtgctgatcctcctgatcccagtgactctaatactgattagctatggctttattgcccaggcagtgctgaaaatcaggtccgctgaggggaggcagaaggccttcggcacctgcggcagtcacatgattgtggtgagtctgttttacggcactgccatatacatgtatctccagcctccttcttcaacttcgaaggattggggtaagatggtctcactattttatgggatcataacgtcgatgctgaacagtcttatatacagcctgcggaataaggatatgaaagaggcattcaagcgcttgatgccacgtatttttttctgtaaaaagtag

SEQ ID NO: 52282 - DNA, 942 bp, Artificial Sequence
  Description of Artificial Sequence: Synthetic coding sequence
atgaactgggtgaatgattccatcatacaggagttcattctgctgggtttcagtgatagaccctggctggaatttccactgctggtggtgttccttatctcatacaccgtgactatcttcgggaatcttactattattctggtctcccgtctcgacactaaactccatacacccatgtacttcttcctgaccaatctttccctgttggacctctgttacaccacctgtacggtgccccaaatgctggtcaatctttgctctatccgcaaggttatcagctaccgcggttgcgtggcacagctgtttatatttctggctctgggcgctacagaatacctccttctcgcagtgatgtcctttgacaggtttgtggctatttgccgcccactgcattacagcgtgatcatgcatcagagactatgtctgcaattggcggctgccagttgggtgacaggcttctccaacagcgtttggcttagcaccctgacgctgcagctcccactctgtgatccttacgtgatcgatcatttcctgtgcgaggtgccagcgcttctgaagttgagttgcgtggaaacgactgcaaacgaggcagaattgtttctggtctccgaactgttccacctcatccctttgaccctcatcctgattagctacgcattcatcgttcgcgcagtgcttagaattcaatccgctgaaggcagacaaaaagcctttggtacctgcgggtcccatttgattgtggtgagtttgttttactctaccgcagttagtgtatatcttcagcctccatctccttcatcgaaggaccagggcaagatggtgagcttgttttacggcatcattgcgccaatgctgaatccccttatctacactctgagaaataaggaagtgaaggaaggtttcaaaagacttgtggctcgcgtgtttctcataaagaaatag

SEQ ID NO: 52283 - DNA, 939 bp, Artificial Sequence
  Description of Artificial Sequence: Synthetic coding sequence
atggacggcgtaaacgattcctccttgcaaggatttgttctgatgggaatctcagaccacccccagttggaaatgatcttttttatcgccatccttttctcttacctcttaaccctcttgggcaactctacaatcatattgctaagcaggctggaagccaggctgcacacacctatgtatttctttcttagtaatctgtctagcttggacctcgctttcgctacaagtagcgtaccccagatgctcataaatttatggggccctggcaaaacaattagttacggagggtgcattacccaactctacgtctttttgtggctcggcgctacagagtgtattctgctggtggtcatggcctttgacaggtacgtagcagtctgcagacccttacgatacaccgctatcatgaacccacagctgtgctggcttctggctgtgattgcatgccttggcggactgggcaacagcgtcatccagtcaactttcacgctgcagcttccactgtgcgggcacaggcgggtagaaggtttcctgtgtgaggtcccggcaatgatcaaactagcttgcggagatactagtcttaatcaggctgtgcttaatggggtttgcacctttttcaccgctgtgcccctatctatcattgtcattagctactgccttatagcacaggccgtgttgaaaattagaagcgctgaaggaagacgcaaggccttcaacacttgtttgtcccatctgttagtggtttttttgttctatggaagtgccagctacggatacctgctgcccgctaagaattcaaagcaagatcagggaaaatttattagccttttctattccctcgtcaccccaatggtgaacccactgatttacacactgagaaatatggaagtgaagggggcactgcgcaggctcctcggaaaggggagagaagttggctag

SEQ ID NO: 52284 - DNA, 963 bp, Artificial Sequence
  Description of Artificial Sequence: Synthetic coding sequence
atgatggagatcgcgaacgtgagctctcccgaggtgtttgtgctcctggggttttctacgcgccctagtctcgaaactgtgctgtttatcgtggttctatccttttacatggttagtatcctgggtaatggaatcattattcttgtttcccacactgacgtacacttgcatacccccatgtatttcttcctcgctaatttgccgttccttgacatgtcgttcaccacctccattgttccccaactgctagctaatctctgggggccacagaagaccattagctatggagggtgcgtggttcagttttatatatcccactggctgggggcaaccgagtgtgtcctcctagctaccatgagttacgataggtatgccgcaatttgccgacctctgcactacaccgtgattatgcatccacagctgtgtctggggctcgcacttgcctcatggttagggggtcttacaacctccatggtcgggtccacccttacgatgttactgccactgtgcgggaacaactgcatagaccatttcttctgcgagatgcctctaattatgcagctagcatgcgtagatacaagtttaaacgaaatggagatgtatctggctagttttgttttcgtcgtcctccccttgggcttaattctggtgagctacgggcatatcgcacgggctgtcctgaaaatccgatctgcagagggaaggcgcaaggcctttaacacctgctcatcacatgtcgctgtcgtgtccctgttttacgggagcattatctttatgtacctgcaaccagctaagagcacctcccatgaacaaggaaaatttattgccctgttttacaccgtagttacccccgcactaaaccctctgatttatactcttcggaacactgaggtaaagagcgcgctccggcacatggtcctcgagaactgctgtgggtctgccggaaaactcgcgcagatatag

SEQ ID NO: 52285 - DNA, 927 bp, Artificial Sequence
  Description of Artificial Sequence: Synthetic coding sequence
atgagacagatcaaccaaactcaagtaacagagttcctactcctcggactgagcgatgggccacacacagaacagctcctgtttatcgtcctgttaggtgtgtatttggtgaccgtactgggcaatctgttactgatctctctggttcatgttgactcccagctgcatacccccatgtatttttttctgtgtaacctgtccctcgccgatctgtgtttttctactaacatagtacctcaggcgctcgtccacctgctttcaagaaaaaaagttatcgcatttaccctctgtgccgctcgactgctgttttttttgatctttgggtgcacacagtgtgctttgctggccgtcatgagctatgatcgatacgtcgccatatgtaaccctttgagatacccgaatatcatgacctggaaggtgtgcgttcagttggccacgggcagttggacctccggaatactggtctccgtggttgatacaacgttcatactgaggctgccatatcgtggaagcaatagtatcgcccatttcttttgtgaggccccagctttgctgatactagcatcgaccgacacacacgcttccgaaatggccatttttctgatgggggtcgttattcttttgatcccagtattcctgattttggtgagttatggaaggatcatcgttacagtcgttaagatgaagagcaccgtcggctcactgaaagcattttctacgtgtgggagtcacttaatggtggtaatcctgttctatggatctgctataatcacctatatgacaccgaaatcaagcaagcagcaagagaaatcagtttctgtgttctacgccatcgtcacaccaatgctgaaccccctgatctactccctcagaaataaggatgtcaaggctgcgcttcgtaaagtagcaacccgtaactttccatag

SEQ ID NO: 52286 - DNA, 993 bp, Artificial Sequence
  Description of Artificial Sequence: Synthetic coding sequence
atgtgctcttttttcctgtgtcagaccggcaagcaggctaagatcagcatgggcgaagagaaccagaccttcgtgagtaagttcatcttcttgggcctcagccaagacctgcagacccagatattgctcttcattctgtttctcataatctacttgctcaccgtgctgggtaatcaactcatcattatcctaatattcctcgactcccgtctgcatacccctatgtattttttcctccggaaccttagcttcgctgacctgtgtttcagcaccagcattgtgccacaagtcctcgtgcacttcttagttaagcgtaagaccatcagcttctatggatgtatgactcagataattgtgttcttgctagttggatgtacggagtgcgccctattggctgtgatgtcatacgaccggtatgtggctgtgtgcaagcccctttattatagcacaattatgacccagcgcgtctgcctttggctgtcattccgcagctgggcgagcggggcacttgtcagcctcgtcgacaccagcttcacattccacttaccttattggggccagaatataatcaaccactatttttgcgagccacccgctctgctaaagctcgcaagtattgacacctactccactgaaatggccatttttagtatgggcgtagtgatcttattggcaccagtgagcctgatactgggctcttactggaatattatctccacggtaattcaaatgcaatccggcgagggcagactcaaagccttctctacttgcgggtcccatttaatcgtggttgtccttttttacggttctggcattttcacctacatgcgcccaaattccaaaaccaccaaggagttagataaaatgataagtgttttctatactgcggtgaccccgatgcttaacccgatcatttacagtctccggaacaaagacgttaaaggggctctccggaaactggttggtaggaagtgcttttcacaccgccagtag

SEQ ID NO: 52287 - DNA, 954 bp, Artificial Sequence
  Description of Artificial Sequence: Synthetic coding sequence
atggggaccgataaccagacctgggtctcagagtttatactgctgggccttagcagcgactgggatactcgcgtttctctgtttgtgcttttcttagtgatgtacgtcgtgactgtgctgggcaattgtctcatcgtcctcttaatacgattagacagtcgtcttcataccccgatgtatttcttcttgacaaatctgtccctggtggacgtcagttacgcgacaagtgttgtgcctcagctcctcgcacattttctggccgagcacaaagcaattccattccagagctgcgcagctcagctgttcttttccctggccctgggaggaatcgaattcgtgttgctcgccgtcatggcatacgacaggtacgtggcagtgtgcgatgctctgcggtatagcgctattatgcatggcggattgtgcgctagactggctatcacttcttgggtttcgggattcattagctcccccgtgcagacggctatcaccttccagctgccaatgtgcaggaacaaatttatcgatcatatctcgtgcgaattactggccgtggtgaggctcgcttgcgtcgataccagtagcaatgaggttaccataatggtgagcagtatcgtacttctcatgactcccttttgtcttgtgcttctctcctacatccaaataatcagtaccatcctcaagattcagagcagggaggggaggaagaaggcgttccatacctgcgcgagccacctgaccgtggtggctctctgttatggtgttgctatcttcacgtacatccagccccacagtagcccaagtgtgctgcaggaaaaactcttttctgtcttttatgctattttgacaccaatgttgaacccaatgatatatagtctccggaataaggaagtgaaaggagcttggcaaaaactgttgtggaagtttagcggtctaacttctaagctggccacatag

SEQ ID NO: 52288 - DNA, 954 bp, Artificial Sequence
  Description of Artificial Sequence: Synthetic coding sequence
atggagattgataaccagacctgggtgcgcgaattcatactactcggcttatcatccgattggtgtactcagatcagcctattttcattgttcctggtcacatacctcatgactgtgctaggaaactgtttaatcgtcctcctgattagactggactctagattgcatacccctatgtacttctttctgacaaacctgtcattggtcgatgtatcctacgcaacaagtgtcgtgccacagctgctggcccattttctggcagagcacaaagcaatcccattccagtcgtgtgcagcccaactgttcttttcgttagctctgggtggcattgaatttgtccttttggccgtcatggcctacgataggcatgtggcagtatctgatcggctgagatattctgctataatgcacggcggactttgcgcaagacttgctatcacaagctgggtgagcggttccattaattctctggtgcagactgccatcacatttcaactgccaatgtgcaccaataaatttatcgaccacataagctgcgagctgcttgctgtggtgcgcctggcgtgcgtcgatacatccagtaacgaggctgctattatggtcagcagcattgtgctgcttatgacacccttctgcctagtgctgctgagctacattaggattatctctacgatcctgaagattcagtcaagagagggcaggaagaaagctttccacacttgtgcaagtcatctgacggtcgtggctctgtgttatgggaccacaatcttcacgtatattcagcctcactctggtccaagcgtgctccaagagaaacttatctcagtcttctacgccattgtgatgcctcttctgaatccagtgatttattccttacgcaataaggaagtaaagggagcctggcacaaattgcttgaaaagttttccggactcactagcaaactaggcacctag

SEQ ID NO: 52289 - DNA, 954 bp, Artificial Sequence
  Description of Artificial Sequence: Synthetic coding sequence
atgggcatggtccgccacactaatgagtctaacttggcaggttttatcctcctggggttcagcgactatccccaactgcagaaggtcctgttcgtgctgatcctgatactatacctcttaacgatcctcggtaacaccactataatcctcgtgtcacgactggaacccaaacttcacatgccaatgtacttcttcctgtctcacctctctttcttatatagatgctttacaagttctgtgattcctcagttgcttgtgaacctttgggagcccatgaagacaattgcctacggcggatgcctggttcacctctacaattcccatgcgttgggatccaccgagtgcgtgctgccagcggtgatgtcctgcgatagatacgtggccgtgtgtcgaccattacattacactgtactcatgcatatacacctatgcatggctttagccagcatggcctggctttccggaatagccactacactggtgcagtctaccttaacgttacagctccctttctgcggccaccgacaagtggatcactttatctgtgaggtcccggtgctcattaaattggcctgcgtgggcactaccttcaacgaggcggaacttttcgtggcgagcattttgtttctcatagtgccagtttctttcattctggtgtcctcgggctacatcgcacatgcagtgttgcgtatcaaatcggccactagaaggcagaaggcctttggaacatgcttttcacacttgaccgtggtcacaattttttacgggaccataatattcatgtacctacagcctgccaagtcacggtcgcgagatcagggtaagtttgtgtcactgttttatactgtggtgacacggatgctgaaccccttgatttacacgctgagaattaaagaggtcaaaggggcactgaaaaaagttcttgctaaagccctgggcgtgaacatcctgtag

SEQ ID NO: 52290 - DNA, 930 bp, Artificial Sequence
  Description of Artificial Sequence: Synthetic coding sequence
atgggcctaggaaacgaaagctctctcatggacttcatactgctcggattcagtgaccacccacgtctggaggctgtgttatttgtattcgttctttttttctacctgctcactctcgttggaaactttacgattatcattatctcctatctggaccctcccctgcatactcctatgtacttctttctgtctaacctgtctctgctggacatatgtttcactaccagtctggctccccagacactcgtgaacctgcaacgccctaagaagacaattacttacgggggatgtgtggctcagctctatatctccctggctctgggctctacggaatgtattctgctggcagatatggccctcgaccgctatattgctgtatgtaagccactccattatgttgtgatcatgaatcctcggctctgccagcagctggcctcaatctcgtggctgtcaggcctcgcttctagtttaatccacgcgactttcactctccagctgccactgtgtggcaaccacagactggatcatttcatatgcgaggtccctgccctactgaagttggcttgcgttgacactaccgttaatgagctcgtgcttttcgtggtgtctgtactgtttgtggttatccctccagctctgattagcatttcatatgggttcattacacaagccgtgttacgaatcaaatcggttgaagccaggcacaaagccttctccacgtgctcatcccacctgacggtggttatcatcttttacggaactatcatatacgtctatctgcaaccaagtgattcctatgcacaagatcaggggaagtttatatctctgttctatacaatggtgactccgaccctgaacccaatcatttacaccctgcgcaataaggatatgaaggaagctcttcgtaaattactttcaggtaagttatag

SEQ ID NO: 52291 - DNA, 951 bp, Artificial Sequence
  Description of Artificial Sequence: Synthetic coding sequence
atggaagagacaaacaactcaagtgagaagggctttctcttactgggcttttctgaccaaccacagctcgagcggttcctgtttgccattattttatacttttacgtcttgtctttgctagggaataccgccctgattctcgtgtgttgtcttgatagcaggttacacacccccatgtactttttcctgtccaacttgtcttgcgtcgacatttgctttactacgtcggtggctcctcagttgctggtgactatgaacaagaaagacaagaccatgagctatgggggatgcgtggcccaattgtacgtggctatggggctcggttcctctgagtgtattctgctggcagtgatggcctatgaccggtacgctgctgtatgcagaccattgaggtacattgccatcatgcaccccagattctgtgctagcctcgcaggcggagcgtggctttctggactgataaccagtctgatccagtgttctctgacagttcagctgcccctctgtggccatagaacactggatcacatcttctgcgaagtccccgttctaatcaaactggcctgtgtcgatactacatttaacgaggccgaactctttgttgcaagcgttgtttttctaatagttcctgtgctgttaatactggtttcctacggtttcattacccaggcggtgctgcgcatcaaatcagctgcgggtagacaaaaagccttcggaacctgcagctcccacctcgtggtcgtcatcatcttctatggtaccatcatctttatgtatctccagcctgctaatcggaggtccaaaaatcaaggcaagtttgtttctctgttctacacgattgttactcccttattgaatcctatcatctatactctccggaataaagatgtgaagggagccctcagaaccctgattctggggagtgctgcgggtcagtctcacaaagactag

SEQ ID NO: 52292 - DNA, 951 bp, Artificial Sequence
  Description of Artificial Sequence: Synthetic coding sequence
atggttaatcaatcttctccaatgggatttctactgctggggttttctgaacatccagccctggagcgcaccctgtttgttgtggtcttcacctcctatttgctcacattggtgggtaataccctgataatcctgcttagcgtactctacccgagacttcactcccccatgtatttttttcttagcgatctttcatttctcgatctctgtttcaccacttcttgtgtgccacagatgcttgttaacctgtggggccctaaaaagacaatttccttccttgggtgtagcgtccagctcttcatcttcttgagcctgggtaccaccgagtgcatcctgttgacagtgatggccttcgacaggtatgtagctgtgtgtcaaccattgcactacgccaccattattcatccacggctctgttggcagctcgcctccgtagcctgggtgatgtccctggttcagagcattgtccagacaccctcgaccttacacctacctttctgcccccaccagcagatagacgacttcctctgcgaggtgccttccctgatccgtctatcctgcggagacactagttacaatgagatccagctcgccgtttcctcagtgatcttcgtcgtggtccctctctccttgatcctggcgtcttacggagctactgcacaggctgttctcagaatcaacagtgctacagcctggagaaaggctttcggaacttgtagcagccatctgactgtggtgaccctgttctacagctctgtaatcgccgtctatctccagccaaaaaatccatacgctcaggggcgaggtaagtttttcggcctcttttacgctgtaggcacaccttctttgaatcccctcgtttatacactcaggaacaaagaaataaaaagagccttaaggagacttcttggcaaggagagagacagccgggaatcttggcgagccgcatag

SEQ ID NO: 52293 - DNA, 951 bp, Artificial Sequence
  Description of Artificial Sequence: Synthetic coding sequence
atggtgaaccagtcctcaccgatgggtttcttattgcttggctttagcgagcatccagcactggaacggaccctgttcgtcgtcgttttcacctcctacctgctgacccttgtgggaaataccctgatcatcctcttaagtgtcctgtacccaagactgcatagccccatgtactttttccttagtgacttgagcttcctcgacctttgtttcaccacatcctgcgtcccccagatgcttgttaacctctggggacctaaaaagacaatttccttcttaggatgcagtgttcagctgtttatattccttagcctcggaacaacggaatgtatcctgctgactgtgatggcattcgaccgttacgttgccgtgtgccagccgctccattacgccacaattattcaccctcgtctttgctggcagctggccagcgtggcatgggttatgtcacttgtacagtcaatcgtgcaaaccccgtccacacttcacttgccattctgccctcaccagcaaatcgacgacttcctctgtgaggttccctctttaattcggctctcctgtggcgacacctcatacaacgaaatccagctagctgtctcctccgtgattttcgtagttgtgccactatcactaatactggcttcgtatggagccactgctcaagctgtcctgaggattaattcggcaactgcatggagaaaagctttcgggacttgtagctcccatctgaccgttgtgacactgttttacagcagcgtgattgctgtgtacctccagccaaaaaatccgtacgctcaggggagaggtaaattttttgggcttttctacgctgtgggcactccctcactgaacccgctggtttataccttaagaaacaaggagatcaaaagggcgttaagaaggttgctcgggaaggagagggattcgagggaatcctggagggctgcctag

SEQ ID NO: 52294 - DNA, 951 bp, Artificial Sequence
  Description of Artificial Sequence: Synthetic coding sequence
atggtcaaccagagttcccctatggggtttttgttgcttgggttttctgagcacccagctttagagcgaacactgtttgtggtggtgtttaccagctatctcttaacactggtgggcaataccctaatcatcctcctcagcgttctgtatcccagactccatagcccaatgtatttcttcctgtccgacctcagcttcctagacttgtgtttcactacaagttgcgtcccgcaaatgctcgtcaatttgtggggtccgaaaaaaacaattagttttctggggtgctccgtgcagttatttatcttcctgtctctggggactaccgagtgtatcctcctcacagtgatggccttcgatagatatgtagcggtgtgtcaaccactacactacgcgaccattatccaccctcgtctgtgctggcagctcgcctccgttgcctgggtcatgtcactggtgcaaagtatcgtgcagactccatcgaccttgcacctgccattctgccctcaccaacagatcgatgactttctctgcgaggtacctagtttgatacggctcagttgcggcgatactagttacaatgagattcagctggccgtctcatcggtgatctttgttgtggtaccactcagcctgatcctggcttcatacggcgctaccgcccaggcagtcctcagaatcaattctgcaacggcatggcggaaagcttttgggacttgttcttcgcacctgaccgtcgtgacacttttttatagtagcgttattgcagtgtatcttcagcccaaaaatccttacgcccaggggcgtggcaaattcttcgggctgttttacgcagtgggaaccccgtctctgaaccctttagtgtacaccctgaggaacaaagaaataaagagggccctgcgccgactcctgggcaaagagcgggattcgcgggagtcctggcgtgctgcttag

SEQ ID NO: 52295 - DNA, 951 bp, Artificial Sequence
  Description of Artificial Sequence: Synthetic coding sequence
atggtgaatcaaagtagtccgatgggattcctgcttctcgggttcagcgagcatccagcgctggagaggacgttgtttgtggtggttttcacttcctacctgctcacacttgtcggaaataccctcatcatcctgttgtccgtgctgtatccaagactccacagccctatgtactttttcctgtcagacttaagctttctcgacttgtgttttaccacatcctgcgtgccacagatgcttgtgaatttatgggggcctaagaagaccatttctttcctgggttgctctgtgcagctatttattttcctctcactggggaccactgagtgcattttactgacagtgatggctttcgatcggtacgtggcagtgtgtcaacccctgcactacgctaccattatacatcccaggctgtgctggcagctcgcatctgttgcttgggtgatgtcattagttcaaagtattgtgcagaccccctcgactctgcacctgcctttttgtccccaccagcagatcgatgactttctgtgtgaggtcccttcgctgatccgattgtcctgcggagatactagctacaatgagattcagctggcggtttcatcagtgatttttgtggtcgtgcccctgagcttaatccttgcttcttacggtgcaaccgcccaagccgtcctgcgtatcaactcagcgacggcctggcgcaaagccttcggcacttgttcgtctcacctcacggtcgtgacactcttctactcatccgtaatcgccgtatacctccagccgaaaaacccatatgcccagggacgaggaaaatttttcggtctcttctatgccgtgggcactccaagtctcaatccgctggtgtacacactgcggaacaaagagattaaacgcgctctgaggcgccttctcggcaaagaaagagatagccgggagtcctggcgggcagcgtag

SEQ ID NO: 52296 - DNA, 951 bp, Artificial Sequence
  Description of Artificial Sequence: Synthetic coding sequence
atggtcaatcagagctcaccaatgggattccttctgctaggattcagcgagcacccagcactcgaacgcaccctgttcgtggttgtctttacatcctacttattaaccttagtcggaaatacactgattatcctactgagtgtgctgtaccccagattacactccccaatgtacttttttttgtcagacctgtcattcctcgacttgtgtttcacaacatcctgtgtgccccaaatgctggtaaacttgtgggggccaaaaaagaccatcagctttcttggctgcagcgtccagttatttatcttcctctccctgggcaccaccgaatgcatcctgttgaccgtcatggcatttgaccggtatgtggcagtgtgccagcctcttcactacgcaactattatccacccgaggctttgctggcagctcgcctcagtggcatgggtcatgagtctggtacagtcaatcgtgcaaaccccctccacactacacctgcccttttgcccacatcagcagatagacgatttcttatgcgaagttccgagtctgatcaggctgagctgtggcgacacgtcttacaatgaaatccagctcgcagtgtccagcgtcatcttcgttgtggtgccgctgagcctgattctcgcgagctacggagcaactgctcaggccgtcctgagaattaattcagcaactgcatggcgcaaagcatttggcacatgctctagtcacttaaccgtcgttaccctgttctacagtagtgtgatagccgtgtatcttcagcctaagaacccctacgctcaggggagaggaaagttctttggactcttttacgccgtaggtactccatcattgaacccattggtatatacactgaggaataaagagattaaacgggcacttcgtcgcttgctaggcaaagagagggattctagggagagttggcgcgcagcttag

SEQ ID NO: 52297 - DNA, 951 bp, Artificial Sequence
  Description of Artificial Sequence: Synthetic coding sequence
atggtgaaccagagttctcccatgggattccttctgctcggtttctcggaacatccagcactggaacgcaccctgtttgtggtggtcttcacctcttatctgctcactttagttgggaacactctaattatcctcctctctgtgctttaccccagacttcactcaccaatgtacttctttctttcggacctctctttcctggatctgtgttttacaacatcttgcgtcccccagatgctggttaatttatggggcccaaagaagaccatctcattcctcggatgctcagtccagttgtttattttcttgtccttgggaacaactgagtgtatcctgttgacagttatggcctttgatcgctatgtggcggtgtgccagcccctccactatgccactatcatccacccaagactctgctggcaactggcctcagttgcctgggttatgtcactcgtccaaagtatagtccagaccccatcaaccctacacctgccgttctgcccacaccaacagatcgatgactttctgtgcgaggtgccttctttaatccgactttcctgtggcgatacaagctacaatgagatacagctcgctgtgagctccgtgattttcgtagttgtccctctgtctttgatcctggcttcatatggagccactgcacaggccgtcctccgaattaactccgccacagcctggaggaaggcctttggcacctgctctagccaccttaccgtagtaacattgttctatagctctgtaattgctgtgtacctgcagcccaaaaacccatacgcccagggcagagggaaatttttcggactattctacgccgtgggaactccttctctaaatcccctggtctataccctgaggaacaaagagataaaaagagcactcaggaggctgctgggtaaggaaagagacagtagggaaagttggcgcgcagcctag

SEQ ID NO: 52298 - DNA, 951 bp, Artificial Sequence
  Description of Artificial Sequence: Synthetic coding sequence
atggttaaccagtcctctccaatgggattcctgcttctgggattcagtgagcatccagctctggagcgaacgctgttcgtcgtagtcttcacctcttaccttctcacgctcgtaggaaatacactgataatcctcctgtctgtgctgtaccccaggcttcatagtcctatgtatttttttctttccgacctgtccttccttgacttgtgtttcacaacaagctgcgttcctcaaatgcttgtgaatctgtgggggccaaaaaagacaattagcttcctgggctgttccgtgcagctctttatttttctgagcttgggcacaaccgagtgcattctgcttacagtgatggcctttgatcgatatgtggctgtgtgccagccactgcactacgccaccataattcacccgagactctgctggcagcttgcttccgtggcttgggttatgtcactcgtacagtctatcgtgcagacaccatctacactccaccttccgttctgccctcaccagcagatagacgacttcctatgcgaagtcccatcgttgattcgcttgtcttgcggagatacctcttataacgagatccagcttgccgtctccagcgtgatatttgtcgtggtcccgcttagtcttattctggcttcctatggagctacagctcaggctgtcttgcggatcaacagtgctaccgcctggcggaaagcatttgggacctgcagctcccacctcaccgtagtcactctgttctattcatccgtgatagccgtgtacttgcagcctaaaaacccatacgctcagggaagaggaaaattttttgggctattctatgctgtgggtaccccatccttgaatccccttgtgtatacactgcggaataaggagatcaagcgcgcactgagaagactgctaggaaaagaacgagattcgagggagagctggcgggctgcctag

SEQ ID NO: 52299 - DNA, 951 bp, Artificial Sequence
  Description of Artificial Sequence: Synthetic coding sequence
atggtaaatcagagttcaccaatggggttcttacttctaggatttagtgagcatcccgcattggagagaacgctgtttgttgttgtttttaccagctaccttctaacactcgttggaaatacacttatcatcttactcagcgtgctgtacccgagactccactcacctatgtatttttttctgagcgatctgagcttcctggacctgtgtttcacaacctcatgtgtcccccagatgctggtcaacctgtgggggcctaagaaaacaatcagcttcctgggatgttccgtgcagctcttcatcttcttgtccctgggaacaacagagtgcattcttttgacggtgatggcatttgacaggtacgttgccgtttgccaaccactacactatgccactatcattcacccacgcttatgctggcagcttgcatccgttgcttgggtaatgagtttagtgcaatcgatagtgcagacaccatcaacacttcatttgccattttgtccgcaccagcagatagatgattttttatgtgaagtgccaagtctgatcaggctcagctgcggagatacgtcctacaacgaaatccagctagcagtgtcgagcgtaatattcgtggtggtgcccctgtccctgattttggcaagctacggcgctaccgcccaggctgtgttgcgcataaactccgccactgcctggcgcaaggcttttggaacttgttccagccacctgactgtcgtgaccctcttttactccagcgtgattgccgtctacttgcaaccgaaaaacccttacgctcagggtcgcggaaagttctttggactattctacgctgtcggtacaccttctctgaacccactggtgtacacactaaggaacaaggaaatcaagcgagctcttaggcgtctgttaggcaaagagcgcgattcaagagagagctggagggctgcatag

SEQ ID NO: 52300 - DNA, 951 bp, Artificial Sequence
  Description of Artificial Sequence: Synthetic coding sequence
atggtgaatcagtcctctcctatgggattcttactgctggggttctcggaacacccggctctggagagaacactgttcgtggtcgtcttcacaagctacctgttgaccttggttggcaacactctcattatcctgctgtcagttctgtaccccagacttcacagccccatgtacttcttcctctctgacttaagctttctggacttgtgttttaccacttcatgcgttcctcagatgctggtcaatctctggggacccaaaaaaaccatatcatttctgggctgcagcgtccagttgttcatctttctgtccttaggaaccacagagtgtatcctgctaactgtgatggcattcgaccgctacgttgcagtgtgccagccactgcactatgcaaccattatccatcctcgcctctgttggcaactagcaagtgttgcctgggttatgtccctggtgcaatcgatcgtgcagacgccttctaccctgcatctgcctttctgtccccatcaacagattgacgactttctgtgcgaggtgccctctctcattcgccttagttgtggcgatacttcctataatgagatacagctagctgtctcatcagtgatttttgtggtagtcccattgtctctcattctggcttcatacggagctacagcccaggctgtactccggatcaactcagctacagcgtggcgaaaagccttcgggacttgcagctcccacttgactgtggtgacgttattctactccagtgtgatcgctgtgtacctccagcccaaaaatccctacgcacagggacgcggaaaatttttcggtctgttctacgcagttggaacaccctccctgaatccccttgtctataccctgagaaacaaagaaattaaaagggccctacggagactgctagggaaggagcgcgacagtcgcgaaagctggagagctgcctag

SEQ ID NO: 52301 - DNA, 951 bp, Artificial Sequence
  Description of Artificial Sequence: Synthetic coding sequence
atggtgaatcagagctctcccatgggatttctgctattaggttttagcgaacatcctgcgctggaaaggacactgtttgtggtagtttttacttcatacctgctgacgctggtcggcaatacactcatcattctgctctctgttctctaccccagactacattcccccatgtacttttttctgtccgatctgagcttcctggacctgtgctttaccacgagctgtgtgccacagatgctggttaacctttgggggccaaaaaagaccatctcctttctaggatgcagcgtacagctgttcatctttctgagtctcggaacaactgagtgtatcctactgacagtcatggcctttgaccgctacgtcgccgtctgtcagcctttgcattacgccacaattatccaccctcgtctgtgttggcagctcgcttctgtggcctgggtaatgtcgctcgtgcagtccatcgtgcaaaccccttctacgctgcaccttcccttctgtccgcatcagcagatagacgatttcttatgtgaggtgccctcgctgatcagactttcttgcggcgacacttcctataatgaaatccagctcgctgtgtcctccgttatctttgtggttgtgccactgagcctcatactggcctcctatggcgctaccgcacaggcagtgctccgtattaactccgctaccgcctggagaaaagcctttggcacttgtagtagccacctgacggtggttacactgttttacagctctgtgattgcggtgtacctgcaaccaaaaaatccatatgcacaggggcgtggcaagtttttcggtcttttctacgcggtggggactccttctctgaatcccctggtgtataccctcagaaataaggagatcaaaagagcattgcgccgtctgctgggcaaggaacgcgatagtcgagagagttggcgggctgcttag

SEQ ID NO: 52302 - DNA, 951 bp, Artificial Sequence
  Description of Artificial Sequence: Synthetic coding sequence
atggtaaatcagagttcacctatgggcttcctcctgctcggcttcagcgaacatcccgctctggaaaggactctttttgtggttgtttttacaagctacctgcttacactcgttggcaacaccctaatcatcttattatctgtgctgtatcctcggctgcatagccccatgtacttctttctgtctgatctctcttttctagacctttgcttcaccacaagctgcgttcctcagatgctagtgaacctgtggggtcccaagaagaccatcagtttcctgggttgctctgtgcagctgttcatattcttgagtctgggtacgaccgaatgcatcttgttgactgtgatggccttcgatcgctacgtagccgtgtgtcagccacttcattatgctaccataattcatccacgactgtgctggcagctggcatcagtcgcttgggtaatgtccctagtgcagtctatcgtccagactccgtctaccctgcatctgccgttttgcccccaccagcagatcgatgacttcctctgcgaggtcccctccctcattcgcctcagctgcggggacaccagctataacgagattcaactagcggtctccagcgtcatcttcgttgtagtcccactatcgctgatccttgcaagctacggcgctaccgctcaggccgtgctgagaatcaactctgctaccgcctggcgaaaagctttcggaacttgctctagccatctcacggtggtgaccctgttctattcctctgtgattgcggtctatctgcagcctaaaaatccatacgcacagggaagaggtaagtttttcggcttgttctacgccgtggggactccttcattgaatcctcttgtctatacgttaagaaataaagaaattaagcgggctttacggaggctcctaggtaaggaacgggactcgcgggagtcatggcgcgctgcatag

SEQ ID NO: 52303 - DNA, 951 bp, Artificial Sequence
  Description of Artificial Sequence: Synthetic coding sequence
atggtcaatcaatcctctcccatgggattcctgctgctgggcttcagcgaacatcctgcattagagaggacactttttgtggtggtgttcacaagctatcttcttacactcgtggggaacacattgattattctgctgtctgtcctttacccacggctccacagccccatgtactttttcttgagcgacctgtcttttctggacctgtgcttcacaactagttgtgtgcctcagatgctggtgaacctctgggggcctaaaaagacaatatcctttctcgggtgcagcgttcaactgttcatttttctgagcctgggaactaccgagtgcatcctgctgaccgttatggcattcgataggtacgtagccgtgtgtcaacccctgcactacgccaccatcattcaccctcggctctgctggcaactagcctcagtcgcgtgggttatgtcactcgtgcagagcatcgtgcaaaccccttctactcttcatttacccttctgccctcatcagcagatcgacgacttcctatgcgaggtgccttcactgattaggcttagttgtggtgatacatcctacaatgagatccagctggctgtgagctcggtcatctttgttgtcgtgcccctcagtctgatattggctagctacggcgctacagctcaggccgtgctcagaatcaatagcgcaaccgcctggcgcaaggctttcggcacctgctcgtcccatctgacggtagttaccttgttttacagtagtgtgattgccgtctacctgcagcccaagaatccctacgctcagggacgcggaaagttcttcggacttttttacgccgtgggaactccttcactaaacccgctggtctacactctccgcaacaaggagataaaacgcgctctcaggcggttactcggtaaggagcgagattctagggaatcctggcgggctgcttag

SEQ ID NO: 52304 - DNA, 951 bp, Artificial Sequence
  Description of Artificial Sequence: Synthetic coding sequence
atggtgaatcaatcttcccccatggggttcctcctcctagggttcagtgaacatcccgcactggaaaggacgctgttcgtggttgtgtttacctcctaccttctgacgctggtcggcaatacccttatcatccttttgagtgtcctgtacccccgactgcatagtcctatgtacttttttctgtctgatttgtctttccttgatctctgcttcacaacctcatgcgtccctcagatgctcgtgaatctgtgggggccaaagaagacaatttcatttctcgggtgttccgtgcaactgtttatttttctgtccttgggcaccacagagtgtattctgttaaccgtgatggcatttgaccgatacgtcgctgtgtgtcaacctctgcactatgcaacaataattcacccccgactctgttggcagctggcctcggtcgcctgggtgatgtcgttagtccagagtatcgtgcagacaccaagtaccctgcatttgcccttctgcccccaccagcagattgatgacttcttatgtgaggtgccatcgctaatccggctgagttgtggggatacttcctacaacgaaatccaattagcggtgtcatctgtaatcttcgtggttgtgcctctttccctcatcctggcgtcttatggtgccacagctcaagcagtcctccggatcaattctgccaccgcctggcggaaagcgtttggcacctgttcctctcacttgacagttgtaactcttttttactccagcgtcatagctgtatacctccaaccgaagaacccctacgctcagggcaggggcaaattctttggattgttctacgccgtgggaacaccatcactaaatcctcttgtttacaccctgaggaacaaagagattaagagggctctgcggaggttactggggaaggaacgcgactctcgcgagtcctggcgcgctgcttag

SEQ ID NO: 52305 - DNA, 951 bp, Artificial Sequence
  Description of Artificial Sequence: Synthetic coding sequence
atggtgaatcaatctagtccaatgggatttctactcctgggattctccgagcacccagccctggagcggaccctcttcgttgtggtatttaccagttacctgctgacgctggtgggtaacactctgatcatcctgctgtctgtcctctaccctagacttcacagcccgatgtactttttcttgtccgacctgtcttttctggatctatgctttacaacaagctgcgttcctcagatgttagtgaacctgtgggggcctaagaaaactatcagctttctggggtgttcagtgcagctgtttatttttctgtctctcggaaccaccgagtgcatccttcttacggttatggccttcgatcggtacgttgccgtatgtcagcccctgcattatgccacaatcattcatcctaggttgtgttggcagctggcgtctgttgcctgggtaatgtccctggttcagtccatcgtccagacaccaagcactctccacttaccgttttgcccccatcaacaaatagatgatttcctgtgcgaagtgcccagcttgattagactgtcttgcggagatacttcctataacgaaatccagctagcagtgagtagtgttatttttgtggtggtccctctgagcttaatcctggcctcttacggggctacggcccaggctgtcctgcgtattaacagcgcaactgcctggcgaaaggcattcggtacatgcagcagccacttgacagtggtcactctattctactctagcgttatcgcggtttacttgcagccaaagaatccctatgcgcaaggaaggggtaaattcttcggactgttttacgcggtaggaaccccttctctgaatccacttgtttacacactgcgaaacaaagagattaaacgggctctcagacgtctgttgggaaaagagcgtgactctcgtgagtcttggcgggctgcctag

SEQ ID NO: 52306 - DNA, 951 bp, Artificial Sequence
  Description of Artificial Sequence: Synthetic coding sequence
atggtcaaccagtctagcccgatgggattcctacttttaggcttttcggagcacccagctttagaacgcacgctctttgtggtggtttttacttcttacttgctcaccctcgtgggaaatacattgataatactcctgtcggtcctttaccctagactgcattccccgatgtacttctttctgagcgatctgtctttccttgacctgtgcttcaccacaagttgtgtgcctcagatgttggttaatttgtgggggccaaaaaagaccatatctttccttggatgtagcgtacagcttttcatctttctttctctggggacgaccgaatgcatactgttgacagttatggcatttgatagatacgtggccgtctgccagcctctacactatgcaaccattatccacccaaggctctgttggcagttggctagcgtggcatgggttatgtccttggtccagtctattgtgcagactcccagcacactccacctacccttttgccctcatcagcagatagacgactttctgtgtgaggtaccttcacttatccgactcagttgcggggatacaagttataatgaaattcagctggcagtttctagtgttatttttgtcgtggtgccacttagtttgatcttggcgagttatggcgctacagctcaggcagtacttcgcattaatagtgccacagcgtggcgtaaggcatttggcacctgctcttctcacctgacagttgtcactcttttctactcctccgttatcgccgtctatctccaaccaaagaacccttacgctcaggggaggggcaagttctttggccttttctacgccgtcggtacgcctagcctcaacccactggtgtatactctgcgcaataaagagatcaagcgcgcactaaggaggctcttgggcaaagaacgggactctagagaaagctggcgcgctgcctag

SEQ ID NO: 52307 - DNA, 951 bp, Artificial Sequence
  Description of Artificial Sequence: Synthetic coding sequence
atggttaatcagtcctcccccatgggtttcctgttgttgggattcagtgagcatcctgcgctcgaacgcactctgttcgtggtggtgttcacatcataccttttaacgctcgtgggaaataccctcattattctgctatccgtgctatatcctagactacattcaccaatgtatttcttcctaagcgatctgtcttttctggacctttgttttaccacatcatgtgtaccgcagatgctggtgaatctttggggacccaaaaagacaattagtttcctagggtgttctgttcagctctttattttcctgagcctggggacgaccgagtgtatcttgctaacagtgatggcttttgaccgttatgtggccgtttgtcagcctctccattatgctaccatcattcaccccagattgtgctggcagctagcaagcgtggcctgggtcatgtccctggttcagagcatcgtacagactccatcaaccctgcacttgccattttgcccacatcagcaaatcgatgacttcctgtgtgaagtcccgtctttaattcggttatcttgcggcgatacgagctataacgaaattcagttagcagtcagttccgtcattttcgtggtcgtaccgctttcgcttatcctcgcctcatacggcgcaacagcccaagccgtgctgagaatcaactctgctaccgcttggcgcaaggcctttggaacttgctcaagccatctgacagttgtgacactgttctactcctctgtgattgcagtgtacttgcagcctaagaatccctatgcccagggcaggggcaagttctttgggctgttctacgcagtggggaccccatctttgaaccctctggtgtacaccctccgtaacaaagaaatcaagcgagctctgcgccgattactgggcaaggaaagggattctcgcgagtcatggcgagctgcttag

SEQ ID NO: 52308 - DNA, 951 bp, Artificial Sequence
  Description of Artificial Sequence: Synthetic coding sequence
atggtgaatcagtcatctcctatggggtttctgctgctggggttctctgagcaccctgccctggaaagaaccctcttcgtggtggtgtttacaagttacctgctaaccttggtcggcaataccttgataattttactgagcgtactctatcctcggctgcatagccccatgtacttcttcctgtccgatttaagctttcttgatctgtgcttcactacttcctgtgtgccccagatgttggtcaatctgtggggaccaaagaagacaatctcctttttgggatgtagcgtgcagctcttcatctttttgagcctgggcactacggagtgtatactcttgacggtaatggccttcgatagatacgtcgctgtgtgccagcccctccactacgctaccatcattcatcccagactgtgttggcagctggctagcgtagcctgggtgatgtctctggtccaatccatagtgcaaactccttctaccctgcaccttccattctgtccccaccagcagattgatgattttctgtgtgaagttccttctcttatcagactgagctgtggagacaccagttataatgagatccagctcgccgtctcctccgtcatctttgtggtggtcccactcagcctgattctggcgagctacggggctactgctcaggcagtcttgagaataaatagcgccacagcttggagaaaggctttcggcacctgcagtagtcaccttacagtggtgacactattttattcttcagttattgcagtgtatctccagcctaaaaacccttatgcacaaggccgaggtaaattcttcgggctcttttacgcagttggcaccccctcgctgaaccctttggtttataccctgcggaataaggagatcaagagggctctgcgtaggctgctcggaaaggaacgcgattcgcgtgagagctggagggccgcttag

SEQ ID NO: 52309 - DNA, 951 bp, Artificial Sequence
  Description of Artificial Sequence: Synthetic coding sequence
atggttaaccagtcgtcacccatggggttccttttgcttggcttttctgagcatcccgctctggagaggacactgttcgtcgtcgtatttacttcatacttgctcactttggtcggaaacacgttgattatccttctctccgtcctttatccacggctccattctcccatgtattttttcctctccgatctgagctttctggatctctgtttcaccacaagttgcgtcccgcagatgttggtaaatctctggggaccaaagaagaccatcagtttcctgggatgttctgttcaactgtttatcttcctgtcacttggaaccaccgagtgcatcctgctaaccgtgatggcctttgaccgctacgtcgccgtgtgccagcccctgcattacgccactatcattcatccccgtctctgctggcagctggcttcagtcgcttgggtgatgtccctggtacagagtatcgtgcagaccccctctacgcttcatctcccgttctgcccccaccagcagatcgacgacttcctctgcgaagtgccatccctgattagactgagctgcggagataccagttacaatgagattcagctcgctgtctcaagcgttatatttgtggttgtaccattgagcctgatcttggcctcctatggcgcaacagctcaggccgttctgcggatcaattctgcaactgcttggaggaaagcgtttggcacttgttctagccacctgactgtcgtcacgctgttctattcgagcgttatcgctgtttatcttcagccaaaaaacccttacgcacaaggccgtggaaagtttttcgggctcttctatgcggtcggaacacccagcctgaatcctctggtctatacgctccggaataaggaaataaaacgcgctttgaggcgactgctcggcaaagaacgtgattctcgggagtcttggcgcgctgcatag

SEQ ID NO: 52310 - DNA, 951 bp, Artificial Sequence
  Description of Artificial Sequence: Synthetic coding sequence
atggtcaaccagtccagccccatggggttcctactgttgggtttctccgaacatccggctctcgaacgtactctgttcgtggttgtctttactagttacctactcacattagtgggtaacacgctcatcatcctactctccgtgctttatcctaggctgcatagtcctatgtacttctttctgtcagacttaagcttcctggatctgtgtttcacaacctcatgtgtgcctcaaatgctcgtaaacctgtggggtcctaaaaagactattagcttcctggggtgcagcgtgcaacttttcatttttctctccttgggaacgaccgagtgcatcctcctgactgtcatggcgttcgatcggtacgtcgcggtttgccagccgctgcactacgccacaattatccatccacggttatgctggcaattggctagcgtagcttgggtgatgtccctggtacagagtatcgttcaaacgccatccacactgcacctccctttttgccctcaccagcagatagatgacttcttgtgcgaggtgccaagcctcattagactctcctgcggcgataccagctataacgagattcagttagcagtatctagcgtcatcttcgtcgtcgtccccctttcattgatcctcgcatcttacggagcaaccgctcaggccgtcctgcggatcaacagcgcaacggcctggcgaaaggcatttgggacctgtagttcccatttaactgttgtcaccttgttctattctagcgtgatcgcagtgtatctccagcctaagaacccatatgcacagggacgcggaaagttctttggcctgttttatgctgtgggcaccccctccctgaaccctttagtgtacaccctccgcaataaggagattaagcgtgctctgcgcaggttactggggaaagaaagagattctcgagaatcatggagggccgcatag

SEQ ID NO: 52311 - DNA, 951 bp, Artificial Sequence
  Description of Artificial Sequence: Synthetic coding sequence
atggtgaaccaatcatccccgatgggctttctactactggggtttagtgaacatcctgccttggaacgcactctctttgtggtggttttcacctcctacctcttaacccttgtgggaaatactttgatcatcctgttgtctgtgctctatccacggctccattctcctatgtacttctttctaagcgacctgtctttcctggacttatgcttcactacaagctgcgtcccccaaatgctggttaacctgtggggaccaaagaagactatcagcttcctcggttgttccgtgcaactcttcatcttccttagtctgggcactacagagtgtattctcctaacagtgatggcctttgaccggtacgtagccgtgtgtcagccactacactatgcaaccataattcaccctagactttgttggcagctggcctccgtggcctgggtaatgagcttggtccagagtatagttcagactccatccactttgcacctgccattctgcccccatcagcaaatagatgacttcctgtgcgaggttccttcacttattcggctttcatgcggagatacctcctacaacgagatacagcttgccgtgtctagcgtaatttttgttgttgttcctctatcacttatcttggctagctatggggcaaccgcgcaagcagtgctgcggatcaattcagcaaccgcttggagaaaggccttcggcacatgcagcagtcacttgaccgtggtcactctattttactcttcagttattgcagtgtaccttcagcccaagaacccctatgctcagggacgaggcaaattttttggattattttacgctgttggcaccccctctctgaaccctctcgtgtacacactgaggaacaaagagattaagcgagcactaaggaggctcctgggcaaagagagagactctcgtgaatcctggcgtgccgcttag

SEQ ID NO: 52312 - DNA, 951 bp, Artificial Sequence
  Description of Artificial Sequence: Synthetic coding sequence
atggtgaatcagtcctcccctatgggattcctactgcttggtttctctgagcaccccgcactggagcggactctgttcgtggtggtttttacctcatatctactaaccttggtgggtaacacactaattatcctgttgagcgtactctaccccagattgcatagtcctatgtattttttcctgagcgacttgagtttcctggacctctgctttacaacctcttgtgtcccacagatgctagttaatttatggggacccaagaagactattagctttctcggatgcagtgtccagctcttcatctttctgtccctcgggactactgagtgtattctcctcactgtgatggccttcgaccgatatgtggcagtttgtcagcccctccattatgccacgatcattcacccgcgattatgttggcaacttgcatccgtcgcctgggtgatgtctttagtgcagtccatcgtacaaacacccagcacccttcatttgccattttgtccacatcagcaaattgatgattttctgtgcgaggtcccttctctgattcgcctgagttgtggcgatacctcctataacgagattcagctggctgtgagcagcgtgatttttgtcgtcgtcccacttagcctgatactggccagctacggagccactgcccaggctgtgctccgcatcaatagcgctaccgcctggcgcaaagcctttgggacatgctcaagccacctcactgttgtcaccctcttttactcgagcgtcattgccgtgtacctacagcccaagaacccttacgctcagggacgcggtaaattttttggtttattctatgccgtggggaccccgtctctcaatcctctcgtgtacaccctgagaaacaaagaaattaaacgcgcactgcgtaggttgctgggcaaagagcgcgactcccgcgaatcctggagggctgcctag

SEQ ID NO: 52313 - DNA, 951 bp, Artificial Sequence
  Description of Artificial Sequence: Synthetic coding sequence
atggtcaaccagagtagccccatgggctttctgcttctcggtttctcagaacatcccgcattggagcggacactctttgttgttgtcttcaccagttacctgttaactctggtggggaataccctgattatcttattatcggtcctctacccacgccttcatagccccatgtacttctttttgtcagacctgagttttctggatctgtgttttactaccagctgtgttccccaaatgctggtcaacctttgggggcctaagaagacaatatcgttcctcgggtgttctgtccagctgtttattttcctgtctctggggacaaccgagtgcatcctgctgacagtgatggcgttcgatcggtacgtggctgtgtgtcagccactgcactacgccacaattatacatccgcgtctttgttggcagctggcctctgtagcctgggtaatgagtctggttcagagtatcgtccagacccccagcacgctacatctgcctttctgcccacaccaacaaattgatgacttcctttgcgaggtgccctcgcttatacgcctgagctgcggggatacctcttacaatgagatccagttagccgtttcgagcgtaatttttgtagtcgtcccactttcgctcatcttggctagctacggggcaacggcccaggccgtgctgaggattaatagtgctacagcctggcgcaaagcatttgggacttgttcctcccacctcactgtggtcacccttttctattcatctgtgatcgcggtctacctgcagcctaaaaacccctacgcgcaggggcgagggaaatttttcggcctgttttacgcggtcgggaccccatctctgaaccctctcgtgtacacgctccgcaataaggagattaagagagcgcttagacggcttctgggcaaagaaagagatagcagagaaagttggcgagcagcctag

SEQ ID NO: 52314 - DNA, 951 bp, Artificial Sequence
  Description of Artificial Sequence: Synthetic coding sequence
atggtgaaccagagctcaccaatgggcttcttactgctgggcttttccgagcatcccgcacttgaacgaacgttgttcgtggtagtgtttacctcttacttgttaactctggttggaaacacactgataatcttgctcagcgtcctgtaccccaggctgcacagccctatgtacttttttctatcagatctctccttcttggatctgtgttttactaccagttgtgtgccgcagatgctagtgaatctttggggtccaaagaaaactatctcgtttctgggctgcagtgtccaactatttatcttcttgagcctcggaacaacagagtgtatactcctgacagtgatggccttcgatcgctacgtggcggtgtgccaaccactccactatgcgacaatcatccacccacgcttgtgttggcaacttgcatctgtggcctgggtaatgagtctggtccagtccatagtacagacaccctctacactacacttgcccttctgtccccatcagcagatcgacgacttcttgtgcgaggtcccctctctcatccgcctctcctgtggagacacctcctacaacgagatccaactggctgtgagtagtgtcattttcgtagtggtccccctgtccctgatcttggcctcatatggtgctactgcccaggcagtactccgtattaactcagcaaccgcctggagaaaggcattcggaacttgttcgtcccatctcacggttgttacgctgttttattccagcgtcattgccgtttaccttcaaccaaagaacccttacgctcaaggacggggtaagttttttggcttgttttatgctgtcggcactccctccctgaaccccttagtgtatacacttcgcaacaaagaaatcaagcgagctctgaggcggttgctaggaaaggaaagagattccagagaatcttggagagcagcctag

SEQ ID NO: 52315 - DNA, 951 bp, Artificial Sequence
  Description of Artificial Sequence: Synthetic coding sequence
atggttaatcaatcgagtcctatgggattcttgcttctcggattttccgagcaccccgctctggagcgcaccttgttcgtggtggtttttacgagttatctgctgactcttgtgggcaacacgctgatcatcctattgagtgttctgtacccacgcctgcatagtcctatgtatttctttcttagcgacctgagttttctggatttgtgcttcacaacgtcttgcgttcctcagatgctggttaacctctgggggccaaagaagactatttccttcctcggctgtagcgttcagctgttcatctttttgagcctgggcaccaccgaatgtatcctgcttaccgttatggcgtttgatcgctatgtggccgtatgccaacccctccattacgcaactataattcacccaagactgtgttggcaacttgcgagtgtggcctgggtgatgagccttgtccagagtatagtccaaaccccttcaacgctccaccttccattttgtccccatcaacaaattgatgacttcctctgtgaggtaccctcccttatccggctcagctgcggagatactagctataatgagattcagctggcggtgagtagtgtgatattcgtcgtggtgccactgagcctgatattggcgtcatacggagctacagcacaagcagtattacgtattaatagcgcaaccgcctggcgtaaagcttttgggacctgttcctcccacctcactgtcgtgactcttttctacagtagcgtcatagcagtatacttgcagcctaagaacccctacgcccagggtagaggaaagttctttggcctgttctatgcagtgggaactccaagcttgaacccactggtgtacactttaaggaacaaggagatcaagcgtgcattgcggcgactgctgggtaaagaacgcgactcccgagaatcctggagagctgcttag

SEQ ID NO: 52316 - DNA, 951 bp, Artificial Sequence
  Description of Artificial Sequence: Synthetic coding sequence
atggtgaaccagtcctctcctatgggattcttactactgggatttagcgagcaccctgccctcgaacgaactttgttcgtggtggtgtttacctcctaccttctcacgctcgttggcaacacgttaattatccttctgtcagtactgtatccgaggctgcacagccctatgtacttttttttgtccgatctgtctttcttggacctgtgctttaccacttcctgcgtgccacaaatgctagtcaacctgtggggcccaaagaaaacaatttcttttttgggctgcagtgtccagctattcattttcctctctctcggcaccactgaatgcatactgctaaccgtgatggcattcgacaggtacgtcgccgtttgtcagcctcttcattacgcgactatcattcatccacggttatgttggcagttagctagcgtggcttgggtgatgtccctggtgcagtccatagtccagactcctagcacccttcacttgcctttctgtccacatcagcaaattgacgacttcctgtgcgaggtgccctcactgatacgtttaagttgtggcgacacatcttataatgagattcagctggcagtttcaagtgttatcttcgtagtggtcccattgtcgctcattttggcctcctacggagcaactgcccaggcggtcttgaggattaattctgcaactgcgtggaggaaggcttttggaacatgttcatcacacttgactgtcgtaacactgttttacagctctgtgatagccgtgtacctgcagcctaaaaacccctatgcacagggcagaggcaagttttttggtttgttttatgcagttggtacaccctcactgaaccctctggtctacactctgcggaacaaagaaatcaaacgcgcacttagaaggttactcggcaaagagagggacagcagagagtcatggagggctgcctag

SEQ ID NO: 52317 - DNA, 951 bp, Artificial Sequence
  Description of Artificial Sequence: Synthetic coding sequence
atggtaaaccaatcaagccctatgggtttccttctgctcggtttcagcgaacatccagcgctggagcggacattgttcgtcgttgtgtttacctcctaccttctcactctagtaggtaacacactgattattttactgtctgtgttataccctcggctgcattcccctatgtactttttcctcagcgacctctcttttctggacttatgcttcactactagctgcgtgccccagatgttggtgaatctctggggaccaaagaaaacgataagcttcctagggtgctccgtgcagctgtttatcttcttgtcactaggaacaaccgagtgcatcctcttgacagttatggctttcgatcgctatgtggctgtctgccaacctttgcactatgctaccataatacacccccgactgtgctggcagctggccagcgtggcttgggtgatgtccctggttcagtccattgtgcaaacaccatcaacgctgcatctccccttttgtccccatcagcaaatcgatgacttcctgtgtgaagtcccttcgctgatccgcctgagttgcggagacaccagctacaatgaaatccaattggctgtgtcctcagttattttcgtggtcgtccccctcagtctgattctagccagttatggggcaacagcgcaggcagttctgcgcattaactccgccacagcctggcgcaaggcttttggcacctgtagcagccatctgacagtggtcaccctgttttatagctctgtcattgccgtttacctgcagcctaagaatccttacgctcaaggtcgtggaaagttttttggcctgttttacgctgttggtacccccagtctgaatcctctcgtatacactctccgcaacaaggaaattaagcgtgcgctgaggaggctccttggcaaagaaagagacagccgtgagtcttggcgtgccgcttag

SEQ ID NO: 52318 - DNA, 951 bp, Artificial Sequence
  Description of Artificial Sequence: Synthetic coding sequence
atggtgaaccagagcagtcccatggggtttctgttgctggggttctcagagcatccagctctcgagcgcacattgtttgtggtggtattcacctcttatttgctcaccctcgtgggtaacaccctcatcattttgctctccgtcctgtacccacggctgcatagcccaatgtacttctttctgtctgatctttcattccttgacttgtgttttaccacctcatgcgttccacaaatgcttgtgaatctctgggggcctaagaagacaatctcatttctcggttgctccgttcagttgttcatcttcctctcgctgggcacgacagagtgcatattactgaccgtcatggccttcgacagatatgtcgcagtgtgtcagcccctgcattatgccacaattatacacccaaggctgtgctggcagttagcaagtgttgcttgggtaatgagtctggttcagtccatagtgcagaccccaagcaccctgcaccttcccttttgtccccaccaacaaatcgatgactttctgtgtgaggtccctagcctgatccgtttgtcctgcggggataccagctacaacgagatacaactcgccgtgtcatctgtgatcttcgtggtggttcctctttcactgatcctcgcgagctacggggctacagcacaggctgtcctgcgcattaacagcgctactgcgtggaggaaggctttcggcacctgcagctctcacctcactgttgttaccctgttttatagtagtgtcatagcagtctacctccaaccaaagaacccatatgctcagggtcggggaaagttctttggattgttttacgcagtgggtacgccctcactgaacccactcgtgtataccctccgcaataaggagatcaagagggcgcttaggcgactgctgggtaaagagagagacagcagagaatcttggcgggcagcatag

SEQ ID NO: 52319 - DNA, 951 bp, Artificial Sequence
  Description of Artificial Sequence: Synthetic coding sequence
atggtcaatcagtcctctcccatgggatttctgctgctgggcttcagcgaacaccccgctttggagcgcaccttgttcgttgtagtgtttacctcctatctcctgacactggttgggaacacactgatcatcctgctgtccgtactttacccacgcctccatagccccatgtatttctttctgtctgacttgtcatttctggatttgtgtttcaccacatcctgtgtgccccagatgctggtgaacctctgggggccaaaaaaaactataagctttctgggctgtagtgtacaactgtttatttttctgagcctcgggacaacagaatgcatcctactgactgtaatggcgttcgataggtacgtggccgtgtgtcagccactgcactatgccacgattatccatccacgcctgtgttggcagcttgcctcagtggcgtgggtcatgtctctggtacagagtattgtccagaccccctcgacgttgcacctcccgttttgtccccaccagcagatcgatgattttctgtgtgaggtgccctccctcattagacttagctgtggcgacacgtcttataatgagatccagctggccgtgtcatctgttatcttcgtcgtcgtgcctctgagcctgattcttgcttcctacggtgctaccgcgcaggccgttttaaggattaatagtgccactgcatggaggaaagccttcggaacatgtagctcccaccttacagtggtaacactgttttattccagcgtgattgccgtctatctgcagcctaagaacccgtacgctcaggggagaggtaaattttttggactcttctacgccgtgggcacccccagcctgaatcccctcgtgtataccctgcgtaataaggagataaaaagggccctgcggaggctgctgggtaaagaacgggactctagagagagctggcgggcagcttag

SEQ ID NO: 52320 - DNA, 951 bp, Artificial Sequence
  Description of Artificial Sequence: Synthetic coding sequence
atggttaatcagtcctcacccatgggctttcttctcttgggattctccgaacaccccgctctggagaggactttgtttgtagtggtatttacatcgtacttgctcaccctggtcgggaacacactgatcatcttgctgagtgttctctacccaagactccacagcccaatgtacttctttctgagcgacttgagctttctggacttgtgcttcacaacatcttgtgtgccacagatgttggtgaatctttggggacctaaaaagaccatttccttcttaggttgcagcgtgcaactgttcatctttctctcactgggaactacagaatgcatcttattgaccgttatggccttcgatagatacgtggcagtgtgtcagccactccactacgcaacaatcattcacccaaggctgtgttggcaacttgccagtgtcgcctgggtcatgagcctggtgcaatctatcgtgcaaactccaagcactttacacctacctttttgcccccatcagcagatagacgactttctctgtgaagtgccgagcctgatccgattgagctgcggagacacatcttataacgagatccagctcgcagtaagctctgtgatcttcgtggtagtaccactctcactgatactggcaagctatggtgcaacggctcaggccgttctgcgaattaatagcgctactgcctggcgtaaggcctttgggacctgttccagtcacctgacagtcgtgaccctgttctattccagcgtgatcgctgtgtacctgcaacccaagaatccctatgcccagggaagaggtaaattcttcggactcttttatgctgtggggaccccctcccttaaccctctggtctacactctaaggaataaggagattaaacgggctctgaggcgactcctgggcaaagagcgcgatagccgggagtcttggagggctgcatag

SEQ ID NO: 52321 - DNA, 951 bp, Artificial Sequence
  Description of Artificial Sequence: Synthetic coding sequence
atggtgaatcagagctcccctatgggtttcctgttgctgggattttccgagcacccggctcttgagcgtaccctatttgtcgtcgtctttacatcttatctgctgaccttggtgggcaacacactgatcattctgctgtcagtactgtatcccaggctgcatagccctatgtatttctttctgagcgacctgagtttcctggacctctgctttacaacgtcctgcgtaccacaaatgctcgtcaatttgtggggtcctaagaagactatcagttttttagggtgctccgtccaactttttatattcctgagccttggtacaactgagtgcattcttcttactgtgatggcctttgaccgatatgtggcagtttgtcaacccctgcattatgcgacaatcatacaccctagactgtgctggcaactagcttccgtcgcctgggtcatgagcctggtgcagagtatcgtccagactccctcaacactgcacctcccattttgcccccatcagcaaattgacgactttctgtgcgaagtgccctctcttattcgcttgagctgcggcgatacctcatataatgagatccagctggccgtctcgagcgttatttttgtggtggtccctctgtctctcattctggccagctatggcgcaacggctcaggcagtcctaagaattaattctgctaccgcttggagaaaagcctttggtacatgttcatcccacctgacagttgtgacactcttttacagcagcgtgatcgccgtctacctgcagccaaagaatccttatgcccagggaagggggaaattttttggcctgttctacgccgttggcacccctagtcttaatcctctggtttatactctgaggaataaggagatcaagagagccctgcgcagactgctcggcaaagaacgggacagcagggaaagctggagagccgcatag

SEQ ID NO: 52322 - DNA, 951 bp, Artificial Sequence
  Description of Artificial Sequence: Synthetic coding sequence
atggtaaatcagagcagcccaatgggtttccttctgctgggtttctccgagcatccggctttggagagaactttgtttgtcgtcgtcttcactagctaccttctgaccctcgtggggaatactctcatcatactgctatctgtcctgtacccccgtctgcacagccctatgtatttctttttatccgatcttagttttctagatctttgttttacgacctcctgcgtgcctcaaatgctcgtcaacctctggggccctaagaagaccatctcattcctcggctgtagcgtgcagctgttcattttcctgagtctgggaactaccgagtgtatattgctgactgtgatggcctttgataggtacgtcgcagtgtgtcagccactgcactatgccacgatcattcatccaaggctgtgttggcaactggcatctgtagcatgggttatgtcactggttcagagcatcgttcagactccttccacactccacctcccattctgccctcaccagcagattgatgattttctgtgtgaagtaccaagcttgatccgcttatcctgcggggataccagctataatgagattcagcttgccgtcagctccgtgatctttgttgtggtgccgttatctctgatccttgccagttatggcgctaccgcccaggccgtcctgagaatcaactccgcaaccgcatggcgcaaggcgttcggcacctgctcttcccaccttaccgtggtcacattattctactcttccgtcattgccgtgtaccttcaaccaaaaaacccttacgctcagggacgcggaaaattcttcggacttttttatgcggtgggtaccccttccctcaacccattggtttacacgctgagaaacaaagagattaagcgtgctctccgccgtctgctgggtaaggagcgagacagtagagaaagctggcgtgccgcttag

SEQ ID NO: 52323 - DNA, 951 bp, Artificial Sequence
  Description of Artificial Sequence: Synthetic coding sequence
atggtgaaccagagctctcctatggggtttctgttgctcggcttttctgaacatcctgccctggagcgaaccttattcgtcgtggtgttcacctcttatttgttgacgctcgtaggcaatacacttataatcctcctatccgttctctatcctcgactgcactcccccatgtattttttcctatccgatttaagtttcttagatctgtgctttacaacttcctgcgtgccccagatgctcgttaacctgtggggtcccaaaaagacaatctcatttttgggatgctctgtgcagctgtttatttttctgtccctcggcaccactgagtgtattctactgacagtgatggcttttgatcggtatgtggctgtgtgtcagcccctacattatgccacaatcatacatccaagattatgctggcaacttgcttccgtggcttgggtaatgtcccttgtccagtctattgtccagacacccagcaccctgcacctccctttctgccctcaccaacagattgacgacttcctatgcgaagtgccaagtttaatacgactctcgtgcggagatacatcgtataatgaaattcagctcgctgtaagcagcgtcatctttgtggtcgtacctttgagcctgatcttggcatcatacggtgcaactgcccaggccgtcctgcgtatcaacagcgctacagcctggcggaaggcgttcgggacatgtagctcgcatctgactgtagtaactcttttttacagttccgttattgcagtctacctccaacctaaaaacccttacgcacagggaagaggaaagttttttggcttattttacgccgtaggaacaccttcactcaaccctctagtgtacacactgaggaataaagagattaagcgtgcactgcgcaggcttctgggcaaggagcgcgactcaagagagagctggcgcgcagcttag

SEQ ID NO: 52324 - DNA, 951 bp, Artificial Sequence
  Description of Artificial Sequence: Synthetic coding sequence
atggttaaccagtccagccctatgggcttcctacttcttgggttctccgagcatccagccttggagaggacccttttcgttgtggtctttacctcttacctattgacactggttggcaatacactgattatcttgttgtctgtgctttacccccgactccattctcctatgtactttttcctgtctgatcttagcttccttgacctgtgcttcaccacttcctgcgtgccacagatgcttgtcaatctctggggacctaagaagacgatttcatttttgggttgctccgttcaactttttatcttcctgagcttaggcactaccgaatgtatcctgctgacagttatggccttcgatcgctacgtcgctgtctgtcagccactgcactatgctacaatcatccatcctaggctttgctggcagcttgccagcgttgcctgggttatgtctctggtacaatctatcgtgcagactccgtcaaccctgcatctcccattctgccctcatcagcagatcgatgactttttatgcgaggtcccttccctcattcgcctctcctgtggagacacgtcgtacaacgagattcaactggccgtgagttcagttattttcgtggtggtgcctttgtccctcattctagcatcttacggcgcaacagcccaggcggtcttgcgcatcaactccgccaccgcttggcgcaaagcctttggaacctgctctagccacctgaccgtcgttaccctgttttacagctcggtaattgctgtctacctgcaacccaagaatccctatgctcaggggagaggaaagttttttggcctgttctacgcggtcggtaccccttctctgaatccattggtttatactctgcgaaacaaggagattaagcgcgcactcagaaggctgctcgggaaggaacgggattctagggagagctggagagcggcttag

SEQ ID NO: 52325 - DNA, 951 bp, Artificial Sequence
  Description of Artificial Sequence: Synthetic coding sequence
atggttaatcagagcagccctatgggatttcttctcctaggattcagtgagcatcctgcgctagaacggaccctttttgtggtggtgtttacgtcctacctgttgaccctggttggaaataccctaataatcttgctctccgtgctgtatcctcgcctccattctcccatgtactttttcctgtccgacctgtcttttctggacttatgctttacaaccagttgtgttcctcaaatgctcgtcaacctttgggggcctaaaaaaaccatcagctttctcggctgctccgtgcagttgtttatatttctttcgctgggtacaactgagtgcatcttgctaacagtgatggcgtttgacagatatgtagcggtgtgccagccattgcactacgccaccatcatccacccccgactctgttggcagctggctagcgtggcttgggtgatgtccctggtgcaaagcattgttcagacgccttctactttgcatctccctttctgcccccaccagcagatagacgacttcttgtgcgaggttcctagtctcatacggttatcatgtggcgacacctcatataatgaaatccagcttgcggtgagctctgtgatctttgtggttgtgccgctgagcctcatcctggcaagctatggcgctactgcccaagcagtgctgcggatcaacagcgccacggcttggcggaaagcttttggcacttgctcctcccacctcacagtggtcaccttgttctattcctctgtcattgccgtctatctgcagcccaaaaacccttatgcccaggggaggggcaagtttttcggccttttctatgcggttggaactcccagccttaatcctctcgtgtatactctgcgcaataaagaaatcaaacgagccctgcggcgattactcgggaaggaacgagatagcagggaaagttggcgcgctgcatag

SEQ ID NO: 52326 - DNA, 951 bp, Artificial Sequence
  Description of Artificial Sequence: Synthetic coding sequence
atggtgaatcaaagtagtcctatgggttttcttttgttagggttctccgaacatcccgcactggagcgcactttatttgtagtggtgtttacaagctaccttctaacactggtaggcaacacactgattatcctcttaagtgtgctgtaccctaggttgcactctcctatgtacttcttcttgagcgatctgtcctttttagacttatgctttacaacctcatgtgtgccacagatgttggtcaacctctggggaccgaagaaaacaatctctttcctcggatgcagcgttcagcttttcatatttctgagtctcgggacgacagaatgtatccttctcaccgtgatggcttttgatcgctacgtggccgtatgccaacccctgcactatgccacgatcattcatcctaggctttgttggcaactcgcctcagtggcctgggttatgtccctcgtacagtctattgtgcagacccccagcacactgcacttaccattctgccctcaccagcagattgacgactttttgtgcgaagtcccgtctttgattcgcctgtcctgtggagacacgagctacaacgaaatccagctggccgtctctagtgtgatcttcgtggttgtcccactctcgctgatacttgcgagctatggggcaacagcgcaggcagttttgagaatcaattcggccacagcatggagaaaggcttttggaacatgttcctcacacctcacagtcgtgacccttttctactccagcgtgatagctgtgtacctccagcctaaaaatccatacgctcagggacgcggaaaatttttcggtttgttttacgcagtcggaacaccgtcattgaacccactggtgtacaccttgagaaataaggagataaaacgcgctctgcgaagactactgggaaaggagagggactctcgggaatcctggcgggcagcttag

SEQ ID NO: 52327 - DNA, 951 bp, Artificial Sequence
  Description of Artificial Sequence: Synthetic coding sequence
atggtgaaccagagctcaccaatgggcttcctcctcctgggcttctccgagcaccctgctttggaacgaacactctttgtcgtggttttcacatcctacctgctgaccctggtgggcaataccctgataatcctgctgtccgtattatatccccgtttgcattcccccatgtatttctttctttccgacctgagttttctcgatctgtgcttcactaccagctgcgttccacagatgctggtgaacttgtggggacctaagaagaccatcagctttctgggctgctctgtccaactgtttatctttctgagccttggaacgaccgaatgtatcttgcttacagtgatggcctttgatcgctacgtggctgtctgccaaccactccactacgccaccatcatccaccccaggttgtgttggcagttggcgtccgttgcatgggtgatgtccctggttcaatctatcgttcagactccctctacgctgcacctgccattttgcccccatcagcagatcgacgattttctttgcgaagtcccctccctcattcgactgtcctgcggagatactagttataacgaaatccaattggccgtctcatccgtgatcttcgtggtggtgccgctatcactgatcctagccagttacggcgctaccgcccaggcagttctccggatcaactccgctaccgcttggcgaaaagctttcggcacgtgcagttcccaccttacggtcgtgaccctcttctatagctccgtgatcgccgtatacctgcaaccaaagaatccttacgcacagggacggggaaaattctttggcttattttacgcagtgggaacccccagcctcaaccccttggtttatacactgcgcaacaaagagataaaacgagccctgcgaagactgctgggaaaggagagagacagccgagagtcttggcgggcagcctag

SEQ ID NO: 52328 - DNA, 951 bp, Artificial Sequence
  Description of Artificial Sequence: Synthetic coding sequence
atggtgaatcaatcatctccgatgggattcctgctgctgggattctctgagcaccccgcattggagcggaccctttttgtggtggtgtttacctcttatttgctgactttggtcggtaacacactgataatcctgctctccgtgttgtaccctaggctacatagccccatgtatttcttcctctccgacctgtcttttctggatttgtgttttaccacttcctgcgtgccccaaatgctggtaaacctgtgggggccaaagaagactatctcttttctggggtgttctgttcagctattcattttcttatctcttggaaccacagagtgcattctactgacagttatggcttttgaccggtacgtcgccgtctgccagcccctgcactatgccactatcatccacccgaggctttgctggcaactggctagtgttgcctgggtgatgtctctggtgcagtccatagtccagaccccatcaactctgcacctaccattctgtccgcaccaacagatagacgatttcctttgcgaggtcccgtccctcatacgcctgagctgtggcgatactagctataatgagatacagttagctgtttcctccgtgattttcgtcgtcgtccccctctcccttatcttagcttcctatggggctactgcgcaggccgttctgcgcatcaattctgccacagcttggcgtaaggcatttggaacctgttcctctcatttaacagtggtcactctattctactccagcgtgatcgcagtgtacctgcagcctaaaaacccctacgcccagggcaggggaaagtttttcgggcttttttacgcagtgggaacaccctccctgaaccccttggtgtacactttgagaaataaagaaatcaaacgagccttgaggcggctcttgggaaaagaacgtgattctagagagagttggagagctgcctag

SEQ ID NO: 52329 - DNA, 951 bp, Artificial Sequence
  Description of Artificial Sequence: Synthetic coding sequence
atggttaaccagtccagcccaatgggctttctcctgctgggcttctccgaacaccctgcattggagaggacgttgttcgtagtcgtgtttacctcatacctcctgacactggtgggcaacacactcatcatcctcctcagtgttctctaccccaggctccactcacccatgtatttcttcctgagtgaccttagttttttggatctgtgctttacaacctcatgtgtaccacagatgctcgtcaatctgtgggggccaaaaaaaaccatctcttttcttggatgttctgtgcaactttttatttttctaagcttgggtacaacagagtgcattctactgaccgttatggccttcgatcgctatgtggccgtgtgtcagcctctgcattacgccacaattatacacccaagactatgctggcagctggccagtgttgcatgggtgatgagcctcgtccagtcgatcgttcaaacccccagcactttgcacctaccattttgcccccatcaacagattgatgactttttgtgcgaggtcccgagcctgattaggctgtcctgcggggacactagctacaacgagattcagttagcggtctcttccgtgatcttcgtagtggtgccactctctctcattttggcctcatacggcgcaaccgctcaggccgttctgcgcattaattccgctaccgcatggagaaaggccttcgggacatgctcctcacacttaactgtagtcacccttttttactcaagtgtcattgctgtgtacctgcaacccaagaatccgtatgctcaggggcgtgggaaattctttggcctattttatgccgtggggacccctagccttaatcctctggtttatacgctgagaaataaagagattaagcgggctctgagacggctcctcggcaaagaaagagacagtagagagtcatggcgtgccgcatag

SEQ ID NO: 52330 - DNA, 951 bp, Artificial Sequence
  Description of Artificial Sequence: Synthetic coding sequence
atggttaaccagtcctcccctatgggatttctgctgttgggatttagcgagcatcccgcactggaacgtacgctttttgtcgttgttttcacatcttacctgctcactctggtggggaacacgctcatcatcctcctctccgtgctctatcctcgtctgcactcccccatgtacttttttctgtccgacctgagcttcctggatctgtgtttcaccacctcctgtgtcccgcagatgcttgtgaatctatggggacccaaaaaaaccatcagtttcctgggatgttcggtgcagctcttcatatttctgtcccttggcaccaccgaatgcattctcctcacagtgatggccttcgacaggtatgtggccgtgtgccagccgcttcattacgcaacaatcattcaccctcggctttgctggcagctcgcctcggtcgcatgggttatgagtctggtccaatcaattgttcagaccccttcaacgctgcacctacctttttgcccccaccaacagatagacgactttctctgcgaggtgcctagtctgatccggctttcttgcggcgatacgagctacaatgaaattcaattagctgtgagtagcgtgattttcgtggtggtgcctttgagcttgatcctggcctcttatggggcaacagcccaggcggtccttaggatcaactcagctaccgcgtggaggaaagcattcggtacctgttcatcccacttaacagtggttaccctgttctacagcagcgtgattgctgtttacctgcaacccaaaaacccgtatgcccagggtagaggcaagttcttcggcctgttttatgctgtgggcacaccttcgctgaatccacttgtctatactctgcgcaacaaggaaattaagagggctctgaggcgtctgcttgggaaagaaagagactctcgcgagtcatggagggcggcatag

SEQ ID NO: 52331 - DNA, 951 bp, Artificial Sequence
  Description of Artificial Sequence: Synthetic coding sequence
atggtgaaccagagttccccaatggggttcctcctgctggggttctctgaacatcctgccctggagagaaccctttttgttgttgtattcacttcgtatctgctcacactagtcggtaacactctgatcattctactctcggtactgtacccccgattgcacagtccaatgtacttctttctgtctgacttgagctttctggatctgtgcttcacaacgtcctgcgttccacaaatgctcgtcaacctgtggggcccaaaaaaaacaattagctttttgggatgttctgttcagctgttcatctttctgagtttaggaactaccgaatgcattctactgacggttatggcattcgaccgctacgtcgccgtctgtcagccactacattacgcaacaatcattcaccccaggctctgttggcagctggcttccgtggcatgggttatgtcactggtgcaatctattgtgcagaccccatctaccttacatcttccgttctgtccacaccagcaaatcgacgactttctgtgcgaagtgccctccttaattagactctcttgcggggatacatcctataatgagattcagctcgccgtctcttccgttattttcgtcgttgtcccactgagtctgatccttgcgagttacggcgcaaccgcacaggccgtgctgaggattaattctgctaccgcctggagaaaggcttttgggacatgttcaagccacctcaccgtcgttacattgttttacagtagcgtcattgctgtttacctccaacccaaaaatccatatgcgcagggcaggggtaagtttttcggcctgttttatgcagtgggaaccccctctctcaaccccttagtctataccctccgtaacaaggagatcaagcgagccctcaggagacttctagggaaagaaagggattccagagaatcttggcgagcggcatag

SEQ ID NO: 52332 - DNA, 939 bp, Artificial Sequence
  Description of Artificial Sequence: Synthetic coding sequence
atggttaaccagtcatccaccccagggtttctgctgttgggattctctgagcatcccggtctggaacgcacattgtttgtggtagttctgacttcatacctcttgacactggtgggaaataccctcatcattctgttgtctgccctggatccaaaattgcattcacccatgtatttctttctcagtaacctctcctttctcgatctgtgcttcactactagctgtgttccacagatgctggtgaatctgtggggcccaaagaagacaatctcttttcttgactgtagtgtgcagatcttcattttcctgagcctgggaacgacagagtgtatactgctaacagttatggccttcgatcgctatgtcgcagtatgccagcccctacactacgccacaattattcatccgcgtttgtgttggcaacttgcaagcgtggcgtgggtcatcggcctcgtagagagtgtggtgcaaaccccatccacactccaccttcccttttgcccagataggcaggtcgacgattttgtctgcgaagtgccagcactgatccgcttaagctgtgaagacacatcctacaacgagatccaggtagcagttgcctctgtctttattcttgtggtaccgttgagcctaatcctggtttcttacggggcaatcacttgggctgtccttagaattaactctgctaagggcagaaggaaggcttttgggacttgtagcagtcatctgactgttgtgacactgttctactctagcgtgattgctgtgtacctccaacccaaaaatccctacgcgcaggaacgtggcaagttcttcgggctcttctatgctgtcggcacaccttcccttaatcctctgatttacactctgcggaataaggaagtgacccgggctttccgtcgccttctaggaaaggaaatgggtctgacccagtcctag

SEQ ID NO: 52333 - DNA, 939 bp, Artificial Sequence
  Description of Artificial Sequence: Synthetic coding sequence
atggtcaatcagtctagcacccccggatttcttctgctgggcttttcagaacatcccggtctggagaggactttgttcgtcgttgtcctgacaagttacctgctaaccctggtcggcaacaccctaatcatcttgctcagtgctctggatccaaaactacatagtcccatgtatttcttcttgtccaatttgtccttcttggacttgtgttttaccaccagctgcgtgccgcagatgttagttaacctgtggggccctaagaaaactataagctttctggactgttctgtgcagattttcatattcctgtctctaggaacgaccgaatgcatactgctgactgtgatggcctttgaccgctacgtcgcagtttgtcagccattgcactatgcaaccattatccatccccgactgtgttggcagctggccagcgtggcctgggtgataggtttagtggagagcgtcgttcagacgccctccacactacatctgccattttgcccagaccgccaagtggacgatttcgtttgcgaggtccctgctctgatccgtctctcctgcgaggatactagctataacgaaatccaagtggcggttgcatccgttttcatcttagtagtcccactgtctcttatattggtgagttacggtgccatcacatgggccgttctgcggatcaatagcgccaaagggaggcgcaaagcctttgggacctgctccagccatctcactgtggtgaccctgttctatagttccgtcatcgccgtgtacttgcaacccaaaaatccgtacgctcaggaacgcggaaagttcttcggacttttctatgccgtagggaccccttcgctgaatcctctcatttacacactcagaaacaaggaggtaacgagggcgtttagaaggctgctggggaaggagatgggactgacccaatcctag

SEQ ID NO: 52334 - DNA, 939 bp, Artificial Sequence
  Description of Artificial Sequence: Synthetic coding sequence
atggtgaatcagtccagcactccgggatttttgctgctaggatttagcgagcatccgggattggagcgaacactgttcgtagtggtactcacatcctatctcctaacactggtggggaacacactgataatcttgctgtcggccctggatcctaagttacacagtccaatgtacttcttcttaagcaacctgagcttcctagacctctgtttcactaccagctgtgtcccccagatgctcgtgaacctctgggggccaaagaagacgatctcgtttctagattgcagtgtgcagatctttattttcctgtcgctgggaactacagaatgcatccttcttactgtgatggccttcgatagatatgtcgcagtgtgccaacccctgcactacgcaaccatcatacatcctagactctgctggcaactcgcttcggtggcctgggtgattggtctcgtggagagcgtagtccagaccccatctacactgcacctgcccttctgtccagatcgacaggtggacgattttgtgtgcgaagtgcctgctctgatcagattgtcttgtgaggacacatcctacaacgaaatccaggttgcagtggcatcagtgttcatcctcgtagtgcccctgtctctgattctggtctcatacggtgctattacgtgggccgtcctgcgaataaattcggctaagggccgtcggaaagcattcggcacttgtagttcgcacctgacggttgttacactcttctattcctcagtgattgcagtgtatctgcaaccgaaaaatccgtacgcccaggagcgtggaaaattcttcggcttgttctacgcagtgggaacaccatctctaaaccccctcatctatacactcagaaataaggaagtgacccgagcctttcgacgactgctcggaaaggagatgggcctcactcagtcctag

SEQ ID NO: 52335 - DNA, 939 bp, Artificial Sequence
  Description of Artificial Sequence: Synthetic coding sequence
atgctcatgaagaagaacgctagctttgaggactttttccttctgctcggcttttcaaactggcctcacctcgaggtggtgctgttcgtggtgatcctgattttctacctgatcaccctgatcggtaatttgttcatcatcatcctgagctaccttgacagccacctccacacccctatgtactttttccttagtaatctgtccttcctggatctgtgttacaccacgtcctcaattccacagctgctggtcaacctgtggggacccgaaaagacaatctcctacgcaggatgtactgtgcaattgtattttgtgctcgctctagggaccgctgagtgcgtgctcctggtagtgatgtcatacgacagatacgccgctgtgtgcagacccctgcactacaccgtactgatgcacccaagattctgtcgacttttggccgcagcatcatgggttagcggatttacaactagcgctctgcatagctcttttacattttggattcccttatgtcgccacaggcttgttgaccattttttttgcgaggtgccagccctactgcgcctaagttgcgtcgacacgcaagccaacgagctgactctgatggtgatgagttccattttcgtgctgatccctctgatattaatcttgaccagttacggggcaatagcacgtgcagtcctgagcatgcaatctactacaggcctacagaaagtgttacggacatgcggggctcacctcatggtggttagccttttcttcattcccgtcatgtgcatgtatctgcaacccccaagtgaaaactcccaggaccagggcaaattcatcgccctgttctacacagtcgtgactccttcgcttaacccactgatatacaccttcagaaacaaggacgtgagaggagctgttaagcgactcatgggatgggagtggggaatgtag

SEQ ID NO: 52336 - DNA, 939 bp, Artificial Sequence
  Description of Artificial Sequence: Synthetic coding sequence
atgatgatcaaaaagaacgcttcctcagaggacttcttcattctgctgggttttagcaattggcctcagttggaagtggtgctcttcgtcgtcattctcatattttacctgatgacgctgacagggaatttgtttatcattattttgagctacgtcgatagccaccttcacacacccatgtacttcttcctgagcaaccttagtttcttggacttatgccacaccacctcctctatcccgcagctcttagtgaacttgagaggacccgagaagacaatctcctacgccggatgcatggttcagctgtattttgtgttagcactgggcattgctgagtgtgttctcctggttgttatgagctacgacaggtacgtcgccgtttgtcggccactgcattatactgtcctaatgcatcccagattttgccatctcttggctgccgcatcatgggtcattgggtttaccatctcagccttacatagcagcttcaccttttgggtgccactgtgcgggcataggctcgttgaccactttttctgtgaggtgccggctctcctgagactgtcctgtgtggatacgcacgccaacgagctcactctcatggtcatgtcatctatctttgtcctgattccacttatcctgatcctcacagcatatggagcgatcgctagagccgtacttagtatgcagagcactacagggctccagaaagtcttcagaacttgcggggctcatctgatggttgtttcactgttctttataccagtgatgtgtatgtaccttcagcctccatctgaaaatagtcctgatcaagggaagtttatcgccctgttctacaccgttgtgaccccctctttaaatcccctgatctataccctgagaaacaagcatgtaaagggagcagccaagcgcttgctcggatgggaatggggaaaatag

SEQ ID NO: 52337 - DNA, 939 bp, Artificial Sequence
  Description of Artificial Sequence: Synthetic coding sequence
atgatgatcaagaaaaacgcctctagcgaggacttctttattttgttaggattttcaaattggccgcagctggaggttgttctgtttgtagtgatcctgatcttttacttgatgaccttgacgggcaatcttttcatcatcatactgtcatatgttgatagccacctgcatacacctatgtatttctttctgtccaatctatctttcctggacctgtgtcataccactagctcgatcccccagttgttggtgaatctgaggggccctgagaagactatatcctacgccggatgcatggtgcagctgtacttcgtgctagctctcggtatagcggagtgcgtgttgctggtggtgatgtcatacgacaggtacgtggctgtttgtcgtcctttgcactacacagttctgatgcaccctcggttttgtcaccttttggcggctgcctcctgggttatcggttttacaatttctgccctgcacagctccttcaccttttgggtacccctgtgcggtcacagactggtcgatcactttttctgtgaggtgcccgcattgttgcgcctatcatgcgtggatactcacgccaacgagctgacccttatggttatgagtagcatcttcgtcctcatccctctgatcctgattctgactgcctacggcgcaatagccagggctgttctgtctatgcagagtactactgggcttcagaaggtctttagaacttgtggcgcacaccttatggtagttagtctattcttcatccctgtgatgtgtatgtacctacaaccacccagcgagaactctccagaccagggcaaattcatcgcactcttttacactgttgttacgccctctttaaatcccttgatttatacccttcgtaataaacatgtaaaaggtgcggctaagaggcttctggggtgggagtgggggaaatag

SEQ ID NO: 52338 - DNA, 939 bp, Artificial Sequence
  Description of Artificial Sequence: Synthetic coding sequence
atgatgataaagaagaacgcctccagcgaggacttttttatactgctggggttttcgaactggcctcaactggaggtcgttctgttcgttgtcatacttatattttacctgatgaccctaactggcaacttgttcatcatcattctcagttacgtggactctcacctgcacaccccaatgtacttcttcctgagcaatctctccttcctagatctgtgtcatacaactagtagtatcccacaactgttggtaaacctgcgaggaccagagaaaactatctcctatgctgggtgcatggtacagctgtactttgttctcgctttgggaatcgcggagtgcgtacttttggtggtgatgagctacgaccgatatgtggccgtatgtaggcctttgcactataccgtacttatgcatccacgcttttgccatttgttagcagccgcaagttgggtgatcggattcactatttccgctctgcacagttctttcactttctgggtacccctgtgtggccatcgcttagtagatcattttttctgtgaggtgcccgcactcctgcggctttcttgcgtcgacacccacgcgaatgaattgaccttaatggtcatgtcgagcattttcgtgctgattccgctgatattgatactgacagcctacggtgccatcgctcgggcagtcctctcaatgcaaagcacgacaggtctgcagaaagtctttagaacctgcggtgctcaccttatggtggtttccctgttttttattccagtgatgtgtatgtacctccagccaccatccgaaaattcaccagaccaagggaagttcattgcactgttttacaccgttgtcacgccctcactgaaccctctcatctacacactgcgcaacaaacatgtgaaaggcgctgccaaacggctgttagggtgggaatggggcaagtag

SEQ ID NO: 52339 - DNA, 939 bp, Artificial Sequence
  Description of Artificial Sequence: Synthetic coding sequence
atgatgattaagaaaaatgcctccagcgaagactttttcatcctgttgggattttccaactggcctcagctggaggttgttctgttcgtagtgatcctgatcttttacctcatgaccctgacagggaacctgtttattataatcctgtcctacgttgatagccatctgcatacaccgatgtacttctttctgtcaaacctgtctttcctggacctgtgtcataccacatcgtccatacctcagctgctggtcaatctgcgtggcccagaaaaaaccataagctatgccggttgcatggtgcagctctacttcgtgctggcactggggatcgctgagtgtgtactgcttgtggtgatgagctatgacagatacgttgctgtttgtcggccactgcactacacagtgttgatgcatccgagattctgccacctcctggctgccgcaagctgggtcattgggttcactataagcgcacttcattcatccttcactttttgggtgcctctgtgtgggcatagattagtggatcacttcttttgcgaggtgcccgcactcctgcgactcagctgtgttgatacccacgccaatgaactcacacttatggtaatgagctccatattcgtgctgattccactcatcctcatccttacagcctatggcgctatcgctagagcagttctctctatgcaatctacaacgggcctgcagaaggtgttccggacgtgcggggctcacctgatggtggtaagtctgttttttatcccagttatgtgcatgtacttgcagccacctagcgagaacagtcctgaccaaggcaaatttatcgcattgttttacacagtggttacacctagcctgaacccactgatctataccttgaggaacaaacatgttaagggtgctgctaaaagactgctggggtgggaatggggcaagtag

SEQ ID NO: 52340 - DNA, 939 bp, Artificial Sequence
  Description of Artificial Sequence: Synthetic coding sequence
atgatgatcaaaaaaaatgcctctagcgaggacttctttattcttttgggattttccaattggcctcagctggaggttgtgctgtttgtggtgattcttattttctaccttatgacattaactggcaaccttttcataattatcttgtcctatgtggatagccatctgcatactccaatgtacttcttcctttctaacctatcctttctcgacctgtgccataccaccagttcaatccctcagctcttagttaacctgagaggacctgagaagacaatatcttacgccggatgcatggtccagttgtattttgtcctcgcactgggaatcgcggaatgcgttctgcttgtggtgatgtcttacgaccgctatgttgccgtgtgtaggccactgcattatacggtcctgatgcatccacgattctgtcatctgctggccgctgcaagctgggtgatcggcttcactattagtgctttacacagtagcttcacattttgggttcccttgtgcggtcacaggctggtagaccactttttttgtgaggtacctgcactgttgaggctctcatgtgttgatactcatgccaatgaactgactctcatggtgatgagcagtatcttcgttctcataccactcatccttatactgactgcttacggggctattgccagagctgttttatcaatgcagtccactactggtctgcagaaagtcttccgaacatgcggtgctcacttaatggtggtctctcttttttttatccctgtcatgtgtatgtatctgcagccccctagtgagaacagccccgatcagggtaagttcattgccctattctacacggtggtgactcccagccttaatccccttatctacactcttagaaacaagcacgtcaagggggcagctaagcgcttgctcggttgggagtgggggaagtag

SEQ ID NO: 52341 - DNA, 936 bp, Artificial Sequence
  Description of Artificial Sequence: Synthetic coding sequence
atgaatgacgacggcaaggtcaacgctagcagtgaagggtactttatcctggtggggttttccaactggcctcacctggaagtagtgattttcgtggtggtgctgatattctacctgatgacgctcataggaaacctcttcattatcatcctcagctatctggactctcatctgcacacccctatgtatttttttttgtcaaatctgtccttcctggacctgtgctatacgacttccagtattccgcagctgttggttaatctctggggaccagaaaagactattagctatgctgggtgcatgattcaactgtactttgtgttggctctcggaacgacagagtgcgtgctcctcgtggtgatgtcctatgatcgatatgctgccgtgtgcagaccactgcactacaccgtcctgatgcatcctcggttctgtcacctgcttgccgtggcatcctgggtcagcgggtttactaactccgcactccactcttccttcactttctgggtgcctctttgtggacatcgccaggtcgaccacttcttctgcgaagtccctgcactgctgagactgtcctgcgttgatacacacgtgaacgagttgacgttgatgatcacaagctctatattcgtactgatacccctgattctgatcttgactagctacggggcaatcgtccgcgctgtgctccgcatgcagtccaccactggcttacagaaagtatttggtacttgtggcgctcatctgatggctgttagccttttttttataccagcaatgtgcatctatttgcagcctccctccggtaatagtcaggaccagggaaaattcatagctctcttctataccgtcgtgaccccttcccttaatccactgatatacactttacgcaataaggtcgtgaggggggcagtgaaaaggttaatggggtgggaatag

SEQ ID NO: 52342 - DNA, 936 bp, Artificial Sequence
  Description of Artificial Sequence: Synthetic coding sequence
atgaacgatgatggaaaagtgaatgcaagttctgagggctatttcattcttgtggggtttagcaactggccacatttagaagtggtgatttttgtcgtggtactgattttctacttaatgactcttatcggcaatttatttattatcatactaagctacctggactctcacctccacactccaatgtacttttttttgagtaacttatctttcctcgacctatgctacactaccagttccatacctcagctgttggttaacctgtggggcccagagaaaacaatatcctacgcaggttgtatgatccaactctatttcgtgcttgccctcggcactaccgagtgcgtgctgttggtggtgatgagctacgacaggtacgcagccgtgtgtcggccactgcattataccgtcctcatgcatccccgattctgccatcttctcgccgtggctagctgggtgtccggatttacgaattcagccctacactcctcattcactttctgggtccccctctgcggccataggcaggtggatcatttcttctgtgaggtgccggctctgctcagactttcatgcgtggacacccatgtgaatgaactgacccttatgatcacctcctctatctttgttctgatcccccttatcctcatcttgacgagctacggcgctatcgtgcgggcagtcttgcggatgcagtcaacaaccggattgcagaaggtctttggcacctgcggcgctcatctgatggccgtctccctcttttttatacccgcaatgtgcatttacctgcaacccccttccggtaactcacaggaccaaggaaaattcatcgctcttttttatacggtagtgaccccaagcctgaaccccctgatatacaccctcaggaacaaagtagtgcgcggtgcagttaagcgtcttatggggtgggagtag

SEQ ID NO: 52343 - DNA, 936 bp, Artificial Sequence
  Description of Artificial Sequence: Synthetic coding sequence
atgaacgatgatggtaaagttaacgcatccagcgaagggtatttcattcttgtaggattttcgaactggccccacctggaggtggtgatttttgtggtagtgctgatcttctacctgatgactctgattggcaacttgttcattatcattcttagctatttggactctcacctgcacacaccgatgtattttttcttaagcaatctgtcattccttgacctttgctatacaacaagctctatcccccagctgctagtgaacttgtggggtcccgagaagacaatttcctacgccggttgtatgatccagctctatttcgtcctggccctggggactaccgagtgtgtactcctggtggttatgtcttatgaccgatacgccgctgtctgtcgacccctccattacaccgtcctcatgcatcctcgcttttgccatttactggcagtggcctcctgggtatccggcttcacaaactcagccctgcacagcagctttacattttgggtgcctctctgtggccaccggcaggttgaccattttttctgtgaagtacccgctctcctgcggctgtcctgcgtagacacccatgtcaacgaactgacgctaatgatcacttcctccatcttcgtgctgatcccactcatcctcatcttgacatcgtacggcgcaatcgtcagagccgtgctgcgcatgcaatccacaaccgggctccagaaagtgttcggaacatgcggagcccacttgatggccgtctcactgttttttatccctgcaatgtgcatatacctgcaaccacccagcggtaactcacaggatcaagggaaatttatcgcactcttctatacggttgtcactccttcccttaaccccctgatttatactctccgcaacaaagtagtaaggggcgcagttaaaaggctgatgggttgggagtag

SEQ ID NO: 52344 - DNA, 936 bp, Artificial Sequence
  Description of Artificial Sequence: Synthetic coding sequence
atgaatgatgacggtaaggtcaatgcctcaagcgagggctatttcattctggttgggtttagcaactggccgcacctcgaggtagttatattcgtggtcgtgcttatcttttatctaatgaccctgatagggaacctgttcatcattatactcagttatttggactctcacttgcacacgcccatgtactttttcttgagcaatctgtcttttctggacctctgttacacgacgtctagcatacctcagctgctggtgaacttgtggggtcccgagaaaacaatctcctatgccggttgcatgattcaactgtacttcgtattggcgctgggaaccaccgaatgcgtgctgttagtggttatgtcatacgaccgctacgccgcagtctgccgaccacttcattatacagtgctgatgcacccacggttttgccatctcctggcagtggccagctgggtttctggttttactaacagcgcacttcacagtagcttcaccttttgggtcccactgtgtgggcaccgacaagtagaccacttcttctgtgaggtaccagccctgctgcgtcttagctgtgttgacactcatgtcaatgaactgacactcatgatcactagctcaatctttgtgcttatcccgctgatcttaattctcacttcctacggagccattgttcgcgctgtgcttaggatgcagtcgacaacaggcctccaaaaagtcttcgggacctgcggggcacacctcatggccgtgagccttttctttatacccgcaatgtgcatttatctccagccacccagcggaaactcacaggatcagggcaaattcattgccctgttttacactgtggtgaccccatctttgaaccccctcatttatactctgcgtaataaggtcgtacgcggagcagttaaaaggctcatgggctgggaatag

SEQ ID NO: 52345 - DNA, 777 bp, Artificial Sequence
  Description of Artificial Sequence: Synthetic coding sequence
atgaatgatgatggaaaagttaacgcatcctccgagggttattttattcttgtcgggttttccaactggcctcacctggaagtcgtgatctttgtcgtcgttctaattttttatttgatgactttgatcgggaatctctttataattattttgagctacctggacagtcaccttcacacgcccatgtatttttttttgagcaacttgtcatttctggatctctgttacacaaccagctctatcccccagctgctcgtcaacctgtgggggcctgagaaaactatctcgtatgcaggctgcatgatacagctgtactttgttcttgcactcgggaccactgagtgtgttctgctcgtggtcatgtcctatgataggtatgcggcagtctgcagacctctgcattataccgtcctcatgcatcctaggttctgccacctcctcgccgtggcatcatgggtttctggattcacgaacagcgctttacacagcagcttcaccttctgggtgccactgtgtggccataggcaggttgaccacttcttttgcgaggttccagcattgctgagactgagctgcgtggacacgcatgttaacgagttaacgctgatgattacttcctcaatatttgttctcattcctctgatcttaatcctgacttcttacggcgcaatcgttcaagcggtgcttcgaatgcagagcaccacagggttacagaaggtctttggcacctgcggcgctcacctgatggcagtgtccctattttttatccccgcatag

SEQ ID NO: 52346 - DNA, 936 bp, Artificial Sequence
  Description of Artificial Sequence: Synthetic coding sequence
atgaatgacgatgggaaggttaatgcttcaagcgaaggatatttcatccttgtgggcttctcgaactggccccacttagaagtggtcatatttgtggttgtcctgattttctatctgatgaccctcatcggcaacctctttatcataatcctgtcctacctggactctcacctccatacacccatgtacttcttcttatcaaacttgagtttcctagacctgtgttacacaacctcaagtatcccgcagctcctggtgaacttgtggggacccgaaaaaactatcagctatgccggatgcatgatccagctgtacttcgtgttggcactaggcaccaccgaatgcgttcttctggtcgtcatgtcatacgatcgctacgccgctgtgtgtaggccgttacactacacggtgcttatgcaccccagattctgccatttgctcgcagttgccagttgggtgtcaggcttcaccaattctgctttacacagcagctttaccttctgggtcccactgtgcggtcacagacaggtggaccattttttttgcgaggtcccagctttgctgcggctctcctgtgtagacacacacgttaacgagcttaccctaatgattaccagcagcatctttgtcctgattcccctgatccttatcctgacatcttacggcgctattgtgcgcgctgtcttgaggatgcagagcaccacaggactccaaaaggtgttcggaacatgtggtgcacatctcatggccgtgagcctgtttttcattcctgcaatgtgtatctacctccagcccccatccggcaacagtcaggatcaggggaagtttattgctctgttctacaccgttgtgactccgtcactcaatcctttaatctacactctgaggaataaagtggtccgtggggctgtgaaacggttgatgggctgggaatag

SEQ ID NO: 52347 - DNA, 936 bp, Artificial Sequence
  Description of Artificial Sequence: Synthetic coding sequence
atgaatgacgacgggaaagtcaacgcctcatccgaaggatatttcatacttgtaggtttcagcaattggccacacctcgaagttgtgatctttgtcgtcgttttaattttttaccttatgacacttattggaaacttgttcattataattctgtcttatctggattcccatctgcatacccctatgtacttcttcctttcaaatctgtctttccttgatctgtgttatacaacttcttctatccctcagcttctggttaacctgtggggtccggagaagaccatctcgtacgccggatgtatgattcagttgtatttcgtcttggcactgggtactaccgagtgtgtgctgttggtagtgatgtcctacgatcgctacgctgcagtgtgtaggccactccattacaccgtgctgatgcacccccgtttctgccacctgctggctgtggcatcttgggtgagcgggttcacaaacagtgcactgcatagctccttcactttctgggtgcccttatgtggccaccgtcaggtcgatcactttttctgcgaggtacccgcactcctccgactttcctgcgtcgacactcatgtgaatgagctgactctgatgataacatcctccatttttgtcctcattccgttgattctgatattgacctcatacggggcaatagtgagggcggtccttagaatgcagtctacaacaggcctgcagaaggtgtttggaacatgcggagcccacctcatggccgtgtcactcttcttcattccggctatgtgtatatacctgcagccccctagcggcaattctcaggatcaaggcaagttcatcgccttattctataccgtggtgacgcctagcctaaaccccctcatctataccctgcgaaataaggtggtccgcggagccgtcaagagactaatgggatgggagtag

SEQ ID NO: 52348 - DNA, 951 bp, Artificial Sequence
  Description of Artificial Sequence: Synthetic coding sequence
atgcagggagagaactttacaatctggagcatcttcttcctggaggggttctcccaatatccaggtttggaagtcgtcctctttgtattctccctagtcatgtatctgacgacactcttggggaactccacattgatcttaattacaatcctggattctcggctcaagacacccatgtatctgttcctcggcaacttgtcattcatggacatatgctatacaagcgccagtgtgccgacattattggtcaatctgttaagctcgcaaaagaccatcatcttctcaggatgcgctgtccagatgtatttaagtttagccatgggctccacggaatgcgtactcctggccgtgatggcgtacgacaggtacgtcgccatctgtaacccgttacgatacagcattattatgaacaggtgtgtgtgcgcacgcatggccactgtcagctgggttacggggtgcctgaccgcactactcgaaacgtcttttgcgttgcaaattccattatgcgggaatctgatagatcactttacctgtgagatcctcgcggttcttaaattggcgtgcaccagctcactgctgatgaataccatcatgttagtagtgtccatattacttcttcccatacccatgctgctggtgtgtattagttacatctttattctgtcaacaatcctcaggatcacatcagccgagggccgaaacaaggctttcagcacatgcggcgctcatctcacagttgtgatcctatactacggagctgcccttagtatgtacttgaaacctagctcctccaatgctcagaagatcgataaaattatctcacttctttacggtgtgttgaccccaatgttaaatcccatcatctattccctcaggaacaaagaagtgaaagatgcaatgaagaaactgctggggaagatcacacttcaccagacccatgaacatctttag

SEQ ID NO: 52349 - DNA, 1038 bp, Artificial Sequence
  Description of Artificial Sequence: Synthetic coding sequence
atgaacatcactttgtattccttcttatacgtgctgcgcctgaacgagggcaacagcacagggcgaaacattgatgagcgcaagaaaatgcagggggagaatttcacaatttggagcatatttttccttgagggtttttctcagtaccccggactggaggtcgtgctgtttgtgttcagcctggttatgtatctaacgactctcttgggaaattctactctaatattgatcacaattctcgatagcaggctgaagactcctatgtatttgtttttgggtaacctctcctttatggatatttgctacacatcggcctctgttcccaccctcctcgtgaaccttctcagtagtcaaaaaactattatatttagcggttgcgctgtccagatgtacttatcccttgcgatggggtctacagaatgcgtgctcttggctgtcatggcatatgataggtatgtagctatctgcaacccactgcgctactccatcatcatgaatagatgtgtgtgcgctagaatggccacagtctcttgggtgacaggttgcctcaccgcgctgctcgagacttcgttcgcgcttcagattcctttgtgcgggaacctcatcgatcatttcacatgcgaaatactcgcagtgcttaagctagcttgcacttcctcactcctcatgaacaccatcatgctggtcgtgtcaatcctgctcctgcccatccccatgttgctggtgtgcataagttatattttcatcctctctactatcctgagaatcaccagcgcggagggtcgaaataaggcattcagtacctgtggggctcacctcacagtggtgatcctctactatggtgccgctcttagcatgtatttgaagccctcgtcgagtaatgctcagaaaatagataaaatcatctccttgctttacggcgtgctgacacctatgctgaatccaatcatatattcactgcgtaataaagaggtcaaagatgcgatgaaaaagctactcggcaagatcaccctgcatcaaacacacgaacacctgtag

SEQ ID NO: 52350 - DNA, 939 bp, Artificial Sequence
  Description of Artificial Sequence: Synthetic coding sequence
atggagaagtggaatcacacgagtaatgacttcatcttactgggcctgctccctccgaatcaaaccggaatcttcttgctatgtctgataattcttatctttttcctggcctctgtgggtaatagtgcgatgatccacctgatccatgtcgatccccgtttgcacacacctatgtattttcttctcagtcagctgtcactgatggacctcatgtacatttccacaacagttccaaaaatggcctataacttcttgtctgggcagaaaggcatctccttccttggctgcggtgtacagagttttttttttctcaccatggcttgttccgaggggttactactgacctctatggcctatgaccggtacctggccatctgtcatagcctttactacccaattcgtatgtcaaaaatgatgtgcgtcaaaatgatcgggggttcttggaccctgggctcaatcaacagcttagcgcacaccgtattcgctttacacatcccttattgccgctctcgggcaatcgatcatttcttctgcgacgtcccagcaatgttactgctggcctgcacagacacctgggtctacgaatatatggtgtttgtgtcaactagcctttttctcctgttcccgttcatcggcattacttcatcctgcggccgtgtacttttcgccgtctatcatatgcacagtaaggaaggacgaaagaaggcgtttaccaccatcagcacccacctcacagtggtaattttctactacgccccatttgtgtacacctacctgcgtcctcgtaatcttaggtcccctgccgaagacaaaattcttgctgtgttctataccatcctgaccccaatgctgaatcctatcatttacagccttaggaataaagaggtattgggggctatgagacgggttttcggtatcttctcctttttaaaagagtag

SEQ ID NO: 52351 - DNA, 939 bp, Artificial Sequence
  Description of Artificial Sequence: Synthetic coding sequence
atggagaaatggaatcacaccagcaacgattttattctgctcggcctactgccccctaaccaaacggggatctttctcttgtgtctcattattcttatatttttcctcgcctccgttggtaattcagccatgatccacctgatccacgtggatccgaggctgcatacacctatgtatttcctgctcagccaactttcgctgatggatctgatgtatataagtactactgtgcccaaaatggcctataactttctgtctggacagaaaggtatctcctttctgggctgcggagttcaaagttttttttttctgactatggcttgttcagaggggttgctgctcactagcatggcttacgatagatacctggcaatctgtcactccctgtattatcccatacggatgagcaaaatgatgtgcgtaaaaatgataggcggtagttggacactgggcagcatcaattccctggcgcataccgttttcgctctgcatattccttattgtcggagtagagccattgaccattttttttgcgacgtgccggctatgctcctgttagcgtgtacagatacttgggtgtatgagtacatggttttcgtttccacaagcctttttctgctttttccgtttatcggtattacaagttcctgcgggagagttctgtttgcagtttaccacatgcattccaaggagggcagaaaaaaggcctttactaccattagcacccatctcactgtcgttatcttctattatgccccttttgtttacacttacctgagaccccgtaatctgaggtcgcctgcagaagacaaaattcttgcagtgttctacaccatcctgacccctatgctcaacccgattatatattccctgcggaataaagaagtcctcggcgctatgagacgggtgttcgggatcttctctttcctaaaggaatag

SEQ ID NO: 52352 - DNA, 939 bp, Artificial Sequence
  Description of Artificial Sequence: Synthetic coding sequence
atggagaattacaatcaaacgagtactgattttatcctactaggcctatttccacagtcccgcatcggactttttgtctttaccctgattttcctgatctttttgatggcactgattggcaacctgtcgatgattctcctgatctttttagacattcacctgcatactcccatgtatttcttgctctcccaacttagcttaattgatctcaactatatctccacaattgtgccgaagatggtctatgattttctgtacggcaataagtccatctcttttacagggtgcggcatacagtcctttttcttcctcacattggccgtcgccgagggtcttcttctgacaagtatggcatacgatcgatacgtggcaatctgcttccctttacactatccaattcgcatcagtaagcgcgtgtgtgtaatgatgattactggttcgtggatgatttcttccataaattcttgtgcgcacaccgtgtacgctctgtgcatcccctactgtaagtctcgggcaatcaaccatttcttctgtgatgtacctgccatgcttaccctggcttgcacagatacctgggtgtatgagagcacagtctttctctcttctactattttcctggtgctcccctttaccggcattgcatgctcctacggccgagtgttattagcggtgtacagaatgcactctgcagagggaagaaaaaaggcttactctacttgctctacccatctgaccgtcgtttccttttattacgccccattcgcctacacttatgtaagacctcgaagccttcggtcaccaacagaagataagatcctagctgtgttctacacaatcctcaccccaatgctgaacccaattatttactcactgaggaacaaggaagtcatgggcgctctgacccaagtaattcagaagatcttctcagtgaagatgtag

SEQ ID NO: 52353 - DNA, 939 bp, Artificial Sequence
  Description of Artificial Sequence: Synthetic coding sequence
atggaaaactataatcagaccagtacggactttattctcctgggttttttcccccctagcaggatcgggctttttctattcatcttaatcgtgttcattttcttgatggcactgatcgggaacctgtccatgatcctgctcatctttctggatacacacctgcatactcctatgtattttctattgtctcagctgagccttatcgatctcaattacatcagtacaatcgtgcccaagatggcttccgactttctgtcggggaacaaaagcatctcttttacaggctgtggtattcagagtttttttttcagtgctctgggtggtgctgaggcccttctgctggcctctatggcatatgaccgctatattgcaatatgctttccattacactaccctatacgcatgagcaagaggatgtgcgtcctgatgattacgggaagctggattattgggtctatcaacgcgtgcgcacacaccgtttatgtccttcatatcccatactgtcagtctagggcgattaatcactttttctgtgacgtcccagccatggtcaccttggcctgcatggacacctgggtttacgaggggaccgtgttcctgtctacaacaatttttctggtattcccatttatcgcaattagttgttcttacggacgcgttctgctcgctgtgtaccatatgaaaagcgccgaggggaggaaaaaagcttacctcacttgctccacacatttgacagtcgtcactttttattacgcacctttcgtatacacctacctccggccacggtctctgcgttcaccgaccgaggacaaagttctggctgtgttttacactacactcacacccatgcttaacccaatcatctattccttacggaataaggaagtcatgggggctctgacacgtgtaagccagaggatttgctcagggaagatgtag

SEQ ID NO: 52354 - DNA, 939 bp, Artificial Sequence
  Description of Artificial Sequence: Synthetic coding sequence
atggagaattacaaccagacttccacagatttcatcctgctgggactgttccctccttcaaaaataggattgtttcttttcattttgtttgtgctgatatttctgatggctttgattggcaacctctccatgatcctgctgatcttcttggacactcatttacacacgccaatgtattttctcctctctcagctttcccttattgatcttaactatataagcacaattgtcccaaagatggcctctgacttcctctatggtaacaagtcgataagctttatcggatgcggaattcaatcctttttttttatgacgtttgccggagctgaggccctgctcctgactagtatggcctatgataggtacgtcgccatttgctttcctttacattatcccatccggatgtcgaaaagaatgtacgtcttgatgatcacaggtagctggatgataggcagtattaactcatgtgcccacacggtttacgcttttagaatcccatactgcaagagtagggccatcaaccatttcttttgcgatgtcccagcgatgctcactttggcctgtactgatacctgggtctacgagtatactgtgtttctgtctagcacgatctttttggtgttccccttcacaggcatagcctgcagctatgggtgggtgctcctggccgtatacaggatgcattctgctgaaggaagaaaaaaagcctactcaacgtgctcaacccatttaaccgtggtcacattctactatgccccatttgcctatacttacttgtgtccgagatcccttcgctcactgaccgaggacaaagtgctggctgtgttttacactatattgactccaatgctgaatcccattatctactcactgcgaaacaaggaggtgatgggcgcactaactcgcgtcattcaaaatatcttttccgttaaaatgtag

SEQ ID NO: 52355 - DNA, 939 bp, Artificial Sequence
  Description of Artificial Sequence: Synthetic coding sequence
atggaaaactacaaccagacaagtacagacttcatccttttgggtttgttcccaccttctcggatcgatctctttttttttattctgattgtgtttatctttctcatggcccttatcgggaatctcagcatgattcttcttatttttcttgatacccaccttcacacacctatgtatttcctgctgtcacaactgagcctgatcgatctgaattatatctccacaattgtccctaagatggcttcagattttctccacggaaacaaaagcatatccttcaccggctgcggcatacaatctttcttttttttagctctggggggagccgaggctctgctgctggcgtccatggcctacgacagatatatagcaatatgctttcccctgcactatcttatcagaatgtcaaagcgcgtgtgcgtgttgatgataaccggttcctggatcatcggcagcatcaacgcctgtgcccacacagtgtatgtgctacatattccctactgtcgatcccgagccatcaaccattttttttgcgacgttcccgcaatggtcactctggcctgtatggacacttgggtgtatgagggtaccgtgtttctgtctgcaactatattcctggtctttccttttatcggcatctcctgtagttacggtcaagtcctctttgctgtatatcatatgaaatccgccgagggacgcaaaaaagcctacctaacatgtagtacccatttgactgtcgtgacattttattatgctcccttcgtgtacacctacctgcgacccagatctttgagatccccgaccgaagacaaggtactcgccgtgttctacactattcttacccccatgcttaaccctatcatttacagcttaagaaataaggaggttatgggcgcactgacaagagtgtctcaacgaatctgcagcgtgaaaatgtag

SEQ ID NO: 52356 - DNA, 1044 bp, Artificial Sequence
  Description of Artificial Sequence: Synthetic coding sequence
atggcttgggaaaaccagacttttaattcagacttcatcctgcttggcatcttcaatcacagtccaccccatacattcctgtttttcttggtactgggaatattcctggtggcatttatgggcaacagcgttatggtattactgatttacctagatacccagctgcatacaccgatgtatttccttctgagccagttgagcttgatggatctgatgttaatctgtacgactgtcccaaagatggcctttaattacttatccgggagtaagagcatctcaatggctgggtgcgtaactcagatctttttttacatctctttatcgggctcggaatgtttcttgctagccgtgatggcttacgatagatatatagcaatctgtcatccactgcgctacaccaatctgatgaatcctaaaatttgcggcctgatggccaccttctcatggattttgggcagcacagatggcattatcgatgctgtggccaccttttctttttccttctgtggttctagggagatcgcacacttcttctgtgagtttcccagtctcttaatactcagttgtaacgacacctcgatttttgaagaagtgatcttcatttgctgtattgtcatgttagtcttcccagtcgccatcatcattgcctcgtatgcccgagtgattcttgccgtgatacatatgggttctggagagggacgctgcaaggccttcaccacgtgctcatctcatctaatggtcgtgggcatgtactacggcgctgccctgtttatgtatatacggccaactagcgatcatagccctacacaggacaagatggtgtctgttttttataccatccttactccaatgctgaacccattgatctattccttgcgcaacaaggaggtaacaagagcgtttatgaaaatattaggaaaaggtaaaagcgaatcagagctgccccataagctgtatgttttgctgttcgcaaaattttttttcctaatcagcatttttttctatgacgtcaagatcttagctctgattatgtatatcgcctag

SEQ ID NO: 52357 - DNA, 939 bp, Artificial Sequence
  Description of Artificial Sequence: Synthetic coding sequence
atggctcgggaaaacagtacatttaacagcgattttatcctgttagggatctttaatcacagtcctactcatacatttcttttctttctggtgttagccattttcagtgtcgcatttatgggaaattcagttatggtgctacttatttacctggacactcaactgcacacacccatgtacttactcctgtcccagctcagtctgatggacctgatgttgatctgcacaaccgttccaaagatggctttcaattacctgagcgggagcaagagcatcagtatggctggatgcgccacccagatattcttttacacctctctgctcgggtctgagtgtttccttctggccgtaatggcctacgatcgctatacagccatctgtcaccctctgcgttacaccaatctcatgagtcccaaaatctgtgggctgatgacggcattttcatggattttggggtctaccgatgggatcatagacgtcgttgctacgttctctttttcttattgcggctctcgcgagattgctcatttcttctgcgatttccctagcctgttgatccttagctgcagtgacacctccatattcgaaaaaattctctttatctgttgcatagtgatgatagtcttccctgtggctatcatcatagcttcttatgctcgcgtgattttggctgttattcacatggggtctggcgaaggccgaagaaaagcatttactacttgttccagtcacctgctggttgtcggaatgtactacggcgcagcactgtttatgtatataagaccaacttctgatcgctccccgacacaggataaaatggtctctgtgttttacactatactgacccctatgctgaatcctctcatctacagcctccgaaataaagaagtgactcgcgctttcatgaagattctgggaaaaggtaaatctggggaatag

SEQ ID NO: 52358 - DNA, 936 bp, Artificial Sequence
  Description of Artificial Sequence: Synthetic coding sequence
atggtttgggaaaatcagaccttcaactctattttcattctactggggatcttcaaccactcccccacacacaccttcctattctctctcgtcctgggaattttttctttggccctcatggaaaacatatcaatggttctgctgatttacatcgagaagcagctccacacacccatgtatttcctattgagccagctctccttgatggacctgatgctgatctgcacgactctccctaaaatgatttttagctatctgtccggaaagaaatccatcagcctcgctggatgtggaactcagatttttttttacgtttcactcctgggcgctgagtgttttctgcttgcagtgatggcgtacgatagatatgtggcaatttgccaccctttgcaatatacgatcctgatgaatccaaagctttgcgtgtttatgacagtggctagctggaccctcggatcactggacggtattatagtgctggccgcagttctctccttcagttattgctcgtctctcgagatacaccactttttctgtgacgtcgcagcgctgttgccactgagttgcactgagacaagtgcatttgagcgtctactggtcatatgttgtgtggttatgctaatctttccggtgtctgtgatcattctgtcctattctcatgtgctgagagccgtgatccatatggggtccggggagagtaggcgcaaagcgtttacgacttgcagttctcatctctccgttgtggggctctactatggggctgctatgttcatgtatatgcgtcccgcaagcaagcacacccccgaccaggataaaatggttagcgccttttatacaatactgacacccatgctgaatccccttatatactcgctcaggaacaaagaggtctttcgtgccttgcagaaggttctgaaaaagcggaaattgatctag

SEQ ID NO: 52359 - DNA, 939 bp, Artificial Sequence
  Description of Artificial Sequence: Synthetic coding sequence
atggcctgggaaaatcagacatttaacagcgatttcattctgttaggtatttttaatcatagccctactcacacgttcctattcttcctggtgttggctattttctcagtagcattcatgggtaatagcgtgatggtgttgctcatttacttggatacacagttgcacactccgatgtactttctgttgagccagctctttctcatggatttgatgctgatctgcagcacagtacctaaaatggccttcaactatctttccggctccaagtcgatttccatggcagggtgcgccacacagatcttcttttacgtcagcctccttgggtctgaatgtttcctcctggcagtaatgtcctatgacaggtacattgccatttgccaccctctgcggtacaccaacctgatgcgtcctaagatttgcggcttgatgactgcattttcatggattctgggatctatggatgcaataattgacgcagtcgcgacgttcagcttctcctactgcggaagtagagagattgcacatttcttttgtgacttcccctctctgctcatcctcagctgcaatgacacttccatctttgaaaaggtcctttttatttgctgcatcgtgatgatagtgttccctgtggccattatcattgcttcgtatgccagagtcatattggctgtgattcacatgggtagcggagagggccgaagaaaagcctttaccacatgtagctcacacctgatggtggtcggcatgtattatggtgcgggacttttcatgtacattaggcctacatctgaccgctcacccatgcaagataagctggttagcgtgttttatacaattctgactcctatgctcaatcctctcatctattctcttagaaacaaggaagtgacgagggcactgcgcaaagttctggggaaagggaagtgcggggaatag

SEQ ID NO: 52360 - DNA, 939 bp, Artificial Sequence
  Description of Artificial Sequence: Synthetic coding sequence
atggcctgggagaatcaaactttcaacagtgattttctgcttctcggaatctttaaccatagcccaacgcatacctttctgtttttcctggtcctcgccatcttttccgtggctttcatgggcaattccattatggtactgcttatctatctcgatacacagctgcatacgccaatgtacttcttgctctctcaactctcactgatggacctcatgctgatctgcacaaccgtgcccaagatggcattcaattacctgagcgggtcaaagagtatctctatggctggctgtgccacccaaatctttttttacatcagcctacttggctcggaatgttttctcttggccgtcatgagctatgatcgttacacagcaatttgtcacccactgagatacactaatctgatgcggcctaaaatttgcggactcatgactgcattcagttggattctgggaagtactgacgggattatcgacgcagttgccaccttcagtttttcatactgcggcagccgagaaatcgcccacttctgttgtgactttcccagccttctcatcctctcctgcaatgataccagcatattcgaggaagtgattttcatttgctgcattgtgatgctcgtgttccccgtagcgatcattatcacttcgtacgccagggtcatcttggccgtgattcacatgggatccggtgagggcaggaggaaagctttcaccacgtgcagctcacacctgatggtggtgggcatgtattatggcgctggcctcttcatgtgcatccaaccaacctctcaccacagccccatgcaggacaagatggtttccgtgttttataccatagttacccctatgctgaatccgttgatttacagccttaggaacaaggaggtgacccgggcactgatgaagatcctgggcaagggcaagagcggggactag

SEQ ID NO: 52361 - DNA, 960 bp, Artificial Sequence
  Description of Artificial Sequence: Synthetic coding sequence
atggaaaaggcaaacgagacatcacctgtcatgggattcgtgcttctgcgactcagcgcccacccagagctggagaagactttctttgtgcttatcttgctgatgtacctcgttattttactgggcaatggagtcctcattttagtgacaattctggattccaggctgcatacccctatgtacttctttctcggaaatctgtcctttctagatatttgcttcacaactagctctgtgcctctcgttttggacagcttcctcactccacaggagaccatcagcttctctgcctgtgcagttcagatggctctttctttcgcaatggctggaacagagtgtttactactgagtatgatggcttttgaccgctatgttgctatatgcaaccctctgcgctacagcgtcattatgtcgaaggcagcatatatgccgatggctgctagctcttgggcaatcggcggagcagcctcagtggtgcacacgagcttagccatacagttgcccttctgcggtgacaatgtgatcaaccatttcacctgtgaaatcttggctgtattgaaactcgcttgcgctgacatttctattaatgtgatttcaatggaggtgaccaatgtgatcttcttgggtgtgcccgtcttgttcatttccttcagttacgtgtttattataactactatccttcgtatcccctcggctgaaggcaggaagaaagtgttttctacgtgttccgctcatttaaccgtggtaattgtattttatggcaccttgttttttatgtatgggaagccgaagtccaaggattcgatgggcgctgacaaagaagatctgagcgacaagctcatccccctcttttatggagtggtcacgccaatgcttaaccctataatttacagccttcgtaacaaggacgttaaggcagctgtgagacggctcctgaggcctaagggttttacccaatag

SEQ ID NO: 52362 - DNA, 1110 bp, Artificial Sequence
  Description of Artificial Sequence: Synthetic coding sequence
atgtggcaggagtattactttcttaacgtattcttccccttgctaaaagtgtgctgtttgacaatcaatagccatgtagtgattctgttgccctgggaatgctatcacttgatctggaaaattctcccctacatcgggaccacggtggggtctatggaggagtataatacatcctcaacagattttactttcatggggttgttcaatcgaaaggagacttcaggcttaattttcgcgataatctcaattatatttttcaccgctctgatggccaacggcgtgatgatcttcttgattcagactgatctaagacttcacacacccatgtattttctcttgtctcacctgtcgctgattgacatgatgtatatttccaccatcgtgcctaagatgctggttaactaccttctggaccaacgaaccatctcctttgtgggatgtacagcccaacacttcctgtatctgacccttgtgggcgcagagtttttccttcttggcttaatggcatatgataggtacgtcgcgatatgtaatcccctgcggtacccggtgctcatgagtcggagggtctgttggatgatcatcgcaggttcttggttcggtgggagcctggatggattccttctgaccccaattacaatgtctttccctttctgcaactctcgggagatcaaccattttttttgtgaagcccctgcagtgttgaaattagcttgcgctgacactgccctgtacgaaacagttatgtacgtttgctgtgtgctgatgctgctgatccctttttccgtggtgctggcgagctatgctcgcattctgacaacagtgcagtgcatgtcctccgtcgaaggaagaaagaaggccttcgcaacttgctcctcccacatgactgtcgtctccctcttttacggagcggcaatgtacacatacatgttgccacactcctaccataagcctgctcaggacaaggtgctgagcgtcttctacacaatccttacacctatgcttaatccactgatctacagtcttagaaacaaagatgtgactggagccctgaagcgggctctgggacggtttaagggcccacagcgggtgtccggaggggttttctag

SEQ ID NO: 52363 - DNA, 939 bp, Artificial Sequence
  Description of Artificial Sequence: Synthetic coding sequence
atgcggctggctaaccagaccctagggggagacttctttctgctgggcattttttcacaaatttcgcaccccggacggttatgcctcctcatcttttccatctttttaatggccgtcagttggaacataacactcatccttctgatccacattgacagctccctccacacgcccatgtattttttcatcaatcaactgagtctgatcgatctgacttatatttccgttactgtcccgaagatgctagtcaaccagttagctaaggataaaacaatatctgtcctcgggtgcgggacacaaatgtatttctatcttcagttgggtggcgctgagtgctgcctattggctgccatggcttatgatcgctacgtggctatttgtcatccactcagatactctgtgttaatgagccaccgagtttgtctcctcctggcgtccggctgctggttcgtaggtagcgtcgatgggttcatgttaacacctatcgcaatgagttttccattctgtagatcgcacgaaatacaacatttcttctgtgaagttcccgcagttttaaagctctcatgtagcgacacttcgctttacaaaatttttatgtacctctgctgcgtgatcatgttgttaatccccgtcacggtgattagcgtcagttactattatattattctgacaattcacaaaatgaactccgtagaggggcgaaagaaagccttcaccacgtgtagctcacatattacagtagtgagtctattctacggggcagctatttataactatatgctcccttcttcataccagacaccggaaaaagacatgatgagcagctttttttacaccatccttacgcctgtgctgaacccaatcatttatagtttccggaataaggatgtgacccgagctctcaagaagatgttgtccgtgcagaagcctccttactag

SEQ ID NO: 52364 - DNA, 951 bp, Artificial Sequence
  Description of Artificial Sequence: Synthetic coding sequence
atgacaaatacttcaagctctgactttactttgcttggccttctggttaactccgaagctgctggcattgtgtttacagttatcctcgcggtttttctgggcgctgtgaccgccaatctggttatgatcttccttatccaagtcgactccagactccacaccccaatgtattttctcctcagtcaactgtccatcatggacacactgtttatctgcacgaccgtccctaaattattggcagacatggtgagtaaagaaaagattatcagcttcgtggcctgtggaattcagatcttcttgtacctgacaatgattggctcggaattcttcctgctaggcctaatggcctatgattgctatgtagccgtttgtaaccctctgcgctaccccgtgcttatgaaccggaagaagtgtttgctcctagcagctggggcttggtttgggggatcattggatggctttctgttgactcccatcaccatgaatgttccttactgcggttcacgcagcatcaaccacttcttctgcgagatcccggctgtgctgaagcttgcatgcgcagataccagcctgtatgagaccttaatgtacatttgctgcgtccttatgctgcttatcccaatctccatcatttccactagttatagcctgattctgttaacaatccacagaatgccgtccgctgagggaaggaagaaagccttcaccacctgctctagtcatctgacagtcgttagtattttttacggagctgcattttacacgtacgtgctgccccagtccttccacaccccagaacaagataaggtggtgagtgctttctatacaattgtcacgccgatgctgaacccactgatttatagtttgagaaacaaagatgtgatcggcgcatttaagaaagtgttcgcttgctgttcatccgcccaaaaggtggctacttccgatgcatag

SEQ ID NO: 52365 - DNA, 963 bp, Artificial Sequence
  Description of Artificial Sequence: Synthetic coding sequence
atggagatgcggaacacaacgcccgattttattctgctcggtttgtttaaccatacgcgtgctcaccaggtcttattcatgatgctgttggcgaccgtgcttacatcgctattcagcaacgccctgatgatcctgctgattcattgggaccatcgcttacaccgccctatgtactttcttttgtcgcagcttagccttatggacatgatgctggtaagcacgaccgtgcccaagatggcagctgattacttgacaggtaacaaagcaatctcacgagctggatgtggtgtgcagatcttctttcttcctacacttggtgggggagagtgttttctcctcgctgctatggcgtacgacagatacgccgctgtctgtcacccactgcgatatccaacactcatgtcgtggcagctgtgtctgcgtatgacaatgagctcatggctcttgggagccgctgacggtctactgcaagcagtcgctaccttgagcttcccatactgcggggctcacgagatagatcacttcttctgtgaggctcctgtcctggtccgccttgcatgcgctgatacgagcgtgttcgaaaatgccatgtatatctgctgtgtactgatgcttcttgtacctttttctctcatactgagttcttatggactcatcctggctgctgtcctgctcatgcggtccaccgaagcgcgtaaaaaagcctttgcaacatgtagcagccatgtggcagtagttgggctcttctacggcgctggtatatttacatatatgcgcccaaaatcccatcggtctacgaatcacgacaaagttgtgagcgcattctatacaatgtttacaccattgcttaaccccctcatttattccgtacgcaattccgaagtgaaagaagcactgaaacgatggttaggaacctgtgtgaacctgaagcaccaacagaatgaagcccaccggagcaggtag

SEQ ID NO: 52366 - DNA, 975 bp, Artificial Sequence
  Description of Artificial Sequence: Synthetic coding sequence
atggggatggagggcttgctgcagaactcaactaactttgtactcacaggcctcattacacaccccgcatttccgggtctgctgttcgccattgtgttttctatattcgtggtggccatcacagctaatctcgtgatgatcctactgatccacatggatagccggctacatacaccaatgtactttctcctctcccagctttctatcatggacaccatatatatttgtattactgtgccaaagatgttgcaggacttgctcagtaaagacaagaccatcagttttcttggctgtgccgtccaaattttcctgtacctgactcttattggaggagaattcttcctgctgggcctaatggcctacgatcggtacgtggccgtgtgtaatcctctcagatatcccctcttgatgaatcgcagggtgtgcctcttcatggtagtggggagctgggttgggggtagtttggacggctttatgctcaccccagttacaatgtcgtttccattctgcagaagccgagagatcaaccatttcttttgcgaaatacccgctgtcctcaaattgtcctgcaccgacactagcctttatgaaacattaatgtacgcctgctgcgttctcatgctcttgattcctcttagtgtgattagtgtcagctacactcacatactgcttacagtgcataggatgaatagcgccgagggtcgcagaaaagcattcgcaacatgcagttcacacatcatggtggtgagcgttttttacggagcagccttctacacgaacgtgctgcctcacagctatcatacaccagagaaggataaggtcgtcagtgcattctacaccatcctcacaccaatgctcaatcccttgatctatagcctccggaataaggatgtagccgctgccctgcggaaagtgctggggaggtgcggctctagccagagtatccgtgtagccacagtgatcagaaaggggtag

SEQ ID NO: 52367 - DNA, 954 bp, Artificial Sequence
  Description of Artificial Sequence: Synthetic coding sequence
atggagcagagtaattattcagtctacgctgatttcatactgctcggcctgttcagcaatgcccgattcccttggctattatttgccctcatcctgctggtcttcctgacctcaattgcctcaaacgtggtcaaaattattcttatccacatagactcccggttgcatacgcccatgtattttctcttgtctcaactctcgctgagagacatcttgtacatctcaactatcgtgcccaagatgctggttgatcaggtgatgagtcaacgcgctatcagttttgctggttgtactgcccaacacttcctgtacctgacccttgcaggagccgagttttttctgctcggcctgatgtcttacgacaggtatgtcgcaatctgcaatccattgcactaccccgtcctgatgagtagaaagatctgttggctgatcgttgccgcagcctggctcggcggatcaatcgacggctttctgcttaccccagttaccatgcaattccctttctgcgcttccagggagatcaaccatttcttctgcgaagtgccggcactcctgaaactaagttgtacagataccagcgcttatgagaccgccatgtacgtctgctgcattatgatgctcctgattccattctccgtgatctccggttcttacacacgaattctgataaccgtctacagaatgtcggaggcggaagggagaggaaaggccgtcgctacgtgcagctcccacatggtagtggtgagtctgttctacggagccgctatgtacacttatgttctgcctcacagttatcatacacctgaacaggacaaggcggtatctgctttttatactattctgacacctatgctgaatcctctgatatactccctccgcaacaaagatgttaccggagcactgcagaaagtcgtgggaaggtgtgtatccagcggcaaggtaacaacattttag

SEQ ID NO: 52368 - DNA, 948 bp, Artificial Sequence
  Description of Artificial Sequence: Synthetic coding sequence
atggctaatatcacccgcatggccaatcatacagggaggctcgattttatactcatgggtcttttccgacagagcaagcatcctgccctcctttctgtggtgatttttgtggtgtttctaaaggctctctcggggaacgccgttcttatattgttaattcattgtgacgcgcacctgcacagccctatgtatttctttatctcccagctctcactgatggacatggcctatatcagcgtgaccgtaccaaagatgctgctggatcaagttatgggagtgaacaaggtctccgcacccgaatgtggaatgcagatgtttctgtatctgacactagctggctccgagttttttcttctcgcaaccatggcatatgacagatacgtcgcgatttgccacccacttaggtacccggttttaatgaaccaccgagtatgtttgtttctagcttcaggctgctggttccttgggagcgtggacggatttatgctcaccccgatcacgatgagctttccgttttgcaggagctgggaaattcaccatttcttttgcgaagtgcctgcggtgacaatactctcatgttcggatactagtctgtatgagacactgatgtacctgtgttgtgtcctcatgctgctgatccctgtgacaataatcagttcttcatatctcctgattctgctcacagtccaccggatgaattccgcagagggcagaaagaaggccttcgccacctgcagctctcatctgactgttgtgattctgttttatggagctgccgtttacacctatatgctgcccagctcataccacacaccagagaaggatatgatggtttctgtcttttacactatactcacacctgtcctcaatcccctgatatatagcctgcgcaacaaggatgtgatgggtgccttaaagaagatgctgacagtgcgcttcgtgctctag

SEQ ID NO: 52369 - DNA, 957 bp, Artificial Sequence
  Description of Artificial Sequence: Synthetic coding sequence
atgtgctcgggaaatcagaccagccaaaaccagaccgcctcgacagattttactctaacagggctcttcgccgaaagcaaacacgcagcactcctgtataccgtgacgttcctgctgtttctgatggccctgactggcaacgcattgttaatactgctcattcactctgaaccacgcctacacacacctatgtacttcttcatttcacagctcgccttgatggatctgatgtacctgtgtgtcaccgtacccaagatgctagtgggccaggtgacaggggatgacactatcagcccttcagggtgcggaatacagatgttcttctacttgacattggctggggcagaggtgtttttactggctgctatggcttacgaccgctatgccgcagtctgccgacccctccactatccactgctgatgaaccagcgggtatgtcagctcctcgtctcagcttgttgggtacttgggatggtcgatggactgctgcttacacctatcaccatgtcattcccgttctgtcagagtagaaagatcctgtccttcttctgtgaaacacccgctctgctcaaactgtcctgtagcgatgtttcactgtataagaccttgatgtatctgtgttgtatcctgatgttattggcacccatcatggtcattagctccagctataccctcatcctgcatctgatccaccgcatgaattccgctgccggtcatcggaaagctctggcaacttgcagtagtcacatgataatcgttctgctgctcttcggggcatctttttatacttacatgctgcctagcagctaccacactgcagagcaggatatgatggtctcagctttctataccatcttcacccccgtgctgaatcccctcatttacagccttcgaaacaaggacgtgacacgcgcactaagaagtatgatgcagagtcgtatgaatcaagagaagtag

SEQ ID NO: 52370 - DNA, 963 bp, Artificial Sequence
  Description of Artificial Sequence: Synthetic coding sequence
atggagatgaggaataccacccctgactttatccttctcggcctgtttaatcacacaagggcccaccaagtgctcttcatgatggtcctgagtatcgtgctgacatcactctttgggaactctctcatgattttattaatccactgggatcatcggctgcacacccccatgtacttcctgctgtctcagctctccctcatggacatgatgttagtttccacaactgtgcctaagatggccgctgactatttgacaggctcaaaggccatttcgcgcgcagggtgcggcgttcagatattctttctgcctacacttggcggaggtgaatgcttcctactagccgcaatggcttacgaccggtacgccgcagtgtgccacccacttcggtacccaacattgatgtcatggcagctgtgcctccgcatgacaatgtcttgttggcttttaggagcagcagatggcttactgcaggccgtggtgacactatcgttcccttattgtggtgcacatgaaatcgatcactttttttgtgaaaccccggtgcttgtgagacttgcctgcgcagacacttccgtgttcgagaatgctatgtacatatgttgtgtgctcatgttgctggtgcccttttcactcattctctctagttacggcctcatcctagcagccgtgttgcacatgaggtctactgaagcgcgaaaaaaggctttcgcgacctgttcctctcacgtcgccgttgtgggattattctacggcgcagctatcttcacttatatgcggccaaagtctcacaggagcacgaaccacgacaaggtagtgtccgcattctacacgatgtttacaccactgctcaaccccctgatatactcagtcaaaaactcagaggtgaagggcgctctgaaacgatggcttggaacctgcgtgaatataaagcaccagcagaatgaagcacaccggagtcggtag

SEQ ID NO: 52371 - DNA, 957 bp, Artificial Sequence
  Description of Artificial Sequence: Synthetic coding sequence
atgtgtagcgggaatcaaacaagccagaaccaaactgcttccaccgacttcacactcactggattatttgccgagtcaaagcacgccgcattgttgtacacagttacattcctgctgtttctgatggctctcacaggaaacgctctgctgatcctgcttatccattcggaacctaggctgcacacccctatgtatttcttcatctctcaacttgcgctgatggatctcatgtacctatgcgtcactgtgccaaaaatgctcgtcgggcaagtgaccggagacgacaccattagtccatctggatgcggtatacagatgtttttccatctaactctcgcaggggctgaggtctttttacttgcagcaatggcttacgatcgctacgcagcggtctgccgacccctgcactatcctttgctcatgaatcagagggtttgccagctgctagtgtcagcctgctgggtcttagggatggttgatggcctcctcctgacccctattacaatgtcatttccattttgtcagtcaagaaaaatactctctttcttttgcgagacccccgctttacttaagctctcatgctcagacgtgtccctgtataagatgctgacatacctctgttgtatcctcatgctgctaacaccaattatggtaattagttcatcgtataccctcatcttacacttaattcataggatgaattccgccgctgggagacgaaaggctctggctacatgtagctcacacatgataattgtgctccttctcttcggcgcatccttctacacctatatgcttcggagtagttaccatacagcagagcaggacatgatggtctccgcgttttatacaatatttacccccgtgttgaaccccctgatttattcactgcgaaacaaggacgtgaccagagcccttagaagtatgatgcagtcccgaatgaatcaagaaaagtag

SEQ ID NO: 52372 - DNA, 972 bp, Artificial Sequence
  Description of Artificial Sequence: Synthetic coding sequence
atgggcatggagggtctgctccagaacagtacaaacttcgtgttgaccggattaatcacccaccccgcattcccagggctgctctttgctgtagtgttttctatcttcgtcgtcgccattacggctaacttagtgatgattctcctgatccatatggatagtcgtctacatactcccatgtactttctgctgtcacagttgagtatcatggacacaatctatatttgtatcacagtgcctaagatgctgcaggatttgctgtctaaggataagaccatatccttcctgggatgcgccgtgcagatcttttatctaactctgatcggcggagaattctttctcctcggtctgatggcttacgaccgatacgttgctgtctgcaaccctctgcgctaccccctactaatgaaccggagagtatgtctctttatggtcgttgggtcatgggtggggggatctctggatggcttcatgctcacacccgtcaccatgagttttcctttttgcaggtcacgagagataaaccattttttctgcgaaatccccgctgtcttgaaactgagctgtacagacacgagtctctatgaaaccctgatgtacgcctgttgtgtcctgatgttgctgattccactgtcagtgatcagcgtctcctatactcacatactcctcaccgttcatcgtatgaacagcgctgaaggccgacggaaagcgttcgccacttgctcaagccatatcatggtcgtctctgtattttacggcgcagctttctacaccaacgttctaccacactcttaccacactccggaaaaggataaagtcgtgtctgcattctacactattcttacccctatgctgaatcccttaatctactctctaaggaacaaggacgtggctgctgcactgagaaaagtcctgggcagatgtgggtcaagtcagtctatcagagtggccaccgttattaggaaagggtag

SEQ ID NO: 52373 - DNA, 1047 bp, Artificial Sequence
  Description of Artificial Sequence: Synthetic coding sequence
atggataatatcacctggatggccagccacactgggtggagcgacttcatcctgatgggtctgtttaggcagtctaagcaccctatggccaatatcacctggatggctaatcacactggatggtccgacttcattctcttaggactgtttcgtcagtccaagcaccctgctcttctctgcgtggttattttcgtcgttttcttgatggccctgagtggcaacgcggtattgatcctcctgatccattgtgacgcacacctccatacacctatgtacttttttatctcgcagttatctttaatggatatggcctacattagcgtgacggttcctaaaatgctgctggatcaggtaatgggcgttaacaagatctccgccccagagtgcgggatgcagatgttcttctatgtgacgttggcaggctccgagttctttctcctggctaccatggcctacgataggtatgtcgccatctgtcaccctctccggtaccccgtcttaatgaaccaccgggtttgcctgttcctatcatccgggtgctggttcttgggaagcgtagatggatttacattcacacctatcacaatgacctttcccttccggggttcaagggagattcatcactttttttgcgaggtacctgctgtcttgaatctctcttgctccgacactagcttgtacgagatctttatgtatctgtgttgtgttctgatgttactcatcccagtggtcatcattagctccagctacctgctgatcctgctgacaattcatgggatgaattcagcagaagggcgaaaaaaagccttcgccacatgctcctctcatctgaccgtggtgattctgttctacggagctgctatctacacttatatgctgccatccagttaccataccccggagaaagatatgatggtatcagtgttctacactatcctcaccccagtcgttaatcctctgatctatagcctgcgcaacaaagatgtgatgggcgcactgaagaagatgctgacggtcgaacccgcttttcaaaaggcgatggaatag

SEQ ID NO: 52374 - DNA, 948 bp, Artificial Sequence
  Description of Artificial Sequence: Synthetic coding sequence
atggctaacattaccaggatggccaaccatacaggaaaattggactttatcctcatgggcctgttcaggagatccaagcatcccgctctgctctccgtcgtaatctttgtggttttcctgaaggcacttagcggcaatgcagtgctgatcctcctgatccactgtgacgcacatcttcactccccaatgtacttttttatttctcagctcagtttgatggacatggcctacatctctgtcacggtgcccaaaatgttattagaccaagtcatgggcgtgaataaagtgtctgcccctgagtgtggaatgcagatgttcctgtatttgaccctagcgggaagtgagttcttcctgctggcaactatggcatatgatcgttacgtcgccatatgccaccccttaaggtatcctgttctaatgaatcaccgcgtgtgcctgtttctagctagtggctgctggttcctcggttcagttgacggcttcatgctgacaccaattacaatgagctttcctttctgccggtcttgggagattcaccacttcttctgtgaggttccagccgtgaccatccttagctgtagcgataccagtctgtatgagaccttgatgtacctttgctgcgtgctcatgttgctcatcccagttacaatcatttcctcatcctacctactcattctgctcacggtgcacaggatgaactccgctgagggtcggaagaaagcatttgccacatgctcctcccacctgacagtcgtaattcttttctatggcgcagcagtgtatacgtatatgctgccatcatcgtatcacactcctgagaaagacatgatggttagtgtattttataccattcttacaccagtgttgaaccctctgatatatagtcttaggaataaagatgtgatgggagcactcaagaaaatgctgacagtgcggttcgtgctgtag

SEQ ID NO: 52375 - DNA, 927 bp, Artificial Sequence
  Description of Artificial Sequence: Synthetic coding sequence
atgaatgagaacaatgagacgctcaccaggggcttcacgctcatgggcttattcacacataataagtgtagcggcttttttttcggagtgatatgcgccgtcttcttcatggcaatgatcgctaacggggtgatgatattcctcatcaacattgaccctcatctccatacaccaatgtacttcttgctcagccatttaagtgtaatcgacacactctatatttcaacgatagtgccgaagatgttggtcgactaccttatgggcgagggaactatttcatttatcgcatgcaccgctcagtgtttcctgtatatgggatttatgggggcagagttttttctacttggcttaatggcttacgacaggtacgtcgctatttgcaacccactcaggtaccctgtcctcatttcatggagagtctgttggatgattctggccagctcatggttcggaggagctctcgattcatttctgctcactccgatcaccatgtccttgccgttctgcgctagccaccagattaaccactttttttgtgaagctccaaccatgttgcggctggcctgtggtgacaaaactacatatgagaccgttatgtatgtctgctgcgtcgccatgctcctcattcccttctctgttgtgactgctagctacacacggattctgatcaccgttcatcagatgacctccgctgaaggacggaagaaggcctttgccacctgtagttctcatatgatggtggtcactctgttctacggagccgcactctacacatataccttgccccagtcctatcatacccctataaaggataaagtctttagtgcattctacactattcttacacctctgttgaacccattgatttactcactccgcaaccgcgatgttatgggcgctctcaagagggttgtggctcggtgttag

SEQ ID NO: 52376 - DNA, 948 bp, Artificial Sequence
  Description of Artificial Sequence: Synthetic coding sequence
atgggaagatgggtgaatcaatcctatacagacggttttttcttgctcggcatctttagtcatagtcagactgatctggttctgttttccgctgtaatggtcgtttttaccgtcgctctgtgtggcaatgttctcctcatctttctaatttaccttgatgcaggcttgcatacccctatgtatttcttcctgagccagttgtccctgatggacctcatgctggtatgtaacatcgtgcctaaaatggcggctaactttttatccggtaggaagtcaatatcattcgtgggctgcggaattcagatagggttctttgtgtccctggtgggttcagaaggccttctcctggggctaatggcctacgacagatacgtagccgtgtcacatcccttacattaccctatactgatgaatcagcgagtgtgtctgcagataactggaagctcttgggccttcggcataatcgatggagtgatccaaatggtggcggcaatgggcctcccctattgtgggagccgaagtgtggatcactttttctgcgaggtccaggccttgctgaagttagcctgtgccgatacaagtctgttcgacacattgctcttcgcttgctgtgtttttatgctgttgctgccatttagcatcattatggctagctatgcttgcatcctcggggctgtcttgcgtatccggtcggcccaagcttggaagaaggctctcgccacctgttcttctcatctcactgccgtgactctgttttacggggctgcaatgttcatgtatctgcgcccacggagatatcgagcccctagtcatgataaagttgccagcatcttttataccgtcttgacgccaatgttaaatcccctgatctattcccttcgcaacggtgaggtaatgggagctttgaggaaaggcttagatagatgccggatcggatctcaacactag

SEQ ID NO: 52377 - DNA, 948 bp, Artificial Sequence
  Description of Artificial Sequence: Synthetic coding sequence
atggagacgtgggtgaatcagagctacaccgacggattttttctgctgggtatctttagtcacagcaccgccgatcttgtcttattttctgtcgtcatggcagtatttacagtcgctctttgtgggaacgtgttacttatctttctgatctacatggatccccacctgcacaccccaatgtattttttcctgagtcagctgagtctgatggacctgatgctggtgtgtactaatgtgcctaaaatggcagccaactttctgtccgggagaaagagcataagctttgtggggtgcggcatacagataggactatttgtgtgcctggtggggtccgaagggctgctgcttggactcatggcttacgaccggtatgtggctatttctcaccctctgcactaccctatcctaatgaatcaacgtgtttgcctgcagattactggctcctcctgggcattcgggatcatcgacggccttatccaaatggtggtagtaatgaatttcccttattgcgggctcagaaaggtgaaccactttttctgtgagatgttaagccttctgaaacttgcctgtgtcgatacatctctgtttgagaaggtgatcttcgcatgctgcgtctttatgcttttatttcccttcagtataattgtcgcctcctatgctcacatactgggtacagtcctccaaatgcattcggcccaggcgtggaagaaggccctggccacatgctcttcacatcttaccgccgtcacccttttctatggtgcagctatgtttatttatcttaggccaaggcattatcgggctcctagccatgataaagtagcatcgattttttatacagtcctgacaccaatgctgaatccattgatatattctctgcggaatcgggaggtgatgggagccctgcggaaagggttggatcgatgtagaattgggagccagcattag

SEQ ID NO: 52378 - DNA, 963 bp, Artificial Sequence
  Description of Artificial Sequence: Synthetic coding sequence
atggatcagtccaactattcttcactgcacgggttcatactcctgggctttagcaatcatcccaagatggagatgatcctgtcaggcgttgtggcaattttctatctgattacactagtgggcaatacggcaataattttggcttctctcctggatagtcagctgcacacccctatgtatttctttctgaggaatctaagctttctggacctatgcttcacaacctccatcataccacaaatgctggttaacctgtgggggccagacaagaccatctcttacgtgggatgtataatccaactgtacgtgtacatgtggcttggatcagttgagtgtctattgctcgcggttatgtcttacgaccgctttacagccatctgcaagccactccattactttgttgtgatgaacccacatctgtgtttgaagatgataattatgatttggtcgatctcacttgcaaattccgtcgtgctctgtactctcacccttaatctgccgacgtgtggaaacaacattctggaccattttctctgtgagctgccagcacttgtcaaaatagcatgcgtcgatactacaacagtagagatgtcagttttcgccctcggaattatcatcgtgcttacccccctcatcctgattcttataagttatggttacattgccaaggccgtccttcgaactaaaagcaaggccagccagagaaaggccatgaacacttgtgggtcccacctcaccgtggtgagcatgttctacgggaccattatttatatgtatctgcaacccggtaatagggcttccaaagaccaggggaagttcctgactctgttttacacagtgatcacaccctccctcaatccactgatctacactctgcgcaacaaggacatgaaggatgccctcaaaaagctgatgcggtttcatcacaagagcactaaaatcaagcggaattgtaaatcatag

SEQ ID NO: 52379 - DNA, 963 bp, Artificial Sequence
  Description of Artificial Sequence: Synthetic coding sequence
atggatcagtcgaattattcatcactgcatggttttatacttcttgggtttagcaatcaccccaagatggaaatgatcctgagtggagtggtggccatcttctacctgatcacgcttgtcgggaacacagcaatcatcctcgctagcctcttagattcccaactgcacaccccaatgtacttctttttgcgcaacctttcattcttggatttgtgcttcaccaccagtatcataccccaaatgctagtgaacttgtggggaccagacaaaaccatctcgtacgtgggatgtatcatccagctatatgtttatatgtggctggggagtgtcgaatgccttcttttagccgtcatgtcatatgataggttcaccgccatctgcaaacccctccactactttgttgtcatgaacccacatctttgcttgaaaatgattatcatgatatggtccattagtctagccaactcagtggtattatgcacactcactctgaacctgcccacatgtggaaacaacatattggatcactttctgtgcgaattaccagcgctggtgaaaatcgcttgcgttgatacgacgacagttgagatgtccgtgttcgcactgggcatcataatagtgttgactcccctgattctgatcctgatttcgtatggctatatagccaaagccgttttgagaactaaatccaaggcatcccagcgcaaggccatgaacacatgcgggagtcacctgaccgtcgtgtccatgttctacggcaccattatatatatgtatctccaacctggcaatagagcgtccaaggaccagggtaaatttctcaccctattttacactgtaattaccccctctctgaatcccctaatatacacacttcggaacaaagatatgaaggatgctctaaaaaagctcatgaggtttcatcacaagtcgacaaagatcaagagaaactgcaagagttag

SEQ ID NO: 52380 - DNA, 963 bp, Artificial Sequence
  Description of Artificial Sequence: Synthetic coding sequence
atggaccaatccaattactcatctctccatggctttattctgttaggcttcagcaatcacccaaagatggagatgatcttatccggcgtcgtggcaatcttttatctcattacattagtcgggaataccgctatcattttagctagcctgttggactcgcagctccacacaccaatgtacttctttctaagaaatctgtcattcctggacctctgtttcactacaagcattatccctcagatgctcgttaacctttgggggccagacaagactatttcctacgtaggctgcatcatacagctgtatgtatatatgtggttgggatcggttgaatgccttctgttagctgtcatgagttatgatcggtttaccgccatctgtaagccactgcattattttgtagtaatgaatccacatctatgtctgaagatgatcatcatgatctggtcgatctcactggccaacagtgttgtcctgtgtacactgactttaaacctcccaacgtgcggcaataacattctggaccactttctgtgcgaacttccagcccttgtgaagatagcgtgtgtggacactactactgtcgagatgagcgtgtttgctcttggtatcataattgtactcacccctttgatcctgattttgatctcctatggctacatcgctaaagcggtactgcggaccaagtcaaaggcttctcagaggaaggccatgaatacgtgcggaagccatctaacagtggtgtctatgttttatgggaccatcatctacatgtacttgcagccaggtaatcgggcatccaaggaccagggcaagttcttgactttgttctacaccgtgatcacgcctagtctgaaccccctgatttatactctgagaaacaaagacatgaaagatgcattaaagaaactgatgaggttccaccacaagagtacaaagattaaaaggaactgcaagtcttag

SEQ ID NO: 52381 - DNA, 963 bp, Artificial Sequence
  Description of Artificial Sequence: Synthetic coding sequence
atggaccagagtaattattcttccctccacggttttattctccttggattcagcaaccatcccaagatggagatgattctgtctggggtcgtggccatcttctatctgattaccctggtcgggaataccgcgattatcctagccagcctcctggattctcagcttcacacacccatgtacttcttcctacgaaatttgagcttcttggatttatgctttacgacgtccattattccgcagatgttggttaacttatggggcccagacaaaacgatttcttatgtcggctgcattatacagctttacgtatacatgtggctgggttcagtcgagtgtttgctcctcgccgtcatgtcgtacgaccgctttaccgcaatctgcaagcctttacactacttcgtcgttatgaacccccacctctgcctaaagatgatcattatgatatggagtataagccttgccaatagtgtggtcctttgcacccttaccctcaatctccccacttgcggcaacaacatcctcgaccacttcctgtgtgagctgcccgctctggtcaagatcgcctgtgtggacaccactacggttgaaatgtcagtgttcgctctgggcatcatcatagtccttacgccacttattctgattctgatcagctatggctacattgccaaggcggttctgaggaccaagtccaaggcaagtcaacggaaggccatgaatacatgcgggagccatctcaccgtggtctcgatgttttatggtacaattatctacatgtacctccagccgggaaaccgcgctagtaaggaccaaggtaaatttctaactctgttttacacagtcatcaccccaagcttgaatccgctgatctacactctgagaaacaaagatatgaaggatgctctaaagaagctgatgaggttccatcataaatccaccaaaattaaaaggaactgcaagtcctag

SEQ ID NO: 52382 - DNA, 963 bp, Artificial Sequence
  Description of Artificial Sequence: Synthetic coding sequence
atggaccagagcaattactcttcactgcacgggttcatattgcttggcttctcaaatcatcctaaaatggaaatgatcctctccggggtggtggccattttttacctcattaccttggtagggaacaccgctatcatcttagcctccctgcttgattctcaactccacacacctatgtacttttttctcaggaacctatccttccttgacctttgttttactacgagcattattcctcagatgcttgtaaatttgtgggggcctgacaaaaccattagctacgtggggtgcatcatacagctgtatgtgtatatgtggctcgggtctgtggagtgtctactgctggctgtgatgtcttatgaccgtttcactgctatctgcaagccactgcattatttcgtggttatgaatccacacctgtgtctcaaaatgataattatgatctggagtatctctttggctaactccgtagttctgtgtaccctcactctgaacctccccacctgcggcaataacatcctggaccacttcctctgcgagctgccagccctggttaaaatagcctgtgttgacaccacaacagtggagatgtccgtgttcgcacttggcataatcatcgtcctgactcccctgatcttgattctgattagttacggatacatcgccaaagccgtccttcgaaccaagtctaaggcttctcagcgtaaggcgatgaacacttgcggttcccatcttacagtcgtctccatgttttacggcaccatcatttacatgtacctgcagccaggaaacagggcgagtaaggatcaggggaagtttctgactcttttttacactgttatcacaccttccttaaatcctctcatctacacattacggaacaaggacatgaaagacgcccttaagaagttgatgcgctttcaccacaagagcaccaaaataaaaaggaactgcaagagttag

SEQ ID NO: 52383 - DNA, 963 bp, Artificial Sequence
  Description of Artificial Sequence: Synthetic coding sequence
atggatcagagtaactatagctcacttcacggcttcatcttgttggggttctcaaaccatcctaaaatggaaatgatactgtcaggggtggttgctatcttttacctaattaccttggtggggaataccgctataattttagctagcctactggacagccagcttcatacccccatgtacttcttccttagaaatttgagtttcctagatctttgctttacaacttcaataattccccaaatgttggtgaacctgtggggccctgacaagactatatcctacgtcggctgcatcattcagttatatgtatacatgtggctcggtagcgtggagtgcctgctgctggctgtgatgtcatacgatagattcacagcaatttgcaaaccccttcattattttgttgtgatgaatccccatctctgtctgaagatgattataatgatttggtccatttcactggctaactcagttgttctttgcactctgacgctcaacctgcccacctgcggcaacaacatccttgatcacttcttatgcgagctccccgcattagtcaaaattgcttgcgttgacaccaccacagtagaaatgagcgtatttgccctcggaatcatcattgtgctgacacccttgatcttgatactcatctcctatgggtatattgccaaagcggtcctcagaacgaaaagcaaagcttcccagcggaaggccatgaatacgtgcggtagccatctgaccgtggtttcaatgttctatgggaccattatctatatgtacctgcagccgggaaaccgggcatctaaggatcaaggaaaatttctgacccttttctacaccgtgattactcctagtctgaatcctctgatctataccctgagaaacaaggatatgaaggatgccttaaaaaagctgatgcgttttcatcacaagagtacgaagattaagagaaattgcaagtcctag

SEQ ID NO: 52384 - DNA, 963 bp, Artificial Sequence
  Description of Artificial Sequence: Synthetic coding sequence
atggatcagtccaactactctagtctgcatggatttattctgctagggtttagtaatcatcccaagatggagatgatcctctcaggcgtggtcgctatcttctacctgattacattagtaggcaataccgctatcatcttggcctctctgctggatagccagctccatactcctatgtacttttttctgcggaacctcagcttcctggacctgtgctttactaccagtataattccacagatgctggtaaacctatgggggccagacaagactattagctacgtgggttgcattattcagctgtatgtatatatgtggttagggagcgtggaatgcttgttgttggccgtcatgtcctatgaccggttcacagccatttgcaaaccactgcactatttcgtggtcatgaacccgcacttgtgtttaaagatgatcattatgatctggtcaatcagtttggccaacagcgttgtcctctgtaccttgaccttgaacttacctacatgcgggaacaacattctggaccacttcctatgcgagcttccagccctcgttaagattgcttgtgtagacacaacaactgtagaaatgagtgtatttgcgctggggattatcatcgtcctgacccccttgatcctaatcctgatcagttacgggtatatcgcaaaagccgtgctcagaaccaaatcaaaagcttctcaaagaaaagccatgaacacctgcgggagccacctgacagttgtttctatgttttatggcaccatcatctatatgtacctccagccgggtaacagggcctccaaggatcagggcaaattcttgacccttttctataccgttataacgccctcattgaaccccctgatatacacactccgaaacaaagacatgaaagatgcactgaagaagttgatgcggttccatcataaaagtacaaagatcaagcgaaactgcaaatcctag

SEQ ID NO: 52385 - DNA, 963 bp, Artificial Sequence
  Description of Artificial Sequence: Synthetic coding sequence
atggaccagtctaactactcctcacttcatggcttcatcctgttgggattttcaaaccaccctaagatggagatgatcctgagcggggtagttgccattttctatttaatcaccctggttggcaacaccgcaatcatcctggctagcttgctggattcccagctacacacacccatgtatttctttctgcgcaacctgtcatttctggacttgtgctttacaacatctatcattcctcagatgctcgtgaacctgtggggaccggataagactatctcttatgtgggctgtatcatccaactatacgtgtacatgtggctggggagtgtggagtgtttgctgctggcggtgatgtcatatgatcgctttaccgcaatctgtaagccactacattacttcgtcgtgatgaacccacacctgtgcctgaaaatgatcatcatgatttggagtatctcactggctaacagtgtggtcctgtgtaccctgacactcaacctccctacttgcggcaataacatcttggaccactttctatgcgaactcccagccctggtgaagattgcctgcgttgacaccaccacagtggagatgagcgtcttcgcccttgggatcatcatagtgctgactcctctcattttgatcttgatcagctatggctatatcgccaaggctgtccttcgcactaagtcgaaggctagtcaaagaaaggctatgaacacctgtgggagccatctgaccgttgtatctatgttctacggcacgattatttatatgtacctccagcccggtaaccgggctagcaaggaccaaggaaagtttctcactctgttttataccgtgataactccttcccttaacccactcatctacactttgcgaaataaagatatgaaagacgcactgaaaaaactcatgaggtttcatcacaagagcactaagataaaaaggaattgcaaatcttag

SEQ ID NO: 52386 - DNA, 945 bp, Artificial Sequence
  Description of Artificial Sequence: Synthetic coding sequence
atggatggcaccaatggatccacacagactcacttcatcctgctgggattctctgatcggcctcacctggaacggatactgttcgttgtgattctgattgcgtacttgctcacactggtaggtaacactaccattatcttagtaagtcgcctggatcctcacctacacacacctatgtactttttcctagcacatctcagctttcttgatctcagcttcacgacatcctccattccccagctgctgtataacttgaatggatgcgataagacgatcagctacatgggatgcgccatccagcttttcctatttctgggccttggaggtgtggagtgcctgttgttggcagtgatggcttatgaccgctgcgtggcgatatgcaagcccctgcactacatggtgatcatgaaccccaggctctgccgaggcctggtaagcgtgacatggggatgtggcgtggcgaatagcctcgcaatgtccccggtgacactgcggctgcccaggtgtgggcaccatgaggttgaccactttttgcgcgagatgcccgctctgattcgcatggcctgcgtgagcactgtagccatagagggcactgttttcgtgctggcggtgggcgtggtgttgtcacccctcgtgtttatcttgttatcgtatagctacattgttcgggctgtgctgcagatccgtagtgcttctggcagacagaaagccttcgggacgtgcggatctcacttgaccgtggtctccctattctatggcaacattatctacatgtatatgcagcctggcgcatccagctcccaggatcagggtatgttcctgatgttgttctacaacattgtcacacccctgctgaaccctttgatttacaccttgcggaatcgcgaggtgaaaggcgctcttggccgactgctcctgggaaagcgcgagttaggcaaggaatag

SEQ ID NO: 52387 - DNA, 945 bp, Artificial Sequence
  Description of Artificial Sequence: Synthetic coding sequence
atggacgggacaaacggctcaacccagactcactttatccttctgggcttcagtgaccgcccacatttagagaggattctatttgtcgtcattctaattgcatacctccttaccctagtgggcaacaccactattatcctagtgagtagactggacccccacttgcataccccaatgtatttctttctggcgcacctgtcattcttggacttgagcttcaccacctcttccattccgcagctgctgtataatctgaacggctgtgacaagacaatttcctacatgggctgtgccatccaattgttcttgtttcttggactggggggtgtggaatgcctgctgctggccgtcatggcttatgataggtgcgtggctatttgtaaaccgctgcattatatggtgattatgaatccacgactttgtcggggtctcgtgtcagtgacttgggggtgtggcgttgccaattctctcgcgatgtctcccgtgactctacgcttgccgcgatgtggacaccatgaggtcgaccattttttaagagaaatgcccgcactcatccgtatggcctgcgttagcaccgtagctatcgaggggaccgtatttgtgctggccgtgggcgtggtgctatctcccctcgtgttcattctgctctcttattcctacatcgtgcgcgctgttctacagatccgttccgcaagtggaagacagaaggccttcggaacctgcgggagtcacctgacggtggtcagtttattctatgggaacatcatctatatgtatatgcagcccggagctagcagctcccaggaccagggcatgtttttgatgctgttctacaatattgtgaccccattactgaaccccctgatttacactctccggaatagggaggtgaagggtgcgctggggcgtctccttcttggcaaacgagaattaggcaaagaatag

SEQ ID NO: 52388 - DNA, 936 bp, Artificial Sequence
  Description of Artificial Sequence: Synthetic coding sequence
atgggatcatttaatacctcatttgaggatggttttatcctcgtcggctttagcgactggccacagctggagccaatcctgttcgtgtttatttttattttctattcacttactctgttcggaaatacaataattatcgccctgtcttggttggatctgaggctgcatacaccaatgtacttcttcctctcgcatttgagtctcctggatctttgctttactaccagtacagtgccgcagctgctcatcaatctttgcggtgtggatcggactatcacacgcggtgggtgtgtggcgcagctctttatatatttggccctcggcagtacggaatgcgtgttgctagtagtgatggcctttgacagatatgctgccgtatgccgcccactgcattacatggccattatgcaccctcatctttgtcaaacactggccattgcaagctggggcgctggttttgtgaatagcctcattcagaccgggctggccatggccatgccactgtgtggccaccgattgaatcatttcttttgcgaaatgcctgtgttcctcaaactcgcctgtgctgacaccgagggcaccgaggcaaaaatgtttgtggctcgagtcattgtcgtcgccgtcccagctgcgttgattctgggctcatacgtacatatcgctcatgcagtgcttagagtgaagtctaccgcgggtcgtaggaaggctttcggaacgtgtggatctcatttacttgtggtcttcctgttctatggcagcgccatatatacctacttacagtcaattcacaactattcagagcgtgagggcaagttcgtggctctattctatactatcataactccaatcctgaatcctctgatttataccctgcggaataaagacgtcaagggcgctttgtggaaagtgctttggcggggtcgggacagtggatag

SEQ ID NO: 52389 - DNA, 945 bp, Artificial Sequence
  Description of Artificial Sequence: Synthetic coding sequence
atgggcgacgtgaaccagagcgtggcttcagattttatcttagtcggactgttttcacactcaggatcacggcaattgcttttctctctggtggcagtcatgttcgtaatcgggctgctgggtaacacagtgctcctcttccttattcgggtggatagtaggctccacacccctatgtactttcttctttcacagctctctctcttcgacatcggttgtcctatggtgaccattccaaaaatggccagtgattttcttcggggtgaaggcgctaccagctatggaggtggagcagcacagattttctttctaaccctcatgggcgtggctgaaggcgttctgctggtgttaatgtcttacgacagatatgttgctgtgtgtcagcccctccaatatccagttcttatgagaaggcaagtctgcctgcttatgatgggtagttcctgggtcgtcggagtgcttaatgcaagcattcagacttccatcaccctgcactttccctactgcgcgtcaagaatcgtggaccattttttctgcgaggttcctgccctcttgaagctgagctgtgctgacacatgcgcatacgagatggccttgtctaccagcggggtgctgatccttatgctgccactttcccttatcgcgaccagttacggacacgttcttcaggcggtgctttccatgaggtccgaagaagcccgacacaaggccgttacaacatgctcatcccatatcacagtcgtgggactgttttatggtgccgcagttttcatgtatatggtaccctgtgcttatcactctcctcagcaggacaatgtcgtgagtctgttttattctctcgtgactcctacattgaacccactgatctatagcctccgtaatcccgaagtgtggatggcactcgtaaaagtgctgtctcgagcaggactgagacaaatgtgctag

SEQ ID NO: 52390 - DNA, 948 bp, Artificial Sequence
  Description of Artificial Sequence: Synthetic coding sequence
atgcagcctgaatctggggctaacggcactgttatcgcggaattcatcctactgggcctcctggaagcacccggtctccaaccagtcgtattcgttttgtttctgttcgcgtatctggttacggtccggggtaatctctccatcctggctgctgtgcttgtggaaccaaagctgcatacgcctatgtacttcttcctgggaaatctgagcgtgctggacgtgggttgcatttcagtgactgtaccctcaatgcttagccgcctgttgtccagaaagagagccgttccatgtggggcttgtctgactcagctcttttttttccacctgtttgtgggggtggattgctttctactgacagcgatggcctacgataggtttcttgccatctgcagacctctgacttattctacaaggatgtcacagacagtccagaggatgcttgtggccgcaagctgggcctgtgcatttaccaacgcactgacccacacagttgccatgtcgaccctaaacttttgcggccctaatgtgatcaaccatttttattgcgacctgcctcagttgtttcaactcagctgctcctctactcagctgaacgagctgttgcttttcgccgtagggttcattatggctggtactccaatggcccttatagttataagctacatccacgtcgccgctgcagtgcttaggataagaagcgttgagggcaggaagaaagctttcagcacttgtggaagccatctcaccgtggtcgctattttctacggatcaggtatcttcaattacatgagactcggtagcaccaagctgagtgataaagataaagcggtgggtattttcaacactgtaatcaatccgatgttgaatccaattatctattccttcagaaatcctgatgttcagagcgccatctggaggatgctgacaggccgacgatccctggcttag

SEQ ID NO: 52391 - DNA, 966 bp, Artificial Sequence
  Description of Artificial Sequence: Synthetic coding sequence
atgtccctgcagaaattgatggagccggaagcagggactaatagaacggctgtggctgagtttatcctcctgggactggtgcagaccgaggagatgcagccagtagtcttcgtcttgctcctgttcgcatatctggttacaaccggaggaaacctaagtatcctggctgccgtattggtggaacctaaactgcacgctcccatgtacttttttctcggaaatctgtcagtactcgacgtcggatgcatcacagtcaccgtcccagctatgctcggtcgtttgctgtcccacaaaagtaccatatcgtacgatgcatgtctctcccagctgttctttttccatctccttgcaggcatggattgcttccttcttactgcaatggcttatgatcgcctattagcaatctgccagcctctcacatatagcacccggatgtcccagacagtccagcgcatgcttgttgcggcttctttggcttgtgcctttaccaatgcactgactcacacggtggctatgtctactttgaatttctgcgggcctaacgaggtcaaccacttttattgtgacctacctcagctgtttcagttgagctgctcttctacgcagttgaatgagctcctgctcttcgctgtgggcttcataatggccggtactccccttgtactgattataacagcctactcccacgtggctgcagcagttttgcggattcgcagtgtcgaggggagaaaaaaggccttttccacctgtggatctcatctgactgtggtgtgcttgttttttggaaggggcatttttaattacatgcggctcggctctgaggaggctagtgacaaggataagggtgtgggagtctttaacactgtgatcaaccctatgctgaacccgctgatctactcccttcgaaacccagacgtccaaggagcgctatggcagatatttttgggcaggaggtctctgacgtag

SEQ ID NO: 52392 - DNA, 966 bp, Artificial Sequence
  Description of Artificial Sequence: Synthetic coding sequence
atgtcattgcagaagctcatggaaccggaggctgggacaaataggaccgccgtggccgagtttatcttgcttggcctggtgcaaactgaggaaatgcagcccgtggtcttcgtgcttcttcttttcgcttacctggtgactacagggggaaaccttagtattctggctgctgttttggtcgaacccaaactccacgccccaatgtacttttttcttggcaacctctccgtcttggatgtgggatgcatcacagtcaccgtgcccgcaatgttggggagactactgtctcacaaatccacaatatcttatgacgcttgcctcagccagctattcttcttccacttgcttgctggcatggactgttttctgctgactgctatggcatatgacagactgctggcaatctgtcaacctctcacttatagcaccagaatgtcccagacagtgcagcgcatgcttgtagccgcttcttgggcatgcgcttttacaaacgctctgacccatactgtcgccatgtccacactcaatttttgtggaccaaatgaggtgaatcacttttattgtgatctcccccagcttttccagcttagctgttccagcacccagcttaatgagctgcttctgttcgtggcggcagcctttatggccgtggcaccactggtgttcatttctgttagctatgctcacgtggtcgccgctgtgctgcagatccggagtgccgaaggaagaaagaaagccttttccacgtgcggatcccatttgactgtggttggcatattctacgggactggggtgttttcttatatgagactgggatcagtcgagtcgagcgataaggacaagggtgtcggagtgttcatgaccgtgatcaaccctatgttgaaccctctgatctattcactcaggaatactgatgtgcagggggctctgtgccagctgcttgtcggcaagcgatcattgacatag

SEQ ID NO: 52393 - DNA, 1035 bp, Artificial Sequence
  Description of Artificial Sequence: Synthetic coding sequence
atggagctgttgaccaataatctgaagttcataacagatccattcgtttgtcgactaaggcacctgtctccaacaccctctgaagaacatatgaagaataagaacaatgtaacagagttcatcctgctcggtctcactcagaatccagaaggccaaaaagtgctgtttgtgacctttcttctgatttatatggtcactattatgggaaatctactcatcattgtcacgattatggccagtcagtccctcggaagtcctatgtacttttttctggccagcttgtccttcattgacacagtctactctactgcttttgctcccaagatgattgtggacctgttgtcagagaagaaaaccatctcgtttcagggctgcatggcccagctcttcatggatcatttatttgccggagcagaggtcattctgctggttgtaatggcatacgacaggtacatggctatatgcaagcccctccacgaactgatcacaatgaatagaagagtgtgtgtcctaatgctacttgcggcatggattggcggtttcttgcactcactcgtgcagtttctctttatatatcagctgcccttctgcgggcctaatgtcatcgataattttctctgtgatctgtacccccttttgaaactagcttgtacaaatacttatgtgacagggctgagtatgatcgctaacggaggagcgatatgcgcggtcaccttcttcaccatcttactgtcttatggagtcatcctccactccctcaaaactcagagtctcgagggcaagagaaaagccttctacacttgcgcttcgcatgttactgtggtgattctgttcttcgtcccatgcatcttcttatatgctcggccaaatagcacttttcccatcgacaaatcaatgaccgtagtattaacattcatcacccctatgctgaatccattaatttacacactaaaaaacgccgaaatgaaatccgcaatgaggaagctatggtccaagaaggtaagtctggccggaaagtggctataccattcctag

SEQ ID NO: 52394 - DNA, 987 bp, Artificial Sequence
  Description of Artificial Sequence: Synthetic coding sequence
atgcgccctagctcaaacgtgaccgagtttgttctgctgggattaacacaggatcccgatgttaagaagaccctctttgttatgttcctgttgatctacatcgtcactatggttggcaatttgttgatttgggtaaccacgatcggttcaccttccctgggatctctgatgtacttctttctagcctacttaagtctcatggatgccatttacagtaccgcaatgtcccccaagctgatgatcgatctcctgtgtgacaaaatcgccattagtttatctgcatgtatgggacaactgttcattgaacacctgctgggaggcgctgaggtgttcctgttggtcgtcatggcttatgatagatacgtggcgatttccaaacctctacactatctcaatatcatgaaccggctcgtgtgtatcctactgttggtcgtagcaatgatcggcggttttgttcactcagtcgtccagattgtctttctctatagcctgccaatctgcgggccaaatgtgatcgaccattcagtgtgtgacatgtaccccctgctggaactactatgcctcgacacctactttatcggcttaaccgtggtcgccaatgggggaatcatctgcatggtaatatttacattcctgctgatttcttgtggtgtgatccttaactttttgaagacctactcgcaagaagaacggcacaaagccttgcctacgtgtataagtcacattatcgtggtggcgcttgtatttgtgccatgtatctttatgtacgttaggcctgtgagcaattttccttttgacaagctcatgactgttttctattccattattactctgatgctcaatcccctgatatattcactgcgacagagcgagatgaaaaacgcaatgaagaatctgtggtgtgagaagcttagcattgtccggaagagggtctcacccaccctcaatatcttcattccgtccagcaaggccacgaacagacgatag

SEQ ID NO: 52395 - DNA, 930 bp, Artificial Sequence
  Description of Artificial Sequence: Synthetic coding sequence
atggaacccaggaagaatgttacggatttcgtgcttctgggcttcactcaaaatcccaaagaacagaaggtgttgtttgtcatgttcctgctgttctacatcctgacgatggtgggaaatctgcttattgttgtgacagtcactgtgtctgaaacactgggaagcccgatgtacttttttctggctggactctcattcatagacattatttattcctctagtatctcccccaggctgatcagtggactgttttttggcaataactcgatatcattccagagttgcatggcccagctcttcattgagcacatctttggcggaagtgaggtcttcctgctgctcgtgatggcttacgactgttatgtagccatctgcaagccccttcactatctcgttataatgaggcaatgggtgtgtgtggtgctcctggtggtctcttgggttgggggttttctgcacagtgtctttcaacttagtatcatttacgggctaccattctgcgggccaaacgttatcgaccactttttctgtgacatgtaccccctgctcaaattagtgtgtactgatactcacgctatcgggcttctcgtggtggcaaacgggggattggcgtgcacaatcgttttcctgctgctcttgatatcgtatggcgtgatcctacactcgttaaagaacctgtcacaaaaaggtcgccagaaggccttgtccacatgctcctcccatatgactgtggtggtattcttttttgttccttgtatcttcatgtacgccagacccgctcggaccttccccatagacaaatccgtgagtgtgttctacaccgtcattacacccatgctgaaccctctcatttacacattacggaacagcgaaatgacgtcggccatgaaaaagttgtggaggcgtgacctcatctctagttccacttag

SEQ ID NO: 52396 - DNA, 948 bp, Artificial Sequence
  Description of Artificial Sequence: Synthetic coding sequence
atgcgccagaataataatattaccgaatttgtgctgctggggttcagccaagaccctggagttcagaaagccctcttcgtgatgtttctgctgacttacctcgtcacagtcgtaggtaacctccttatagtagttgatattatcgcttctccctcactcggaagcccaatgtacttctttttggcctgcctctctttcatagacgctgcctattcaaccactatcagtccaaaattgatagtcggactattctgtgataaaaaaaccataagcttccagggctgtatgggccagctcttcatcgaccatttcttcggaggggctgaggtattcctcctggttgtgatggcgtgtgaccgctacgtggcgatttgtaagccgctgcactacttgaccattatgaaccgacaggtctgtttcctcctgctagtggtcgccatgattgggggttttgtgcatagtgccttccagatcgtggtctactctctccctttttgtggccctaatgttattgtgcatttctcctgtgatatgcatccattactagaactggcgtgtacggacacctacttcatcggccttaccgtcgtggttaattcgggggctatctgtatggtcatctttaacctccttctgatcagctatggcgtaattttgtcgtcactcaagacttacagtcaggaaaaacgaggtaaggccctttccacttgttcttcaggcagcacagtggtggtgttgttctttgtaccatgtatcttcatttacgtgcgccctgtcagcaacttcccgactgacaagtttatgaccgtcttttatacaataatcactcacatgctgagcccattaatttacaccttgcgtaacagcgaaatgcggaatgcgatcgagaaactgctcgggaaaaaacttaccatcttcattattgggggagtgagtgtgctgatgtag

SEQ ID NO: 52397 - DNA, 930 bp, Artificial Sequence
  Description of Artificial Sequence: Synthetic coding sequence
atggctagcacaagcaacgtcaccgagctgatttttacagggctttttcaggatccggcagttcaaagcgtatgttttgtggtgttcctgcctgtgtacctcgccacagtggtaggcaacggcctcatcgttcttactgtctcgatctctaagagtctcgactccccaatgtacttttttttgagttgtctgagcctggtcgagattagctacagcagtaccatcgcccctaaattcattatcgacctactagccaagatcaaaacgatttccttagaggggtgcctgactcagatctttttttttcattttttcggcgtggccgagatcctgctgatcgtggtgatggcatatgactgctatgttgccatctgcaagcctctacattacatgaacatcattagcagacagttgtgccacttactcgttgcagggagttggctgggcggtttctgccacagcattatccagatcctagtgattattcagctgcctttttgcggacctaatgtaatcgaccattatttctgcgacctccaaccattattcaagttggcatgtacagatacatttatggagggtgtgatcgtgcttgccaattccggactgtttagtgttttcagctttctcatccttgtttcgtcctacattgtgatcctggttaatctgagaaaccactccgcagaggggaggcataaggcactgtccacctgtgcatctcacatcacggtcgtgatcttgttctttgggcctgctatcttcctttatatgagaccatccagcaccttcaccgaagacaagcttgtggcggtgttttatactgttatcaccccaatgctgaaccccattatctacacgctgcgcaacgcagaagtcaaaatcgcaatccgaagactatggagtaaaaaggaaaacccgggtagggaatag

SEQ ID NO: 52398 - DNA, 933 bp, Artificial Sequence
  Description of Artificial Sequence: Synthetic coding sequence
atgcagcagaacaactccgtccctgaatttattctgctgggactgacccaggacccgctgaggcagaagatcgtgttcgtcattttcctgattttctacatgggaaccgttgttgggaacatgctgattatcgttactatcaagtcttcccggactctgggtagcccaatgtattttttccttttttatctgtctttcgcagattcttgtttctcgaccagcaccgctccaagactgattgtcgatgctcttagtgaaaagaaaataataacgtacaacgaatgcatgacacaggtgtttgcgttgcatttatttgggtgcatggagatttttgtcctgatcttgatggctgtcgaccgttacgtcgcaatttgtaagcctctgagataccccactattatgagccagcaggtatgtattattctcattgtcttggcctggatcggatctctgatccacagcacagctcagattattctcgcattgcggctccccttttgcggaccctacctgatcgatcactattgttgcgacctgcagcctctgttaaaactggcatgcatggatacatacatgatcaacctcctgcttgtgtcaaactcaggggcaatctgtagcagctcattcatgatcttgatcattagctatattgtcatactgcactcactacgcaaccacagtgctaagggtaagaagaaagcactgagtgcatgtacctcccatattatagtggtgatcctgtttttcggaccttgcatttttatctatacgcgtcctcccacaaccttcccgatggacaaaatggtggccgttttttacactattggaaccccatttctgaacccactcatttacacgttgagaaatgctgaggtcaaaaatgcaatgcggaagctttggcacggaaaaatcatctcagagaataaaggatag

SEQ ID NO: 52399 - DNA, 930 bp, Artificial Sequence
  Description of Artificial Sequence: Synthetic coding sequence
atggaaaaaaagaagaatgttactgaatttatcctgattggcctgacccaaaatcccattatggagaaagtaacattcgtcgtctttctagtgctatatatgatcactctaagtggtaatctgctcattgtggtcactattacgacttcccaagccttgtctagcccaatgtactttttcctgacccatctgtccctcatcgacacggtttatagctctagcagtgctccaaagttgatcgtggacagctttcaggagaaaaaaattatctcattcaacgggtgtatggcgcaggcttacgctgagcacatttttggagccacagagatcatacttctgactgtcatggcctgtgactgttatgttgctatatgtaaacccctgaactatacaacgattatgagtcatagcctctgcatcctgcttgtcgctgtagcctgggtaggtggattcctccacgcgacaatccagatactgttcaccgtgtggttgccattttgcggacccaacgttataggccacttcatgtgcgacttgtatcccctgctgaaattagtctgtatagatactcatactctgggtctattcgtcgcagtcaacagtggattcatttgtcttctcaactttttgattctagtagtgagctatgttattattctacgcagcctcaaaaacaatagtcttgaaggaagatgcaaggccttgtccacatgtatcagccacattattgtggtggtgctgttcttcgtcccatgtattttcgtatacctacgctctgtgacaaccctgcctatcgacaaggccgtggcagtcttttatacaatggtggtcccaatgctaaaccccgttgtctacacccttaggaatgccgaggtgaagtccgctatccggaaactttggcggaagaaggtcacaagcgacaacgactag

SEQ ID NO: 52400 - DNA, 930 bp, Artificial Sequence
  Description of Artificial Sequence: Synthetic coding sequence
atggccaaccgaaacaacgtcaccgaattcatcttactggggcttaccgagaacccaaagatgcagaaaataatttttgttgtgttctctgtcatctatattaacgcaatgatcggaaatgttctaatcgtcgtcactatcacggcatccccttccttacggtcccccatgtacttctttcttgcttacctgtcttttatcgatgcctgctattcctccgtcaacacacctaagctgattactgatagcctttatgaaaataagaccattttatttaacgggtgtatgactcaggtatttggagagcatttttttaggggggtagaggtcatcctgctgacagtcatggcctacgaccattatgtggcaatatgcaagccccttcactacaccaccgtcatgaaacagcatgtttgttctttattagtgggcgtctcctgggtcggtggttttctacatgccactatccaaattctctttatctgtcagctacccttctgcggccctaacgttatcgatcatttcatgtgtgatttatacaccctgatcaatcttgcatgcactaatactcacaccttggggcttttcatcgcagccaattcgggattcatttgtttgctcaattgtttgttgcttctggtgagctgcgtcgtgatcctgtattcactcaaaacccacagtcttgaggcccgacatgaggctctatcaacttgtgtatcgcacattactgtcgtcattctgagcttcattccttgcatatttgtctacatgcgacctcccgcaacactgcccatcgacaaagccgtcgcagttttttacacaatgatcacctccatgctgaatccccttatctatactctgaggaacgcacagatgaaaaacgctatccgtaagctctgcagtcgtaaggcaataagctctgttaaatag

SEQ ID NO: 52401 - DNA, 1113 bp, Artificial Sequence
  Description of Artificial Sequence: Synthetic coding sequence
atgtttagcatgacgacagaagccctcaataatttcgcactgggctgcacaaaccttttgatgaccatgatcccacagattgatctgaagcagatattcctctgtcccaactgcaggctatatatgatccctgtgggagcgttcatcttcagtttgggtaatatgcagaaccagtccttcgttaccgaattcgtactcttaggcctgtcccagaatccaaacgtccaagaaatcgtgtttgttgttttcctgttcgtgtacatcgccactgttggcggaaacatgctgatcgtagttacgattttgtcttcacccgcacttctggtcagccccatgtactttttcctgggcttcctcagttttctggacgcatgtttttcctccgtgatcacccccaagatgattgttgatagcctgtacgtcacaaagacaatcagctttgagggttgcatgatgcagctgttcgccgaacacttttttgccggagtagaagtgatagtcttgacggctatggcttatgaccggtacgtcgccatttgtaagccattgcactactcctcaatcatgaatcgacggctgtgcggcatcctgatgggtgtggcttggacagggggactgctccactcgatgatacaaattctgtttaccttccagttgcctttctgcggtcccaacgtgattaaccacttcatgtgcgatctgtacccactgctggagctggcatgcacagatacacatatatttggtctgatggtggtgattaatagtggttttatctgtatcatcaacttctccttgctgttggtcagctacgcagtcatcctgctctctctcaggacccactcttcagagggtcgttggaaggctctgtcaacctgcgggtcccatattgccgtggtgattttgttctttgttccctgcattttcgtttacacaaggccgccttccgcctttagcttagataaaatggccgctattttctatattattctcaaccccttactcaatccactgatctacacattccgcaataaggaagtgaaacaggctatgcgccgaatatggaacagacttatggtggtgtcagatgaaaaggaaaatatcaagctgtag

SEQ ID NO: 52402 - DNA, 933 bp, Artificial Sequence
  Description of Artificial Sequence: Synthetic coding sequence
atgcaactgaataacaatgttaccgagttcattttgctgggacttactcaggacccattttggaaaaaaattgttttcgtcatcttcctgaggctctacctggggactctactggggaatctgctcatcatcatctccgtcaagacttcccaagcgctcaagaacccaatgttcttctttctgttctacctatcactgagtgacacgtgtctctctacatccataaccccacgtatgatcgtcgatgccctgctgaagaaaactactatatcgttttccgaatgtatgatccaggttttcagcagccacgtcttcggatgcctggaaatctttatcttgattctcacagctgtggataggtacgtagatatttgtaagccgctgcattatatgactattatttcccagtgggtatgtggagtcctgatggctgtggcctgggtgggctcctgcgttcattccttagtccagattttcctcgccttaagtctacctttctgtggtccaaacgtcataaaccattgtttctgcgatctccaaccccttctgaagcaggcatgtagcgagacatatgtggtgaacctgctgctggtatctaactcaggtgcaatatgtgcagtgtcctatgtaatgttaattttcagttacgtgatattcctgcattccctacgtaatcactccgccgaggtgatcaaaaaagccctgagcacatgcgtgtcccatatcatcgttgtgattctttttttcggcccttgtatttttatgtacacctgcctcgcaaccgtcttcccaatggacaagatgatcgcagtgttttatacagtgggtactagctttctaaaccctgtgatctacaccctcaagaatactgaggtgaagtctgcaatgcgcaagttgtggtccaaaaagctcatcaccgatgataaaagatag

SEQ ID NO: 52403 - DNA, 990 bp, Artificial Sequence
  Description of Artificial Sequence: Synthetic coding sequence
atgcagctggtgctcctcctcatgttcttgctagtctttatcgggaacacagcccctgccttcagcgttacactcgagtcaatggatattcctcagaatattaccgagttttttatgctcggactttcgcagaacagcgaggtccagcgagtccttttcgtggtgttcctgctgatttacgtagtcactgtttgcggaaatatgctcatcgtggtaaccattacgtcctctcctactttggcttcaccggtctacttcttcctggccaatcttagttttattgatactttctatagcagttctatggccccaaaactcatcgccgattccctgtatgaaggccgaaccattagctacgagtgctgtatggcacagttgttcggggcacactttctcggtggtgtggagatcatactgcttaccgtaatggcctatgatcggtatgtagctatttgcaagcccctgcacaacacgactattatgacacgtcatttgtgcgccatgctggtaggcgtcgcatggctcggtggctttctccattctttggttcagctattgctagtcctctggcttcccttctgtggacccaacgtcattaatcacttcgcgtgtgacctgtacccactcctggaagtcgcttgcaccaatacgtatgtaatcggcttgttagtcgtcgccaatagcggccttatctgcttactgaattttctgatgttggcagcttcatacattgtgatattgtattctctccggtcccacagcgcagatggtagatgcaaggccctttccacttgtggggctcatttcatagtggtcgcccttttcttcgtgccttgtatctttacctacgtacacccattttctactctgcctattgataagaacatggcacttttttatggcatactgacacccatgttgaaccccctgatctacaccctcaggaacgaggaggtgaagaatgcaatgcggaagctattcacctggtag

SEQ ID NO: 52404 - DNA, 603 bp, Artificial Sequence
  Description of Artificial Sequence: Synthetic coding sequence
atcctgctcaccgtcatggcctacgatcggtacgtcgcaatatgtaaaccactacacaatacaacgatcatgacaaggcatttgtgcgcgatgctggtcggcgtggcatggttagggggtttccttcactcgttggtgcaactcctgctggtcctctggctgcctttctgcggcccaaatgttatcaaccatttcgcatgcgacttatatcccctgttagaggttgcatgtaccaatacatatgtcatagggctgctggtcgtggcaaattcaggattgatctgtctgcttaattttctgatgctagccgcttcatacatagtgatcctgtacagcctgcgcagccacagtgccgacggtaggtgcaaggctctgtccacatgtggggctcacttcatagttgtggcactcttttttgttccatgcatttttacatatgtacatccattctctacgctcccgattgataaaaatatggctttgttctacggcatcctgacacccatgttgaatcccttgatctacacactgcgcaatgaagaggtgaaaaataatacgatcaagcatttctggaaacacatcttggaggaggataagacttag

SEQ ID NO: 52405 - DNA, 981 bp, Artificial Sequence
  Description of Artificial Sequence: Synthetic coding sequence
atgtacgtgtctaattgtaacccctgcgcaatacatcggaaaatcaactatccaaacaccaaattggactttgagcaggtgaacaatatcaccgaattcatcttactggggttgacacaaaacgctgaggcgcagaaactactctttgctgtgttcaccctgatatactttttgaccatggtagataaccttatcattgtagtgaccatcacgacttcgcccgcacttgacagtcctgtctattttttcctctcattcttcagctttattgatggatgctcatcctccaccatggctcctaaaatgatatttgacctgcttaccgagaaaaagaccatatctttcagcggatgcatgacccagttattcgtagaacatttctttgggggagtcgagatcatcttactggttgtgatggcgtatgattgctacgtcgctatctgcaaacctttgtattacttgatcaccatgaaccgacaagtatgcggactgctcgtggctatggcctgggttggcggttttctgcacgcgctgattcagatgttattgattgtgtggctccccttctgcggtcctaatgttattgaccatttcatttgcgatctgttccccctattgaagttgtcgtgtaccgatacccatgtgttcgggctcttcgttgccgcaaattctggtctcatgtgcatgcttattttttcaattttgataacatcatatgtgctaattctatgttcacagcggaaagcgctaagcacttgcgctttccacatcactgttgtggtgctattcttcgttccttgcatactcgtgtacctgagaccaatgataacttttccaatcgataaagcagtgtcggtattctacacagtcgtgacccctatgcttaacccactgatatataccttacggaataccgaggtaaagaatgcaatgaaacagctttggagccagataatttgggggaataatttgtgtgattag

SEQ ID NO: 52406 - DNA, 930 bp, Artificial Sequence
  Description of Artificial Sequence: Synthetic coding sequence
atggaaaatcaaaataatgtgacggagttcatcttactagggctgaccgaaaacctagagctgtggaagatcttctctgccgttttccttgtgatgtacgtggcaaccgtccttgagaatctgctgatcgtcgtgactataatcaccagtcaatccctacgctcccctatgtatttttttctgacctttctgagtttacttgacgtgatgttttccagcgtcgtggcccctaaagtgatcgtggacactctgtctaagtcgacaactataagcctgaagggatgcctgacacagctatttgtagagcactttttcgggggagtcggaatcatactgttaacagtgatggcatatgataggtatgtagccatttgtaaaccactccactacactattatcatgagccctagggtttgctgtctgatggtgggtggtgcctgggtcgggggattcatgcacgccatgatccagttactgtttatgtaccaaattcctttttgtggacctaacatcattgatcactttatctgtgatctgttccagttactcaccttggcctgcacagatacccatattctaggcctgttagtgacattaaactccggaatgatgtgcgtggcgatcttcctgattctgatcgcaagctacacggttatactgtgctccctgaagagctattccagtaaggggagacataaggctttgtctacatgtagtagtcaccttacggtcgtggtcctcttttttgttccctgcatatttctgtatatgcggccagtggtcacacatcccatcgataaggctatggccgtaagcgatagcatcataacaccgatgttgaaccccctgatctacacgttgcgtaatgccgaagtgaagtctgccatgaaaaagctttggatgaaatgggaggcgctggctggcaaatag

SEQ ID NO: 52407 - DNA, 933 bp, Artificial Sequence
  Description of Artificial Sequence: Synthetic coding sequence
atggagccgcaaaacaccacccaggtctccatgttcgtgttgctaggcttctcccaaactcaagaactgcaaaaatttctgttccttctgttcttgctggtttatgtgactactatagtagggaacctgttaatcatggtgaccgtgactttcgactgccgcctccatacgcccatgtacttcctgctgagaaatctggccctcatcgacctctgctattccacagtaaccagcccgaagatgcttgtggactttctccacgagaccaaaacgatctcttatcaaggctgtatggctcaaattttttttttccacctgctcggcggaggcacggttttttttctgtctgtcatggcctacgacagatacatcgccatcagccaaccgctcagatatgtgaccatcatgaatacccagctatgcgtggggctcgtcgtggccgcttgggtggggggattcgtccactcaatcgtgcagctcgctctgatcctgcctctaccgttctgcgggcctaacatactggataatttttattgcgacgttccccaggtgctgcgcctggcctgtaccgacacaagtctgctggagttcctgatgatcagtaactctggcctgttggtgatcatctggttcctcctgctattaataagctacaccgtgattttagtgatgttgagatcccacagtggcaaagccaggagaaaagccgcttctacctgtacaacacacattatagtggtgtcaatgattttcatcccctgtatatacatctacacatggccctttacaccattcttaatggacaaggctgtatcaatttcttatacggttatgactcccatgctcaaccctatgatttacacactgagaaatcaagacatgaaggctgccatgaggcggctcggcaagtgccttgtgatctgcagagagtag

SEQ ID NO: 52408 - DNA, 936 bp, Artificial Sequence
  Description of Artificial Sequence: Synthetic coding sequence
atggagatggagaactgtacgcgtgtgaaagagtttatttttctgggtcttacccagaaccgggaggtaagtctggtgctctttctcttcctgttgctggtctacgtcactactctgctggggaatctccttattatggtcacagtgacctgcgagtccaggttgcatacaccaatgtactttctcttgcacaatttgagtatagcagacatctgtttcagttcaatcactgtgccaaaggtgctggtcgacctcctgagcgagagaaaaactattagcttcaaccactgcttcacccagatgttcttgttccatctgataggtggggtggatgtgttcagtttgtccgtgatggcactagatcgatacgtagctatcagcaaacccctgcactacgcgactattatgagccgggatcattgcattggactaaccgtcgccgcatggctcggtggattcgtccacagtattgtccagatctctttactgctccctctgccattctgcgggccaaatgttctggacaccttctattgcgacgtccatcgtgtgctcaagcttgcccatacggatattttcatcctggaattgctgatgatctccaataatggcttacttaccacactatggttctttcttttgcttgtctcctatattgtcatcctgtcactaccaaaatcacaggccggagaaggcaggagaaaggctatcagcacatgcacctcacacatcacggtggtgaccttgcatttcgtgccatgcatctacgtttacgctcgcccttttactgctttaccaatggataaagcaatctcagtcacattcactgtcattagcccactgttaaatcctttgatctacacacttcgtaaccatgagatgaaatcagcaatgcggcgactcaagcgtcggttagtgcccagtgaccgaaagtag

SEQ ID NO: 52409 - DNA, 936 bp, Artificial Sequence
  Description of Artificial Sequence: Synthetic coding sequence
atggagcttggcaatgtaacacgggtgaaggagtttatatttcttggcctgactcaaagccaggaccagagcctggtactgttcctgtttttatgcctggtgtatatgaccaccctacttgggaacctcttaatcatggtgaccgtgacttgcgagagcaggctccatacccctatgtacttcctcttacggaatcttgccatcctagacatctgcttcagctctacaaccgcaccgaaagttcttctggacctcttgtcaaagaagaagacaatctcatacacttcatgtatgacccaaatttttttattccacttattaggtggcgcagatatattttcattatctgtgatggcatttgactgttacatggccataagcaagccactccactacgtgacaatcatgagcagaggtcagtgtacagccctaatctcagcctcctggatgggtggttttgtgcattcaatcgtgcagattagcctcctcctccctctgccattctgcgggccaaatgtgctggatacattttattgtgatgttcctcaggtgctcaaacttacctgcaccgatacatttgcgctggagtttctgatgatttctaataatggactggtaactaccctttggttcatattcctcctggtatcttataccgtcatccttatgacacttcgctctcaggcagggggtggtaggcgcaaagccataagcacttgtaccagccatatcaccgttgtaaccctccacttcgtgccttgtatttacgtttacgccaggcccttcaccgcacttcccactgagaaagctatttccgttacgttcaccgtcatctcgcctctgctcaacccgctaatctatactcttagaaatcaggagatgaaaagtgctatgcgaaggctgaagcgccgattggttccttccgagcgggaatag

SEQ ID NO: 52410 - DNA, 924 bp, Artificial Sequence
  Description of Artificial Sequence: Synthetic coding sequence
atggagactggcaacctgacttgggttagcgatttcgtctttttagggctgtctcagacacgagagctccagaggttcttgttcctgatgtttttgtttgtttatatcacgactgtgatgggcaacatcttgatcataattaccgtgaccagcgactcccagctccatacacctatgtattttcttctgaggaatctggcagtgcttgatctatgtttctcaagcgtaactgcacccaagatgctagtggatctactatctgaaaaaaaaacaattagttatcaaggctgtatgggacagattttcttcttccatttcctgggaggagccatggtgtttttcctcagcgtgatggcgtttgacaggttaattgccatttctcgtccactacggtacgttacagttatgaatacacaactgtgggtcggtctcgtggtcgccacctgggtgggtggatttgtacatagcattgttcagctggccctgatgctgccactaccgttttgcgggcctaacattctcgacaacttctattgcgacgtcccccaagtgcttaggttggcctgtacggacacttcgctgctcgagttcttaaagatctccaacagtggtctccttgacgtcgtctggttctttttgttattgatgagttatctgttcattctggttatgctccggtcgcatccgggtgaggcccgtcgtaaagctgcaagtacttgcactacccatatcatcgtcgtttccatgatttttgttccgtccatctacctttatgctaggcctttcacaccgtttccaatggataagctcgtgtctattgggcatacagtaatgactcccatgctcaatcccatgatctacactttgcggaaccaggacatgcaggccgctgtgcgtaggttgggcaggcaccgcctggtctag

SEQ ID NO: 52411 - DNA, 957 bp, Artificial Sequence
  Description of Artificial Sequence: Synthetic coding sequence
atgaatcccgctaaccattctcaggtggctggcttcgtccttctcggcttgagtcaggtgtgggaactgaggtttgtgttcttcacagttttctccgcagtctattttatgacagtggttgggaatttacttatcgtagtgatcgtgacttcggatccccacctgcatacaacaatgtattttttgctggggaacctgagtttcctggacttctgttatagctctattacagcccctcgcatgttggttgacttgctgtcaggtaatcccactatatcatttggaggttgccttactcagctgttcttctttcactttatcggcggtattaagattttcctgctgaccgtaatggcctacgaccgctacatcgccatttcacagcctctgcactacactctcattatgaatcagacagtgtgcgctttattgatggctgccagttgggtgggagggttcatacactccatcgtgcagatcgcgctgaccatccagctccccttttgtggcccagataaattggataatttctactgcgacgttccacaactaataaagctggcgtgcactgacaccttcgtcctcgagctgctgatggtctctaacaacggcctggttaccctgatgtgcttcttggtcctgctagggtcctacaccgcgctgctcgtaatgttgaggagtcatagtcgtgaaggcaggtctaaagccctgagcacttgcgcttcccatatcgcggtggtcacactcatttttgtgccgtgcatttacgtgtacacacgaccctttaggaccttcccgatggataaagctgttagcgttctttacactattgtcacccctatgcttaatcctgcaatttacaccttacggaataaggaggtgatcatggctatgaagaagctgtggcgaagaaaaaaggatccgattgggccactcgaacatcgccctttgcactag

SEQ ID NO: 52412 - DNA, 945 bp, Artificial Sequence
  Description of Artificial Sequence: Synthetic coding sequence
atggaccagatcaatcacactaatgtgaaagagttctttttccttgagctgacgcggtctagggagctggagttcttccttttcgtcgtgtttttcgcagtttacgtggcaaccgtcttagggaatgccttgattgtggtgaccattacgtgtgagagccgccttcacaccccaatgtatttcttactgagaaataagtccgtgttggacattgtcttttccagtatcactgtgcctaaatttttagtggacttattgagtgatcggaaaactatctcctacaatgattgtatggcccagatttttttctttcactttgcaggtggcgcagacatcttcttcttgtctgtcatggcttatgataggtatctggcaatagccaagcctctgcactacgtgactatgatgagaaaggaggtttgggttgctctcgtggttgcctcatgggtttctggagggcttcacagtatcattcaggttatattgatgctccccttccctttctgcgggcctaatacgttggatgctttctactgttatgtcttacaagtggtgaaattggcctgcacggatacatttgctctcgaactgttcatgattagtaacaacggcctggtgacacttctgtggttcttactcctgctggggtcctataccgtgattttagtgatgctgcgctctcattccggagaggggcgtaacaaagcactgtccacgtgtacatctcacatgctggtggttaccctccactttgtaccctgtgtttacatttattgtcgcccatttatgactctgccgatggatactaccatcagtattaataacacagtcattaccccaatgctgaatccaattatttacagtctcagaaaccaggaaatgaagagcgctatgcaacgattgcagaggaggttgggtccctctgagtcacgcaagtggggctag

SEQ ID NO: 52413 - DNA, 945 bp, Artificial Sequence
  Description of Artificial Sequence: Synthetic coding sequence
atggaccagaggaattatacgagagtgaaagagttcacttttctgggcattactcagtcccgcgagctgagtcaggtactcttcacgttcctgtttctggtgtatatgaccacactgatgggcaatttcctgataatggttacggtgacatgcgagagtcatctgcataccccgatgtattttctccttcgcaatctgagtatcctggatatctgctttagcagtatcacagcgcctaaggttctgattgatcttcttagcgagaccaagacaatctccttctcaggctgtgtcacgcaaatgttcttctttcaccttttggggggtgctgatgtattcagtttatcagtgatggcttttgacagatacatcgcaatctctaagcctctccattacatgacaatcatgtctagaggcaggtgcaccggcctcattgtggcctcctgggtgggaggcttcgtgcactcgatcgcccagatttccctactcctgccactgcctttttgtggacccaacgtgttggacactttttattgtgatgtgccccaagttctgaagctggcctgcacggacacgttcacacttgaacttctgatgatctccaataatgggttggtatcatggtttgtattctttttccttttgatctcctacactgtgatcctcatgatgctcagatcccacacaggggaaggtaggcgaaaggccatcagtacctgtacaagccacattaccgtcgtcacactgcactttgtgccatgtatctatgtttatgcaagacctttcaccgccttacccactgacaccgccatcagtgtcaccttcactgtgattagccctctgctcaatcccataatttacacgcttaggaaccaggaaatgaagttggctatgcggaaactaaaaagaagactgggacaatcagaaaggatcctgattcagtag

SEQ ID NO: 52414 - DNA, 942 bp, Artificial Sequence
  Description of Artificial Sequence: Synthetic coding sequence
atggatagtcttaaccaaacgcgggttacagagttcgtgttcttagggctcactgacaaccgggttcttgaaatgctattctttatggcctttagtgcgatatatatgcttacgctctcaggcaatattctgatcataatagcaactgtttttaccccaagcctccatacgcctatgtacttttttctatccaatctgtcatttattgatatttgtcacagctccgtgacagtaccaaaaatgctcgaggggctgttgctggagagaaagacaattagcttcgataactgcattactcagctttttttcctccacttatttgcttgcgccgaaatcttcctgctgattatcgtggcctatgaccgctacgtagcgatttgcactcccctgcattaccctaacgtgatgaatatgcgcgtgtgtatccagctggtgttcgcattatggctcggaggcactgtgcattccctgggccagacttttctgaccattcggctgccatattgtggtcctaacatcatcgactcatatttctgcgacgtgcccttggtgattaagctggcatgcaccgacacctatctcacaggcatcttaattgtcactaacagtggaactatttcactgtcctgtttcctggccgtggttaccagctacatggtcattctggtgtccctgagaaagcactcggcagaagggaggcagaaagccctgtctacatgttccgcacacttcatggtcgttgccctcttttttggcccatgcatcttcatatacacccggcctgatacaagctttagtatcgataaggtcgtctccgtgttttatactgtggtcaccccgctgctgaacccttttatctatactttgcgtaacgaggaggtaaagtccgcgatgaaacaactacgacaacgacaggtattctttaccaaatcctatacctag

SEQ ID NO: 52415 - DNA, 939 bp, Artificial Sequence
  Description of Artificial Sequence: Synthetic coding sequence
atgaatggcatgaatcattccgtggtatctgaattcgtctttatgggtcttaccaattctcgcgaaatccagctcttgctgtttgtcttctcactcctgttctacttcgcttccatgatgggcaatctagtgattgtattcaccgtgacgatggatgcacatctgcactcgccaatgtacttcctgttagctaatctctccattatcgatatggcgttttgctctattactgctccaaagatgatttgtgatatcttcaaaaagcacaaagctatctcttttcggggatgtatcactcagatctttttttctcacgccctcgggggaactgaaatggtactgctaattgccatggcttttgatagatacatggctatatgtaagcctttacattatctcactatcatgagcccccgaatgtgtctgtacttcttggccactagcagtattataggtctgattcactctttagtgcagctggtctttgttgtggacctgcccttttgtggacccaacatttttgattctttctattgtgacctaccgcgattgttaagattagcttgtactaatacacaggagcttgaattcatggttacggtgaatagtggcctgatctccgtgggctcttttgttctgttggttattagttacattttcatcctcttcaccgtctggaagcattctagtggtggcctagccaaggccttgtccacactttcagctcacgtgactgtggtgatacttttttttggacctctcatgttcttttacacctggccttcccccactagtcatcttgataagtatctggccatatttgacgcctttataaccccattcctgaacccggtgatttataccttccgcaacaaagacatgaaagtggctatgcgcaggctatgctcccggttggcccactttaccaaaattctctag

SEQ ID NO: 52416 - DNA, 939 bp, Artificial Sequence
  Description of Artificial Sequence: Synthetic coding sequence
atggatggcgagaaccacagcgtcgttagtgaattcttatttctgggccttacccactcatgggagattcagctgttgctcctggttttctcttcagtactttacgtcgcctcaatcaccgggaacatcctcattgtctttagcgtgacaaccgaccctcacctgcacagccctatgtattttctcctcgcttctctcagctttattgacctgggcgcatgctccgttacctccccaaagatgatctacgacctgttccggaaacgcaaagtcatctcgttcggtggctgcatagctcaaatcttttttatccacgtggtgggaggagttgagatggtgctgcttattgccatggctttcgatcgctacgttgcactgtgtaagccactacactatttgaccataatgtcgcctaggatgtgtctcagttttctggccgtggcttggaccctgggagtgtctcactctctgttccaattggccttcctggtgaatctggccttctgcgggcctaacgtgttagactctttttattgtgatctccctcggctcctcaggttggcctgcactgatacctatcgccttcagttcatggttactgtaaactccgggtttatctgcgtgggcactttcttcatcctgctcatctcctatgtgttcattctatttactgtgtggaaacacagttcagggggaagttcaaaagcactttcgacactgtccgcacattccaccgtcgtactgctcttcttcggcccacctatgttcgtgtatactagaccccatcccaattctcagatggataagttcctggctatttttgacgctgtactgacgccttttctgaatcctgtagtgtatacattccggaataaggaaatgaaggctgcaattaagagggtttgcaagcagcttgtgatctataagaggatttcttag

SEQ ID NO: 52417 - DNA, 918 bp, Artificial Sequence
  Description of Artificial Sequence: Synthetic coding sequence
atggtgactgagttcatttttcttgggctgtccgattctcaggggctgcagacatttctctttatgctgtttttcgtgttctacggaggcatagtctttggcaatctgctcatagtcatcaccgtcgtgagtgacagtcacctccatagcccaatgtattttctgctcgccaacctaagccttattgatctgtccctgagcagcgtgactgcccctaagatgatcaccgactttttctcacagcgaaaagtgatctcttttaagggctgcctagtgcagatattcctcttacatttttttggtggctccgaaatggtcattttgatcgccatggggttcgatcgatatatagcaatttgtaaacctctgcactacaccacaatcatgtgtggtaatgcttgcgtgggaatcatggccgtagcttggggaatcggcttccttcatagcgtcagtcagctcgctttcgcagtccacctccctttctgtggccctaacgaagtggactcgttttattgcgaccttccacgtgtcatcaaactggcttgcacggacacatacagactcgatatcatggttatcgctaattccggagttctgactgtgtgtagctttgtgctgctgataataagctacaccattattctgatgacaatacaacacagacctctggataagtcaagcaaggccctgtctacactgacagctcacattactgtcgtcctcttgtttttcggcccatgcgttttcatttacgcctggccatttccaattaaatccctggacaaatttcttgcagtgttttacagtgttattacgccactgctcaatcctataatttacacactcagaaacaaggacatgaagacagcaatacggcagctccggaaatgggacgctcacagtagcgtgaaattttag

SEQ ID NO: 52418 - DNA, 885 bp, Artificial Sequence
  Description of Artificial Sequence: Synthetic coding sequence
tccccaggccctgtgtttagttacccccctcccagtctgctcttcatcattcccgtcaagttgggactggagcattttttccacatcaaggtcactgcggaggctatcagctggaatgagagcacttctgagacgaacaatagcatggtgacagagtttatattcctggggctgtcggactcccaaggcctgcaaacgttcctcttcatgctcttcttcgtattttacggcggtatagtgttcggcaacctgctcatcgtgattaccgtcgttagtgactcccatctgcattccccaatgtactttctgctggccaacctgagcttgatcgatttgtccctttcctccgtaacagctcccaagatgatcaccgatttcttcagtcagcgaaaagtcattagtttcaaaggatgcctcgtgcagatcttcctactgcatttttttgggggatcggagatggtgattcttatcgctatgggtttcgataggtacatcgccatttgtaagcctctccattataccacaatcatgtgtggtaacgcatgcgtcgggataatggcggttgcctggggaattggatttctccacagtgtgtcccagcttgccttcgctgtgcacctgcccttctgtggtcccaatgaagtagactcattctactgcgatctgccaagagtaattaaacttgcctgcacggatacgtaccggctggatattatggtaatcgccaactcaggagtgctgaccgtctgctctttcgtgcttctgattatatcatacaccattatcctgatgaccattcagcaccgacctttggacaagtcctccaaggccctatcaacattgaccgctcacattacagtagtgttgctcttcttcgggccatag

SEQ ID NO: 52419 - DNA, 939 bp, Artificial Sequence
  Description of Artificial Sequence: Synthetic coding sequence
atggatggggagaatcactcggtggtgagcgagttcctgtttttgggcctgacacattcttgggagatccaattactgttacttgttttttcaagcgtactgtacgttgcttcaattacgggaaacattttcattgtttttagcgtgacaactgacccccatctgcactcgcccatgtacttcctgctcgcctctctcagctttatcgacttgggcgcatgttcagtcacctcacctaagatgatctatgatctgttccgcaagaggaaagtcatttcttttggcggttgcattgcccagatcttctttattcatgtgatcggaggagtggagatggtgttattgatcgctatggctttcgataggtatgttgccctttgcaaacccctgcattacctgacaattatgagcccaagaatgtgcctgtccttcctagctgtggcttggactctgggggtatcccactcactctttcagctagcatttttggtcaacttggctttctgcggccctaatgttctagatagtttttactgcgatcttccacgcctgttgcgcctggcctgtacagatacctacaggctccagtttatggttactgtgaattccggattcatatgcgtgggaacatttttcatcctgttaatatcgtatgtgttcatcctctttactgtgtggaagcattcgagcgggggatctagcaaggctctctcgaccttatcagcgcactcaacagtcgttctgctcttttttggccctccaatgttcgtgtatacaaggcctcatccaaattcacagatggacaagttcctggccatcttcgacgcagtcttaacgccgtttttaaatcccgtagtgtacacttttcgcaataaagaaatgaaggccgctattaagagagtgtgcaagcagttggtgatctataagaagattagttag

SEQ ID NO: 52420 - DNA, 939 bp, Artificial Sequence
  Description of Artificial Sequence: Synthetic coding sequence
atggacggcgaaaaccatagcgtggtcagcgaatttctgtttctgggactgacacattcctgggagattcaactgctcctgcttgtgtttagtagcgtactgtatgtcgctagcattaccgggaatattctgatcgtattcagcgtcacgaccgacccgcatttgcactcacccatgtattttttgctggcttctctcagtttcatcgatcttggcgcttgctcggtgacatccccaaagatgatctatgatttgttcagaaagaggaaggtaatttctttcggcggttgcattgcccagatttttttcattcatgttgtcggcggagtcgaaatggttcttctcatagctatggcgttcgataggtacgtggcactgtgtaagcccttgcactacctaaccatcatgagtccacggatgtgcttgtcttttcttgccgtggcatggacactcggagtcagccacagcctgtttcaactggccttccttgtcaacctagcgttttgtgggcctaatgtgctggatagtttctactgtgacctgcctcgtctgttaaggctcgcttgtactgatacctacagactacaattcatggtgactgttaactcaggattcatctgtgttggcacgtttttcatcctcctgatttcatacgtgtttattttattcaccgtctggaaacactcatccggagggtctagcaaagcattgtccaccctgtctgcacatagcaccgtggtcctcctgttcttcggtcccccaatgttcgtgtacactagaccccacccaaattctcagatggacaaattcctagcgattttcgacgccgttctgaccccttttttgaatcctgtcgtctatacctttaggaataaggaaatgaaagccgctatcaagcgcgtgtgcaagcaattggtgatctacaaacgaatctcatag

SEQ ID NO: 52421 - DNA, 939 bp, Artificial Sequence
  Description of Artificial Sequence: Synthetic coding sequence
atggatggggagaaccacagtgtggtgtccgaatttctgtttctggggttaactcacagctgggagatccagcttcttctgttggttttttccagcgtgctctatgtggctagtattaccggtaatatccttatcgtcttctctgtgactactgaccctcacctccactcccctatgtacttcctgctggcgtcactctctttcattgacctcggcgcatgctccgtcacttcccctaaaatgatctacgatcttttcagaaaaagaaaagttatctcatttggcggttgtattgcacagatcttcttcatccacgtggtcggcggagtggaaatggtgctactgatcgctatggctttcgataggtacgtggccctctgtaagccactccactacctcactattatgtccccaaggatgtgcctctcttttctcgccgtggcctggactctcggagtgtcacactcactgttccaactcgcttttctggtaaacctggccttttgtggccctaacgtgttggatagcttctactgtgacctgccccgtctgctccgtctggcgtgtactgacacatacaggctgcagttcatggtgacagtaaactccggattcatttgtgttggaacttttttcatcttgcttatctcctatgtgtttattctgttcacggtgtggaaacactcctccggtgggtctagcaaagcactctcgaccttgagtgcacacagtacagtagtccttctatttttcgggcctccgatgttcgtttacacgcgacctcatcccaattcacagatggacaaatttctagctatatttgacgccgtgctcactccatttttgaaccctgttgtatatacatttaggaataaggaaatgaaagctgcaattaaacgcgtatgcaagcagctggttatttataagaggatcagttag

SEQ ID NO: 52422 - DNA, 918 bp, Artificial Sequence
  Description of Artificial Sequence: Synthetic coding sequence
atggtaaccgagttcattttcttgggcttgagtgactctcaggaacttcaaaccttcctcttcatgctcttcttcgtgttttacggtgggatagtcttcggaaacttgcttattgtgataactgtagtctcagatagtcatcttcattctcccatgtatttcttgctcgctaatctatccctcatcgacctgtccttgtcctctgttacagctcccaagatgattacagattttttctctcaaaggaaagtcatttcattcaagggatgtctcgttcagatcttcctgctacactttttcggcggatctgaaatggtgatcctcattgccatggggtttgataggtacattgcaatatgcaagccactgcactacacgaccatcatgtgtgggaatgcatgtgtgggcatcatggctgtggcctggggtatcggcttcctacatagtgtctctcagttggctttcgctgttcatttaccgttctgcggcccaaatgaggtggattctttttattgcgacctgcccagagtcataaagctggcatgcactgatacatatcggctcgacatcatggtgattgccaatagcggtgtgttaactgtctgctcattcgtcctgcttattatctcctacacgatcattctaatgacaatccagcattgtccccttgataaatcttccaaggccttgtccaccctgacagcgcacatcaccgtagtgctgctcttcttcggtccgtgtgtgtttatctacgcctggccatttcccataaagtcccttgacaaattcctagctgtgttttactctgtgatcacacctcttttaaacccgattatctatacgctgcgaaacaaggatatgaaaaccgcaatcagacgactgcggaaatgggatgctcacagtagtgtgaagttctag

SEQ ID NO: 52423 - DNA, 918 bp, Artificial Sequence
  Description of Artificial Sequence: Synthetic coding sequence
atggtcactgagtttatctttcttggtttatcagactctcaggaactgcaaacatttctgttcatgctgttcttcgtgttttatgggggtatcgtctttggaaacctgctgatcgtgatcacagttgtctccgatagccatctgcactcgccgatgtatttcttgctcgctaatctcagtctgatcgatctctctctctcctccgtgacagcgccaaaaatgattacagatttttttagccagcggaaggtgataagcttcaaaggctgtttggtgcagatctttttgctccatttctttggcggatctgaaatggtcattttgattgctatgggcttcgatcgttacattgctatttgtaagcccttgcattataccaccataatgtgtgggaacgcctgcgtgggcatcatggccgtaacttggggtatcggatttctgcacagtgtgagccaactggccttcgctgtacatttgctgttttgcggacccaacgaagtcgactccttctattgtgacctgcccagagtcatcaagctggcatgtactgacacctaccgactcgatataatggtcattgccaattccggggtgctcacagtttgcagctttgtacttctgataatctcctacaccatcatactcatgacaatacagcatcgaccacttgataagtcaagcaaagctttgtcgactctgacggcacacattacagtcgtgctgctgttcttcggcccttgtgtttttatatatgcgtggcctttcccaataaagagcttagacaaatttctcgctgtgttttactccgtgattacccccctacttaaccccattatatacactcttagaaacaaggacatgaaaaccgccattcggcagctgcggaagtgggatgcccacagttcggtcaaattttag

SEQ ID NO: 52424 - DNA, 939 bp, Artificial Sequence
  Description of Artificial Sequence: Synthetic coding sequence
atggacgaagcgaaccactccgtggtgtccgagtttgtgtttcttggtctgtccgactcacggaagatacaactgcttctgttcctctttttcagcgtcttctacgtgtcctctttgatgggtaatctgctgatagtgctcactgtaacctctgaccccaggttgcaaagccctatgtattttctcctcgccaacttatccattatcaatttggtgttctgcagcagcactgccccaaagatgatttatgatctgtttcgaaaacataaaacaatctcctttggtgggtgcgttgttcagatcttttttatacacgcagtgggaggcacagagatggtcctcttgatagctatggccttcgaccgctatgtcgccatctgtaagcccctgcactatctgacaattatgaacccgcaaagatgtattctgtttctggtgatttcgtggataattggcataatccacagtgtgattcaacttgcctttgtggtggacctgttgttctgtggacccaatgaactggattcttttttttgtgatctgccccgtttcatcaagttggcctgtatcgaaacttatacgttgggctttatggtcacagctaatagcggattcatttctctcgcaagttttctgattttaatcatcagctacattttcattctggttacggttcagaaaaaatcatccggaggtatctttaaagccttttccatgctgtccgcccatgttattgtggtagttttggtgtttgggccactcatttttttttatatctttccttttccaactagtcacttagataagttcctggcgatcttcgatgccgttattacacctgtgctgaatccagtcatctacacctttcgtaacaaggagatgatggtcgctatgcggcgacggtgcagccagttcgtgaactatagcaagatcttctag

SEQ ID NO: 52425 - DNA, 936 bp, Artificial Sequence
  Description of Artificial Sequence: Synthetic coding sequence
atggcgcataccaatgaatcaatggtgtccgagtttgtactgctgggactgagtaacagctggggcttgcaactattctttttcgcaatttttagcatagtctacgtgaccagtgtccttggcaacgtgctcataatcgtgattatctccttcgactcacacctaaactccccaatgtatttcctgctatcaaatctttcttttatagatatctgccaaagtaactttgctacacccaagatgctggtcgatttttttatcgaacggaagaccatctcttttgagggatgtatggctcagatctttgtgctgcacagctttgtcgggtcagaaatgatgctgctggtggcaatggcctatgaccggttcattgcaatttgcaaaccactgcactacagcaccattatgaatcgccgattgtgcgtgattttcgtgtctatttcttgggcagtcggcgtcctacactccgtctcgcatttagcgtttaccgtagatctgcccttctgcggccctaatgaggtggattcatttttctgtgacctgcccttggtcattgaactggcctgcatggacacatatgagatggagatcatgacactgacaaattccggcctgatctccctgagctgcttcctggctctgatcataagctacactattattctgatcggcgtccggtgccggtccagttcgggtagtagtaaagccctcagtacccttactgcccacatcacagtggttatcctgtttttcgggccttgtatctatttctacatctggcccttcagtagactgcctgtggacaaattcctgtctgtgttttacacggtgtgtactccattattaaatcccattatttactccctgaggaacgaagacgtaaaagcggcaatgtggaagctgagaaatcgacacgtaaattcttggaagaattag

SEQ ID NO: 52426 - DNA, 915 bp, Artificial Sequence
  Description of Artificial Sequence: Synthetic coding sequence
atggaacgcgcaaatcattcagtagttagcgagttcattttacttggactctccaagtcccagaatctgcagatcctattttttctgggtttttccgtggtgtttgttggcattgtgctcggcaatttactgattttggtgaccgttacattcgactctttattacatacacctatgtactttctcctctctaatcttagctgcatcgacatgatcctcgcctcgttcgccaccccaaaaatgattgtggactttcttagggaaagaaagactatctcatggtgggggtgttatagccagatgttctttatgcacctcctcggaggttccgaaatgatgctgctggtagccatggcaattgacaggtacgtcgctatatgtaagccactgcactatatgacaattatgtccccgcgagttctgaccgggcttctgttaagctcttacgctgtaggttttgtccattcttcttctcagatggcttttatgctcaccctgcctttctgtggccctaatgtgattgacagcttcttctgcgacctccctctggtgataaaactggcctgcaaggatacctatatcttacagctgttggttatcgctgactccggactgctgtctctagtgtgtttcctcttactgctcgtgtcatatggggtcattatcttttctgtccggtatcgggctgctagccgatcctctaaagcgttctctacactgtcagctcatattaccgtcgtgaccctgttctttgctccatgtgtgtttatctacgtttggcccttctcccgctacagcgtggataaaatcctgagtgtattctatactatctttacccccctgttgaatcccattatctacaccttgcggaaccaggaagttaaagcagctatcaagaaacgcttgtgtatctag

SEQ ID NO: 52427 - DNA, 933 bp, Artificial Sequence
  Description of Artificial Sequence: Synthetic coding sequence
atggacccccaaaactattccctcgtgtcagaatttgttctgcacggtttatgcacctcacgtcacctgcagaactttttcttcatcttcttcttcggagtgtacgtggcgatcatgctgggtaatctcctcatcctcgtcaccgtcatctccgacccctgcctccactcttctccaatgtacttcctgttaggcaatttggcctttctcgacatgtggctggcgagctttgccacccctaaaatgatcagagatttcctgagtgatcagaagctaatatccttcggcggatgcatggcgcagatcttttttttgcactttactggcggagccgagatggtactgctggtaagcatggcctacgacaggtatgtcgcaatctgcaagcccttgcattacatgactctcatgagctggcagacatgcatccgactcgtcttggccagctgggtggtgggattcgtgcacagcattagtcaggtggcctttaccgtgaacttaccctactgtggacctaacgaggtagattcgttcttttgcgacctgcccctagttattaaactcgcctgcatggacacatatgtcttgggaattatcatgatttccgacagcggcttgctttctctcagttgtttcctgctgcttctcattagctacaccgtgattctgttagctatccgccagagagcagccggatccacaagtaaagctctttcaacctgcagtgcccacataatggtcgtgaccttgttcttcgggccatgtatatttgtgtatgtgaggcctttttcccgcttttctgtggataaattgcttagcgtgttctacaccatctttactcccttacttaaccctatcatttatacgctcaggaacgaggaaatgaaagcagccatgaagaagttgcagaaccggcgagtgacctttcagtag

SEQ ID NO: 52428 - DNA, 1047 bp, Artificial Sequence
  Description of Artificial Sequence: Synthetic coding sequence
atgctgaccagtctcacggatctatgcttttcccccatacaagtggcagaaataaagagtctcccgaagtctatgaacgagacgaaccattcgcgagtgacggaattcgtgctactgggcctgagcagttcacgtgagctgcaaccctttctgtttctcacgttctctctcctgtacctcgctatcctgctcggcaactttttgatcattctgacagtcacttcggactcccgcctgcatacgcctatgtactttctattagccaatctcagcttcatcgacgtttgtgtggcttccttcgctaccccaaaaatgattgctgactttctcgtggagcgtaagacaattagtttcgacgcttgtctcgctcagatattcttcgttcacttgtttaccggttcggaaatggtgctgttagtctcaatggcctacgatcggtatgtagccatttgtaagcccctgcattatatgactgtgatgagccggcgagtatgtgtggtgctggtgttgatttcatggtttgttgggttcatccatacaacatctcagttggcttttaccgtgaacttacctttctgcggaccaaataaagtggactccttcttctgcgatcttcctttggttaccaaactggcctgcatcgatacgtatgtggtgtccctactcattgtcgccgattcgggtttcctgtccctgtcgtcgttcctcctgctggtggtttcatataccgtgatcctagttactgtgcgcaataggagctctgcatctatggccaaagccaggtctactttgaccgcccatatcaccgtcgtcacactgttttttggaccatgtatcttcatctatgtgtggcccttctctagttactcggtcgataaagttttagcagtattttacacaatcttcactctcattttgaatcctgtaatttacactttacgcaataaagaggtcaaggccgctatgagcaagctgaagtcgaggtatctgaagccatcacaagtgagtgtagtgatcagaaatgtgctttttctcgagacgaagtag

SEQ ID NO: 52429 - DNA, 1032 bp, Artificial Sequence
  Description of Artificial Sequence: Synthetic coding sequence
atggctctctacttttccctcatcctccatgggatgtctgatctgtttttcttgagcacagggcaccctcgcgcatcgtgcaggatggaagctatgaagctgttaaaccaatcacaagtttccgagttcattctcttggggctcacatctagtcaagatgtcgaattcctccttttcgccttgttttccgtgatctatgttgtgactgtcttgggcaacctcctcatcatagtcacggtttttaacacccctaatttgaatacccctatgtattttctcctcggcaacttgtctttcgttgatatgaccttggccagttttgctactccaaaggtgatcttgaacctactgaagaaacagaaagtgatctcattcgccggttgctttactcagatcttccttctgcaccttctggggggtgtcgagatggttctgctggttagcatggcctttgatcgctatgtggcaatttgcaaaccactccattatatgacaattatgaataaaaaggtttgcgtcttgctggttgttacctcgtggctgctggggctcctgcacagcgggttccagatcccgttcgcagtcaacctgcctttttgcgggcctaatgttgtcgattccatattctgtgatttaccattggtgaccaagcttgcctgcattgacatttactttgtgcaggtggtgatcgtggctaatagcggtatcattagcctgagttgttttatcattctactcatctcatatagccttatcctcattactatcaaaaaccattctccgaccggccagtccaaagccaggtccaccctcacagcccatatcactgtcgttatacttttttttggcccttgcatttttatctacatctggccatttggaaatcattccgtggacaagttcctcgccgtgttttacacaattattacccctatcctgaatccaattatctatactctgagaaacaaggagatgaaaattagtatgaaaaagctttggagggcttttgttaatagtcgggaggatacctag

SEQ ID NO: 52430 - DNA, 945 bp, Artificial Sequence
  Description of Artificial Sequence: Synthetic coding sequence
atggatgtaggtaataagtccacaatgagcgaatttgtattgcttggattgagtaactcttgggaactgcagatgttctttttcatggtcttctcactcctgtacgtggctacaatggtgggcaacagcttgatagtgatcacggtgattgtcgatccccatctgcattctccaatgtactttcttctcacaaatctgtccataattgatatgagcctggcttctttcgctacccccaaaatgatcacagattatcttactggccacaaaacaatcagtttcgacggctgtcttactcagattttctttctccacttatttacaggtacagagattatccttctcatggccatgagctttgatcggtatattgcgatctgtaagcctctgcactacgcttccgtgattagccctcaggtgtgtgtagcgctggtggtcgccagctggatcatgggtgtgatgcactcgatgtcacaagtgattttcgccttgacacttcctttctgcggaccctacgaggtcgactcctttttttgcgatctgcccgtggtgtttcagctggcatgtgtagatacctatgtactgggcctatttatgatctctacaagtggcattatagcactctcttgctttattgtgctattcaattcttatgttattgtgctggtgactgtgaaacaccattccagtcggggatcctccaaagctctaagcacttgtacggcacattttattgtagtgtttttgttcttcggaccatgcattttcatctacatgtggccactgtcatccttcctgaccgacaaaatcctttctgtattttatacaatcttcacaccaacccttaatcccataatctatactctgcggaatcaagaggtaaaaatcgcaatgaggaagctcaagaatagatttttaaactttaataaagccatgccctcttag

SEQ ID NO: 52431 - DNA, 972 bp, Artificial Sequence
  Description of Artificial Sequence: Synthetic coding sequence
atggacaagagcaactcttccgtagtatccgaattcgtcctgctggggttgtgttcttctcaaaagttacagctcttttatttttgcttcttctccgtcctgtatacagtgatcgtgcttggaaacttgttaattatactgacagtgactagcgacacttctctccactcacccatgtattttctgctggggaacctcagcttcgtggacatctgccaagcaagtttcgcaactcctaaaatgatagccgacttcttatctgcccacgagactatttcgttcagcggttgcatagcacagatcttctttattcacctgtttacaggaggagaaatggtcctgttagtgtcaatggcgtatgaccgctacgtggccatctgcaaacctctgtactatgttgttattatgagcaggcgaacatgtactgtgctggtgatgatctcctgggccgtgtcactggttcatacactcagtcagctgtcctttacagttaacctgcctttttgcggcccaaatgtcgtcgatagctttttctgtgacctgcccagggtcacgaagttggcgtgcctggactcctacattattgaaattttgatcgtagtgaattccggaattctctcattaagtacattctctctactggtatcctcctacataatcatactcgtaaccgtgtggctaaagtcttccgcggctatggccaaggcattctccaccctggcctctcacattgctgtcgtaatcttatttttcggaccctgtatatttatttacgtttggccgttcactatttcaccgctggacaagtttctggcaattttctatacagtgttcacacctgtccttaacccaatcatatacacactgcggaatagggacatgaaagccgcagtacggaagatagtgaatcactatctgagaccaaggcgcatttccgaaatgagtctggtcgtgcgtacaagcttccactag

SEQ ID NO: 52432 - DNA, 939 bp, Artificial Sequence
  Description of Artificial Sequence: Synthetic coding sequence
atggacttgaaaaacggctcactggtaactgagttcatcttgctgggctttttcgggcgatgggagctccagattttcttcttcgttacattcagtttgatctatggagcaacggttatgggcaatattctaataatggtgaccgttacatgccgatcaactttgcactcccctttatatttcctcctgggaaatctgagcttccttgacatgtgtctctccaccgcgacgactcccaaaatgattattgatctgctgacggatcacaagaccatttctgtgtggggctgcgttacccagatgttcttcatgcacttttttggcggagctgaaatgaccctgctgataataatggcctttgacaggtatgtagcaatttgtaagcccctccactaccgaacgatcatgtcacacaagctcctcaagggattcgcgattctcagttggataatcggcttcctgcactccatttcacagatcgtgctcaccatgaaccttccattctgcggacacaacgtgatcaataatatcttctgtgacctgccccttgttatcaaactagcatgcatcgaaacttacactctggagctttttgtgatcgccgatagtgggctattgtcgtttacgtgcttcattttgttgctggtaagctatattgtgatccttgtgtctgtgcctaaaaagtcgtcgcatggtctgtcgaaggctctttcgactctgtcggcccacattattgtggtgactctgttttttggcccatgcatctttatttacgtgtggccattttcctccctcgcaagcaataaaacgctggctgtgttttacactgtgataaccccactgctcaacccatcaatttatactctccgaaataagaaaatgcaggaggccattaggaaactcagattccaatatgtgtcttctgctcagaacttctag

SEQ ID NO: 52433 - DNA, 942 bp, Artificial Sequence
  Description of Artificial Sequence: Synthetic coding sequence
atggagacggccaattataccaaggtgacagagttcgtgctgacaggtttgtctcagactcgtgaagtacagctggttctgttcgtgattttcctgtctttctacttgtttatcttgcctggcaatatactcatcatctgcacaattcggctggacccccatttaacatcccccatgtacttcctgctggctaatctggccctgctcgacatatggtattcgtctataaccgcccctaagatgctgatcgattttttcgtggagcgcaaaataatatcctttgggggttgcatcgcccagctcttctttctccattttgtaggagctagcgaaatgtttctgcttacagtgatggcctatgatagatacgccgctatctgcagacctctgcattatgcgacaattatgaatcggcgactctgttgcattctcgtagccctttcctggatgggcggttttattcactccatcatccaggtggccctcatagtgaggttacccttttgcggccctaatgagttggatagttatttttgtgacataactcaggttgtcagaattgcgtgtgcaaacacttttcccgaggagctggtcatgatttgttccagcggcctcatcagcgtggtttgctttattgcactgctgatgtcctatgctttcttactcgcgctcctgaagaaacattcagggtcgggagaaaacactaatcgcgctatgtcaacctgttatagtcacataacaatcgtggtgttaatgttcgggcctagtatctatatttatgctcggccattcgattcttttagtttagacaaggttgtgagcgtgttccacaccgtgatttttccactcctcaaccctattatctatacacttcgaaacaaggaggtaaaggccgcaatgagaaaagtggtcacaaaatacatactgtgcgaggagaaatag

SEQ ID NO: 52434 - DNA, 942 bp, Artificial Sequence
  Description of Artificial Sequence: Synthetic coding sequence
atggagacagctaattacaccaaagtgacggagttcgtcctgacaggtctgagccagactcctgaggtgcagctggtgttgtttgtgatcttcctgtctttttacctatttatcttacccggtaatatcctcatcatctgcaccatcagtctggaccctcacctgacgtcccctatgtactttttgctagcaaacctggctttcttggatatatggtactcctccatcactgcgcctgagatgcttatcgatttctttgtcgagaggaagatcatttcattcgacggatgcattgctcaactctttttcctgcattttgccggtgctagcgagatgtttctgctgacggtaatggcatttgatctctatacggccatttgccgccctctgcactacgctaccatcatgaatcagcgactctgttgcattctggtagccctgtcttggcgcggaggattcatacactccattatacaggtagccttgattgtgagactacctttttgtggcccaaacgagttggactcttacttttgtgacattactcaggtagtcaggatcgcgtgtgccaatacctttcctgaagaattggtgatgatttgctcttcgggcctaatcagtgttgtgtgtctgattgcattactgatgtcatacgccttcctgctagccctgtttaaaaaactgtccgggagcggggaaaataccaacagagctatgagtacatgctactcccatatcacgatcgttgtgctgatgttcggcccatcaatatacatatacgcgaggcccttcgatagcttctcattagacaaagtggtttccgtatttaatacactcatttttcctctgagaaacccgataatatacacactgcgtaataaggaggtgaaagccgcaatgcgaaagttggtgaccaagtacatactgtgtaaggaaaagtag

SEQ ID NO: 52435 - DNA, 924 bp, Artificial Sequence
  Description of Artificial Sequence: Synthetic coding sequence
atggagtccgaaaatcgcacagtgatccgagaattcatcctcctgggactgacccagtcacaagatatccagctactggtgtttgtcctcgtgctgatattctactttatcattcttccaggcaacttccttattatattcaccattaagtccgaccccggattgaccgcacccctgtatttctttctcgggaatcttgccttccttgacgcgtcctacagttttatcgtggcccctcgtatgcttgtcgattttttgtccgcaaaaaaaattatttcctacaggggttgcatcactcagctgttttttttgcactttcttggtgggggagagggcctcctgctagtggtaatggcatttgaccgatacattgctatctgtaggccactgcactaccctaccgttatgaaccccagaacctgctacgctatgatgctggctctgtggctaggaggctttgtccattctattatacaggtcgtcctaatcttgcggctccccttctgcgggccaaatcagttagacaattttttctgcgacgtgccacaggtgatcaagctggcatgcaccgatacttttgtagtggagttgctgatggtgttcaattctggactgatgacattattgtgttttcttggtctgctcgctagttatgccgtgattctctgcagaataagaggttcaagcagcgaggcaaagaataaggctatgtcgacctgtataacccacattattgtgatcttcttcatgtttggccctggtatttttatctacacaagaccgtttcgagccttccccgctgacaaagtggtcagtcttttccataccgtgatcttcccattgcttaatcctgttatatacacactcagaaaccaagaagtcaaggcctctatgaaaaaggttttcaataaacatattgcctag

SEQ ID NO: 52436 - DNA, 66 bp, Artificial Sequence
  Description of Artificial Sequence: Synthetic coding sequence
atggagagcgagaataggactgttattcgggagttcattctgcttggccttacccagagccagtag

SEQ ID NO: 52437 - DNA, 441 bp, Artificial Sequence
  Description of Artificial Sequence: Synthetic coding sequence
atggaaagcgagaatagaaccgtcatacgcgagtttatcttacttggactgacacagtcacaggacattcagctgctggttttcgtcctcgtcctcatcttctacttcattattcttcccggtaatttcttgatcatctttaccatcaaatctgatccagggctcacagcccctctgtactttttccttggaaatttagcctttctagatgcttcctactcctttattgtcgccccacgcatgcttgtggactttttgagtgcaaagaagattatttcttatagaggctgcattacacagctctttttcctacatttcttaggagggggagaaggcctgctcctggtggtcatggcattcgatcgctacattgctatatgtcgtcccttacattaccctaccgtaatgaatcccaggacttgttatgctatgatgctatag

SEQ ID NO: 52438 - DNA, 951 bp, Artificial Sequence
  Description of Artificial Sequence: Synthetic coding sequence
atgaaaatcgccaataataccgttgtcaccgaattcatcctgctgggtctgacccagagccaggacattcagctgctggtgttcgtgctcattttaattttctacctgattatactacctgggaattttctcatcatttttacaatacgatccgacccgggtctaactgctccattgtacttattcctggggaacctggcatttctggacgcttcatatagtttcatcgtcgccccacgtatgcttgtggactttctctcggagaagaaagtcatctcatatagaggatgcatcacccaattatttttccttcacttcttggggggtggcgaagggttgctgctggttgtgatggccttcgatagatatatcgccatctgtaggcccctgcactgcagcacagtcatgaatcccagggcctgctacgcaatgatgctcgcactgtggctcggcggttttgtacattccatcatacaggttgtgctgattctgagactgccgttttgcggacctaatcaactggataattttttttgtgacgtacgccaggtgataaagctcgcctgtacagatatgttcgtcgtagagctgcttatggtgttcaatagcggactcatgacccttctctgcttcctgggactattagctagttacgcggtcattttatgtcatgtacggagagccgcaagtgagggtaagaacaaggcgatgtcgacctgtaccacaagggtgattattatactgctgatgtttggccctgccattttcatctacatgtgtccattccgggcattaccagctgataagatggtctcactttttcacactgtaatctttcccttgatgaaccctatgatctataccctccgcaatcaggaagtgaaaacgtcaatgaagcggctgctttctcgtcatgtggtgtgccaagtggattttataattcgcaattag

SEQ ID NO: 52439 - DNA, 927 bp, Artificial Sequence
  Description of Artificial Sequence: Synthetic coding sequence
atggaaacccagaacctaacagttgtgaccgaatttatccttctcggactgacacagtcacaggatgctcagttacttgtcttcgttctggtgttgatcttttacctcattatcctgccaggtaattttctgattatttttacaatcaagtctgacccaggactgacagcacctctgtattttttcttgggcaacctggctctgctcgatgctagctatagcttcatagttgtgcctaggatgcttgtcgatttcctgtcggagaagaaggtcatatcctaccgctcctgtatcactcagctgtttttcctgcactttcttggagctggggagatgtttctgctggtggtgatggcattcgataggtatatcgctatttgcaggccgcttcattatagcaccattatgaatcctagagcctgctacgcactctctcttgtgctgtggctcgggggattcatccattcgatcgtgcaagtggcccttattctgcaccttcccttttgtggacccaatcagcttgacaacttcttctgcgacgtacctcaagtcatcaagcttgcatgcaccaataccttcgtggtggagctccttatggtcagcaactctggtcttctttcactattgtgcttcctcggcctacttgcctcgtacgcagtgattctgtgtcgtatcagggagcactcttctgagggcaagtccaaggccatatctacctgcactacccacatcataattatctttctcatgttcggtcccgcaattttcatatacacatgcccattccaggcgttccccgctgacaaggtcgtctcgctctttcataccgtgatcttccccttgatgaaccctgtgatctacacactgcgtaatcaagaggtcaaagccagcatgaggaaacttctttcacagcatatgttctgctag

SEQ ID NO: 52440 - DNA, 939 bp, Artificial Sequence
  Description of Artificial Sequence: Synthetic coding sequence
atggagaagagtaataacagcacgctattcatccttctgggattctcacaaaataaaaatatcgaggtcttgtgtttcgtattgttccttttctgctacattgccatttggatgggcaatctgctcatcatgatttccattacttgtacccagttgatccaccagcctatgtacttctttctaaattacctgtctctctccgacctgtgttatacctccactgtgacccctaaactcatggtggatctattggccgaaagaaaaacgataagctataataattgcatgatccagttgttcactactcacttcttcggaggaatcgagattttcattctcactggaatggcctacgatcgctatgtagctatctgcaagcccctccactacactatcataatgtctaggcaaaagtgcaataccataattattgtttgctgtacaggcggtttcatacatagcgcgtcacagtttttgttgaccatttttgtgccgttttgtggtcctaatgaaatcgatcattatttctgcgatgtgtatcccttattgaaattagcctgctctaatatccatatgatcggtttgctggtgattgccaacagcgggctgatagccttggttacgttcgtggtgctcttattatcctatgtgttcatcctgtacaccatccgcgcttactcagctgaacgacgcagcaaagccctagccacatgttcctcccacgtgattgttgtcgtgcttttctttgcccctgccctgtttatctacattaggcctgtcaccaccttctccgaagacaaggtcttcgccctcttttacaccattatcgcccctatgttcaatcccttaatctacacgttgcgaaatactgagatgaaaaatgccatgaggaaggtgtggtgctgccagatattgctgaaacgcaaccagttattttag

SEQ ID NO: 52441 - DNA, 942 bp, Artificial Sequence
  Description of Artificial Sequence: Synthetic coding sequence
atgaagaaggagcaggacagtaatgtgacagagtttgtcctgctcgggctatcctcaagttgggaacttcaactctttctgtttttactgttcctttttttctatatcgccatcgtcttagggaacctactgattgtggtgaccgtgcaggcacacgcccacctgctgcagagcccaatgtactacttccttgggcatctgtctttcatcgatctgtgcctatcttgcgtgaccgtccctaagatgctgggagattttctccagcaaggaaagtctataagcttcagcggatgtcttgctcaaatctacttcctgcatttcttaggtgctagcgagatgtttcttctgacggtgatggcatacgatagatatgtagcaatctgcaatcccctccgataccttactgtgatgaacccccagctgtgcctgtggctggtgctggcctgctggtgtggtggcttcatccactccatcatgcaagttatcctcgtgatccagctaccattctgcggccctaatgagttggacaacttctattgcgacgttccccaagttatcaagctggcctgcatggatacctatgtcgtcgaggtgttggtcatagctaactcgggcctgctgtcactcgtgtgtttcttagtgctattatttagctatgctatcatcctaattactctaaggacccacttttgccaggggcagaataaagtctttagcacatgcgctagccatttaacggtggtgtcccttatatttgtgccctgcgtgttcatctatctgaggcccttctgttcgttctctgtggacaaaatattctcacttttttatactgtcataacgccaatgttaaatccacttatttataccttgaggaatacggatatgaaaacagccatgaaaaagcttcggattaaaccatgcggaatacctttaccatgctag

SEQ ID NO: 52442 - DNA, 930 bp, Artificial Sequence
  Description of Artificial Sequence: Synthetic coding sequence
atgggagccaaaaacaacgtcaccgagtttgtcctgttcggcctgtttgagagcagagaaatgcagcatacatgcttcgtggtgttcttcctcttccacgtactcacagtacttggaaatctgcttgtgattattacgattaacgcacgaaaaaccctaaagtccccgatgtatttctttttaagccaactcagtttcgcagacatttgttacccgtctacgaccatcccaaaaatgatcgccgatacttttgtggagcataagattatcagtttcaacgggtgtatgacacagctatttagcgctcacttcttcggcggaactgagatattcctgcttactgccatggcttacgatcggtatgtcgccatttgccgtcctctccactacacggctatcatggactgtcggaaatgtggcttgctggctggtgcatcctggctcgcaggcttcctccactccattctgcagaccctgctcactgtgcagctgcctttctgcggtcctaacgagatcgacaattttttctgcgatgtgcatcctctgctcaaactcgcctgcgctgatacctacatggtggggttaatcgtggtcgctaacagtggcatgattagcctagcttcttttttcatattaatcatttcttacgttatcattctgctgaatctgaggtcacagagcagtgaggacagaagaaaagcagtgagcacttgtggatctcatgtgattactgttctcttggttcttatgccacccatgtttatgtacatccgcccatctactactctggcggctgataagctcatcattctgttcaatatcgtcatgccaccattattaaaccccctgatatacacccttcggaacaacgatgtgaaaaatgccatgaggaaactgttccgtgtgaaacgtagtctgggagagaagtag

SEQ ID NO: 52443 - DNA, 936 bp, Artificial Sequence
  Description of Artificial Sequence: Synthetic coding sequence
atggaaaagatcaataacgtaacagagttcatattttggggtctatcccagagcccagagattgagaaggtttgcttcgtggtgttctcattcttttatattataattcttcttggtaacttacttatcatgctgaccgtttgcctgagcaacctgttcaaatcacctatgtatttctttctctccttcttgtcgttcgttgatatatgctattctagcgtaacagccccaaaaatgatcgttgatctcttagcaaaagataagactatctcatatgtcgggtgtatgctgcagttatttggagtgcatttcttcggctgcacagaaattttcatcctgacagtgatggcttatgaccgctacgtcgcaatctgtaaacccctccactacatgaccattatgaaccgtgagacctgcaataaaatgctgctgggcacatgggtcggaggattccttcacagcattatccaggtggcactcgtggtccaactgccattttgcggccctaacgagattgatcactacttctgtgacgtccatccagtactgaaactggcatgcaccgagacgtatatcgtaggagtagtggtgacagcgaatagcgggaccatcgctctcggctccttcgtcattctgctcattagctatagtatcatcctcgtctccctgcgaaaacagagcgccgaaggccgtcgcaaggcattaagcacttgcggctcgcacatagccatggttgtaatcttcttcggaccatgcacattcatgtacatgcggcctgacacaacattctccgaagacaaaatggtcgctgtgttttacacaataattactcccatgctgaaccccctcatctataccctccgcaacgccgaagtcaagaatgccatgaagaagctctgggggcgaaatgtgtttctcgaggctaagggcaagtag

SEQ ID NO: 52444 - DNA, 918 bp, Artificial Sequence
  Description of Artificial Sequence: Synthetic coding sequence
atggtggccacgaacaatgtcacagagataatcttcgttggtttctcacagaattggtccgagcaaagagtgatctccgtgatgttcctgctcatgtacactgcagtggtcttgggcaatgggttaattgttgtgacaattctggcttccaaggtgctgacatctcccatgtacttcttcctgtcgtatctctctttcgtggagatttgctattgctccgtgatggcgccaaagcttattttcgatagcttcattaagcgcaaagtgatttcactcaagggatgtcttactcagatgttctcactgcacttctttgggggtacagaggcgtttctgttgatggtaatggcttatgaccgttacgtcgctatttgcaagcccctccactacatggccataatgaatcagcgcatgtgcggcctattggtccgcatagcatggggtgggggattactccacagcgtaggacaaacattcttgatcttccagcttcccttctgtggccctaacataatggatcactatttttgtgacgtacacccagtgctagaattggcgtgcgcagacacattcttcataagtttactcatcattactaatgggggatctatttccgtagtatctttttttgtcttgatggctagttatcttatcatcttgcacttcttaaggtcccacaacctagagggtcagcacaaggccctgtcaacgtgcgccagccatgtaaccgtagtggacctgttttttattccatgctccttggtgtatatacgcccttgcgtcactctgccagccgataagatagtcgcagtcttctacaccgttgtcacccccctgcttaacccagtaatttacagtttccgaaatgctgaagtgaaaaatgcaatgcgaagatttattgggggaaaggtgatctag

SEQ ID NO: 52445 - DNA, 912 bp, Artificial Sequence
  Description of Artificial Sequence: Synthetic coding sequence
atgacagagttcatctttctcgtgctgtcgccaaaccaggaagtacagcgcgtctgtttcgttattttcctgttcttgtacaccgcgatcgtccttggaaattttctcatcgtcctcacagtgatgacaagtcgcagcttgggtagccccatgtatttctttctgtcttacttaagttttatggagatatgttattcttccgccactgctcctaagctgatcagtgaccttctcgctgaaaggaaggtgatttcctggtggggatgtatggcacagttgttttttctgcattttttcggaggaactgaaatttttttgctgactgtcatggcttatgaccactatgttgctatctgtaaacctctgtcgtacaccaccattatgaattggcaagtttgtacagtccttgtcggcatagcttgggtcggcggattcatgcattctttcgcgcagatcctgctgattttccacctcctgttctgtgggccaaacgtcattaatcactatttttgcgacctagtccctcttctgaaattggcctgcagtgatacttttcttattggcttgctgatagtcgcaaatggaggaacactcagcgtgatatcttttggggtgctgcttgctagctatatggttattctcctgcacctacggacctggagctcggaaggatggtgcaaggcgttatcgacatgcgggagtcacttcgctgttgtgatcctgtttttcggaccttgcgtgttcaactccctaaggccatcaacaactctcccaatagacaagatggttgctgtgttttacactgtgatcaccgcaatacttaatccagtaatatacagcctgcggaacgcagaaatgagaaaagctatgaagaggctctggatcagaaccctccgcctcaatgaaaaatag

SEQ ID NO: 52446 - DNA, 948 bp, Artificial Sequence
  Description of Artificial Sequence: Synthetic coding sequence
atgtccatcaccaaggcgtggaactcatcttccgttacaatgtttatcctcctcggtttcacagaccaccccgagttgcaggctctcttgttcgtaacatttctgggcatctatctcactaccctggcttggaatcttgccctgatctttctgatccgcggagacacccacctccacaccccgatgtattttttcttgagcaatctctcttttattgatatctgttactcctcagccgtggcacctaatatgctgacagactttttttgggaacaaaaaacaatctcctttgtcgggtgtgctgcccagttcttttttttcgttggcatgggactgtctgagtgcctcctgctaacggctatggcgtacgaccgctacgcggctatttcgtccccattactttatcccactatcatgactcaaggcttatgtactaggatggttgtaggagcctatgtgggtggttttctgtcttccttgatacaagcaagctctattttccgtttgcacttttgcggcccaaacatcatcaaccacttcttctgtgaccttccacctgtgctcgccctctcgtgctccgatactttcctgagccaagtggttaacttcctggtggttgtaaccgttggcggtacttcgtttctgcaactgctgattagctacgggtatattgtgtccgcagtgcttaaaattcccagtgcagagggcagatggaaagcttgcaacacctgcgcctcacacctgatggtcgtgacgttattgtttggaaccgctttgtttgtttatctgcgtccctcctcaagttacttgctaggacgggataaggtcgtgtccgtcttctattctttggttatccccatgttgaatcctttgatatactcactacgcaataaagagattaaagatgcactatggaaagtcctggagcgaaagaaggtgttttcctag

SEQ ID NO: 52447 - DNA, 975 bp, Artificial Sequence
  Description of Artificial Sequence: Synthetic coding sequence
atggccgtgggcagaaacaataccatcgtgaccaaattcatacttctcggcctcagcgatcacccgcaaatgaagatcttcctgtttatgctattcctgggattatatctactcacgttggcgtggaatctgtccctgatcgcattaatcaagatggacagccatctccatatgccaatgtatttcttcttatccaacctcagttttctagacatatgctacgtgagctccacggcaccaaaaatgctgtcagacataatcacagagcagaagactatttcttttgttggttgcgctacccaatattttgttttttgcggcatgggactgacagagtgcttcttgcttgccgctatggcatatgatcgctacgccgctatttgcaatccactcttatacaccgtgttaataagtcataccctgtgtctcaagatggtcgtcggagcgtatgtaggaggctttctgagctccttcattgaaacttacagcgtttatcaacatgacttctgcggcccatatatgatcaaccacttcttctgcgacctgccacccgtgctcgccctgagctgttctgacaccttcacaagcgaagttgtgacatttatagtgtctgtagtcgttgggattgtgtctgtcctagtggtgctgataagctatggctatattgtcgccgctgtggtgaaaatcagcagtgccaccggacggaccaaagcttttagtacatgtgcttcccatctgaccgcggtgacactgttttacggctctggatttttcatgtacatgaggccttcaagctcctactctcttaaccgcgataaggtggtgagtatattctacgcactagtgattcccgtggtcaacccgatcatttattcttttaggaataaagagatcaaaaacgccatgaggaaagccatggagcgcgaccctggaatctctcacgggggtccgtttatcttcatgacactgggctag

SEQ ID NO: 52448 - DNA, 930 bp, Artificial Sequence
  Description of Artificial Sequence: Synthetic coding sequence
atggatatcagcgaaggaaataagacgctggtgacagaatttgttttgaccggcctcaccgatcggccatggctgcacgtgctgtttttcgtcgtgttcctagttgtgtacctgattactatggtgggcaacttgggccttatcgtgctcatttggaacgaccctcacttacatatgcccatgtatctgttcctcgggggactggcatttagtgacgcttgtacttctaccagcattacccccagaatgctggtgaactttctggacaagacggccatgatatctctggcagaatgcatcacacagttctatttcttcgcatcttccgccacaacagagtgttttcttctagtgatgatggcctacgatagatacgtagccatctgcaatcctctgttgtaccctgtgatgatgtctaacaagctaagcgcacagttattgtccatatcttatgttatcggcttccttcatccccttgtgcatgtgtccctgcttttgagactgactttctgtaggttcaatattattcattatttctactgtgagatcctgcaattgttcaagatcagctgcaatgggccttctattaacgctctgatgattttcatctttggggcattcatccaaatccccaccctgatgacaattattatttcttacactcgggtcttatttgacattcttaaaaagaagagtgaaaaaggtaggagtaaggctttctccacttgcggagcccacctcctctcagtgagcctgtattacggcaccctaattttcatgtacgttaggcctgcgtccggactcgccgaggatcaggacaaggtgtactctttgttttacactattatcattcctctactgaacccctttatctactcccttagaaacaaaaaagtgatgcacgccctaaggcgggtcattagaaagtag

SEQ ID NO: 52449 - DNA, 930 bp, Artificial Sequence
  Description of Artificial Sequence: Synthetic coding sequence
atgacccttggaaattctactgaggtgaccgaattctatcttcttggattcggagcccagcatgagttctggtgcatactcttcattgtatttcttctgatttatgtaacttcgataatgggtaactccggcatcatcttgctaataaacactgacagcaggttccagactctaacgtattttttcctccagcacctagcctttgttgatatatgctatacgtcagctattacaccgaagatgctgcagagtttcacggaagaaaagaatctgatgcttttccaaggctgcgtgatccagtttctcgtgtatgcaacattcgctacatccgactgttacttactcgcgatgatggctgttgatccgtacgttgcaatctgtaagcccctccactacaccgtcattatgtcaaggaccgtatgtatccgattggtggccggttcttacatcatgggcagcatcaatgcctcggtgcaaaccgggtttacctgttccctgtccttttgcaaatcaaattcaatcaaccacttcttctgtgacgttcccccaattctggccctgagctgcagcaatgttgacatcaatatcatgctgctggtggtcttcgttgggtctaaccttatttttacgggtctggtggtgatcttttcgtatatttacattatggcgactatcctaaaaatgtcttcatccgccggtcggaaaaagagcttttccacttgtgcaagccatcttacagctgtgaccatattctacggtactctgtcctacatgtatctgcagtcccactcgaataatagtcaagagaacatgaaagtggcatttatcttctacgggacagtaattcccatgctgaatcccctaatctatagcttaagaaacaaggaggttaaagaggccctgaaagtgatcggaaaaaaattattctag

SEQ ID NO: 52450 - DNA, 936 bp, Artificial Sequence
  Description of Artificial Sequence: Synthetic coding sequence
atgactgggggtggcaatatcacagaaatcacttacttcattcttctgggctttagcgatttccctcggatcatcaaagtgctcttcactatcttcctcgtaatttatataacgtccctagcttggaatctgagtttgattgttctgatacgtatggatagccacctacacacacccatgtacttttttttgtcaaaccttagcttcattgacgtgtgctatatctctagcactgttcccaagatgttgtctaacctgttacaggaacagcagaccatcacatttgtgggatgcattatccaatactttatcttcagtacaatgggtttatccgagagctgcttaatgaccgccatggcttacgatcgatacgccgctatctgtaaccctctattgtactcttccattatgtcccctacactctgtgtatggatggtgctgggtgcatatatgaccggccttactgcctctctgttccagattggtgctctcctgcagctccacttttgtgggagtaacgtcatccggcacttcttttgcgacatgccccaactgttgattctcagctgcaccgatacattcttcgtacaggtgatgaccgctatactgaccatgttttttgggatcgctagcgctctcgtgatcatgatcagctatggatacattggcataagcatcatgaagatcacatcagcaaaagggaggagtaaagcctttaacacatgcgcctcccacttaaccgcagtctccctcttctacacctccggcatattcgtgtatctgagtagtagctccggtggttcatcttcgttcgacagattcgcctctgtcttttacacggtggtcatccctatgctgaacccacttatctactcactgcgaaacaaggaaatcaaggacgcattaaaacgactccagaaacgaaagtgctgttag

SEQ ID NO: 52451 - DNA, 951 bp, Artificial Sequence
  Description of Artificial Sequence: Synthetic coding sequence
atgagactaatgaaggaggtgcgcggaaggaatcagactgaggtcaccgaattcctcctgttgggtctttccgacaatccagacctccagggcgtcctgtttgccctcttcctgctgatctatatggccaatatggtggggaacttggggatgatagtacttataaagatagacctgtgcctgcacactcccatgtacttcttcctaagcagcctgagctttgttgacgcaagttacagtagctctgtcacgcctaagatgctggtgaacctgatggcagagaataaggccattagttttcacggctgtgccgcacagttttactttttcggtagttttctgggaactgagtgctttctcttggccatgatggcctatgaccgatacgccgctatatggaaccctttgctctatcctgtgctggtttcaggtagaatctgttttctccttattgcaactagcttccttgccggatgtggaaatgcagctatccacactggcatgactttcagactgagtttctgtggcagtaataggatcaaccacttctactgtgatacccctcccctcttaaaacttagttgcagcgatacccattttaacggcattgtgattatggcgttcagctcgtttatagtgatttcatgcgtgatgatcgtgctgatcagttacttatgtattttcatcgctgtgctaaagatgccctccctcgagggcagacataaggccttttcaacttgcgccagctacctgatggcagttaccatcttctttggaaccatcctgttcatgtaccttagacccaccagctcttactccatggaacaggataaggtagttagtgtgttctacactgtgatcattccagtgcttaacccgcttatttactcattgaagaataaagacgtcaagaaggcattgaaaaagatcctctggaaacatattctgtag

SEQ ID NO: 52452 - DNA, 954 bp, Artificial Sequence
  Description of Artificial Sequence: Synthetic coding sequence
atgatgcgcttgatgaaagaggtgcgaggacgcaaccaaacggaagtgactgaattcctgctgcttggactcagcgataaccccgacctgcagggcgtcctctttgcattatttttgctcatctacatggccaatatggtgggcaatctgggaatgatcgtgctgatcaagattgatttgtgcctgcacacccctatgtatttcttcctgtcctccctgagcttcgtggacgcctcctactccagctcagtgactccaaaaatgctcgtcaatcttatggccgaaaacaaagccatcagctttcacgggtgcgcagcccaattctacttcttcggctccttcctgggtactgagtgcttcttgctcgcaatgatggcttacgacagatatgctgccatttggaacccactcttgtaccctgtcctggtgtccggacggatctgcttcttgcttattgctacctcctttctcgcaggctgcggcaacgccgctatacacaccgggatgaccttccgtctatccttttgcggcagtaatcggattaaccacttctactgcgacacgccgccactgctcaagctcagttgtagcgacactcactttaacggcattgtcattatggctttcagtagtttcatcgtcatttcatgtgtcatgatcgtgctgatcagttatctatgtatcttcatcgctgtgctgaaaatgccttctctggaaggccgacataaagcattcagtacttgcgcttcttatttgatggcagtaactattttcttcgggaccatcttatttatgtacctccgccctaccagcagttactcgatggaacaagacaaggtggtgtcagttttttatacagtcattatccctgttttgaatcccttaatttattccctgaagaacaaggatgtgaagaaggccttgaagaaaattctgtggaaacatatactgtag

SEQ ID NO: 52453 - DNA, 933 bp, Artificial Sequence
  Description of Artificial Sequence: Synthetic coding sequence
atggacaaggaaaactccagcatggtcaccgagtttatcttcatgggcattactcaggatccgcaaatggagataatttttttcgtcgtttttttgatcgtatacttggtcaacgtcgtgggtaacattgggatgatcatcctgatcacgactgacactcagctgcatacgcctatgtacttcttcctttgcaacctgagcttcgtcgatttaggttattcttctgcaatcgccccaagaatgctggccgacttcctgactaatcacaaggtcatcagcttctcctcctgtgccacgcagttcgcattttttgtgggatttgtcgacgcggagtgttatgtactagcagccatggcctatggccgtttcgttgccatctgtcgaccgctgcactactcaactttcatgagcaaacaagtctgtttggcactcatgctcggcagctatttggccggtctggtgagcttggtcgcccacacaaccttgacgttttctctgtcttactgtggatccaatatcattaaccatttcttctgtgaaattcccccactacttgcactaagttgttctgatacttatatcagcgaaattctccttttttccctctgcggtttcattgaattcagtaccatccttattatcttcatatcctatactttcatcctcgttgctatcatccggatgagaagtgccgaggggagattaaaggcattctctacgtgcggcagccatctcactggtatcacactgttctacgggacagtcatgtttatgtatctgcgaccaacgagcagctattctctggaccaggataaatgggcatccgtgttttacaccgtaatcattcccatgctgaaccccctgatctattcgctacggaataaggatgtcaaagccgctttcaaaaaactcattggtaagaagagccagtag

SEQ ID NO: 52454 - DNA, 975 bp, Artificial Sequence
  Description of Artificial Sequence: Synthetic coding sequence
atgctcgagagcaactatactatgcccaccgaatttctgttcgtgggattcaccgactacctaccgcttcgtgtgaccctgtttctggtctttctgctcgtgtataccctgacaatggtggggaacatcctgctaattattttggtgaatatcaatagttcactgcaaataccaatgtactattttcttagtaatttgagctttttagacatcagttgttccaccgccatcactcccaaaatgttggccaattttttagctagcagaaagtccatctctccctacgggtgtgctttgcagatgttttttttcgccagtttcgccgatgcagagtgtctgatcctcgccgctatggcctatgaccgctatgccgctatctgtaatcctcttctgtacactaccctcatgtccagacgtgtgtgtgtttgcttcattgtcctggcttacttctctggaagtacaacttcactcgtccatgtgtgtcttaccttcagactgagtttttgtgggtctaacatcgtgaaccatttcttctgcgacattcccccactgctggcactgagctgtaccgacacgcagattaaccagctgctactgtttgctctatgttcgtttatccagacctccacatttgtcgtcattttcatttcttatttctgcattctgatcacagtactgtctataaagtcatctggtggtcgaagcaaaacctttagcacgtgtgcttctcacctcatcgcagttaccctcttctatggcgcactgcttttcatgtacctgcagccaacaacatcctacagcctagacaccgataaggtggtggccgtgttttacaccgtggtttttcccatgtttaatccgattatttactcattccggaacaaggacgtcaagaatgccctgaagaaactcctagagcgtattggttactccaatgagtggtacctgaatagactgcgtatagtgaatatctag

SEQ ID NO: 52455 - DNA, 1089 bp, Artificial Sequence
  Description of Artificial Sequence: Synthetic coding sequence
atgaccgagtttcatttgcagtcccagatgccttccattcgcctgatatttaggcggctgtccctgggcaggattaaacccagccaaagccccagatgctccacatcatttatggtggttccaagtttctctatcgctgagcactggagacggatgaaaggtgccaacctctcccaggggatggagttcgaactcttggggcttactaccgatccacaattgcaacgcctgctcttcgttgtgttcttgggaatgtacactgccaccttactcgggaacttggtcatgtttcttttaatacatgtgtctgctaccttacacacacctatgtacagtctccttaaaagcctctcatttcttgacttctgctattccagtaccgtagtcccacagacacttgtgaacttcctggctaagaggaaggtgattagttacttcggctgtatgacccagatgttcttctacgccggttttgcaacaagcgagtgttacttgatcgcggctatggcgtacgacaggtatgcagcaatttgtaatccattactgtattccaccatcatgagccccgaagtgtgcgccagcctgatagtggggtcatatagtgctggcttcctcaacagccttatccacacgggctgtatcttcagcctaaaattctgtggcgcacacgtggtcactcattttttttgcgatggacccccaatattgtccctgtcttgcgtggacactagcctgtgcgagattctcctcttcattttcgcaggatttaatctcctttcctgtaccttaactattctgatctcttacttcctgattctaaacactatactgaagatgtcctctgcacaaggtcggtttaaagcattcagtacgtgcgcttcccacctcactgctatctgtcttttcttcggaaccactctgtttatgtatctgaggcctagaagtagctactccctgacgcaggaccgcactgtggccgtgatttatacagtcgtgattcctgtccttaatcctctgatgtatagtctgaggaacaaggacgtcaaaaaagcactgatcaaagtttggggcaggaagactatggagtag

SEQ ID NO: 52456 - DNA, 945 bp, Artificial Sequence
  Description of Artificial Sequence: Synthetic coding sequence
atggaaaacaacacggaggtcaccgaatttatccttgtcgggctgactgacgacccagagctgcagattcccctgtttatagtgttccttttcatttacctcatcaccttagtgggaaacctgggcatgatagaactgatcctgctcgacagctgtctgcatacccctatgtacttctttctcagtaatttatctctggtggacttcgggtactcatcagccgtcactccaaaagtaatggtgggcttcttgactggtgataagttcatactgtataacgcatgtgccactcaattttttttctttgtggccttcatcactgccgaaagtttccttctagctagcatggcatatgaccggtatgccgcactgtgcaagccacttcactataccacaaccatgactactaatgtatgcgcctgcctggcgataggatcctacatctgtgggtttctgaatgcttcaattcacacagggaacacttttagactcagcttctgcaggtcaaacgtcgtagagcacttcttctgcgacgcacccccattactcacccttagctgttccgataactacatctcagagatggtgatattttttgtggttgggttcaatgacctgttctcaatcctcgttattcttataagttacctcttcattttcatcacaatcatgaagatgaggagcccagagggcagacagaaagcattcagcacatgtgcctctcacctgacggccgtcagtattttctacggaaccggaatctttatgtatctccggccaaatagttctcacttcatggggacagacaagatggcctccgtgttctatgctatcgtaattcccatgcttaacccgctcgtgtacagcttgcggaataaggaggtaaagtccgcatttaagaagaccgtggggaaagccaaggcttctattggcttcatcttctag

SEQ ID NO: 52457 - DNA, 945 bp, Artificial Sequence
  Description of Artificial Sequence: Synthetic coding sequence
atggaaaacaataccgaggtgagcgagtttattctcttaggcctaactaacgctccagagctccaagtgcctctcttcatcatgttcactctgatttatcttattactctgacgggaaatctaggcatgattattctcatcttactggactcacacctccacactcctatgtatttctttctttctaatctcagtttggccggaataggttacagttctgccgttacccccaaggttttaaccggtctgttaatagaggataaagccatttcttattcggcctgtgccgcacagatgtttttttgtgctgtgttcgccacagttgagaattacctcttgtcttccatggcctacgaccgctacgcagctgtttgcaaccccctgcactatacgactacgatgacaaccagagtctgtgcttgtcttgccattgggtgttatgtcataggttttctcaatgcatccattcagattggtgataccttccgactttcattttgcatgagtaatgtcatccatcattttttctgtgataagccagcagtcatcactctaacctgtagtgaaaagcatatcagtgagcttattttggtgttgattagctcatttaacgtgtttttcgcattgctcgtgactttgatttcatacctattcatcctgattacaatcctcaaaaggcacacaggaaaggggtaccagaaacccctgtctacgtgcggctcacacttgatcgcaattttccttttctatattactgtcatcataatgtacataaggcccagtagctctcactcgatggacaccgataaaattgcgagtgttttttataccatgatcattcctatgcttagcccaatcgtctatacactgcggaacaaagatgtgaagaacgccttcatgaaagtggtggaaaaagctaagtacagtctggacagcgttttttag

SEQ ID NO: 52458 - DNA, 930 bp, Artificial Sequence
  Description of Artificial Sequence: Synthetic coding sequence
atggaaaactgcaccgaggtaactaagtttatacttctggggttgacttccgtccccgagctgcagattccactgttcatcctttttacctttatctaccttctgaccctatgtggcaatctgggaatgatgcttcttatactgatggattcatgcctgcacacaccaatgtacttttttctctctaaccttagtttagtcgacttcggttattcttccgccgtgacccccaaggtcatggctggcttcctgcgtggggacaaggtgatctcttataacgcctgtgcagtccagatgttctttttcgtcgcactcgcgaccgtggagaactatcttttagcgtctatggcttatgatcgctacgctgcagtctgcaaacccctgcattacaccacaactatgaccgcctctgtcggggcatgccttgctctcgggtcttacgtgtgtggcttcttaaacgcgagttttcatatagggggtattttttccctgagtttttgtaagtcgaacttggtacaccacttcttttgtgacgtcccggctgtcatggccctgtcctgctccgacaaacacacgtctgaagttattctcgtgtttatgtcttcgttcaacattttcttcgtgctgctcgtcatctttatatcttacctgttcattttcatcacaattctaaagatgcactctgcgaaaggccaccagaaagccctctcaacttgcgctagccactttactgcagtgtccgtgttttatggcacagtcattttcatctacctgcaaccgagctcctcccattcaatggataccgataagatggcctcagtgttctacgctatgataatcccgatgctgaacccagtcgtctattcgctccgaaatcgcgaagtgcaaaacgccttcaagaaagtgctcagacgccaaaagtttctgtag

SEQ ID NO: 52459 - DNA, 945 bp, Artificial Sequence
  Description of Artificial Sequence: Synthetic coding sequence
atggaaaacaagactgaagtgacccagtttattctcctgggcctgaccaatgattcagagctacaggtccctctgtttatcaccttccctttcatctacatcattacattggtgggcaatctggggataatcgtgctgattttttgggatagctgcctgcacaaccctatgtactttttcctgtctaacctgtcccttgttgacttttgctactcctctgccgtgaccccaatcgtgatggctggatttctgattgaggacaaggtcattagctataatgcctgcgcggcacagatgtatattttcgtagcatttgccacggttgagaattatttgctcgctagcatggcttatgaccgatatgcagccgtatgcaagccacttcattacacgacaacaatgacaaccactgtgtgtgccaggctagcaattgggtcatacctctgcggctttttaaacgcctcaatccacaccggggacacattctctttgtcattttgtaaatcgaatgaagtccatcactttttctgcgatattccagccgtcatggtgctctcatgttctgataggcacataagcgaactcgtcctgatctatgttgtctccttcaatatctttattgccctgctggtgatcctgatctcttacacatttatctttattaccatactgaaaatgcatagcgcatccgtatatcaaaagccacttagtacctgcgccagtcattttatcgccgtgggtattttctatggcacaatcatattcatgtaccttcagcccagctcttcccacagtatggatactgacaaaatggctccggtgttctataccatggtgattcctatgttgaatcccttagtgtattccctgagaaacaaggaggtcaagtctgcttttaaaaaagtggtggagaaagcaaaactctccgttggctggagtgtatag

SEQ ID NO: 52460 - DNA, 963 bp, Artificial Sequence
  Description of Artificial Sequence: Synthetic coding sequence
atgaattcagagaacttgacccgggcagccgtggctcccgctgagtttgtcttgctggggataacaaacaggtgggatttgcgtgtagccctctttctgacatgcttgccggtctatttagtttcccttctggggaacatggggatggccctgcttattagaatggacgccaggctccatacccctatgtatttttttcttgctaacctatcactgttggatgcctgctatagctctgctatcgggccaaaaatgctcgttgatctgctgcttcccagagcaactatcccatatactgcctgcgcgctgcaaatgttcgttttcgcgggattggcggatactgagtgctgcttattggccgcaatggcctacgaccgatatgttgccattcgcaacccactgctctacactaccgcaatgtcacagaggctgtgtctggctcttttaggcgcatcgggcctaggcggtgcagtttctgccttcgtgcacaccacactgacattccgcctcagtttctgccggagcagaaaaattaactcatttttttgtgacattcctccactcctggcgatttcctgtagtgacacgtcattgaacgagttactgctatttgcgatttgcggttttatacaaactgctacggtgctcgctatcacagtgagctacggcttcattgcgggtgccgttattcacatgaggagcgtcgaggggtctaggcgagcagcatctactggtgggagtcacctgaccgcagtggctatgatgtatggaacactgatttttatgtatctacggccttcttcctcttatgccttggatactgacaagatggccagtgtgttctatacactggtgattccgagtctgaaccccctaatttattctcttcgaaataaggaggtgaaggaagccttgagacagacctggagcaggttccattgcccgggtcagggcagtcagtag

SEQ ID NO: 52461 - DNA, 945 bp, Artificial Sequence
  Description of Artificial Sequence: Synthetic coding sequence
atgatggcgtcagagcgtaaccaatcttctacacccacgttcattcttttaggcttctcagaatacccggagattcaggtgcccctatttttggtgttcctgttcgtgtacactgtgaccgttgtgggaaacctcggaatgattatcataatccgcctgaactcaaaactccataccatcatgtgcttctttctgtctcatctaagtctgactgatttctgtttctccaccgtggtaactcctaagctcctcgaaaatctggttgtggagtacaggaccatctccttctcagggtgcatcatgcagttctgcttcgcctgtatctttggcgtcacagaaacgttcatgcttgctgccatggcgtacgatcgctttgtagccgtgtgcaaaccacttctctacacaacaattatgtcccagaaactttgtgctttactggtcgctggatcttatacttgggggatcgtctgttccttgatcctgacctattttctcctggacctgagcttttgcgaatccacattcatcaacaacttcatctgcgaccattctgtgattgtgtcagcctcctattctgatccttacatctcacagcgactgtgctttatcattgcaatctttaatgaagtttcttccctcattatcatattgacctcctacatgctcatattcacaacgattatgaagatgcggtccgcttccggacgccagaaaactttttccacatgtgcctctcacttgacagcaatcaccatcttccacgggacgatcctgtttctgtactgcgtgcctaaccccaaaacctctagcttgattgtaacggtggcatcagtcttttacacagtggccatccccatgctgaatcctctgatttactcactgaggaataaggatatcaacaacatgttcgagaaactggtagttaccaagctgatctatcattag

SEQ ID NO: 52462 - DNA, 945 bp, Artificial Sequence
  Description of Artificial Sequence: Synthetic coding sequence
atgatgatggttctgcgtaatctttctatggagcccaccttcgctctgttgggttttacagattaccctaaactgcagatccctttgtttcttgtgtttctactgatgtatgtaattaccgtcgttggcaacctgggaatgatcatcattatcaagataaaccctaaatttcacacccccatgtatttttttctgtctcatctgtcatttgtcgacttttgttactcatccattgtcacgcccaaattactcgagaacttagtgatggctgataagagcatcttctatttttcatgcatgatgcagtattttttgagctgcacagcggttgttactgagtccttcctacttgcagtcatggcgtatgatcgatttgtcgccatctgcaacccccttctgtacactgtggcaatgtcacaacgcctgtgcgctcttttagtcgccggttcatacctgtggggtatgttcggacctctcgtgttactttgctacgctcttagactcaacttctctggacccaacgtgatcaaccactttttttgtgaatataccgcacttattagcgtgtctggctcagacattcttatccctcatctgctgcttttttccttcgcaacattcaatgaaatgtgcacgctgctgatcattctgacttcctatgtcttcatatttgtcacagtgctgaaaattaggtcagtgtccggcagacacaaggcgttttcaacatgggcctctcacctgacgtccattaccatttttcatgggacaatccttttcttatattgtgtgccaaactcaaagaacagcagacagacagtgaaggtggcttcagtcttctacacagtggtgaatcctatgctcaacccattaatctacagtctgaggaacaaggatgttaaggacgccttctggaagttgattcacacgcaagtaccctttcactag

SEQ ID NO: 52463 - DNA, 987 bp, Artificial Sequence
  Description of Artificial Sequence: Synthetic coding sequence
atgttcctgactgaaaggaacacaacttctgaggcaacttttacacttctgggtttctcagattatctggagctgcagattcctcttttcttcgttttcttagctgtctatggctttagtgttgtagggaaccttggcatgattgtgattatcaagattaacccaaaacttcacactccgatgtacttctttttaaatcaccttagcttcgtcgacttctgctattcgtctattatcgcccctatgatgctagtgaacctggtggtagaggaccgcaccatctcattcagcggatgtctggtgcagttttttttcttttgcacttttgtcgtgaccgaactgattctcttcgcggtgatggcctacgaccactttgtggcaatttgcaatcctcttctgtacactgtagctatctcccagaagctctgcgccatgctggtagtcgttctgtacgcctggggagtggcttgtagccttaccttggcctgctcagccctgaagctgtcctttcacgggttcaatacaattaatcatttcttctgcgaactttcaagcttgattagcctgtcctaccctgatagttaccttagccagctactcctgtttactgtggccacttttaatgagatttcaaccttgctgatcatactcacctcatacgcttttatcattgtcacaactctgaagatgcctagtgcctccgggcatcggaaggtgttttctacatgcgctagccacttgacagcaattaccatcttccacgggacgatcctgttcctttattgcgtaccgaacagtaaaaacagccggcacacggtgaaagtggcctcagtgttttacaccgttgtaatcccgttgctgaatccccttatttactccttgagaaataaggatgtcaaggacgcgatccggaaaataattaacaccaaatacttccacatcaaacacagacactggtaccctttcaacttcgtgatcgaacaatag

SEQ ID NO: 52464 - DNA, 942 bp, Artificial Sequence
  Description of Artificial Sequence: Synthetic coding sequence
atgctgcttacggacagaaatacttcagggaccaccttcaccctcctgggatttagcgactaccctgagttgcaggtgcccttgttcctggttttcttggctatctataacgtgacagtgctgggaaatattggcctgattgtgattatcaagattaaccctaaactacataccccaatgtatttttttctctcacagctgagcttcgttgacttttgttatagctcaatcattgctcccaagatgctggttaatctagtggtgaaggatcggacaatatcttttcttggctgtgtggttcagtttttctttttctgtacgtttgtggtgacggagtctttcctcctggcagtcatggcctacgaccgtttcgtcgctatctgcaacccattgctctataccgtgaatatgtctcaaaagctgtgcgtgctgctggttgttggttcctatgcctggggagtttcctgctctctggagctgacttgcagcgctctgaaactatgctttcatggctttaacacgattaaccacttcttttgcgagttcagcagcttactgtccctgagttgctctgacacttacattaaccagtggctgctgttttttctcgctacattcaacgagatcagtactctcttaatagtactcacctcttacgctttcattgtcgtgacaatactcaaaatgaggtccgtctctggcagaagaaaggctttcagcacatgcgcatcccacttaacagcaataactatctttcacggaacaattctgttcttgtattgcgtgccaaattctaagaacagccgtcacaccgtgaaagtcgctagcgtgttttatacagtagtcatccctatgctaaaccccctcatctattcactccgaaataaggatgtgaaggacactgtgacagagatactggacacaaaagtgtttagttactag

SEQ ID NO: 52465 - DNA, 945 bp, Artificial Sequence
  Description of Artificial Sequence: Synthetic coding sequence
atgacaaggaagaattatacctctcttacagaattcgttctgctcggtttggcggacaccctggagctccagatcatactgttcttgttcttcctggtcatttatacacttactgtactcggcaacctcggcatgattctcttaatacggatcgactctcagctccacactccaatgtacttcttcctggccaaccttagtttcgtggacgtatgtaatagcaccactattacacccaagatgctggcggatctgctcagtgaaaaaaagactatcagtttcgcagggtgtttcctgcagatgtacttttttatctctttagccacaactgagtgtatactctttggcctgatggcctacgaccgatatgccgctatttgcaggcccctgctctatagcctgatcatgagtaggacagtgtacctcaaaatggcagccggagcattcgcggctggacttctcaatttcatggtcaatacctcacatgtgtctagtcttagcttctgtgacagcaatgtaatccatcatttcttctgcgactcacctccccttttcaagctgagctgttctgatacaatcctgaaagaatctattagctcaatactcgccggtgtcaatatagtgggtacattgctggtgatcctgagctcctatagctacgtcctgtttagcatcttctctatgcactcaggagagggcaggcatagggccttttcaacctgcgcctcacatctgactgccatcatcctattttatgcaacctgtatctacacgtatctgagacctagttctagttactctctgaatcaggataaggtggcttccgttttctataccgtcgttattcctatgctaaaccctctcatatattcccttcggagcaaagaagtcaaaaaagccttagcaaatgttatctccaggaagcggacaagtagtttcctatag

SEQ ID NO: 52466 - DNA, 933 bp, Artificial Sequence
  Description of Artificial Sequence: Synthetic coding sequence
atggaggaggaaaacgcaacactgttgacagagtttgtgttgacaggcttcctgtaccagccccagtggaagattcccctgttcttggccttcctggtaatctatctgattactatcatgggtaacctgggcctgatcgccgtcatctggaaggacccgcaccttcacatcccgatgtaccttctgttgggtaacctggcattcgttgacgcgctcttgtcaagttcagtgaccctaaaaatgttaatcaacttcctcgctaagagcaagatgatcagcttgtcagagtgtaaaatacagttgttttccttcgcaatctcggtgactaccgaatgctttctcctggctaccatggcatatgaccgttatgtagccatttgcaaaccactcctgtaccccgcaattatgacaaacggcctgtgcatcaggctgctgattttgagctacgtggggggtttgctgcacgctctgattcacgaagggttcctcttcaggctgacgttttgcaactctaacatcattcagcacttctactgcgacataattccactgttgaagatctcttacaccgactcttcaattaactttctgatggtgtttatttttgccggatccattcaggtgtttaccatcgggacggtgctcatatcttatatattcgtgctatatacgatattaaaaaaaaagagtgtaaagggaatgcgtaaggcattttccacttgtggagctcaccttttatccgtgagtctatattacggcccactggccttcatgtacatggggtctgcttctccacaagcggacgatcaagacatgatggagtctctgttctacaccgtaattgtgccactgctcaatcccatgatctattctctgaggaataagcaagtgatcgccagcttcactaagatgttcaagagaaatgacgtatag

SEQ ID NO: 52467 - DNA, 945 bp, Artificial Sequence
  Description of Artificial Sequence: Synthetic coding sequence
atgagtaatgaggacatggagcaggacaatacgacattgctgacagagttcgtacttaccgggctcacataccagcccgagtggaaaatgccattgtttctggtgttcctggtgatttatcttatcacaatcgtgtggaacctaggactgatcgcgctgatttggaacgatcctcagctgcacatccccatgtacttctttctgggatcactagcgtttgttgatgcatggatcagctccacggtcacccccaagatgcttgttaatttcctcgccaaaaatagaatgattagcctctccgagtgtatgatccagtttttctcctttgcgttcggcggaactacggagtgtttcctgctggccaccatggcatatgatcgctatgtggctatctgtaagccgctcctgtaccctgtgataatgaacaactcactctgcatacgactgctggcgttttcctttcttgggggattcctgcatgcactgatccacgaggtgctgatctttaggttaactttttgcaattccaacataatccatcacttctactgcgatattattcccctgtttatgatttcctgcaccgatccgagcataaattttcttatggtgttcatactgtcagggagcatacaagtgttcacaatcgtcaccgtcctcaactcttacaccttcgcgctgttcactatcctgaagaagaagagcgtcaggggcgtaaggaaggctttcagcacctgcggagcccaccttttgtccgtcagcctctactacggacctctgatatttatgtacctcaggccagcctctccccaggctgacgatcaggatatgatagacagcgttttttacacaattatcattcccctgcttaacccaatcatctactcactgaggaataaacaggtcatagactcttttacaaaaatggttaaaagaaatgtgtag

SEQ ID NO: 52468 - DNA, 945 bp, Artificial Sequence
  Description of Artificial Sequence: Synthetic coding sequence
atggagttcacggatcgcaactatacactcgtgacagagttcatactgctgggatttccgacccggccagagttacagatcgtgctgttcctgatgttcttaaccctgtacgcaatcatattaatcgggaatattgggttgatgctgctcatcaggatcgatccacaccttcagacaccaatgtatttctttctgagtaacttgtcgtttgtcgacctctgttacttctccgacattgtgccgaagatgctggttaacttcctgtctgaaaataagtccatctcctattacggctgtgcactacagttctactttttctgtacattcgccgacaccgagagtttcattctggccgctatggcttatgataggtatgttgccatctgcaaccctctgctgtataccgtcgtcatgtctcgtggcatatgcatgagactcatcgtgttgtcttacctggggggaaatatgtcttccttggtgcatacttctttcgcatttatactgaagtattgtgataaaaacgtcattaatcactttttttgcgatctcccccctcttctgaagctgagctgtaccgatacaacaataaatgaatggctgctgtcaacttatggcagcagcgtcgagatcatttgcttcattattattattatctcatatttcttcatcctcctctctgttctgaagatccgaagcttcagcggaagaaagaagacgttctctacctgtgctagccatctgactagcgtgacaatttatcaaggaaccctccttttcatctacagccgcccaagctacctgtactccccaaacactgataagatcatctcggtattttatactatctttatcccagtgcttaatccgctaatatatagcttaaggaataaagacgtgaaggacgctgcagaaaaagtgcttcggtcaaaagtggattctagttag

SEQ ID NO: 52469 - DNA, 939 bp, Artificial Sequence
  Description of Artificial Sequence: Synthetic coding sequence
atggccgatgacaacttcaccgtggtgacggagtttattctacttggtctcactgatcacgcggaattgaaagccgtattgtttgtggtgttcctggtcatctatgccatcacccttttgcggaatctcggcatgattcttctgatccaaataacctccaagctgcatacacctatgtattttctgctgtcctgcctcagtttcgtagacgcttgctattcaagtgccatcgcccctaaaatgctggtcaaccttctggttgttaaagctacaatctccttcagtgcgtgcatggtccagcatctctgcttcggcgtctttattactacagagggttttctgctgagcgttatggcttacgatcgctatgtggcgatcgtcagcccactgctttacacggtggccatgagcgatcgcaagtgcgtcgaactggtcacaggatcttggattggcggtattgttaatacactcattcacactatttcactgcgtcgacttagcttttgtagactgaacgccgtgagccacttcttttgtgatattccaagcctgctgaagctttcatgttctgacactagcatgaatgaactcctactcctcaccttcagcggagtcatcgcgatggccacattcctgaccgttatcatatcctacatctttatcgccttcgcctcccttaggattcacagcgcctctggccgtcagcaggcattctccacttgcgccagccatctaactgcggtgacgatcttctacggaacgctgatattttcttacatacagccctcctctcagtattttgttgaacaggaaaaagtggtgagcatgttctataccttgggaatccccatgcttaatcttttgattcactctctgcggaataaggatgtcaaggaagcggtgaagcgggctattgaaatgaaacacttcctgtgttag

SEQ ID NO: 52470 - DNA, 927 bp, Artificial Sequence
  Description of Artificial Sequence: Synthetic coding sequence
atggccgaggaaaatcacaccatgaaaaacgagtttatcctcaccggttttaccgaccatcctgagctgaagactcttctgttcgtagtttttttcgcaatctatcttatcacagtggttgggaacatttctctggtggccctaatttttacccacaggagacttcatactccaatgtacatctttttagggaacttagccctcgtcgatagttgctgtgcctgcgcaatcactcctaagatgctggagaacttttttagcgagaacaagcggatcagcctgtacgagtgtgctgtccagttctactttctgtgtacagtcgagaccgcagattgcttcctgcttgccgcaatggcctatgacaggtacgtcgccatctgtaatccgctccaatatcacatcatgatgtctaagaaactgtgtatacagatgaccaccggcgcatttatcgcaggcaacctccactctatgattcatgtgggccttgtttttaggctcgtgttttgtgggtctaatcatatcaaccatttctattgcgatattctccccctgtaccgtctgtcttgtgtggacccatacatcaacgagctagtgttgtttattttcagcggctctgtgcaggttttcaccatcgggtccgtacttatctcatatttgtacatcctcctgacaatatttaaaatgaagtcaaaggaaggtagggctaaggcattttctacatgcgcctctcattttttatcggtatcgctcttttatgggagcctgttcttcatgtacgttaggcccaatctgctcgaggagggcgacaaagatattcccgcagccatactgtttactatagtcgtcccactgctcaaccctttcatctacagccttcggaatagggaggttatctctgtgctccggaaaatcttgatgaagaagtag

SEQ ID NO: 52471 - DNA, 951 bp, Artificial Sequence
  Description of Artificial Sequence: Synthetic coding sequence
atggtcgaggagaatcatacaatgaagaacgaatttatactgaccgggttcaccgatcatccagagttgaagacccttttgttcgtggtatttttcgcgatctatctgattactgtggtggggaatatttccttggtcgcactgatttttactcactgtaggcttcatacaccgatgtatatctttctcggcaacctggctctagttgacagctgctgtgcttgcgccatcacacctaagatgctggaaaactttttcagtgagggcaagagaatttctctgtacgagtgcgccgtacagttctactttttgtgcaccgtggagactgccgactgtttcctgttggctgctgtggcttatgacagatatgtggccatctgcaaccccctccagtatcatataatgatgtctaagaagctttgcatccagatgactacaggtgcatttatagcaggcaatctacactcaatgatccacgtcggcctcgtgtttcgtcttgtgttctgtggcctgaatcacatcaaccatttctactgcgatactcttcctttgtacaggctcagctgcgtagatccttttatcaatgagttagtactcttcatcttttcgggatcagtgcaggtcttcaccataggatctgtgctcatttcttatctgtacattttgctgactatctttaggatgaaatccaaggaggggcgtgcaaaagccttttctacctgtgcaagtcatttttccagtgtgtctttattttacggctcaatattttttctgtatatccgaccaaaccttctagaggagggcggaaacgacatacctgcggcaatcctcttcactattgttgtacccttactcaatccattcatctattccctgaggaataaagaggtgatcagtgtcttgagaaagatcctcctgaagattaagtcgcagggcagtgtgaataaatag

SEQ ID NO: 52472 - DNA, 966 bp, Artificial Sequence
  Description of Artificial Sequence: Synthetic coding sequence
atggcacgcgagaaccattcactagcggcagagtttatcctgatcggtttcactaactatccagagttgaaaacgcttttattcgtcgtcttcagtgccatatacttggtgaccatggtagggaatctcggcctcgtagccctgatatatgtagagaggcgcctgttgactcccatgtatatctttctcgggaacttagccttgatggactcctgttgctcgtgtgcagtgacaccaaagatgctggaaaactttttctccgaagataggatcataagcttgtatgagtgtatggcccagttctacttcctgtgcctggcggaaacaaccgattgttttctgctggccaccatggcttatgatcggtacgtggccatctgtcatccactccagtatcatactatgatgtccaagaccctctgtattaggatgactacaggggcttttaaggccggtaacctccatagcatgatacacgtgggacttctgctccgtctcaccttctgccggtccaataaaatacatcattttttttgcgatattctgccgctgtatcggctctcctgcacggatccttctatcaacgaacttatgatctatatctttagcatacccatccagattttcactatcgccaccgtgctgattagctatttgtgtattttacttactgtgtttaagatgaagagtaaagagggtcgaggcaaggccttctcaacatgtgcgtcacactttctgtcggtgagtatcttctacatctgcctgttgatgtatatcgggcctagtgaggagggcgataaggacaccccggttgcaattttttacgccatcgtgattccattgctcaatccgtttatttacagtctgcggaacaaggaagtaattaacgtgctaaaaaagataatgcggaactacaacattcttaaacagacttgctcaatagcgaacctatttcttatctattag

SEQ ID NO: 52473 - DNA, 936 bp, Artificial Sequence
  Description of Artificial Sequence: Synthetic coding sequence
atgggcaaagaaaattgtaccaccgtggcagaattcatcctgttaggcctgagtgacgtgcccgaactccgtgtgtgcctcttcctgctcttcttgctgatctatggtgtaacattacttgctaacttgggcatgatagccttaatccaggtttcatccaggctccacacacccatgtatttcttcctgtcgcatcttagcagcgtggacttttgctactcttccattatagttcccaagatgttggcaaatatctttaacaaagataaagcaattagctttttaggatgcatggtgcagttttatctgttttgtacttgcgttgtgacagaagtgttcttactagccgttatggcttacgacaggtttgttgcgatttgcaaccctctgctttacacggtgaccatgtcctggaaagtgagggtggaactggccagctgctgttacttttgtgggactgtttgctctctgatccacctgtgtctggccctgcggataccattttatcgctccaacgttattaaccattttttctgtgatcttccacctgtgctgagcttggcatgttccgacattactgtcaacgagacgctgttgtttcttgtggcaactttaaatgagtccgtgacaataatgatcatcctcacaagctacttgctcattttgacaacgatcctcaagatggggtccgctgagggcaggcataaagcattttcgacctgtgcttcccacctcactgccattacagtcttccatggcaccgtgctgagcatttactgtagaccgtcatccgggaattcaggggacgccgacaaagtggctaccgtcttttacaccgtggtgatcccaatgctcaacagcgtcatctattcactgcggaacaaggacgtaaaagaagccctgagaaaagtcatgggctcaaagattcatagctag

SEQ ID NO: 52474 - DNA, 936 bp, Artificial Sequence
  Description of Artificial Sequence: Synthetic coding sequence
atgggcaaagagaattgcactaccgtggccgagttcatcctgctcgggctctctgacgtgcctgaactgcgcgtttgcctgttcctcctgttcctgctcatctacggggttacactgttggctaaccttgggatgactgctctcatccaggtgagctcaagactgcacacacccgtctatttcttcctctcccatctgagtttcgtcgatttttgttactcctccatcattgtccccaaaatgctggctaacatctttaacaaggataaagctatcagttttctgggatgtatggtgcagttctatctgttctgtacctgtggcgtcacagaggtttttttattagccgtcatggcatatgaccgtttcgtcgcaatttgcaaccccctcttgtatatggtaacaatgagtcagaagctgagagtggagcttaccagctgctgctacttctgcgggaccgtgtgttctttgattcatagctctctggcccttagaatcctgttctaccgatctaatgtcattaatcattttttctgtgatttgccaccgctactgtcactcgcctgtagcgatgtcacagtaaatgagactctgctgttccttgtggccaccctcaatgagagcgttacgattatgattatcctcacgtcctacctcctgatcctcacaactatcttgaaaatccactccgctgagagtcgtcacaaagctttttccacctgcgcaagtcacctgactgcaattacagtgtcccatggcacaatcctttacatttactgtagaccaagttcaggaaattccggcgacgtcgacaaggtggccaccgtgttctacacggtagttatccccatgttgaacccactcatatactccctgaggaacaaggacgtgaacaaggcactaaggaaagttatgggttctaagatccactcatag

SEQ ID NO: 52475 - DNA, 948 bp, Artificial Sequence
  Description of Artificial Sequence: Synthetic coding sequence
atgttttccccaaatcatactatagttacggagtttatattgctaggcctgaccgatgatcccgtcctggaaaagatcttatttggggtttttttggcaatttacctgatcaccctggctggtaacttatgcatgatcctgctgatcaggacaaactcccacctgcagacaccaatgtatttttttcttggacacctgtcttttgtggatatctgttattcttcaaatgtaacgccaaacatgttgcacaactttctgtctgaacagaaaactattagctacgcaggatgctttacccagtgtctgctattcattgcccttgtgataacggaattttacatcctggcctcaatggctctagataggtacgtcgcaatctgctctccacttcactactcttcaagaatgagcaagaatatttgcgtgtgtctcgtcacaattccgtatatgtatggttttctctctggtttctcacagagtttgttgacatttcacttatctttctgcggatctctggagattaaccacttctactgcgccgacccgccactgataatgcttgcgtgctctgacacccgagtcaagaagatggcgatgttcgtcgtcgctggcttcaatctctcatcttccctgtttatcattttgctatcttatctgttcatcttcgccgctatcttcaggatcaggagtgcagagggacggcataaggcattttccacttgcgcctcccacctgaccattgtgacgctattttacggcaccttgttctgcatgtacgtgcgtcccccatccgagaagagtgtggaggaatccaaaattaccgcagtcttctatacgttcctatcgcctatgctcaatccacttatatattccctgcggaatacagacgtgatccttgctatgcagcaaatgatccgcggtaagtcgtttcacaagatcgccgtgtag

SEQ ID NO: 52476 - DNA, 948 bp, Artificial Sequence
  Description of Artificial Sequence: Synthetic coding sequence
atgctctcccccaaccatacgatagtaaccgaattcattctgctcgggctcaccgacgatcctgtcctcgagaagattctgttcggagtgttcctcgccatttaccttatcactttggctggaaacctctgcatgatactgttgatccggacaaactcacagctccaaactccaatgtatttctttctgggtcacttgagttttgtcgacatctgctatagtagcaatgtgacacccaatatgcttcacaacttccttagcgagcagaagacgatcagctacgccggatgtttcacccaatgtctcttattcattgcgctggtaataacagagttttatttcctcgcgtccatggcactggataggtatgttgcaatttgtagccccttacattactctagtcgcatgtccaagaacatttgcatctcactggttaccgtgccctacatgtacggctttctgaacgggctcagccaaacactgctcaccttccacctgagcttttgcggatccctcgaaatcaatcacttctattgcgctgaccctcctcttataatgctggcatgttccgacactagagtgaaaaaaatggccatgtttgtggtggcgggttttaccctgtcctcgtcccttttcattattctactgtcttacctgttcattttcgccgctatcttccgcatccggtctgctgagggtcggcacaaagccttcagtacatgtgcgagccatctgacaattgtgactctcttttacggcacattattctgtatgtacgttcggccacccagtgaaaagtcagttgaggaatcaaagattattgccgtcttctacaccttcctttctccgatgcttaatcccctcatatacagtctccgcaatcgggacgtgattctggcaatccagcaaatgatccggggtaaatccttttgcaaaatagctgtatag

SEQ ID NO: 52477 - DNA, 918 bp, Artificial Sequence
  Description of Artificial Sequence: Synthetic coding sequence
atgtccaacaccaacggcagtgccatcactgagttcatattgctaggcttaactgactgtcccgagctgcagtctctgttgtttgtattgtttctcgttgtctatctcgtgacactgcttgggaatttgggaatgatcatgctaatgcggttggattcacgattgcatacacctatgtatttctttcttacgaatctcgcctttgtcgacctgtgctatacctccaacgcaaccccacagatgtccacaaatatcgtctccgagaagaccattagttttgccggttgtttcacacagtgctacattttcatagctctgctcctgacagagttctacatgcttgcggcaatggcctatgatagatacgtggcgatctacgatccattacggtacagtgtcaagactagccgtcgcgtctgcatctgtctcgcgacattcccctacgtgtacgggttttccgacggtctatttcaagctattctgaccttcagattaaccttttgcagaagctcagtgatcaatcatttttactgcgccgatcctccactcatcaagctgtcctgctctgatacatacgtcaaggagcatgctatgttcattagtgcgggttttaatctatccagctctctcacaattgtgctggtgagctacgctttcattctagccgcaatcttaaggattaaatccgctgagggaagacataaagcgttctccacttgtggctcgcacatgatggccgttactctgttctacggtaccttgttctgcatgtacattagacccccaactgacaagaccgtggaagaatcaaaaatcatcgcagtgttctacacattcgtgtcccctgtgctgaatccactcatctacagcctgaggaacaaagacgttaagcaagctctgaagaatgtgctgagatag

SEQ ID NO: 52478 - DNA, 924 bp, Artificial Sequence
  Description of Artificial Sequence: Synthetic coding sequence
atgttaaactttacggacgtgaccgaattcattctgctggggctgacttcaagacgagaatggcaggtgctgttcttcataatatttctggtcgtatacatcataacaatggtgggtaatatcggcatgatggtgctgatcaaggtttcgccacaactgaataatcccatgtatttttttttgtctcacctgtcattcgttgatgtgtggtttagttccaatgtgacacccaagatgttagagaacttactcagtgacaaaaaaacgattacttacgcaggatgtttggtccagtgttttttcttcatagctctggtccacgtggagatattcattttggcagcaatggccttcgaccggtacatggcaattgggaatcccctgctgtatggctctaaaatgtcacgagtggtatgtattcgcctcatcacattcccatatatctacggcttcctcacttctctggcggctaccctctggacctacggattatatttctgtggaaagatcgaaatcaaccacttctactgcgccgatcctccactgattaagatggcatgtgccggtacattcgtaaaggaatacacaatgatcatactggcaggtattaacttcacatattctctgacagtgattatcatcagttatcttttcattcttatcgccatccttcggatgcgctctgccgagggtaggcagaaagcattctctacctgtgggtctcatctgaccgccgtgattattttttatggcacactgatattcatgtacctgcgtaggcccactgaagaaagcgttgaacagggaaaaatggtagcagtgttttacaccactgtgattcccatgttaaatccgatgatttattctctgcggaacaaggatgtgaagaaagctatgatgaaggtcatttcacgcagttgttag

SEQ ID NO: 52479 - DNA, 936 bp, Artificial Sequence
  Description of Artificial Sequence: Synthetic coding sequence
atgcgaagaaattgcaccctagtgacagagttcattctgctcggcctgacttctcggagagagcttcaaattttgctatttactttgttcctggctatttacatggtgacagtggctgggaatttggggatgattgtcctgatccaggctaacgcttggctgcacatgccaatgtattttttcctgagccatcttagttttgtcgatctatgcttttcctccaacgtcacaccgaagatgctagaaatctttctctccgaaaaaaaatccatcagttaccctgcctgtctagtccagtgctaccttttcatagctttagtccatgtggagatctacatcctggctgttatggccttcgatcgctacatggcaatttgcaacccacttctctatgggtctaggatgtctaagtcagtctgctcatttctcatcaccgtcccatacgtgtacggagccttgaccggtttgatggagaccatgtggacctacaacctggctttttgcggaccaaatgaaataaatcacttttactgtgctgaccctccacttatcaaactggcctgtagtgatacatacaacaaggaactctccatgtttatcgtcgccggatggaacctatccttttcacttttcattatctgtatttcttatctctacatatttcctgccatcctgaagatccgctctactgagggccgtcagaaagccttcagtacatgcggcagtcacctgactgccgttacaatcttttacgctactctgttcttcatgtatcttcggcctccgtctaaggaaagcgtagagcaggggaagatggtcgccgttttttacaccacggttatcccgatgctgaatctgatcatttatagcctcaggaacaaaaatgtgaaagaagctcttattaaggaactgagcatgaaaatatatttctcctag

SEQ ID NO: 52480 - DNA, 933 bp, Artificial Sequence
  Description of Artificial Sequence: Synthetic coding sequence
atgcccaatttcactgatgtgacagagtttacacttctgggattaacctgccgtcaggagctccaggtcctgttttttgtcgtctttctcgccgtgtacatgatcaccctcctaggcaacattggaatgattatcctcattagtatatctcctcagttacagtctcccatgtatttctttttgtcccatcttagtttcgccgatgtctgcttttccagcaacgtgaccccaaagatgttagaaaatctgctctcagagactaaaactattagctacgtgggttgccttgtgcagtgctattttttcatcgcagttgtccatgtggaggtctacatcttggccgttatggcctttgatagatacatggcagggtgcaaccctcttttgtacggatctaaaatgtcccgtaccgtatgcgtgaggctcataagtgtcccctacgtgtatggcttctccgtctcgctgatctgtacactctggacttatggattgtatttctgtgggaactttgagattaaccacttctactgcgccgacccccctctgattcagattgcatgtggccgtgtacatataaaagaaataaccatgattgtcattgccggaattaactttacctattcgctcagcgtagttcttatctcctatactctcatcgtcgtggccgttcttagaatgcgcagtgccgacggtcgccgaaaggccttctctacctgcggcagtcatctcaccgctgtctcgatgttttatggtacccccattttcatgtatttgagaaggcccaccgaggagagcgtggagcaggggaagatggttgcggtattttatacgacggtcatcccgatgctcaacccaatgatctattctctgcggaacaaagacgtcaaggaggccgttaataaggccatcaccaaaacctatgtgaggcaatag

SEQ ID NO: 52481 - DNA, 969 bp, Artificial Sequence
  Description of Artificial Sequence: Synthetic coding sequence
atgaattcgctcaaagacgggaatcacacagcactaacaggctttattttactcggactaacagacgaccctattctgcgggtgattttgttcatgatcatcctctcaggtaacctgtccataattatccttatccggatttcttcccaactccaccatcctatgtactttttcctgagtcacctggctttcgctgatatggcatatagctcttcagtcacccccaacatgttggtgaacttcctcgtggaacgaaataccgtgtcttacctcggctgtgctattcagttgggtagcgctgctttttttgcaacagtggagtgtgtgttgctcgcagcaatggcgtatgaccgcttcgtcgctatctgctcccccttattgtatagcaccaagatgagcacacaggtcagcgtccagttgctgctggtggtatatatcgctgggttcctaatcgccgttagctacaccacttctttttattttttattattctgtgggccaaaccaggtcaatcactttttctgcgacttcgctcccctactggagctgagctgctcagacatctcagtttctacagttgtgctgtccttttcttccggatctattatcgtcgtgaccgtctgtgtgatcgctgtctgctatatatatatcctgatcaccatcctgaaaatgagaagtaccgaggggcatcacaaggcattttctacatgcacatcacacctgaccgtcgtgactctcttctacgggacaatcaccttcatctatgttatgcctaacttttcctactctactgaccagaacaaagtggtgtctgttctgtacacggtcgtcatccccatgctgaatccactaatatacagcctgcgaaataaggagatcaaaggtgctctgaagcgggaactggtgcggaagatattgagccatgatgcatgttacttctcgagaacctccaataacgacatcacctag

SEQ ID NO: 52482 - DNA, 936 bp, Artificial Sequence
  Description of Artificial Sequence: Synthetic coding sequence
atgggaacggggaacgatacaacggtggttgaattcactctactgggcctgtcggaggatactacagtctgtgccattctgttcttggtgttccttggtatctacgtggtcacactcatgggcaacatttccatcatcgtcctgattcggagatcccaccacttacacacacccatgtacatattcctgtgtcatctggcattcgtagacattgggtactcctcatcggtgactccagtgatgctgatgtccttcctcagaaaggaaaccagcctgcccgtggcaggctgcgtggcacagttgtgctctgtggtgactttcggaacggcagagtgttttttactcgctgcaatggcctacgatcgttacgttgcaatttgcagtccactactgtactctacttgcatgtctcccggagtatgtataattctggttgggatgtcttacttaggcggttgtgtcaacgcctggacgttcattggatgcttactcaggctgagcttttgtggccctaataaagtcaatcacttcttttgtgattatagcccacttctgaaactcgcgtgctctcacgactttacctttgaaattatacccgctatctctagcggatcaatcatcgtggcaacagtgtgcgttattgctatctcctatatttacatcctgattaccattctgaaaatgcattccactaagggcagacacaaagcattttccacatgtaccagccatctaactgccgttaccctgttctatggcaccattacctttatctatgtgatgccaaaatcaagttactcaaccgaccagaacaaggtagtgagcgttttctacacagttgtgattcctatgcttaaccccctgatatactccctcaggaacaaggaaattaaaggagccttgaaaagagagctgcgtattaagatattcagctag

SEQ ID NO: 52483 - DNA, 975 bp, Artificial Sequence
  Description of Artificial Sequence: Synthetic coding sequence
atggcagaagttaacatcatctacgtcacagtgttcatcttgaagggcattactaatcgccctgaactacaggctccatgcttcggggtgtttctagttatatatcttgtgacagtactggggaacttgggcctgatcacactcatcaaaatcgacacacgcctacacaccccgatgtactatttcttgtcacacttagccttcgtggatctgtgctactccagtgctatcacccctaagatgatggttaattttgtggttgagagaaataccattccttttcacgcttgcgctacgcaactcggttgtttcctaacttttatgatcactgagtgcttcttattagcgtccatggcctatgattgctacgtggcgatctgtagcccactccactatagcactctgatgtctaggagagtttgcatccagctcgtagcagtgccctacatatacagtttcctggtcgctctttttcacacagtgatcacattcagactcacttactgtggccctaacttgattaaccatttctactgcgacgacctcccttttctcgccttgagttgtagcgatacccatatgaaggagatactaattttcgcattcgcaggctttgatatgatcagcagcagttccatcgtccttacttcatacatctttattattgcagcaattctccgaatacgaagcacacaaggacaacataaagctatcagtacatgtggctcccatatggtcacagtgacgatcttctacggcacgctcatcttcatgtacctgcagcccaagtctaaccacagcctggacactgataagatggcgagtgtgttctataccgttgtgattcctatgctcaaccctctcatttatagcctcaggaacaaggaggtgaaagatgcatcaaagaaggcgcttgacaaaggttgtgaaaatcttcagattctcacatttcttaaaattcggaagctgtactag

SEQ ID NO: 52484 - DNA, 981 bp, Artificial Sequence
  Description of Artificial Sequence: Synthetic coding sequence
atgagcggcctccccagtgatatggacctgtataagctgcaattgaataactttacggaggtgaccatgttcattcttatcagctttaccgaggagtttgacgtgcaggtattcctttttctcctcttccttgcgatctatctgttcacattgatcgggaatctgggcctggtggtccccatcatcggcgatttctggctccacagccccatgtattatttcctgggagttttgtccttcctagatgtgtgttatagtacagtagtgacccccaagatgctcgtgaacttcttggccaaaaacaagtcaatctccttcctgggatgcgcaacacagatgttcttggcttgtacatttggcacgacagaatgctttctcttggctgctatggcatacgaccgctacgtggctatctacaaccccctgctctactctgtctccatgtcacctcgcgtgtacgtccctctaatcactgcttcctatgttgccagcatcctgcacgccaccatccataccgtggccacattcagcctgtctttttgtggtagcaatgagatcagacatgttttctgcaacatgccaccacttcttgcaattagctgtagcgatactcacgtaatacaacttttgtttttctattttgttggtagcatagagatcgttactattctgattgttttgatctcttacggatttatactgctagcaattctgaagatgcagtctgctgaaggcaggagaaaggtcttttcaacgtgcggagcacacttgactggggttacgatataccacggcaccatactgtttatgtacgtgcgacccagctcttcttacacatccgacaacgacatgatagtgagtatcttctataccattgtcatacccatgctcaaccccatcatttactccctgcggaataaggatgtgaaagaagctattaagcggctgctggttagaaattggtttatcaacaaattgtag

SEQ ID NO: 52485 - DNA, 1080 bp, Artificial Sequence
  Description of Artificial Sequence: Synthetic coding sequence
atgagctactctatctataaaagtacggtgaatattcctctgagccatggcgtcgttcattcgttttgtcacaacatgaattgtaatttcatgcatatctttaagttcgtactggattttaacatgaagaacgttaccgaggtgactctgttcgtgctgaaaggctttaccgataatctcgaactgcaaacaatcttctttttcctgtttctggcaatctatctctttacgctgatgggaaacctagggctgattcttgtcgttatacgcgacagccaactgcataagccaatgtactacttcctgtctatgctgagcagcgtcgacgcctgctattcctctgttatcacaccaaatatgttggtcgactttactacaaaaaataaggtcattagttttttgggttgtgtggcccaggtatttcttgcctgttcattcggtacaactgagtgctttctgctggccgcaatggcctatgacagatatgtagcgatatacaacccactgctttatagcgtgtccatgtcaccaagagtctacatgcctctaatcaatgctagctatgtggccggtattctgcatgctaccattcacacagttgcaaccttttctctgtccttctgtggggcaaacgagatacgaagagtgttctgcgatattccaccgttgctggctatctcttactccgatacccacacaaaccagctgctgttgttctactttgtaggcagtattgagctggtgaccattctgatagtgctgatcagttacggactcatcctgcttgcaatcctaaagatgtattccgctgaaggtaggaggaaagtgttctccacctgcggggctcatctgactggtgtgtctatctactatggaaccatcctgtttatgtacgtaagaccatcgagttcctacgcatcagaccacgatatgattgtctctatattttataccattgtgattcctcttttaaaccccgtgatctattccctcaggaataaggatgttaaagacagtatgaagaagatgttcggaaaaaaccaggtgattaacaaggtgtattttcatacgaagaagtag

SEQ ID NO: 52486 - DNA, 1023 bp, Artificial Sequence
  Description of Artificial Sequence: Synthetic coding sequence
atggatagtacctttaccggatacaacctgtacaacctccaagtgaagaccgaaatggacaaactgtcttcagggctcgatatctaccgtaatccgctcaagaataaaacagaagtgaccatgttcatcctgacagggtttacagacgatttcgaactccaggtgtttctgttccttctgtttttcgccatttacctgttcactctaatcggcaatcttggactcgtagtgctggtcattgaagacagttggctacacaatccaatgtactattttctatccgtactgtcatttctcgacgcatgttatagcaccgttgtaacccctaagatgcttgttaacttcctcgcgaaaaataaatctataagtttcataggatgcgccactcaaatgctcctttttgttacatttggtacaacagagtgctttctcctggctgcaatggcctatgaccactacgtggcaatttacaatccgctcctttattcagtttcaatgagccctcgtgtttacgtccccttaatcactgccagctatgtggctggcatcctgcatgcaactattcatatcgtagccacctttagtctgagtttttgcggtagcaatgaaattcgccacgtcttttgtgatatgccacccttgctagcgatctcgtgttccgatacccacactaaccaacttctgctgttttatttcgtcggcagtattgagatagtgaccatcttgatcgtgctaatttcatgtgacttcattttgctgtcaatcttgaagatgcattccgccaagggcaggcagaaggcattctccacttgtggcagccatcttactggcgtgaccatctaccacggcacgatcctggtcagctacatgcggcctagcagcagctacgccagtgaccatgatattatcgtcagtatcttttacactatagttatccctaagctgaatcccatcatctactccttgagaaacaaggaagtaaagaaggcagttaagaaaatgctgaaactggtgtacaaatag

SEQ ID NO: 52487 - DNA, 966 bp, Artificial Sequence
  Description of Artificial Sequence: Synthetic coding sequence
atggaaaggaaaaaccaaactgccatcaccgagtttataatcttgggattctccaatctgaacgaattgcagttcctgctctttacaatcttctttttaacctatttctgcacattaggcggtaacattctcatcatcttaaccactgttactgatccgcaccttcataccccaatgtactactttctcggcaacctagctttcatcgacatttgttataccacaagcaacgtgcctcagatgatggttcaccttctgagcaaaaagaagtccatttcatatgttggctgcgtggttcagcttttcgcattcgtattctttgtagggagcgagtgcttgctcctggctgccatggcctatgataggtatatcgccatatgtaacccacttaggtacagcgtcatcctgagcaaagtgctgtgcaatcagctggccgcatcgtgttgggcagctggtttcctgaactcggtagtgcacactgtgctgaccttttgtctgcctttctgcggtaacaaccaaatcaattattttttctgtgacataccccctctgcttatccttagctgtggaaataccagtgtgaacgagctggcactgctgtctacaggggtttttatcggctggacaccatttctgtgtatagttttgagttatatttgtatcatcagtactatcctgcgcatccaaagttccgaaggaaggcgcaaggccttctctacatgtgctagtcacctagccatcgtgtttctgttttatgggtcagcaatttttacctacgtgcggcctatctctacatacagcctgaaaaaggaccgtctggtgagcgtattatattctgtcgtcacaccaatgctgaaccccattatctataccctgcgaaataaagacatcaaagaggcggtcaagacaatcggctctaagtggcaaccaccgatctcctctttggattcaaaacttacgtactag

SEQ ID NO: 52488 - DNA, 966 bp, Artificial Sequence
  Description of Artificial Sequence: Synthetic coding sequence
atggaaaggaaaaaccagaccgctatcactgaatttattatcttaggcttctccaacctcaacgaactccagttccttctgtttaccatcttttttttgacgtacttttgcactcttggagggaatattctgattattcttacgaccgtgactgacccacatctgcacaccccaatgtattactttcttggcaatttggctttcattgatatatgttacactacctcaaatgtgccacaaatgatggtacacctgctgtcaaagaaaaagtctatcagttacgttggctgcgtcgtccagctatttgcctttgtgttctttgtcggaagtgagtgcttgttattagctgctatggcgtacgatcgatacattgccatttgcaacccgcttcggtacagtgtgatactgagcaaagtactgtgtaatcagttggctgctagttgttgggcagctggctttctaaactcagttgtccacaccgtgctcacattttgcttgccgttctgtggcaacaaccaaatcaattacttcttctgcgacatcccgcctttgctaatactcagctgtggtaacacatcagtaaatgaactcgccttgctctcaacaggcgtcttcatcgggtggacgccattcctgtgcatcgtcttgtcctatatatgtatcatctcgactatcctgcgcatccagagctcagagggacgacggaaagcattttcgacttgtgccagtcacctcgccatcgtcttcctgttttacggctctgctatttttacatatgtacgcccaatttctacatacagcctcaagaaagataggctggtgtctgtcctgtattcagtggtgacccctatgcttaacccaatcatctatacacttaggaataaggacatcaaagaagccgtgaaaactattggaagcaagtggcaaccaccaatcagttcactggatagcaagctgacttactag

SEQ ID NO: 52489 - DNA, 966 bp, Artificial Sequence
  Description of Artificial Sequence: Synthetic coding sequence
atggagcgaaagaaccagacagctatcacagagttcattatcctggggtttagcaatcttaacgaactccagtttttgctgttcaccatcttctttcttacatatttctgtacactgggcggaaacatcctgattatcctaacaaccgtgacggacccacatctccacacccccatgtattacttcctcggaaaccttgcattcattgacatatgctatacaacatcaaacgtgccccagatgatggtgcatctattatcaaagaaaaagtctattagctatgtggggtgcgtggttcagcttttcgcattcgtcttttttgtcggctctgagtgcctattgctggcggcaatggcatatgaccgctatattgctatctgcaaccccctcaggtactccgtgatcttgagtaaggtgttgtgcaatcaactggcggcttcatgctgggccgcaggattccttaacagcgttgtgcatacagtgctgacgttttgcctgccattctgcggcaacaaccagattaattacttcttctgcgacatcccaccactgctgatcctcagctgcggcaacaccagcgtgaatgagcttgccctgctctctactggagtgtttataggctggacacctttcctctgtatcgttctatcatatatttgcatcatctccaccatccttagaatacagagtagcgagggcaggcggaaggctttcagcacctgtgcatctcatcttgcaattgtgttcctcttttatggaagtgctatttttacatacgtgcgccctataagtacatattccttgaagaaggaccgattggttagcgtgctgtactcagtggtcaccccgatgctgaatccaataatttacacactccggaataaagacatcaaggaggccgtgaagaccataggctcgaaatggcagcctcccatctcttccctggattccaaactgacatactag

SEQ ID NO: 52490 - DNA, 966 bp, Artificial Sequence
  Description of Artificial Sequence: Synthetic coding sequence
atggaaaggaaaaaccagactgccatcaccgaatttatcattctcgggttttccaaccttaatgagcttcagtttttgttgttcacgattttcttcctcacatacttttgcaccctcggcggtaacattttgattatcctcacaaccgttaccgacccccacctgcacactcccatgtattattttctgggcaacttagccttcatcgacatttgttacactactagcaacgtgccccagatgatggtccacctgttatccaaaaagaagtcaatttcgtacgtcggctgcgtggtgcagctatttgcctttgtattttttgtgggcagtgagtgtctgctgcttgcagccatggcatatgaccgttatatcgcaatttgcaatccgctaagatatagcgtaattctgagcaaagttctgtgtaaccagctggctgcgtcatgttgggctgccggatttttgaactccgtcgtccacacagtattgactttctgtctgcctttttgcggaaacaaccagatcaactacttcttctgtgacatcccacccctattgattctttcctgcggtaacaccagcgttaatgagttggcactgctgtccacaggcgtgttcattgggtggacccccttcttatgtattgttttatcctatatatgtatcatcagcaccatactgcgcatccagagctcagaggggaggcgcaaggctttctccacttgtgcaagtcatctagctatcgtttttctgttttacgggagtgccatctttacctacgtgcgaccaatcagcacttatagtttgaaaaaagataggctcgtgagcgtgttatactcagtcgttactcctatgctcaacccgatcatctacaccttgcgtaacaaagacattaaggaggctgtgaaaaccatcggatccaagtggcagcccccaatcagcagccttgattccaagctcacctactag

SEQ ID NO: 52491 - DNA, 966 bp, Artificial Sequence
  Description of Artificial Sequence: Synthetic coding sequence
atggagagaaaaaaccagacagcaataacagagtttattattctgggcttctccaacctgaacgaacttcaattcctgctatttactattttcttcttgacctatttttgcaccctgggcggaaacattttgatcatactgacaaccgtgactgatcctcacctgcacactcctatgtattactttctcggaaatctggcattcattgacatttgttacaccacgtctaacgtgcctcagatgatggtacacctcttgagcaaaaagaaatcaattagttacgtgggttgtgtggtccagctgttcgctttcgtatttttcgtgggctctgagtgtttactcctggcagccatggcttatgacagatacatagcaatctgtaatccgctgcgatattctgttattctgtccaaagtgctctgcaaccaactggccgctagctgctgggccgcagggttcctgaacagcgtcgtccataccgtgttgactttctgtctccctttctgtggcaataaccaaatcaattacttcttctgcgacatccctcccctgttgatactcagctgcgggaatacatcagtgaacgagctggcattgctctccactggggtgtttatcggctggactccattcctgtgcatcgtcctgagttacatctgtatcatctcaacgattttgcgaatccagtcttccgaaggaagacgtaaggctttcagcacctgtgcctctcacctcgcaatagtgttcttgttttatggtagcgccatcttcacatatgttcggccaattagcacctacagtctgaagaaggacagactcgtttccgtgctgtattctgtggtgacccctatgctgaaccctatcatctacaccctcagaaacaaagatataaaagaggctgtcaaaactattggcagcaaatggcagcctccaatttcctctctggactctaaactcacatactag

SEQ ID NO: 52492 - DNA, 966 bp, Artificial Sequence
  Description of Artificial Sequence: Synthetic coding sequence
atggagcggaaaaaccagaccgctatcactgagtttatcattttgggatttagcaatctaaacgagctgcagtttcttttattcaccatattcttccttacctatttctgtaccctcggcggaaatattctgatcatactgacaaccgtgacagatccacacctgcatacacccatgtattactttcttggaaacttggctttcattgatatttgttacaccacatccaacgtgcctcagatgatggtgcacttattgagcaagaagaaaagcatatcatacgtgggatgtgtggtgcagctctttgcttttgtgttcttcgttggctctgagtgcctgctgctagcagcgatggcctatgaccgctacattgcaatttgcaacccactgcgctattcagtgattctctcaaaagtcctgtgcaaccaactggcggctagctgctgggccgctggctttctcaactccgtggtacatactgtactgacattctgcctgcctttctgcggtaacaatcagattaactatttcttctgcgacatccctcccttgcttatattgagttgcggcaatacctcagttaatgagttggctctcctctcaaccggcgtgttcattggctggactccttttctgtgtattgtgttaagctacatttgcatcataagcaccatccttcgcatccagagctctgagggacgtcgtaaagcattcagtacatgcgcttcgcaccttgctatagtttttctgttttatgggtctgcgatcttcacttatgtcaggcccatttcaacatactctctgaaaaaggacaggctggtcagcgtgctgtattccgtcgtgacacccatgctgaatcctatcatctacacactgcgcaataaagacatcaaagaagcggtgaagactattgggagcaaatggcagccgccaatatctagcctcgactctaagctgacctactag

SEQ ID NO: 52493 - DNA, 966 bp, Artificial Sequence
  Description of Artificial Sequence: Synthetic coding sequence
atggagcgtaagaatcagacagctatcaccgagttcatcatcctcggcttcagcaatcttaacgagctgcaattcctactcttcacaatctttttcctaacctacttctgtacactgggcggaaatatcttgattatcctaacgaccgtgacagaccctcatctacacactcccatgtactacttcttgggtaaccttgccttcatcgatatctgttataccacaagtaatgtgcctcaaatgatggtgcacttgttgagcaagaagaagtccatatcttatgtcgggtgcgttgtacaactgtttgccttcgtgtttttcgtcggttccgagtgtctgctcctggcagctatggcttatgataggtatatagccatttgcaaccctctgcggtattctgtcattctgtcaaaagtgctttgcaaccagctggccgctagttgctgggccgcaggattcctgaactccgtcgttcacacagttttgaccttctgcttgcctttctgcggcaataatcagattaattactttttctgtgacatcccacccctgctgattctctcatgcggcaatacctccgttaatgaactagccttgctgtctactggtgttttcataggctggaccccattcttatgcattgtcctatcttacatatgtattatttcaactattctccgcatccagagcagcgaagggcgtagaaaggcgttctcaacctgcgcaagccatctagctatcgtctttttattctacggatccgccatctttacttacgttaggccaatttccacttacagtctcaagaaagacaggctagtatcagttctttacagcgtggtgacgcctatgctgaaccctattatttatacactgaggaacaaggacatcaaggaggcggttaagacaattgggagtaagtggcagcccccaatttctagtctcgactctaagctcacctactag

SEQ ID NO: 52494 - DNA, 966 bp, Artificial Sequence
  Description of Artificial Sequence: Synthetic coding sequence
atggagagaaagaaccaaacggcaatcacggagttcatcatactgggcttctcaaacttaaatgagctgcaattcctgctctttaccatcttcttcttgacctatttctgcacactggggggaaacatcctcattatcctgacaacagtgaccgatccacacttacacacccccatgtactattttctgggcaatctggccttcattgatatctgttacacgacctccaacgtcccccagatgatggtccacctgcttagcaagaagaaaagcatctcctatgtcggctgtgtggtacagctgtttgcctttgtcttcttcgttggcagcgagtgcctgcttcttgcagctatggcttatgaccgatacattgctatctgcaatcctctcagatactccgtcatactgtccaaggtgctctgcaatcaactagccgcatcttgttgggccgcaggattccttaacagcgtggtccacaccgtgcttacgttctgcctgccgttttgtggcaacaaccagataaattattttttctgtgacatcccaccactcttgattctgtcttgcggcaatacatcagtgaacgaattagcactcctgagcacaggcgtgttcatcgggtggaccccttttctctgcatagtgcttagttacatctgtataatcagcacgattctccgaattcagtcttccgagggcagacgcaaagccttctctacatgcgccagccatcttgctattgtgttcctgttctatggcagtgccattttcacctacgtcaggcctatctcaacttattcccttaagaaggacaggcttgtctccgtcttgtactccgtggtgacaccaatgctgaacccaatcatttacaccctgcggaataaggatatcaaggaggcggttaagacaatcggatccaaatggcagcccccaatcagtagcctggattccaaattgacatattag

SEQ ID NO: 52495 - DNA, 966 bp, Artificial Sequence
  Description of Artificial Sequence: Synthetic coding sequence
atggaaaggaagaaccagactgccatcactgaatttatcattctgggtttctctaatctgaacgagctccagttcctcctgtttacaatcttttttctgacctacttttgtaccctcggcggtaatatactgattattcttacaacagttaccgacccccatttgcacacaccaatgtactacttcctggggaacctggctttcattgatatttgttacacaacatctaacgttccccagatgatggtgcatttgcttagcaagaaaaagtcgatctcatatgtgggatgtgtggtgcagttgttcgcgttcgtcttcttcgtgggcagtgaatgtctcctattggccgcaatggcctacgaccgatacatcgcgatctgtaaccccctccgatactcggtgatcctgagtaaagtgctctgcaaccagctcgccgcatcctgctgggccgctggcttcctcaacagtgtcgttcatactgttctgaccttttgtctcccattctgtgggaacaaccagatcaactatttcttctgtgacatcccgccattactgatcctttcatgcgggaacactagtgtgaacgaattagcgctgcttagtacaggcgtcttcatcggctggacaccctttctctgcatcgtgttatcttacatttgtataattagcaccatcttgcgcatccagagctctgaaggcaggcgcaaagcctttagcacatgtgcttcacacctggccatcgtgttcctattctacggaagcgctatctttacttatgtacggcctatctcaacatactcactgaaaaaggatcgcctagtgagcgttctgtacagcgtggtcacgcccatgctcaacccaattatttacaccctcaggaacaaggatatcaaggaggccgtcaaaacgattgggtctaagtggcaacctccgatcagcagcctggactcaaagttgacctactag

SEQ ID NO: 52496 - DNA, 933 bp, Artificial Sequence
  Description of Artificial Sequence: Synthetic coding sequence
atggactgggagaactgtagtagtctcaccgatttttttctcctggggatcaccaacaacccggaaatgaaggtgaccctgtttgccgtgttcctcgctgtctacattattaatttctcagcaaatttggggatgattgttttgattaggatggattatcaactgcacactccgatgtacttttttctatcccacctgagtttctgcgacctttgctactcaacagctactggaccaaaaatgctggtcgacttgctggccaagaataaaagcatcccattctacggctgtgcactgcagttccttgtgttctgtatctttgcggactcagagtgcctcctgctgagcgtgatggcctttgatagatacaaagctatcatcaatcccctactctatacagttaatatgtccagtagggtctgctatctcttgctaacaggcgtctacttggtggggattgccgacgcacttattcatatgactctggcattcagactgtgcttttgtgggtccaacgagattaatcactttttttgtgatattcctccactgctgctcttgtcaaggagcgacacacaagtgaatgagctagtcttgttcactgtgtttggcttcattgaacttagtacaatttctggagtgttcattagctattgctacatcatcctgtctgtccttgaaatccactccgcagagggaagattcaaggcgctgtctacgtgtacctcccacttgagcgccgtagccatcttccagggcaccctactttttatgtattttagaccatcatccagctatagccttgaccaggataagatgacatcgctgttttacactctcgtggtgcctatgctgaatcctttgatatacagcctgcgcaacaaggacgttaaagaggccctaaagaaacttaagaacaaaatactgttctag

SEQ ID NO: 52497 - DNA, 942 bp, Artificial Sequence
  Description of Artificial Sequence: Synthetic coding sequence
atgagtattatcaatactagctatgtggagattactactttcttcctggttggtatgccagggctggaatatgcccatatttggatcagcatccctatctgtagcatgtacctcattgccattcttggcaatggaacaatcctgtttataatcaagacagagccatcgcttcacggcccaatgtactactttctgtcaatgctggcaatgtctgacctcggcctaagcttgagttctctgccgactgttttgagcatctttctgtttaatgcccctgaaacttccagttcagcttgctttgcccaagaatttttcatccacgggttcagcgttcttgagtcatcggtcctccttatcatgtcctttgatcgttttctcgcgatccataaccctctcagatacacctcaatacttacgaccgtccgggtagcgcaaatcggaattgttttctcattcaagtctatgctgttggtccttccctttccttttacgttacggagcttgagatactgcaagaagaatcagttgtcacattcttattgtctgcatcaggacgtgatgaagttggcttgctctgacaacaggattgacgtaatttatggcttcttcggcgctctttgcctgatggtggacttcattttgatcgcagtatcgtatacactcatattgaagactgtgccgggaatcgcctccaaaaaggaagaactgaaggccttgaacacctgcgttagtcacatctgtgccgtgatcattttctaccttcctataattaatctggcggttgtccacagattcgccggacatgtgagtcccttgattaacgtcctgatggcaaatgtcctgctactcgtccctccactgatgaaaccaattgtttactgcgtgaaaacaaaacaaattagagtaagggtggttgctaagctgtgtcagtggaaaatctag

SEQ ID NO: 52498 - DNA, 942 bp, Artificial Sequence
  Description of Artificial Sequence: Synthetic coding sequence
atgtcaatcatcaatacaagctacgtagagattacgactttcttcttagtgggtatgccaggacttgagtacgctcacatttggatttccatcccaatatgttccatgtaccttattgccatcttgggaaatgggactatccttttcattatcaaaaccgagccttcgctgcacgaaccaatgtattattttctaagcatgctggcaatgagtgacctcggactctcgctgtcatcactgcctactgtactctccatcttcttattcaacgcgcctgagatctccagcaatgcctgcttcgcccaggagtttttcattcatggcttcagcgttctggagagcagcgtactccttatcatgagctttgatcgcttcctggcgattcacaaccctctgaggtacacctccatccttacaacggtgagagtcgcacagattggaattgtatttagtttcaaatccatgctgctggtacttccattcccgtttacacttcggaatttaagatattgcaagaagaaccagttgagccactcatattgccttcaccaggacgtgatgaagctcgcgtgctcggacaacagaatcgacgtgatctatgggtttttcggagccttgtgtcttatggtcgatttcatcctgattgcggtttcctataccctaatcctgaagactgtgcttggaatagcgagcaaaaaggagcagctcaaggccctgaacacctgcgtgtcacacatatgcgccgtcatcatcttctatctacctattattaacctggcagtggttcaccggtttgcaagacacgtaagcccactgataaatgtcttgatggcgaacgttttgcttctggtgcctcccctgacaaaccctatcgtgtattgcgtcaaaacaaagcagatccgcgtgcgagtcgtggcaaagctctgccagaggaagatctag

SEQ ID NO: 52499 - DNA, 939 bp, Artificial Sequence
  Description of Artificial Sequence: Synthetic coding sequence
atgtccgtcctcaacaattctgaggtcaagttgtttctgctgataggaattcctgggctggaacatgcacacatttggttttcaatccctatctgtctgatgtatctacttgctataatgggcaattgcacaatcctgtttattatcaagactgaaccctcactccacgagccaatgtactactttttagccatgctggctgtgagcgatatgggtctgagtttgagttccctgcctacaatgttgagggtctttctgtttaatgcgatgggaatcagtcctaacgcgtgctttgcccaggagttttttatccatggcttcacggtcatggagagctcagttcttttaatcatgtctcttgatcgttttctcgcaatccacaatcccttacgctatagctcaatcctcacttccaaccgggtggccaaaatggggctgatcctcgccattcgttccattctactggtgattcctttcccctttacccttcggaggctgaaatactgccaaaagaatctgctgtcgcactcttattgcttacaccaggacacgatgaagttagcttgtagcgacaacaaaacgaacgttatctacggcttcttcatcgccctgtgtactatgctcgatcttgccctcatcgtcctcagctatgtgctgatcttgaaaaccattctgtctatcgcgtcactcgccgagcgactgaaggccctgaatacttgcgtctcacacatctgtgccgtgctgaccttctacgtcccgattatcaccctcgcagccatgcatcacttcgctaagcacaaatcaccattagtggtgattttaattgcggacatgtttctccttgtaccccctttgatgaatccaatcgtgtactgcgttaaaaccaggcagatctgggagaaaattctcggcaaattgttaaatgtgtgcgggcgatag

SEQ ID NO: 52500 - DNA, 894 bp, Artificial Sequence
  Description of Artificial Sequence: Synthetic coding sequence
tttctgctgatcggtattccagggttggagcatgctcacatttggttctctatcccaatttgcctcatgtatctgctggccatcatgggtaactgcacaattcttttcatcatcaaaacggagccctctctccacgagcccatgtactattttttagctatgctggccgttagcgacatgggcctgtcactaagctcacttcccacaatgctgagggtgttcttgttcaacgccatgggtataagcccaaacgcctgcttcgctcaggagttctttattcatgggttcaccgtgatggaatcttctgtgcttttgatcatgagccttgaccggttcttggccatccataatccactgaggtactccagcattctcaccagcaatcgcgtggctaagatgggtctcatattggccatccgatctattctgcttgtaatcccattcccatttaccctgaggaggcttaagtactgtcagaaaaacttgctatcccactcctattgtcttcaccaggacaccatgaagctggcatgcagcgataataagaccaatgtcatctatggattctttatcgcgctgtgcacaatgctggatttggctctgatcgtactgtcttatgttctgatcttgaagactattctgtccatcgcatctctcgcagagcggctgaaggctttgaatacttgtgtgtcacacatttgcgccgtccttacattctacgtcccgatcatcaccctggccgcaatgcaccattttgctaagcacaagagtccactggtggtgatcctaatagcagacatgtttctcctggtaccccctttaatgaatcccattgtgtattgcgtgaagacacgccagatttgggagaaaattctcggcatttactgccactag

SEQ ID NO: 52501 - DNA, 957 bp, Artificial Sequence
  Description of Artificial Sequence: Synthetic coding sequence
atgtccgtgctcaacaacagcgaggtgaaattattcctgttaatcggcatcccagggctcgaacatgctcatatttggttttccattccaatctgcctgatgtatctcctggcgatcatgggtaactgcaccatcttattcattattaaaacggagccttctctccacgagccgatgtattatttcctcgcgatgttggccgtctctgacatggggctgtccctttcttcactcccgacgatgctgagggtgttcttgtttaacgccatggggatctctcccaatgcatgctttgcccaggaattttttattcacgggtttacggtcatggagtcctctgtcctcctgattatgtcccttgataggttcttagctattcataacccacttaggtattcctctattcttacttccaacagggtggccaagatgggcttgatcctggccatcaggtcaatactcctggtgatcccatttccatttacattaagacgccttaaatactgtcagaagaacttgttatctcactcatactgcctgcatcaggatacgatgaagcttgcttgtagtgataacaaaactaatgtgatctatggcttcttcatcgccttatgcacaatgctggacttggctttgatcgtgttgtcctatgtccttatccttaaaactatcctgtcaattgcatccctcgctgagcgccttaaagctctgaatacatgtgtgagccatatttgcgctgtgctcactttttacgtcccaattattaccctggccgctatgcatcattttgctaagcacaaatctccactggttgtaatacttatagctgatatgtttcttttagtgccccctctaatgaaccccattgtatactgcgtcaagacacgccaaatttgggaaaaaatcctagtcaccttccgattcatcaagaccgtaaagaaattctggaagagatag

SEQ ID NO: 52502 - DNA, 939 bp, Artificial Sequence
  Description of Artificial Sequence: Synthetic coding sequence
atgtggccaaacatcactgccgctccattcctcctgaccggattcccaggtttggaggctgcacaccattggatttcaattccgttcttcgcagtttacgtgtgcatactgttggggaacgggatgttgctgtatctgatcaagcacgatcactccctccatgagccaatgtattattttctaacgatgctggccggaaccgatctaatggtgacattgacaacaatgcccacagtcatgggtatcctttgggtgaaccaccgggaaatctctagcgtaggctgttttctccaggcttatttcatacacagcctatctgtggtggagtctggctctttgctggctatggcttatgattgctttatcgcgattaggaatcccctgcggtatgcctccatccttacaaacaccagagtgatcgcgctgggagttggcgtgttcctgcggggattcgtctccattttgcctgtgatactgcgtctgttttctttttcttactgtaaatcacatgtgatcactcgggctttctgtctccatcaggagataatgagactcgcgtgtgccgatataacctttaaccggctgtaccccgtcattttaataagcctgacaatattcctggattgtctcatcatcttattctcctacatcttgatcctcaacaccgtaattggcattgctagcggggaagaacgcgcaaaggcactgaacacatgtatatctcatataagttgtgtgctaatcttctacgtcacagttatgggactaacctttatatatcgatttggtaagaacgtgccagaggtggtccatattataatgtcctacatatactttctcttccctcctttaatgaacccagtcatctatagtatcaagacaaaacaaattcaatacggaattatcaggctgctatccaaacaccggttcagctcctag

SEQ ID NO: 52503 - DNA, 933 bp, Artificial Sequence
  Description of Artificial Sequence: Synthetic coding sequence
atgtggtacaacaatagtgctgggccattcctcctgacaggatttctcggctccgaagcggttcactatcgcatctctatgagttttttcgtgatttacttctcagttctgtttggtaacggtactctgttggtgctcatctggaatgatcacagtctgcacgaacccatgtactattttttggccatgcttgccgacaccgacctcggaatgaccttcaccacaatgccaacagtcctgggggtcctactgctggaccagagggaaatcgcacatgctgcttgtttcacacaatctttcattcatagcctggccatcgtggagagcgggattctgcttgttctcgcctatgattgcttcattgctataagaacccctctgcggtacaattgcatattgaccaacagtcgcgtgatgaacatcgggctgggtgtgcttatgcgaggcttcatgagcatccttccaataatactgtcactgtactgttatccttactgtggatctcgagctctgcttcacactttctgtctgcatcaagatgtcattaaacttgcctgcgctgacattaccttcaatcatatctaccccattatccagaccagcctgactgtcttcctcgatgccctcattataatattctcttatatactgattctgaagacggtgatgggaatcgccagtggccaggaggaagcaaagtcacttaacacctgtgtgagccacattagttgtgtgctggttttccacatcaccgttatgggtctctctttcatacatcgctttggtaaacatgcccctcatgtggtgcccatcactatgagctatgttcattttctcttcccaccatttgtgaaccccattatctactccattaaaaccaaacaaatacagcgcagtatcattagactgtttagcgggcagtctcgggcatag

SEQ ID NO: 52504 - DNA, 939 bp, Artificial Sequence
  Description of Artificial Sequence: Synthetic coding sequence
atgagctcttccggctcaagccacccatttctgctcacgggtttccccggactagaggaggcgcaccattggatcagtgtgttttttcttttcatgtatatcagtattctcttcgggaacggcacgctcctgttgttaattaaggaggatcacaacttgcacgagccaatgtatttcttcctcgccatgctggccgcaaccgatctgggactcgcattgactacaatgccaactgtgctaggcgtgttatggctcgaccatcgcgaaatcggttcggccgcatgtttctctcaggcttatttcattcacagtcttagcttcctggagagtggtattctgcttgcaatggcttatgaccggtttatcgcaatttgcaaccctcttcgctatacatccgtcctgactaatactagagtggtgaagatcgggttaggcgttcttatgcggggttttgtctcagtcgtgccacccattaggccactgtacttctttttgtattgccactctcacgttctctcacatgccttttgtctgcaccaggacgtgatcaagctggcgtgtgcggacacgacattcaataggctgtaccccgctgtcctggtcgtgttcatatttgtgctcgactatctgattatcttcatttcctatgttctcattctgaagaccgtgctgagcatcgcttctcgagaagagcgagccaaggccctgatcacttgtgtctcccacatctgctgcgttcttgtcttctatgtgaccgtcatagggttatcattgatccataggttcggcaagcaggtgccccacattgtacaccttatcatgtcctatgcttatttcctgtttccaccactcatgaaccctatcacctattccgtcaagactaagcagatacagaatgcaattctccacctgtttacaacgcaccgtattggtacctag

SEQ ID NO: 52505 - DNA, 939 bp, Artificial Sequence
  Description of Artificial Sequence: Synthetic coding sequence
atggggttaaacaaaagtgcttctaccttccagctgacaggctttcccggaatggagaaggcccaccactggatttttataccccttcttgctgcctatatcagcatcctgctggggaatggcacattgctgtttctgatacgcaatgaccataatttgcacgaaccaatgtactatttcctagcaatgctggcagcaaccgacctgggcgttacccttaccacaatgcctactgtgctgggcgtgctgtggctggaccaccgggaaatcggacacggagcctgcttttcgcaggcctacttcatccacaccctgtccgtgatggagtctggggttctacttgccatggcctatgattgcttcattacaatccgcagccctttgcgctacaccagtattctcaccaacacgcaggtgatgaagattggagttcgtgtgctcacccgagccggattgtcaatcatgcctatcgtcgtgcgattgcactggtttccctactgcagaagtcacgttctttcacacgcattctgtcttcaccaggacgtgattaaacttgcatgtgccgatatcacattcaacagattatatcctgtggtggtgctcttcgccatggtactgctagattttctgatcatctttttttcctatatcctgattctaaagactgtgatgggaattggctccggcggagagagagccaaagctctaaacacctgtgtctctcacatttgctgtattctggtgttctacgtcacggtggtctgtctgactttcatacaccggttcggcaaacacgtaccccatgttgtacacattaccatgtcctatatccacttcctctttccacctttcatgaatcccttcatatacagtattaagactaagcagatccagtctggtattctgaggcttttctccctgccccattctcgggcttag

SEQ ID NO: 52506 - DNA, 918 bp, Artificial Sequence
  Description of Artificial Sequence: Synthetic coding sequence
gtgtcaacatcacaaagccatgacttcctcctgaccggcttccctggcatggagaaggcacatcactggatttttatccctctgctggccgcttatatctctattctattggggaacggaaccttactatttctgatcagaaatgaccacaaccttcacgagcccatgtactattttttagcaatgttggccgctacagacttgggcgtcaccctgaccacaatgcctaccgttctgggagttctgtggctcgaccacagggagatcggacatggcgcatgcttctcacaagcatacttcatccacaccctcagcgtaatggagagtggcgtgctccttgctatggcctacgattgcttcatcacaatcagatcccctttgaggtatacctcaatccttaccaacacccaagtgatgaagattggagtcagagtactgaccagagcaggactgtcgatcatgccaatcgttgtgagactgcattggtttccttactgtcgcagtcatgttttgtctcacgcattttgtctgcatcaagacgttatcaaacttgcttgtgccgatattacctttaatagactgtatcccgtggtggtcctctttgccatggtccttctagactttctcataatctttttttcttatatactgattctgaaaaccgtcatgggcatcggcagcggcggagaaagggcaaaagctctgaacacctgtgtgagtcacatttgttgtattctggtcttctacgtgacagtagtctgcctgaccttcatccatcgcttcggcaaacacgttccccacgtggtccatattaccatgtcttatatccattttttatttcccccttttatgaacccattcatttactccattaagaccaagcaaatacagagcgggattctgcggctattctcctag

SEQ ID NO: 52507 - DNA, 939 bp, Artificial Sequence
  Description of Artificial Sequence: Synthetic coding sequence
atgaccaacaatatcactagcacgtctatcatttttctcctaaccggcgttccaggattggaagccttccacacgtggatttctattcctttctgtttcctatctgtcactgctctcctggggaacagtttgattctgttcgctacaatcacgcaaccgagtctccatgaaccaatgtactatttcctttcaatgctcagcgccacagatctcgggctctccatttctaccttagtaaccatgctttctatattctggttcaatgtgcgggaaatctcttttaatgcctgtttatcccacatgtttttcataaagtttttcacagttatggagtctagtgttctgctcgccatggccttcgaccgcttcgtcgcagtgtccaatcccctcagatacgccatgatactcacagactcaagaatcgcccagattggtgttgccagtgtaataaggggtctcctgatgctgacacctatggtggcactgctgatccggttaagttattgccattcccaggtgctgcaccatagttactgttaccacccagacgtgatgaaactcagttgcacggacactagaatcaactccgcggtcggtctaactgctatgttttccacagtgggcgtggatctgcttttgatattgctgtcttatgtgctgatcattcgcacagtcctgtccgtggccagccctgaggagcgaaaagaaacattctccacttgcgtatctcatatagtagcctttgccatctactacatcccgctgatctctttgtctattgtacatcgatttgggaagcaggcgcctgcgtatgtccatacgatgatcgctaacacctacctcctgatctctccactgatgaacccagtcatctatagtgtgaaaaccaaacaaattcgtagggctgtgattaaaatcctgcatagcaaggagacatag

SEQ ID NO: 52508 - DNA, 975 bp, Artificial Sequence
  Description of Artificial Sequence: Synthetic coding sequence
atgcagaaaccgcagctgttagtgccaataatcgctacaagtaacggcaatctggttcatgcggcttacttcctgttagtgggaattcccggtttgggcccaactatacatttctggctcgctttccccctctgttttatgtacgctctggccacgctgggcaaccttaccatcgtgttgattataagagtggaacgacggttgcatgaaccaatgtatctgttcctcgcgatgctctccacaatcgatttagtattgtcctccataaccatgcccaagatggcttctctatttctgatgggcattcaggaaatcgaatttaatatctgcctcgctcaaatgtttctcatacatgctctgtccgctgtggaaagtgcggtactgctcgcgatggcctttgataggttcgtggctatctgccatcctctgcgacacgcatccgtgctgacaggatgcactgtggctaaaatcgggctgagtgctctaacgcggggtttcgtcttcttcttcccactcccgttcattttaaaatggctgtcatactgtcagactcataccgtcacccacagcttttgcttgcaccaggacatcatgaagctttcatgcactgacacacgcgtaaatgtggtctacggattatttatcattctgagcgtaatgggtgtcgactctctcttcataggattcagctacatcctcattctctgggcagtgcttgagctgtccagccgtcgagctgcactgaaagccttcaatacgtgcatttctcacctctgtgctgtgctagttttctacgtaccgttgatcgggctgagcgttgtgcacagactgggcggaccgaccagtctcctgcacgtcgtgatggcaaacacttacttactgctgccacccgtggtgaatccattggtctacggagccaagacaaaggaaatctgtagccgagtgttatgcatgtttagccagggtggtaaatag

SEQ ID NO: 52509 - DNA, 957 bp, Artificial Sequence
  Description of Artificial Sequence: Synthetic coding sequence
atgatggtggacccaaatggtaacgagtcttccgccacgtattttattttgattggactgcctggcctggaggaagcccagttctggctcgccttccccctctgctctctgtatcttattgctgtccttggaaacttaaccattatttacatagttagaaccgaacactctcttcacgagccaatgtatattttcctgtgtatgctgtccggtattgatatcctgatatccacatcctctatgcctaaaatgctggccattttctggtttaactctacgaccatccaattcgacgcctgtcttcttcagatgttcgccatacatagcctgtctggcatggaatctactgtgctgctcgccatggcattcgataggtatgtcgccatttgtcaccccctccggcacgctactgtgttaacactccctcgagtcactaagataggcgtcgccgcagtggtgagaggggcagctcttatggctcctttacctgtcttcattaaacagttacccttttgtcgctctaacatcctgtcccattcctattgtctgcatcaggatgtgatgaagctggcatgtgacgacattcgggttaacgtggtctacggacttattgtgattatttccgcaatcggcttggacagcctgcttatctctttctcttacctgctgatcctaaaaaccgttctggggcttacaagggaggcccaggcgaaagctttcgggacctgcgtttcccatgtctgcgccgtctttattttttacgtacccttcataggcctcagcatggtgcataggttcagcaagaggcgggatagtcctctaccagtgattctcgcgaacatctatcttctggtccccccagtactgaatcctattgtgtatggagtaaaaactaaagagattcgtcaacgcattctcagactgtttcatgtggctacacacgccagtgaaccttag

SEQ ID NO: 52510 - DNA, 963 bp, Artificial Sequence
  Description of Artificial Sequence: Synthetic coding sequence
atgtcaagctgcaactttacgcatgccacgttcgtgctcatcggaatcccaggcctggagaaggcccatttctgggttggtttccccctgctttcaatgtacgtagtggccatgttcgggaattgcattgttgtgttcatagtgagaaccgaacggagcttgcacgcccctatgtacctttttctgtgcatgctggctgctattgacctcgctctgtcaacgagtacgatgccaaagatactggccctcttctggttcgactctagggagatcagcttcgaggcctgcctcacacagatgttttttatacacgcgctgtccgccatagagtccactatactgcttgcaatggcgtttgatcgctatgttgccatctgccacccacttcgccacgctgcggtcctgaacaatacagttactgcccaaatcggtatcgtagccgtggtacggggatccctcttcttcttcccacttcctctgcttattaagcggctggctttctgccacagtaatgttctaagccactcttactgcgtccatcaggatgtgatgaagcttgcctacgccgataccctgcccaacgtagtgtacggcctgacagctatattgctcgttatgggagtagacgtcatgttcatctcattgtcatacttccttattatacgcacagtgttgcagctaccctctaagtccgagcgcgctaaggcttttggtacatgtgtgagtcatatcggcgtcgtcctggcattttatgtgccgttaataggcctgagcgtcgtgcataggttcgggaattcactgcaccctatcgtccgcgtggtaatgggcgatatatatctgttgctgccaccagtgattaacccgataatttatggtgcaaaaacgaaacaaattcggactcgggttctggctatgttcaagatcagttgcgacaaggaccttcaggcagtcggaggaaagtag

SEQ ID NO: 52511 - DNA, 252 bp, Artificial Sequence
  Description of Artificial Sequence: Synthetic coding sequence
atgagttcatgcaactttactcacgcaacgtttgtgctaattggtattcctggcttggaaaaggcccacttttgggtgggcttccccttactttctatgtacgtagtagccatgtttggaaactgcatcgtcgtattcatcgtacggacagagaggtctctacacgccccaatgtacctttttttgtgcatgctggccgcaattgacctagcactctcaacaagcacaatgcctaaaattctggcactgtag

SEQ ID NO: 52512 - DNA, 1029 bp, Artificial Sequence
  Description of Artificial Sequence: Synthetic coding sequence
atgacagaaacgagtctgtcttcacagtgcttcccaatgagcgtgcttaataatactatagcagagcccttgatcttccttctcatggggatccctgggttgaaagcaacccaatactggatatccattccattttgcttgctgtatgtggttgccgtttcgggcaattcgatgatcctgtttgtggtcctgtgcgagcgcagtctgcacaaaccaatgtattatttcctgtccatgctctctgctacggacctctctctgagtctgtgcaccctgtcgactacactgggggttttttggttcgaagctcgggagattaatcttaacgcatgcatcgctcagatgttcttcctgcacggcttcaccttcatggagtccggggtgctattggcgatggccttcgaccggtttgtcgccatctgttacccgctccggtacaccaccattctgacaaatgctcgcattgcaaaaatcggcatgagcatgctgattcggaacgtggcagtgatgcttcccgtgatgctttttgtgaagaggctgagtttctgcagctctatggtcttatcccacagctactgctaccacgttgacttgatacaactgagctgtacagacaaccgcatcaacagtatattgggcctgttcgccctgctgagcaccaccggcttcgattgtccttgtatcctcctgtcttacatcttgataattcggtcagtgctctccattgcttcttccgaggagcgaagaaaggcattcaacacctgcacctcacacatatcagccgtgtctattttttatctgcctctgatcagtctttcattggtgcaccggtacggtcattctgcaccaccttttgtccacattatcatggctaacgtgttcttgttgatcccccctgtgcttaacccaatcatttactcagtaaaaattaaacaaattcagaaggccattattaaggtactgatccagaaacacagcaagagcaatcaccagctgtttctcattcgcgataaagccatctatgagtag

SEQ ID NO: 52513 - DNA, 966 bp, Artificial Sequence
  Description of Artificial Sequence: Synthetic coding sequence
atgacaattctcttgaatagctccctgcagcgtgcgacttttttcctgaccggcttccagggccttgaaggactgcatggctggatctcaatacctttttgctttatctaccttacggtcatcctgggcaacctgactatactgcacgtcatttgtaccgatgctaccttgcacgggcctatgtactacttcctgggcatgttagcagtgactgatctggggctgtgcctcagcactctaccaacggttctcggcatcttctggtttgatacaagggagatcggtatccccgcttgtttcacccagctgttcttcatccacactcttagtagtatggagtcttccgtcctgctgagcatgagtatcgatcggtatgtggccgtctgcaatcccctacatgattctaccgtcctgactcccgcttgcattgttaagatgggcctgtcctcggtactgaggagtgccctgctgattttgcccttaccctttctgctgaagcgctttcagtactgtcattcacatgtgcttgcccatgcatactgcttgcatctcgagatcatgaagctggcatgctcaagtattatcgtcaaccacatctacggtttgttcgttgttgcttgcactgtcggcgtggactctttgcttattttcctgagctacgctttgatccttcgcacagtgttgagcatcgcgagtcatcaggaaagactcagggccttaaatacatgcgtgtctcatatctgtgcagtactgctcttctatatacctatgatagggttgtctctcgtgcataggttcggcgagcacttacctagggtggtccatctgtttatgtcctatgtttacttgctggtgccaccactgatgaacccaatcatatactcgataaagaccaagcaaatcagacaacgcatcattaaaaagttccagtttatcaagtctctgagatgcttttggaaggactag

SEQ ID NO: 52514 - DNA, 945 bp, Artificial Sequence
  Description of Artificial Sequence: Synthetic coding sequence
atgaccttggggtccctaggtaactccagcagctccgtaagcgctacttttttgctgtcaggtattccaggattggaaaggatgcatatttggatctccatccccctgtgtttcatgtacttggtgtctattcctggaaattgcaccatcttatttatcatcaaaaccgaaaggtcactacacgagcccatgtacttgtttctgtcaatgctggcattgatagatctgggcctgtccctttgcaccctgcctaccgtgctggggatcttctgggtaggggctcgggaaatctctcacgacgcttgcttcgcccagctgttttttattcattgcttctcatttctggaatcgtccgtactgctctcaatggctttcgacagatttgttgccatctgtcaccccctgcactacgtcagcatcctgactaataccgtgatcggcagaatcggtctggtctctctcggccgaagtgtagccctaatctttcctctgccctttatgctgaagcgctttccatattgcggttcaccggtgttgagccattcttactgcctgcaccaggaagtcatgaaactcgcttgcgccgacatgaaagcaaactccatttatggaatgtttgtgatcgtttcaactgtcggcattgactccctgctcattctgtttagttacgctctgattcttcgaactgtcctttcgattgcctccagagccgagagattcaaggcccttaatacatgtgtctcccacatttgtgccgtgttattgttttatacccctatgatcggcctgtctgtgattcatagatttggaaagcaggctcctcatctggtgcaggtggtgatgggcttcatgtacctgctgtttcctcctgtcatgaatcctattgtctatagtgtgaaaacaaagcagatccgcgaccgcgttacccacgccttctgttattag

SEQ ID NO: 52515 - DNA, 909 bp, Artificial Sequence
  Description of Artificial Sequence: Synthetic coding sequence
atgaccaatctcaatgcctcgcaggcaaatcaccgcaactttattctcaccgggatccccggtacacctgataaaaacccctggcttgcatttcctttggggttcttatatactttaacgctgctcgggaacggaactatcctcgccgtcattaaggtggaaccctctcttcatgaaccaacttactacttcctctccatcttggccctcaccgacgtgtcgctgtctatgtcaacactgccctcaatgctgtctatctactggtttaatgcaccacaaatcgtttttgacgcttgcattatgcagatgttttttatacacgtattcggcatagtcgagtcaggcgtgctggtctccatggctttcgaccgtttcgtcgccattcgcaacccacttcattatgtttcaatcctcacccacgatgttatccgcaagaccggcatagcagtgctgacccgcgctgtgtgcgtggtgtttccagtcccttttctcatcaagtgtttacccttttgtcattctaatgtcctcagtcattcctattgcttacaccagaatatgatgcgacttgcctgtgccagcacccgcatcaatagtctatacgggttaatagtggtgatttttacactcggcctggatgtgcttctgacactgctgtcgtacgtcctgacattaaagacggtactcggcattgtatccagaggtgagaggcttaaaactctgagtacatgtctaagccacatgtctaccgttctgttattttatgtgccattcatgggcgctgcttcaatgattcaccgtttctgggaacatttgagccccgtagtgcatatggtgatggcggacatttatctgctcctgcctcctgttctgaatcccattgtgtacagcgttaagacaaagcagatctag

SEQ ID NO: 52516 - DNA, 894 bp, Artificial Sequence
  Description of Artificial Sequence: Synthetic coding sequence
ctgactggaattcccggaattcagaccggcctcacttgggtggccctgatattctgtatactctatatgatttcaatagtcggaaacctttctatcctcacactcgtcttttgggagcccgctcttcatcagcccatgtactacttcttgtccatgttggcgttgaatgaccttggcgtctcctttagtaccctgccaactgtgatctctaccttttgctttaactataaccacgtggctttcaatgcctgcctggtgcaaatgttcttcatccacaccttttcctttatggaatccggaatccttctggctatgtcacttgatcggttcgtagcaatctgctacccactccgatatgtcaccgtgctgacacacaatcggatcctggccatggggttgggcatcctgaccaagtccttcactacccttttccctttccctttcgtcgtcaagcgccttcctttctgtaagggtaacgtgttacaccactcatactgtctgcatcctgatcttatgaagttgccttgtgctgacacgaaacttaactcaatattgggactggcaatcgtattggcaaacttcggattggactcactccttatagtggtgtcttacgttttaatcctgtacacagtgatggggattgcatctggagagggcaggtggaaagcactgaacacatgtgtcagccatatttgcgccgttctgatttattatgtaccaatgatcggtgtgtctgtaatgcacagggcagcaaaacacgcctcacccattgtgcatacgttgatgtccagtatctgcttgctggtcccacccgtactgaaccctattatctactctgtgaaaacacagactatcaggcagggcatcctgaccctcttctcttgtaagtag

SEQ ID NO: 52517 - DNA, 936 bp, Artificial Sequence
  Description of Artificial Sequence: Synthetic coding sequence
gggcttagacactctacgcaccctgcgacccttcagttgacaggtatccccggaatccagaccggcctgacctgggttgccctaattttttgtattctgtatatgatatcgattgtcggtaatctgtcgattctgaccctcgtcttctgggagccagcgctccaccagcccatgtactatttcctgtcaatgctggcgctgaatgacttaggtgtgtccttcagcacattacctacggtgatttcgacgttttgcttcaattataaccacgtcgcctttaacgcgtgcctcgtgcagatgtttttcatccacacttttagcttcatggaaagcggtattcttctggccatgtctctcgatcgctttgtggctatttgttaccctctccgctatgtcacggttctgacccataatagaatccttgctatgggcctgggaatactcaccaagtcttttacaaccctgtttcctttcccttttgtggtgaagagactgccgttctgtaaggggaacgtactacatcattcatactgcctgcaccctgacctcatgaaggtggcctgcggagatatccacgttaataacatctacgggctcttggttattattttcacttatggcatggattcaaccttcattttactctcttatgctttgatactgagagctatgttagtgataatttcccaggaacaacgcctgaaggccctgaatacatgcatgtcccatatttgcgccgtcctcgcgttttacgtgccaattatcgcagtgtctatgattcatcgcttctggaaaagcgcaccccctgtggttcacgtgatgatgagcaacgtctacctttttgtgcccccaatgctaaacccaattatttattctgtcaaaactaaggagatccggaagggcatcttgaagttctttcacaaatcacaggcgtag

SEQ ID NO: 52518 - DNA, 945 bp, Artificial Sequence
  Description of Artificial Sequence: Synthetic coding sequence
atgctcgggctgaacggaactccgttccagcctgctaccctacaacttactggaattccaggtatccagaccggcctgacttgggtagccctaatcttctgtatactgtacatgatatctatcgtgggaaatctttcgattctgaccttagtcttctgggagccagctctgcaccagcctatgtactactttttaagtatgctggctttgaacgatctgggagtgtctttttccaccttgcccaccgtgatttctacattttgcttcaactacaaccacgtggccttcaacgcctgccttgtccagatgttctttattcatactttctcttttatggagtcaggcatactcctagccatgtccctggacaggtttgtggctatatgttatcccctccgttatgtcaccgtgctcacccacaatcgaatcctggcaatgggtctggggattctgacaaaaagcttcactacattattcccatttcccttcgtggtgaagcggctgccgttttgcaaagggaacgtgctgcatcacagctattgcctacaccccgatctcatgaaggttgcgtgcggcgacattcatgtgaacaacatttatggcttactcgttattatcttcacatatggtatggactccacctttatactcctgtcttatgccctgattttgagagctatgctcgtcattatctcacaggagcagcgactaaaagcactgaacacatgtatgagccacatttgtgctgtcttggcattttacgtcccaatcatcgccgtttcaatgattcaccgattctggaagtccgcgcctccagtagtgcatgtgatgatgagtaacgtctacctgttcgtccctcccatgctgaatccaattatctatagcgtcaaaaccaaagagatcaggaagggcatcctgaagttcttccacaagtctcaagcttag

SEQ ID NO: 52519 - DNA, 939 bp, Artificial Sequence
  Description of Artificial Sequence: Synthetic coding sequence
atgggacttttcaacgtcacccatcctgcgttcttcctccttaccgggatcccaggcctggagtcatctcatagctggttgtcgggcccactgtgtgtcatgtacgcagtggccttgggcggaaatactgtgattctacaggccgttagagtggaaccatccttgcacgagccaatgtattactttttgagtatgttatctttttctgacgtggcgatcagtatggccaccttgcctactgtgcttagaacgttctgcctgaatgccaggaatatcaccttcgatgcctgcctgatccagatgttcttgatacacttctttagcatgatggagtcgggaattctgctagctatgtcctttgacaggtacgtggccatctgtgaccctctcaggtacgcaactgtcctgaccactgaggtcattgccgctatgggactgggtgcagcggctagatctttcattactctgttcccgttaccctttcttattaagaggttaccgatctgtaggtcaaatgtgttaagtcactcgtattgtcttcatccagacatgatgcggttagcatgtgcagacatctccattaactcaatctacggccttttcgtgctcgtttccacgtttggtatggatctgttctttatctttctgtcttacgtgcttattctacgcagcgttatggctaccgcttcacgggaggagcggctcaaagctcttaatacttgtgtgtcccacatccttgccgtgctggcattctacgtgcctatgattggcgtcagcaccgtccacaggtttgggaaacacgttccgtgctatatccatgtcctgatgagcaacgtgtatctcttcgtgccccctgtcctgaatccgctcatttactccgctaagacaaaagagattcgaagagcgattttccgcatgtttcaccacataaaaatctag

SEQ ID NO: 52520 - DNA, 951 bp, Artificial Sequence
  Description of Artificial Sequence: Synthetic coding sequence
atgaaaatcagcaataactcactcggtttcctacccactacattcattctcgtcggcatccccggactggagtctgagcacctctggatcagtgttccattctcactcatttatataataattttcctgggcaatggcatcattttgcatgtcatccgcacagatatcgctctgcatcagccgatgtacctgttcctcgctatgctcgccttagccgaggtgagggtgtctgccagtacactgcctaccgtgttggggatttttctatttgggaacaccgaaatctcactcgaggcatgtctcttcccagatgtgctacacccattcttcatccacgatggagcatcttgcgccgctgggcacgtgtttgggccattgtacagccacttgcaacccacggagctgcacagttaccctgacaccgcccagggattgtggcaccgttcttactatcgtacggaaaaacattatgcccatggcagcgttgcccactctctgatggcttccgcacttctttggcctcagtgtccgctgacattcttactgtctgcaccgcaatcgtacttgtcctgcggaaatatttctgtgaacaatatctatggcatttttatcgtcacttctaccttcggccttgactcattgctgatagtaattagttacggtttgatacttcacacggtgctgggaatcgccacgggggagggcagaaagaaggccctcaatacatgcgggagtcacgtgtgtgctgtgctggcatactacgtgcctatgattggcttgtcaatcgtgcacaggctgggccaccgcgtgagccccttgctacaggccatgatggcaaacgcctacctgttcttcccacctgtcgtgaacccgattgtgtactccatcaaaacaaaagagattcatggcgctattgtaagaatgctgttagagaaacgccgaagggtgtag

SEQ ID NO: 52521 - DNA, 948 bp, Artificial Sequence
  Description of Artificial Sequence: Synthetic coding sequence
atgggggattggaacaactctgatgccgtggagcctatctttattctgcgaggatttcctggtctggaatacgtgcattcatggttgtcaatcctcttttgtctggcatacctcgtggcattcatggggaacgttactattctgtccgtgatttggatcgagagttcactacatcagccaatgtattattttatcagcatccttgcagtgaatgatcttgggatgagcctgagtacactgccaacgatgctggccgtgctttggctggatgcgcctgagattcaagctagcgcttgttatgcccagctgttcttcattcataccttcacctttctagagagctccgttctgctggcaatggctttcgatagatttgtcgccatatgtcaccctctccactaccccacaatccttacaaatagcgtcattggtaaaatagggctcgcctgcctcttaaggagcctcggagtcgttctgcctacccctctgttgcttcgccactatcattactgccacgggaatgccctgagtcatgccttttgtttgcaccaggacgtgctaaggctgtcgtgtacagatgccaggacaaatagcatatatggactgtgcgtggtgattgccacactgggcgtggattcaattttcattttgttgtcctacgtgttaattctgaatactgtcttggatatcgcatcacgggaggagcagcttaaggccctcaacacctgtgtctcccatatatgcgtagtactcatattcttcgttccagtcatcggagtgtcgatggttcatcgtttcggaaagcacctgagccccattgtccatatcctgatggcagacatctacctgcttctaccgcctgtgctgaatcccatcgtgtatagcgtgcggactaagcagattcgcctcggcattcttcacaagtttgtactaaggagacggttttag

SEQ ID NO: 52522 - DNA, 954 bp, Artificial Sequence
  Description of Artificial Sequence: Synthetic coding sequence
atgagccaggtgacgaacacaacgcaagaaggcatttacttcattctgactgatattccgggattcgaggcctcccacatctggattagcatccctgtgtgctgtctgtacactatctctattatgggcaataccacaatcctgactgtgatcagaaccgaaccatccgtgcatcagcgcatgtacctgttcctcagtatgctggcactcaccgacctgggacttacgctgaccacactgccaacggtgatgcagctgctgtggttcaatgtgagacgcatctcctccgaagcttgtttcgcacagttcttcttcttgcatggattcagtttcatggagagcagtgtgctgttggccatgtcagtggattgctacgtagcaatctgttgccccctacactacgcaagcatactgacaaacgaggtgattggccgtacaggtttggccatcatttgctgctgtgtgctcgccgtgctcccatctctcttcttgttgaagaggttgccattttgccactcacatcttcttagtaggtcttactgcctgcaccaagacatgatcagactggtgtgcgctgatatcaggctaaattcttggtatgggttcgccctggccctgctcatcataatcgttgatccgctgttaattgtgatttcctatacactgatccttaagaatatcctcggcaccgccacatgggcagagcggctgagagctctgaataattgtttatcacacattctggcagttttagtgctatatatcccaatggtaggagtgtctatgacccaccgatttgccaagcacgccagcccactggtgcatgtcataatggctaatatctatctgttggccccacctgttatgaacccaataatttacagcgtgaaaaataaacagatccagtggggaatgcttaatttcctgagtcttaagaatatgcatagtaggtag

SEQ ID NO: 52523 - DNA, 972 bp, Artificial Sequence
  Description of Artificial Sequence: Synthetic coding sequence
atgtcaacactccctacgcagattgcgccaaactcgtctaccagcatggctccaacctttctgctggtaggcatgcccggtctctccggagcaccatcctggtggacactccctcttatcgccgtgtacttactttcagccttgggtaacggcacgatcttatggataatcgccctccagcctgccctgcaccgccctatgcacttctttttatttctcctgtcagtatctgacattggccttgtaacagcgctaatgccgactctgctgggtatcgcactcgctggagcacatacagtacccgcttctgcctgtctccttcagatggtgttcattcatgtgttctcagtaatggagagttcagtcctgcttgccatgtcaatcgaccgtgccctcgcgatatgccgacccctgcactaccctgcattgcttaccaacggtgttatcagcaagatctccctggcgatttcattcagatgtttggggctccatctcccactcccgttcttacttgcttacatgccctattgcctcccacaggtgctgacacacagctactgccttcatcccgacgtcgcccgactggcttgcccagaggcttggggtgctgcatacagcctgtttgtggttctctccgcaatgggattagaccccctgcttatctttttttcttacggcttaataggaaaggttctgcaaggagttgaatcacgcgaggaccgctggaaggctggccagacttgcgctgcgcacctgagcgccgttctgttgttctacatccccatgattttgctggcgctgattaaccaccccgaactaccgattacccaacatacgcacaccttgttgtcatacgtgcacttcctgcttccaccattgattaaccctattctgtactccgtgaagatgaaagaaatcaggaaacgcattcttaaccgattacaaccacgcaaagtgggtggcgctcagtag

SEQ ID NO: 52524 - DNA, 984 bp, Artificial Sequence
  Description of Artificial Sequence: Synthetic coding sequence
atggctatcttcaacaataccacctctagtagtagcaatttcttgctgacagcgtttcccggactggagtgcgcccacgtgtggatttcaatcccagtttgttgcttgtataccattgctttgctcggaaacagcatgatctttctcgtgattattacaaagcgaaggctgcacaagccaatgtactacttcctgagcatgctagccgcagtcgatctctgcctaactatcacaactttgcctacggtactgggcgtgctctggtttcatgcacgggaaatatctttcaaggcatgctttatacagatgttttttgtgcatgcattcagcctactcgagagttccgttctagttgccatggccttcgatcgcttcgtcgctatatgcaacccattgaactacgctacaatcctgacggacagaatggtcttagtcattggcctcgtgatctgcatcaggcccgcagtcttcctgttaccgctgttggtagcaatcaacacagtgagctttcacggcggacacgagctcagtcatcctttttgttaccacccggaagttatcaagtatacatacagtaaaccatggatttcttccttttgggggctgtttctacaattatatctgaatggcacagacgtgctgttcatactgttttcctatgtgttgatcctgaggactgtattaggaattgtcgcgaggaaaaaacagcagaaagcgctgtccacttgtgtgtgtcacatctgtgcagtcactatcttctacgtgccactgatttccttgagtctggcccaccggctgttccattccacccctcgggtgctatgctctaccctggccaacatctacctactcttacccccagtactaaaccctatcatatattcccttaagacaaagacaatcaggcaggccatgtttcagctgctccagagcaagggcagctgggggttcaatgtgaggggactcagaggtaggtgggattag

SEQ ID NO: 52525 - DNA, 1065 bp, Artificial Sequence
  Description of Artificial Sequence: Synthetic coding sequence
atgacgaataaaatgtacgcaatctacattaagaatctgaactattttagcttcctgatcgtgcagtgtttacagcccactatggccatatttaataacaccacttcctcctcctccaatttccttctcaccgcatttcctggcctagaatgcgcccacgtgtggatctctatccctgtctgttgcctgtatacaattgctctgttgggtaactccatgatttttctggtaataatcacaaagagaagactccacaagcctatgtactatttcctttcaatgcttgccgctgtcgatctctgcctgacaataacgaccctgcccacagtgctgggtgtgctatggttccatgctagagagatctctttcaaagcctgttttatacaaatgttttttgtccacgctttctcattactggagtcttcggtcttggttgcaatggcattcgaccgctttgtggccatctgcaacccactgaactatgctacgatcttgactgataggatggtgttggtgatcggcctggtgatttgcattaggcccgcagttttcctgcttccactgttggtggctatcaatacagtgagcttccacggtgggcacgaactgtcacacccattctgttaccatccagaagtgatcaagtacacgtattccaaaccttggatttcttcgttttggggacttttcctgcagctttacctcaacggcacagacgtccttttcattttattctcatatgttctgattttacgcacagtcctgggcatcgtggcacggaaaaagcagcaaaaggcgctgagcacctgtgtttgccacatctgtgccgttaccatcttttacgtgccacttatctcattatcactggcccaccggttattccactccactccgcgtgtgttgtgcagtactctggctaacatctaccttctcttgccacctgtcctgaaccctatcatctattcacttaaaaccaagacaatcaggcaggcaatgtttcaactgctgcagtctaaagggagctgggggttcaacgtaagaggactcagagggagatgggactag

SEQ ID NO: 52526 - DNA, 966 bp, Artificial Sequence
  Description of Artificial Sequence: Synthetic coding sequence
atgtttctgtcctctcgaatgataacttcggtgtctccatccaccagcactaacagttctttcctcttgactggattctcaggtatggagcagcagtatccctggctgagcattcccttttcctctatctacgccatggtgcttctggggaattgcatggtactccacgtgatctggactgagccaagcttgcaccagccaatgttttactttttaagtatgctggccttgacggatctgtgtatgggactctcaaccgtgtacactgttctcggtatcctctggggcattatacgtgagatcagccttgacagctgcatcgctcaaagctacttcatccacggtctgtccttcatggaatcgtccgtcctgctgacgatggccttcgatagatacattgccatctgtaaccctcttaggtactcctcgattctaacaaacagcaggataatcaaaattggactgaccatcatcggcagatcatttttctttattactcctcctataatatgtcttaaattttttaattattgccacttccatattttatctcacagtttctgccttcaccaggatttgcttagactggcctgttccgatatacgctttaacagctattacgccctcatgctggtgatatgcatattgctgctggacgcaatcctgattttgttctcgtatattctaatcctgaagagcgtgctggccgtggcctctcaggaagagagacacaaacttttccaaacctgcatttcgcacatatgcgctgttctggtattctatattcccataatatccctaaccatggtacaccgttttggaaaacacctgagcccagtggctcacgtgctcatcgggaatatctacatcctgttcccacctttgatgaaccccatcatttattctgtgaaaacgcaacaaatccatacgcgtatgctgcgactgttttctctgaagaggtactag

SEQ ID NO: 52527 - DNA, 939 bp, Artificial Sequence
  Description of Artificial Sequence: Synthetic coding sequence
atgagcatctccaatatcacagtttacatgccctccgtcctcactctcgtgggcattccagggctggagtccgtccaatgctggatcggtattcccttctgtgccatctacttgattgctatgattggaaactctctgttgctgtccattatcaaaagtgaaaggagtctacatgagccactgtacatattcctgggaatgctgggggcaaccgacatcgccctggccagcagtattatgccaaagatgctcggcattttctggttcaacgtaccagaaatttattttgactcttgcctgttacagatgtggtttattcacaccctgcaggggatcgagagtggaatactggtggctatggccctggatcggtatgtggccatatgctatccactgagacacgcaaacatctttacacatcagcttgtaatccagatcggcaccatggtcgtacttcgcgctgcgattctggtggctccctgcctcgttctcatcaagtgccgattccaattttatcacaccacagtgataagtcactcctactgcgaacatatggcaatcgtcaaacttgctgctgctaatgtacaggtaaacaagatttacggcctcttcgttgccttcactgtggctggtttcgatttaacatttatcacactctcttacatccagatctttataaccgtgttcaggttgccccaaaaagaagccagatttaaggcttttaatacttgtattgcccacatctgcgttttcttgcagttttacctactggcattcttttcctttttcacccacagatttggctcacacatttctccctatattcatattctctttagcagcatttaccttctcgtgccaccatttctgaacccactcgtatatggagccaagaccacccaaatccggattcacgtggtaaaaatgttctgctcctag

SEQ ID NO: 52528 - DNA, 939 bp, Artificial Sequence
  Description of Artificial Sequence: Synthetic coding sequence
atgagtatttcgaacattacagtctacatgccttccgtcctgacactggttggcatccccggacttgaaagcgtgcagtgctggattggaatcccattttgtgctatatatctgatcgctatgataggcaattcactccttctatctataataaagtctgaacgttcactgcacgagccactgtatatctttctcggaatgctcggggcaaccgatattgccttggcctcttctatcatgccaaagatgctcggcatcttctggtttaacgtgcccgagatctatttcgactcctgccttctacagatgtggttcatccacacgctgcagggcattgagagcggaatacttgttgccatggccttagaccgatacgtagcaatttgctaccctctcaggcacgccaacattttcactcatcagttggttattcagatagggaccatggtggtacttcgcgctgctatcctggttgctccctgcttggttctcatcaaatgtcgcttccagttctatcataccaccgttatttcgcacagttactgcgagcatatggcaatcgttaaactggccgctgccaacgtccaggtgaataagatatacgggttattcgtggcatttacagttgcaggatttgatctcacattcatcaccctgagctatatccagattttcatcacggtttttcgtctgccacaaaaggaagctcgcttcaaggcattcaacacatgtattgctcacatttgtgtgtttctccaattctatctccttgccttcttcagcttcttcacccacaggtttgggtctcacatttctccatacatccatatacttttttcttccatctatctccttgtgccaccatttctgaatcccctggtctacggggctaaaaccacccagatacggattcatgtcgtgaagatgttctgttcatag

SEQ ID NO: 52529 - DNA, 951 bp, Artificial Sequence
  Description of Artificial Sequence: Synthetic coding sequence
atgcccacgtttaacggatcagtgtttatgccttctgcctttatcctgatcggcattcccggactggagtctgtgcaatgttggatcggtatccccttttccgccatgtatctgataggcgtcatcgggaactccctcatcctggtcatcatcaagtatgagaattccttgcatattcccatgtatatcttcttagctatgttagccgcaaccgatattgcactgaacacatgcatcctacccaaaatgctcgggattttctggtttcatcttccagagatctcatttgatgcatgcctgtttcagatgtggctgatccacagtttccaggccattgagtcgggaattttgctggcgatggccttagaccggtatgtcgcgatctgcatcccactgcgacacgcaacaatcttttctcagcagtttctcactcatatcggactcggcgttaccttacgtgccgctattttaatcatcccctccctggggctcattaagtgctgtctcaaacactaccgcaccaccgtcattagccactcatactgtgagcacatggccatcgtgaaactggccaccgaggatatcagggtcaataagatatacggccttttcgtggctttcgcaatcttgggtttcgatattatcttcattacactctcctacgtgcaaatattcataaccgtgtttcagctgccccagaaagaggcccgtttcaaggcgtttaatacttgcatcgcccatatctgcgtattcttgcagttctacctgctggcctttttttcattctttactcaccggtttgggtcacacatcccaccctatatccacatattgctttcgaatctgtatctgttagtccctccttttcttaatccgatcgtgtacggagtaaagacaaaacagataagagaccatatagtgaaagtgttttttttcaaaaaggtcacctag

SEQ ID NO: 52530 - DNA, 972 bp, Artificial Sequence
  Description of Artificial Sequence: Synthetic coding sequence
atgagccacaccaacgttaccattttccatccggctgtattcgtcttgcctgggatacctggcctggaagcctaccacatttggctctcaatccccctgtgcctaatctacatcaccgccgtactgggtaactccatcctaattgtcgtcatcgtgatggagaggaatctgcacgttcctatgtacttcttccttagcatgctggccgtgatggatatcctactgtccactacaacggtcccaaaggcactggcaattttctggttacaagcccacaacattgcattcgacgcctgcgttacacagggcttttttgtccacatgatgttcgtcggtgaatcggccattctcctggccatggcattcgaccgattcgttgctatctgtgcccctctgcgttataccaccgtgctgacatggcctgtcgtcggcagaattgctctagccgtcatcacgaggtcattctgtatcatcttccctgtcatctttcttttgaagaggctccccttctgcctgacaaacatcgttccacatagctactgtgaacacatcggggtggcgcgactggcttgcgccgacatcactgtgaacatctggtacggtttctccgtgcccatagtgatggtgattttagatgtgattctgatcgcagttagttactcccttatcttacgcgctgtgttccgcctgccatcacaggacgctcggcacaaagcactcagtacctgtggcagccatttatgtgtgatactgatgttttatgtgccatctttttttacactgctgacgcaccacttcgggagaaatatccctcaacatgttcacatcctcctggctaacttgtacgtggctgttcccccaatgctcaatccaattgtgtacggggtaaagaccaagcagatccgcgagggcgtggcccaccgattcttcgatatcaaaacttggtgctgtacatctccactgggcagctag

SEQ ID NO: 52531 - DNA, 945 bp, Artificial Sequence
  Description of Artificial Sequence: Synthetic coding sequence
atgccaacagtcaaccacagcggaaccagccatacggtgttccaccttctcgggattcccggactgcaggatcaacacatgtggatatccatcccttttttcatctcttatgtgaccgctcttttgggtaattcacttcttatattcattatcctgaccaaacgctcacttcatgagcccatgtacctgtttctgtgtatgctggctggtgcggacattgtgctctcgacatgtaccattccacaggcactagccatcttttggttccgtgcgggtgatatatcactggatcggtgtatcacacagttattcttcattcatagcaccttcatttcagagtctggaatcttgttggtaatggcctttgaccattacatcgccatatgctatccactcagatacactacgatcttaaccaacgcccttatcaaaaagatctgtgtcacagtgtctcttcgcagttacggcacaattttcccaatcatctttctgctcaagcgcctgacattttgccagaacaacatcatccctcacacattttgcgagcatattgggttggcgaagtacgcatgtaatgacattcggattaacatttggtatggattcagcattcttatgtcgacagtggttcttgacgtcgttctgatttttatatcatacatgctcatcctccacgctgttttccacatgccatcgcctgacgcctgtcacaaggctctgaacacattcggttctcacgtctgcatcataattcttttctatggttctgggatattcaccattctgacgcagcggttcgggagacacataccgccatgcatccatatcccattggcaaatgtctgtattctggcgccacccatgctcaatcccatcatctatggcatcaagaccaaacaaattcaggagcaggtagttcagttcctctttatcaagcagaagtag

SEQ ID NO: 52532 - DNA, 1008 bp, Artificial Sequence
  Description of Artificial Sequence: Synthetic coding sequence
atggctcaagtgagggccctgcacaagattatggcactctttagcgcaaacagtatcggcgcaatgaacaattcggacacgcgaattgcgggatgttttctgactgggatccccggtctggagcagcttcacatctggctatccattcccttttgtattatgtacatcaccgcactggagggtaatggtattttaatttgcgtaattctgagtcaggcaatattacatgaacccatgtacattttcctgtctatgttagcaagcgcagacgtgctgctttccacaacgaccatgccgaaggccctcgcaaatttgtggttagggtattcactgatctcatttgatggatgcttaactcaaatgttttttatacatttcctgtttatccacagcgccgtgctgcttgctatggcgtttgacagatatgtggcaatctgtagcccactccgctatgtaacaatcttgactagtaaggtgattggcaagattgtgactgctgctctcagccactcattcatcataatgtttccttcaattttcttgctcgagcatttgcattactgccagataaacattatagcgcacaccttttgtgagcacatgggtatcgcccacctgtcttgctccgacatcagcataaatgtgtggtacgggcttgccgctgccttactgtctacaggtcttgatatcatgctgataacagtgtcctatatacacattctgcaggcagtgttcagactgctctcccaggatgcacgctcaaaagctttatccacttgcgggagccacatatgcgtcatactcttattctacgtgcctgctctcttctctgtcttcgcctatcgcttcgggggtaggtcagtaccatgctacgtccatatactgctagcgagcttgtatgtcgtgatcccgcctatgctgaaccctgttatttacggggttagaaccaaaccgatactcgaaggggcaaagcagatgttctccaatctcgctaaagggtcaaagtag

SEQ ID NO: 52533 - DNA, 957 bp, Artificial Sequence
  Description of Artificial Sequence: Synthetic coding sequence
atgagcgatagtaatctgtccgacaaccacctgccagacaccttcttccttaccggcatcccagggctggaggcagctcatttttggatcgccatacccttctgcgctatgtacctggtggcactggtgggcaatgccgctctaatactcgttatcgcaatggataacgcattgcacgctcccatgtacttgttcctttgccttttatctctgaccgacctggctctcagctccacaactgtgcctaagatgctcgctatcctgtggctgcacgctggtgagatatcttttggtggttgcttggcccagatgttctgtgtgcacagtatatatgcgttggaaagttctattcttctggcgatggctttcgatcgctacgtcgccatctgcaacccgctacggtacacgactatactgaaccatgctgtaataggcagaatcggtttcgtgggccttttccggtctgttgcaatcgtgagcccctttatcttcctgctgcgccgactgccctactgtggtcacagggtaatgactcatacctattgtgaacacatgggaattgcgaggctggcctgcgcaaatattaccgtgaacatagtctacggactcactgtggctctgctggcgatgggtttagacagcatactcatcgccatcagctacggatttatccttcatgccgtgttccacctgccttcccacgatgcccagcacaaggcactgagtacatgtggctctcatattgggatcattttagtattctatattccagccttcttcagtttcctaacacatcggttcgggcaccacgaggtgccaaagcatgtgcatatctttcttgctaacctatatgttctcgtccctccggtgctgaatcccatcctttatggtgccaggaccaaggagattagatcccgcctcctcaagctcttgcatctcgggaagactagtatctag

SEQ ID NO: 52534 - DNA, 978 bp, Artificial Sequence
  Description of Artificial Sequence: Synthetic coding sequence
atgtttctgccgaatgatacccagtttcatccttcaagctttctgttactggggatccccggtttagagacactccacatatggattggatttcccttctgcgcagtttatatgatcgctctgataggaaactttaccatcctgctggtgatcaaaaccgatagcagcctgcatcaaccgatgttctactttcttgccatgcttgccacaacggacgtgggtctgtctaccgcgactatccccaagatgttaggtatcttctggatcaacctcagaggcattattttcgaggcttgtctgactcagatgttctttatccataattttacattaatggagagtgccgtgctggtggcgatggcttacgatagttacgtggcaatctgcaatcccttacagtattccgctattctgaccaacaaggtcgtgtcagtgatcggcctgggagtttttgttagagcactcatcttcgtgattccttctattctcctgattctgcgcctcccgttctgtggtaatcatgtgatcccccatacgtattgtgagcacatgggtttggctcatctgtcctgtgccagcattaaaatcaatattatttatggactgtgcgccatttgcaatctcgtttttgatataacggtaattgccctgtcgtacgtccacatactttgcgcagtttttagactgcccactcacgaagcaaggctgaaatccttgagtacctgcggaagccacgtctgtgtaatcctggccttctacaccccagcattgttttccttcatgacacaccggtttggaagaaatgttcccagatacattcacatcctcctggcaaacctgtatgtcgttgttccacctatgttaaatccagtaatctatggagtcaggaccaagcagatatataagtgtgttaagaaaattcttctgcaagagcaggggatggagaaggaggagtatctgatccacactcggttctag

SEQ ID NO: 52535 - DNA, 939 bp, Artificial Sequence
  Description of Artificial Sequence: Synthetic coding sequence
atgccttccatcaacgatacccacttctatccgccattttttctcctcctgggcatccccggtctcgataccttgcatatttggatttcgttccccttctgcatcgtgtatttaattgcgatcgttggaaacatgactattttgttcgttattaaaacagaacactccttgcaccagcccatgttttattttctggccatgctcagcatgatcgacctgggcctgtcaacgtctacaatccccaaaatgcttgggatcttttggttcaatttgcaagaaatttcatttgggggatgtctgcttcagatgttcttcatccacatgtttactggcatggaaacagtgttgctcgttgtgatggcatacgacagattcgtagctatatgcaatcctctgcaatatacaatgattctgaccaataagactattagtattcttgcctccgtggtggtgggtagaaatctggttttggtcacccccttcgtttttctgatcctgaggttgcccttttgtggccataatattgtaccacatacatactgtgaacaccgcggtttagcaggtctagcctgtgctcccattaagatcaatatcatttacggtcttatggtgatttcctacattatcgtggacgttattttgattgcctcttcttatgttttaatcctccgggctgtatttcggctgcccagtcaggacgttcggctcaaggccttcaacacgtgcggatctcacgtatgcgtcatgttatgcttctacactccagcgttcttttctttcatgacacataggttcggacaaaatatacctcactatattcacatcctccttgctaacctgtatgtggtcgtgcctcccgctctgaaccctgtgatttatggtgtgagaactaaacagatccgggagcagattgtgaagatatttgtgcaaaaagagtag

SEQ ID NO: 52536 - DNA, 942 bp, Artificial Sequence
  Description of Artificial Sequence: Synthetic coding sequence
atgcccattgccaacgatactcagttccacacgagctcttttcttctcctgggcatccctgggttagaggatgtgcacatttggattggctttccctttttcagcgtatacttgattgctcttctcgggaatgctgccatattcttcgtgattcagaccgaacagagcctgcacgaaccaatgtactattgtctggcaatgctggattccatcgaccttagcctttccactgctaccatcccaaagatgctgggaattttttggttcaacatcaaggagataagcttcgggggatacctttcccagatgttcttcattcactttttcacggtcatggaatccatagtccttgtggctatggcatttgatcggtacattgcaatctgtaaacccctgtggtatacaatgatccttaccagtaagattatttccctgatcgccggaatcgccgtcctccgctcactgtatatggtcattcctcttgtttttttactgttgcggttgcctttttgcggccatagaatcattccacatacctactgtgaacacatgggaatcgccagactggcctgcgctagcattaaagtgaacatcatgttcggattaggaagcatcagcctcttgctcctggatgtgctactcattatactgagccacattcgcatcctttacgccgttttttgtctccctagttgggaagccaggttgaaagcccttaatacatgcggcagccatattggcgtgattctggcatttagcacccccgcatttttctccttcttcacgcactgttttggacacgacataccccagtacatacacatcttcctggcaaatctatatgtggtagtgcctccgacattgaatcccgtcatttatggggtccgtactaagcatatacgagagacagtgctccgtatctttttcaagaccgatcattag

SEQ ID NO: 52537 - DNA, 954 bp, Artificial Sequence
  Description of Artificial Sequence: Synthetic coding sequence
atggaaaaaaggatgccaattgctaacgatactcaattccatacctcgtccttcctgttacttggaattcctggcctcgaagatgtgcacatctggatagggtttcctttcttctccgtctatctgatagccctgttgggaaatgccgcaatcttcttcgttatccagacagaacaatctctccacgaacctatgtactactgcttggcaatgttggactcaattgatctgagtctgtcaaccgccaccattcctaagatgctgggtattttctggttcaatataaaggagataagctttggcggatacttgagtcagatgttctttatacatttcttcacagtcatggagagcattgtgctggtcgccatggccttcgataggtacatcgctatctgcaagcccctttggtacacgatgatattgacttccaaaattatatcattgatcgctgggattgcagtacttaggtccttgtacatggttattcctcttgtatttcttctcctaagactccctttttgtggacaccgtattatcccacatacatactgcgaacatatgggcatcgctcggttagcctgtgccagcattaaagtgaacattatgtttggcctcggaagcataagcctgctgttgctggatgtcctgctgatcattctgagtcacattagaattttatacgctgtgttctgcctgccttcctgggaagcccgtctgaaggccctcaatacctgcggtagccacatcggtgtaatcctggcctttagtacgcccgcttttttttcatttttcacacattgctttggtcacgatataccccagtacatccatatctttctggccaatttatacgtagtagttccccctaccctgaatccggtgatctacggggtccgcaccaaacacatacgcgaaacagtcctgaggattttcttcaagaccgatcactag

SEQ ID NO: 52538 - DNA, 954 bp, Artificial Sequence
  Description of Artificial Sequence: Synthetic coding sequence
atggctggcagaatgtctacgagcaaccatactcagtttcacccctcaagcttcctgttgttggggatccctggactcgaagatgtgcacatctggattggggtacccttcttcttcgtgtacctcgtcgccctactggggaacacggcgctgcttttcgtgatacagactgaacagtctctgcatgagccaatgtactacttcttggcaatgctcgacagcatcgaccttggactctctacagctaccatcccaaaaatgctgggcatattctggtttaatacaaaagagatatctttcggcggatgcttatcccatatgttcttcatacacttcttcaccgctatggaaagcatcgtgctggtggccatggcattcgacaggtatattgcaatatgcaagccacttagatataccatgattttaacaagtaagatcatctcgttaatcgccggaatcgcagtgctgagatctttatacatggtcgtgccactcgtctttctgcttcttcggttacccttctgtggccatcgcataatccctcacacgtattgcgaacacatgggcattgctaggctcgcgtgcgcttctataaaggtgaatataagattcgggctgggcaatatcagccttttgctgctggatgtgatattgatcatcctgtcctacgtgagaattctgtacgccgtgttttgcctgccgagctgggaggctaggcttaaagctctcaatacctgcggctcacatataggtgtgatccttgcattttttactcccgcatttttctcatttttgactcaccgattcgggcacaatatccctcagtacatacacatcattctggccaacttgtacgttgtggtgcctcccgctttgaaccccgttatttatggagttcgaactaagcaaatccgagagcgagtccttcgaatttttctcaaaaccaaccattag

SEQ ID NO: 52539 - DNA, 963 bp, Artificial Sequence
  Description of Artificial Sequence: Synthetic coding sequence
atgccatcagcctccgccatgattatctttaaccttagcagctacaacccgggaccctttatcctcgtgggaatcccaggcttggaacaatttcacgtttggattggcatccctttctgcatcatctatatcgtggctgtggtgggcaattgcatcttgctgtatctaatcgtcgtggagcactccttgcacgaacccatgttctttttcctgtcaatgttggccatgacggacctgatcctgtcaactgccggagtgccaaaagcgctttctatcttttggctcggtgcacgggagatcactttccctggctgtctgactcagatgttttttcttcattacaatttcgtactcgatagtgccatcctcatggcgatggcatttgaccattatgttgcgatctgttctcctcttcggtacacaacaatcttgacgcccaaaacaatcatcaagtccgcaatggggatatccttccggagcttctgcattatcctgcccgatgtcttcctgcttacctgtctgccgttctgccggactaggataattccacacacctattgcgagcatatcggagtggcacagttggcctgcgccgatatcagcattaacttctggtacggcttctgcgtcccgatcatgactgtgatcagcgacgtcatactaattgcagtcagctacgcacacatcctatgcgccgtgtttggtctcccatcacaagatgcttgtcagaaagctctcggaacatgtggttctcatgtgtgcgtcatcttgatgttctacactcctgcattcttttccatccttgcacatcgcttcgggcataatgtgtcgcggacattccatataatgtttgcgaatctttacatcgtgatacctcccgcactgaacccaatggtatacggtgtaaagaccaagcagatccgtgataaagtgatactcctgttctccaagggaaccggctag

SEQ ID NO: 52540 - DNA, 1047 bp, Artificial Sequence
  Description of Artificial Sequence: Synthetic coding sequence
acacaggtcccgaaggactgcaccatcctgcttcatcatctctacatcaaccggcaggaagtgtccccagtcatgttggggcctgcatataaccataccatggagactccggcaagcttcttactcgtaggtattcccggtttgcagtcctctcacctctggttggctattagtttgtccgccatgtatatcactgctttgcttggcaatacgctgatcgtcaccgctatttggatggattccacaaggcacgagcccatgtattgcttcctctgcgtgctagcagcggtcgatattgtcatggcctcctctgtggtgcccaaaatggtgtctatcttttgctcaggcgacagcagcattagtttttcagcctgtttcacccaaatgttctttgtccacttggcgactgctgtggaaacaggattgctcctgactatggcttttgatcgatatgtggccatttgcaaacccctgcattacaagcgaattttaaccccacaggttatgctcgggatgtccatggcagttaccatccgcgctgtcacgtttatgacccccctgtcatggatgatgaatcacttacccttctgtggaagtaacgtcgtggtgcacagctactgcaagcacattgccctagccagattggcatgcgccgacccagtaccaagctctttgtattctctgatcggatctagcctgatggtaggcagcgatgtcgcctttatcgctgcctcatacatcctaattctaagggccgtatttgatctaagcagcaaaacagctcagcttaaggccttgtcaacctgtgggagtcatgtcggtgttatggccctgtactatctccctggaatggccagtatttacgccgcatggctggggcaggatattgttcctctgcatacccaggttctgctggcggatctgtatgttattataccagccacattgaaccctattatctacggaatgcggacgaaacagctgctggaaggcatttggagctacctgatgcattttctatttgatcattctaacttgggttcatag

SEQ ID NO: 52541 - DNA, 975 bp, Artificial Sequence
  Description of Artificial Sequence: Synthetic coding sequence
atgcttggcccagcctacaatcacactatggaaacgcctgcgtctttcctgttggtcgggataccgggtttacagagcagtcacctgtggctggccatcagtctgtctgcgatgtacataactgctctgctaggaaataccctgatcgtgacagccatctggatggatagtactcggcatgagcctatgtattgtttcctctgcgtactcgctgccgtggacattgttatggcatccagcgtcgtccccaagatggtgagcatattctgcagcggtgactcaagtataagcttctccgcatgtttcacacagatgtttttcgtgcacctggcaacagccgtcgaaaccggtctcctgctgaccatggctttcgataggtacgttgcgatttgtaagcctctgcattacaagcgcatcttaaccccacaagtgatgctggggatgagcatggcagtgacgattcgggctgtaacctttatgaccccgctgtcgtggatgatgaaccacctcccattctgtgggtcaaatgtggtagtacatagctactgtaagcacatcgcactcgccaggctcgcttgcgccgatccagtgcccagcagtctctatagtctaatcggctccagtctcatggtgggaagcgacgtggccttcattgccgcatcttatatcttaattctgcgcgctgtgtttgacctgtcttccaagaccgcacagctgaaagccctgagcacttgtggatcccatgtgggcgtgatggcgctgtattacctccccggtatggccagcatttatgctgcctggttaggccaagatattgtccctctccacacacaggttcttctggccgacctctatgtcattattccagctaccctgaacccaattatatacgggatgagaacaaagcagctgttagaggggatttggtcttatctaatgcatttcctgtttgaccactcaaacctgggtagctag

SEQ ID NO: 52542 - DNA, 1053 bp, Artificial Sequence
  Description of Artificial Sequence: Synthetic coding sequence
atgtgtcagcagatcctccgcgattgcatcctcctgatccaccacctgtgtatcaatcggaagaaagtttccttggtaatgctaggacccgcttataatcatacaatggaaactcccgcatcgtttctgcttgtggggatcccaggactgcaatcttcacacttatggctcgccatttcactcagcgctatgtatattatagccctcctgggtaacacaatcattgtaactgctatctggatggattccaccaggcatgagccaatgtattgcttcttgtgcgtgcttgccgctgttgacatagtcatggcgagctctgtggtccccaaaatggtcagcatcttctgtagcggtgacagctctatatctttttcagcttgcttcacacagatgtttttcgttcatctagcaacagcggttgagacggggcttctcttaactatggccttcgatcgatacgtggctatttgcaagccattacactataagcggattcttacgcctcaagtaatgctggggatgtctatggctattacgatccgggctatcattgctatcacaccattgtcctggatggtcagccatctacccttttgcggcagtaacgtcgtagtccattcttactgtgagcacattgctctcgctaggctcgcctgcgccgatccagtccctagttcactgtatagtctgatcggcagctctcttatggttggctctgacgtcgcgtttatcgcagcttcttacatcttgatactgaaagccgtcttcgggcttagctcgaagactgcccagctcaaggccctgtccacttgtggttctcatgtgggagtcatggccctgtactacctcccgggaatggcttcaatttacgctgcctggctcggccaggacgtggtccctctccacacccaggtccttctagccgacctgtacgttataattccagctacattgaatcccataatctacggcatgcggactaaacagctgcgtgaaaggatctggagctacctcatgcacgtcctttttgaccacagtaacttggggtcgtag

SEQ ID NO: 52543 - DNA, 936 bp, Artificial Sequence
  Description of Artificial Sequence: Synthetic coding sequence
atgttttatcacaacaagtctatttttcacccagtgactttcttcctaatcggaattcccggactcgaagatttccatatgtggatctccgggccattctgttctgtctacctcgtcgccttgctgggtaacgccactatcttgttggtaatcaaagtagaacagactctccgagagcccatgttctactttctggccatcctctcaaccatcgatctggccctttccacaaccagcgtgcctagaatgttgggaattttctggtttgatgctcacgagatcaactacggcgcttgcgtcgcacagatgtttttaatccacgccttcaccggtatggaggccgaagtgttactggctatggcttttgacaggtacgtcgcagtttgcgctccacttcactatgctaccatcctcaccagtcaagtcctggttggtatttcgatgtgtatcgtgatccgccctgtgttgctaactctccccatggtgtatttaatatataggcttcctttctgccaggcgcacatcatcgctcatagttactgcgaacatatgggtattgctaaactgtcctgcggcaacatacgaataaatgggatctatggcttgtttgtggtttctttttttgtgctaaatctggttctcattggcatctcttacgtatacattctcagagccgtttttcggcttccctcgcacgatgctcagctgaaagccctcagcacctgcggcgctcacgttggcgtgatctgcgtcttttatatcccaagtgttttctccttcctcacacatcggttcggccatcaaataccgggatacatccacatcctggttgcaaacctgtatttaatcatcccacccagcctgaaccccatcatctatggcgtacgaactaaacagataagagagcgcgtgctgtatgtctttactaagaagtag

SEQ ID NO: 52544 - DNA, 945 bp, Artificial Sequence
  Description of Artificial Sequence: Synthetic coding sequence
atgctgccaagcaacattacctcgacacaccccgctgtgttcctgctggtcggtattccaggcctggagcatttgcacgcttggataagcattcccttctgctttgcatataccttagcactgctcggaaattgtaccctacttttcatcatccaggccgacgcagccctccacgagcccatgtacctcttccttgcgatgctagcaaccattgacctggttctgagtagcacgaccctcccgaaaatgttggccattttttggtttcgggatcaggagattaattttttcgcatgtctcgtacagatgttttttttacactcgtttagtataatggaaagtgccgtactactcgccatggcgtttgatcggtatgttgcgatctgcaagcctctccattacaccacggtccttaccgggtcgcttatcactaagattggaatggctgcggtggcgcgagctgtgacccttatgactcctctccctttcctcctgcgtagatttcattactgtaggggacccgtgatcgcacactgctactgtgagcacatggccgtggttcggctggcttgcggagacacaagtttcaacaatatctacgggattgctgtcgcgatgttcatagttgtcctcgacctgcttttcgtcattctttcttatgtgttcattctgcaagcggttttacaactggcgtcccaagaggcacggtataaggccttcggcacttgcgtctcgcacatcggcgcaatactctcgacgtatacacctgtggtgattagctcagtcatgcaccgcgtggcaagacatgccgctccgcgtgtgcacatactccttgccatcttctacctgctatttccccctatggtcaacccgattatatatggcgtcaagaccaagcagatcagggagtacgtgctaagcctgttccaacgtaaaaatatgtag

SEQ ID NO: 52545 - DNA, 945 bp, Artificial Sequence
  Description of Artificial Sequence: Synthetic coding sequence
atgtctgccagcaacattaccctgacgcacccaacagcgttcctcttagtggggattcccggtttggagcacttgcacatctggattagcattccattttgcctggcatataccctggcactcctggggaactgcacactcctcctcataatccaggctgacgcggcactgcacgagccaatgtatctcttcctcgccatgctagctgcgattgatttagtcttgtctagttcagcactccctaagatgttagccatattctggttccgagatagagagatcaatttttttgcttgcctcgctcagatgttttttctgcacagcttctccatcatggaatctgctgtattgctcgcgatggcattcgacagatatgtggccatatgcaagcccctgcactacactaaggtcctgaccggcagtctgatcacgaagattggtatggcggcagtcgctcgtgccgttaccctgatgactcctctgccatttttgctgcggtgctttcattactgtcgtggaccagtcatagctcactgctattgtgagcacatggcggttgtgcgcttggcctgcggcgacacctccttcaacaacatatatggtattgcggtggcaatgttcatagtcgttctagacttgctgctggtgatcctgtcttatatctttattctgcaggcagtactactccttgcttcacaagaagcccgttacaaggccttcggaacctgcgtctctcacatcggagccatactggccttttacactactgtggtgattagtagcgtaatgcacagagtggccagacatgccgctccacacgttcacatcctgctcgccaacttctacttactgtttccccctatggtgaaccccattatctatggcgttaaaaccaaacagatccgggaaagcattctgggggtatttccacgaaaagatatgtag

SEQ ID NO: 52546 - DNA, 990 bp, Artificial Sequence
  Description of Artificial Sequence: Synthetic coding sequence
atgactctggtgtcttttttttcgtttctcagtaagcctctcataatgctcctgagtaattcaagctggcggttgagtcagccatcattcttgctggtgggcatcccagggctggaggagtctcagcactggattgcattaccacttggaatcctctatctgctcgcccttgtcggcaacgtgacgattttattcataatctggatggaccccagcctgcaccagagcatgtacctgtttctgtctatgctggcagccatcgacctcgtactcgcctcctcgacagccccaaaagcgctcgctgtgctgctcgtgcacgcccatgagataggctacatagtctgcctgatccagatgttcttcatccacgcctttagttccatggagagtggcgtgctggtggcaatggcgttggattgctacgtggccatatgtcatcctctgcatcattctaccattctgcatccaggggtcattggatgtattggaatggtggtgctcgtccgagggctattgttacttatccccttcccaattctgctgggcaaactgattttctgccaggccaccatcataggacacgcatactgcgaacacatggccgtggttaaacttgcgtgttccgagaccacagtgaaccgagcttacggactcactatggcgctcctggtgattggactggatgtgctagccattggggtgtcttatgcccacatcctccaggccgtgttaaaggtgccaggatctgaggcacgcttaaaggctttttccacctgcggatctcatatatgcgttatactcgttttttatgtgccaggaatctttagcttcctgacgcacaggtttggccaccacgtcccacatcacgtccatgtcctgttggctacatggtacttgctcatgcctccagctctcaatccactggtatacggggtgaaaacccagcagattagacaaagggtcctccgggtgttcacacagaaggattag

SEQ ID NO: 52547 - DNA, 954 bp, Artificial Sequence
  Description of Artificial Sequence: Synthetic coding sequence
atgctgacctttcataacgtttgttctgtgccctccagcttttggctcactggaatcccgggattggagtctttgcacgtctggctctccataccattcggaagcatgtacctggttgcagtagtagggaatgttacaattctcgccgtggtaaaaatcgaaaggtctctgcaccagccaatgtatttcttcttatgcatgctggccgcaatcgacctggtgttaagcacgagtacgattcccaaactcctggggattttctggttcggggcatgcgacattggcctagatgcctgcctgggtcaaatgtttctgattcattgcttcgccacagttgaatcaggtatttttctcgctatggcctttgatcggtacgtagccatatgtaaccctttgcggcacagcatggtgttgacatacacggtagtcgggcgactcgggctggtcagcctgttacggggagtgctgtatattggcccactcccgttaatgataagactgcggctgcccctgtacaagacacacgtgatctcgcatagctactgtgaacacatggctgtggtggccctaacctgcggtgacagtcgggttaataacgtttatggccttagcattggtttcctagtgctgattctcgactccgttgctatcgcagcgtcttacgtgatgatcttccgcgctgtgatgggattggcaactccagaagcgcgactcaaaactttgggcacttgtgctagtcatctgtgcgccatcttgatcttctatgtgcctatcgctgttagctctctcatacaccgcttcggccagtgcgtgcccccacctgtgcataccttgctggcgaacttctacctgctgatcccacctatcctaaaccccattgtgtatgctgtgcgtaccaaacaaatacgagagtccctgctccagattccacggatcgaaatgaaaatacgatag

SEQ ID NO: 52548 - DNA, 963 bp, Artificial Sequence
  Description of Artificial Sequence: Synthetic coding sequence
atgagctttctgaatggcacatctctgaccccagcgagcttcattctgaatgggatccctggcctggaggatgttcatctgtggatcagctttcctttgtgcaccatgtactcaatagccataactggaaatttcggtctaatgtacttaatctattgcgatgaggccctccataggcctatgtatgtgttcctagcactgctgtcttttacagacgtgctgatgtgtacatctactctcccgaatacactgttcatcctgtggttcaacttaaaggaaattgactttaaggcctgcctggcgcagatgttctttgtccatacttttacaggcatggagtctggcgtcctaatgctgatggccctagatcattgcgtggccatctgctttcctctacgctatgccactattttgactaacagcgtcattgctaaggccggtttcctgacgtttcttcgcggtgtcatgttagtgatcccctccacttttctgactaaacggctgccctattgcaagggtaatgtgattccccatacctattgcgaccatatgtctgtagctaaaatctcgtgcgggaacgtgcgcgtgaatgctatctacggcttaatagtggcgttgctgatcgggggtttcgacatcctctgtatcactatctcttacacaatgattctgcaggccgtggtctctttgtcgagtgctgacgctcgtcagaaggcattctccacgtgcaccgcacatttctgtgccatagtgctgacatatgttcctgcgtttttcacattctttacacatcatttcggcggacataccatcccactgcacatccatataatcatggccaatctgtacctgctcatgcctccaacaatgaacccaattgtgtatggggtgaagacccgtcaagtgcgcgagagcgtcataaggttttttctcaaaggcaaggacaattcccacaatttttag

SEQ ID NO: 52549 - DNA, 966 bp, Artificial Sequence
  Description of Artificial Sequence: Synthetic coding sequence
atgagcggcgataactcgtccagtctgacacctggctttttcatattaaatggagtccctggccttgaagccacccacatctggatcagcctgcccttctgcttcatgtacatcattgcagtcgtggggaactgcggtctcatttgtctcattagtcatgaggaagccctccaccgtccgatgtactattttcttgcgttactcagcttcactgatgtaacactctgcacaacgatggtgccgaacatgttgtgcatcttctggttcaatctgaaggaaatagatttcaacgcttgcctggcccagatgttttttgtgcacatgctgaccggcatggaaagtggtgtacttatgctgatggcccttgatagatacgtggccatctgctacccgctgaggtatgccaccatcctgactaatccagtcatcgcgaaggcaggcctggccaccttcctgaggaatgtgatgctaattatcccctttaccttgttgaccaagagactgccatactgccgaggaaatttcattcctcatacatactgtgatcacatgagcgtggctaaggtctcctgcggtaatttcaaagttaatgctatctacggcctgatggtggcactgttgatcggagtctttgatatatgttgcataagcgtttcttacacgatgattcttcaagccgtgatgtcgctgtcgagtgcagacgctcggcataaggctttttctacctgtacatcacatatgtgttctatcgtcatcacgtatgtggccgcattctttacttttttcacacatagatttgtcggacacaacattcctaaccatattcacatcatcgtggccaacctgtacctcctcctgccaccaaccatgaacccgattgtgtacggcgtaaagactaaacagatccaggagggcgtaataaagttcttgttaggagacaaagttagcttcacctacgacaaatag

SEQ ID NO: 52550 - DNA, 966 bp, Artificial Sequence
  Description of Artificial Sequence: Synthetic coding sequence
atgctgacgctcaacaaaacggacctgattcctgccagctttattcttaacggcgttcctggtctcgaagacactcagctgtggatcagcttcccattttgttcaatgtatgtggttgccatggtcggcaactgtggactactgtatctcattcattatgaggacgcgttgcacaagccaatgtactatttcctagcaatgctcagcttcaccgacttggtaatgtgctccagtaccattcccaaggccctctgcatcttctggttccacctgaaagacattgggtttgacgaatgcctcgtccagatgttttttacccacacatttactggcatggaatcaggggtcttgatgctaatggccttggataggtacgtggccatctgctatcctcttcgatatagcacaatcctgacaaatcctgttattgccaaagtcgggacagcaacatttctgaggggagttttacttatcataccatttaccttcctcactaaattactgccatactgccgtggcaacatccttcctcatacttactgcgatcacatgtctgtggcgaaactcagctgtggtaatgttaaggtgaatgcaatatatgggctgatggtggccttactcatctggggctttgacatcctgtgcatcacaaactcctacaccatgattcttcgggctgtcgtctcccttagctctgcagatgctagacagaaagcttttaatacgtgtaccgctcacatctgtgcaatcgtgttttcatatactccagcctttttctcattcttctcccatcgcttcggggaacatatcatacccccttcctgtcacataatcgtcgctaacatttacttgcttctgcccccaacaatgaatcctattgtttacggcgttaaaacgaaacagatccgtgactgcgtcatccggattctttcagggtctaaggataccaagtcctattcaatgtag

SEQ ID NO: 52551 - DNA, 975 bp, Artificial Sequence
  Description of Artificial Sequence: Synthetic coding sequence
atgccactcttcaacagcctgtgctggtttcctactattcacgtcactcctcccagcttcatcctgaacgggattcctggcctggagagagtacacgtgtggatatccttgccgctttgtacaatgtacatcatctttctagtgggaaatctgggtttggtctacttgatctattatgaagaatcactgcaccatcctatgtatttcttttttggacacgccctatccctcatcgacttgctgacctgtacgacaacactgcctaatgccctgtgtattttctggttttcacttaaggagatcaattttaatgcttgccttgcacagatgttctttgtacatggcttcacaggagtagaatctggggtgcttatgctgatggcccttgatcgatacgtagcaatttgttatcccctccggtatgccactactctgaccaatccgatcatcgccaaagccgaactggctactttcttacgaggggtcctcctgatgatccctttccctttcttagtgaagcggttgccattttgccaaagcaacatcatctctcacacctactgtgaccacatgtccgtcgtgaagctgagctgtgcaagcataaaggtgaacgtaatttacggactcatggtggctctcctcatcggagtgtttgacatatgttgcattagcttgtcttacaccttgattcttaaagctgctattagcctgtcttcctcagacgctagacaaaaggctttcagtacttgtaccgcccacatttctgctatcattatcacatacgtccccgctttcttcacctttttcgcgcaccgcttcggcggacacacgatccctccctccctgcatatcatcgtggcgaacctgtatttgttgttgcccccaaccctcaatcctatcgtttatggcgtgaagacaaagcagatccgaaaatctgtcattaaattttttcagggcgataagggcgctggatag

SEQ ID NO: 52552 - DNA, 948 bp, Artificial Sequence
  Description of Artificial Sequence: Synthetic coding sequence
atggtgctcgccagcggaaactcgtctagtcatccagtcagtttcatcttgctgggaattcccggactggaaagctttcaactttggatcgcatttccattctgtgcgacttatgcggtcgctgtggtgggtaatattacactgctgcatgtgatccgcatcgaccacacactccatgagccgatgtatctgttcctggctatgctagctattacggatttagtactgtcttcctctacccaacccaaaatgttggcgattttctggttccacgcacacgagatccagtatcatgcatgcctcatccaggtcttcttcatccatgccttcagtagcgtcgagagcggtgttctcatggcaatggccctggactgctatgtggctatctgctttccattgaggcactcttctatcttaacaccttccgtcgtaattaaacttgggaccatcgtcatgttacgtgggttactatgggtgtcgcctttctgttttatggttagccgaatgcccttctgtcaacaccaagcgataccccagagttactgcgagcatatggcagtgctgaagctcgtgtgtgccgacactagtatcagccgcggaaatggactgtttgtggcattttcagtcgcaggcttcgatatgatagtgataggcatgtcttatgtcatgattttgcgcgcagttctccagctgccttctggagaagcgaggcttaaggcgttctctactcgctcatcccacatctgtgtaatacttgctctgtacatcccagctttgttttcgtttctgacataccggttcgggcacgacgtgccacgggtagtccatatcttgttcgcaaacctttatctccttattccccctatgctgaaccccatcatttacggagttcgcacaaaacaaattggcgaccgagtgatacagggctgctgcggcaatattccctag

SEQ ID NO: 52553 - DNA, 1185 bp, Artificial Sequence
  Description of Artificial Sequence: Synthetic coding sequence
atgttctaccccattctgaatgacattagtacaaagaacaacagtaacatcatgtcttgttgcaacattctgttcatcaagacagttgagatcatccttgtgtacaaccagacgcagagtccctggtatcccatagtgccatctaagagtctcgtgtacaataataacacatgcttcgattgctaccacctgcagagagtggattgtgtgccatccagagatcatataaatcagtcaatggtgcttgcctctggcaactcatctagtcacccagttagtttcatcctcttgggtatccctggactggaatctttccaactctggattgcctttcctttttgtgcaacatatgccgttgccgtggttggaaacatcactctgctccacgttattcgcattgaccatactctgcacgagccaatgtatttatttcttgccatgcttgctatcacagatttagttctgagttccagtacgcagcctaagatgcttgctatcttctggtttcacgcccatgagattcaatatcatgcctgcctgattcaggtgttcttcatccacgcctttagctctgtcgaatcaggtgtgctgatggcaatggctcttgactgctacgttgctatctgtttccccctacgccattcctctattctgacaccttccgtggtcattaagctcggcacgattgtcatgctgagaggactcctgtgggtctcacctttttgttttatggtctcaaggatgccattttgccagcaccaggctattcctcaatcctactgcgaacacatggctgtacttaaactggtgtgtgcggatacaagtatcagccgtggaaacggtctttttgtagccttctcagttgctggttttgacatgatcgtgatcggcatgagttacgtgatgattctccgggcagttctacagctccctagtggggaggcgaggctaaaagcgttctctacgcggtcttctcacatttgtgtgatcctggctctatacatcccggcactcttctccttcctgacctaccgttttggccacgatgtccctagagtagtccacattctctttgccaatctttacttattaatcccacctatgctcaaccccatcatttacggggtgcgcacaaaacagatcggtgaccgtgtgattcagggctgctgcggaaacattccctag

SEQ ID NO: 52554 - DNA, 963 bp, Artificial Sequence
  Description of Artificial Sequence: Synthetic coding sequence
atggccgagaccctgcagcttaactcaacatttctgcaccccaatttcttcatcctaaccggattcccaggtctcgggagtgcgcagacctggctcacacttgtgttcggccctatttacttgctcgccttgctcggaaatggtgccctcccagctgtcgtatggatcgatagcaccctgcatcagccaatgttcctgctgctggctatcctcgcggcaactgatctcggcctggcgacctccattgcacccggactacttgccgtgttatggcttggacccaggagtgtaccctacgccgtgtgccttgtacagatgttctttgtccacgccctgaccgcaatggagtcgggcgttctgttagctatggcctgtgaccgcgctgccgcaatcgggaggcctctgcactaccccgttctggtcaccaaagcatgcgtcggatacgcagcccttgctctggcactcaaagccgtcgccatagtcgtgccttttccactgctcgtggctaagttcgaacatttccaagcgaagacgatagggcacacgtactgtgcccacatggcagtggtggagttagtcgttgggaacacccaagccacgaacttatacgggctcgccctctccttagccatttcaggaatggacattctaggtatcactggaagttacggcttaatcgcgcacgcggtactgcaactgccaactagggaggcacacgcaaaagccttcggaacgtgttcgtcccatatatgtgtgatcctggctttctatatccccggacttttttcttatctgacacatcgattcgggcatcacaccgtgccaaagcctgttcatatcttattaagcaacatctacttgctgcttccgcctgcattgaatcccctgatctatggtgctcggacaaagcagatcagagatcgcttgctggagaccttcactttcagaaagtcccccctctag

SEQ ID NO: 52555 - DNA, 957 bp, Artificial Sequence
  Description of Artificial Sequence: Synthetic coding sequence
atgatccaaccgatggccagtcccagcaattcatcgacagtacctgtatccgaattcctactcatttgcttccccaactttcagtcttggcagcactggctaagcttgccattatctttgctgttccttctggccatgggggctaatacaacgttgctcataaccatccaacttgaagcatctttgcaccagcctctttactacctcttgagtctgctttctctgctcgatatcgtgctgtgtctgacggtgattccaaaagttttagcaatcttctggtacgatttacggtccatctcatttccagcctgctttctccagatgttcatcatgaattcatttctgccaatggagagctgcacttttatggtgatggcatatgaccgctatgttgccatatgccaccccctgcgttaccccagcatcatcacaaaccagtttgtggctaaagcttccgtgtttattgtggtgcgcaatgcccttctgactgccccaattcccattctcacatcactgctgcattattgcggagagaacgtgattgagaactgtatctgcgctaatttatcagtgtcacggttgagttgtgacaacttcaccctgaaccgtatctatcaattcgtggccggatggacactgctcggctcagacctgtttttgatctttctttcttacacatttatcctgagggctgttctgagatttaaggctgagggagccgctgttaaagcgctcagcacctgcgggtcccacttcatcctgatactattttttagcacaatcctgctggtagtcgtccttacaaatgtcgctcggaagaaagtgccgatggatattctcattctccttaatgtattgcaccatttgatcccaccggctcttaatcctatagtctacggtgtaagaacaaaggagatcaagcagggaatccagaaactactccaaaggggcaggtag

SEQ ID NO: 52556 - DNA, 948 bp, Artificial Sequence
  Description of Artificial Sequence: Synthetic coding sequence
atgaccactcatcgaaatgacaccctctctactgaggcttccgatttcttgctgaactgttttgtgcgatctccgtcctggcagcattggctgagcctccccctgtctcttctgtttttgctggctgtcggagcaaataccacgctcctcatgacgatttggctcgaagccagcttgcaccagcctctgtattacctgttaagcttgctctcacttttggacatcgttttgtgtttgactgtgatccctaaagttctgaccattttttggttcgacttgagaccaatttcgttcccagcttgcttcctgcagatgtatataatgaactgtttcctggccatggagagttgtacatttatggtgatggcttacgataggtatgtcgcaatctgccaccccctgaggtacccctcgatcattacggatcatttcgtggtcaaggctgctatgtttattctgactaggaacgtccttatgactctgcctattccaatcctatctgctcagttgcgttattgtgggcgtaatgtgatcgaaaactgtatctgtgcaaacatgagcgtttctcgcctgagctgcgacgacgtgaccatcaaccacttataccagttcgctggaggctggactctgcttggttccgatctgattcttatatttctaagctacacctttatactcagagcggtgctgaggctgaaagcagagggcgcagttgccaaagcacttagtacctgcggctctcatttcatgctgatcctatttttcagcacaatattgttagtgttcgtgctgactcatgtggctaaaaagaaagtttcccctgatgtcccagtgctcttaaatgtgctccaccacgtaattcccgctgccctcaaccctatcatatacggcgtgcgtactcaggagattaaacaagggatgcagcggctcctgaaaaaaggttgttag

SEQ ID NO: 52557 - DNA, 1098 bp, Artificial Sequence
  Description of Artificial Sequence: Synthetic coding sequence
atgatgactgtgatcctgaaaacactgctcggacagatccaggggctcagcggtaacccccacagcaccacgtcaaggatgtacttcctctgcttctgcacctcactcctcagattcaaggtgcactgggtttctcgccttatcagaaaattgtacatggccagcccttccaacgacagcactgcacccgttagtgagtttttgttgatttgctttcccaactttcagtcttggcaacactggctgtcactgcccctgtccctcctgttcctgctggctatgggagccaacaccacccttcttattacaattcagctggaggcctctctgcatcagcctctgtactatctgctatctctcttatcacttttggacatcgtgctgtgtctgacagtgattccaaaagtgctggcaatcttttggtttgatctcagaagcatcagcttccccgcttgctttctccagatgttcataatgaatagcttcctgaccatggaatcttgcaccttcatggtgatggcctatgatcgttacgtggctatatgccacccactgaggtaccccagcattattactgaccagttcgtggcacgtgccgtggtgtttgttattgcacggaatgcattcgtgtcgctgcccgtgcccatgctctccgctcgacttcgctactgcgcaggaaatatcatcaaaaattgcatctgttccaaccttagcgtctctaagctgagctgtgacgacatcacttttaaccagctgtatcagtttgtggctggatggacactgttagggtccgacctcatcctgattgtaatcagctattccttcattctcaaggtcgtgttgagaatcaaggcagagggtgccgtggccaaagccctatctacatgcggttctcattttatactgattctgtttttcagtaccgtgctgctggtgctggtgataactaacctggcccgaaagaggattcccccagatgtccctatcttgctgaatatcttacaccacctgattcctcccgctctgaatccaatagtttacggcgtgagaacaaaagagattaagcagggtattcagaacctgctcaagagattgtag

SEQ ID NO: 52558 - DNA, 975 bp, Artificial Sequence
  Description of Artificial Sequence: Synthetic coding sequence
atgaaccatatgtccgcctccctcaagatctcgaactctagcaagtttcaagtgtcagagtttatactgctggggtttccaggtatccattcctggcagcattggctgtctctgcctctggccctcctgtatctctccgccctggcagctaacaccttaatactcatcattatctggcagaaccccagtttacaacagcccatgtatatattcctgggaatattgtgcatggtagacatgggattggcaacgaccatcatcccgaaaattctggctatcttttggttcgatgctaaagtcataagccttcccgagtgtttcgcccagatatatgccattcatttctttgtgggtatggaatccggcatcctgctctgtatggctttcgacaggtatgttgccatctgccatccactgcggtaccctagtattgtaacttcttcgttaatcctcaaagctactcttttcatggtcctccgcaatgggcttttcgtcacaccagtgcccgtgcttgccgcacagcgcgactactgctctaaaaatgaaatcgagcattgcctgtgctctaatctcggggttacctcacttgcctgtgacgaccgcaggcctaatagtatttgccagctggtgctggcttggcttggaatggggagcgatctgtctctgattatcctgagctacattctgatactgtactctgtgctgcggttaaacagtgctgaagcagcggctaaggcactgtctacttgttcctcccacctgacgttaattctgtttttttacaccatcgtggtcgtgatctccgtgacccatctgaccgagatgaaggccaccctcatcccggtcctactcaatgtcctccacaacatcatccccccttctctgaatcctactgtgtatgctctgcagacaaaggagcttcgcgctgccttccagaaagtactattcgcgcttaccaaggagatcaggtcctag

SEQ ID NO: 52559 - DNA, 960 bp, Artificial Sequence
  Description of Artificial Sequence: Synthetic coding sequence
atggatacgtcaaccagcgtcacctatgattcctcgttacagatcagtcagttcatactgatgggcctgcctggtatacatgagtggcaacactggcttagtctgcccctcaccctgctgtacctgctggctttgggagcgaatcttcttatcattatcaccattcagcatgagaccgtccttcacgagcccatgtaccacttactgggaatcctggcggttgttgatatcggattagccaccacaatcatgccgaaaatcctggctatcttctggttcgacgccaaggctattagcttgcctatgtgtttcgcgcagatctacgctatccattgcttcttttgtatcgaaagcgggatattcctctgtatggcagtggatcgctacatagccatttgtcgaccgttacaatacccctccatagtcaccaaagcattcgtcttcaaggcgacaggcttcatcatgctccgcaacgggctccttaccattcccgtgccaattctggccgcacagagacactactgcagcaggaatgagattgagcactgtttatgctccaacttgggcgtcatctcgttagcatgcgatgacataactgttaataaattctatcagcttatgttagcatgggtgctggttggcagcgacatggcgctggtgtttagctcttatgccgtgatcttgcattcagtgctgcgactgaattcagccgaggccatgagtaaagcgctgagtacgtgtagttctcacctgatactcattctcttccataccggtataatagtcctgtccgtcacacatctagccgagaagaagatcccacttattccggtctttctgaacgttctccataatgtgatcccccctgctttaaatcccttagcttgtgcattgcggatgcacaagcttcggctaggattccagcgcctattaggcctgggccaggacgttagtaaatag

SEQ ID NO: 52560 - DNA, 984 bp, Artificial Sequence
  Description of Artificial Sequence: Synthetic coding sequence
atggagtggaggaaccactccggtagggtgagtgagttcgtcctcttggggttccctgctcccgctcctctccaggtcttgctcttcgccctgctactcctggcctacgtgctggttctgactgaaaacactcttattataatggctatccgtaatcattctacattgcacaagcccatgtacttctttctggcaaatatgagttttcttgaaatttggtatgtgacagttacaatccctaagatgttagcaggatttgtgggaagcaagcaggatcacggacagctgatttctttcgagggatgcatgactcagctgtatttcttcttgggtcttggctgcactgagtgtgtactgctggctgtgatggcttacgataggtacatggccatttgttatcccttacattatccagttatcgtgagcggaagactgtgtgtccagatggctgctggatcctgggccggagggttcggaatctcaatggtcaaggtgtttcttatctctggcctttcatactgcggtccaaacattatcaatcactttttttgcgatgtcagcccactactgaacctgtcatgcactgacatgagcaccgccgaactaacggacttcattctcgccatctttatcctcctcgggccactatctgttacgggggctagctacgtggctattactggtgccgtgatgcacatcccttcagcggcaggtcgatataaagccttcagtacttgcgcatcccatttgacagtggtgattatcttttatgcagctagcatttttatttacgcacgacctaaagctctaagcgcatttgacacaaacaagctggttagcgtattatacgccgtaattgtccccctgctgaatcccatcatttattgcttgagaaaccaggaagtcaaaagggcattgtgttgtactctgcatctataccagcaccaggaccccgaccctaagaaggcctctagaaacgtatag

SEQ ID NO: 52561 - DNA, 936 bp, Artificial Sequence
  Description of Artificial Sequence: Synthetic coding sequence
atggagctggagaaccagactagggtgaccaagtttatcctagtgggctttcctgggtcactgagtatgagagccgctatgtttctcatttttctcgtcgcctacatcctgaccgtggctgaaaatgtgattatcatacttctggtgttacaaaataggccactacacaaaccaatgtactttttcctggcgaacctgtcattcctcgaaacttggtacattagtgtcacggtgcctaagctacttttcagtttctggtcggtcaacaattctatttccttcaccctgtgcatgatccagctctattttttcattgccctgatgtgcaccgaatgcgttctgctagctgccatggcctatgacaggtatgtcgcgatatgtcgacctttgcattatcctacaattatgagtcatgggctgtgctttcggttagctctgggcagctgggccataggctttggaatctctctggcaaaaatctatttcatcagttgcctctccttttgcgggcctaacgtgattaaccatttcttctgcgacatatcaccagtgctgaacctgagttgtacggatatgagtatcaccgaattggtggatttcatcttggctttagttatctttctgtttcccttattcattacagtgctgagctatggctgtatcttagcaacaattctgtgcatgccaacagggaaacagaaggcattttccacctgtgcgagccacctggtggtcgtgactatcttctacagcgccatcatatttatgtatgctcggcctcgtgtgattcatgctttcaacatgaacaaaattatcagcattttttatgccattgtaacacctagtctgaatccatttatttattgcctccgaaaccgagaagtgaaagaggcccttaaaaagctggcctattgccaagccagtcggagcgattag

SEQ ID NO: 52562 - DNA, 939 bp, Artificial Sequence
  Description of Artificial Sequence: Synthetic coding sequence
atgtcaggggaaaacgtcaccaaagtctcaactttcatcctggtggggctcccaactgcacctggcctgcagtacctgttattcctcctgtttcttctgacttatcttttcgtgttagtggagaacctggcgatcatactgatcgtgtggtccagtaccagtctgcatcgaccaatgtattacttcctcagctcgatgtctttcctagagatttggtacgtgtccgatattaccccaaagatgctggaaggctttctactgcagcagaagcggattagctttgtcgggtgtatgacacagttgtatttcttcagcagtttggtgtgtacggaatgtgtgcttctcgctagtatggcctatgataggtatgtggctatttgccatcccttgagatatcacgtgttagtgacccctggcctctgtctgcagctggtggggtttagcttcgtgagtggctttactatcagtatgatcaaggtatgctttatttcttccgtgaccttctgtgggtcgaatgtgctaaaccacttcttctgtgatatctctccaatcttaaaactggcctgtaccgacttttctactgcagaactggtagattttattctggcttttattatattggtgtttcctcttctggccaccatcctgtcctactggcacattaccttggccgttctcaggataccttcagcaacaggttgttggagggcattctccacctgtgcgtcccacttgaccgttgtgacagttttttatactgccctgttatttatgtatgtcagacctcaagccattgactcccaatcaagtaataaactaataagcgcggtctatactgttgtcaccccaattataaacccattgatatactgtctgcgcaacaaagagtttaaagacgccctgaaaaaagcattgggattaggtcaaacctctcactag

SEQ ID NO: 52563 - DNA, 996 bp, Artificial Sequence
  Description of Artificial Sequence: Synthetic coding sequence
atgtcaggcgagaatgtcactcgagtgggcactttcattttggttggcttcccgacagccccaggactgcagtatctcctcttcttactttttctgctgacctacctgttcgttttagtcgagaaccttgcgatcattctgactgtgtggtcttccaccagtttacaccggccaatgtactacttcctctcaagtatgagctttctggaaatatggtatgtgtctgatatcacgcctaagatgctggaagggtttctcctccaacagaaacggatttcgtttgtggggtgcatgacccaactgtactttttctcttctctggtctgtacagaatgcgtgttgctagcgagtatggcatacgaccgatacgtggctatttgtcaccccctgaggtatcatgtgctggtgacgcccggtttgtgcttgcagctggtggggttttcattcgtgtctgggttcacaatcagtatgattaaggtgtgtttcatctcatctgttaccttctgcggctctaatgttttgaatcacttcttctgcgacatctcacccatcctcaagctggcctgcactgatttttcaacagcggaattagtggatttcatcttggcctttatcattttagtctttcctcttctggccacaatgctcagctacgctcacatcacactcgccgtgctccgaatcccctccgcaaccgggtgttggagggctttctttacgtgcgcctcacacctgaccgttgtgaccgtgttctacaccgctttgttgttcatgtatgtgcgacctcaagctattgactcacgatcatcgaacaaactgatctcggtgctatatactgtaatcactccaattctgaatcctctgatctactgcctgcgcaataaggagtttaaaaacgctctgaaaaaggcatttggcctcaccagttgcgcggttgaagggaggctgtcatccctgctcgagttgcatctgcagatacattctcagcctctatag

SEQ ID NO: 52564 - DNA, 939 bp, Artificial Sequence
  Description of Artificial Sequence: Synthetic coding sequence
atgagaaaccacaccgagattactgaatttattctgctcggcttgactgatgatccgaacttccaagttgtgattttcgtatttctgctgattacatatatgctcagcatcactggcaatttgacactcatcaccatcactctgttggacagccatcttcagacgcctatgtactttttcttgcggaatttttccatcctagaaatctccttcaccacagtgtctattcccaaattcctgggaaacatcatcagcggcgacaagaccatctctttcaataactgtatcgtgcagctcttttttttcattctgttaggggtgaccgagttctaccttctcgcagctatgtcatacgatcggtacgttgccatctgcaagcctctccactgcctgagtatcatgaatcgccgagtgtgcacattacttgttttcacaagctggctggtctcttttctcataatttttccggctcttatgcttctgctgaagctccattactgtcgctccaacatcatcgatcactttacatgtgactacttcccactgctgcaactcgcatgttctgatactaagtttttggaggtgatgggtttctcttgcgcggctttcactcttatgtttaccctggccttaatttttctatcctacatatacattatccggactatccttcgcattccatcgacatctcagcgcacgaaggccttttctacgtgctcaagtcacatggttgtggtttccattagctacggatcctgtattttcatgtatattaaaccctccgctaaagatcgggtgtccctgtccaagggcgtggctatcctgaacaccagtgtggcgcctatgatgaatcccttcatttactcattgcgcaatcagcaggtcaagcaggcttttatcaacatggcgaggaagactgtgtttttcacctcaacttag

SEQ ID NO: 52565 - DNA, 939 bp, Artificial Sequence
  Description of Artificial Sequence: Synthetic coding sequence
atgaaaaatcataccgtgatccgcacttttattttgttgggcttaacaggagacccccacctgcaggtcctgctgtttatctttctgtttctgacctacatgctgagcgtgacaggcaatctcacgatcataaccctgacactggtggaccaccacctaaaaacccctatgtactttttccttcggaatttcagttttctcgaggtcagctttaccacagtatgcatcccccgattcctgtacaacattagtatgggggataataccataacatacaacgcttgtgctagtcagatattttttgtgatcctgtttggcgcaacagaattctttttgctggccgctatgagttatgatcgttacgttgctatttgtaaacctcttcactacgtcgtcattatgaataacagagtgtgtacactgttagtgctctgttgctgggtcgccggactaatgatcatcgtccctcccctgtctctgggacttcaactggagttctgtgacagcaatgccattgatcatttcagttgtgatgcaggacccctactgaagattagttgctctgacacttgggtgatcgaacaaatggtgatcctgatggctgtttttgcattaatcatcaccctcgtttgcgtaattctgtcttatttgtacatcgtccggacgatacttaaattcccatccgttcagcagcggaaaaaagcattcagtacctgcagcagtcatatgatagtagtgtcaattgcttatggctcctgtatctttatatacatcaagcccagtgcgaaagacgaagtggccatcaacaagggagtttccgtcctgactacttccgtcgccccattgcttaacccgttcatttacaccctacgaaataagcaagtcaaacaggctttttcagactccataaaaagaatcgctttcctgtctaaaaagtag

SEQ ID NO: 52566 - DNA, 936 bp, Artificial Sequence
  Description of Artificial Sequence: Synthetic coding sequence
atgaaccataccatggttacggaattcgtgctacttggtctgagcgatgatcctgacttgcagattgttattttcctgtttttattcatcacctatatcctgtcagtcacaggtaatctcaccattatcaccctaacttttgtagactctcatttacaaactcccatgtatttttttctgcgaaacttcagctttctggagatcagtttcaccactgtctgtatcccacgatttctaggggctattatcaccagaaataagactatctcctacaacaactgcgctgcccagttgtttttcttcatttttatgggagttactgagttctacatcctcaccgcaatgagctacgatcgttacgtggccatctgcaaaccactgcactatacgtccataatgaaccgcaagctgtgtactctcctggtcctctgcgcttggctgtcggggttcctcacgatattccctcctctgatgctgctgcttcagctggactactgcgccagtaacgttatcgatcactttgcgtgcgattactttccacttctccagctctcctgcagcgacacgtggctcctcgaagttattggtttttacttcgctttggtgaccctgctcttcacccttgctctggtcatacttagctacatgtacattattcgaactattctcagaatccctagtgcgagccagcgaaaaaaagctttcagtacgtgtagcagccacatgatcgttattagcatctcttacggcagctgcatcttcatgtatgctaatccatccgccaaagaaaaagcctcactgaccaaaggcatcgctatcctaaacactagcgttgcacccatgctcaatccgtttatttacactctaagaaaccagcaggtgaagcaggcctttaaaaatgttgtccataaggtggttttttacgctaaccagtag

SEQ ID NO: 52567 - DNA, 930 bp, Artificial Sequence
  Description of Artificial Sequence: Synthetic coding sequence
atgaagaaccggacgatgttcggagaatttatcctgctcggcttgaccaaccagcccgagcttcaagttatgatttttattttcctctttcttacctatatgctgagcatcttgggtaacctgacgattatcacattgaccctcctcgacccccacctacagactcccatgtatttttttctacgcaactttagctttctggaaataagcttcacgtctattttcatccctcggttcttgacgagcatgacaactgggaataaggtgattagtttcgcaggttgtctgacgcagtacttctttgctatcttcctgggcgctactgagttctacctgctggcctcaatgtcttacgacaggtacgtcgccatttgcaaacctctccactatctgacgatcatgtcatctcgggtctgtatacagcttgttttctgttcttggctgggaggcttcctcgcaattttgccccctattatcctgatgactcaggttgatttttgcgtgtctaatatactaaaccattactactgtgactacggtccactcgtggaactcgcctgttcagacacatctcttctcgagctcatggtaatcctgctggctgtggtgaccttaatggtcacactggtgcttgtcactttgagttacacgtatataatacgtacaatccttaggatcccctcagctcaacagagaacgaaagccttctcaacctgctccagccatatgattgttatatccctatcctatggaagttgcatgttcatgtatattaatccgagcgctaaggaaggcggagctttcaacaagggcattgctgtgttgataacctcggtcacccctcttttgaatcctttcatctacacactacgaaatcagcaggtgaagcaagccttcaaagactctgtaaaaaaaattgtaaagctgtag

SEQ ID NO: 52568 - DNA, 939 bp, Artificial Sequence
  Description of Artificial Sequence: Synthetic coding sequence
atgcccaatatgacatctattcgcgagttcatattgctgggcttcacagataatcccgaattgcaggtggtaatcttcttctttatgctcattacttaccttctctccgtctctgggaacatgatcatcataatgctgacgctgtcaaacatacacctcaagactcccatgtattttttcctgagaaacttttcctttctggaaatctcattcaccaccgtttttatcccgaggtttctgattaacattgcaaccggcgacacaaccatcagttacaacgccagcatggcccaggtttttttcttgattctcctgggtagcacagaattcttccttcttgcagtgatgtcctatgacaggtatgtggcgatttgcaaacctctgcactatactactatcatgtccaataaggtgtgtaattggttagtgatctcctcctggctggccggtttcctgattattttcccacccgtgataatggggttacagctagacttctgcgacagcagcaccatagatcactttatatgcgactcaagtccgatgctgctgattgcctgtacagacactcagttccttgaactcatggcctttttattggcagtatttaccctgatggtaacccttgccctcgtagtgctgtcatatacattgatcctgaagacaattctgaagatcccgagcgcccaacagcgaaagaaagccttctccacatgctcttcccatatgatcgtggtcagtgtgagctacgggagctgcatctttatgtgcgtaaagacttccgccaaggagggaatggcattaagcaaaggggtagcagtcctcaacacctctgtcgcgcctatgctgaatccgtttatatataccctgcggaaccagcaggtcaagcaggctctgagagagtttacgaagaaaatcttgagtctcaataagcaatag

SEQ ID NO: 52569 - DNA, 954 bp, Artificial Sequence
  Description of Artificial Sequence: Synthetic coding sequence
atgcagaagagcgtaatgaggaaacatacggccattacaacctttattctgcttggactgactgaagacccccaattacaagttcttctgtttatgttcttattcatcacttatatgttaagcgtgaccggcaaacttacaattattgcactgactatgctcgatccgcacctaaagacccctatgtacttctttctccagaacctatcgttcttggagatttcttttacagcaacttgcgtccctcgctttctttacagtatatccactggcaataagataataacttacaacgcctgtgtcatccagctcttcttcgcggatctcttcggcgtgacagagttctttctgctggcaactatgtcgtacgaccgctacgttgcaatctgtaagccacttcattatatggcaattatgagcaataaggtgtgtaagaccatggtgatttgttgttggatggcagctcttatgattatactgccacctctgtcactgggtttccacctcgaattctgtgacagtaatgtgataaaccactttggatgtgatgcgctacccattctcaagatcccttgttccgacacaagcctcatcgaacaaatggtcgttgctagtgctgtcctgacattcataatcacactcgtctgtgttgtgcttagctatacctacataattagaaccatcctcaagtttccttccgttcagcaaaaaaagaaggccttcagtacttgctcctctcacatcacagtggtgagtattacctatggcagttgtatatttatttacatcaaaccatctgctaaggaagaggtgaacatcaacaagggagtatcagtccttatttcatcgatcagccccatgttgaattctttcatctacacgctgaggaatgagcaggtaaaacaagcgttccacgatagtctgaagaagatcgccttccgccttaagaagtag

SEQ ID NO: 52570 - DNA, 939 bp, Artificial Sequence
  Description of Artificial Sequence: Synthetic coding sequence
atgcggaagcacaccgctatcaccactttcatcctgcttggcctgacagaagacccacagcttcaggtgctgctttttatgttcctcttcatcacatacatgctgagtgttactggcaagttaaccattattgcgctcacaatgctggacccccacctcaagacgcccatgtattttttcctgcaaaaccttagcttcctcgagataagctttacggccacatgtgtgccaaggtttttgtactcaatctcgacaggaaacaaaattatcacttacaacgcctgtgtcattcagctgttcttcgccgacctgttcggtgtgactgagttctttttattagccaccatgagctacgatcggtatgtagcaatttgtaaacccttgcactatatggcaattatgtccaataaggtgtgcaagacgatggtcatttgctgttggatggccgctcttatgatcattctgcccccacttagtctcggattccacctcgaattctgcgactccaacgtcataaaccatttcgggtgtgacgcgcttccaatcctgaaaattccttgctctgataccagccttattgagcagatggtggtcgcaagcgcagtgctcaccttcatcatcacactggtctgtgtggtcctttcttatacctacatcattcgcaccatcttgaagtttccctctgtgcagcagaagaaaaaggctttcagcacttgctcttcgcacataaccgtggtgtcaattacttacggtagttgtatctttatctatattaagccttcagccaaggaggaggtgaacattaataagggggtttccgtactaatttcctccatctctcctatgctgaacagttttatttacactcttcggaacgaacaggtaaagcaagccttccacgactccctgaaaaaaattgcattccgcctgaagaaatag

SEQ ID NO: 52571 - DNA, 939 bp, Artificial Sequence
  Description of Artificial Sequence: Synthetic coding sequence
atgaaaaatcacacacgtcagattgagttcattctgttgggcctcaccgacaattcccagctccagatcgtcatctttttatttttgttactcaattgcgtgctgtctatgataggaaacttcactatcattgccttgatattattggacagtcagcttaaaacaccaatgtacttttttttaagaaacttcagtttcctcgagatcagctttaccaccgcatgtattcctcgttttctgatcactatcgtcacacgagaaaagaccatcagctgcaacggctgtatcagtcagctgttcttctacatatttctcggcgtgacagagttctttttgctggcagcactgtcctacgataggtatgtcgcgatttgtaaaccgctgcgatatatgtctattatgagcaacaaggtgtgttatcagctcgtcttttctagttgggtaacgggattcttaattattttcacaccactgattttgggtcttaacctggatttctgtgcttccaacattatcgaccattttatttgcgatataagtctaattctccaactctcatgtagtgacactcacctactggaactaattgctttcctgttggcagtgatgacattgatcgtaactttgtttcttgttattctcagttacagctacatcatcaaaaccattttgaaatttccgagtgcacagcagaaaaagaaggccttttctacatgctcaagccacatgatcgtggtttctattacctacggctcttgcatgttcatctacataaaaccgtcagctaatgagagagtggctttgtctaaaggtgtgaccgtcctgaacacgagtgtggcccctctcctgaacccattcatctataccttacggaaccagcaggtgaaacaagccttcaaggcagtgttccgtaaaatattttctgcgagcgacaagtag

SEQ ID NO: 52572 - DNA, 939 bp, Artificial Sequence
  Description of Artificial Sequence: Synthetic coding sequence
atgagaaatcatactacggttgcaaactttatcctgttgggcctcacagatgatcctcagcttcaggtgattatcttccttcttctgttcttcacttatatgctaagcatcaccggaaacttaactatcattactctgacactcctggaccttcaccttaagacccctatgtatttcttcctgcggaactttagctttttagaggtctcattcaccactgtctatataccaaaatttctggtgtccatggctacaggtgataagacaatttcttataacgattgtgccgcacagcttttcttcaccatactgttgggtgccacggagttcttcctactggccgctatgagctatgagaggtatgtggctatctgcaaacccctgcattataccacaataatgagctctcgcgtgtgttcactcttagtattcgctagctggatggcgggtttcctgatcatatttccaccattgcttatggggcttcagcttgacttttgcgccgctaacacggtggatcatttcttttgcgacgtctcccccattttgcagttgagttgtaccgacaccgacattatcgagctgatgatgttactgtccgcaatcttgacactcctggtcaccttggtcctggtgatactctcgtataccaacattatccgtactatcctcaagattccgtcttcacagcaaagaaaaaaggctttttccacttgcagctcacatatggtagtggtatctatttcctacggttcgtgcatatttatgtacgtgaagcccagcgctaaagaaagagtgtctctgaacaaggggatagccctcttgtctacttctgtcgccccaatgctcaaccctttcatctatacactaaggaataagcaggtgaaagatgtctttaaacacaccgtgaaaaagattgagctgttctctatgaagtag

SEQ ID NO: 52573 - DNA, 939 bp, Artificial Sequence
  Description of Artificial Sequence: Synthetic coding sequence
atgagaaattcgacagccgtgactgactttatactcctgggacttacttctgacccccaatggcaggtcgtcttgttcatctttctgttggtaacctatatgctgagcgtcaccggcaatttgatcatcattaccctgaccctgagcgaccctcatctccagacaccgatgtattttttcttgcggaatttctcattcctggagatttcattcaccagcgtgtgtattcctcggttcctggtcacagtggtaacggggaatcgaactatttcgtacaatggctgtgtcgctcagctcttcttcttcatttttctgggcgtgaccgaattttatttgctagcagccatgtcatatgataggtgcatggccatttgcaagccgctccattatactataataatgagcactcgcgtgtgcacactgttggtgttctctagctggctcgctggcttcctaatcattttcccgcctgtcatgcttctgcttcagctcgacttttgcgcctcgaacgtgatcgatcacttcatttgcgatagctcccctatgctgcagctttcctgtaccaacactcattttctggagctgatggccttttttctggctgtcgtgaccctaatggtgaccctcacactagtgatcctttcctatactaatatcatcaggactattctcaaaattccttcaatgtcccaacgtaagaaggcgttttcaacctgctccagccatatgatcgtcgttagcattagttattcttcttgtatctttatgtacattaagacatcggcacgggagcgggtgaccctgtcaaagggggtggccgtgctaaatacctccgtggccccactgttaaatccttttatttacaccctgagaaacaagcaggtaaaacaagctttcaaatctatggttcagaaaatgatcttctcattgaataaatag

SEQ ID NO: 52574 - DNA, 927 bp, Artificial Sequence
  Description of Artificial Sequence: Synthetic coding sequence
atggatacagggaataaaacactgccacaggatttccttttactgggcttccctggtagccagacattgcagctatctcttttcatgttgttcttggtaatgtacatcctgactgtttctggaaatgtcgcaattctaatgctggtgtccacttcacaccagctgcatacgcctatgtacttctttctgagcaacctgtcattcctggagatatggtacaccactgccgcagtgcccaaggccctggccatacttctcggcagaagtcagacaattagcttcacgtcgtgcctcctgcagatgtacttcgtattttccctggggtgcaccgaatatttcctgctggccgcaatggcctacgaccggtgtctggctatttgttatcctctacactacggcgcaattatgagctctctgttgtctgcccagctggccctcgggtcatgggtctgtgggtttgttgccattgccgtacctacagctcttatatcaggcctgagcttctgcgggccacgtgccatcaatcacttcttctgcgacatagctccttggattgccctagcctgtacaaatacccaggccgttgaactcgtcgcttttgttatcgcggttgtggtaatactgagctcatgtctgattactttcgtttcatacgtctatatcatttccacgattctgcgtatccccagcgcttccggcagatctaaggcattttccacttgctctagtcacctcacagtagtgttaatctggtatgggtcaacagtgttcctgcacgttagaacaagcatcaaggacgccttggatttgataaaggcggttcatgtcctgaacactgtggtgactcccgtgctgaatccattcatctatacactaagaaataaggaggtgcgggaaactttgttaaaaaagtggaagggcaagtag

SEQ ID NO: 52575 - DNA, 1044 bp, Artificial Sequence
  Description of Artificial Sequence: Synthetic coding sequence
atggggaactggacggccgctgtgaccgagttcgtactccttgggttcagcctgtcaagagaggtggaattgttgctgttagtgctgttgctgccaactttcctgctgacattgctgggtaatctgctcatcatctccacagtcctctcttgctccaggctgcacaccccgatgtatttcttcttgtgtaacctgtctatacttgatatcctttttacctcagtgatctccccgaaagtcttggctaatctgggatccagagataaaacaatatcctttgccggttgcataactcagtgttatttctacttcttcttgggtacagttgaattcctgctcctgaccgttatgtcatacgaccggtatgctactatctgctgtcctctgaggtatacgactatcatgaggccctccgtttgcattgggacggtggtcttttcgtgggttggagggttcctgtcagtgctctttcccaccatcttaatctcacagctgccattctgcggaagcaacattattaaccatttcttctgtgatagtggacctcttctggcactggcctgcgccgacacaactgcaatagaactaatggacttcatgctttcttctatggttatcctgtgttgcattgtgcttgtggcatactcttacacttatattattcttacgattgttcgcattccttcagcatctggccgaaaaaaagcttttaatacctgtgcttcccacctcaccatagtgattattccttccggcataaccgtttttatctacgtgaccccatctcaaaaggagtacttagaaattaataagatccctcttgtattgtcctccgtcgtcacgccctttcttaaccccttcatttacaccttgcgtaacgacaccgtgcagggggttctgcgtgacgtgtgggtgcgcgtacgaggagtttttgaaaaacgcatgagagcggtgttacggtcaagattgagttcgaacaaagaccaccagggcagagcgtgttcaagcccgccttgcgtgtactccgtgaaattacaatgttag

SEQ ID NO: 52576 - DNA, 975 bp, Artificial Sequence
  Description of Artificial Sequence: Synthetic coding sequence
atggaatctccgaatcgaactactatccaggaatttatcttttcggcatttccctactcatgggtaaaatctgtggtgtgttttgttccactcctgttcatatacgccttcatagttgtcggcaatctcgtgattattactgtagtgcaactaaatacccacctacacacacctatgtacaccttcattagcgcgctttctttcttagagatttggtacaccacagcgacaatccctaagatgctttcttctctgctctccgagcggtctattagcttcaacgggtgcctcttgcagatgtacttctttcatagtactggaatttgtgaggtctgtctcttgacagtgatggcatttgatcattacttggctatttgctccccgctgcactacccaagcattatgacacccaagctttgcacgcaacttaccctgtcatgttgtgtctgtgggttcatcacacccttacccgaaattgcatggattagcacactgcccttctgcggctcgaaccacttggaacatatattttgcgactttctacctgtcctgagattagcctgcacagatacccgagcaattgtaatgattcaggtggtcgacgtcattcatgcagtggaaattatcacggcggtgatgctcattttcatgtcgtatgatggcattgtcgccgtgatcctccgcatccactctgctggagggcgaaggactgccttctcgacatgtgtgtctcattttatcgtgttttccctatttttcgggtctgttaccctgatgtatctgcgtttcagtgctacctatagcctgttttgggatatcgctattgctctggcctttgccgtgcttagtccattctttaaccccataatctactccctcaggaacaaggagatcaaggaagccattaaaaagcacatcgggcaggcgaaaatattcttctcagttcggccaggtacaagcagtaagattttctag

SEQ ID NO: 52577 - DNA, 948 bp, Artificial Sequence
  Description of Artificial Sequence: Synthetic coding sequence
atggagagcggaaaccaaagtacagtgactgaattcatattcacgggattccctcagctgcaggacggcagcctgctatacttttttcctctcctttttatctatacattcataatcattgataacctcctcatcttcagcgcggtacgcctcgacacacatttacataacccgatgtacaatttcatctctattttttcatttctcgagatttggtatacaacggccactatccctaaaatgctttcaaatttaatttccgagaaaaaggctatctccatgacaggttgcatcctacagatgtatttctttcacagcttagaaaatagcgaaggcatcctcctgacgactatggctattgataggtacgtagccatttgtaatccactgaggtatcagatgatcatgacaccaagactttgtgcacagctgtctgctggcagctgcttgtttgggttcctgattctgttaccagaaattgtgatgatcagcacacttccattctgtggccctaatcagatccatcaaatcttttgtgacctggtgccagtgcttagtctggcctgcacagacacgtctatgatccttattgaggatgttattcacgcagttaccattattattacctttcttatcatcgcacttagctacgtgcggatagtcaccgtgatcttacgcattccctcaagcgaggggcgacagaaagcgttttctacctgcgctggacacctgatggtgttcccaatctttttcggctccgtgtctctgatgtacttgcgattctctgacacgtacccccctgtgctggacaccgcaatcgccttgatgtttaccgtgctggccccattcttcaatcccatcatctatagccttcgcaataaagatatgaataatgccatcaagaaactcttctgtcttcaaaaggtgttgaacaaacccggtggatag

SEQ ID NO: 52578 - DNA, 996 bp, Artificial Sequence
  Description of Artificial Sequence: Synthetic coding sequence
atgtgctggacgatgccctccccctttaccggctcaagtacccggaatatggagtctggcaaccaatccacagtcaccgaatttatcttcactgggtttccacagctgcaagatggatccctgttgtactttttccccttactgtttatttacacattcatcatcattgacaacctgctcatctttagcgcggtgcggctggacacacacctccacaatcctatgtacaacttcatatccatttttagcttcctcgaaatatggtacacgacagccacgatccctaaaatgctcagcaacttaatctctgaaaaaaaggccatctcaatgactggttgcatccttcagatgtatttcttccacagtttagagaatagcgagggtattctcctgacgacaatggccattgacaggtatgtggcaatatgtaaccccctaagatatcagatgatcatgaccccccgactgtgtgcccagctaagcgctggcagttgcctgtttggttttctgatcctgcttcccgaaatagtaatgatttctacgctgcctttctgtggtccaaatcagatacaccagattttctgtgatctggtccccgtgctatctctggcgtgtaccgacactagtatgattcttatcgaagatgttatccacgctgtcacgattattatcactttcctgataatcgccctgtcatacgtgcggattgtgacagtaatcttgcggattcctagctcagagggtaggcagaaggctttctcaacctgcgccggacacttgatggtgttcccgattttcttcgggtctgtgtctctcatgtacctccgcttttcagacacttacccccctgtgttggacaccgcgatcgctttgatgtttacagtgcttgccccattttttaatcccatcatctacagtcttcggaataaggacatgaataacgcgatcaagaaattgttctgcctccaaaaggtgctcaataagccagggggttag

SEQ ID NO: 52579 - DNA, 1032 bp, Artificial Sequence
  Description of Artificial Sequence: Synthetic coding sequence
atgaaacaatacagcgtgggcaaccagcactccaactaccgtagtctcctgttccccttcctttgcagccagatgactcaactgacagcatctggaaaccagacaatggtgacagaatttctgttctccatgttcccgcatgcgcaccgaggcggattgctcttttttattcccctgcttcttatctatggcttcatcctaactggaaatctcattatgttcatcgtgatccaggttggcatggctcttcacacccctctctatttctttattagcgtgctgtccttcctggaaatttgctataccaccactaccattcctaaaatgttgagctgtttgatctctgagcaaaagtcgatttcggttgccggatgtctactacagatgtacttttttcacagtcttggaatcacagaaagctgcgtcctcacagccatggccattgatcgctacatcgcgatatgcaacccattgaggtacccaacaattatgatccctaaactgtgcatccagcttaccgttgggagttgtttttgcggattcttgttagtgcttccggagattgcttggatcagcacactgcctttctgcggttctaaccaaattcatcagattttctgtgactttacccctgtcctgtccttggcctgcacagatacattcctggtggtaatcgtagatgcaatccacgcggctgagattgtggccagctttctagtcatcgccctgtcttacattcggatcataatcgttattctaggtatgcacagcgcagagggccatcataaggcgttcagtacatgcgcagcccatctcgccgtttttctgctattcttcggctcagttgctgtgatgtatctcaggttcagcgccacatactcagtattctgggatacagccatcgccgtcacctttgttatactggcaccattcttcaatcccatcatttactccttaaagaacaaggacatgaaagaagctatcgggagactctttcattatcagaagcgtgcaggatgggcagggaagtag

SEQ ID NO: 52580 - DNA, 942 bp, Artificial Sequence
  Description of Artificial Sequence: Synthetic coding sequence
atgggcaactggtcaaccgtgacagagatcactctcatcgcgtttcctgctctgttggagatccgaatctcactgttcgtggtgttagtcgtcacctataccctgacggcgacagggaacatcacaatcatcagcctgatttggatcgatcatcggctgcaaacccccatgtactttttcctcagcaatctgagcttcctggacattctgtataccactgtgatcacacctaagctgctggcctgcctcctaggcgaagagaagaccatctccttcgccggttgcatgattcagacttacttctacttctttctgggcaccgtggagtttattctgcttgcagttatgtccttcgacaggtatatggccatctgtgaccctctacactacactgtaatcatgaacagcagagcgtgtctgctgctggtgctgggctgctgggtgggggcattcctgagcgtattgttccccaccatagtagtgacacgccttccctactgtagaaaggaaataaatcacttcttctgcgacatcgcgccactgcttcaggttgcgtgtataaacactcacctcatcgaaaagatcaattttttactcagtgcactcgtgattctgtcttctctggccttcacaaccggctcttatgtgtatattattagcactatcttacggatcccctcaacccagggaaggcagaaggcgttcagcacttgcgcaagtcatattacagttgtgtccattgcccacgggtccaacatctttgtgtacgtacgcccaaaccagaattcaagcctcgattatgacaaagttgccgctgtcctcataactgtcgtgacgcctttgctcaatccatttatctatagccttcgaaatgaaaaggtacaggaagttttgcgggagaccgtcaaccgcatcatgaccctaattcaacgaaagacatag

SEQ ID NO: 52581 - DNA, 939 bp, Artificial Sequence
  Description of Artificial Sequence: Synthetic coding sequence
atggacacgggaaattggagtcaggtggccgaattcatcattttgggcttcccccacctacagggggtgcaaatttatcttttcctgctactgttattgatttatctcatgaccgtcctcgggaatctcctaattttccttgttgtatgcttggactcccgactgcacacacccatgtaccatttcgtgagcattctgtctttttcggagctcgggtacaccgcggcaaccataccaaaaatgctcgctaaccttctgagtgagaagaaaaccatcagctttagcggctgcctcctccagatctacttctttcactctcttggcgcaaccgagtgttacctgcttacagccatggcatatgatagatacttagcgatttgcagaccactccattacccaacactcatgactcccaccttatgtgctgagatagctataggatgctggttgggagggcttgctgggcctgttgtggaaatttcacttataagtcgactgcccttctgtggacctaaccgtatccaacacgtcttttgtgacttccctcctgtcttatctttggcctgtaccgatactagcattaacgtcctggtggattttgtgattaattcctgcaagatactggctacattcctgctgattttgtgttcctatgttcagataatctgcactgtgctgagaatcccaagcgccgctggaaagcgaaaagctatatctacttgcgccagccatttcacggttgtactcatcttttatgggagcatactatccatgtatgtacagctgaagaagtcgtacagcttagactacgaccaggccctggctgtcgtgtactcagtcctgacaccatttctcaacccatttatttactctctgaggaataaggagatcaaggaagccgtgcgcagacagcttaagcgtataggaatcctcgcctag

SEQ ID NO: 52582 - DNA, 954 bp, Artificial Sequence
  Description of Artificial Sequence: Synthetic coding sequence
atggatcagtacaaccacagttcgttagccgaattcgtatttttgggttttgcatccgtcggctatgtgaggggttggctttttgtgttactcttactggcttatctgttcaccatctgtgggaacatgctcatcttctctgtaattcgcctggacgccgctctgcatactcctatgtatcactttgtttcagttcttagctttctcgagctctggtacactgcgacaaccatccccaaaatgctatctaacatcctttccgagaaaaagactatcagcttcgccggatgtctcctccaaacatacttttttcattcacttggtgcttccgagtgctatctactcactgcgatggcatatgacagatacctcgccatctgccgacccctgcattatccaatcatcatgacgacaactctttgtgcaaagatggctgcggcttgctggacctgcgggtttctctgtcctattagtgaggtgatattggcaagtcagcttccattttgcgcttacaacgaaatccagcacattttctgtgacttcccacccttgctctccctggcctgcaaggatacgtcagctaatatcttggttgatttcgctatcaacgcatttatcatcttaataaccttttttttcataatgattagctacgccaggataattggcgctgtgctaaaaattaagacggcctctgggcgtaagaaggccttttctacatgcgctagccacttggctgttgtgctcattttctttggaagtattatcttcatgtacgtcagattaaagaagtcctacagcttaactcttgacaggaccttagccatcgtttacagcgtgttgacgccgatggtgaatccgatcatctatagtctcagaaataaagaaattattaaggctattaagcggacaatattccagaagggagacaaggcttctctggcacacttatag

SEQ ID NO: 52583 - DNA, 954 bp, Artificial Sequence
  Description of Artificial Sequence: Synthetic coding sequence
atgaggaatcttagcggcggacacgtggaggaattcgttttggtggggtttcctaccaccccccctctccaacttctgctttttgttcttttcttcgccatttacttgctcacactacttgagaatgcactcatcgttttcaccatttggctcgccccaagcctgcacagacccatgtacttctttctgggtcatctctcctttctggaactgtggtatattaatgtgacaatccctagactccttgctgccttcctaacacaggatggaagggtgtcatacgtgggttgcatgacccagctatatttttttatcgccctcgcctgtaccgagtgtgtccttcttgctgtgatggcatacgataggtatttagccatatgtggtcccctactgtatccaagcctgatgccttctagcctagcaacacgcctcgcagcggcatcttggggatctggcttcttcagttccatgatgaagctcctttttatcagccaattgtcctactgcggaccaaatatcattaaccatttcttctgcgacattagccccctgttaaatctgacgtgttcggacaaagagcaggctgaactcgtcgactttttgcttgcactagtgatgatcctgttgcctctgctggctgtggtaagttcatacactgccattattgccgcaatcctccgcatcccaacttcccggggaaggcataaagccttctctacatgtgccgctcatctggccgttgtcgtcatctattattcaagtactttgttcacttacgcccgacctcgagctatgtatactttcaaccacaacaagatcatctcagttctatatacaatcatcgtcccattcttcaatcccgcaatttattgcctgaggaataaggaggttaaagaggccttccggaagacagttatggggaggtgccattaccccagagatgtacaggactag

SEQ ID NO: 52584 - DNA, 954 bp, Artificial Sequence
  Description of Artificial Sequence: Synthetic coding sequence
atgcagccttacacaaaaaactggacccaggtcactgaattcgtgatgatgggatttgctgggatacacgaggcccatttgctttttttcatccttttcctaaccatgtacctatttaccctggtggagaacctggctataatcttagtggtgggactggaccacaggttgagacggccaatgtatttcttcttgactcacttatcctgtctcgagatatggtacacttcagtcacagtgccgaaaatgctcgccggattcattggtgtggacggcggaaagaacatctcttatgcagattgtctctcccagctgttcatttttacctttttgggggctactgaatgcttcttgctagcggctatggcctatgaccgctatgtggcgatttgcatgcctctgcattatggtgcatttgtcagctggggtacgtgtattaggcttgctgccgcttgctggcttgtcgggttcctgactccaattctgcctatctacctgctttcacaactaacattttatgggcctaacgtgatcgaccacttctcctgtgacgcttctcctctgctcgcactcagttgttcagatgtgacttggaaggaaaccgtcgattttctggtgtcattagccgtcctccttgcatccagtatggtgattgcagtgtcctacggtaatattgtgtggactctcctgcatatacggtccgcggctgagcggtggaaggctttctctacatgcgccgctcacctgactgttgtgtccctgttctatggaacactttttttcatgtacgtacagactaaggtaacgtcgagcatcaatttcaataaagtagtcagcgttttttattctgtggtcaccccgatgttaaacccactcatttactccctgagaaataaggaggtaaaaggtgcgttgggacgagtattctctctcaacttttggaagggacagtag

SEQ ID NO: 52585 - DNA, 996 bp, Artificial Sequence
  Description of Artificial Sequence: Synthetic coding sequence
atgtctcctgatggtaaccacagttccgacccaacagagttcgtgcttgccggactgccgaatctcaacagtgccagggtggagctcttctccgtatttctgcttgtgtatctactgaatcttacagggaatgtcctgattgttggcgtcgtcagggccgataccagattgcagaccccaatgtacttcttcctcggcaatctgagctgtcttgagattctcctcacaagtgtgatcattcccaagatgttgtccaacttcctgagtagacagcatacaatatcttttgcggcttgtattacacagttttatttctacttttttcttggggcaagcgagtttttacttctcgcagtaatgagtgccgaccggtacctcgctatctgtcatccactccgctatccactgctaatgtctggagctgtctgcttcagagtggcactggcgtgttgggtcggaggactggtgcccgttttaggccctaccgtcgcagtggcactgctgccgttctgtaaacagggagctgtagtgcagcattttttctgtgacagtggaccattgcttcgcctggcatgcacaaacaccaaaaagcttgaggaaacggatttcgtcttggcatccctggtaatcgtcagcagtctcttaataaccgcagtatcatacgggctcatagttctggctgtcctgagcatcccctctgcctcgggtcgtcagaaagccttctcgacctgcacttcccatctgattgtggttacattattctatggttcagcaatatttctgtatgtcagacccagtcagagtggatcagtggacacaaattgggcagtgactgtgatcaccacctttgtaactcccctgctgaacccatttatttatgctctccgaaatgaacaggtgaaggaggcgctgaaggatatgtttcgtaaagtcgtggcgggtgtcttgggcaatctacttctggacaagtgtcttagcgaaaaggctgtgaagtag

SEQ ID NO: 52586 - DNA, 972 bp, Artificial Sequence
  Description of Artificial Sequence: Synthetic coding sequence
atgaatcccgagaattggacacaagtgacttctttcgtgctcctgggcttcccatcctcgcacctgattcagttccttgtgtttctgggactaatggttacttatatagttactgcaaccgggaagctgctcatcatcgtgctttcctggatagatcagagattacatattcagatgtacttctttctccgcaactttagttttttggagttgttactggtaaccgtagtagtcccaaaaatgctggtcgtcatacttaccggggaccataccatttcatttgtgtcgtgtatcatacagtcctacctgtatttttttttgggaactacagattttttcctgttagctgtaatgtcactggaccggtacctcgcaatttgtaggcctctgaggtatgagacactgatgaatgggcacgtttgttcccaactggtgcttgcatcgtggctggccggattcctgtgggtgttgtgccccactgtgcttatggctagtcttcctttttgcgggccaaatggcatcgaccacttcttccgggattcttggccgcttcttcgactgagttgcggcgacactcacctcctgaagcttgtagcattcatgttatccaccctcgtgctgctgggatccctggcccttactagtgtttcatacgcttgcattctcgcaaccgtgttgcgggcacccaccgctgcggagcgtagaaaggccttcagcacgtgcgcaagccatttgaccgttgtcgtcatcatatatggatctagcatctttctgtatatccgaatgagcgaagcccagagcaaacttctgaacaaaggagcctcggtgctgtcttgcatcatcactcctctcctaaatccttttattttcacccttaggaacgacaaagtacagcaggcgctcagagaggccctgggatggccacggctgacagccgtcatgaagcttcgggtcacaagtcagcggaagtag

SEQ ID NO: 52587 - DNA, 942 bp, Artificial Sequence
  Description of Artificial Sequence: Synthetic coding sequence
atggctaacctgtctcagcctagcgaatttgtcctgctcggcttctcctctttcggtgaacttcaggctcttctgtacggcccatttctgatgctctatctgctcgctttcatggggaataccatcatcattgttatggtgatcgcagacacacatctgcacacaccaatgtattttttcctgggcaatttttctcttcttgaaattctcgtgacaatgacagcggtcccacgtatgctttctgatcttcttgttcctcacaaggtgattacattcaccggctgcatggtgcagttctattttcacttctctctggggtccacatctttcctcattttgactgatatggctctcgacaggtttgtggccatatgtcaccccctacgttacgggactcttatgtctcgagcaatgtgcgtgcagctggccggagcggcttgggccgctcccttccttgcgatggtgccaactgtgctcagcagggcccatttggattattgccacggagacgtgataaatcactttttttgcgataacgaacctctgctgcagctgtcatgttcagacacaagactcctggagttctgggactttttgatggcactcacatttgttctttcatcctttctggttactttgatctcctacgggtacatcgtgactaccgtgctgaggatcccaagtgcttctagctgccagaaggcctttagcacctgcggtagccacctgactttagtgttcatcggatattcttcgaccatcttcctgtatgtccgcccaggaaaggcccactcagtccaggtgagaaaagtggttgcgctggtgaccagcgtattaaccccttttctgaaccccttcatcctgacgttctgtaaccagacggtaaagactgttctgcaggggcagatgcagagactgaaggggctttgcaaggcccagtag

SEQ ID NO: 52588 - DNA, 939 bp, Artificial Sequence
  Description of Artificial Sequence: Synthetic coding sequence
atgcggaatggaaccgtgattacggaattcatcctcctcggatttcctgtgatacagggtctgcagacaccactgttcattgcaatctttctgacctatattttgacccttgccggtaacgggctgattattgcaacagtgtgggctgagccacgcctacagattccaatgtatttcttcttatgcaatctgtcatttctggaaatctggtacacaacaactgtgattcccaagttgctgggaaccttcgtcgtagcccgtacggtgatatgcatgtcttgctgcctcctacaagcgttctttcatttttttgttggtacaacggagtttttaatccttactatcatgagctttgatcgctacttgactatttgcaaccctctacatcatccaaccattatgacgtccaagctctgcctccagttggccctttccagctgggtcgtgggcttcacaattgtcttctgtcagaccatgctgctgatccaactgcctttttgcgggaataatgtgatctcccatttttattgtgatgtgggccctagtttaaaggccgcatgtatcgataccagcatcctcgaactgctaggggttattgctaccatcctggtgatcccaggcagcctgctcttcaatatgatcagttatatatacattctgtccgccatcctcagaattcctagcgccaccggccaccagaaaacctttagtacatgcgccagccatctcacggtggtgtctctgttgtacggcgcagtgctctttatgtacctgaggccaactgctcattcgagtttcaagatcaataaggtcgtatccgtgcttaacacaatcctcacccctctactcaatcccttcatctataccatacgaaacaaagaagtaaaaggagctctgcgcaaagccatgacctgcccaaagaccgggcatgctaaatag

SEQ ID NO: 52589 - DNA, 978 bp, Artificial Sequence
  Description of Artificial Sequence: Synthetic coding sequence
atgactacaatcatcttagaggtggataaccacacagtgacaacacggtttatcctcctgggtttcccaaccagacccgcattccagcttctctttttctctatcttcctggccacctatttgttgactctcctggaaaatctgctgattattctcgcaatccactccgatgggcaactgcacaagccaatgtatttttttctgtctcacttaagcttcctggaaatgtggtacgtgaccgtgatctctccaaagatgctggttgatttcctttcccacgacaaaagcatcagcttcaatggctgcatgacccagctgtacttctttgtcacctttgtctgtaccgagtatatactcctggccattatggccttcgacagatacgtggcgatctgcaatcccctgcgatacccagttattatgacgaatcaactgtgcggaactctagctggtggctgctggttttgcggactcatgacagccatgatcaagatggtctttatagcgcaactgcactattgcggcatgccccaaatcaaccactacttttgtgatatcagtccccttctaaatgtgagctgcgaggacgcatctcaggccgagatggtcgatttcttcctggctctgatggtgattgccatacctctttgcgtggtcgtggccagttacgccgcaatcctggccacaatattacgcattcctagcgcgcaggggagacagaaggcattctctacctgcgcaagccacttgacagtggtgattctgttctattccatgactctattcacatacgccagaccgaaactgatgtacgcctataacagtaacaaggttgtgtctgtgttatacacagtgatcgtaccgttgctgaatccgattatttattgcttgagaaaccacgaggtgaaagctgcactgcgaaagaccatccactgtaggggaagcggaccacagggtaatggagccttttcgtcttag

SEQ ID NO: 52590 - DNA, 930 bp, Artificial Sequence
  Description of Artificial Sequence: Synthetic coding sequence
atgaaatcctggaacaatactataatcctggaatttctccttctcggcataagcgaagaacctgagctgcaggcttttctatttggcctgttcctaagcatgtacttggtgacagtccttggcaatctgctgataatcttggctaccatctctgacagccatcttcacacgccaatgtacttttttttatctaatctgagttttgtggatatttgttttgtcagcacaaccgttcctaaaatgctggtgaacattcagactcacaacaaggtgatcacctacgcgggatgcattacacagatgtgctttttcttattgttcgtcggcctggataatttcttactcactgtgatggcctatgacagattcgtggcaatctgccaccctctccattacatggtcatcatgaatcctcagctctgcggacttctggtactggcctcatggattatgtcagtcctgaactcgatgctgcagagtcttatggtgttgcccctcccattttgcacgcatatggaaattccccacttcttttgcgagattaatcaagtggtgcacctggcatgctctgacactttccttaatgacatcgtcatgtatttcgccgttgcactcctcgggggaggcccactgacaggcatcctctattcatatagtaagatcgttagttctattcgcgcaatcagcagtgctcaggggaaatacaaagctttttccacctgtgctagccacctgtctgttgtgagtttattttatggaacatgcctgggagtgtacctcagttcagcggctacgcacaactctcatacaggggctgccgcttcagtcatgtatacggtggtaacgcctatgctgaacccctttatctatagtttaagaaacaaacatatcaagggcgctatgaaaacattttttagaggaaagcaatag

SEQ ID NO: 52591 - DNA, 930 bp, Artificial Sequence
  Description of Artificial Sequence: Synthetic coding sequence
atggagccagaaaacgataccggaatctcggaattcgtgctgctgggcctgtccgaggagcctgagttgcagccttttctgttcggcctgtttctgtccatgtacctggtgacagtgctaggaaatctgctcattatcctggcaacgatctctgacagccacctccacacaccaatgtacttctttctgagcaatctgagttttgctgatatctgctttatctcaaccaccatccctaaaatgctgataaacattcagactcagagccgcgtgatcacctacgccggttgtataacccaaatgtgtttctttgtgctttttggaggcctagactcactactgctggccgtgatggcgtacgaccggttcgtagcaatatgccaccctcttcactatacagtgatcatgaatccaaggctatgcggcctgctcgtgctggcctcttggatgattgccgctttaaattctctgtctcagagcctaatggttctgtggctgagcttctgtaccgacctcgagattcctcacttcttctgtgagctgaaccaggtcatccacctggcctgctctgatactttcctaaatgacatgggtatgtactttgccgctggactactggcagggggaccccttgtagggattctctgctcctatagtaagattgtcagctccatacgggctataagctctgcacaggggaagtacaaggccttttccacttgcgcaagtcatctttctgtggtctccctgttctgttgcacggggctgggtgtttatctgacaagcgctgctacccataattcacacacctcagccaccgctagtgtaatgtatactgtcgccacgcctatgctgaacccatttatctactctttgcgcaacaaagatatcaaacgagcacttaaaatgagcttccgaggtaagcagtag

SEQ ID NO: 52592 - DNA, 930 bp, Artificial Sequence
  Description of Artificial Sequence: Synthetic coding sequence
gttaaagccggtaacgaaacacagatctctgaattcttgctcctcggattctctgagaaacaagaattgcagcccttcctgtttggcctgtttctgagtatgtatctagtgactgtgttgggcaatttgctcatcatccttgcagctataagcgactcctgcttgcatacacccatgtactttttcctttctaatctgagcttcgttgacatttgctttgcttccactatggttcctaagatgctggtgaatattcagacccagagtaaggtgattacttatgctggctgcataacgcaaatgtgcttcttcgtgctgttcattgtgcttgatagcctgctactaacggtgatggcctatgaccaatttgttgcaatttgccatccactgcactatacagttattatgagtccacaattgtgcgggctgctcgtgctagtttcatggataatgagcgtactgaattctatgctgcagtcactcgtgacattgcagcttagcttttgcacagacctcgaaattccacacttcttctgtgaattaaatgaaatgatacatctggcatgctccgataccttcgttaataacatggtgatgcattttgcagccgtcctactggacggtggacctctggtgggtatcttatatagctactgcaggatcgtgagctcaattcgggctattagctccactcaggggaaatacaaggctctgagtacctgcgccagccacctcagcgtcgtttcaattttttacggcaccggcctcggtgtctatttgagttctacaatgacccaaaatcttcactccacagccgttgcaagcgtaatgtacaccgttgtaaccccaatgctgaacccgttcatctatagtctccgcaacaaggacatcaaaggcgctctcacacagttttttagaggcaagcagtag

SEQ ID NO: 52593 - DNA, 960 bp, Artificial Sequence
  Description of Artificial Sequence: Synthetic coding sequence
atggagcccggtaacgacacccagatatcagagtttcttctcctcggtttttcccaagaaccaggcctccagcctttcttattcgggctgtttctcagcatgtacctggttactgtgttgggcaacctgttaataatcctggcaacaatcagcgactcccacctgcacactccgatgtattttttcctgagcaacttaagtttcgccgatatctgtgtgaccagcacaaccattcccaagatgctcatgaatattcagacccaaaataaggtcataacctatattgcctgcctgatgcagatgtattttttcatcctgttcgctggatttgaaaattttctgctgtccgtcatggcctacgacagattcgttgccatctgtcaccccctgcactacatggttatcatgaacccccacctgtgcgggctcttggttctagctagctggacaatgagcgcactttactcactcctacaaatactgatggttgtccggctgtctttttgtaccgcacttgagatacctcacttcttctgcgagcttaaccaagtaatccagctcgcatgcagcgatagtttcctcaatcacatggtgatctatttcacggtagccctgcttggcggtgggcctttgactggcattttatattcctactctaaaataatctcctcgatccatgccatttcctccgcccaaggcaagtataaggcattctcgacttgcgcaagtcatctatctgttgtgagccttttttacggtgcgatcctaggagtctatctgtcgtccgctgctacccgtaacagtcatagttccgccacggcctcggtgatgtacactgtagtcactcctatgctgaatcccttcatctatagtttgagaaacaaagacataaaacgggctctcggcatacatctgttgtgggggacaatgaaaggccagttttttaagaagtgcccgtag

SEQ ID NO: 52594 - DNA, 939 bp, Artificial Sequence
  Description of Artificial Sequence: Synthetic coding sequence
atggaggctggtaaccaaaccggattccttgaattcattctgcttggactctctgaggaccctgaactgcagcctttcatttttggcctgtttctctccatgtatctggtcactgtcttaggcaatctgctcataatattagcaattagcagcgattcccatctgcacacacccatgtacttctttctgtctaacctcagctgggtagacatctgcttctccacgtgtatcgtgccaaagatgttagtgaatatacagacagagaataaggccatcagctatatggactgtttgactcaggtgtacttttctatgttctttccaattctagatactttactgctgacggtcatggcttatgataggttcgtggctgtctgccatcccttgcattatatgataatcatgaatcctcatctgtgcggcttacttgtctttgtcacatggttgatcggggtgatgacctctctcctgcacatctccctgatgatgcacctcatcttttgtaaagactttgagatccctcacttcttttgtgaactgacgtatattctccagctggcatgtagtgatactttccttaattccacactgatttacttcatgactggcgtgttaggggtgtttcctcttctcggaataatattcagctacagcagaatagcatcttctattaggaaaatgagctcttcaggcggaaagcagaaagctcttagcacctgtggcagccacctttccgtggtgagcttattttacggaacaggcattggggtccactttacttccgccgttactcatagctcgcagaaaatatctgtggcatctgtaatgtatactgttgttacgccaatgttgaacccgttcatttactcacttcggaacaaggacgttaaaggagccctgggaagtctactctcacgagctgcatcatgcctgtag

SEQ ID NO: 52595 - DNA, 1020 bp, Artificial Sequence
  Description of Artificial Sequence: Synthetic coding sequence
atgagctatttccctattttgttttttttttttctgaaacgatgtccatcctacaccgagccgcagaatctcacgggagtctctgaattcctattgttaggactgagcgaggaccctgaactgcagccagtgctcgctggcctttttctctctatgtatctggtcactgtgcttggcaacctgttaatcatacttgccgtctccagtgacagccacctgcatacgcccatgtattttttcctctccaacttaagtctcgccgacataggctttacaagcactaccgtccccaaaatgatcgtggacatgcagacacactcgcgggtcatatcatatgagggctgtcttacccagatgagcttcttcgtgttattcgcttgcatggacgatatgctcctgagcgtgatggcgtacgatcgttttgtggctatctgtcatccacttcattacaggatcatcatgaatccaaggctatgcgggttcctcatcctgttgagtttttttatatccttgctcgatagccagctgcacaatcttataatgctgcaattgacttgtttcaaagacgtggatatttcaaacttcttctgcgacccgtcgcagctgcttcatctccgatgttcggacaccttcatcaatgagatggtgatttactttatgggtgcaatctttggatgccttcccattagcgggatcctcttctcttactacaaaattgttagtcctatcctgagagtgccgaccagtgatggtaagtacaaagcttttagcacatgtgggtcacatctggcggtggtgtgcttgttctatggaacaggattagtgggatacctgtcatccgcagtgctcccttctcccagaaagtctatggtcgcttccgtgatgtatactgttgtgacaccaatgttgaatccgttcatctacagcttaaggaacaaggacattcagtccgctctatgcaggcttcacggccgaattatcaagtctcaccatttgcacccattttgctatatgggttag

SEQ ID NO: 52596 - DNA, 1002 bp, Artificial Sequence
  Description of Artificial Sequence: Synthetic coding sequence
atgggccctcgcaaccagacagcagtaagtgagttccttctcatgaaggtcactgaggatcctgaactgaaactcatccccttctccctgtttttgagtatgtatctcgtcactatcctgggaaacctgctaattctcctggctgtgattagcgattctcatctgcatactccaatgtacttcctgctatttaatttaagctttaccgatatttgtctgaccactaccaccgtgccaaagatcctggtaaatattcaggcccagaaccagagcatcacatacacggggtgcctgacacagatttgccttgttctggtttttgcaggcttggagagctgtttccttgccgtcatggcctatgatagatacgtggcaatttgccaccccctgcggtatacagtcctgatgaacgttcacttttgggggcttcttatcttactttccatgttcatgtcaactatggatgcccttgtgcagagcctgatggtattgcagctgtcattctgtaaaaacgtggagatccccttattcttctgcgaggtggtgcaagtgattaaacttgcttgttctgacacacttattaataatatcctgatctattttgcttcatctgtgttcggtgcaatacccttgtcaggaataattttcagttactcccaaattgttacgagcgtgctgaggatgcccagtgcacgcggtaaatataaagctttttcgacttgtggatgtcacctcagtgttttctccctgttttatggtacggcctttggcgtctacataagctctgccgtcgctgagtcatcacggataactgcggtggcctctgtgatgtataccgtcgtcccgcaaatgatgaatccttttatctactctttgagaaataaggagatgaaaaaggcactaaggaaactcatcggctggtctaccgtggcgaggagcagactaactgccaacagtgctagcagggtgcacgctatcctgctacctagaccccctgagtag

SEQ ID NO: 52597 - DNA, 936 bp, Artificial Sequence
  Description of Artificial Sequence: Synthetic coding sequence
atgggacccaggaaccaaacagctgtgagcgagtttctgttgatgaaagtgacggaggacccagaactgaagttgattccattcagtcttttcctgtccatgtatctcgtgactatcctcgggaacctactcattctcttggctgttataagcgatagtcatctgcatacccccatgtattttcttttgttcaaccttagttttactgacatatgtttgacaactacaaccgttcctaagatactcgttaacatacaggctcagaaccaatcaatcacatacacagggtgtctaactcaaatttgtctggtcctcgtctttgccggtctggaatcttgttttctcgcggtcatggcctacgacagatacgtcgcaatttgccatccactgaggtacacagtattgatgaatgtccatttttgggggcttctgattctgttgagtatgtttatgagcactatggatgctctcgtacagtctctgatggtactgcagctgagcttttgtaagaacgtagagattcccctattcttttgcgaggtggtccaggttatcaagctggcctgctcggacacccttataaataacattcttatctacttcgcctcatctgtgtttggagccatacctctcagcggaatcatattcagctattcccagatagttacgagcgtgctccgcatgccatccgccagggggaaatacaaggccttctccacgtgcgggtgtcatctctcagttttttcccttttttatggtactgcatttggagtatatatctcttctgccgtcgctgagagtagcaggatcacagccgtggcatccgtaatgtataccgtagtaccgcagatgatgaatcccttcatctactcattaagaaataaggaaatgaagaaagcactacgcaagctgattggcagactcttccccttctag

SEQ ID NO: 52598 - DNA, 1038 bp, Artificial Sequence
  Description of Artificial Sequence: Synthetic coding sequence
atgcctatgcagctgctactgacagactttattatcttttcaataaggttcattattaacagcatggaagcccgtaatcaaaccgccattagcaaatttctgctgctgggattgattgaggatcccgagctccagcctgtgctattcagcctgtttttgtctatgtatctggtaacaattttggggaatcttctgatactgcttgcagtgattagcgattcacatctgcatacccctatgtatttcttcctgtccaacttatcgttcctggatatatgcctgtctaccactaccatcccaaaaatgctcgtgaacatacaggctcagaacagaagcattacctattccggctgtctcactcagatctgcttcgtcctgttctttgccggtttggagaactgcctgctagcagctatggcatatgaccggtacgtggccatctgtcaccccctacggtacactgttattatgaatccacgtttgtgcgggttgctaattctgcttagcctgctgacttccgttgtgaacgctctgctcctgtccctcatggtactgaggttaagcttctgtacggacctcgaaatcccactatttttctgcgaactggcacaggtcatccagctgacgtgctctgataccctgatcaataacatcctgatttatttcgcagcctgtatttttgggggtgtccccttgagtggcattatactctcttatacgcaaattaccagctgtgttcttaggatgccgtctgcctcaggcaagcacaaagccgtgagcacgtgtgggtctcacctcagtatcgtcctcctgttctacggtgccggtctgggagtttacatcagttccgtcgtcaccgatagtcctaggaagacagcagtggcctctgtgatgtactccgtgtttccccaaatggtgaatcccttcatctacagcttacgcaacaaggatatgaaaggcactctgcggaagttcattggaaggatacctagcctcctctggtgcgcaatctgtttcgggttccggttcctcgaatag

SEQ ID NO: 52599 - DNA, 939 bp, Artificial Sequence
  Description of Artificial Sequence: Synthetic coding sequence
atgaaggctgggaatttttccgacactcccgaattctttcttctcggcctctccggtgaccccgagcttcagccaattctttttatgctcttcctgagcatgtatttggccactatgcttggcaatttgctgatcatcctggcagtgaactccgacagccacctgcacactccaatgtacttcctgttaagcatactgtcacttgtggatatctgtttcacctccaccacgatgcctaaaatgctggtcaacatccaagctcaggcccagagcattaactacaccggctgtctgacccaaatttgttttgttttggttttcgtggggctggagaacgggattttggttatgatggcttacgatcggttcgttgctatttgccacccactgagatataacgtgattatgaatcctaaactctgcgggctgctcctactcctgtcctttatcgtgtcagttctggatgccctgctgcatacactcatggtgctgcagctgaccttttgcatagacctggagatccctcattttttttgcgagctagcccacatcctgaaactcgcgtgttctgatgtcctgatcaataacattctggtgtatctcgttacatcactattgggggtggtgcctctctccggcattatctttagctacacacgtattgttagctcagtcatgaagatcccctcagcaggcggtaagtacaaggcatttagtatatgcggctcgcatctgatagtcgtgtccctcttttacggtaccggctttggcgtctaccttagctctggcgcaacccactcttccagaaagggagccatcgcttctgtgatgtacaccgtggtgacccccatgctcaaccctcttatttattcactgcggaacaaagatatgctcaaggcactgcggaagctcatctcacgcattccttcattccactag

SEQ ID NO: 52600 - DNA, 981 bp, Artificial Sequence
  Description of Artificial Sequence: Synthetic coding sequence
atgggttttctgagccctatgcacccctgtcgcccacctacccaacgcagaatggcagccggtaaccactctactgtcaccgaatttattctgaaagggctgacaaagcgggcagatctccagctgccactgttcctgttgtttcttggcatatatctggttacgatcgtcgggaacttgggcatgattactctgatctgtttgaactcgcagcttcatacacccatgtattatttcctgtccaatctgtctctgatggacctgtgctattcttcagtcatcacaccaaaaatgctggtgaactttgtgagtgagaagaacatcatctcctacgcaggctgtatgtcccagctgtactttttcctggtcttcgtgattgctgagtgttacatgctgacagttatggcctacgatcggtacgtcgccatatgccatccacttctctataatatcatcatgagccaccatacctgtctcctattggtggctgtggtctacgccatcggactgatcggctcaaccattgagaccggcctcatgctgaaactgccttactgcgaacatctgatttcccactatttctgcgacatcctgccattaatgaaactatcctgctctagcacctatgatgtggagatgactgtcttcttttcagctgggttcaacatcatagtgaccagcctgaccgtcctagtgtcttacacattcattctgtcttcgatccttggaatcagtaccacagagggacggagcaaagccttctcgacatgttcctcccacttggctgcagttggcatgttctacgggtctaccgcgtttatgtatctgaagccttctaccatatcctccctcacacaagagaatgtagcgagtgtgttctacaccactgtaataccaatgttgaatcccctaatctattctctgcgaaataaggaagtcaaggccgctgtgcagaaaacactaaggggtaagttgttctag

SEQ ID NO: 52601 - DNA, 933 bp, Artificial Sequence
  Description of Artificial Sequence: Synthetic coding sequence
atggccgcaaaaaacagctcggttacagagtttatcctcgagggactaactcaccaacctggacttcggattccacttttttttctgttcctcggcttctatacagttactgttgtgggcaatctaggcctcatcacattgattggcctgaacagccacctacacaccccaatgtacttttttctgtttaatctgagcctgattgacttctgcttcagtacaacaataacccctaagatgctcatgagtttcgtatctaggaagaatattatctccttcacaggctgcatgacacagcttttcttcttctgcttttttgtggtttccgagtcttttattctgtccgctatggcttatgataggtacgtggccatctgcaatcctcttctatatacagtgactatgtcctgccaggtctgtctcctcttgctcctgggggcttacggcatgggttttgccggtgccatggcccatacaggttccataatgaatctgacattctgtgccgataatctcgtgaaccacttcatgtgtgacatcctgcccctgttagaactcagttgtaacagtagctacatgaacgagcttgtggtttttatcgttgtggccgtagacgtcggaatgcccattgtgacagtgttcatctcttatgctctgattctctcttctattctgcataattcaagtacggaaggtagatccaaggccttttctacctgttcctctcatataattgtcgtcagcctattcttcggcagcggggctttcatgtacctgaagccgctttccattctccccctcgagcaaggcaaggtctctagcttattctatactatcatcgtgcctgtgttaaaccctctgatctattccctacggaataaagatgtaaaggtggcgcttagacggacgctggggagaaaaattttcagctag

SEQ ID NO: 52602 - DNA, 942 bp, Artificial Sequence
  Description of Artificial Sequence: Synthetic coding sequence
atgctcgcccgtaacaactcgttggtaaccgagttcatcctggccggactcactgatcacccggagttcaggcagccactgttttttttgttcctagtcatatacattgtcactatggtgggcaacttggggcttatcacattgttcgggctgaacagtcatcttcacacccctatgtattatttcctcttcaacctgagcttcatagatctctgttactcctctgtttttacgccaaaaatgctgatgaattttgtatctaaaaagaatataatctcaaacgtgggctgcatgacccggctgttcttcttccttttcttcgtgatctctgaatgttatatgctaacatctatggcatacgataggtatgtagctatatgtaacccactgttgtacaaggtgaccatgtctcatcaggtctgtagtatgctgacattcgctgcctatatcatggggttagctggtgccacagctcatactggatgcatgctgcggctgacattttgctctgccaatattatcaaccactacctctgcgacatcctacctctcttgcagctctcgtgtacttctacttacgttaatgaagtcgtggtccttattgtggtaggcaccaatatcacagtgccgagctgcaccattttaatttcctacgttttcattgtaacatcaattctccatattaagagcactcaagggaggtcaaaagccttcagcacatgctcctcccacgtcatcgctctcagcctgttttttggctcagcagcttttatgtatattaagtactcttccggatctatggagcagggtaaggtatcaagcgtcttttatactaacgtggtgccgatgctcaatcccttgatctactccctgcgcaataaggacgtgaaggtcgccctgagaaaggctctaattaaaattcaacgtcggaatatcttttag

SEQ ID NO: 52603 - DNA, 942 bp, Artificial Sequence
  Description of Artificial Sequence: Synthetic coding sequence
atgctggccagaaataacagtctggtgacagagttcattctggcaggtttgactgaccatcctgagttccagcagcctctatttttcctgttcttagttgtctacattgtcactatggtgggaaatctcgggctgattattttgtttggccttaacagtcacttgcacacacctatgtactactttctgttcaacctttcttttattgatttgtgttattcctccgtgttcacacctaaaatgctcatgaatttcgtgtctaagaaaaatataatctcctacgtggggtgcatgacccagttgtttttcttcctgttctttgttataagcgagtgctatatgcttaccagcatggcctatgataggtatgtcgctatctgcaatccgttgctttacaaggtcacaatgagtcaccaggtctgcagcatgctgacttttgccgcatacatcatgggtctagctggcgcaaccgcgcacactggctgtatgcttcgactcactttctgcagcgcaaatatcattaatcactacctctgcgacatcctgcccctgctgcaactgagttgtacatctacctatgttaatgaggttgtggttctgatcgtggtgggtataaatatcatggtaccctcgtgcactatcttgatctcttacgtttttatagtgacttcaatccttcacataaaatctacgcagggccgatcaaaagctttctctacatgcagtagccacgttatcgcactgtctctcttctttggaagcgctgcctttatgtacatcaagtactcaagtgggtctatggagcaggggaaggtgagctcagtgttctacactaacgtggtccctatgctcaaccctttgatctacagccttcgcaacaaagacgttaaagtggcgctaagaaaggcactcatcaaaatccagagacggaacattttctag

SEQ ID NO: 52604 - DNA, 930 bp, Artificial Sequence
  Description of Artificial Sequence: Synthetic coding sequence
atgacactgagaaattcttcctctgttaccgagtttatcctagtaggactaagcgaacaaccagaactgcagttacctttgtttctcctgttcctcggcatctacgttttcacagtggttggaaacctggggctgattactttaatcggaatcaacccctccctgcacaccccgatgtacttctttttatttaacctctccttcatcgatctttgttactcatgcgtctttacacctaaaatgctgaacgacttcgtcagcgaaagtattattagctatgtcggctgcatgacccaactgttcttcttctgcttcttcgtgaactcggagtgttatgtgcttgtgtccatggcgtatgatcgctacgttgcaatttgtaatcccctgctgtacatggtgactatgtcgccgcgagtgtgctttctcctcatgttcggctcctatgtcgtcggctttgccggagcaatggcacacacgggatcaatgctgcgtttgacattttgcgatagcaatgtgatcgaccattacctgtgcgacgtgttgccactgttgcaactctcatgtacctccacgcacgtttccgagctggtgttcttcatcgtggtgggggtcattaccatgctgtctagtatcagcatcgtgatttcttacgcactgattctcagcaacattctatgcatccccagcgcagaaggtcgcagcaaggctttctcaacatggggaagccacatcatcgccgtggcacttttttttggcagcggcactttcacatacttgactactagctttccgggatctatgaaccatggcagattcgcaagcgtgttttatactaatgtggtgcccatgctgaatccatcgatctacagtctgcgtaacaaggatgataagttggctctgggtaagaccctgaagagggttctcttttag

SEQ ID NO: 52605 - DNA, 936 bp, Artificial Sequence
  Description of Artificial Sequence: Synthetic coding sequence
atggccgctgaaaacagctccttcgtgacacagttcatcctggctggactaacagatcaaccaggcgtccaaatccccctgttctttctgttcctcggcttctacgtggtcactgtagttggtaaccttggcctcattaccctgatccgactgaacagccacttgcacactcccatgtatttcttcctctataacttgagcttcatagatttctgttactctagtgtcatcactccaaaaatgttaatgagcttcgtcttgaaaaagaactctatctcatacgcgggatgcatgacgcagctcttcttctttctgtttttcgtggtgtctgagtcattcatcctttctgccatggcgtatgatcgctacgtcgcaatttgcaatccactgctttatatggtgactatgtccccacaggtttgcttcctcttgctgttgggggtgtatgggatgggttttgctggcgctatggctcacacagcatgcatgatgggcgtcacattttgcgcaaataatctcgtgaatcactacatgtgtgacatccttcccctcctagaatgtgcttgtacctctacctatgttaacgaacttgtggtgtttgtagttgtggggatcgacatcggagtgccaactgttaccatttttatcagctatgcactaatcttgtcctccatctttcacattgacagcactgaaggaaggagcaaggcgttctccacctgcagctctcacattatcgccgtaagcctgttctttgggagtggcgctttcatgtacctcaagcccttttctctcttggccatgaaccaggggaaagtcagcagtcttttctataccacagtcgtgcccatgcttaacccattaatctatagtctgcgaaacaaggatgtgaaggtcgctctgaaaaagatactgaataagaacgccttctcttag

SEQ ID NO: 52606 - DNA, 927 bp, Artificial Sequence
  Description of Artificial Sequence: Synthetic coding sequence
atgacgatggagaattacagtatggccgcacaatttgtgctggatggactgacccagcaagctgagcttcagcttccactcttcctgctcttcttgggcatctatgtggttacagtagtcggtaacctcggaatgatcctgctcatcgcagtcagcccacttctgcacacccctatgtattacttcctgagcagcctgtcctttgtggacttctgctacagttccgttattacgccaaagatgctggtgaatttcctcgggaagaagaatactattctctattcagaatgtatggtacagctctttttttttgttgtgttcgtggttgcagagggctacttgctgaccgctatggcttatgaccgatacgttgcaatctgcagcccgctattatataatgcaataatgtcctcatgggtttgttccttactggtactagccgcattcttcctagggttcttaagtgctttaacccacacttccgctatgatgaaactgagcttttgtaaatctcatatcatcaaccattatttttgcgacgtcctccctctgctcaacctgtcctgttcgaacacacacctaaacgagttactacttttcattatcgccggatttaatactttggtgcccactctggctgtggctgtcagttacgctttcattttgtattctatccttcacatcagatcgagtgaaggtagatccaaagccttcggaacttgttcctctcacctcatggccgtggtgattttttttggatcgattacattcatgtatttcaagccccctagcagcaactcactggatcaagagaaggtgtcttccgtcttttatacaaccgtgatccccatgctgaaccctctgatctactccctgcgaaataaggacgtaaagaaggccctcaggaaagtccttgtgggaaagtag

SEQ ID NO: 52607 - DNA, 936 bp, Artificial Sequence
  Description of Artificial Sequence: Synthetic coding sequence
atggctactagtaatcattctagtggcgctgagttcatcctcgccggacttacccaacggcctgaactccagctgcctctcttcctcttgtttcttggtatctatgtcgtaaccgtggtgggaaacctaggaatgatttttctcatcgctctgagttcgcagctgtacccacctgtgtactactttctcagtcaccttagttttatagatctgtgttacagctctgtaatcaccccaaaaatgctcgtcaactttgtgccagaggagaacattatttcttttctcgagtgcatcactcagctctacttcttcctgatctttgtgattgctgagggttatctcctcacagctatggaatacgacaggtacgtggcaatttgccgccctttactgtacaacatcgttatgtcacacagggtgtgtagtatcatgatggcagtcgtgtactccctggggttcctatgggcgaccgtgcacaccactagaatgtctgtcctgtctttttgcaggtctcacacggtgtcccattacttttgcgacattctgcccctccttaccctgagctgcagctctactcatatcaatgagatccttctgtttatcatcggaggcgttaatactctcgccaccacgctcgccgtcctgatttcatacgcattcattttttctagcatcctggggattcacagcactgagggtcagagcaaggctttcggtacctgctcaagtcatctcctggccgttggcatcttttttggctcaattacctttatgtactttaaaccgccatccagcaccactatggagaaggagaaagtgtcctccgtgttctacatcaccattattccaatgctgaatcctctgatatacagcctcaggaacaaggacgtgaaaaatgccctcaagaagatgacccggggtcgacaatccagctag

SEQ ID NO: 52608 - DNA, 945 bp, Artificial Sequence
  Description of Artificial Sequence: Synthetic coding sequence
atgggggtcaaaaaccactctaccgttacagagtttctgcttagtggactgaccgaacaagccgaactccagctgcctttgttttgtctgttcctcgggatatacaccgttaccgtagtagggaacttaagcatgatttccatcatccgcctgaatagacagctgcacactccaatgtattacttcctaagctcactgtcctttttagacttttgctactcctcagttattactccaaaaatgctctccgggtttctgtgtcgggatcgctcaatcagctattccggctgtatgatccagctcttttttttctgtgtctgtgtcattagcgaatgttacatgctggccgctatggcctgtgatcggtacgtggcaatctgctcccctctgctctatagagtcataatgagccctcgggtctgtagtctcctggtggccgcagtgttctctgtggggtttaccgatgccgtcattcacggtggctgtatactacgactgtccttttgcgggtctaacatcataaaacattatttctgtgatatcgttccactgattaagctgtcttgctcatccacctacattgacgaactgcttattttcgttatcgggggatttaatatggtggcaacttccttgaccattattatcagctatgcgttcattttgacttcaattttgcgcatccactcgaagaaaggccgatgcaaagccttttccacttgtagctcccacctcactgctgtgctgatgttctacgggagtctgatgtccatgtatctgaagccagctagttcctcatcactgacgcaggagaaagtttctagcgtattttataccacagtcatattaatgctaaaccccctaatttattccctgcgtaataacgaggtccggaacgccttgatgaagctcctgagaaggaaaattagcctatctccgggatag

SEQ ID NO: 52609 - DNA, 936 bp, Artificial Sequence
  Description of Artificial Sequence: Synthetic coding sequence
atggggcgtcggaataatactaacgtccccgattttatcctgacagggctttcagattccgaagaagtccagatggccctgtttatcctattcctcctgatttatttgattacaatgcttggaaatgtcggaatgatcctgattatccgcctggatctccaattacacaccccaatgtatttcttcctcacacacctttcattcattgatcttagctattctactgtgatcacccccaagacgctggcaaatctgctgacttctaattacatcagttttatgggctgtttcgctcagatgttcttcttcgtcttcctgggggctgcagagtgtttccttttgagctcaatggcttatgataggtatgtggcaatctgtagccccttacgatatcctgtgattatgtctaaacgactttgctgtgccctcgtgacaggaccctacgtaatctccttcatcaattcattcgtcaatgtcgtctggatgtcccggctgcacttctgcgatagcaatgtggtgcgtcatttcttctgcgacactagtcctatattggctctcagctgtatggacacttacgacatagagattatgatccatattctcgccggttccaccctgatggttagccttattaccatctccgcctcatatgtatcaattctgagtaccatactaaagataaacagtacttccggaaagcagaaagccctgtccacatgtgcaagtcatcttctgggagttacaatcttttatggtacgatgatcttcacctacctgaaaccacgtaagagttatagtctgggcagagatcaagtggcctctgtcttttacacgatagtgattccgatgttgaatccacttatttattctctgaggaataaagaggtcaaaaatgctctcataagagtaatgcaacgccgtcaagattccagatag

SEQ ID NO: 52610 - DNA, 930 bp, Artificial Sequence
  Description of Artificial Sequence: Synthetic coding sequence
aataacactaatgtaccggacttcatcctgactggactgagtgactccgaggaagtgcagatggctcttttcatactcttcctgttgatctacctcatcacaatgctgggtaacgtcgggatgattcttatcatcaggctcgatttacagcttcacacaccaatgtatttctttcttacccacctgtccttcatcgacctgtcatattctactgtgataacgcccaagaccctcgccaacttgctgacttctaattacatctcattcatgggctgcttcgctcagatgttctttttcgtttttcttggcgcagccgaatgcttcctgttaagtagtatggcctacgacaggtatgtcgctatctgttctccactgcggtaccctgtcatcatgagtaaacgcctgtgctgcgccctagtgaccggtccctatgtgatcagctttattaattcctttgttaatgtggtgtggatgagcagacttcatttctgcgactcgaatgtggtgcggcactttttctgtgacacatccccaattcttgcactgagctgcatggatacatacgacatcgaaatcatgatacacatcctggcagggtctaccctgatggtttccctgatcactatttctgccagttacgtctccatcctatcaacaatattaaaaatcaactctaccagtgggaaacagaaggcgttaagtacctgcgcctctcatttactgggcgtcacaatcttttatgggaccatgatttttacctacctgaaaccgaggaagagttattctttaggcagagatcaggtggcatctgtattttacactattgtaatacccatgttgaacccactgatatattccctcagaaataaggaggtgaagaacgccttaatccgcgtcatgcagcggatctggtatgtgctgggcttatag

SEQ ID NO: 52611 - DNA, 939 bp, Artificial Sequence
  Description of Artificial Sequence: Synthetic coding sequence
atgatggggagacgtaataataccaacgttgccgatttcatcctgatgggcctgaccctgtccgaagagatacagatggctctctttatgttgtttctgttaatctatctcattaccatgttgggcaatgtgggcatgatactgattatcaggctcgacctacagctccacactccaatgtattttttcctgacccatctttcattcatcgatctgagctattccaccgtcgtaacgcccaagacccttgcgaacttactaacctccaactacatcagttttaccggctgtttcgcccagatgttttttttcgccttcctcggtacagccgaatgttatcttctgtcgagcatggcccatgatagatacgccgcaatttgctctcccttgcactatacagtgatcatgagcaaaagattatgtcttgcgctgattactggtccatacgtgatcggattcattgactctttcgtaaatgtggtcagtatgtctcggctgcacttctatgacagcaatgttattcatcacttcttctgtgataccagccccatccttgcgctgtcctgcactgatacatataacaccgaaattctgatttttattatcgttggatccacattaatggtgtcgttgtttacgatctctgcatcctacgtgttcatactattcaccatcctgaagatcaacagcacatcaggtaaacagaaagccttcagcacgtgtgtttcccatctccttggtgtgactattttttattctaccctaatcttcacctaccttaagccccgtaagtcctacagtctgggacgcgaccaggtcgcctcggtattttacaccattgttatccccgtgctgaatccgttaatctatagccttaggaataaagaggtgaagaatgctgtgatacgcgtgatgcaaaggaggcaagactccaggtag

SEQ ID NO: 52612 - DNA, 939 bp, Artificial Sequence
  Description of Artificial Sequence: Synthetic coding sequence
atgatggggcgtagaaatgataccaatgtggctgactttattctgactggcttaagcgacagtgaagaggtgcagatggccctgttcatgttgtttctgctgatctaccttataacgatgcttgggaatgtgggcatgctgcttattattaggttggacctccagctgcatactcctatgtattttttcctgacacatctctcctttatcgatctgtcatattcaacagtcgtgacgcctaaaaccctcgctaacctcctaacttccaactatatctctttcacgggttgtttcgctcagatgttttgcttcgtgttccttgggactgccgaatgctatttgctgtccagtatggcctacgataggtatgctgcaatttgctctcccctgcattatacagtgatcatgccgaaaaggctatgcctcgccctgattacagggccttacgtcattggcttcatggacagcttcgtaaacgtcgtgagcatgtccagactccacttttgtgacagcaatatcatacaccatttcttctgcgatacttccccaattttagccctctcatgcaccgacacagacaacaccgagatgctgatcttcattatcgccggatccactctgatggtttccttaattactatctctgcaagctatgtgagcatattgtctaccatacttaagatcaacagcacgtcgggtaaacaaaaagctttttcaacgtgtgtttcacatctgctcggagttactattttttacgggaccatgatttttacatacctaaaaccaagaaaatcctactcactggggcgagatcaggtggctccggtcttttacacgatcgtgattccgatgctgaatcctttaatctacagcttaagaaaccgggaagtgaagaatgccctgatcagagttatgcagcgcaggcaggattcacgctag

SEQ ID NO: 52613 - DNA, 933 bp, Artificial Sequence
  Description of Artificial Sequence: Synthetic coding sequence
atggcgggtaataattttacagaggtcaccgtctttatccttagcggatttgccaatcaccccgagcttcaggttagcctctttttgatgtttctttttatctacctgttcaccgtgctgggaaacctgggtctaatcacactgattaggatggatagtcagttgcatacacctatgtacttctttctctccaaccttgccttcatagatattttttattcgtccaccgtaacccctaaggctctggtcaatttccaaagtaaccggagatcaatttcatttgtgggttgttttgtgcagatgtatttctttgtggggctggtgtgttgtgagtgttttttgctgggctctatggcgtacaaccgatatattgctatttgcaatccgctcctgtactctgttgtgatgtcccagaaggtatctaattggctgggcgtgatgccctatgtgataggatttacatcttcccttattagcgtatgggtaataagcagtctggctttttgtgactcctcaattaatcactttttctgcgatactacagcactcctggccctgagctgcgttgataccttcggcaccgagatggtatccttcgtccttgcgggtttcactctcttgagtagtctgctcatcataacagtcacatacattattattatcagcgcaatcctgcgtattcagtctgctgcagggagacagaaagcattttctacctgtgcctctcacctgatggcagtcacaatcttctatgggtctttgatctttacgtatctacagccagacaatactagctcacttacacaggcacaagtggccagcgtgttctacacaattgtgattccaatgctgaatcccttgatctacagtctgcggaataaggatgtgaaaaacgccctcctgcgcgttatccatagaaaactgttcccatag

SEQ ID NO: 52614 - DNA, 951 bp, Artificial Sequence
  Description of Artificial Sequence: Synthetic coding sequence
atggcacccgaaaacttcacgcgcgtgaccgaatttattctgaccggtgtgagcagttgccccgagctgcagattcccctgtttctggtgttcctggtgttgtacgggctgacaatggcaggcaacttggggatcataacgctcacgtccgtggatagcagacttcagactcccatgtactttttcttgcaacatctggcactgattaacctggggaatagtaccgtgatagctcctaagatgctgattaatttcttagtgaagaagaagacaacatccttctacgagtgcgccacccagcttggaggatttctgttcttcatcgtatctgaagttattatgttagcactcatggcttacgataggtacgtcgccatctgtaacccgcttctgtacatggtcgttgtgtctcggaggctgtgcctactgctggtcagcttaacttatctgtatggatttagtacagccatcgtagtgtctagttatgtgttctccgtgtcatattgcagcagtaacatcatcaatcacttctattgcgacaatgttccgcttttagcactgtcatgcagtgacacttatctaccggagactgtcgtcttcattagtgctgcaacgaacgtagtgggaagtctgattatcgtgttggtgtcatacttcaacatcgtgctgtcaatattgaaaatttgctcttccgagggacgcaaaaaagcattctctacttgcgccagccacatgatggctgtaacaattttctatggcaccctgctttttatgtatgtccagccgcgtagcaaccactcgctggatacggatgataagatggcaagcgttttctacaccctagtgatacctatgctcaacccattgatctacagcctacgaaacaaagatgtaaagaccgcactgcagaggtttatgactaatttatgctatagttttaagactatgtag

SEQ ID NO: 52615 - DNA, 948 bp, Artificial Sequence
  Description of Artificial Sequence: Synthetic coding sequence
atggcccctgaaaactttaccagagtcacagagttcatcctgactggcgtgtcgtcatgcccagaattacagattccactcttcttagtattcctggtgctgtacgtgttaactatggcgggtaatctgggcatcatcacccttacatcagtagacagccggctgcagaatccgatgtattttttcctcaggcatctggctataatcaaccttggcaactccactgtgatagctcctaagatgctgatgaatttcctcgtgaagaagaagacaactagcttctatgaatgcgcaacacagctggggggtttcctgttttttattgtgtctgaggtaatgatgctagccgttatggcctatgaccgctacgtggctatctgcaatcctctcctttatatggtggtggtgtcaaggcgcctttgccttctcctggtcagtcttacatatctatatggctttagcacggccatagtggtctctccgtgcatcttctctgtgtcctactgttcctcgaacataatcaaccacttctactgcgatattgcgccactgcttgcactttcatgcagtgacacatatatacctgaaactattgtatttatcagcgctgctacaaacttagtgttttcgatgattacagtcctggtctcctactttaacatcgtcctgtccatcctgaggattaggtcgccggaaggtagaaaaaaagccttttcaacgtgcgcatcgcacatgattgctgttactgttttctacggcacgatgcttttcatgtatctgcagccccaaacaaatcatagcctggacactgacaaaatggcgagtgtattctataccctggttattccgatgctgaatcctctcatctattctctgcggaacaatgatgtgaatgtggctctgaagaagttcatggaaaacccgtgctacagtttcaagtccatgtag

SEQ ID NO: 52616 - DNA, 960 bp, Artificial Sequence
  Description of Artificial Sequence: Synthetic coding sequence
atgaaccacgtggttaagcacaaccacactgccgtcacaaaggtgacagagttcatcctgatggggattacggacaatcccggactccaggcccctctcttcgggctgttcctgattatttatctggtgacagtaattggcaatctggggatggtgattctgacgtatcttgacagcaagctgcacacccccatgtacttcttcctccgccatctgtcaattactgatctcggatattctaccgtgatcgctccgaagatgctggtgaactttatcgtacacaagaacacaattagctacaactggtatgcaacccaactggctttttttgagatttttattatctctgagctctttatactgagcgcaatggcctatgatagatatgtagccatctgtaagccacttttgtacgtcataatcatggctgaaaaagtcctgtgggtgctggtgattgttccctacctgtactcaacgttcgtctcattgttcctcacgatcaagctcttcaaactgtctttttgcggaagtaacattatcagctatttttactgtgactgcatcccccttatgtctatcctttgctcagacaccaatgagttggaattaataattctgatctttagcggatgcaatctgttgttctcgctctccatcgtcctgatttcctacatgtttatcctggtggctatcctccgcatgaacagccggaagggaagatataaggccttcagcacgtgctcctctcatcttactgtggtgattatgttctatgggactctgctgtttatttacctgcaacctaaaagcagccacacgctggccatagataagatggccagtgtcttttataccctgttgattcccatgttgaacccccttatttatagcctgagaaacaaagaggtgaaagatgcgctgaagcgcacactgacaaatcgcttcaagatccctatttag

SEQ ID NO: 52617 - DNA, 939 bp, Artificial Sequence
  Description of Artificial Sequence: Synthetic coding sequence
atggaacagcacaaccttacaactgtgaacgagttcatccttaccggcattaccgacatcgccgaactacaggccccactcttcgcgctatttctgatgatttatgtgatttctgtaatgggtaacctcggaatgattgtcttgactaaactggatagccgcctacagacccccatgtactttttcctccgccacctcgcctttatggacctaggatactctactacagtcggaccaaagatgttggtcaattttgtcgtggacaagaatattattagctactatttctgcgccacacaactggctttcttccttgttttcatcggctcagaactgttcatcttgtccgcaatgtcctacgatctttatgtggcaatctgcaaccctctgctctacaccgttataatgtcaagaagagtctgtcaggtgttagtggcaatcccttacctgtactgtaccttcattagcctgttggttactatcaagatcttcaccctctctttctgcggatacaacgttatttcacacttctactgtgatagcttaccgcttttgcctctgctatgctcaaatacgcatgagatcgaattgatcatcctcatattcgccgcaatcgatctaatcagttctttgctcattgtgctcctgtcataccttctgatactggtggccatcctgagaatgaattccgctgggaggcagaaggcattctccacatgcggcgctcatctgacagttgttattgttttctatgggactttattgtttatgtacgtgcagcccaagtcttcacacagtttcgataccgataaggtggcctcgatcttttacactctcgttataccaatgcttaatccactgatctactccctgcgaaataaggacgtgaaatatgccctccgccgaacgtggaacaacctgtgtaacatttttgtctag

SEQ ID NO: 52618 - DNA, 924 bp, Artificial Sequence
  Description of Artificial Sequence: Synthetic coding sequence
atggggcagcacaacttgacagtgctgactgaattcatcttgatggagcttacacggagacctgagctgcagatccccttattcggcgtgttcctggtgatatacctcatcactgtagtggggaaccttactatgataattctaacaaagctagatagccacctgcacacacctatgtacttttcaataaggcacctggcatttgttgaccttggtaattctacagtgatttgccccaaggttctcgccaacttcgtggtggatcgtaacacgatatcatattatgcatgcgcagcccaactagcattcttcctcatgttcatcatcagtgagttcttcattctgtctgcaatggcttatgaccggtatgtcgccatttgcaatcctttgctctactacgtcattatgtcacagcggctgtgccatgtcctagtggggattcaatatctttactctaccttccaggccctgatgttcacaatcaaaatatttacactcaccttctgcggctctaatgtcattagccacttctattgcgacgacgtgccactcttaccgatgttgtgcagcaacgcccaggagattgaactcttaagtatcctctttagcgtttttaacctgatctcttccttcctcattgtgctcgtctcgtatatgctaattctgttggcaatatgtcagatgcacagcgcagagggccgaaagaaagctttttctacttgcggaagccacctgacagtggtggtcgtattttacggatccctacttttcatgtacatgcagccaaattccacccactttttcgatacggataaaatggcttcagtattttatactctcgtgatccctatgctcaaccctttaatttattccctgaggaatgaggaagttaagaacgcgttctacaaactattcgaaaactag

SEQ ID NO: 52619 - DNA, 1080 bp, Artificial Sequence
  Description of Artificial Sequence: Synthetic coding sequence
atggctctggggaaccatagcaccattacagagttcctgctcctgggcctcagcgccgatcctaatattagggctctgttattcgtccttttcctaggcatttatttgctgacaatcatggagaacctcatgctcctgctcatgatccgcgctgacagctgcttacacaagccaatgtacttcttcctctcccacctctcctttgtggatctctgtttctcctctgtcatcgtgcccaagatgttggaaaatcttctgtcccagaggaagaccatatcagtagaggggtgcctcgcgcaggtgttttttgttttcgttacggcaggtacagaagcttgcctgctaagcggcatggcttatgatcgacatgcagcaatctgccgccctctcttgtatggccagattatgggaaaacaattgtatatgcacctggtgtggggcagctggggcctgggatttcttgacgcactgattaatgtgctgttagcagtgaacatggtgttctgtgaagcaaaaatcattcaccattacagttacgagatgccaagccttctccctttgagttgttctgacatatccagatccctgattgcccttctttgctctaccctcttgcatggcctaggaaatttccttttagtctttctgagttatacacggatcataagtactatactttctatcagcagtactagcgggagatccaaagccttttccacgtgttccgcacacctcaccgctgtgaccctctactatgggagcggtctactgaggcatctgatgcctaactccggatccccgatcgaattgatcttctctgtgcagtacaccgtcgtgacgcccatgctgaactcactgatctactccttaaaaaataaggaagtgaaaggagagcggtccctcagggacagttctcatttgccccaattgcataaagggcaggctcggtggaagcgaccagcctttactgagggtcggagagaacctgggcacccagagctctctatacccgtgacgcctcagccccagggcgcatgcgcctgctcggcccttcgcgcagcaccgaccgcattgccatag

SEQ ID NO: 52620 - DNA, 930 bp, Artificial Sequence
  Description of Artificial Sequence: Synthetic coding sequence
atggcacacatcaattgcactcaggccacagagtttatcctggtgggcctaaccgaccatcaggagttaaagatgcctctgttcgtcttgttcctgagtatttatttgtttactgtggttggcaatcttggcctgatactcttaattagagctgacacatctctgaacacacccatgtatttctttttgagtaatctggccttcgtggacttctgctatagttcagtgattactccaaagatgctgggtaactttttgtataagcagaatgtgatttccttcgacgcctgtgcaacacaattggggtgtttcttaacttttatgatttcagaaagtctgctgctggcctctatggcatatgatcgctacgtggccatatgtaatcccttgctatacatggtggtcatgacacccggaatttgtatccaactggttgccgttccttacagctacagttttctgatggcactgtttcacaccattctgacctttcggctatcttattgccactcaaatattgtaaatcatttctactgtgacgatatgcctctcctcaggctgacctgttcagacactcgcttcaagcagctgtggatttttgcctgtgccggaataatgttcatctcttccctgctcatcgtgttcgtgtcctatatgttcattatttcagcaatactacggatgcactcagcagagggacgccaaaaagccttctccacctgtggatctcacatgttggccgtgaccatattttatggaacccttattttcatgtacctgcagccgtcatcgagccatgcattggataccgacaaaatggcctccgtcttctatacggtgataattcccatgttgaatcctctcatctatagccttcagaataaagaggtgaaagaggcccttaagaagatcattattaataagaactag

SEQ ID NO: 52621 - DNA, 933 bp, Artificial Sequence
  Description of Artificial Sequence: Synthetic coding sequence
atgatggacaaccatagttccgccaccgaatttcacctgctcggctttcctggttcacaaggactacatcacatcctctttgcgatttttttcttcttttacctggtcaccttgatgggaaatacggtcatcatcgtgatcgtttgtgtggacaagagattgcaaagccccatgtacttcttcctctcacatctgtccacgctggagattctggttacaaccatcatcgttcctatgatgctgtggggactcttattccttgggtgtaggcaatacttgtcactgcatgttagcttaaatttctcttgtggcactatggaatttgcgctgctcggcgtcatggccgtggacagatatgtcgctgtgtgtaaccctctcaggtacaacatcataatgaactcttctacatgtatatgggtggtgatcgtcagctgggtttttggatttctgtctgaaatctggcctatttacgcgaccttccagtttacatttagaaagtctaacagcctagaccatttctactgcgatcgagggcagctcctcaaactgagttgtgataacaccttgctcactgaatttatactattcctaatggctgtgtttatcctgataggctcccttattcccaccatcgtgtcttatacctacatcatatccacaatcttaaagatcccctccgccagcggcaggagaaaggcattctccactttcgcgagtcacttcacctgtgtggtgataggatacggtagttgcctcttcttgtatgttaagcccaaacagactcagggggtagaatacaataaaattgtgagtttactggtctcagtactgactcccttcctaaatcccttcatattcaccttaaggaacgataaagtgaaagaggctctcagagacggcatgaagcgttgctgccagttgctgaaggactag

SEQ ID NO: 52622 - DNA, 945 bp, Artificial Sequence
  Description of Artificial Sequence: Synthetic coding sequence
atgctaatgaactacagttccgccactgagttctacttattggggtttccgggatctgaagagctgcatcatatcctgttcgctatttttttttttttttacttggttacactgatgggtaatacagtgatcataatgatcgtctgtgtagacaaacgactgcagtcaccgatgtatttcttcttggggcacctctctgctctggagatcttggtcaccaccataatcgtcccagtgatgctgtggggactactgttacctgggatgcaaaccatttacctatccgcatgtgtggttcaactcttcctctacttggcagtaggcactaccgaattcgcccttctcggagctatggctgtcgacagatacgttgcggtgtgtaacccactccgatataatatcataatgaatcgccacacatgcaacttcgtggtgttagtgtcttgggtatttggcttcttgtttcagatctggcccgtctacgtgatgtttcagcttacctactgcaagagcaacgtggtgaacaacttcttctgtgatagaggtcaactgcttaagctcagctgtaacaacacgctctttaccgagttcatactgttcctgatggccgtgtttgtgctctttggttcactgatccccactatcgtgtcaaatgcctatattatctctactatactgaagataccaagctcctcggggaggagaaaatcattctccacgtgcgcctcccatttcacgtgtgttgtgattggctacggtagctgtctctttctctacgtcaaacctaaacaaacacaggccgcagattataattgggtcgtttcattaatggtctccgtggtgacgccttttctgaatccgttcattttcacccttcgaaacgataaggtcatcgaagctctccgcgacggcgttaaaagatgctgtcagctctttagaaattag

SEQ ID NO: 52623 - DNA, 918 bp, Artificial Sequence
  Description of Artificial Sequence: Synthetic coding sequence
atgcagagaagtaaccacacagtgaccgaatttattcttctgggctttaccacagacccaggcatgcagctaggactgttcgtggtgttcctgggcgtatatagtctcaccgtagttggcaactccaccctgattgtcttaatttgtaatgatagttgcttgcacaccccaatgtattttttcaccggtaacctttctttcctcgacctgtggtattcttcagtgtacactcccaagatcctagtgacatgcattagcgaagacaagagcatatcatttgcaggctgtctgtgccagtttttctttagcgcagggttagcatattcagagtgttacctactggctgcagtcgcatatgatcgatacgttgctattagcaaacctctgttatatgctcaggctatgtccattaaattatgcgctttactcgttgcagttagctattgtgggggatttataaatagttcaattatcaccaaaaagacttttagcttcaatttttgtagagagaacataatcgacgactttttttgcgatctcctgccgctggtggagttggcatgtggggaaaaggggggatataaaattatgatgtactttttgctggccagcaatgtgatttgtcccgctgtgttgatccttgcttcatacttatttataattactagtgtcctgcgaataagcagctctaaaggctatctgaaggcattttccacctgctcaagtcacctgactagcgtaaccctctactacgggtccatcctgtacatttatgcactccccaggagctcgtactccttcgacatggacaaaatagtcagcactttttatacggtcgtgttccccatgctgaatttgatgatttacagcctaagaaacaaagacgtgaaggaagcactcaagaaacttttgccctag

SEQ ID NO: 52624 - DNA, 984 bp, Artificial Sequence
  Description of Artificial Sequence: Synthetic coding sequence
atgatctttccaagccacgattcccaggctttcacctcagtcgatatggaggtgggcaattgtaccatactaacagagtttatcttactgggtttcagtgcagatagtcagtggcagcctatcctctttggagtgtttcttatgttgtaccttattaccttaagcggcaacatgacccttgtcattctgatccgcacggactcccacctccataccccaatgtacttctttattggcaatctatctttcttggatttctggtacacctcagtctacacccctaagatactcgcctcttgtgtttctgaagacaaacggatttccctcgcaggctgcggcgctcaactgtttttctcctgtgttgtggcatacacagaatgctatctgctcgctgcaatggcttacgatagacatgccgcaatttgtaatccgctgctgtactccggcaccatgtccactgcgctgtgtaccggactcgtggcaggctcatatattgggggattcctaaacgccatcgcccacacggcaaatacattccgactccacttttgcggtaagaatataatagatcatttcttctgcgatgccccaccactcgtgaaaatgagttgtaccaatacgcgcgtgtatgaaaaagttttgctcggcgtggtgggattcaccgttctcagctccatcttggcaattctcatctcatatgttaacatcctgctggcaattttgaggatccatagcgcctcaggcaggcacaaagccttttcgacatgcgcaagccacttaatcagtgtgatgttattttacggatctctcctctttatgtatagccgaccgtcttcaacctactcgctagagcgcgataaagtcgccgctttgttttatactgtgatcaaccccctgctgaacccactgatctactccctgaggaataaggacattaaagaagcgttccgaaaagccactcagacaattcagccgcagacatag

SEQ ID NO: 52625 - DNA, 945 bp, Artificial Sequence
  Description of Artificial Sequence: Synthetic coding sequence
atggctaaaaataatctgactcgggtcacggaatttattttaatgggattcatggatcatcctaagttggaaatccctctgttccttgtcttcctcagtttctacctggttacattactggggaacgtggggatgataatgctcattcaggtggatgtgaagctctacactcccatgtacttcttcctctcacacttgagtctgctagacgcttgctacacctctgtgatcacgccacagatactggccaccctcgccactggtaaaactgtgatcagttatggccactgcgctgctcagtttttcttgtttaccatctgcgccggtaccgagtgcttcctgttagctgtgatggcatatgataggtatgccgctatccgcaaccccctgctctataccgttgctatgaatcctagactttgttggtccttggtcgtgggagcctacgtgtgcggagtcagcggcgcaattcttagaactacctgcactttcactttatcattctgtaaggacaaccagattaatttttttttttgtgatttgccacccctcttgaagctggcctgtagcgataccgctaacattgaaattgtcatcatattcttcggtaactttgtcatattagcaaatgcctccgtgatactgatatcctaccttttgataattaaaactatcctgaaagtgaagtcctccgggggtcgggcaaaaacattttccacctgcgcgtcccacatcaccgccgtcgctcttttctttggtgccctaattttcatgtacctacagtccggttctggaaagagcctggaggaggataaggtcgtatctgtattctacacagtggttatacccatgctgaacccactcatctacagcctgcgtaacaaagacgtgaaagacgcctttaggaaagtagcgagaagacttcaggtctctttgtccatgtag

SEQ ID NO: 52626 - DNA, 1008 bp, Artificial Sequence
  Description of Artificial Sequence: Synthetic coding sequence
atgctggggtcgaaaccgcgagttcacctttacatccttccatgcgcctcccaacaagtatctactatgggtgatcgcggtacttcaaaccacagtgagatgactgatttcatcctggccggattccgcgtgcggccagaactccatattcttttattcctgctttttctgtttgtctacgcaatgattctgctgggcaacgtgggcatgatgactataattatgacagatcccagactgaacactccaatgtacttcttcctgggcaacctgtctttcatcgatcttttctactcctccgtaatcgaaccgaaagccatgatcaacttttggtctgagaacaagagtatttcgttcgcaggttgtgtggcacagctgtttctgtttgcactgcttatcgtaaccgaaggctttctcttagctgcgatggcctacgacaggtttatagctatctgcaacccattactttattcggttcagatgtctacccgattatgcacccaactggtagcaggatcatatttctgtggatgtatttctagcgtcattcagactagcatgacattcaccttatctttctgtgcctccagggcagtcgatcatttttactgtgactcaagaccgctgcagcgtctgtcttgtagtgacctcttcatccaccggatgatcagcttctcactgagctgcatcattatactacccaccatcatcgtcattatcgtgtcttacatgtatatcgttagtaccgtcctgaagatccatagtactgaaggccacaagaaggccttctctacttgctcttcccacctaggtgtcgtgagcgtgctgtatggggctgtgttcttcatgtatctgaccccagaccggtttcctgagctcagcaaagtggcgtccctctgctacagcctggtgaccccaatgctcaatcctctcatttattcacttcgaaataaagatgttcaggaggctctgaaaaaattcttggagaagaaaaacattattttatag

SEQ ID NO: 52627 - DNA, 933 bp, Artificial Sequence
  Description of Artificial Sequence: Synthetic coding sequence
atggccgagatgaatctcacattggtcacagagttcttgttgatcgcgtttactgaatatccggaatgggctctcccgcttttcttgctgttcctcttcatgtatctaattacagtcctggggaacctggaaatgatcattttgattttgatggatcatcagctgcatgctccgatgtactttttgttaagccacttggcattcatggacgtttgttatagcagcatcaccgtcccacagatgttggcggtgctcttagagcacggtgccgctctgagctacaccaggtgtgcagctcaatttttcctgtttacttttttcgggagtatagattgttacctactggctcttatggcgtacgaccgatacctcgctgtctgtcagccactgctatacgtgaccatattgactcagcaggccaggctatcactggtggccggtgcctacgtggctgggctaatatcggctctcgtgaggaccgtcagcgcatttaccctgtcattctgcggaacgtctgaaatagacttcatattctgtgaccttcctccgctactaaagctgacttgcggtgaatcttatacccaggaggttcttataattatgttcgcaatctttgtgataccggcaagcatggtcgtgatactggtgagctacctgtttatcattgtagctataatgggtattcccgctggctcccaggcaaagaccttttcaacgtgcacatcccacctcaccgcggtgtccctattcttcgggacgttaatattcatgtatctgcggggaaattccgaccaaagctcggagaaaaaccgcgtggtcagcgtgttgtacacagaggtgatacccatgcttaatcccctgatctattccctgaggaacaaggaggtcaaggaagcgttgcgaaaaattctcaatagagccaagctgtcatag

SEQ ID NO: 52628 - DNA, 945 bp, Artificial Sequence
  Description of Artificial Sequence: Synthetic coding sequence
atggctgagcggaactataccgtggttacagagttttttttgaccgctttcactgaacacctccaatggcgggttccactgtttctcatttttctgagtttctatcttgcgaccatgctcggaaatactggaatgattctgctcatccgcggtgaccggcgactgcatactcccatgtactttttcctaagccacctgagcctggtggacatttgctacagctcagctataataccccagatgctggccgtactgtgggaacacggcaccaccatctcccaggctcgctgtgcagcacagtttttcttgttcaccttctttgcgtcaattgattgctacctgctggcgatcatggcctacgaccgatacacagccgtctgtcagcccctactgtatgttacgatcatcactgagaaagctcgctgggggctggtgaccggggcatacgtggccggatttttctccgctttcgtccggactgtgaccgccttcaccctatccttctgcggaaacaatgagatcaattttatcttctgcgacctgcccccactgctcaaactgagctgtggggacagctacacgcaggaagtggtcattattgtattcgcccttttcgtgatgccagcgtgcattctggtaatcctcgtgtcatatctctttatcatcgttgccattttgcagattcacagtgctggcggtcgggctaaaaccttctccacctgcgcttcccacctcaccgcagttgcactcttctttgggacgctgatcttcatgtatctacgggacaataccgggcaaagcagcgagggcgatagagtcgttagtgtgctgtacaccgtcgtgaccccaatgttaaaccccctgatatacagcctgagaaacaaagaagtcaaggaggctacacggaaagccttgagcaaaagcaaacccgcacgcagaccttag

SEQ ID NO: 52629 - DNA, 426 bp, Artificial Sequence
  Description of Artificial Sequence: Synthetic coding sequence
atgagttttagccttaacttcacccttcctgccaacaccacctccagccccgtgactgggggaaaagagacagactgcggcccatcattgggactcgctgctggcatcccgttactggtagcaacagccttgctggtggcattactgtttaccctaatccatcgtcgtcggagctccattgaggctatggaggagagcgacaggccatgcgaaataagtgaaatagacgataacccgaagatctccgaaaaccctaggagatcacccacgcacgagaagaatacgatgggcgctcaggaggcccacatatacgtaaaaacagtggccggttccgaggagccagtccatgaccggtatagacccacaattgaaatggaacggaggcggggtctctggtggctcgtgcccaggttgagcctcgaatag

SEQ ID NO: 52630 - DNA, 393 bp, Artificial Sequence
  Description of Artificial Sequence: Synthetic coding sequence
atgtctttcagtctgaacttcactctccctgccaacaccgactgcgggccttcactcggcttggccgcaggaattcctctgttagtggccactgcattgttagttgcccttctctttactctcattcatcggagaagaagttcaattgaagccatggaggaatccgacaggccatgtgagatctctgagatcgacgacaatccgaagatctccgagaatccgcgtcgctctcccactcacgagaagaataccatgggcgctcaagaagctcacatctatgttaagaccgtggccggttccgaagagccagtgcacgacagatacagaccaaccatcgaaatggagcggagacgcggactctggtggctggtgcctcggctgtctctggagtag

SEQ ID NO: 52631 - DNA, 357 bp, Artificial Sequence
  Description of Artificial Sequence: Synthetic coding sequence
atggactgcggaccatctctgggacttgctgccggtattcctttgctcgtagctactgcattactggtggcgctgctttttacactgatacaccgcagacgatcatccattgaagcgatggaagaatctgataggccctgcgagatctctgagatagacgataatccgaagatcagtgaaaaccccagacgatctcctacgcacgaaaagaatacaatgggcgcacaagaggcccacatctacgttaaaactgtcgccggttcggaggaaccagtgcacgatcgctaccgacccactatcgaaatggagcggcgtcgcggattatggtggcttgtgcctcggcttagcctcgagtag

SEQ ID NO: 52632 - DNA, 396 bp, Artificial Sequence
  Description of Artificial Sequence: Synthetic coding sequence
atgagaatgaccagtagcccggtgactggcggaaaagagacagactgcgggccatctttgggccttgccgctggtattccactgttggtggccactgctttgttggtggctctcctgttcacacttattcacagacggagaagcagcattgaggcaatggaagagagcgataggccttgtgagatcagcgaaattgacgacaaccctaagatctccgaaaaccctcggaggagcccaactcacgagaagaacaccatgggcgcacaggaagctcatatctatgtgaaaacagttgccggaagcgaggagcctgtgcatgaccgttataggcccacgatcgagatggagcgcaggagaggcttgtggtggctggtcccaagactaagtcttgaatag

SEQ ID NO: 52633 - DNA, 396 bp, Artificial Sequence
  Description of Artificial Sequence: Synthetic coding sequence
atgaggatgacatcatcacccgttacgggtggcaaagagacagactgtggaccgagtctcggcttggcagcaggaataccattgctcgtcgccacggccttgttggtcgcgctgctgttcaccttaattcacagacgccgtagctctatagaagccatggaggagtctgatagaccatgcgaaatcagtgaaatcgacgataaccccaagatttctgagaatcctaggcgtagcccaactcacgaaaagaatacaatgggcgctcaagaggcacacatctacgtcaagacagtggccggaagcgaggaaccagtccacgacaggtatcgacccacgatcgagatggagaggagacggggactgtggtggctcgttcctaggctgagcctggaatag

SEQ ID NO: 52634 - DNA, 450 bp, Artificial Sequence
  Description of Artificial Sequence: Synthetic coding sequence
atggagaccctgtaccgcgtgccctttctggtgctggaatgcccaaacttgaagcttaagaagccaccctggctgcatatgccgtcagcaatgacagtgtacgcactggtcgtggtgtcctatttcctcattaccggcggtatcatctacgacgttatcgtggagccacccagcgttggatccatgacagacgagcacggccaccagaggcccgtggccttcctggcctatcgtgtgaatggtcagtatatcatggagggcctagcaagtagctttctctttacgatgggtggactggggtttatcattctggaccgcagtaatgcgcctaacataccaaagctgaaccgattccttctgttgttcataggattcgtttgcgtgctgctcagcttcttcatggcacgggtttttatgcggatgaaattgccagggtatctgatgggatag

SEQ ID NO: 52635 - DNA, 516 bp, Artificial Sequence
  Description of Artificial Sequence: Synthetic coding sequence
atggaaactttatatagagtgccatttctcgtgctcgagtgtcccaacctaaaactgaagaaaccgccttggctgcatatgccgagcgcaatgactgtgtatgcactggtcgtcgtttcatacttcctgattacaggcggtataatttacgacgtcattgttgaaccgccttctgtcggcagtatgactgacgaacatggacatcagagacctgtggcttttctggcctaccgggtaaacggtcagtatataatggagggactggcttcaagtttcctgtttaccatggggggactcggttttattatcctcgatcggagcaatgcccctaatatccctaagcttaatcggtttctgcttctcttcataggctttgtttgcgtactcctctctttctttatggcacgggtcttcatgcgcatgaaactgccgaggtcattagcccttctgcccagattagagtgctctggcgttatatctgcccactataaactatgtctccctggtgcaatctag

SEQ ID NO: 52636 - DNA, 1461 bp, Artificial Sequence
  Description of Artificial Sequence: Synthetic coding sequence
atgtcctttatatgcggattgcagagtgccgcacgcaatcatgtcttttttcgcttcaactcactctccaattggaggaagtgtaatactttagccagcacatcccggggttgccatcaggtccaggttaaccacatcgtgaataagtaccagggcctgggagtgaaccagtgcgaccggtggagttttttgcccggtaactttcatttttattccacgtttaataataaacgcaccggtggacttagctctaccaagagcaaggagatctggcggattaccagtaagtgtactgtttggaacgacgctttttccagacagctgctaattaaagaagtgactgcagtccccagtttatctgttctgcaccccttatcgcctgccagcatccgggctataagaaatttccacacgagcccgaggtttcaggccgcacctgtccccctgctgttaatgatcctcaaaccggtccaaaaactgttcgctattattgttgggagaggaattaggaagtggtggcaggccctaccacccaataagaaagaggtcgtgaaagagaatattcgcaaaaataaatggaagttgttcctgggcttgagctcattcggcctgcttttcgtggtattctatttcacacacctggaggtgagcccgatcactggcaggagtaaactgcttctccttggtaaggagcagtttaggttgctgtctgagttagagtacgaggcctggatggaagaattcaagaatgacatgctaactgagaaggacgcaaggtacctagcggtcaaggaagtattgtgtcacttgatcgaatgtaacaaagacgtcccaggaattagccagattaattgggttatacatgtggtggactcaccaatcatcaacgccttcgtcctacccaatgggcaaatgtttgtgtttaccggctttttgaactcagtcactgatatacaccaactatcatttctcctagggcacgagattgcccatgcagtccttggacatgctgccgagaaggcaggcatggtgcatctgctcgacttcctgggtatgatttttttgacaatgatatgggcaatttgcccaagggattctctagccctcctgtgtcaatggattcagtcaaaacttcaggaatatatgttcaaccgcccatacagccggaaactggaggcagaagcagataaaatcggactcctgctggctgctaaagcttgtgctgacataagagcctccagcgtcttctggcaacaaatggaattcgtggacagtctgcacggccagcctaagatgcctgaatggttaagtacacacccttcgcacgggaatagagtggagtatctcgacagactcatccctcagctggtccgcgaagaaaagttcatagaacagcccgagcaaatcgctgagctgacactcaactcatttatccagaataccgaaatttgtagaagttag

SEQ ID NO: 52637 - DNA, 1575 bp, Artificial Sequence
  Description of Artificial Sequence: Synthetic coding sequence
atgagttttatctgtggcttgcagagcgcggctcgtaaccatgtctttttccggtttaattctctcagcaattggcggaagtgcaacacgctggcgagcacctccaggggctgccaccaagttcaggtgaaccacatagtaaacaaataccagggactcggggtgaaccagtgtgatcgctggtcctttctccctggcaattttcatttctactccacgttcaataataagcggactggcggtctttcaagcaccaagagtaaagaaatttggcgaattaccagtaagtgtaccgtgtggaacgacgcattttccaggcagctgctgattaaggaagtgacggctgtgccttcactgtccgtcctgcatcccctgagtcccgctagtatccgtgcgattcgtaacttccatacatccccacgcttccaggctgcaccggtgccactcctgctgatgattctgaagccagtacagaaactgttcgcaattatcgtcggcaggggcatccgaaagtggtggcaggccttgccacccaacaagaaagaggttgttaaggaaaacatccggaagaataagtggaagctatttctgggtctctccagcttcggactcctttttgtcgtgttctatttcacccatctcgaggtcagccccatcacagggagatccaagctgctcctgttgggcaaggaacaatttcggctgttaagtgaactggagtacgaggcctggatggaagaatttaagaatgacatgctcactgaaaaggatgcacggtatctcgccgttaaggaagtgttatgtcacctcatcgagtgtaataaggatgtgcccggaataagccagataaactgggtcattcatgtggtcgacagcccaataattaatgcatttgtccttcctaacggacaaatgtttgtcttcacgggttttctgaatagtgtgacagacatccatcagttatcctttctgctagggcacgagatcgctcacgctgtccttgggcatgctgccgagaaggcaggtatggtccatctgctggacttcctaggcatgatattcctgacgatgatttgggctatttgtcctcgcgacagtctggcactactttgccagtggattcagagcaaactgcaggagtatatgtttaacaggccctatagcagaaaactcgaggccgaggcagacaagattggattactgctagccgcaaaggcctgtgccgatatacgcgcaagttctgttttctggcagcagatggagttcgttgatagtttgcacggtcagcctaagatgcccgagtggttgagcacacacccttcccatggaaatcgggttgaatatctggaccggctcatcccccaagctcttaagattagagagatgtgtaactgtccccctcttagcaaccccgatccacgattattgttcaagctctcgactaaacacttcttggaagagtctgagaaggaagatcttaatattaccaagaagcagaagatggatacactgcccatccagaagcaggagcagattccgcttacatacattgtggagaagcggactgggtcctag

SEQ ID NO: 52638 - DNA, 768 bp, Artificial Sequence
  Description of Artificial Sequence: Synthetic coding sequence
atgtccttcatctgtgggctgcagagtgctgcacgtaaccatgtgttctttcgcttcaatagcttgtccaattggagaaagtgtaacactctcgcctcaacgtcaaggggatgccatcaggttcaagtaaaccatatcgttaataagtaccaggggttaggtgtcaaccagtgcgatcgctggagctttctgccaggcaactttcatttttattcaacttttaacaataaacggaccggcggtctttctagcacaaaatccaaggagatctggagaatcactagcaagtgtacggtttggaatgatgcattcagccgacagctcctgatcaaggaggtgaccgcggtgcccagcctctctgttttacatcctttgtcacccgcttccatccgtgcaatcaggaatttccacacttcccccaggttccaagccgctccagtcccgttgctcctgatgattctgaaaccggtgcagaagctgttcgctattatcgtaggaagaggcatcagaaagtggtggcaagctctgccaccaaacaaaaaggaggtcgtgaaggaaaatatacgaaagaacaagtggaaactatttctcggattgagctctttcgggctcctctttgtggttttttactttacccacctcgaggtctctccaatcacaggccgatccaaactgctgcttcttgggaaagagcagttccgattgctcagcgaactcgaatatgaagcctggatggaagagtttaaaaacgatatgctgacagaatag

SEQ ID NO: 52639 - DNA, 987 bp, Artificial Sequence
  Description of Artificial Sequence: Synthetic coding sequence
taactgttcgccattattgtcgggaggggcattaggaagtggtggcaggcactgccacctaataaaaaggaagtagtgaaggagaacatccgtaagaacaaatggaaactgttcctgggattaagcagcttcggcctgcttttcgtagtgttctacttcactcacctggaagtgagccctatcaccggcaggagcaaactgcttctcctgggaaaagagcagttcaggttactgtccgagttggagtacgaggcatggatggaggaattcaaaaatgacatgctgaccgagaaagatgcccgttatctcgctgtcaaggaagtgttgtgtcacctcatcgagtgtaataaagacgtgcccggaatctctcagattaattgggtaatacacgtggtcgatagcccgattataaacgcgtttgtgctccctaacggacaaatgttcgtgttcactggattccttaacagcgtcaccgatattcatcaactgagctttctgctgggccacgagatcgcacacgccgtactaggacatgccgctgagaaggctggcatggtacacctcctggatttcctggggatgatctttctgacgatgatctgggccatttgtcctagagactctctggcactcctgtgtcagtggatccaatctaaactccaagagtacatgttcaaccggccttactcaagaaaactagaagccgaggccgataagatcggcctcctgcttgctgcaaaagcctgtgcagatattcgtgcaagctccgtgttttggcagcagatggaattcgtggacagcctccacggccagccaaaaatgccggagtggctaagcacacaccctagccacggcaaccgggtggaatatctcgacagactgatacctcagttagtcagggaagagaagttcattgagcagccagaacaaatcgcagaattgactttaaattccttcatccagaacactgagatctgtcgtagctag

SEQ ID NO: 52640 - DNA, 762 bp, Artificial Sequence
  Description of Artificial Sequence: Synthetic coding sequence
atgagttttatctgtgggctgcaaagtgccgctcgcaaccatgtgttctttcggttcaacagcctgagcaactggcggaaatgcaatactcttgcaagcactagccgcggatgccatcaagtccaagtgaatcatatcgtaaacaaataccaagggttgggagtgaaccagtgcgacaggtggtcatttttgcctgggaatttccatttttactccactttcaataataagcgcacaggcggattatcgagcactaaatcgaaggagatttggcggataacgtcgaagtgtaccgtgtggaatgacgccttcagtaggcagttactcattaaggaagtgaccgcggtgccgagcctaagcgtgctgcaccctcttagccccgctagtatccgagcaattagaaactttcacactagtccaaggttccaagctgcgcctgttccgttgctgctcatgatcctcaagccagtgcagaaacttttcgcaattatagtggggagaggaattaggaagtggtggcaggccctgccacctaacaaaaaggaagtggtgaaggagaatatcagaaagaataagtggaagttatttctgggtctctcctcttttggcctgctatttgtagtgttttactttacccacctcgaagtgtctcctattacaggacgaagtaagctcctgctactgggcaaggaacagttccgtctcctctcagagcttgagtatgaagcctggatggaagagttcaaaaatgacatgctctag

SEQ ID NO: 52641 - DNA, 555 bp, Artificial Sequence
  Description of Artificial Sequence: Synthetic coding sequence
atgtcatttatctgtggccttcaatcagccgctcgcaaccacgtgttcttcagatttaacagcctgagtaattggcgcaaatgtaataccctagcgtccacatcaagaggatgccaccaggtccaggtgaatcacatagtgaacaaatatcaggggctgggagttaaccagtgcgataggtggtccttccttccgggaaatttccacttctattccacttttaataacaagaggaccggaggattgtcttccacaaaaagtaaggagatttggagaatcaccagcaagtgcactgtatggaatgacgcttttagccgccagctactcatcaaggaagttaccgctgtgccaagtctgagtgttctgcacccattatctccagcgagtattcgggctatccgcaatttccacacttctccgcgttttcaggcagctcccgtccccctgttgcttatgatcctgaagcctgtgcagaaattgtttgcgatcatcgttggtaggggtattcggaagtggtggcaggcactgcccccaaataaaaaagaagttgtctag

SEQ ID NO: 52642 - DNA, 981 bp, Artificial Sequence
  Description of Artificial Sequence: Synthetic coding sequence
atgtcatttatttgcgggttgcaaagtgctgctcgaaaccacgtcttttttcgttttaattcattatcgaactggagaaaatgcaacaccctggcctcaacatctcggggttgccatcaggtccaagtaaaccacatagtgaataagtatcagggactgggcgtgaatcagtgcgatcgctggagttttttgcctggaaattttcacttctacagcacctttaataataagaggacaggaggacttagttcaactaagagtaaggagatttggcgtatcaccagcaaatgtactgtgtggaatgacgctttcagccgccagttactgattaaggaggtcaccgctgtccctagtcttagcgtgctgcatcctctgtccccagcgagcattcgggcaattcggaattttcataccagcccgaggttccaagcagcgcctgtccccctgctgctgatgatccttaaaccggtgcaaaagctgttcgccatcattgtcggacgcggaattagaaagtggtggcaagcactgccccctaacaagaaggaagtggtgaaggagaatattaggaaaaacaagtggaaactgttcctcggtctctcttcattcggcctgttattcgtcgtattctattttacccacttggaggtctccccaattaccgggaggagcaagctgctgctcttggggaaggagcagtttagactgctgtccgaactggagtatgaagcatggatggaagaatttaagaacgacatgctgacggagaaggacgcccgttatttagcggtgaaggaggtgttgtgccatcttatcgaatgcaataaagacgtgccgggaatctcacagatcaactgggtgattcatgtggtggactcccctattattaatgcctttgtccttcccaacgggcagatgtttgtgtttacgggattcctaaattccgttaccgatatccatcagctctctttcttgttgggatag

SEQ ID NO: 52643 - DNA, 1086 bp, Artificial Sequence
  Description of Artificial Sequence: Synthetic coding sequence
atgtcccccgagtgcgccagagctgccggtgatgcacccctgcggtctctcgaacaggcgaaccgtacgcgttttcccttcttttctgatgtgaagggggaccaccgcctcgtgctggctgccgtcgaaaccactgtcctcgtgctcatattcgccgtatccctcctgggcaatgtgtgcgccctcgtactagttgcccgtaggcgcagaaggggggcaacagcctgtctcgtactcaacctcttctgtgctgatctgttgttcatctccgctattcccctggtgctcgcagtgcggtggacggaggcctggttgttagggcctgtcgcttgtcatctgctgttttatgtaatgactttgagcggctccgtgaccattctgaccctggccgcagtctcactagaaaggatggtttgcatcgtgcacttgcagcgaggtgtgcgcggaccgggtcgaagggctcgcgcagtgctcctggccttaatctggggatattccgccgttgccgctttgccactttgtgtcttttttagagtcgtgccacagcgactccctggggctgaccaagaaatctccatttgcactcttatttggccaacaatccctggcgagatatcctgggatgtgagctttgtgactctgaatttcctggtgccaggtttggtcatcgtaatttcttactcaaagatcttgcagattacaaaggcctctcggaaacgcctcaccgtgtccctggcttactcggaatctcatcaaataagagtctcacagcaggatttcaggctctttagaactctctttctgctgatggtctcctttttcatcatgtggtctccaatcatcataaccattttgctgatactgattcagaatttcaagcaggatctcgtgatttggccgagcctgttcttctgggtcgtcgcgttcaccttcgccaacagcgccttaaatcctatcctgtacaatatgacgctgtgccgtaacgaatggaaaaaaattttttgctgtttttggtttcctgagaagggcgcaatactgactgacacttcagtgaaacggaatgatctcagtattatctcagggtag

SEQ ID NO: 52644 - DNA, 1134 bp, Artificial Sequence
  Description of Artificial Sequence: Synthetic coding sequence
atgtccccagaatgcgccagggccgcaggtgatgccccactgcggagtctagagcaagccaacaggacccgctttccattctttagcgacgttaaaggcgatcatcggttggtgctagcggctgtggaaactactgtactcgtgttaatttttgcagtgagcctgctcggcaacgtatgtgccctggttctagtggcaaggcgtcgcaggaggggtgctacagcatgtttagttcttaatctgttttgcgcggacttacttttcatcagcgcaatcccgttagtgctggccgtgcgatggactgaagcatggctgctgggccctgtggcatgccatctcttattctatgtgatgacgctatccggatcggtgactattttgactctggcagccgtctctttggaacgcatggtctgtatcgtgcacctccaacgaggagttagaggccctgggcgtagagccagagcagttctgcttgccctgatttggggttacagtgctgtggccgcactgccattatgtgtgttctttcgtgtggtgccccagcggctgcccggagcagaccaggagattagcatctgcaccttaatttggccaacgatcccgggtgagataagttgggacgtctcgttcgtgactctaaattttctggtgcctggcctcgtgatagttataagctattcaaagatactccagacctccgagcacttgctggatgctagagccgtcgtgacccatagcgaaattactaaggccagcagaaagcggctcactgtgtctctagcttattctgagagccatcaaattcgtgtgtcacaacaggacttccgccttttccgcaccttgtttctcctaatggttagcttcttcataatgtggagccccattataattactatacttcttattcttatccaaaattttaagcaggacttagttatctggccatcgctgttcttttgggtggtggcctttacttttgccaactctgcgctcaacccaatcttatataatatgacgctgtgccgcaacgagtggaaaaaaattttctgttgtttttggtttcccgagaagggcgcaattctcacagacactagcgttaagagaaatgatctgtccattattagcgggtag

SEQ ID NO: 52645 - DNA, 1113 bp, Artificial Sequence
  Description of Artificial Sequence: Synthetic coding sequence
atggaaccattattccctgccccattttgggaggttatttatggatcacatctgcaaggcaatttgtctctcctctccccaaatcattcactgcttcctccacatttgctcctcaacgcatcccacggggcttttcttcctttgggcctgaaggtgactatagtgggattgtacctcgcggtgtgtgtgggaggactcctgggaaactgccttgtaatgtacgttatactgaggcacaccaagatgaaaaccgccaccaatatttacatctttaatctcgctctcgctgataccttagtcttattaaccctgccattccaaggaacagatatcctgttggggttttggccttttggaaatgccctttgcaagacagtgatagcaatcgactactacaatatgtttacatctacctttacactgactgctatgtccgtagaccggtacgtagctatctgtcaccctatcagagcacttgacgtgagaacctcttccaaggcccaggcggtcaatgtagcaatctgggctctcgcgagcgtggtcggagtgcccgtggctattatgggtagcgcccaggtggaagatgaggaaattgagtgtctcgtcgagattccgacccctcaggactattgggggcctgtcttcgctatttgcatcttcctctttagcttcatagtgcctgtgctcgtgatcagcgtctgctacagcctgatgattcggagattaagaggggttcgtcttctgtctggcagtcgtgaaaaagaccggaacctccggaggatcactaggcttgtgctggtggtcgtggcagtgttcgttgggtgctggacccccgtgcaggtgtttgtgctcgctcagggcctgggcgtccagccctctagcgaaacagcggtcgccatcctgaggttctgtaccgcccttgggtacgtgaacagctgtttgaacccaatcctgtacgcgtttctggacgagaattttaaggcctgttttcgcaaattttgctgcgcttctgcattgcgccgagatgtccaggtgtctgacagagtgcggagtatcgctaaggacgtggccttggcatgcaagacctccgagactgtcccaaggcctgcttag

SEQ ID NO: 52646 - DNA, 1113 bp, Artificial Sequence
  Description of Artificial Sequence: Synthetic coding sequence
atggagccgttattccccgcaccattctgggaggtgatctatggatcccacctgcagggaaacctttccctgctttctccaaaccatagccttcttcctccgcaccttctgctgaatgcaagccacggcgctttcctgccacttggacttaaagtaactattgttggtctctacttggccgtttgtgttgggggactcctgggtaattgcctggtgatgtacgttattctgcggcacaccaaaatgaaaaccgctaccaacatctatatatttaacctcgcactagccgacaccctcgtcctcctgacactgccgtttcaggggacagacattctgctgggcttttggccgttcgggaacgccttatgtaaaactgtgattgctatcgattactacaacatgttcacctctaccttcaccttgacagcaatgagcgtcgatcggtacgttgcgatttgccatcccattcgggctttggatgtgcgaacctcctccaaagcccaggccgtaaatgtcgctatctgggccctagccagcgtggtgggagttccagtcgccattatgggttcagcccaagtggaagacgaggagatcgagtgtctggtggagattcccactcctcaggattattgggggcctgtttttgctatttgtattttcttattcagctttatcgtgcctgtcctcgtcattagcgtttgttactcccttatgatcaggagacttcgcggagttagacttttgtccggcagccgtgaaaaggataggaacttaaggaggatcacacgcttggtcttggtcgtcgtcgccgtgttcgtgggatgctggaccccagtccaggttttcgtgcttgctcaagggctcggggttcagcctagttccgagacggctgttgccattctgaggttctgcacagccctggggtatgtaaactcctgtttgaatcccatcttatatgcctttctggacgaaaatttcaaggcttgcttcaggaagttctgctgcgcctccgcgctgcggagagacgtccaggtgagcgaccgagtaagatcgattgcaaaggatgtggctcttgcctgcaagacttctgagacagtacctcgacccgcttag

SEQ ID NO: 52647 - DNA, 1113 bp, Artificial Sequence
  Description of Artificial Sequence: Synthetic coding sequence
atggaaccacttttccctgctccattttgggaagtgatctacggtagtcatctgcagggaaatctgagtttgttgtccccgaatcactctctgctcccgcctcatttgctgctgaatgctagtcatggagcctttcttccgcttggcttaaaggtgaccattgttggactgtaccttgctgtgtgcgtcggcggtctgctcggcaactgtctggtcatgtacgtgatcctgcggcacaccaagatgaaaactgccaccaatatttacatattcaatctggctctggctgacaccttggtgttattgacactaccgtttcagggtacggacattcttttaggtttttggccttttggtaacgccctctgcaaaacggttatagctatcgactactataatatgttcaccagtacattcactctgacagcaatgagcgtggataggtacgttgccatctgtcatcccatccgggcattagacgtaagaacaagtagcaaagcacaggctgttaacgttgcaatctgggccctggccagtgtcgtcggggtgcccgtcgcgatcatgggaagtgcccaagtggaggacgaagagatcgagtgtttggttgagatcccgacaccacaggactactggggtcccgtctttgccatttgcattttcctgtttagctttattgttccagtactggtcatatctgtttgttactctttaatgatcaggcgactcagaggagtgagactgctttccggttccagagaaaaggacagaaatctccggaggattaccaggttggtgttggtggtggttgctgtgtttgtgggatgctggacccctgtgcaggttttcgttctggcccaggggttaggcgttcagccttcctcagaaacggcggtggccatcctaaggttctgtacagctctcgggtacgtgaacagttgtctcaacccaatcctgtatgccttcctagacgagaactttaaagcctgtttcaggaaattttgttgtgcttcagccctgcggagggatgtgcaggtgtctgatcgggtccggagcatagccaaggacgttgcattggcctgcaaaacctccgagacagttcccaggccagcttag

SEQ ID NO: 52648 - DNA, 495 bp, Artificial Sequence
  Description of Artificial Sequence: Synthetic coding sequence
atcacgggattgtggagcttggctatcatatcctgggaaagatggctggtggtgtgcaagccattcgggaacgtgcgattcgacgccaaactcgcaattgttggcatagccttcagctggatctggtcagccgtgtggacagctccacctatttttggctggagcaggtactggcctcatggcctcaaaacctcttgcgggccagacgtgttcagcggaagctcctaccccggagtgcagagctatatgatagtcctcatggtaacgtgttgcatcatcccgcttgccatcatcatgttgtgctatctgcaggtgtggttggccattcgggctgtggccaaacagcagaaggaaagcgaaagtacccaaaaagcagagaaagagtttcggaactgcatactgcagctgtttggaaagaaggtggacgacggatcagaactaagtagtgcgtccaaaacagaggtgagtagtgtctcttcagtctcacccgcatag

SEQ ID NO: 52649 - DNA, 1095 bp, Artificial Sequence
  Description of Artificial Sequence: Synthetic coding sequence
atggcccaacaatggtctctgcagaggctcgccggtcggcaccctcaggactcatatgaagattctacccagagtagtattttcacctacacaaattccaactccactagaggtcccttcgagggtccaaattatcacattgctccaagatgggtgtatcatctcacttctgtttggatgatattcgtggtgatagcttctgtgtttactaatggtctggtgttggcagccaccatgaaattcaagaaattaaggcaccccttaaactggatcctcgtgaatttggcggtggcagacctggctgagaccgtgatcgcgagtactatatccgtagtgaaccaagtatatgggtatttcgtgctgggacaccctatgtgtgtactagagggatataccgtttcactgtgcggcattaccggactgtggagtctggccatcatatcctgggagagatggatggtggtgtgtaagccgttcgggaatgtgaggtttgacgcaaaactcgctattgtcgggattgcattctcatggatatgggctgctgtgtggaccgcccctccgatttttggctggtctaggtattggccacacgggctgaagactagctgtggtcccgatgtttttagtggctctagctatccaggcgtccagtcgtacatgatcgtcctaatggtgacatgttgcatcacccccttgagtattattgtgctgtgctatttgcaggtctggttagcaatcagggccgtagcgaaacagcaaaaagagtccgaatcaacacaaaaagccgagaaagaggtgacacgcatggtggttgtcatggtgctggctttctgcttttgttggggcccttacgcattctttgcctgcttcgccgctgccaatcctggttacccatttcaccctctgatggcagcattacctgcattctttgccaaatctgcgaccatatacaatcctgtcatctacgtattcatgaacagacagttcagaaactgcatactgcagctctttggaaaaaaggtggacgacgggtccgaactgtcttcagcctctaaaacggaggtttctagcgttagctcggtgtccccagcctag

SEQ ID NO: 52650 - DNA, 1437 bp, Artificial Sequence
  Description of Artificial Sequence: Synthetic coding sequence
atgaaccccccttccgggccaagggtgcctccctcacccactcaagaacccagctgtatggctacaccagctcccccttcctggtgggactctagtcaatcttccatctcatctctaggaagactgccaagcataagcccaactgcgcctgggacttgggcagccgcttgggttcctctgcccacagtggatgtgccggaccatgctcactacaccttgggaaccgtgattctcttggtgggtctgacaggtatgctgggcaatctgaccgtaatatataccttctgtagatccagatctttaaggaccccagcaaatatgtttataatcaatcttgccgtgtcggacttccttatgagctttacccaggcccctgttttctttacttcctctctgtacaaacaatggcttttcggcgaaaccggatgcgaattctacgctttctgtggagccttgttcggaatttctagtatgatcacgctaactgccattgctttggacaggtacttggtgattaccagacctctggccactttcggcgtggcttctaagagaagagccgctttcgtgcttctgggggtgtggctctatgccctggcctggtctttacctccctttttcggatggagcgcctacgtgcccgagggacttctcacaagctgctcttgggattacatgagcttcacgcctgctgtccgagcctacactatgctgttgtgctgtttcgtgtttttcttgcctctgctgatcattatctactgctacattttcattttcagagctatccgagaaacggggcgtgctctgcagaccttcggggcatgtaaggggaatggtgagtcactctggcagcggcaacgcctgcagtccgagtgcaagatggccaagatcatgcttctcgtgattctcctttttgtgctgagctgggctccttatagtgccgtcgcccttgttgcatttgccggatacgctcacgtattgactccttatatgagtagtgtcccagccgtgattgcaaaggcgtctgcaatccataacccaataatctatgccattactcatcccaagtatcgtgtcgccatcgcacagcacctaccttgcctcggcgtgctgctgggcgtttcccgcaggcattctaggccctacccctcataccgttctacacatagatcaaccctcacttcccacaccagcaaccttagttggatctcaatcaggagacggcaggaaagcctcgggagcgaaagcgaagtcggttggactcatatggaggcggcagccgtctggggtgccgctcagcaggctaatggccgttccctctacggacaaggcttggaggacttggaagccaaggcgcctccaagaccccaggggcacgaggcagaaaccccaggcaagacgaaggggctgatacctagtcaggacccaaggatgtag

SEQ ID NO: 52651 - DNA, 1470 bp, Artificial Sequence
  Description of Artificial Sequence: Synthetic coding sequence
atgaacccacctagcggacccagagtgcccccaagtccaacgcaggagcccagctgtatggctactccagccccaccctcctggtgggacagtagtcaatcaagcatttcatcgctcgggcgactgccatccattagtcctactgcacccggtacctgggccgctgcatgggtgcccctgcctaccgtcgatgtgcccgaccacgcccattatacgctgggtacagtgatcctgctagtgggactcaccgggatgctggggaaccttaccgtgatctacacattctgtcgcgcagtcctccgcggtgtaacagtcatgatgcagtcccgttcgttacggaccccggcaaacatgttcattatcaatctcgctgtgtcagacttcttgatgtctttcacccaggcccctgtgttttttacatccagtctgtacaaacagtggttgtttggtgaaaccggctgtgagttttacgcattctgcggagccctcttcggcatttcatctatgataacactgacagcaatcgcactggaccgctacctcgtgatcactcgtccattagccacctttggcgtggcgagtaagcgcagggctgcttttgttctcttaggagtgtggttgtacgcccttgcttggtccctcccaccctttttcggctggagcgcatatgtgcccgaaggcctgctcacaagctgctcatgggactacatgagcttcacgcctgcggtgcgggcttataccatgcttctgtgctgctttgtcttcttcctccccctgctaattatcatctactgctacatcttcatttttcgagcaatacgagagaccggcagggccctgcagacttttggtgcgtgtaaaggtaatggagagagtctgtggcagcgccagcgcctgcagtcagaatgtaagatggccaagatcatgctgctcgtaatccttctctttgtactatcatgggctccatacagtgccgtagcacttgtagcattcgctggctatgctcatgtgctgacaccctacatgtcctctgtgcccgcagtaattgctaaggcttctgctatccataaccccattatctatgcaatcacccacccgaagtaccgggtcgccatcgcccaacatcttccttgtctgggcgtgctcttgggtgtatccaggcgtcactccagaccatatcctagttatcgatcaacacacagatccacgctcacctctcatacttcaaacctgagctggatctcaattaggcggaggcaggagtcacttggcagtgaatctgaggtaggctggacccatatggaggcagccgcagtttggggggctgcgcaacaggctaacggacggtccctgtacgggcaggggctggaagacctggaggccaaagcccctcctcgcccacagggccatgaggcagaaacaccgggaaagaccaagggtcttataccaagccaggaccctcgcatgtag

SEQ ID NO: 52652 - DNA, 1488 bp, Artificial Sequence
  Description of Artificial Sequence: Synthetic coding sequence
atgaatcccccttctggacctagggtcccaccaagccccacacaagaacccagttgtatggcaacgcctgcgcctccttcttggtgggacagttcgcagtccagcatcagctcgctgggaagactgccaagtatttccccaacagcacccggaacttgggccgctgcatgggttcccctcccaactgtggatgttcctgaccacgctcattacactctgggcacagtgattctgctcgttggcctgacaggtatgttgggtaacctgactgtaatttacactttctgtcgtgcagtcctgcgaggagtcaccgtgatgatgcagagccgttccctaaggactccggcaaacatgttcattatcaacctagctgtgtccgatttccttatgagctttactcaggccccagtgttctttaccagcagtctttacaagcagtggctctttggagaaacagggtgcgagttctatgcgttttgtggtgccttgtttggcataagctctatgattactttaacggctatcgccctcgaccgctacctggtcataactcgccctctggctaccttcggagtcgccagcaaacggcgagctgcttttgtactgctcggagtctggttgtacgcacttgcgtggtccttaccaccattttttggttggtccgcttacgtcccagaaggactgttaacatcttgtagttgggactatatgtctttcaccccagctgtgagggcttatactatgcttttgtgctgcttcgttttctttctgcccctattgatcatcatttactgctatatttttatcttccgcgcaatacgtgagacaggcagggccttacaaaccttcggggcatgcaaaggcaatggagaaagtctgtggcagcgccagcgtctgcagagcgaatgtaagatggccaagatcatgcttctcgtgattctgctgttcgtcctatcgtgggcaccatatagcgccgtggccctggtggcatttgctgggtacgcccatgttttgactccttatatgagcagcgtgcctgccgtaatcgccaaagcgtctgcgatacacaaccctattatttatgccatcactcaccctaaatatagagtagcaatagcacagcatctgccttgcctgggtgttctcttgggcgtgagccgtcgacacagtcgaccttacccaagctatcgctctactcaccgatccaccttgacatcccacacatctaatctcagctggatatcaatcaggaggcgacaggagagcctgggatcagaatccgaagtcgggtggacgcatatggaggccgcagctgtgtggggtgcagcccagcaagcaaatggccgatccctctatggacaaggtctggaggacttagaagctaaagcccctcccagaccccaggggcatgaggctgaaactcctgggaaacggcgtgcaagtagtgggcgtagccaacggcctgagcgccaacgagccgcaccctag

SEQ ID NO: 52653 - DNA, 1065 bp, Artificial Sequence
  Description of Artificial Sequence: Synthetic coding sequence
atggcgctcaaccacacagccctaccacaagatgagcggcttccgcattacctacgcgatggcgacccgtttgccagcaaactcagttgggaggcagacttagtcgccggtttttacttgaccatcataggtatcctgtcaacttttggcaacggctatgtgctgtacatgtcctccaggcgcaagaaaaagctccggccagctgaaataatgactattaatctggcagtgtgtgacctgggcattagcgttgtcgggaaaccttttaccatcataagctgtttctgccacaggtgggtgtttggatggattggctgtaggtggtatggctgggcaggtttcttctttggatgtgggtctctgatcacaatgactgctgtctcacttgatagatacctgaagatctgttatctgtcttatggtgtgtggctgaaaaggaagcatgcctatatttgtctcgcagccatatgggcatacgctagtttctggactaccatgccgctggtaggactcggtgactatgtgccagagccctttggaacaagctgtacgcttgactggtggctagcacaagcttcagttggaggacaggtattcatcctgaacattctgttcttttgtttattactcccgactgccgtaatcgtatttagttacgtcaagattattgccaaagtgaaatccagctcaaaggaggtcgcacactttgacagtcgtatccactctagccacgtactggaaatgaaactgaccaaggtcgcgatgctcatatgtgcaggcttcctgattgcatggattccttacgcagtggttagcgtttggtccgccttcggcaggccagatagtatcccaattcagctaagtgtcgtgcccacactgctggccaagagtgctgccatgtataatcctataatctatcaggtgatcgattataagtttgcctgctgccagacaggaggactcaaagcaaccaagaagaagagcctggagggcttccggttgcacaccgtgaccactgtgagaaaatcctccgcagttttggagatccacgaagagtgggaatag

SEQ ID NO: 52654 - DNA, 1140 bp, Artificial Sequence
  Description of Artificial Sequence: Synthetic coding sequence
atgagcgtacgaaccctgccactgttgtttctcaatctcggcggagagatgctttacatcctcgaccagagactgagggctcagaatatccccggagataaagccaggaaagtactgaatgatattatctcgactatgtttaacagaaaattcatggaggagttgttcaagccacaagaactgtacagtaaaaaggctctgagaaccgtgtatgagagactggctcacgcctcaattatgaagttgaatcaggctagtatggacaaactgtatgacttaatgacaatggctttcaagtatcaggtgctactctgccctcggcctaaggatgtgttactcgtgacattcaatcaccttgataccattaaaggattcattagggattcacctacgatattgcagcaggtggatgagacgctacggcagctcaccgaaatctacggtggactgtctgccggagagtttcagcttattagacagactttactgatctttttccaggacctgcatattagagtgagcatgtttctgaaagataaagtccagaataataacgggcgatttgtgctgcctgtttctggtcctgtgccatggggaacagaagtgcctggactgatccgaatgttcaataacaagggcgaagaagtgaaaagaatcgagttcaagcacggcggtaactacgtgcccgcacccaaagaggggtccttcgagctgtacggggacagagtgttgaaattgggcaccaacatgtactctgtgaaccagccagtggaaacacacgtttcaggatccagtaagaatttagcaagctggacccaggagagtattgcgcctaacccattagccaaggaagaactcaactttctggcacgtcttatggggggaatggaaattaaaaagccatctggaccagagcccggattccgactaaacctgtttacgactgatgaggaagaggaacaagccgcactcactcgtccggaggaactgtcttacgaggtcatcaatattcaagcgacccaagaccagcagagaagcgaagaattggcgagaataatgggggagttcgaaatcacagagcagcccagactatcaacttctaagggggatgatctgctggcaatgatggatgagttgtag

SEQ ID NO: 52655 - DNA, 1020 bp, Artificial Sequence
  Description of Artificial Sequence: Synthetic coding sequence
atgagcgtgcgtacactgcctctcctatttctgaatttagggggtgaaatgctgtacattctggaccagcgcctgcgcgctcagaacatcccaggagataaggcacgaaaagatgagtggaccgaagttgaccgaaagcgagtgcttaacgacattatctccactatgttcaaccgaaaatttatggaagaactgtttaagccgcaagagttgtatagtaagaaagcactaagaaccgtttatgagcggcttgcgcacgcttcgattatgaaactgaaccaggccagcatggacaagctatacgatctcatgactatggctttcaagtaccaggtcctgctatgcccgagaccaaaggacgtgctgctggtcaccttcaaccacctagatacgataaagggttttatcagggattccccaactatcttgcagcaagtcgacgaaaccttaagacaactcaccgaaatctacggcggactttcagctggagagtttcagttaatccgacagaccctgctgatattttttcaggaccttcacattcgggttagtatgtttctaaaagacaaagtgcagaacaataatggtaggttcgtgctgcccgtttccggccctgtgccgtggggaactgaggtcccgggtctgatcagaatgttcaacaacaagggtgaggaggtgaagcgaatcgagtttaaacatggaggtaactatgtgcccgcaccaaaagaggggtcttttgagctatacggagacagggtgctgaaacttggcactaacatgtacagtgttaaccagccagttgagacccatgttagcggcagtagtaaaaatctggcgtcctggacacaggagtccatcgctcccaatcccttggccaaggaagaactgaacttcctagctcgcctgatgggtggcatggaaattaagaaaccatccggaccagaaccaggattccggctgaatctgtttaccaccgatgaggaaggcgacgaccttcttgccatgatggatgagctgtag

SEQ ID NO: 52656 - DNA, 672 bp, Artificial Sequence
  Description of Artificial Sequence: Synthetic coding sequence
atgtctgtcagaaccctgcctctgctattcttaaatctcggcggagaaatgttatacattttagatcagcggctgcgagctcagaacatcccaggagacaaggccagaaaagtgttgaacgacatcatttccactatgttcaacaggaagttcatggaagaactgtttaaaccacaagagctgtatagcaaaaaggcactacgcacggtctacgaaaggttagcacatgcctcgatcatgaaactcaaccaagcctcgatggataagctgtacgatctcatgaccatggctttcaagtaccaggtcctgctgtgccccaggccgaaagatgtgttactggtgacatttaaccatctggacaccatcaagggctttatccgcgacagtcctactatcctccaacaggtggatgaaactctccggcagttgactgaaatatacggaggcctgagcgccggtgagttccagctgattcgacagactttgctgattttcttccaggatcttcatattcgtagagaatgtttctggaagcacatgcaagagactgtgcattctgcccagtgctgcctccccggagttgggaattacatggaagaccggagacgaaggcttacttttcactacgtctatccgtttgaaaattttgagttctgcacctgggcaaaatag

SEQ ID NO: 52657 - DNA, 1170 bp, Artificial Sequence
  Description of Artificial Sequence: Synthetic coding sequence
atgtcagtgcggacattgcctctactgttcttgaatctcggcggagagatgttatatattttggaccagaggctcagagctcagaacataccgggagacaaggctaggaaagatgaatggactgaagtggatcggaagcgggtcctgaatgatatcatatctaccatgttcaataggaaattcatggaggagctcttcaaaccacaagaactctactcaaagaaggccctgcgaacagtttacgagcggctcgcccatgcgtctattatgaagctaaatcaggcgagcatggacaaactgtacgacctcatgaccatggcatttaagtatcaggtgttgctctgccctcggccaaaagacgtgttgctcgtcacttttaaccatctcgacaccattaaaggctttattcgggactctcccaccatcctgcagcaggttgatgaaacactgcgtcagctgaccgagatctatggaggcttatctgcgggagagtttcagctcatacgccagactctactgattttttttcaggacttgcatatcagggtttccatgttcctgaaggacaaggtgcagaataataacgggcgatttgtgctccccgtatccggccctgtaccgtggggaacagaagtacctggactgattcgtatgtttaataacaaaggggaggaggtcaagcggattgaattcaaacacggaggcaactacgtgcccgcacccaaggagggctctttcgagctgtacggcgacagagtccttaagttaggcacaaacatgtattcggtgaaccaacctgtggagacacacgtgtctggaagctccaagaacttagcctcatggacccaggagtcgatagcgccaaatcctctcgcgaaggaggagttaaattttctcgcgcgactgatgggtggtatggaaatcaagaaaccatctgggccagagccaggttttcgcttgaatttattcacaacagatgaagaggaggaacaggcagcactgaccagacccgaagagctgtcgtacgaggtgatcaacattcaggccactcaggaccaacagcggagcgaggaattggccaggatcatgggcgaattcgagatcaccgagcagcccaggctttccacttccaagggggacgatctcctggcaatgatggacgaactctag

SEQ ID NO: 52658 - DNA, 1023 bp, Artificial Sequence
  Description of Artificial Sequence: Synthetic coding sequence
atggagccgggacggacccagatcaaattggatccacggtataccgcagacttgctcgaagtgctgaagaccaattatggaattccctctgcttgcttttcccaacccccaaccgcagcccaacttctgcgggcactgggacctgttgagttagcactcacctccatccttaccctgcttgccctcgggtctatagccatcttcctggaagacgcagtgtacttatataaaaacacactgtgtccaattaaaaggcgaaccctgctttggaagtcttctgcgcctaccgtcgtgagcgtgctctgctgtttcgggttatggatcccaagatctctcgtgcttgtggagatgaccattacatccttctacgccgtatgcttctatctcttgatgctcgtgatggtcgagggctttggcggaaaggaggccgtcctgcgcacgctccgggacactcctatgatggtccatacaggtccatgctgttgttgctgcccctgctgccctcggctcctgttgacgaggaagaagctgcaactgctaatgctgggaccgttccagtacgccttccttaagatcacgctgaccctcgtgggactcttcctggtccctgacggcatctacgacccggctgacatcagtgagggatccacagcgttatggataaacacattcctgggggtaagcaccctgctggcactatggactctcggaattataagccgccaggcacgtcttcacctcggggaacagaacatgggggcaaaatttgcactgttccaggtgctgcttattctgacagccctgcagcctagcatcttttcggtcctggcaaatggcggacagattgcttgcagtccaccctacagctccaagacccgatctcaggtcatgaattgtcatctgctcatcctggaaactttcttaatgacagtcctcacgcgaatgtactatcgcaggaaggaccataaggtcgggtacgaaacctttagtagccctgacctcgacctcaacctcaaggcttag

SEQ ID NO: 52659 - DNA, 387 bp, Artificial Sequence
  Description of Artificial Sequence: Synthetic coding sequence
atggagcattcagaaggcgcaccgggtgatcctgctggcaccgtggttccccaggaactcctggaagaaatgctgtggtttttccgagtggaggacgcttctccgtggaatcattcgatcttggccctggccgcagtggtcgttatcatcagcatggttctccttggccgatccattcaggccagccgaaaggaaaagatgcagccccctgaaaaggaaaccccagaggtgctacaccttgatgaggcgaaggatcataactccctgaacaacctccgtgaaaccctgctgtccgagaaacccaatttggcccaggtggaattggagctgaaagagagggacgtcttgtcagtcttcctcccagatgtgcccgagacagaaagctag

SEQ ID NO: 52660 - DNA, 1245 bp, Artificial Sequence
  Description of Artificial Sequence: Synthetic coding sequence
atgctcatactgacgaaaacagctggggtgttcttcaagccttcaaaaaggaaagtctatgaattcctccggagctttaactttcatcccggaaccctgtttcttcacaagatcgttctgggcattgaaacttcctgtgatgacactgctgccgctgtggtcgacgaaacgggcaatgtgctgggcgaagcgatacactctcagactgaggtccacctgaagacaggagggatcgtgccccctgccgctcagcagctgcaccgcgaaaatatacagcgaattgtccaggaggctttgtccgccagcggggtgagccccagtgacctgtctgccattgccaccactatcaagcccggtttagccttgagtctcggcgtgggattaagttttagcctccagctcgtggggcagctgaagaagccgtttatccctatccaccacatggaggcgcatgctttgaccattcgattaactaacaaagtcgaattccccttcctcgtcttactgatcagcgggggtcattgcctgttggccctcgtacagggtgtttcggacttcctgctgcttggcaaatcacttgacatcgctccaggagacatgttggataaggttgcacgtcggttgtccttgattaagcacccggagtgttcgacaatgtcagggggaaaggctatcgagcacctggctaaacaaggcaaccggttccacttcgacattaagcctcccctgcatcatgccaagaattgcgacttctcctttaccggcttacagcacgtgaccgataaaatcatcatgaagaaagaaaaagaagaaggtattgagaagggacaaatcctatcatcggctgcagacattgccgctaccgtgcagcacactatggcttgccatcttgttaagaggacgcacagggcaattctgttttgtaagcagcgcgatctactccctcaaaacaacgctgtgctagttgcctctggcggtgtcgcctccaacttttacatcagacgcgctctggagattctgacaaacgcaacacagtgcactctcctgtgccctccgccaaggctatgtaccgataatggtattatgatcgcttggaatggaatagagagactgcgagctgggctggggattttacatgacatagaggggatccggtacgaaccaaaatgtcccctgggggtagacatcagcaaagaggtcggtgaggcttcaataaaagtgcctcaactgaagatggagatatag

SEQ ID NO: 52661 - DNA, 669 bp, Artificial Sequence
  Description of Artificial Sequence: Synthetic coding sequence
atgctgattctgacaaagacagcgggagtgttttttaaacctagcaaaaggaaggtctatgagtttctgcgatctttcaacttccatcctgggaccctatttctgcacaagattgttctgggcattgagacctcctgcgacgacacagctgccgctgttgtcgacgagactggcaatgttctcggagaagcgatccacagtcagactgaagtgcacttgaagactggtgggattgttcctcccgcagcacagcagcttcatcgcgagaatatccagcgcatagttcaagaagccctgtccgcaagcggggtgagcccttctgacctgagtgctatcgccacaactatcaagccaggcctcgcgctctcactcggtgtgggtctttcgttctcactgcagttagttggccaactgaagaagccttttatccccattcaccacatggaggcccacgcattaacgatcaggctgacgaataaggtggagttccccttcctggtgctgctgatctccggcggacactgcctcctcgcactggttcagggggtttccgacttcctgctcctcggcaaaagccttgatattgctccaggagacatgttggacaaagtcgcacggagactctctctaattaagcacccagagtgctcgaccatgagcgggggttag

SEQ ID NO: 52662 - DNA, 612 bp, Artificial Sequence
  Description of Artificial Sequence: Synthetic coding sequence
atgcttatcctgaccaaaacagccggtgtcttcttcaaaccatccaaacgcaaggtctatgagttcctgaggtcattcaatttccatcctggaactctgtttctgcacaaaattgtactgggaatagaaacatcttgtgacgacacagctgcagcagttgtcgacgagaccggaaacgtgctgggtgaagctatccacagccagactgaagttcatcttaagaccggcggtatcgttccgcctgccgcacaacagctgcatagggaaaatatccagagaattgtccaggaggctctgtccgcctctggagtgagcccgagcgacttaagcgctatcgcaaccaccatcaagccaggcctggctttgtccctcggcgttggactatctttctccctgcagctggtcggacagctgaaaaaacccttcatcccgattcaccacatggaggctcatgccttgaccattcggctcactaataaagtcgagttcccctttctagtgctgctcatttccggcggacattgcctcctggctctagtccaaggggtttccgatttcctccttttggggaaatccctggatattgcacctggcgatatgctggacaaatag

SEQ ID NO: 52663 - DNA, 1245 bp, Artificial Sequence
  Description of Artificial Sequence: Synthetic coding sequence
atgttaatactgacgaagacagcaggagtctttttcaagcccagcaaacggaaggtgtacgaattcctcaggtccttcaactttcaccccggaactctcttcctgcacaaaatcgttttgggaatcgagaccagttgcgacgacacagctgccgcagtggttgacgagaccgggaacgtccttggcgaagcaatacacagccagaccgaggtgcacctgaagaccggtggcatagtcccccctgccgctcagcagctgcatcgagagaacatccagcgaatagtccaggaggctctttcagcttctggagtgtctcccagcgacctgtcggctatcgctaccacaattaaacctggactggccctgtcattgggagttggcctatccttcagtcttcaattggtggggcaattaaagaaaccatttatcccgatccaccacatggaggcccacgccctcacaatccggctgactaataaagtggaattccccttcctggttctccttatatcagggggtcattgcctcctggcattagtacagggggtgagcgattttctgcttcttggaaagagcctcgacattgctccaggagacatgcttgacaaggtggccaggaggctcagcctaattaaacatcctgaatgctcgaccatgtccgggggaaaggctattgaacatttggccaagcaaggcaaccgcttccacttcgatatcaaacccccactgcatcatgccaagaattgcgacttctcctttactgggttgcagcacgtaactgacaagatcatcatgaagaaggagaaggaggagggaatcgagaaggggcagattctttcttctgctgctgacattgccgctacagtccagcacaccatggcatgccaccttgtaaagagaactcatagggcaattctgttttgcaagcagagggacctgctccctcagaacaacgcagtcttagttgcttccgggggtgtggcaagcaatttctacatcaggagggcactcgagattttgacaaacgcaacacagtgtacgttgctttgtcccccaccaaggctgtgcactgataacggcattatgatagcctggaatggaatagaacgactgcgagccggactcgggatcctgcacgatatcgagggaattcgctacgaaccgaagtgcccgctgggtgtggatatttcgaaagaagtgggcgaggcatccatcaaagtgccacagcttaaaatggagatctag

SEQ ID NO: 52664 - DNA, 1689 bp, Artificial Sequence
  Description of Artificial Sequence: Synthetic coding sequence
atgagcgaggaactcgcccagggaccaaaagaatcgcccccagctccgcgagccggaccaagagaagtgtggaagaaaggcggtcgtctgctgtcggtgttgcttgcagttaacgtgttgctgttggcatgtacattaataagcggaggcgctttcaataaggtcgctgtctatgacaccgacgtcttcgcacttctgacagcaatgatgcttctggcgactctatggatactgttttacctgctcagaaccgtacggtgcccctgcgctgtaccttacagagatgcccatgcaggccctatttggctgagaggaggtctcgtcctgttcgggatttgtacgctcatcatggacgtctttaaaacaggctactattcaagcttcttcgagtgccagagtgccatcaagattctgcatcctctgattcaagcggtgtttgtgataattcagacgtacttcttatgggtgtctgcaaaagactgtgtgcacgtgcaccttgacttgacttggtgcggccttatgtttaccctgaccactaatctggcaatatggatggcagccgtggtcgacgagagcgtgcatcagtcccactcttatagctccagtcattctaatgccagccacgcgcgtctgatcagcgatcagcacgctgataacccagtcggtggcgacagctgcctttgcagcaccgccgtttgccaaatctttcagcagggctatttctatttatatccttttaatatagaatacagtctgtttgcatcaacgatgctgtacgtaatgtggaagaatgtcggacggttcctcgccagtactccagggcacagccacactcccacccctgttagtctctttagagaaacctttttcgcagggccagtacttggactccttttgtttgtagtggggctggctgtattcatcatctacgaagtgcaagtaagcggcgatggctctaggactcgccaggctctcgtgatctattacagctttaatatcgtgtgcctgggactgactaccttagttagcctttcagggtccattatctatcggtttgaccgtcgcgctatggatcatcataaaaacccaaccagaacattggacgtggctctcctgatgggggcagccctcggccagtacgcgatatcctactactcaattgtagctgttgtcgcaggcacgccccaggatctgctagccggtctcaacctgacccacgcgctgttgatgatagcacagcacactttccagaatatgtttattatcgagtccttgcaccgaggccctcctggagccgagcctcactctactcatcccaaggagccctgtcaagatctgacatttacaaatctagatgccttgcacacactgagtgcctgtcctcctaacccagggctagtgagcccatccccctcagaccagagggaggctgtcgctatcgtctctactccaaggagccaatggaggcggcagtgcctcaaggatatatccctgtttcttctgctctgtaacgttatcctgtggatcatgcctgcgtttggcgcaagaccacatttcagtaatactgttgaggtggacttttacggttattccctgtgggctgtgatcgttaatatttgcctgcctttcgggattttttatcggatgcatgcagtgtcatccctgctcgaggtgtacgtcctcagctag

SEQ ID NO: 52665 - DNA, 1791 bp, Artificial Sequence
  Description of Artificial Sequence: Synthetic coding sequence
atggggaggggtgctagagcagccgctgctcagagccgatggggaagagccagtcgggcaagcgtgtctcccggtcggaccatccgctccgctcccgcagtgggagaagcgcaggaaaccgaagcagcaccagagaaagaaaatagggtggatgtcggggctgaagagcgggctgctgccacgcgcccacgccagaagtcatggctggtgcggcacttctcgctgctgctgcgcagagatagacaggcacagaaagccggacagctcttttctgggctgttggctctgaacgtggttttcttgggtggcgctttcatctgcagtatgattttcaacaaagttgctgtcaccctgggagatgtgtggatccttttggctactctcaaggttctgtccctgctgtggctgctgtactacgtcgcctcaactacgcgaaggcctcatgccgtcttgtatcaggatccacatgcaggccctctttgggtccgcggttcactcgttttgttcgggtcctgcaccttctgcttaaatatttttagggtcggatatgatgtgtctcacatccggtgcaaaagccaactggacctcgtgttcagtgtgattgaaatggtgtttataggagtgcaaacctgggtgctgtggaagcattgcaaggattgtgtccgggttcaaacaaacttcacaagatgtggactcatgctgacactggcgactaatcttttactttgggtcttggccgttacaaacgatagtatgcacagggaaattgaggctgagctggggattttaatggaaaagtctacgggaaacgaaaccaacacctgcctgtgtctaaatgctacggcatgcgaagcattccgcagaggctttctcatgctgtatccattcagtaccgagtactgcttgatatgttgcgccgtgctttttgtgatgtggaaaaatgtgggccgacacgtagcccctcacatgggggctcatcccgcaaccgctccattccatctccatggagctatctttgggccacttcttgggctgcttgtactgctggccggtgtgtgcgtgttcgttctgtttcagatagaagcaagcggacccgcaatcgcatgccagtatttcactctgtactacgctttttatgttgccgtcttgcctacaatgagtttggcctgcctggcaggcaccgccattcacggccttgaagaacgggagttggatacagtcaagaatccaacaaggagcctcgatgttgtccttctgatgggagcggctctcggccagatgggaattgcatatttcagcatcgtagccatcgttgctaaaagaccacacgaacttctgaatagactcattctggcctactcattattactaattcttcagcatattgcacaaaatctgtttattatcgagggcctgcataggcgcccactctgggagacagtgcctgaggggctcgcagggaaacaagaggccgaacctccacgccgtggctccctgctcgagcttggtcagggcttgcagcgggcttctctggcttatattcatagctactctcaccttaactggaagcgtagggcgttaaaagaaatctcactctttctcatattgtgtaacatcacgctgtggatgatgcctgcatttggcattcaccccgaattcgagaacggcctggagaaagacttttacggctatcagatctggtttgccattgttaacttcggcctccctctgggcgtgttctatcgtatgcacagtgtgggcggacttgtggaggtgtatctgggcgcatag

SEQ ID NO: 52666 - DNA, 939 bp, Artificial Sequence
  Description of Artificial Sequence: Synthetic coding sequence
atggcgtgcgcggctgtaatgattccaggcttattgcgctgtagtgtcggggctataagaatcgaggctgcctccctgcggctgacccttagtaccctgcggcacttaacattgacctcaataatgaagtcaaaacgaaagactgatcacatggagagaacggcttcggtcctgcgaagggagatagtgagtgccgcaaaagtgtgcggcgctgcttccgaatcgccaagcgtcaagagtctgcgattattggtggcagatcaagacttttctttcaaggccggacagtgggtagacttctttatccccggtgtgagtgtggtcgggggttttagtatttgtagtagcccaagattgctggagcaggaacgggtgatcgagttagcggtgaagtacacaaatcatcccccagccctctgggtgcataacacttgcacgcttgattgtgaagttgcagttcgcgtaggcggtgagttttttttcgatccccagccagccgacgcttcaagaaacctggtactgatcgcagggggagtggggatcaaccccctgttgtctatccttcggcacgccgctgatctgctgcgggaacaagctaataagaggaacggctatgagatcggtacgatcaagctgttctactctgcaaagaatacaagcgagctcctcttcaagaaaaatatacttgacctagttaacgagtttccagagaaaattgcctgttctttgcatgtgactaaacagacgactcagatcaacgccgagctgaagccctatatcaccgaggggagaatcactgaaaaggagatccgcgatcacatttccaaagaaactctgttttacatttgtggcccaccgccaatgaccgatttttttagtaaacaactggagaataatcacgtccccaaggaacacatatgttttgagaaatggtggtag

SEQ ID NO: 52667 - DNA, 486 bp, Artificial Sequence
  Description of Artificial Sequence: Synthetic coding sequence
atggcatgcgctgcagtgatgatcccagggctgctgcgctgttccgtgggtgctatacgcatcgaggccgcttcccttcgcctcactctgtcaacattgagacacctgaccctgacctccattatgaagagtaaacggaaaacagatcacatggagcggactgcttcggtactgagacgagagattgtgtccgccgctaaagtgtgcggcgctgccagcgaatcccctagcgtcaagagtttgaggttgttggtggcggatcaggatttcagtttcaaggcaggccagtgggtcgactttttcatccctggcgtctcggtggttggtgggtttagtatctgcagctcgccacgactcctagaacaagaacgggtgatcgagcttgccgtgaaatacaccaatcaccccccagctctatgggtccacaatacctgcacgctggattgtgaagtagctgtcagggtgggaggggaattcttcttttag

SEQ ID NO: 52668 - DNA, 993 bp, Artificial Sequence
  Description of Artificial Sequence: Synthetic coding sequence
atgacgcccaagatctcctggacaagcaaattttctgtttgtccggaaagtgcgatggcctgtgccgctgttatgatcccgggactgctgaggtgttccgtgggggctatcaggattgaagctgcatcacttcgcctgacactaagtacactgagacatctcaccctgacgtccataatgaagagcaagcgaaaaacagatcacatggagcgcaccgcctccgtccttagacgcgagattgtgtccgctgcgaaagtctgtggcgcagcatcagagtctccaagcgtgaagtctctgaggctgctggtggctgatcaggatttttcatttaaggcaggccagtgggtagacttttttataccgggagtgagcgttgtcggagggtttagcatttgttctagcccacgactgctggaacaggagcgggtaatcgagctcgcagttaagtatacaaatcacccaccagcactgtgggtacacaacacgtgtacactcgattgtgaagtcgctgtgcgtgtggggggtgaatttttcttcgaccctcaacccgctgacgcttctcgcaacttggtgctgattgctggaggtgtcgggattaacccactgcttagtatcttaaggcatgccgcagacctcctgagggagcaggctaacaagcgcaacgggtacgagattggaactatcaaactcttctattctgccaagaacacaagcgagttactcttcaagaagaacattctggaccttgtcaacgaattccccgagaagatcgcatgttctctgcacgtcacaaagcagaccacacagattaatgcagagctgaagccttacatcacagagggtagaatcaccgagaaggaaatacgggatcacatttccaaagagacacttttctatatttgtggtccaccaccaatgaccgattttttttcgaaacaattggagaataatcacgtccccaaggaacacatttgcttcgaaaagtggtggtag

SEQ ID NO: 52669 - DNA, 1272 bp, Artificial Sequence
  Description of Artificial Sequence: Synthetic coding sequence
atgctttgtcacaggggtggtcagctgatcgtgcctatcatccctttgtgtcccgagcacagttgcagaggcaggaggttacaaaacttactttctggtccctggcccaagcagcctatggaactgcataatctctcatcaccctcccccagcctgagtagtagcgttctgccccctagcttttcgccttcccccagctccgcccctagcgcgtttacaacggtgggaggatcctcaggcggaccttgtcacccgactagctctagtttagtgagcgcattcctcgccccaatcctggcactggaattcgtactcggcttggtaggtaatagcttggcccttttcattttttgcattcacacacgtccctggacctcaaatactgtgttcctcgtgagtctcgtggctgctgacttcttgttgatcagtaatttgccactgagggtggactactacttattgcatgagacatggagatttggcgctgccgcatgcaaggtgaatttatttatgctcagcaccaatagaaccgctagtgtcgtgtttctcactgcaatagctcttaaccggtacttgaaggtggtccagcctcaccacgttctgtcccgggctagtgtcggagctgctgccagggtggccggagggctctgggtcggcatactcctcctgaacggccacctgctgctgagcaccttttccggcccaagctgcctgtcctatcgggttgggaccaagccaagcgcctcactccgctggcaccaggccttgtacttactcgagtttttcttgcctcttgcgctgatattgttcgcaattgtgagtattgggctgaccatcaggaataggggacttgggggacaagctgggcctcaaagagcaatgcgcgtgttagcaatggtcgttgcagtctacacaatctgtttcctaccaagcatcatcttcggcatggcctccatggtggcattctggctgtctgcttgcagaagcctggatctatgcactcagctgtttcacggatccctagcgtttacatacttaaatagcgtgttagatccggttctgtactgtttctcgtcgcctaattttctccaccaaagccgggctctactcggattgacacgaggtagacagggccctgtgtctgacgaaagctcctatcagccatcccggcagtggcggtaccgcgaggccagccgcaaagctgaggcgattggcaaactgaaagtccagggcgaagtgtcactcgaaaaagaagggtcttctcaaggatag

SEQ ID NO: 52670 - DNA, 1014 bp, Artificial Sequence
  Description of Artificial Sequence: Synthetic coding sequence
atgaatgaaccactggattatcttgctaacgcctcagactttcctgactacgccgcagcattcggcaactgtaccgatgagaacattcctctgaagatgcactatctgcctgtgatctacggcatcatctttctggtagggttccctggtaacgctgtagttatcagcacatacatctttaagatgcgcccatggaagtcaagcacgattatcatgctgaatctggcgtgcactgacctactatatctgactagcctgcccttcttgatccattactacgcttcaggtgagaactggatctttggtgacttcatgtgtaagttcatacggttctccttccactttaacctctattcttccatattgttcttgacatgtttctcaatcttccgctattgtgtgatcattcaccccatgagttgcttctccatacacaaaacaagatgcgcggttgtggcttgcgccgttgtctggattattagcttggtggccgttatacccatgaccttcctcatcacctccaccaatcgcaccaaccggtcggcatgcctcgacttaacttcctccgatgagctgaacacaattaagtggtataatctgatactgacagccaccaccttctgcctgccccttgtgattgtgaccctgtgctatacgacaattattcatactctgacccatgggctccagacggactcctgcctgaaacaaaaggcaaggcggctgaccatcttgttactgctagccttttacgtttgctttttaccttttcatatactcagggtgattcggatcgaaagtagattactctctatttcttgcagcatagaaaatcagatccacgaggcatacattgtgtcacgcccactggcggcactgaacacctttgggaacctcttgctctacgtggtggtctctgacaatttccagcaagccgtatgttctaccgttcgttgtaaggtatccggcaacttggagcaggccaagaaaatcagttactccaacaatccctag

SEQ ID NO: 52671 - DNA, 189 bp, Artificial Sequence
  Description of Artificial Sequence: Synthetic coding sequence
atgaatgaaccactggattacttggcaaacgccagtgacttccctgattacgccgctgcctttggcaactgtacagacgaaaacatccccctgaagatgcactatctgcctgtgatttacgggattatcttcctggtgggtttcccaggcaatgctgtcgtgatttctacatacatttttaaaatgtag

SEQ ID NO: 52672 - DNA, 210 bp, Artificial Sequence
  Description of Artificial Sequence: Synthetic coding sequence
atgaatgaaccgctggactatctggcgaacgctagcgactttcccgattatgccgctgcgtttggcaactgcaccgacgaaaacattcctctgaagatgcactatctgccagtgatttacggcataatattccttgtagggttcccaggcaacgctgtcgtcatcagcacttatatcttcaagatgcgcccatggaaaagcagcacatag

SEQ ID NO: 52673 - DNA, 1014 bp, Artificial Sequence
  Description of Artificial Sequence: Synthetic coding sequence
atgaacgagccactggactacctggccaacgcgagtgacttccccgattacgcggcagcatttggcaactgcacagatgagaacattccactgaaaatgcattacttgcccgtgatttatggcataatcttcttggtcgggttccccggaaacgccgtagtgatctccacgtacatcttcaaaatgcgaccatggaagtctagcacaataataatgctgaacctggcttgtaccgatctgctttatcttacatctctcccctttctcattcactactacgcgtctggggaaaattggatatttggcgatttcatgtgtaaatttatcaggttctctttccacttcaacctttactcttcaatcttgtttctgacatgtttctctatcttcaggtactgtgttattattcacccaatgtcctgtttctcaatacacaagacccggtgcgccgtggtggcatgtgcagttgtgtggatcatctccctcgtcgccgttatccctatgaccttcctgattacatcgaccaaccgaaccaataggtcagcatgtttagatcttacatcctccgatgagctgaataccattaaatggtacaatttaatcctgaccgctaccaccttttgcctgccactggtgatcgtgacactgtgttacactaccataatccatacactgacacacggtcttcagacagattcttgcttaaagcaaaaggccaggcggctcacgattctgcttctcttagctttctacgtctgtttcttaccctttcacatacttcgcgtgatcagaattgagtcacgactgctgagtatttcctgcagcattgaaaatcaaattcacgaagcctatattgtgtcccggcctcttgcggcattgaacacttttggaaatctgctgctgtacgtggtcgtcagcgacaacttccaacaagcggtctgcagtaccgttcgttgcaaagtgtcaggcaatctcgagcaggccaaaaaaatatcatactcgaataacccatag

SEQ ID NO: 52674 - DNA, 3033 bp, Artificial Sequence
  Description of Artificial Sequence: Synthetic coding sequence
atgagccagttgcgcctgcttccctcccggcttggggttcaggctgcaagacttctggctgcgcacgatgtgcctgtattcgggtggcgaagtcgcagtagcggacccccagcaacatttccctcaagcaagggcggtggcggttcgtcgtacatggaagagatgtacttcgcctggttagagaaccctcagtctgtgcacaagagctgggatagcttttttcgagaagcttctgaggaggcattctctggttccgcccagcccaggcccccttcagtcgttcatgagtcccgatcagccgtgtcatctcgcaccaaaacctccaaactcgtcgaggatcaccttgcagttcagtccctaattcgggcttatcagataagaggacaccacgttgcgcagcttgaccctcttggcattctggacgcagacctggattcctttgtgcctagtgatctcatcacaaccatagacaagttagctttttatgacctgcaggaggcagatctggacaaggaatttcagcttcctaccacaacttttatcggcggtagtgagaacacgctgtcactgcgcgagattattagacgcctggaaaacacgtattgtcaacacatcgggctggaattcatgttcattaacgatgtagagcaatgtcagtggattagacaaaaatttgaaacaccaggtgttatgcagttctcatccgaggagaagcggactctgttggcacggcttgtcagatccatgcgatttgaggacttcctagccaggaagtggagttctgagaagcggttcggtctggagggatgtgaagtgatgatacctgcccttaagactattatcgacaaatcaagcgaaatggggatcgaaaacgttattctgggtatgccacaccgagggagactgaatgtcctggccaatgtgatacgcaaagatcttgaacagattttttgccaatttgatcccaaattggaagcagccgacgaaggctcgggggatgtcaagtaccatctgggcatgtatcatgagcgaattaaccgagtgaccaatcggaatatcacgctgtcactggttgcaaatccttctcacctggaggcagtggatcccgtggtgcagggaaagacaaaagctgagcagttttacaggggggacgcccagggaaagaaagtgatgagcatattggtgcatggcgatgctgcattcgccggacagggcgtggtatacgaaacttttcatctctctgatctacctagctatactactaacggcactgtacatgtggtcgtcaacaaccaaattggctttaccaccgaccctcggatggcaagatccagcccgtaccccacagatgtggctagagtggtcaacgcgcctatcttccacgtgaacgccgatgatcccgaggccgtcatttatgtatgttccgtggcagccgagtggcgtaatacattcaacaaagatgtcgtggtggatctggtgtgttaccggaggaggggacataatgagatggacgagcctatgtttactcagcctcttatgtacaaacagattcataggcaggtgcccgtactgaagaaatacgcagataagctcatcgccgaggggacagtgaccctgcaagaattcgaagaggagattgcaaagtacgatcgcatctgtgaggaagcttacggccgtagcaaagacaagaaaatccttcatatcaaacactggctggactctccctggccaggcttttttaatgtggatggggagccaaaaagtatgacgtgtcctgcaaccggcattccagaggacatgctgactcatatcggaagcgtagcctcttccgtgcctctagaagattttaagattcacaccggtctgagccggattctgcggggacgcgcagacatgaccaagaacaggactgtcgactgggccctggcagaatacatggcatttggctccctgctcaaggagggcatacatgtgcgcctgtcaggtcaggacgtcgagcggggtacgttctctcataggcatcatgttttgcacgatcaggaggttgatcgacgaacgtgcgttccgatgaaccacctatggcctgaccaagcaccctataccgtgtgtaattcctcactgagcgagtacggagtactcggtttcgaactcggttatgcgatggcctcgcccaatgcactggtgctgtgggaagcccagttcggtgattttcacaacaccgcccagtgcattatcgatcaatttatctcgacaggtcaggctaaatgggtacgacacaacgggatcgtgttgctactgccacacggtatggaaggtatgggaccagaacattcatccgccaggcctgagcggtttctgcagatgtccaatgatgacagcgatgcataccctgcgttcacaaaggactttgaggtgtcccagctatacgactgtaattggattgtcgtgaactgttccaccccagccaactatttccatgtattgagacgtcagatccttctgccatttagaaagcctctgatcatattcacacccaagagcctccttaggcacccagaagccaagtcctcatttgaccagatggtcagcgggacatccttccagagggtgatcccagaagacggagccgcagcaagggcacccgaacaggtgcagagactgatcttctgtactggaaaggtttactacgatctggttaaagagcggtcaagccaggaccttgaagagaaggtggccattacccgcctagagcagatcagcccgttcccttttgatttaatcaaacaggaggccgagaagtatcccggtgccgaactggcctggtgtcaggaggagcacaagaacatgggctattacgattatatctcgccaaggttcatgacaatcttgaggcgggcacgccctatttggtacgttggaagagacccggcagctgctccagcgacaggtaatcggaatacacatttagttagcttgaaaaagtttctcgacacagcattcaatttgcaggccttcgaaggaaagacattttag

SEQ ID NO: 52675 - DNA, 2862 bp, Artificial Sequence
  Description of Artificial Sequence: Synthetic coding sequence
atgagtcaactgaggctcttgccatcaaggctgggcgtgcaagctgccaggctcctggctgctcatgatgtccccgtgtttgggtggcggagtcggtcaagtggcccaccagccacttttcctagctccaagggaggcggaggtagctcttacatggaggaaatgtactttgcctggctcgagaaccctcagtcagtgcacaaaattcggggacaccacgtcgcccaattggacccattaggcattctcgatgccgacctcgatagctttgtgcccagcgatctgattacaacgattgataagctggccttttatgacctacaagaagcagacttggataaagaatttcagctgccaactacaaccttcatcgggggatccgaaaataccttgagcctgcgtgaaattatcaggcgccttgagaatacgtattgccagcatatcggtctagagttcatgtttatcaacgacgttgagcagtgccagtggatccgccaaaaatttgagacaccaggcgtgatgcagttcagtagcgaagagaagagaaccctcctggcccgtctggtgcgctccatgaggtttgaggattttctcgcccgaaagtggtcgtcggagaagaggtttggactagagggatgcgaggtcatgattcccgctttgaagaccattatcgataagtcctccgaaatgggtatcgaaaatgtgattttggggatgccccaccgcggaagactgaatgtactagccaacgttatcagaaaagaccttgagcagatcttctgtcaatttgatcctaaactcgaagctgcagatgaaggttcgggcgacgtgaagtaccaccttgggatgtatcacgaacggatcaatcgcgtgaccaacagaaatatcactttgtcgctcgttgccaaccccagccaccttgaggccgtggatcccgtagtgcagggaaagaccaaagcggagcagttctacagaggcgatgcccaaggaaagaaggttatgtctatccttgtccacggggatgccgcttttgcagggcagggtgtcgtgtacgaaacattccatctctcggacctgccctcatacacgaccaacggcacagtccatgttgtggtgaacaatcaaatcggattcaccactgatcccaggatggctcggtctagcccgtacccgactgatgtcgccagagttgtgaatgcacctatttttcatgtgaacgccgatgatccagaagctgtgatatacgtgtgcagcgtcgcagcggagtggcgtaacactttcaacaaagacgtagtagtggacctggtgtgctatcgcagacgagggcataacgaaatggacgagcccatgtttactcagcccctgatgtataagcagatacaccgccaagtccccgtattaaagaagtacgcagataaacttatcgctgagggaactgtcacacttcaggagttcgaggaagagatcgctaagtatgaccgcatctgtgaagaggcctacggcaggtccaaagataagaaaattttgcacattaaacattggttagactctccctggccaggcttctttaatgtagacggtgagccaaagagtatgacttgccccgcaacggggatccctgaggatatgttgacgcacattggctctgtagcaagcagtgttcctctggaagattttaaaattcacactggcttgagccggatccttcgaggacgggctgatatgaccaaaaatcgaactgttgactgggcactagccgaatatatggctttcgggagtctattgaaagagggcatccatgtccgcctctccggacaggacgttgaaagaggcacattttcccatcgacaccacgtgctgcatgaccaggaggtcgatcgacgtacctgtgtgcccatgaaccacctgtggccagaccaggcgccatacactgtgtgcaactcatcactgagtgaatacggtgtgctcggatttgagcttgggtatgccatggccagtcctaatgctctggtgttgtgggaagctcagtttggagattttcacaacacagcccagtgcattatcgaccagttcattagtactggacaagccaagtgggtgcgacacaacggtattgtgctgctgctgcctcatggcatggagggaatgggtcctgaacactcttcagcacgtccagagagatttctgcagatgagtaatgatgactcggatgcctatcccgctttcacgaaggactttgaggtcagccagctttatgattgtaattggattgtagtcaattgcagcacacctgctaactacttccatgtgctccggcgacaaatcctgcttccgtttaggaagcctctcattattttcactccgaagtccctcctgaggcaccccgaagcaaagagttcctttgaccagatggtctccggcacatccttccaacgggtaataccagaggatggcgctgcagccagagccccagaacaggtccagagactgatattttgcactggtaaggtttactatgatcttgtcaaggagagatcctcccaggacttggaagagaaggttgcaataacacggctggagcaaatcagtcctttcccattcgatttaatcaagcaggaggctgagaaataccctggcgctgaattggcctggtgtcaggaagagcacaaaaatatgggttattatgactatatttcacccagattcatgaccatcctgaggcgggcaaggcctatctggtatgtcggcagagaccccgcagctgcccctgcaacagggaatcgtaatacacacctggtcagcctgaagaagtttcttgacactgcatttaatcttcaagccttcgagggcaaaactttttag

SEQ ID NO: 52676 - DNA, 2406 bp, Artificial Sequence
  Description of Artificial Sequence: Synthetic coding sequence
atgtttattaacgacgtggaacagtgtcagtggatcaggcagaaattcgagactcctggggttatgcaattttcttccgaggagaagcgcacacttctagcacgcctggtgcggtcaatgagatttgaggacttcctggccaggaaatggagttctgaaaaacgcttcggacttgaaggctgtgaagttatgatccctgcgctgaagacaataatcgacaagagcagtgagatgggcattgagaatgtgattctcgggatgccacatcgaggaagactcaacgtgcttgctaacgtgattaggaaggacctggagcagattttttgtcagtttgaccctaaactcgaagctgccgatgagggtagcggggatgtgaaataccatttgggaatgtaccacgagagaattaatcgagtcacaaaccggaacatcactctttctctagtggccaatccttcacatctggaggctgtagatccagttgtccagggcaaaaccaaagcagagcagttctatagaggggacgctcaagggaagaaggtcatgagcatcctggtgcacggggacgctgcgttcgcgggacagggcgtggtgtacgaaaccttccaccttagcgacctgccaagctatacaaccaacgggacagtacacgttgtcgttaataatcaaattggcttcacgaccgatccacgtatggctagaagctcaccatatccaactgatgtggcccgagtggttaacgcccctatattccacgtcaatgccgacgatccagaagccgtgatatatgtgtgtagcgtcgctgcagaatggcgtaacacatttaacaaggatgtcgtcgtggacctggtctgctaccggagaaggggccataatgagatggacgagccgatgttcacacaacctttaatgtacaagcaaatacaccggcaggtcccggtactgaagaagtatgccgacaagttaattgccgagggaacggtgactttacaagagttcgaagaggaaatcgcgaaatatgaccgcatttgtgaagaagcctatggcaggtccaaagataagaagatcctccacattaagcactggcttgactcaccttggccgggatttttcaacgtggatggagaaccgaagagtatgacgtgcccggctacaggcattccagaagacatgctcacccacattggctctgtggcttcttccgttccactggaggattttaaaattcacaccggtctcagcagaattttgcgcggacgcgctgatatgaccaaaaatagaactgtcgattgggccctcgccgagtacatggccttcgggtccctgttgaaggagggaatccacgtgcgcctgtctgggcaagacgtcgagaggggtacattcagccacagacaccacgtcctgcacgatcaagaggtagacaggcgcacttgtgtgccgatgaaccatctgtggcctgatcaggcaccctataccgtttgcaacagctccctgagtgagtatggggtactgggctttgagctgggctacgccatggctagtccaaacgctttggtactatgggaagcccagttcggggatttccacaacacagcacagtgcattatcgatcagtttataagcaccggtcaggcgaagtgggttagacacaacggaatcgtgcttctcctgccacacggtatggagggcatgggacctgagcacagctctgccagacctgagaggtttctccagatgagtaacgacgatagcgatgcataccccgcatttaccaaggacttcgaggtttcccagctgtatgattgtaactggatcgtggttaactgtagcacaccagcaaactacttccacgtgttgcgcagacagatactcctgcctttcagaaaacccttgataatttttactcctaaatcgctccttcgccaccctgaagccaaatcctcctttgatcagatggtgtccggaaccagctttcagagagtaattccagaggatggagcagcagctcgcgctccagaacaagtgcaacgcctgatattttgtacagggaaagtgtactatgatctggtcaaggaacggtcctctcaagatctggaggagaaggtggccattacccggctggagcagatctccccctttccctttgacctcataaaacaggaagccgagaaataccccggtgccgagctggcttggtgccaagaggaacacaagaacatgggatattacgattatatctctcctaggttcatgactatcttacgaagggcccgtcctatctggtacgtgggccgtgaccccgctgctgctccggcaacaggtaacagaaacacccacctggtgagcctgaagaaattcctcgatacagcctttaacctgcaggcgttcgagggcaaaacattctag

SEQ ID NO: 52677 - DNA, 2160 bp, Artificial Sequence
  Description of Artificial Sequence: Synthetic coding sequence
atgtttggcaaaaaaaagaagaagatcgagatttcaggaccaagcaacttcgagcaccgggtgcatacagggtttgatccacaggagcagaagttcacaggcctgccacagcagtggcatagtcttctcgcggatacagcaaacagacctaagccaatggtcgacccctcttgcattacccccattcaacttgctccaatgaagaccatcgtgcggggtaacaaaccctgcaaagaaacatcaataaatggactgctcgaagacttcgacaacatttctgtaacccgttctaatagccttaggaaagagtctccacccaccccagaccaaggcgcatcctcccatggacctgggcacgctgaagagaatgggttcattaccttcagccagtacagctccgaatcagatactacagctgattacaccactgaaaagtacagggaaaaatccttgtacggagacgatctggacccttactaccgagggtcccacgccgcaaagcagaatggacatgttatgaagatgaaacatggcgaggcttattattcggaagtgaagcctctcaaatcagacttcgcacgcttcagcgcagattaccacagtcatctcgacagcctctcgaaaccaagtgaatactccgaccttaagtgggagtaccagagagccagttcctctagtcccctcgattacagctttcagttcaccccgagccgaactgcaggcactagtggatgtagtaaggaaagtctcgcatactcagagtcagagtggggcccaagcctggacgactacgatcggaggccaaagtcatcttatctgaatcaaacttcgcctcaacctacaatgagacagcggagccggagtggcagcgggctccaggaacctatgatgcccttcggcgcatccgcctttaagactcatccccagggccattcctacaactcgtacacctatccaagactcagcgagcccaccatgtgtattcctaaggtggactatgacagggcacagatggtgttgagcccacccctgtccggaagcgatacttatccgaggggcccagctaagctgccccagtcacagtcaaagtccggatactcatcgtcgtctcatcaatatccaagtggatatcataaggccaccttatatcatcacccgtctttgcagtcctcgagtcagtatatttcaacggcatcttacttaagcagtctctcactttcctcctcaacttatccccctccaagttggggaagctcatcagaccagcagccgtcaagagttagccatgagcagttccgtgctgccctacagcttgttgtgtcccctggggacccacgggagtatcttgcgaacttcatcaaaattggagaaggatccaccggaatcgtgtgcatcgcgacagaaaagcacactgggaagcaggtggccgtgaaaaaaatggacctgcgaaagcaacagcggagggagctgttgtttaatgaggtggtgattatgcgggactaccaccacgataatgtggtagacatgtactcttcttatctggtgggcgacgagctttgggtggtgatggaattcctggaaggcggagctctgacagacattgtgacacacacgcgtatgaatgaggagcagatcgcgactgtctgcttaagcgttctgcgtgctctgtcatacctgcacaatcagggagttatccacagggacattaagtcagattctatcttgctgacctctgacggtcgaatcaagctgtccgactttggattttgtgcgcaggtaagtaaggaggtcccgaaacggaagtctttggtcgggactccatactggatggcacctgaagtgatatccagactcccttacggcacagaagtggatatatggtccctgggcatcatggttatcgagatgatcgacggcgaacccccatacttcaacgagcctccgctccaggcaatgcgacggatccgagattctctgcccccaagggtcaaagacctccataaagtcagttccgtgttgcgcggttttctcgacctcatgcttgtacgggagccttcccagcgcgcaaccgcccaggaattgctgggtcacccttttctgaaactcgccggtcccccaagttgtatcgtaccacttatgcgtcagtaccgtcaccattag

SEQ ID NO: 52678 - DNA, 2160 bp, Artificial Sequence
  Description of Artificial Sequence: Synthetic coding sequence
atgtttgggaagaagaagaagaaaatcgaaatctcaggtccaagcaatttcgagcatagagtccataccggcttcgatccacaggagcagaagtttactggactgcctcaacagtggcactctctgctcgcggatacagccaaccgccctaagcctatggtggatccgtcgtgcatcaccccaattcaactcgcccctatgaaaaccatagtacgcggaaataagccctgtaaggaaacctccatcaatggtcttctcgaggatttcgataatataagcgttacgagatcaaattccttgcgcaaagaatctcctcctaccccagaccagggagccagttctcatggtcccggtcatgccgaagaaaacggatttatcaccttctcccagtactctagcgagagtgatacaaccgctgactacaccacagagaaatacagggagaaaagcctctacggagatgacctagacccatattaccgtggaagtcatgccgctaaacagaacgggcacgttatgaagatgaaacatggtgaagcctattatagtgaagtgaagccgctgaagtctgatttcgctagattctctgcggattaccatagccacctggatagcctcagcaagcccagcgagtacagcgaccttaaatgggaataccagagggcatcgagcagctcccctctggattattcctttcagtttacgccgtcccgaacagcagggaccagcggatgctccaaggagtcactggcctattcagagtcagaatgggggccatcactcgacgattacgatcgacgaccaaagagcagctatctcaaccagacaagtccacagccaaccatgcggcagaggtcaaggtccggttcagggctccaggagcctatgatgccttttggtgcctcggctttcaagactcatccacagggccattcttataacagctatacttacccgcgattgtcagagccgactatgtgcattccaaaagtggactatgaccgggctcagatggtgctgtctccccctctgagcggatcagacacatatcctagagggcctgccaagctcccacagagccaaagtaaaagtggctactcgtcctcatcccaccagtacccttcaggataccacaaggccacactgtatcaccacccgagtttacagagcagttctcagtatatctcaacggcctcctacctatcatccctgagcctctctagtagcacttatcctcctccatcttggggctcaagtagcgaccaacagccgtctcgagtcagtcacgagcagttcagggcagccttacagctcgtggtctctccaggtgaccctcgcgaatacttggctaactttatcaagatcggggagggctctaccggtattgtttgcatcgccaccgagaaacatacaggcaagcaagtggcagttaaaaagatggacctgagaaagcagcagcgcagagaactgctattcaatgaggtagtcatcatgagggactaccatcacgataacgtggtcgacatgtatagctcgtacctcgtgggggacgagctgtgggtggtgatggagtttctggagggtggcgctctgactgacatcgtgacacatacgcggatgaatgaggagcagattgcaacggtctgcttgtcagtcctccgcgcactatcataccttcacaatcagggtgtgatacatagggatatcaagtcggactcaatcctcttgacctccgatggccgaattaagctgtccgactttgggttctgcgctcaggtttccaaggaggtccctaaaagaaagtccctcgtaggaacaccctattggatggcgccagaggtcatatcgcgcctgccgtatggcactgaagttgacatctggtccctcggaattatggtcattgaaatgatcgatggggaacccccatatttcaacgaacctccactccaggccatgaggaggatacgcgactcgcttccaccacgggtgaaggacctccataaggtaagtagcgtgctcagaggctttcttgatcttatgctagtgcgggaaccttctcaaagagccacagcccaggaactgctgggccatcctttcttaaagcttgcaggtccaccatcatgcatagtccctcttatgagacagtacagacaccattag

SEQ ID NO: 52679 - DNA, 2160 bp, Artificial Sequence
  Description of Artificial Sequence: Synthetic coding sequence
atgttcggcaagaaaaagaagaagatcgagatatccggcccatcaaacttcgagcaccgagttcatactggcttcgatcctcaggagcagaagtttaccggattgccccaacagtggcacagtctgcttgccgatacagcaaacaggccaaagccgatggttgatccaagctgcatcacgccaatccagctggctcccatgaaaaccatcgtgcgagggaacaaaccttgcaaagagacatctataaacggcctgctagaggatttcgacaacatttccgtgacccggtccaacagcctgagaaaggagagtcctccaacaccagaccagggggcatcttcccacggtcccggacacgctgaagagaacggctttattacattttcccagtattcatcggagagtgacaccacagcagattatacaaccgagaagtacagagagaagtctctttacggtgacgatctggacccgtactataggggatctcacgcagcaaaacagaacggccacgtcatgaagatgaaacacggtgaagcctactattcagaggtgaagccccttaagagtgacttcgctaggttctccgccgactaccactcccacctcgactctttatccaagccaagcgaatactctgatctaaagtgggaataccagcgagcttcttcttcatcccctctggattatagttttcagttcactccatctcgcacagcagggaccagtggatgttcgaaagagtccctggcttacagcgagtctgagtggggtccttctctggatgactatgatcgcaggcccaagtctagctacctgaatcagacttcaccacagcccaccatgcgccagcgctcacgatccggtagtggcttacaggagccaatgatgccttttggcgcatccgccttcaagacgcacccccaaggccattcctacaattcatacacttatccaaggctttccgaacctaccatgtgtattcctaaggttgattacgatcgagcgcagatggtgttgtctcccccactgtcaggcagtgacacttaccccagaggacccgcaaagctgcctcagagccagtcaaagtcagggtactcgagtagtagtcatcaatacccatcaggctaccacaaagccacgctatatcaccacccgtccctgcagagtagcagtcagtatatctctacagcctcttacctttcttcactctccctttcctccagtacctacccccctcccagttggggctcctcaagcgatcagcagcccagcagagtttcgcacgagcagttccgggctgccttacagctcgtagtttctcccggagacccgcgagagtacctagctaactttataaagataggcgaagggtccaccggaattgtgtgtattgcgactgagaagcatactggaaaacaggtggccgttaagaagatggaccttaggaaacagcagcgaagagagctgctgttcaacgaggtggtgataatgcgcgattaccatcacgacaacgtggtggacatgtacagctcttatctagtcggcgacgaactgtgggtcgtcatggaatttctcgagggaggggctctgactgatattgttacccatactaggatgaatgaggaacagatcgctaccgtgtgtctctccgtcttaagggccctgagttatttgcataatcaaggagtcatccatagggacataaaatcagactccattctgctgacaagcgatggccgaatcaaactctccgactttggcttctgcgcccaggtgtcgaaggaagtgcccaaacgaaagtccctcgtcgggactccctattggatggctccagaggtgatctcaaggctgccctatgggacagaggtggacatctggtcactaggtatcatggttattgagatgattgatggcgagcctccctatttcaacgaacccccactgcaggccatgcgcaggatccgagactcactgcccccaagggttaaagatctacataaagtctcttctgtgctcagagggttcctggatctgatgttagttcgtgagccttcacagcgcgctacagcgcaagaactcctgggacatcctttcctcaagcttgccggtcccccatcctgtatcgtccccctgatgcgtcaatatcggcaccactag

SEQ ID NO: 52680 - DNA, 1743 bp, Artificial Sequence
  Description of Artificial Sequence: Synthetic coding sequence
atggtggaccctagttgtatcaccccaatccagctagccccaatgaaaacgatagtgcgtggcaataagccttgcaaagagacctcaattaatggactgcttgaggatttcgacaatatatctgtcaccagatcgaactctctgcggaaggagagccctccaactcctgatcaaggcgcatcttcacacggtccaggacatgctgaagaaaacgggttcattaccttcagccagtacagttctgagtcagacaccactgccgactacacaactgagaagtatagagagaagagtctctacggggatgatttggacccttattaccgcggatcccacgccgcaaaacagaatggccatgttatgaagatgaagcacggtgaggcatactattcagaggtcaaaccattaaagagcgatttcgctcgtttctcagccgattaccactcgcatctggattccctgagcaaacctagcgaatattctgacctcaaatgggagtatcaacgtgcaagcagtagtagccctcttgattatagttttcaatttacaccaagtagaaccgcaggtactagtgggtgctcgaaggaatccttagcttacagtgaaagtgaatggggtccatctctggacgattacgatcgtcgacctaaatcctcttacctcaaccagacatccccccagcctaccatgcgtcagagaagccgcagcggcagcggattacaggagcccatgatgccctttggggcatctgcattcaagacacacccgcaggggcacagttataacagttatacataccctcggttaagtgagccaacgatgtgtataccaaaggtcgactacgaccgagcgcagatggtgctaagcccacccctctcaggctccgatacctaccctagagggcctgccaaacttccacagagccagtccaaatcaggttatagctccagcagtcatcaatacccatccggctatcacaaagccacgctataccaccacccaagtttacagtcttccagccagtatataagcaccgcaagttatttaagcagtctttctctgtcctcctccacatacccacccccatcttggggaagttccagcgatcaacaacccagccgcgtgtcccatgagcagtttagggccgctctgcagttagtggtctcacccggagacccgagagagtaccttgcaaatttcattaaaatcggcgaaggcagcacagggattgtatgtatcgccacggaaaagcacaccggaaagcaggtcgccgtcaagaagatggacctgcggaagcaacagaggagggagcttctgttcaatgaggttgtaattatgcgggattaccaccatgacaacgtagtggacatgtattcatcatacctagtgggcgacgagctctgggtggtcatggaatttctggagggtggcgcactgacggatattgttacccatacaagaatgaatgaagaacagatcgctactgtatgccttagcgtactacgagcgctgagctacctgcacaaccaaggcgtcatccacagggacatcaaatctgattcaatcctgcttacatctgatgggcgtgtctccagcgtcctgagggggtttttagatttgatgctggtacgtgagccatcacaacgggcaaccgcccaggagttactggggcacccattcctgaagttggcaggaccccctagttgtatcgtccctttaatgcggcaataccggcaccactag

SEQ ID NO: 52681 - DNA, 366 bp, Artificial Sequence
  Description of Artificial Sequence: Synthetic coding sequence
atgtccactctgtttcctagtttgttcccgagagtcactgagactttatggtttaacttggaccgcccttgcgttgaggagaccgagcttcagcaacaggaacaacaacaccaggcatggctgcagtccatcgctgagaaggacaataaccttgtccctatagggaaacctgcatctgaacactacgacgacgaggaagaagaggatgatgaagatgatgaggattctgaagaggactctgaggacgacgaggacatgcaagacatggacgagatgaacgactacaacgagtctccagatgacggcgaggtcaatgaagtggacatggagggaaacgagcaggatcaagaccagtggatgatctag

SEQ ID NO: 52682 - DNA, 1269 bp, Artificial Sequence
  Description of Artificial Sequence: Synthetic coding sequence
atggctattgcccagctcgcaaccgaatatgtattttctgacttcctcctgaaggagccgaccgaaccaaagtttaaaggtctgaggcttgagctcgctgtggataaaatggttacttgcatcgctgtggggttaccactgcttctgatctccctcgccttcgcccaagagataagtattgggacccaaatcagttgtttcagcccatccagtttctcgtggagacaagcggcttttgtggactcttattgttgggcggctgtacagcaaaagaacagcctccagtccgagagtggaaacttacccctctggctgcataagttcttcccctatatccttctgctgtttgctatcctgctgtaccttcctcctctgttctggcggtttgcagccgctccacacatttgcagtgacctcaagtttattatggaagaactcgacaaggtttataatcgcgctatcaaggccgcaaagtccgccagggatctcgacatgcgggacggagcttgtagcgtacccggtgtgaccgagaatctgggacagagcctctgggaagtgtcagagagccacttcaaataccctatcgtggagcaatatctcaaaacaaagaaaaacagcaataatctgatcatcaagtacatcagctgccgcctacttacactgatcattatcttgctggcgtgtatttacttagggtattacttcagcctaagttccctgtccgacgagttcgtttgcagcatcaaaagcggaattttgcggaatgactccaccgtgccagatcagttccagtgcaaactcatcgcagtgggcatattccaactgctcagcgtgattaacctcgtcgtgtacgtcctgttagctcccgtggtggtatacaccctgtttgtaccattccgccaaaaaactgatgtcttaaaggtgtatgaaattcttcccacgtttgacgttctgcatttcaaaagtgaagggtacaatgatttgagcctgtacaatctctttctggaagaaaatatttccgaggttaagtcttacaagtgccttaaagtgctggagaacattaagagtagcggccaagggatcgaccccatgttgcttctgaccaatctgggaatgatcaagatggatgtggtggacggcaagacccccatgagcgccgaaatgcgggaggaacagggaaaccaaacagctgagctgcaggacagcgagacgaaagcaaataacggcgagaagaatgcccgacaaagactgttggatagtagctgctag

SEQ ID NO: 52683 - DNA, 2034 bp, Artificial Sequence
  Description of Artificial Sequence: Synthetic coding sequence
atgcatcacttactggagcagtcagctgatatggctaccgccctgctggctggcgagaagctacgtgaattaatactgcccggagcgcaggatgataaagcaggcgcactggctgccctactgcttcagctcaaactagagctgcctttcgatagagtggtgactatcggcacagtcctggttccaatactgctcgttactctggtctttacgaagaactttgccgaggagcctatatactgctacacaccacataatttcacccgtgatcaggccctctacgccagaggttattgttggactgaactcagagatgcgttgccaggggtggacgcctcactttggccttcgctatttgaacacaaatttctgccatacgcacttctcgcgtttgctgcgattatgtatgttcccgctctgggctgggagttccttgcctcaacccgcctcaccagcgaactgaatttcttgctccaggaaatcgataattgctaccatcgtgcggcagaaggaagagcccctaagatcgaaaaacagattcaatcaaagggtcctggaataactgaacgagaaaagcgagaaatcatagagaacgccgaaaaggagaagagtccagaacagaaccttttcgagaaatacttggagcgcagagggcgtagcaacttccttgccaagctctaccttgccagacacgtgttaatcctgctgctttctgccgtacctatttcctacctctgcacatattatgccacccaaaagcagaacgaatttacctgtgctttaggtgccagcccagacggagccgctggagctgggcctgcagtgcgggtttcatgcaagctccctagcgtgcagttgcagagaatcatagcaggggtggacatcgttctcctctgcgttatgaacctcataattcttgttaacctgatccatttattcatcttccggaaaagcaattttatttttgacaaactgcacaaggtcggaatcaagactcggagacaatggaggagatctcaattctgcgacattaacatcctcgccatgttctgcaacgagaatagagaccacatcaaatccttgaatagactggacttcatcactaatgagtcggacctgatgtatgacaacgtagtgagacagctcctcgcggcactcgctcagagcaatcacgacgccacacccacagtacgggattctggtgtgcagacagtggacccctctgccaatcccgcagaacccgacggcgctgccgagcccccagtggtgaaacggcctcggaaaaaaatgaaatggattcccaccagcaacccgctgccacagccatttaaggagccattagccatcatgcgggtggaaaattccaaagctgagaagcctaaacctgcacggaggaagaccgcgacagataccttgattgccccactcctcgacaggagcgctcaccactataaaggcggagggggtgacccaggccctggtccagcccctgcacccgcacctccacccgctcccgataaaaagcacgcccgacattttagcttggacgtgcacccctacattctgggcaccaagaaagccaaagctgaagcggtgcccgctgccttgccagctagtaggagccaagaaggcggtttcttgtctcaagcggaggactgcgggctcgggctggcacccgcaccgatcaaggacgcgccactccccgaaaaggagattccctatcccactgaacccgctcgagcaggtctgccatccggtggaccgtttcatgtgcggtcaccaccagctgctcccgctgtggcccctctgactccagcctccttgggcaaagctgagccactgacaattctgtcccggaatgcaacccaccctcttctgcacatcaacacactgtacgaagcccgtgaggaagaggatggaggcccaaggttgcctcaagacgtgggagatcttatagcgatcccggcacctcaacaaatcctgatagccacttttgatgagcctagaacagtggtgtcgaccgtcgaattctag

SEQ ID NO: 52684 - DNA, 1065 bp, Artificial Sequence
  Description of Artificial Sequence: Synthetic coding sequence
atgaatctaattatccttgttaacttgattcaccttttcatatttaggaagagcaactttatatttgataagcttcacaaagtgggtatcaaaacccgtcggcagtggagaagatcgcagttctgcgatataaacatccttgccatgttctgtaatgagaaccgcgatcacattaagtccttgaatcggctggacttcattaccaatgaaagcgatttaatgtacgataacgttgtgcgccaactcctggccgcacttgcccaatccaaccacgatgccactccgaccgtgcgagattcaggcgttcaaacggttgacccaagcgccaaccctgccgaaccagatggtgccgctgaaccgcctgtcgtgaaacggccacgcaagaagatgaagtggatccctacctccaatccacttccccagcctttcaaagagccacttgccattatgagggtcgagaacagcaaagccgagaagcccaagcccgcacggcgaaaaaccgccaccgacacacttattgcccctctactggaccgctccgccccagacaaaaagcacgcaaggcatttctcactggacgtacacccctacattctcggcactaaaaaagctaaagccgaagcagttcccgctgcgcttcctgccagccgtagccaggagggtggtttcctgtctcaggcagaggattgtggactggggctggcccctgctcctataaaggacgctccactgccagagaaagagattccttacccgaccgaacccgctcgggcaggactcccgagcggaggacccttccatgtcagaagcccacccgctgcccctgctgtggccccactcacccccgcatccctgggaaaggcagagcctctcactattctgtctcgaaacgccacacatcccctgttacacatcaatacattgtatgaggccagagaagaagaggatggcggacccagattaccacaggatgtcggcgatcttattgcaattccagctcctcagcagattctgattgcgacgttcgatgagcccaggaccgtggtgtccactgtggaattctag

SEQ ID NO: 52685 - DNA, 1179 bp, Artificial Sequence
  Description of Artificial Sequence: Synthetic coding sequence
atgtccctagcacatacagctgcagagtacatgctgtctgatgcactcctgcctgaccgcagaggacccagactgaaaggactccgcctggagctgccactggaccgcattgtgaaatttgtcgctgtaggcagcccgctcctgttgatgtccctagcctttgcgcaggaattttcatcaggctctcctatctcatgctttagtccaagcaacttctctattaggcaggctgcttatgtcgactcctcatgctgggactctttgctccaccacaaacaggacggacctggtcaggacaaaatgaagagcctgtggcctcacaaagctctgccctacagtctcctagctctggctttgttgatgtacctacctgtcctactgtggcagtacgctgccgtccctgccctttctagtgacctgctgtttattatcagtgaactggataagagctataaccggagtatccggcttgttcaacacatgctcaagatcaggcagaaatcgtccgacccatatgtgttctggaacgagctggaaaaggctaggaaggaaagatactttgaattccctcttctggagcggtacttggcgtgcaagcagagatcccactccctggttgcgacgtacctcctgcggaactctcttttgctgattttcaccagcgcgacttatttgtacttgggccacttccacttggatgtgttctttcaggaggaattttcctgctccatcaaaacgggtttactctccgacgaaacacatgtgcctaacctaatcacctgccggctgacctccctttctatatttcagatcgtgagcctgagctcggtggcaatatacaccatacttgtacccgtcatcatctataatctgaccaggctctgtcggtgggataaaagactgttatctgtgtacgagatgttgccagcttttgacctcctgtcccggaaaatgttggggtgccccattaatgatcttaacgttattctgctttttttaagggctaatataagtgaactgatttctttctcttggcttagtgttttgtgcgtgctaaaggacacgactacccagaaacataacattgatacagttgtcgacttcatgactctcctggcgggattggaaccgagcaagccaaagcacctgactaactccgcctgcgacgaacatccatag

SEQ ID NO: 52686 - DNA, 309 bp, Artificial Sequence
  Description of Artificial Sequence: Synthetic coding sequence
atgaggtatgggtttgtgaggaagaaacatagaggacttttcctgacaactgtggcggctctacctatctggaatcccatctcagagtttgtaaaatggtataaatcccataagctttcccaacactgtattaggatctgtgggcacctatgccagaagcatctggacatgtttctgtctgtgattggccagcgatggcccatcgatgtatttagtagcgtctttgaccaccaggttagcgctattgggtcggacattatatggtggtttctgaagctgttcttggtgagcttcttcttcttcttctag

SEQ ID NO: 52687 - DNA, 3315 bp, Artificial Sequence
  Description of Artificial Sequence: Synthetic coding sequence
atgaaagtgacagtgtgttttggcaggacaggcatcgtagtgccctgtaaggaaggccagctgagggtgggcgagttaacacagcaagcattgcaacgctacttgaagacacgcgaaaaaggacccggatattgggttaaaattcatcacttagaatataccgatggcggaattctggatcccgatgacgtgcttgccgatgtcgtggaagacaaagacaaattaattgccgtgttcgaggaacaggaaccactacacaagattgagtcccctagcgggaatcccgcagatcggcagagccccgatgcattcgagaccgaggtcgcggctcaacttgccgcttttaagcccattgggggtgagatagaagtgacacccagcgccctgaagttaggcaccccactcctcgtcagacgttcatccgatcccgttcctggaccgccagccgatacccagcccagcgcatctcatcctggcggtcagagcctgaaactcgttgtaccagactcgacgcaaaacctggaggacagggaggttctgaatggcgtccagactgagcttctcacatctcctagaacaaaggacaccttatccgacatgacacgaactgtggaaattagcggcgagggaggacccctgggtatccatgtggtgccgttcttcagcagcctgtccggtcggatactcggcctctttataaggggtattgaggacaacagtagaagcaaaagggaaggactgtttcacgagaatgagtgcatcgtcaaaattaataacgtggacctggttgacaagacctttgcccaagctcaagacgtcttccgacaggcaatgaagagtccatcagtgctactacacgtgttgccgcctcagaacagggagcagtatgaaaaaagtgttattggtagccttaacatcttcggcaacaatgacggtgtcctcaagaccaaggtacctcctcccgtgcatggtaaatccgggctgaaaacagccaatctgaccgggaccgactcccctgagactgacgccagcgcaagcctgcagcagaataagtcacctagagtgccaagacttggaggaaaaccaagctctcctagcctgtctccactaatggggttcggaagcaacaaaaatgccaaaaaaattaagatcgatctcaaaaaaggtccagaagggctgggtttcaccgtcgtgaccagggactcgagcatccatgggcctggacccatcttcgtgaagaacatcctgcctaaaggagctgcgattaaggatgggcgtctccagagtggcgatagaattctggaagtgaatggccgtgacgtgaccggacgcacccaggaagagctggtggcaatgctgaggtccacaaaacagggcgaaaccgccagtcttgtgatcgcacgacaggaagggcattttctgcctcgagagctcaaaggcgagcccgattgctgcgctctgtcactggagacttctgagcagctgaccttcgagatacctttaaatgacagcggaagtgctgggttaggggtatccctaaagggcaataagtctcgcgagaccgggacagatttggggattttcataaaatccataatccatgggggagctgcctttaaggacgggagactcagaatgaatgatcagctcatcgctgtgaatggggagtctctgcttgggaaaagcaatcatgaggccatggaaaccctccggaggtctatgagtatggaaggaaacattcgaggcatgattcagctcgtgatattacgaaggccagaaagaccgatggaggacccagcagaatgcggtgcctttagcaagccttgctttgagaactgccagaacgccgttaccacaagtcggagaaacgataacagcatcttgcatcccctgggaacatgctctccccaggataaacagaagggtctcctgctgcctaatgatggatgggccgaatccgaagtaccccctagccccaccccgcactccgcgttgggcctgggactggaagattactcgcattcctccggcgtcgactcagctgtgtactttcccgatcagcatataaatttccggtcagtcacccccgctaggcagccggagtcaataaacctcaaagccagcaagtccatggatctggttccagacgagtccaaggtgcatagtctagctggtcaaaagagtgaatccccaagcaaggatttcgggcctaccttgggcctgaagaaatcctcaagtctcgagtccctccagactgccgtggccgaagtaaggaaaaatgatctgcctttccatcggcctaggccccatatggtcagagggaggggctgtaacgagagcttccgggcagccatcgacaaatcctatgatggacccgaagaaattgaagccgacggcttgtctgacaaaagtagccattctggccaaggcgcactgaactgtgagtccgcaccccaaggcaattctgaactggaggatatggaaaataaggctaggaaggttaagaagactaaggaaaaagagaagaaaaaagagaaggggaagctgaaggtgaaggagaaaaaaagaaaagaagagaatgaggatccagagagaaagattaagaagaagggatttggggctatgttacggttcgggaaaaagaaagaggataagggcggaaaggcagaacagaagggaactctcaaacatgggggtctgagagaagaggagttagagaagatgaaggaggagcgagaatccggcaggccaaccggcggtagcaccgatcgaatccaaaagctgcgtaaagagtactaccaggccaggcgcgagggatttcccctgtatgaggacgacgagggcagagccagaccatccgagtacgatcttctctgggtaccagggaggggtcccgatggcaacgcccacaacctgcgcttcgagggtatggaacggcaatatgccagcctgcccagagggggtcctgcggatcccgtggactacttacccgcagccccacgcggactgtataaagagagggagctgccttactaccccggtgcccatcccatgcacccaccaaaagggtcctatcccaggcctaccgagctacgggttgccgacctgcgatatccccagcactacccccctccaccagcaccacaacataagggcccttttaggcaggatgtgcctccttcccctcctcagcatcaaaggatgccagcttaccaggaaactggacggcctggccctcgcggtggttctcccgaccagtatccataccgaacccaggacagtcgtcagaagaatccaatgaccgcggcagtttag

SEQ ID NO: 52688 - DNA, 3411 bp, Artificial Sequence
  Description of Artificial Sequence: Synthetic coding sequence
atgaaggtcactgtgtgctttggtagaaccggaattgttgttccctgcaaagaaggccagctacgggtgggcgagttgacgcaacaggccttgcagagatacctcaagacccgcgaaaaaggccctggatactgggttaaaatccaccacctggagtacaccgacggcggtattctggacccagacgacgttctggcagatgtagtggaagacaaggataagttgatcgcagtgttcgaagagcaggaaccgctgcataaaattgagagtccaagcggtaatcctgccgaccggcaatcaccagacgcctttgagactgaggtggccgctcaactcgccgcatttaagccaatagggggagagatcgaggtcactccgagcgccctcaagctgggaaccccccttctagttcggagatcctcggaccctgtgcccggaccaccagctgacacacaaccttccgcaagtcacccaggcggacagtcgctgaagcttgttgtccccgatagcacccagaacttggaggacagagaggtgctaaacggggtacagacagagctgctgacctcgccccgtaccaaagacacattgtcagacatgacacgcaccgtggaaatctcaggtgaaggtggccctctggggatccatgttgtgccattcttcagcagcctgtcaggtaggatcttgggcctttttatccgcggtatcgaagacaactctagaagtaagagagaggggttatttcacgaaaatgagtgtattgtgaagattaataatgtggacctggtcgacaagacatttgcacaggcccaggacgtgtttcgtcaggccatgaaatcaccttcggttctcctgcacgtgctacctccacagaaccgggagcaatacgaaaaatccgtgataggttcactgaatatattcggtaataacgatggagtgttgaagactaaggtaccgcctcctgtgcacgggaaaagtggcctcaaaactgcgaaccttaccggaacagattcaccagaaacagatgcatccgccagtttacagcagaataagagtcccagggtacctaggctaggcggaaaaccaagcagtccctccctctccccattgatgggattcgggagcaacaaaaacgctaagaaaatcaagatcgatctcaagaaagggcctgaaggactcggcttcaccgttgtcacccgggactctagcattcacggtccaggccctatttttgtcaagaacatactgccaaagggtgccgctattaaagatgggcgacttcaatccggcgatagaatattagaagttaatgggagggacgttacgggacgtacccaggaggagctggtagccatgttacgctcaactaagcaaggcgaaactgcaagcctggtgatcgccagacaagaaggccactttctgcctcgcgaactgaaaggagaaccggactgctgtgcccttagcctggaaacctcagaacagctcacatttgaaattccacttaacgacagcggaagtgccggactgggtgtaagtctgaagggcaataagagcagagagaccgggaccgatcttggcatctttatcaagagtatcattcacggcggagcagcttttaaggacgggagattgagaatgaacgatcagctcatcgccgttaacggagaaagtcttctcggcaaatctaaccatgaggcaatggagaccctccggaggtcgatgtcgatggagggtaatattaggggcatgatccagcttgtgatactgagacgaccagagagacctatggaagacccagcagagtgtggcgctttctccaaaccctgttttgaaaattgtcagaacgccgtgactacctctcgacggaacgacaactcaatccttcatcctttaggtacatgttcccctcaagataaacagaagggcctccttcttccgaatgatggctgggcagagtccgaggtcccgccttcacctacaccccatagtgctctggggctgggcctggaggattattcacactccagcggggtggactcagccgtctactttcccgaccagcacattaattttcgcagcgtcactccagctcggcagccagagtccatcaacctgaaagctagcaagtccatggacctcgtcccggatgagagcaaggtgcattcgctcgctggccagaaatctgacggattgtcagacaaaagctcccactccggtcagggtgctttgaattgcgagtctgcccctcagggcaactccgagctggaagatatggaaaataaggcaagaaaggtcaaaaaaacaaaagagaaagaaaaaaagaaggaaaaagggaagctcaaagttaaggagaaaaagcggaaggaggagaacgaagacccggagagaaaaatcaaaaaaaaaggctttggggctatgctcagatttggtaaaaaaaaggaagacaaagggggtaaggctgaacagaagggaacgctgaagcacggaggcctacgtgaggaagaactagagaaaatgaaggaagagcgggagcgtataggagcgaagcaccaggaactgagagagaagcaagcccgtggtttactggactacgcgactggtgcgatcggaagcgtgtacgacatggatgatgatgaaatggaccctaattacgcaagagtaaaccatttccgcgagccttgcacgtcagccaacgtgtttagaagcccttcccctccacgtgccggaccgtttggctatcctagggacgggcaccctctctcaccagaacgcgatcatcttgagggcctatatgcaaaggtaaacaaaccgtatcaccccctggtgcctgccgatagtgggaggcccacagggggaagcaccgacaggatccagaaactccggaaagaatattatcaggctagacgcgaggggtttcctttatatgaagacgacgagggacgggctcggccatccgaatatgacctgttgtgggtgccgggtcgaggtccagatggaaacgcccacaatctgcggttcgagggaatggaacggcagtacgccagtttacccaggggaggaccagcggaccccgtagactatctgcccgctgcaccacgcggactttacaaagagcgagaactgccatattacccaggcgcacatcctatgcaccctccaaagggcagctatccaagacctacggagctgagagtggccgatctgcgttacccacaacattacccacctccacccgctccgcagcacaaaggccctttccgacaggatgttccaccgtcaccgcctcaacatcagcgcatgcccgcatatcaggagacgggaaggcctggccctcgtggaggaagcccggaccaatacccctaccgcacgcaggactccaggcagaagaatccaatgactgccgctgtctag

SEQ ID NO: 52689 - DNA, 3432 bp, Artificial Sequence
  Description of Artificial Sequence: Synthetic coding sequence
atgaaggtcacagtatgcttcggacgcacaggcatcgtggtgccatgtaaagaggggcagctgcgggtcggggagttaacccagcaggccctgcaaagatatctgaagacacgagaaaaaggccctgggtactgggtgaagatccaccatctagagtataccgacggcggtatcctggatcctgatgatgtcctggctgatgtggttgaggataaggacaagctgatcgccgttttcgaggaacaggaacccctacacaaaatcgaaagtccatccgggaatcctgcagaccggcagtccccagacgcattcgagaccgaagtcgccgcacaattggccgcatttaagccaatcggtggcgagatcgaggtcacaccctctgccctcaaactggggaccccattactcgttcggcgaagctcagaccccgtgccgggacctccagccgacacccaaccaagtgcaagccaccccggaggccagtcacttaagctcgtggtcccagattctacacagaatctcgaggatcgggaagtactgaatggggtgcaaaccgaactgctgacgagcccaagaacaaaggacacactgtccgatatgacccggactgtggagatttctggagaaggcggaccgctgggtatccacgtggtcccgttcttctcatcgctttcaggcaggatactcggtctgttcatccgcggaatcgaggacaacagccgctcgaagagggaaggattgttccacgagaatgagtgcatcgtcaaaattaacaacgtggacctcgtagacaaaacgtttgcccaagcgcaggatgtctttagacaggcaatgaagagcccttcagtgctgttgcacgtcctgccgccacagaatagagagcagtacgagaagtctgtcatcgggagcctcaatattttcggcaacaacgacggcgtgctgaaaaccaaggtgccacctccagttcatggaaaatctggcctcaagacagccaatttaactggtaccgactcccctgaaacggatgcctccgcatctcttcagcaaaataaatcgccaagagtccccaggctaggcggaaaaccgtcaagtccctcactatcccctctgatgggtttcggcagtaataaaaacgcaaagaaaattaagatagatctcaagaagggtccagaagggctcgggttcaccgtggtgacgcgggactccagcatccacggcccaggccctatctttgtgaagaatatactgcccaagggtgcggcaatcaaagacggccgactgcaatcgggcgataggattttggaagtaaatgggagggacgttaccggcaggactcaggaagaactcgtcgcgatgctgcgctcaactaaacagggcgaaactgcgtcactggtgatcgcgaggcaggaaggccacttccttcctcgggagctggacggaaggttgaggatgaacgatcaactgatagctgtgaacggcgagtccttacttggtaagagtaatcatgaggcgatggagacactcaggcgatctatgtctatggaaggaaacattcggggtatgatccagcttgtaatcctccgtaggccagagcggccaatggaggatcccgctgaatgtggcgctttttctaaaccgtgtttcgagaattgtcagaacgctgtcaccactagtcgacggaatgataatagcattctccacccactgggcacttgtagcccccaggacaagcagaaaggtctgctcctccctaatgacggatgggcggagagcgaggtgccaccttctcctactccccactcagcacttggcttgggactggaagattatagccattccagcggggtggacagtgccgtttattttcccgatcagcacataaattttcggagtgtgactcccgcaagacaaccagagagcattaatctcaaggcctcaaagtccatggatttggttcctgatgagtcaaaagtgcactcactggctggccaaaaaagcgagtctccatcgaaggatttcggccctacattaggtctgaagaagtcaagtagcctggaaagcctgcagacggctgttgcagaggtgaggaagaatgatctcccctttcacagacctaggcctcacatggtcaggggaagaggttgcaacgagagctttcgagccgcaatcgacaagtcttatgatgggccagaggaaattgaggcagatggcttatctgataaatcttcacacagtgggcaaggggcactgaactgcgagtcggctcctcagggcaattccgagctggaagacatggagaataaggccaggaaggtcaaaaagaccaaggaaaaggagaagaagaaggagaaaggcaaactgaaagtgaaggagaagaaacggaaggaagagaatgaagaccctgagagaaagattaaaaaaaaaggatttggggctatgcttcgtttcggcaagaagaaagaggataaaggaggcaaagccgagcagaaaggcaccctgaaacacgggggactgcgggaagaggaactcgagaagatgaaagaggagagggagagaatcggcgctaagcaccaggagctgagggagaagcaggcacgaggcttgctcgactacgccactggagctatcggcagtgtgtatgacatggacgacgacgaaatggatccaaactatgcgcgagtgaatcacttccgagaaccttgtacgtcagccaatgtgtttaggagcccttcaccgccaagggcgggacccttcggttatccccgtgacggacaccccctaagccctgagcgggatcatcttgaggggctgtatgctaaagtcaataaaccttatcacccattagtgccagctgactccggccgtcccaccggcggtagtaccgacagaattcagaagcttagaaaagagtactaccaggcacgaagagagggctttcccctgtacgaagacgacgaagggagggcgcgacccagtgagtatgatctcctctgggtgccgggtagaggacctgatggaaacgcccataacctgagatttgaaggaatggaacgccaatacgcctccttgcccaggggtggtcctgccgatcccgtggactacttacccgctgccccaagagggctatataaggaacgggagctgccctattatccaggtgcccacccaatgcaccctcctaaagggtcctaccctcgacccacagaactaagagtggctgacttgaggtatcctcagcattaccccccacctcccgcacctcagcataaagggccattccggcaagatgtgcctccgagtccaccgcagcaccagcgtatgcctgcctaccaagagacaggcaggcctggaccacggggaggttcacccgaccagtacccatatcgaactcaggactcaaggcagaagaatccgatgactgccgcagtgtag

SEQ ID NO: 52690 - DNA, 3618 bp, Artificial Sequence
  Description of Artificial Sequence: Synthetic coding sequence
atgaaagtcaccgtgtgtttcggacggaccgggatcgtcgtgccctgcaaagaggggcagctgagggtgggagaactcacccaacaagccctccagcgatacctgaagactcgagaaaaaggccctggctattgggtcaagatccatcatcttgaatacacagatggcggaatcctcgatcccgatgatgtattagctgacgtggtcgaggacaaggataaactgattgccgtatttgaggagcaggaaccactgcacaaaatcgagtcgccttctggtaatcccgctgataggcagtcccccgatgcctttgagacagaggtggccgcacagctagctgctttcaagcccattgggggtgagatagaggtcacgccttctgcactaaaactgggcactccccttctcgtgaggcgctctagtgatccggtgcctgggccaccagcagatacgcagcccagcgcttcccacccaggagggcagagcttaaagctcgttgtcccagattccactcagaatttggaagatagagaagtcctcaacggagtccaaacggagctgctaacaagcccgaggacaaaagatacattatcagacatgaccagaacggtcgaaatctcgggcgaagggggaccccttggtattcacgtggtaccgtttttcagctcgctctccgggcgtatactgggactgttcatccggggtatagaagataattccaggtccaagcgggagggactcttccatgaaaatgaatgcattgtcaagattaataatgtggatttagttgataaaactttcgctcaggcccaggacgtatttaggcaggccatgaaatcaccgagcgttttgctccacgtgctgccgccacagaacagggagcaatacgagaagagtgttatcgggagtctgaatatattcggcaataacgacggggtgcttaagactaaagtgcctccacctgtgcatgggaagtcaggacttaagaccgcgaacctcacaggcaccgattcccctgagacggatgcatcagcttccctgcagcaaaacaaaagcccccgagtgccccgtcttggtggcaagcccagctccccttctctgtctccactcatgggtttcggatccaataagaacgcaaagaaaatcaagatagacttgaagaaagggccagaaggattgggcttcactgtggtgaccagggactcatctatccacggtcccggacctatctttgtgaagaacatactacctaaaggtgccgcaatcaaggatggacgattacagagcggggatcggatattagaagtgaacggacgagatgtaacaggcaggacacaagaggagctggtagccatgcttcgctccacaaaacagggagagactgcctccctggtgatcgccagacaggagggacactttctgcccagggagctcaaaggcgagccggattgctgcgccctgtccctggagaccagcgaacagctgacatttgaaatccctctcaatgattcaggatcagctggactgggcgtgtctcttaagggtaataagagcagggagaccggtactgacctgggaattttcatcaagagtatcatccacggaggagccgcatttaaggacggtcgcctgcggatgaatgaccaattgatcgctgttaatggggaatctctcctggggaagtcaaatcatgaagcaatggagactctccgacgcagtatgagcatggagggaaacattagggggatgattcagcttgttatactccggagaccagagagacctatggaggatcctgctgaatgcggagccttctctaaaccttgctttgagaactgccagaacgctgttaccacctctcgacggaacgataacagtatcctgcacccactcggaacttgctcccctcaggataaacaaaaggggctgctgctgccaaacgacggctgggccgagtcagaggtgccaccatccccgaccccgcattccgctctgggtctggggctcgaagactattcacactcaagcggagttgatagcgctgtgtacttcccagatcagcatattaactttaggagcgttacccctgcccgtcaaccagagtccattaacctgaaagcctcaaagtctatggacctggttcctgacgaaagcaaggtccactctctcgctggccagaagagcgaatctccaagcaaggacttcggccctacattgggtctgaaaaagtcaagttcgctggaatctcttcagaccgcagtggctgaagtgaggaaaaacgacctacctttccaccggcctaggcctcatatggtcagagggaggggctgcaatgagtctttccgggctgcaatcgacaaatcgtatgacggtcccgaagaaatcgaagctgacggcctttcggacaagagttctcattccggtcagggtgcattgaattgtgaatctgcccctcagggtaattcagagttggaggacatggaaaacaaagccagaaaggttaagaagaccaaagagaaagaaaagaagaaagagaaaggcaagctaaaggtaaaagagaaaaagaggaaggaggagaacgaggaccctgagcgcaaaattaagaaaaaaggcttcggcgcaatgctacgcttcggaaagaagaaggaggacaaaggcggtaaggctgagcaaaagggtacgctaaaacatgggggactgcgcgaagaagagctggagaaaatgaaggaggagcgagaacgcatcggcgctaaacatcaggaactccgagaaaagcaagcccgaggcttgcttgattacgccactggagccatcggtagtgtgtatgatatggatgatgacgagatggaccctaactacgccagagtcaatcactttcgggaaccttgtaccagcgccaatgtgtttcgtagcccttcaccccctagagccggaccatttggctaccccagagatggtcaccctctcagccctgaacgggaccacctcgagggtttatatgcaaaagtcaataaaccttatcacccactcgttccagcagacagcggccgacccaccggcggtagcacagaccggattcaaaagcttcggaaagagtactatcaggcaaggcgtgagggttttcctctatatgaggacgatgaaggcagagcaagaccgagcgagtacgacctgctgtgggtcccaggccgagggccagatgggaacgcccacaatctgaggtttgaaggaatggaacgccagtatgcctcattgcctcggggaggtcccgctgatcctgtagattacctccccgctgctcccagggggctgtataaagaacgggaactaccttactaccccggtgcgcatcccatgcaccctcctaaaggcagttacccaagacccacagagctccgggtggctgacctcagataccctcagcactatcccccaccaccggctcctcagcacaaaggcccatttcggcaggatgtgcccccttcccctcctcagcaccaacgaatgccggcttaccaagagacgggcaggccaggaccacgtggcggtagtcctgaccagtacccctaccgcactcaggattcccgccagaaaaaccctatgacagcagctgtatag

SEQ ID NO: 52691 - DNA, 828 bp, Artificial Sequence
  Description of Artificial Sequence: Synthetic coding sequence
atgccttatgcaaaccaacccaccgtgaggattacagaattaactgacgagaacgtcaagttcatcattgagaatactgacctggccgtggcaaattctattaggagagtattcatcgctgaggtccctatcattgcaattgactgggtgcagatcgatgctaatagtagcgtgttacatgatgagttcattgcgcaccgattgggactgatcccgctcatttcagatgatattgtggataagctccagtactcccgcgattgtacatgtgaggaattctgccctgagtgcagtgttgaattcactctggatgtacgatgcaatgaggaccagacccggcatgtgacatctcgggacttgatttctaattcacctcgagtcatcccagtgactagtcggaaccgggataatgatccaaatgactatgttgagcaggatgatattttaatagttaagctgcgcaaaggccaggagctacgactgcgggcatacgccaaaaaaggctttggaaaggagcacgccaagtggaacccgactgctggtgtagccttcgagtacgacccagataatgccttgaggcatacagtatacccgaagccggaggagtggcctaagtctgagtactctgagcttgatgaagacgaaagccaggcaccgtatgatccaaacggcaagcctgagcgtttctactacaacgtagaatcttgcgggagcttgagaccagagactattgtcctctctgcgctatctggcctgaaaaagaaactgtcagacctgcaaacacagctgagccacgagatacagagtgacgtactgacaattaattag

SEQ ID NO: 52692 - DNA, 1038 bp, Artificial Sequence
  Description of Artificial Sequence: Synthetic coding sequence
atggcccgaccccagcgcacccctgcgcgtagtccggattccatagtcgaggttaaaagcaagtttgatgcagaattccgacgtttcgctctacccagggctagcgtgtccggcttccaggagtttagccgtttgctgcgtgcagtacatcagattcctgggctggatgtcctcctgggctacacagatgctcacggggatcttctccccctgacgaatgatgactcccttcacagagcactcgcttcggggcctcctcccctcagactgctcgtccagaaacgtgaagccgacagtagcggcctcgcattcgcctcaaactctctccaacggagaaagaagggcttactgctgcgtccagtcgcacctctaagaaccagaccaccgcttctaatttcgctgccgcaggatttccggcaggtgagttccgttattgacgtcgatctgctgcccgaaactcaccgccgagtgcggctgcataaacatggctctgatcggcctctaggcttctacattcgtgatggcatgtcagtgcgggtggcgccacagggtctggagcgtgtcccagggattttcatatcccggttagtcagaggtggactagcagaatccaccggcctgcttgccgtgagtgatgagattctcgaggtgaacgggatcgaagtagctggcaagacactggaccaggtgacggacatgatggttgctaattcccataatctgatcgttactgttaagccggctaatcagagaaacaacgtcgtgcggggagccagtggacggcttacggggccacccagcgccggacccggacccgcagagcctgactccgacgacgatagctctgatctggtgatcgagaatagacagcctccttcatccaacggattgtcccagggccctccttgttgggatcttcaccccggttgtcggcaccctggcactagatctagtctgcccagcctcgatgatcaagagcaagcctctagcggatggggaagccgcatccgtggggatgggtccggtttcagcttgtag

SEQ ID NO: 52693 - DNA, 1032 bp, Artificial Sequence
  Description of Artificial Sequence: Synthetic coding sequence
atggaggttctggctgctgagaccacctcacagcaagagcgcctgcaagctatcgccgagaaacgcaaaagacaggcagaaattgaaaacaaacgcaggcagctggaagacgagcggcgtcagctgcagcaccttaagagtaaggctctgagggagagatggctcctagaaggcacgcctagcagtgcatctgagggagatgaggatcttcgtcgacagatgcaggacgacgaacaaaagacgcgtctgctggaagattccgtctctaggctggaaaaagaaatagaggtcttggagagaggcgattcagccccagccacagccaaagagaatgcggctgctcccagtcccgtccgggcaccggctccctctcccgcaaaggaagagaggaagactgaagtggtgatgaacagccagcagacgcctgttggaacaccaaaggacaagcgggtatccaacaccccccttcgcactgtcgacggcagtcccatgatgaaagctgtggtccatgctgtggacggtacggccgaaaatggtattcacccactgagctcttctgaggtcgatgaactaattcataaagccgacgaggtaacgctgagcgaagccggaagtaccgctggggcagcggaaacacggggtgccgttgagggtgccgcacggacaaccccctcaaggcgtgaaataaccggagtgcaggcccagccaggcgaggcgacgtctggaccaccaggtatccagcccggacaagagcctccagttaccatgatcttcatgggataccagaatgtagaagacgaggccgagacaaagaaggtgcttggcctccaggatacaattaccgcagaactggtagtgattgaggacgctgccgaaccgaaggagcccgctcccccaaacggaagcgctgcagagccaccaactgaggccgctagcagggaagaaaatcaagcaggtcctgaggccaccacaagtgatccacaggatctggatatgaaaaagcatagatgcaaatgctgtagcattatgtag

SEQ ID NO: 52694 - DNA, 1164 bp, Artificial Sequence
  Description of Artificial Sequence: Synthetic coding sequence
atggaggtgctggctgccgaaacaacaagccagcaagagcgcctgcaggccattgcggagaagcgaaagcggcaggccgagatcgagaacaagcgtcgtcagctggaagatgagcggcgtcaactgcaacatctaaagtctaaggcacttcgagagaggtggttactggagggaacaccttcatctgcctctgagggagacgaggatcttcggagacagatgcaagacgatgagcagaaaactaggttacttgaggacagcgttagtagactggaaaaggaaattgaagtgctcgaaagaggcgatagtgccccagcaacagccaaggaaaacgctgccgctccttctccggtgcgggctcctgccccatcccccgctaaggaggagcggaagaccgaggtcgtgatgaacagccagcaaacccctgtggggacccccaaggacaagcgcgtctccaatacacctttgaggacagtggatggcagtcctatgatgaaggccgcaatgtactcagtggagatcacagttgagaaagacaaggtgactggagaaaccagggtgctgagctcaaccacactgttgcccaggcagccgttgccgttgggcatcaaggtttatgaagacgagacaaaagtggtgcacgccgtggacggcactgccgagaacggaatacatccactttcatccagcgaagtagacgagttaatacataaggccgatgaagtcacactgtcagaagcagggagtactgcgggagcggctgaaacccggggtgctgtagagggtgccgcaagaacgacacccagtagacgggagattacaggcgtccaggctcagcctggtgaggccacttctgggccacctgggattcagccgggacaggagccccctgttaccatgattttcatgggataccagaatgttgaagatgaagcggaaaccaaaaaagtcctgggcttgcaggatacaatcacagcagaacttgttgtgatcgaggatgccgcagagcccaaagagcctgcaccacctaacgggtcggccgctgagccgccaactgaagccgcaagtagggaggaaaaccaagcaggccctgaagccactacttccgacccgcaggatcttgatatgaagaagcatcggtgcaagtgttgctctattatgtag

SEQ ID NO: 52695 - DNA, 759 bp, Artificial Sequence
  Description of Artificial Sequence: Synthetic coding sequence
atgaacagccaacagacaccagtgggaacgcctaaggataaaagagtgtccaacacacccctccgtaccgtagatggctcaccgatgatgaaagcggcaatgtacagtgttgaaattacggtagaaaaggataaggtcacaggagagaccagagtgttgagtagcaccaccctcctgcccaggcaaccattacccctgggcatcaaagtgtatgaggacgagactaaggtggtgcacgctgtggacgggacagctgagaatggaattcatccactgtcatcgtcagaggtggacgagttgatccataaggccgacgaggtgacgctgtcagaagctgggagtacagccggagcagctgagacccgtggcgcagtcgaaggtgctgctcgaaccacgcccagcagacgggagatcactggcgtgcaagcgcaacccggagaagccacgagtggtcctcctggcatacagcccggacaggaaccccctgtcacgatgatcttcatgggatatcagaacgtggaagacgaagccgaaacgaagaaagtgttggggctgcaggacactatcacggcagaacttgtcgtgatcgaagatgctgcagaacccaaggaaccagcacctcctaacggctctgctgccgagccccctactgaagccgctagcagagaagagaatcaggctggcccagaggcaaccacatctgatcctcaggacctggacatgaagaaacaccgctgcaagtgttgctcaatcatgtag

SEQ ID NO: 52696 - DNA, 1062 bp, Artificial Sequence
  Description of Artificial Sequence: Synthetic coding sequence
atggcaatgacgctcctagaggattggtgcaggggaatggatgtcaattcccaacgtgcgctgctggtatggggcatacctgtgaattgcgatgaggccgagatagaagaaaccttacaagccgcaatgccgcaggtctcctataggatgcttgggcgaatgttctggagggaagagaatgccaaagccgctctgcttgaactgactggcgcagtggactatgccgcaataccgcgagagatgccaggcaagggcggtgtgtggaaggtcctgttcaaacctcccaccagcgacgctgaatttttggagcgccttcacctttttctcgcgagggaaggatggacggtccaagacgttgcaagagtcctcggtttccagaacccaaccccaacccccggacccgaaatgccagccgagatgctgaactatatcctggataacgtgatccagccactcgtggaatccatttggtacaagcggctgaccctgttctccggccgagacataccgggaccaggagaggagacttttgacccttggctggaacacacaaatgaggtgctcgaggagtggcaggtgtcagatgtggagaaacggaggagactgatggagagccttagggggccagcagccgacgtcattaggatcttgaaaagcaacaaccccgcaatcaccacagctgaatgtcttaaggccttggagcaagtgttcggctcagtcgagtcctcgcgcgatgcacagataaaatttctaaatacatatcagaaccctggcgaaaagctgtcagcatacgtgatccgcttggaacctctccttcaaaaagtggtggagaaaggagctattgataaagacaacgtgaaccaggctaggctagaacaagttatcgccggagctaaccactctggagccatcagacggcagttgtggctcactggggctggtgaaggccctgcccctaacctgtttcaacttctggtccagatacgggaagaagaagccaaggaggaggaggaggaagcggaagctacactgctgcagctcggtctggagggtcatttttag

SEQ ID NO: 52697 - DNA, 1782 bp, Artificial Sequence
  Description of Artificial Sequence: Synthetic coding sequence
atgggtacagccaggatcgctccaggactggctctgctgctttgctgtcctgtgctctccagcgcatacgcactggtcgacgcagacgacgtgatgaccaaggaggagcaaattttcctcctgcaccgcgctcaggcccagtgcgaaaagcgcctgaaagaagtcctccagaggcccgcatcaatcatggagtccgataaggggtggacatccgcgtccacttcaggcaaacctcgcaaggacaaggcaagtggaaagttgtaccctgaatcagaagaggataaagaagcaccaacagggtcacggtaccggggtagaccctgcctccccgaatgggaccatattctgtgctggccactgggggcacctggtgaagtggtcgcggtcccatgcccggactatatatatgacttcaatcacaagggccatgcttacaggagatgcgacagaaacggaagctgggagttagtgcctggacataaccgcacatgggctaattattctgagtgcgtgaaattcctgaccaacgaaacaagggagcgtgaggtctttgaccgtctcggaatgatttacaccgtgggctactccgtcagcctcgccagcctgacagtggcagttctgattttagcttattttcgcaggctccactgtactaggaattacatacatatgcacttgttcttatcattcatgctgagggcagtcagcatatttgtgaaagatgctgtcctgtattccggcgctactctcgatgaagcagaaaggctgacagaggaggagttgagagccatagctcaggccccaccccctccggctacagctgccgctggatacgcaggctgtcgtgtggccgttacatttttcctctacttcttggcaacaaactattactggattctagtcgaagggttgtatctgcactctctcatattcatggcttttttctcggagaagaagtacctctggggcttcactgttttcggatgggggctcccagccgttttcgtcgctgtctgggtgagcgtgcgcgcaaccctcgcgaacaccggctgctgggatctgtctagcggtaataaaaagtggatcattcaggtacctatactcgcgtcaattgtgttgaactttatcctattcatcaatatcgtccgagtgctggccaccaagctcagagaaactaacgccggacggtgtgatacccgccagcaatacaggaagctccttaaatccactcttgtgctcatgcctttgttcggagtacactatatcgtctttatggccacaccctatactgaggtaagcggtaccctgtggcaggtacagatgcactatgagatgctttttaattcattccaagggttcttcgtagctatcatctactgcttttgcaacggtgaagttcaggccgagatcaagaagagttggtccagatggacgcttgccctggacttcaagcgaaaggcccgatcgggctctagcagctattcttacggcccaatggtgtcccacacatccgtgactaatgtcgggccacgggtcgggctcggcctgccgctctccccaagactactgcccacggccaccacaaacgggcacccccagctccctggccatgccaagcccggaaccccagctctggagaccctggaaacgactcctcctgctatggccgctccaaaagacgacggattcctgaacggtagttgcagcggcctggacgaagaggcgtccggacccgaacgcccacctgcacttctgcaggaagagtgggaaacggtgatgtag

SEQ ID NO: 52698 - DNA, 1782 bp, Artificial Sequence
  Description of Artificial Sequence: Synthetic coding sequence
atgggcaccgcacgaattgcacctgggcttgccctcctgctgtgctgccccgttctctcttccgcctacgcactcgtggacgctgacgacgtcatgaccaaggaagaacaaatctttttgctgcaccgcgctcaggcgcagtgcgagaaacggttaaaggaggttctccaacggcctgcttcaatcatggagagtgataagggttggacttctgcatccactagcgggaagcccaggaaggataaagcatctggaaaactgtatcccgagtccgaagaagataaggaagcacccacaggctcaagatataggggccgaccatgtctgcctgaatgggaccacattctctgctggcctctcggggcaccaggcgaggtagtggctgtcccctgcccggactacatctatgactttaatcataagggccacgcatacaggagatgcgacaggaacgggagctgggagctcgtgcccggacacaaccggacctgggcaaattactcagaatgcgtcaagttcttaacaaacgagacccgggagagagaagtatttgatcggctcggaatgatttacactgttggctattccgtctctctcgccagcctgacagttgccgttctgatcctggcttactttcgcagactgcactgcactaggaattacattcatatgcatctcttcctgagcttcatgctgcgcgcagtgtccatctttgtgaaagacgctgtcctttacagcggagcaaccctggacgaagccgagcggctcaccgaagaggagctgagggccattgctcaagccccacctccaccggcaaccgcagcagctggatatgcgggttgccgtgtcgccgtcacttttttcctgtactttctggcgacaaactattattggatcttggttgaaggcctttacctgcactccctcatctttatggctttcttctcagagaagaagtacctgtggggcttcaccgtctttgggtggggcctcccggctgttttcgtggctgtgtgggtatccgtgagagctacgctggcaaacacaggatgttgggacctgagctctgggaacaaaaaatggatcatccaggtgcctatacttgcctccatcgtgttaaatttcatattgttcatcaacattgtgagagtccttgccactaagctgcgggagacaaacgctggcagatgtgacactaggcagcaatacaggaagctgctgaaatcgacccttgtcttgatgccgctgttcggtgtacactacattgtgtttatggcgaccccttacaccgaggtgagtggtacattgtggcaggtccaaatgcattatgagatgctgttcaattctttccaggggtttttcgtggctatcatctactgcttctgtaacggagaagtgcaggcagagatcaaaaaaagctggagtagatggacgctggccttggattttaagcggaaggccagaagcggcagtagcagttactcatatggtcccatggtcagccacacctccgtcactaacgtgggccctagggtgggcctgggcctccccctttctccaaggctgctgccaactgccactacgaatggccatccacagcttcccggacatgcaaagcccggtacgcccgcacttgagactttagagacaacaccacccgcaatggcagctccaaaggacgacgggtttctgaacggatcatgcagcgggctggatgaagaggccagcggccctgagcgacccccagccctgttacaggaggagtgggagacagtcatgtag

SEQ ID NO: 52699 - DNA, 1584 bp, Artificial Sequence
  Description of Artificial Sequence: Synthetic coding sequence
atggggacagctaggattgccccaggtttagctctcttactctgctgccccgtgttgtcctcggcgtacgccctagtagacgcagacgatgttatgacgaaggaggagcagatttttttgctgcaccgggcacaagctcagtgcgagaagcgactaaaagaggtgctgcagcggccagcatcaatcatggagtccgacaagggttggacctcagcaagcactagcgggaaaccccgaaaagacaaagcatccgggaagctttacccagaatctgaagaggataaagaggcccctactggaagtaggtataggggtcggccatgcctgccagaatgggatcatattctgtgttggcccctcggagcaccgggagaggtggtggccgtcccttgtcctgattacatttatgattttaaccataagggacacgcataccgacgatgcgatcggaatggatcctgggaactggtacctgggcacaacagaacctgggcaaactactctgagtgtgtgaagttcctcacaaatgagaccagggagcgcgaggtctttgaccgcttgggtatgatatataccgtcggctatagtgttagccttgcctctctgacagtggccgtgctcatactggcctactttaggcgactgcactgtacacggaactatattcatatgcacctgtttctgtcctttatgctgagggccgtttcaatcttcgttaaagatgccgtgttgtactctggggcaactcttgatgaagctgagcggctgaccgaggaggaacttagggccattgctcaggcgccacccccaccagctactgctgctgccggatatgcaggatgtcgcgtggccgtaacattctttctgtattttctggctacaaactactactggatcctcgtggaagggctgtatctccactcgcttatctttatggccttcttttcagaaaagaaatatttatggggattcacagtgttcggttggggactgccagccgtctttgtcgccgtttgggtgtccgtcagggccactctggctaacactggatgctgggatctctcatccggaaataagaaatggatcattcaagtgcctatacttgcaagcatcgtgctcaattttatcctctttattaatatcgtgagggtgctggccacgaagctgcgtgaaacaaacgccggacggtgtgatactcgtcagcagtatagaaaactgctgaagtctactctagtactgatgcccctctttggggtgcattacatagtatttatggctaccccttacaccgaagtttcaggtaccctttggcaagtccagatgcactatgagatgctgtttaatagctttcaaggcttctttgttgccattatctactgcttttgcaacggggaggtgcaggccgaaatcaagaagtcttggagccggtggacactcgctttagactttaaacggaaagccaggtcggggtcaagtagttattcatatggtcctatggtgagtcatacttctgtcacgaacgtggggccaagggttggtctgggactacccttgagccctagactactgccgacagccacctag

SEQ ID NO: 52700 - DNA, 1002 bp, Artificial Sequence
  Description of Artificial Sequence: Synthetic coding sequence
atgggaacagcccgtatcgcccctgggctggcactgctcctgtgctgccccgtgctgagcagcgcctatgctttagtggatgcggatgacgttatgacaaaagaagagcaaatttttctgctgcacagggctcaggcgcagtgtgagaaacggctgaaagaggtgctgcaacgtcctgccagtattatggaatcagacaaggggtggaccagtgcttccacttccggtaaacccagaaaagataaggcctctggaaaactttacccagagtctgaggaggataaagaagcacccacagggtcacggtatcgcggacggccatgtctgcccgagtgggaccatattttgtgctggccactcggcgcacctggcgaggtcgtggctgtaccctgccctgattacatttacgactttaaccacaaggggcatgcatatcgtcggtgtgaccggaacgggagttgggagctcgttcccggacataatcggacttgggccaactactcagagtgtgtcaagttcctgacgaacgagaccagagaaagagaagtctttgaccgtctgggaatgatatatactgttggatacagtgttagccttgcctcactgaccgtggccgttctcatactcgcttactttcgtaggttgcattgcacccggaactatattcacatgcacctgtttctttctttcatgttgagagccgtgtccatcttcgttaaagacgcagtcctgtactctggcgctacacttgacgaggcggagcgtctgacagaagaggagctgagggccattgcccaggctccacctccccctgcaactgctgctgcaggctacgcaggatgtcgagtggccgtgaccttctttttatatttccttgcaacaaactattactggattctggttgaagggctctatttgcattcactcatcttcatggcatttttttctgagaaaaaatatctctgggggttcactgtgtttgggtggggcgctggtacctag

SEQ ID NO: 52701 - DNA, 1782 bp, Artificial Sequence
  Description of Artificial Sequence: Synthetic coding sequence
atgggcactgctcggattgcccctggtctggccctgcttctgtgctgtcccgtgttgtcaagtgcatacgcgctggttgacgcagatgacgttatgacaaaagaagagcagatctttctcctgcacagggcccaggcccagtgtgagaagcgcctgaaggaagttctgcaacgccctgcttcgattatggaaagcgacaaagggtggaccagtgcttcaacttccgggaagccccgtaaagataaggcttcaggaaaactgtaccctgagtcagaggaggataaagaagcgcctaccggctcaagatatcgcggaagaccgtgcctgccagaatgggaccatatcctatgctggcccttgggggctcccggtgaggtggtcgcagtcccgtgccctgactatatctatgattttaatcataagggacacgcgtatcgcagatgcgaccgaaatggtagttgggaattagtgccaggacataatagaacctgggccaattactccgagtgtgttaaattcctcacgaatgaaacacgcgagagagaagtcttcgacaggctcggcatgatatacacagtgggctactccgtttcgctcgcttccctgactgtggctgtgctcattctggcctatttccggaggctgcattgtaccaggaattatatccatatgcacctgttcctgagtttcatgcttagagccgtgtccatcttcgttaaagacgcagtcctatactccggcgctactctggatgaggcagagaggctcaccgaagaagaactccgtgccattgcccaagcaccaccccctccggctactgcggcagccggttacgccggatgccgtgtggctgtaacgttcttcctgtattttcttgccactaattactattggatactggtggaagggttgtacctccactcactgatatttatggcattcttctctgagaagaaatatttgtgggggtttacagtctttgggtggggacttcctgccgtgtttgtggccgtgtgggtgagcgtaagggcgactctcgccaacacagggtgttgggatctttcctccggcaataaaaagtggatcattcaggtgcccatcttagctagtatcgtcctgaacttcattttgttcataaacattgtgcgggtgctggccacaaaacttcgagagaccaatgctggtcggtgcgacaccagacagcagtaccgaaaattgctcaaatcaacgctcgtcctcatgccgctcttcggcgttcattacatagtgtttatggccacgccttacactgaagtgtccgggactctgtggcaagtgcagatgcattatgaaatgctcttcaactcctttcagggattttttgtggctatcatctactgcttttgcaacggggaggtgcaagccgaaatcaagaagtcatggagtcgctggactttggcactggattttaaacggaaagcacggagcggctcgtcttcatacagttatggtcccatggtgtcccatacatccgtgaccaatgtgggacctagggttggcctgggactgcccttatcgccaaggctcctgccaactgccacaacaaatggtcacccacaacttccgggacacgctaagcctggaaccccagccctcgaaacactggagactactccaccagctatggccgcacccaaagacgacggattcctgaatgggtcatgtagtggcttggacgaagaggccagcggaccagagcgacctccagcattgctccaagaagagtgggaaactgttatgtag

SEQ ID NO: 52702 - DNA, 1782 bp, Artificial Sequence
  Description of Artificial Sequence: Synthetic coding sequence
atgggtacggccaggatagctcctggactagctttgctgttatgttgtccggtgttgtctagcgcttacgcacttgttgacgcagacgatgttatgactaaggaagaacagatctttctcctccaccgcgctcaggcccagtgtgaaaagaggctaaaagaggtgttgcagcgcccagcctctatcatggaatcggataaggggtggacgagcgctagcacctccggtaagcctcgtaaggataaagctagtggcaagctctatccggaatcagaggaggataaggaagccccaacaggaagccgataccgcggtcggccttgcctgcccgagtgggaccatatcctatgttggcccctaggcgcacctggcgaggtagtggctgttccttgcccagattatatatacgacttcaaccataagggccacgcatatcgcagatgcgaccgcaatggctcatgggagctggtgcctggtcataacaggacctgggccaactactccgagtgcgtgaaatttctcaccaatgagacccgtgagcgtgaagtgttcgaccgcctcgggatgatttacactgtgggttatagtgtgagcctggccagtttgaccgttgccgtcttgatactcgcctacttcagacgtttacactgcactcgtaattacatacacatgcatctgtttctgtccttcatgctgcgtgctgtgtcaatctttgtcaaagacgccgttctgtactctggtgcaaccctggacgaggctgagcgccttaccgaggaggagctgcgagctatcgcccaggcccctcccccacctgcaactgctgccgctggctatgccggatgtcgggtggcagtgaccttcttcctgtactttcttgcaaccaattattattggatccttgtcgagggactttaccttcatagtttgatctttatggcattcttcagcgagaagaagtacctgtggggctttacagtctttggctggggcttacccgctgtgtttgtggcagtgtgggtatcagtccgcgctacattagctaatactggctgctgggatttgagttcaggaaataaaaagtggatcattcaggtgccgatcctggcgtccatagtcttaaatttcatcctctttattaatattgtaagggtgttggcaaccaagctgagagagacgaacgccggtcggtgtgacacccgtcagcaatacaggaagctgttgaaatcaactcttgtgctgatgccactgttcggagtacattatatcgtctttatggctaccccgtataccgaggtgtcaggaactttatggcaagtgcagatgcattacgagatgctctttaactcattccagggttttttcgtggccatcatctattgtttttgcaacggagaagtgcaggcggagatcaagaagtcctggtcccggtggacgctggcacttgattttaaacgaaaagcacgctctggttctagctcatatagctacggccctatggtctcgcacacaagcgtcacaaatgtggggcctcgggtgggtctggggctgcccctgagtccacggcttttgccaactgctactaccaacgggcacccacagctgccgggacacgcgaaacccggtacgccagccctggaaaccttagaaacgactccaccagcaatggccgctcccaaggatgacggcttcctgaacgggagctgttcaggactagatgaagaggcctcagggccagagcgtcctccagctttgctgcaagaggagtgggagacagtgatgtag

SEQ ID NO: 52703 - DNA, 1653 bp, Artificial Sequence
  Description of Artificial Sequence: Synthetic coding sequence
atggccggtctgggcgcatcgcttcacgtctggggctggctgatgctaggttcttgcctcctcgcgagagcacagctggactcagatggtactattacgatcgaggagcaaattgtgctcgtattgaaagccaaggtccagtgtgagcttaacatcacggcccagttgcaggaaggggagggaaattgttttcctgagtgggatggcctcatttgttggccacgaggaacagtgggcaagatctctgctgtcccgtgtcccccatacatctacgattttaaccataagggcgtggccttcaggcattgtaatcctaatggcacttgggactttatgcactctcttaacaagacatgggccaactacagtgattgcctgcgcttcctgcagccagatattagcattggaaagcaggagtttttcgagcgactgtacgtcatgtatacggtgggatattcaatcagtttcggaagccttgccgttgccattctgatcatagggtactttaggcgtcttcactgtactaggaattatatccatatgcacctcttcgtgagctttatgttgcgtgctacatcaatcttcgtgaaggaccgcgtggtgcacgctcatatcggggtgaaggagcttgaaagcctaatcatgcaggacgacccgcagaatagcattgaagccacctccgttgacaagtctcagtatataggttgtaaaattgccgtcgtcatgtttatctattttctcgccaccaactattactggatcctggtggaagggctgtacctccacaatctgattttcgtggcctttttctccgatactaagtacttgtggggttttattttgattggctggggtttcccagctgcctttgtcgcagcttgggccgttgcccgagccacactggcggatgcaaggtgttgggaactgtccgctggagacatcaaatggatctaccaagcaccaatcctcgccgcaatcgggctcaatttcattctgtttctgaacacagtacgcgtgctcgccacaaagatctgggaaacgaatgccgtgggtcacgacactagaaaacaataccgcaagttagccaagtccactctggtgttagttctcgtgttcggtgtgcactacatcgtgttcgtgtgtctgccgcacagcttcactggactggggtgggaaattagaatgcactgtgagctctttttcaacagtttccaggggttctttgtgtccattatatactgctactgcaacggcgaggtccaagcggaggtgaaaaaaatgtggtcgcgctggaacctctccgtcgactggaaacggacacccccatgtggcagtcgccgatgcgggtccgttctcaccacggtgacccattccacttccagtcagagtcaggtagccgcatcaacccggatggttctcattagcggtaaagcggctaaaatcgcctcgcgtcagccggacagtcacatcacactaccagggtacgtgtggtcaaattccgagcaggattgcttaccacacagttttcatgaggagacaaaagaggattccggaagacagggtgatgatatcttgatggagaagccaagccgtcccatggaaagcaacccagacaccgagggctgccagggagagacagaagacgtgctatag

SEQ ID NO: 52704 - DNA, 345 bp, Artificial Sequence
  Description of Artificial Sequence: Synthetic coding sequence
atgagcgctctctcacttctcatccttgggctactcactgccgtgcctccagccagttgtcagcagggactgggcaaccttcagccatggatgcagggactcatagcggtggcggtcttcttggtgctcgttgccattgcatttgcagtcaatcacttttggtgccaggaagagccagagcctgctcacatgatcctgactgtaggtaacaaggcagacggagtactggtggggacagacggacgctactcctccatggccgcatcttttagatcttctgagcacgagaacgcttacgagaacgttcctgaagaagaagggaaggtccgctctacacccatgtag

SEQ ID NO: 52705 - DNA, 345 bp, Artificial Sequence
  Description of Artificial Sequence: Synthetic coding sequence
atgtctgctctttccttgctaatactgggactcctcactgcagtgccaccggcatcatgtcaacaagggctcggaaatttgcagccctggatgcagggactgattgccgtcgcagttttcctggtactggttgcgatagcctttgccgtgaaccacttctggtgccaagaggaacccgaacccgctcacatgatcttgactgttggcaacaaggctgacggggtacttgtgggaaccgatgggcgatacagttctatggccgcatcctttcgtagctccgaacacgagaacgcatatgaaaatgtgccagaagaggaaggaaaggttagaagcaccccaatgtag

SEQ ID NO: 52706 - DNA, 6810 bp, Artificial Sequence
  Description of Artificial Sequence: Synthetic coding sequence
atgggttctcagactctacagattttgcgacagggcgtttgggccgctcttagcggtgggtggtactatgatccccaccaggccacgttcgtcaatgccttgcacttgtacctgtggttatttctcctcgggctgcctttcaccctgtacatggctttaccaagcaccatgatcattgtcgcagtgtattgcccagtaattgctgccgtgtttatcgtgttgaaaatggtgaattatcgactccatagagcactagatgcgggagaggtggtggacagaaccgccaatgaattcacggatcaacggaccaaggccgagcagggcaactgctctaccaggaggaaggattcaaatggacctagcgaccccggagggggaattgagatgagcgagttcattcgcgaggccacccccccagttggttgttcctctagaaattcatatgctggcttggaccctagcaatcaaattggcagcggaagcagtcgcctggggaccgcggcaaccattaagggagacacggacaccgccaagacatccgacgacatcagcctaagcctgggacagtcctctagcctctgtaaggaaggcagtgaggagcaggacctggccgctgatcgtaagttgttcagactggtctccaacgattctttcattagcattcagcctagcctgtcttcttgtggccaggacctgcctagggacttctccgataaagtaaaccttccctcacataaccaccaccatcacgtagatcagagtttgtcctctgcatgtgataccgaagtcgcctccctggtcccactgcatagtcactcttataggaaagatcataggcccaggggagtgccccgaaccagttcttcagccgttgcattcccagacacttctttgaatgacttccctctttatcaacagcgcagggggctggaccccgtaagcgaactggagtcatcaaagcccctgtctggatcaaaagaaagtctggtggagaattctggcctgtctggggagtttcagcttgctggtgatctgaaaataaacaccagccagcctcccacaaaatctggaaaatcaaagccgttgaaggctgagaagtctatggattcgttgagatctttgagtacgaggtcgtctggttccaccgagtcctactgctccggaaccgatagagacacaaactcaactgttagttcatataagtctgagcagacgagtagtactcacattgaaagcatattgtccgaacatgaagagagtcctaaagccggtacgaaatcgggacggaagaaggagtgctgtgccggtccagaagagaaaaattcctgtgcctcagacaagcggacgtcaagcgagaagatcgcgatggaagcatctaccaacagcggcgttcatgaggctaaagatccaactccctccgatgaaatgcataaccagcggggtctctcgacgagcgcaagcgaggaggcaaacaaaaacccacacgcgaatgagtttaccagccagggggacaggcctcctggaaacactgccgagaataaagaggaaaagtcggataagtccgccgtctctgtggactcaaaggtgcggaaggacgttgggggaaaacagaaagaaggggacgtgcgacctaagagctcatctgtgatccacagaacagcgagtgcacataagagcgggagacgacgaactggcaagaagcgggcaagttcgttcgatagttctcggcatagagattacgtgtgttttcgcggtgtgtcaggcactaagcctcattccgcgattttctgccacgacgaggatagctcagatcagagcgacctctccagagccagctccgtccagagtgctcaccagttcagctctgactccagctcctcaacaacaagtcactcgtgtcagagtcccgagggtcgatacagtgccctgaaaaccaaacacacccataaggaaagaggcaccgatagtgaacacactcataaagctcatctcgtgccagagggaactagcaagaaacgggcaacacggaggacctcttctaccaacagcgcaaaaacccgggctcgagtgctatcactggactctggcactgtcgcttgcctgaacgactctaataggctcatggcccctgagtccatcaaacctctgactacaagtaagtcagacctggaagctaaagagggagaagttctggatgaactttctctcctgggcagggcttctcaattggagacggttacacggagccgtaactctctacctaatcaggtggcatttcctgaaggagaggagcaggatgccgtctcaggagctgcccaggctagcgaagaagcagtctctttcagaagagagagatcgacctttcgcagacaagctgtccgccgtcggcacaatgccggatccaaccccacacccccaacgttattaattggaagcccacttagcttgcaggacgggcagcagggccagcaatccaccgcccaggtcaaggtccaaagcaggccaccaagtcaggccgcagtgctaagcgcctccgccagccttcttgttagaaacggctcggtgcatctcgaagcttctcatgacaacgcatcggctgtggggggaagtagcctgcacgacgagctgggaaagttctcctccactttatatgagacagggggatgcgatatgtccctggtgaacttcgaacccgcagcacggcgagcaagcaatatctgtgacacagattctcacgtgtcatcaagcacatccgtacgcttttatccacatgacgtgctgagtctgccccagatccgcctaaataggttacttactatagatactgacttgcttgagcagcaggacattgatttgtctccggatctggccgcaacctacggccctacagaggaagccgcacaaaaagttaagcactactacaggttttggatactccctcagttgtggataggaatcaattttgatcgactgactctgctagccctcttcgacagaaatcgggagattttagagaacgtattagcagtaatcttggcaatcctagtcgcttttctgggttccatccttcttatccagggtttttttagagacatctgggtcttccagttctgtttagtgatcgcctcatgccagtactccttgctaaaatctgtgcagccagacagttcaagtcccagacacgggcacaatcgtatcatcgcctacagtagaccggtctatttctgtatctgctgcggcctgatctggctgctggattatggcagtaggaaccttacagcaacgaaattcaagctttacgggatcacttttacaaacccgctggtgtttatctccgctcgagacttggtgatcgtgtttactctgtgcttcccgatagtgtttttcatcgggctcctgcctcaagtgaatacgtttgtgatgtatttatgtgagcaactggacatccacatatttggcggtaacgctacaacttcactactggccgctttgtacagcttcatctgcagcattgttgccgtggctctcttgtatggtctctgttatggggctctcaaagacagttgggatggccagcatattccagttttattcagtattttctgtgggcttttagtggccgtttcatatcatttgtcgaggcagagtagcgatccctcagtcctgtttagtttagtacagagtaagatctttcccaaaactgaagaaaagaaccctgaggacccattaagtgaagttaaagaccccctgcccgaaaaactgcggaatagcgtgtcggagagactacagtccgacctggtggtgtgcatcgtgattggcgtcctctacttcgccattcacgtatccacggtgtttactgtcttgcaaccagctttaaaatatgtcctatataccttggtcggctttgtgggcttcgtgacccattacgtgctgccacaggttagaaagcagctgccgtggcattgcttctcccaccccctgttgaaaactctggagtacaatcagtatgaagtgagaaacgcagctaccatgatgtggtttgagaagttacacgtatggctgctcttcgtggagaagaatattatctaccccttaattgtcctgaatgagctgagcagcagtgccgagactattgcttctcccaaaaaactgaacacagaactgggcgcacttatgatcacggtggccggtctgaaactactaagatccagttttagtagccccacataccaatatgtcactgtgatcttcaccgtcctgttctttaaattcgactacgaggcgttctcggagacgatgctcctggaccttttcttcatgtccatactcttcaacaagctgtgggagctcttatacaagcttcaattcgtctatacatacatcgctccctggcagattacttggggaagtgcttttcatgcttttgctcagccctttgcagtgccccactctgcaatgctcttcattcaggccgctgtctccgcctttttctccacacccctcaacccgttcctgggcagcgccatatttataaccagctacgttcggccagtgaaattctgggaacgggactataataccaagagagttgatcactccaatacgagactggcttcccagcttgaccgtaaccctgggacctactgccagcagcgggaggtggaggcaattacggaaggagtggaggaagacgaggggttctgttgttgtgagccaggtcacatccctcatatgctctccttcaacgcagccttctcacagcgatggctggcatgggaggtcatcgtcactaagtacattctcgaggggtactcaattaccgataactcagcggctagcatgctgcaggtattcgatctgcggaaggtcctaacaacttattatgttaaaggcatcatctattacgtgaccacatcatctaaactcgaagaatggctggccaacgagacaatgcaagaggggctcagactgtgcgcagaccgcaactacgtcgatgtagatcctacatttaatcccaacattgacgaggattacgaccaccgtctggccggtatcagtagagaaagtttctgcgtgatttatctgaattggatagaatattgttcctccaggagggcaaagccagtggatgtcgataaagactcttctctcgtgacactgtgctatggattatgtgtcctggggaggagagccttaggcaccgccagccaccacatgtcatctaatctggagtccttcctgtacggactccacgcattgttcaaaggcgatttcagaatttccagtatcagagacgagtggatctttgcggacatggaattgctcaggaaggtcgtggtgccaggcattaggatgagtattaaactacaccaggaccatttcacatccccagatgagtatgatgatccaaccgtgctctacgaggccatcgtctctcacgagaaaaacctggttatcgctcacgagggagaccccgcatggcgatccgccgtgctggcaaatagccctagcttgctggccctacggcatgtcatggatgatggaactaacgaatataaaattatcatgctaaaccgacggtatctgagcttccgcgtcatcaaggtcaataaagaatgtgtccgcggtctatgggcagggcagcaacaggagcttgtgtttttgagaaaccgcaacccagagcggggttccatacagaacgcgaagcaggccctgaggaatatgataaacagcagctgtgatcagcccatcggctatccaatctttgtatcacctctgactaccagctacagcgacagtcatgaacagcttaaggatatactcggcggaccaatctccctgggcaacatccgcaattttatagtaagcacctggcacaggctgcgcaagggttgtggggctggctgcaatagcggagggaatatcgaggactccgatactggtgggggaacctcttgtactggaaacaacgccacgaccgccaataacccccattctaatgtgacccagggctccattggcaatcctggacagggtagcggaacaggcctgcatcccccagttacatcatatcctcctactctggggacatctcacagcagccattctgtgcagagcggcttggtgcggcagtcccccgcacgagctagcgttgcttcccaatcttcttactgctattcctccaggcattcttctttacgtatgagcacgacagggttcgtgccctgccgcaggtcaagtactagccaaatcagtctgcgcaaccttcccagttctatccagtcaagactgtctatggtgaatcagatggagccctccgggcagagcggccttgcttgtgtgcagcatggcttgcccagttcctctagttcttcgcagagtattccggcatgcaagcaccacacacttgtaggattcctcgcgacggaaggagggcagtcgtctgccaccgacgctcagcccggtaacaccctgtccccagcaaataactcacattcacggaaggcagaggtgatctaccgcgtgcagattgtagatcccagccagatcctggagggaatcaacctgtctaagcgcaaagaattacaatggcctgacgaaggcattcgtctgaaagctggacgtaacagttggaaggactggtcccctcaggagggtatggaaggccacgtgatccaccgctgggtgccttgttcccgagaccctgggacgaggtctcacatcgataaggctgtcctgctggtgcagattgacgacaaatatgttacagtcatcgagacaggggtgctcgaactgggggcagaagtataa

SEQ ID NO: 52707 - DNA, 7025 bp, Artificial Sequence
  Description of Artificial Sequence: Synthetic coding sequence
atgggcagtcagactctgcagatactgaggcagggcgtctgggccgctctatccggcggatggtattacgacccccaccaggccacattcgtgaatgctctccacctctatctctggcttttcttgttagggctgccttttaccctctacatggcactgcctagcaccatgattattgttgcggtgtattgtccagtcatcgctgcagtttttatagtgctcaagatggtaaattataggttgcatagagcgctggatgccggagaggttgtcgatcgcactgctaatgagttcaccgaccagcggaccaaggctgagcagggcaattgtagcacaagaaggaaggattctaacggtcctagcgaccctggtggcggaatcgagatgtccgaatttatccgcgaagcaacaccacccgtgggatgttcgagcaggaactcatacgcaggcctcgatccctccaaccagataggtagtgggtctagccgccttggcaccgccgctactattaagggggacaccgacacagccaagacgagcgatgatatttctttgtccttaggacaatcatccagcctttgtaaggagggctctgaagaacaggacttggccgctgataggaagctgttcaggttggtatctaatgattcctttatctccatccaaccatccctgtctagttgtggccaggatctgccaagagacttttctgacaaggtgaatctgcctagtcacaaccaccaccaccatgtggaccagagtctgtcttcagcctgcgacacagaggtcgcctccctcgtccccctccatagccactcttaccgcaaagaccaccgcccacggggtgtgcctagaacttcaagctcagcagtggcatttcctgacactagtctcaacgatttcccactgtatcagcaacgaagaggcctcgatcccgtcagtgagctcgagtcgagcaagcctctgtcaggcagcaaggagagcttagtcgagaacagtggcctgtctggagaattccaactggctggcgatcttaaaatcaacaccagccaacccccaactaaaagtggaaaatccaagccactgaaggcagagaagagcatggatagtctgcgctctctgtccactagatcctcgggttcaaccgagagttattgtagtggcaccgaccgggacacaaactcaaccgtttcttcttacaagtccgagcagacttcttctacacacattgagagcatcttgagtgagcatgaggagagtcccaaggcgggtacaaagtccggcaggaagaaagaatgctgtgcgggaccggaggagaagaattcttgcgcgagtgacaagaggacttcgagcgaaaagatcgcgatggaagcttccactaactccggtgtgcacgaggccaaggacccaacaccaagtgacgagatgcacaaccagcggggtctgtcaacctcagcctctgaagaagccaacaagaatccacacgctaatgagttcaccagccagggcgacaggccgccagggaacaccgcggagaacaaagaggaaaaatccgacaagtcagcggttagcgtcgactctaaagtaaggaaggatgttggcggaaagcagaaggagggcgacgttaggcccaaatcttcctctgtgattcatcggacggccagcgcacacaaaagtgggaggcgtcggacaggtaagaaacgcgctagtagttttgactcaagtaggcacagggattacgtctgctttagaggggtttccggcacgaagccgcactccgcaattttttgtcacgatgaggactcctccgaccaatccgatctgtcacgagcctcctccgtccagtctgcacatcagttttcttccgacagctcttccagcactacatcgcactcttgccagtcgccagaaggcagatactcagcccttaaaaccaaacatacacataaggagcgaggcactgactctgagcatactcacaaagctcacctcgtacctgaaggcaccagcaaaaaacgagcgacgcgtcgtacttcttctactaattccgcgaagacccgggcaagggtactgagtttggactccggcaccgttgcttgcttaaacgactccaaccgtctgatggcccctgagtctatcaagcccctgacgacttccaagtccgacctggaggcaaaggagggggaggtcttggatgagctttcgctactaggcagggcctctcagttggagacggtcacccgcagcagaaactcactgcctaatcaggtcgcctttccagagggagaggaacaggatgctgtctccggagcagcacaggctagcgaggaggccgtgtcctttcggagagaaaggtccaccttccggaggcaggctgtccgacgcagacataacgccggaagcaacccgaccccaccaactttgctaataggctcccctctcagcctgcaggatggccagcagggacaacagagcacggctcaggtgaaagttcagtcgcgtcctccctctcaggcagcagtgctgagcgcctctgcatccctgctggtgaggaacggcagcgttcacctcgaagcttcccatgacaacgctagcgcggtgggcggttcttcattacacgacgagctgggcaagttcagtagcaccctctacgagacaggtgggtgcgatatgtcactcgtaaattttgagcccgcagctcgacgtgcgtccaatatctgcgatactgattcgcacgtctcctcttccacctctgtaagattttaccctcacgatgtgctcagtctcccacaaattcgccttaatcggttgctgacaatcgacacagatctgctcgagcaacaggatattgacctgtctcccgacctggccgctacctacggaccaacagaggaggcagcccagaaggtgaaacactactatagattttggatattgccccaattgtggatcgggataaatttcgaccggctgaccttgctcgccctttttgaccggaaccgagaaatactggaaaatgtgctcgccgtaattctggccatattggtggctttcctgggctccatcttgctgatccagggcttttttcgggatatctgggtgttccagttttgcttggtgatcgctagctgccagtactccctgctgaaatcggttcagcccgacagctcctcacccaggcacgggcacaaccgcattattgcctacagtcgtcccgtgtatttttgtatttgttgcgggctaatatggctgctcgattatggaagtagaaatctcaccgcaactaagttcaagttgtacggtattacttttacaaaccccttagtgtttatctcagccagagatttagtgatagtgtttaccttgtgcttccccattgtattcttcatcggtctgctgccgcaagtgaacacttttgtaatgtacctttgtgaacagctggatatccacatttttggtgggaacgccacgacctctctgctggcagccttgtacagctttatatgctcgatcgtagccgtcgctttgctctacgggctgtgctacggcgctctcaaggactcttgggacggccagcacatccccgtattattcagcattttctgtggactgttagttgctgtgagctaccatctgtcccggcagtcttccgacccttccgtgctgttctccctggtccagagcaagatcttccctaagaccgaggaaaagaaccctgaagatcccctgtctgaagtgaaagatccactgccggagaaacttcgcaatagcgttagcgaaagactccaatccgacttagtcgtatgtatagttattggcgtgctgtatttcgcaatccacgttagtacagtttttaccgtgcttcagccagccctgaaatacgtcttgtacaccctagtaggtttcgtcggcttcgtgacacattatgttttgccacaagtgaggaaacaattaccttggcactgctttagccaccctctcctgaaaaccctcgagtataaccagtacgaagtgcggaatgccgcaactatgatgtggtttgagaagctgcacgtgtggctgctgtttgtggagaagaacatcatttatcccctcattgtcttgaacgagctcagttctagtgctgagacaatcgcctcacccaaaaagctcaacaccgaactaggagcactaatgatcactgtggccggtttaaaactactccggtctagctttagctctccgacatatcaatacgtcactgttatcttcacagttttatttttcaagttcgactacgaagccttctccgagaccatgctgctggacctgttctttatgtcaatcctttttaacaagctatgggagctgttgtacaaactccaatttgtctacacgtacatagcgccttggcagattacctggggatcagcgttccacgccttcgcgcagccctttgctgtccctcattccgccatgctttttatacaagccgctgttagcgcattcttctccacacctcttaatccttttctgggcagcgcaatttttatcacatcttacgtccggcctgtcaagttttgggaaagagattacaatacgaaaagggtggatcattcaaatacacggctggctagccagctcgacaggaatcccggatcggacgacaacaacttgaattcaattttttacgagcacctgactcggagcctgcagcattccctgtgtggcgacctgctgctagggagatggggtaactactctacaggagattgcttcatcctcgctagcgattacctgaacgctcttgtgcacctgatcgaaatcggcaatggcctggtgacatttcagctgcgaggattagagttccggggtacatactgtcagcagagagaagtggaagctatcactgaaggagtggaggaggacgagggtttttgctgttgtgagcccggtcacattccacatatgctctctttcaatgcggcattctctcagcgatggttggcctgggaggtcatcgtgaccaaatatatccttgagggctactctattaccgacaattccgccgcttcaatgctgcaggtgtttgacctccggaaggtcctgacaacatactatgtgaaaggcattatctactatgtgaccacctcatccaagctggaggagtggctggctaatgaaaccatgcaggagggacttcggctctgcgctgatcgcaactacgtcgacgtcgatccgacctttaaccccaacattgacgaggactacgaccacaggctggccggtataagccgtgagtccttttgcgtcatctacctcaattggattgaatactgctcctctaggagggccaagccagtggacgtagacaaggactcatccctcgttaccctttgttacgggttgtgtgtgttaggccgtcgcgcactcggcaccgcaagtcatcatatgagttcaaatcttgagtctttcttgtatggcctgcatgcacttttcaaaggtgacttcagaatcagctctattagggatgaatggatttttgccgacatggaactgttacgaaaggtggtcgtgcctggcatacgaatgtcaattaagctgcatcaggaccactttacctcgcccgacgaatacgacgatccaaccgtcctgtacgaagccattgtgagccatgagaaaaacctggtgatcgctcatgaaggggatccagcctggcgttcagcagtcctggcaaactcgccttctctcctggctcttcggcacgtgatggatgacggcacaaacgagtacaagataattatgctgaataggcggtatctgtcctttagggtcataaaggtaaataaggagtgcgtgcggggactttgggcaggccaacagcaggagcttgtgtttctgcgcaatcggaaccccgaaaggggctccattcagaacgctaaacaggccctgagaaacatgataaattcctcctgtgaccaacccatcggctaccctatcttcgtctcacccctgaccacttcttactctgactcccatgagcagttgaaggatattcttggcggaccaatctcgctgggcaacatcaggaactttattgtgagcacttggcacagattgaggaaggggtgcggggctggctgtaatagcggagggaacatcgaggattctgatactggcggtgggacctcgtgcaccggcaataacgcaaccactgctaacaatccccactctaacgttacccagggttcaatcggcaaccctggccagggttccgggactggcttgcatccaccggtgaccagctacccgcctactttggggacgtcacatagtagccactccgtgcagtccggtctggtaagacagagtcctgccagagcctcagtggcctcgcagagctcatattgctactcctcccgacacagctcgctgcgaatgagcacaaccgggttcgtcccttgtagacggagtagcacaagccagatatccttaaggaacttaccgagctcaattcagtcacgactgtctatggtcaaccagatggaaccatctggccagagtggtttggcatgtgtacagcatgggctgcccagttcatcctccagttctcaatccatacccgcttgcaaacatcacacactagtggggttcctggccactgagggcggacagagctctgcaacagacgcccagccagggaataccctctctccagcgaacaacagccacagtcgtaaggcagaagtgatatacagggtacagattgtggaccccagtcagatccttgaagggatcaacttgtcgaaacgtaaggaacttcagtggccagatgaagggatcagactgaaggcaggccgaaactcctggaaagattggtcacctcaggagggtatggaaggacatgtgatacaccgttgggtgccctgctcaagggatcccggtactagaagccatatcgacaaggctgtactgctggtccagattgacgacaagtacgtcacagtgatagagacaggggtgcttgaactcggggcagaagtcta

SEQ ID NO: 52708 - DNA, 6692 bp, Artificial Sequence
  Description of Artificial Sequence: Synthetic coding sequence
atgggctctcagacactccagattctgcgacagggcgtttgggccgctctcagtggtggatggtattacgatcctcaccaagctacgttcgtgaacgcattgcatctttacctatggctattcctcttggggttaccttttacactgtatatggcgttgcctagcactatgattatcgtggccgtttactgccccgttatcgcagctgtctttatcgttttgaaaatggtcaattatcgacttcaccgggcactggatgccggtgaggtcgtcgacaggacagccaacgagttcacggaccagcgcaccaaagccgagcaggggaattgttcaacaagaaggaaagactccaacggcccttctgatcccggtggaggaatcgagatgtccgagttcatcagggaagctaccccacctgtaggctgtagctcgcgcaacagctacgcgggactggacccttccaaccagatcggctcgggatcttctaggctgggcacagcagccacaataaaaggtgatacggataccgccaagactagtgacgatatcagcctttccctgggacagtcatctagcttgtgtaaggagggcagtgaagagcaggacctggccgcagaccggaagttgtttaggctggtgtccaacgactcttttatctccatccaaccttctctgagcagctgcggccaggacctccctagagattttagtgataaggttaacttgccgagtcacaatcaccaccatcacgtggatcaatctctgagttctgcctgtgacacagaggtggcctcactggtgccactccacagtcattcttacagaaaagaccacagaccacgaggagttccgaggacatctagctccgccgtggcgtttccggacacttccctcaacgactttccactgtaccagcaacggagaggcctggaccctgtgtccgaattagagtcctcgaagcccctgagtggaagtaaggagtctctagtggagaactccggcttaagcggagagtttcagttggccggagatttaaagatcaacacctctcaacctccgaccaagtctggtaagagtaaacctcttaaggccgagaagtctatggatagcttgcgaagcctctctacccggtcctccggttctacagagagctactgctcggggaccgatcgtgacacaaacagcaccgtctccagttataaaagtgaacagacttcatccacacacatcgagagcattctgagcgaacacgaagaaagcccgaaagccggtaccaagtcagggaggaagaaggagtgttgtgccggaccagaggagaagaattcatgcgcctccgataagcgtacaagctccgagaagatagctatggaggcttcgaccaactccggcgtgcacgaagcaaaggaccccaccccttcagacgagatgcacaatcagagaggcctgtctacctccgcctctgaggaagcaaacaaaaatccccacgccaatgagtttacctctcagggcgacagaccacctggcaacacggcggagaacaaggaggagaagagcgataagtctgccgtgagtgtggacagcaaggtgaggaaagatgtcggagggaagcagaaggagggtgacgtgcgcccaaaatccagctccgtcatacaccggaccgccagtgcccacaagtccgggcgtcggaggacaggcaaaaagcgggcttccagctttgattcttcccgtcaccgagattacgtttgcttcagaggcgtgtccggtacaaagcctcatagcgcaattttctgtcatgatgaggattcttctgaccagagcgacctgtctcgcgcatcttctgttcagtctgcccatcagttctcatcggattcctctagctccaccacctcacacagttgccagagtcctgaaggcaggtacagtgctttgaagacaaagcacacgcacaaggagcggggaaccgattcggaacacacacacaaagctcaccttgtgccagaagggaccagcaagaagcgggcaacacggcgtaccagctcaactaattcggccaagacccgcgcacgggttctttctttagatagcgggactgtggcttgcctcaacgattctaaccgacttatggcgcctgagagcatcaagcctctgacgacctctaagagcgaccttgaggcaaaagaaggcgaagtgctggacgagttgagcttgctaggtagggccagccaactcgaaacagtcactagatctagaaattccttgccaaatcaggttgcctttccagaaggagaggaacaggacgctgtaagtggaggaaagttttcttcaaccctgtacgagactggagggtgcgacatgtctctggtcaactttgagccagccgctcgtagggcatccaacatatgcgacaccgattctcacgtgagtagttcaacctctgttcgattttatccccatgatgtcatccgacttaatagactgctgactattgataccgatctgctagaacagcaggacattgatttgtctccagatctggccgctacgtacggaccgacagaagaagccgctcagaaggttaagcactactatcggttttggattttgccccaactgtggataggcattaactttgatcgcctgacattgctggcactcttcgatcgtaatcgagagattctggagaacgtccttgcagtgattctggccattctcgtggcttttctcggatcgattctgcttatccaaggcttttttcgagacatctgggtgtttcagttttgtctggtcatcgccagctgtcagtatagcctgctaaagtctgttcagccagacagttcttctccaaggcacggccataataggataatcgcttactcacgacctgtttacttctgcatatgctgtgggctgatatggctcctcgattacggcagccgcaacctgacagcaaccaagttcaaactctatggcattacttttacaaaccccttagtgtttatctccgccagagacctggttatcgtgttcacgttgtgcttccctatagtgttctttattggactgcttccccaggtgaacaccttcgttatgtatttgtgcgagcaactggatattcatatttttggcggaaatgcaacgacatcactacttgcagcactatatagcttcatatgctcaattgtcgctgtggccctgttatacggcctctgttacggcgctttaaaagatagttgggacgggcagcatattccggtgctcttctccattttctgcggcctcctcgttgctgtgtcttatcatctgagccgtcagtctagcgatccctcagtgctcttcagtctagttcagtctaagatattcccaaaaacagaggagaaaaaccctgaagatccactgagcgaagtcaaggatcctctgcctgagaagttgcgtaactctgtgtccgagagactgcagtccgacctcgttgtgtgcatcgttatcggcgtcctctattttgcaattcacgtgtccacagttttcacagtgcttcagcccgctctgaaatacgttttgtacaccctcgtcggttttgtcgggttcgtcacccactacgtactgccccaggtccggaagcagctgccgtggcattgtttttctcacccgctcctcaagactcttgagtataaccagtacgaggtaaggaatgctgcaaccatgatgtggttcgagaagctgcacgtgtggttgctgtttgtcgagaaaaatataatttacccgctgatcgtgctgaatgaattgtcttcaagcgccgagactattgcgtccccaaagaagcttaacaccgaactgggagctctgatgatcaccgttgccggactgaaattgctcaggtcaagttttagttctccaacctatcagtatgtaacagtgatctttacggtgctgttcttcaagttcgactacgaggccttctccgagaccatgctcctggatctcttcttcatgtcaatactttttaataagctttgggagcttttatataagctccagttcgtatatacatacatcgcaccctggcagattacctggggctctgccttccacgctttcgcgcagcccttcgccgtgccacatagcgccatgctgtttattcaagccgcagtgtctgcctttttttccactccccttaatccctttctgggatccgctatcttcatcacttcatatgtacgccctgtcaaattttgggaaagagactacaacactaagcgcgtggaccacagtaatacacggctggcttcccaactcgatcggaaccctggcagcgatgacaacaacctgaatagcatattctatgagcaccttacaagatcattacaacattcactgtgcggcgacctcctattaggcaggtggggcaactacagtactggtgactgctttattctcgctagcgactatctgaacgctttggtgcacctgatagaaataggcaacggactcgtgacttttcagctccgaggcctggagtttagaggaacatactgtcagcaacgagaggtggaggctattactgagggggtcgaagaggatgagggcttctgttgttgtgagccgggtcatatcccacatatgctctccttcaatgccgctttctctcagcggtggcttgcctgggaggtgattgttaccaagtatattctcgaaggatatagtatcactgacaacagcgctgctagcatgctgcaagtgtttgacctccgtaaagtgttgactacctactatgttaaaggaattatttactacgtgactacatcttccaaactcgaagaatggctggccaacgaaaccatgcaggaggggctgcggttatgcgccgaccggaattatgtcgatgtggatccaactttcaatcccaacatcgacgaggattatgatcaccgtctggccggaatctcccgagagtccttctgcgtcatatacttgaactggatcgagtactgtagctctcggcgagccaagcctgtagacgtggacaaagacagctccctcgtgaccttatgctacgggttgtgcgtgctgggcaggcgggcactcggcacagcatcacaccatatgagctctaatctcgagtcctttctgtacggtcttcacgctctgttcaagggagattttagaatctctagcattcgcgacgaatggatctttgccgatatggaactacttaggaaagtcgttgtacctggaatcagaatgagtatcaagcttcaccaggatcattttacttctcccgacgagtacgacgatcccacggtgctctatgaggccatcgtatctcatgagaaaaatctggtgattgcgcacgagggggatcccgcttggcgcagtgccgtgctggccaacagcccttccttgctcgctttgcgccacgttatggatgatggaactaacgaatataagattatcatgttgaaccggcgttatctctcgttccgcgttatcaaagtgaacaaggagtgtgtgcgaggactctgggctggacagcagcaagagctcgtgttcctgcgaaacagaaatccagaaaggggctccatccaaaatgctaaacaggccctgcggaatatgattaactcatcttgtgatcagcccattgggtacccgatttttgtgtctcccctgacgaccagttattccgattcacatgagcagctgaaagatattctaggtggccctatctcactggggaacatccggaacttcattgtgtctacatggcatcggcttcgtaagggttgcggggctggttgtaattccggcggtaatattgaggacagtgacaccggcggtggcacctcctgtaccgggaacaacgccactacagcgaacaacccacacagcaacgtgacgcagggcagtattggtaatccagggcaagggtccgggactggccttcatcccccagtaacttcttaccctccaactcttggaacctcgcacagctcacactctgtgcaaagtggcctggtgcgccagagcccagcacgggcatcggtggcctcccagagcagctattgctattctagccgacactcatccctgcgcatgtccaccaccggattcgtgccatgccggcgttcaagcaccagtcagatcagccttcgcaatctaccgagctccattcagtcacgactgtccatggtgaaccagatggaaccctccgggcagagtggactggcctgcgtacagcacggcttaccctcttcttcttctagttctcaatccatacctgcctgcaaacaccacacactggtgggttttctggccacagaggggggacagtcatccgccacggacgcccaacccggtaacacgctctctccggcaaataactctcatagcagaaaagcagaggtgatatatcgcgtacagatcgtcgatccctcccagatcctcgaaggaataaatctgtctaagagaaaagaactgcagtggccagatgagggaattagactgaaggcagggcgtaacagttggaaagattggagtccccaggagggcatggagggtcacgtcatccacaggtgggtgccatgtagccgggatcccggaacaaggtctcatatagataaggccgtcctgttggtccagattgacgacaagtacgtgacagtaatagagactggggttctggagctcggagctgaggttta

SEQ ID NO: 52709 - DNA, 3987 bp, Artificial Sequence
  Description of Artificial Sequence: Synthetic coding sequence
tgagacctattggaacagcaggacatcgacctttctccagatctcgccgctacatacggccctaccgaagaggccgctcagaaggtgaagcactattatagattttggattctcccgcagctgtggatcggaatcaacttcgatagattgacactcctggctttgtttgatcggaacagagagatattagaaaacgtactcgccgtgatccttgctatcttggtggctttcctgggctcgattctgctcattcagggtttttttcgcgacatctgggtattccagttttgcctggtcatagctagctgtcagtacagtctgctgaagtcagtacaacccgacagcagtagccctcgccacggccataatcgtatcatagcatatagtaggccagtgtacttttgtatttgctgcggactgatatggctgctggattatggatcccggaatctaactgcgaccaagtttaaactgtacggcatcacctttacaaatcccctggtgttcatatctgctcgcgacctcgtaatcgtcttcacgctttgcttcccgattgtattcttcatcgggttgcttcctcaggtaaacactttcgtgatgtatctgtgcgagcaattggacatccacatctttgggggaaacgccactacatcactcctcgctgctctgtattcatttatctgttcaatcgtggccgtagccctgctgtacgggttgtgctatggcgctttaaaggatagctgggatgggcagcatatccctgtgctgtttagcatattttgtggacttttagttgctgtatcctaccacctgtcccgccagagcagcgacccaagcgtgctgtttagcctggtgcagagcaagatattcccgaaaactgaggagaagaacccggaggatccactcagcgaggtcaaagatcccttgcccgagaaactcaggaattccgtgagcgagcggttgcagagtgacctagtagtgtgtattgttatcggagttctctacttcgctatccacgtatccactgtcttcaccgtcttgcagcccgcactgaaatatgtcctatataccctcgtgggctttgtggggtttgttacacattatgtcctaccacaggtgcgcaagcagctcccatggcattgcttttcgcacccactgttgaaaacacttgagtacaatcagtacgaggttagaaatgccgctacaatgatgtggttcgaaaaactacacgtgtggttgttgtttgtggaaaaaaatatcatttatccgcttattgtactgaatgagcttagctcctctgctgaaaccattgcctctccgaagaagctcaatacggagctcggagcattgatgattaccgttgctgggctaaaactcctgaggagctcattctcctcgccaacttaccagtacgttaccgtgatcttcacagtgctgttctttaagtttgattatgaagcatttagcgaaacaatgcttctcgatctgtttttcatgagtatcctgttcaataagctgtgggagcttctgtataagctgcagttcgtctacacatatattgctccatggcaaattacctggggctccgcctttcacgcttttgcgcagccattcgccgtccctcattccgcaatgcttttcatacaagcagctgtctcggcttttttcagtactcctctaaatccattcctgggttccgctatctttatcacctcttacgtacggccagtaaaattctgggagcgagactacaacaccaagcgggtggatcactccaatacgaggttggcatcacaactggaccggaaccccggaacctattgccaacaacgggaggtggaagcaatcactgagggcgtggaagaggatgaaggattttgctgctgtgagccgggacacataccacacatgctgtcgttcaatgccgctttttcccaacgctggctagcatgggaggttatcgtaacaaagtacatcctggaaggatattccatcaccgacaattcagctgcttcaatgctgcaggtttttgatcttcgaaaggtgcttacaacatattacgtcaaaggtattatctactatgtgaccacgtctagcaaactggaagagtggctcgcaaatgagacaatgcaggagggtttacgtctgtgcgccgatcggaattatgtagatgttgacccaacgttcaaccccaacattgacgaggattatgaccaccgactggccggaattagtcgcgaatccttttgtgttatctatctcaattggatcgaatactgttcatcaaggcgggctaagccggtggacgtcgacaaggattctagcctagtgaccctgtgctacggcctgtgtgtgctgggacgcagagcattggggactgcttcacatcatatgagtagcaacctggaatctttcctgtacggactacacgcactgttcaaaggcgacttccgcatttcatccatccgggacgaatggatctttgcagatatggagctgcttcggaaggtcgtggtgcccggtattagaatgtccattaagctacaccaggatcacttcacctctcctgatgagtatgacgaccctacagtgttatatgaagccatcgtgagtcacgagaaaaacctggtaatcgcccatgaaggagatccggcatggcggagcgctgttcttgccaactcgcccagcctgctggctctacgacacgtgatggatgacggtacgaacgaatacaaaatcataatgttgaaccgcagatatctcagcttcagagtgattaaggttaacaaggaatgtgttcgtgggctctgggcaggacagcaacaagagcttgtatttctgcggaaccgtaatccagaaagagggtcaattcagaatgccaaacaggccctgcgcaatatgataaacagctcatgtgaccaacccattggctacccgattttcgttagccctctgacgacttcctacagtgacagccatgagcaactgaaagatattttaggcggtcctatcagccttgggaacataagaaactttatcgtgtccacttggcacagactacgcaagggctgcggggcaggctgcaactcaggtggcaacattgaggatagcgataccgggggaggaacaagctgcactggaaacaacgctactacagctaacaaccctcactccaacgtaactcagggatcaattggaaaccccggtcaaggttctggaacaggtctgcatccccctgtgactagttatccccctaccctgggcacatcacatagttcacattctgtgcagtcaggccttgtccgtcagagccctgcccgagcatccgtcgctagtcagagcagttattgctatagctcccggcactcctccctgaggatgagcacaactggatttgtgccttgtcggagatcctccacgtcccagatcagtttgagaaacctgcccagtagcatccagtcaagactttcaatggtgaaccagatggaacccagtgggcagtccggtctggcatgcgtgcaacatgggctgccgtctagcagctcctcgtctcaaagtatccctgcctgtaagcaccataccctcgttggattcctggccaccgaaggcggacagtctagcgcaaccgatgcccagcctggcaacacccttagcccggctaacaattcacacagtaggaaagcggaagtgatttaccgggtgcagatagtggaccccagtcaaatcctggagggcatcaacctgagcaagaggaaagagctgcagtggccagatgaagggatccgactgaaagcagggcgaaatagctggaaagactggtcaccacaggaaggcatggagggacatgtcatccacagatgggtcccctgcagtagagaccccggtactcggtctcacattgacaaggccgttctgctggtccagattgatgataagtatgttaccgtgattgagacaggtgtgctcgagctcggagccgaagtatag

SEQ ID NO: 52710 - DNA, 6414 bp, Artificial Sequence
  Description of Artificial Sequence: Synthetic coding sequence
atggtctcacaagtcctgcagctcctgaggcagggggtgtgggcggcactgaccgggggatggtaccacgaccccgaacaaagcaaattcactaatagttgtcacttatacctttggctttttctcctgctcctgcctctggctctccacctggcctttcctcccaacgccatcatagtcttcttttactgctccgccgtgactatctttttcaccatcataaagctcgtcagttatcggctgcatctgatgttcgataagggggaggtcattcaacaaaagccatcacggaaagaggaaaaaccgaataaggacaaggaggctaagggagaacacataaccaaccaccggaaccctagcaacaaccgacaaatccacaatggcaagaaggaggaggcgtcacgaaacctatcgacacccccattacggtgctcaagtcgaggacagagcatcacatcccaccacagctcagggcctctcgagttgtccgcccaggaaaccgtcgaggacctgaaaggggtgatcctgctcgaagaccaccccatcgctcccgtttcaagtacctcccccggaatcaaagtagagagcctgccagccagccaggcccatatgttggaaaccaccactaaatcagttatcccagtgaagccagttgcgactgagacactgatcaacggtaagggtaaggagcgtggcggaaaagggcagcctcctcttcgccacaggtctgagggcggactggtcgacaaaggcccactgaagaagctgcctcacctctccctctcgcagtacgacctgttagagacagacgtcagctttcagccatggggctcagaaaattccgtgctcatccctgagcctgttagttgccccagaggaagtattcgcgaacgcgtccagtccaagtccccacaggattcactcagcagctcgtgtccccagtgcgacaccatcgtggcgaagcctgtcgaagaacccgcagacacatcctgtcaggttgatacctcctgccagggggacctccccctgcaccaggaagttgattctagcgatagtgaggtcgctgtgactttgattgacacctctcagcccggagaccccttgtccctgcacgagcccattaagatcgtgatcaccatgagttccacgcccaactcgatgacggatctcgagtcctccttacatttgcgagttgtcggaacagagaaaacctcagtgaagagcgacgccgaacccaccaaccctggggctgccggtagccctaatgccgaacagatatccattccagtcatcaccctggacctgcccgagggcggaggcggtggggtgccgtgtccggaggggaacggttctgaaaggactcctgaaaggttgaaaacccgcgttagcacaaaccaatgtagcggctacggctctggtgagggcggaaacgcaatcaaggatcactcatcctcttcccgcgagccatgggagtcagtttcccgccttacccccgatacaggttctgaatcaaaggttggtaaagagggccagacaaacttggatccaagcagttgcaagtcgagtcacgaaaagagacatgccagagtgctatcggttgacagtgggactgacgtatttctgagcaaatcctctgctgagattgtgaatgatacagagaagacaatgcccacttccaagtctgacttggaggctaaagaaggccagatgcccaacgaatctaactttctagagttcgtcagtctgctggaatccattaacactagtaagatgaccgcctcatcacaactgaatggaagcgccgagcaaaatgaggaatctggcttgttgagagacaactgtagccaggagaaaaaggaagaaatcttggagaatgagaaacccagcggccattcttcaaaacagggcaagcctgaccttcaatcacaggatcatacttctactggccctgcttgtactcagcctgcaaagactaccgcattctttcaaggtaatcggcagaggcagatcatctaccgcgtgacgtcccagcaggacagttctgtgttgcaggtgatctccggtcctgagacgtctgtacaggaagagattagcgtggacgcaatgcacgtatttattgacgaacacggagagatccggagttgctacttaaaaagtgggaatcagaaagaaggccctctccagcctcttccatcaaataacgactgtctttcccaggcacgagaaatgcaggtcagcagctcttcaaccactacatcagaaagtcaggatccttcaagtggggatcctgcagtgtctgctttacagcagcagctgttgttgatggtcgccagacggactcagtccgaaacacccaggcacgtgtctcaggatttggaggccagtagctgtagctccacccaagggaaatttaaccgggagcaattttacaagttcatcattttccctggaaaatggatcaaagtctggtacgacagattgacactcctcgctctcctggatcgaactgaagatataaaagaaaacgttctcgcaatcttacttatagttctggttagcctgctcggatttctgaccctttcccagggattttgcaaagacatgtgggtcctgctcttctgcctcgtgatggcctcatgccaatactctctgctgaagagcgtccagcccgatccagcctctcccattcacgggcacaaccaaatcataacatatagcagaccaatatatttctgtgtcttgtgcggactgatccttttacttgataccggagcgaaagctcgccatcctcccagctacgtcgtatacgggcttaagctgttctctcccgtatttctccagtcagccagagactacctcatcgtgtttctttactgctttcctgccatctcactgctggggttatttcctcagatcaatacattctgcacttatctactcgaacaaattgatatgctgttcttcggcggatcggccgtgtccggcattacctccgctgtgtacagcgtggcaaggtcagtgctggccgctgctctgctccatgcggtatgtttctcagctgttaaagagccgtggtccatgcaacacattcccgcattatttagtgccttctgcggccttctggtcgccctctcatatcatctgtctaggcagtccagcgatccatcggtccttatgtccttcatccagtgtcgcctgtttcccaaattcctccaccagaatctcgccgaatccgctgcagatcctctccctaagaaaatgaaggactctgtgaccgatgtcttaaagtgggacctcatcgtctgcgccgttgtggctgtactgtctttcgccgtcagcgcatcaacagtcttcctgtccctgcgccctttcctgtccattgtcctctttgcattggctggagcagtaggtttcgtgactcactatgtcctaccacaacttcgaaagcatcatccgtggatgtggatttctcaccctatcctcaagaacaaagaataccatcagcgagaggttcgagatgtcgctcacctcatgtggttcgaacgactctacgtttggctacagtgtttcgagaagtatatcttataccctgcactcatcctgaatgctctgactattgacgcgttccttatcagcaatcataggcgattgggtacccactgggacatatttctgatgataattgccggtatgaaactgctgcggacgagcttttgtaatccggtgtatcaatttattaatctgagttttaccgttatcttttttcattttgattacaaagacatttctgagtctttcctgttagacttcttcatggtgagcatcttgttctctaagctaggggatctgctgcacaagttgcagttcgtactcacctacgtggccccatggcagatggcctggggatcatcatttcatgtttttgcacaacttttcgctattccccatagcgctatgctgttttttcagactattgcgacttcaatcttctctacccctctgtctcccttcctagggtctgtgatttttatcacctcctacgttaggcctgtgaagttctgggaaaaaaactacaatacgagaagggtcgacaacagcaatacaaggctggctgtccagatcgagcgagacccgggtaatgatgataacaatctgaactccatcttctatgaacacttaacccggacactgcaagagagcctctgcggcgatctggtcctcggacgctggggcaactacagctccggagattgcttcatcctggcctctgatgaccttaacgcgtttgtccacctgattgagattggcaatggcctggtcacctttcagcttcgtgggttagagttccggggaacttactgccagcagagagaggtggaggccatcatggagggagacgaggaggataggggatgctgctgttgtaagcctggacacctgccacatctgctctcctgcaacgcagctttccatttgcggtggttaacatgggagatcacacagacacagtatatcttggagggctacagcatactggacaataatgccgctacgatgctccaggtgtttgaccttcggaggatattaatccgctattatataaaatccatcatttactacatggtcacgtccccaaagctcctgagctggatcaaaaatgagagtttattgaaatctctgcaaccgttcgctaagtggcattacattgagagggacctggctatgttcaatattaatattgacgatgactatgtgccatgtctgcaaggcattactagagcctcattctgcaacgtttatctggagtggattcagcattgtgctcgcaaacgccaggaaccctctacaacgttagactcagatgaagacagccccctcgtgactctgagttttgcactgtgtacgttagggaggcgggctcttggcacggccgcacataacatggctatttcccttgattcattcctctatggcttgcacgtcttgttcaaaggcgatttccggatcacggcccgtgatgaatgggtcttcgccgacatggatctgcttcacaaggtggtcgccccagccatcagaatgtcactgaagctgcaccaggatcagtttacctgtcctgatgagtatgaagaccctgcggtgctctacgaggcaattcagagctttgagaaaaaggttgtcatctgccacgaaggcgatccagcttggcggggagctgtcctttccaataaagaggaactgctgactctgagacacgtcgttgatgaaggagctgatgaatataaggtgattatgctgcatcggtcttttttgagtttcaaagtcataaaggttaataaagagtgtgtgagagggttgtgggccggtcagcagcaagaactgatatttctgcgcaataggaacccggagagagggtcgatccaaaacaataagcaggtattacgaaatctgattaactcttcctgcgatcagcctctcggctatcctatgtacgtgagccctctgacaactagctatctggggacccatcgacagctgaaaaacatctggggtgggccaattaccctcgatcgtatccgaacctggttctggaccaaatgggtgcgcatgagaaaggattgcaacgccaggcagcattcaggagggaacatagaagatgtagacggagggggagccccaacaactgggggtaataacgcaccatccggaggttctcaggagagctccgcggagcagccacgcaaagggggtgcgcaacacggagtgagctcctgtgaagggactcagcggacaggcagacggaagggaagatctcaatcagtccaggcccattctgccttgagtcagagaccaccaatgctaagttcttccggcccaattctggaatctaggcagactttcctgcagacctccaccagcgttcatgaactcgcacaaaggttgagcggctcccgcttatcactgcatgctagcgctacctctctccattcccagcctcccccagttacaacaacggggcatcttagtgtgagggaaagagctgaagcgctgattagatcaagcctgggctcttccacgagcagcactctgtccttcttgtttggcaaacgtagtttcagcagcgccctggtcatctctggcctgtcagccgctgagggcggtaatactagcgatacacaaagtagcagcagcgttaacatcgtgatgggacctagcgccagggccgctagccaggccactaggcacttgtctgagccttgcgagcccccagacgcgacagaacaagggcagctgcatgacagatgtcttgcagaggccgttgccgatacactcggagtggtgtgtagacgcgcaagccaggaggatatggggttggacgacacggcatcccaacagtcagtctctgacgaacagtaa

SEQ ID NO: 52711 - DNA, 2334 bp, Artificial Sequence
  Description of Artificial Sequence: Synthetic coding sequence
atgactttttatccatttgtggctagttcaagcacaagaagggtggacaattccaacacgcgactggccgtccagattgaacgggaccccggaaatgatgataacaaccttaattctatattttacgaacatctcaccaggaccctacaggaatcactgtgcggagatctggtgcttggtaggtggggcaattattctagcggggattgttttattctggcctcggatgacctgaacgcttttgttcatctcatcgagattgggaacggattggtgacgtttcagctaaggggccttgagttcagaggaacctattgtcagcagagggaagtagaagccatcatggagggcgatgaagaggatcggggttgttgttgctgtaagcctggccatctgccccatctgttaagctgcaacgccgcatttcatctccgctggctcacgtgggagatcacgcagacccaatacatactggaaggatactctatacttgataacaacgcagctacaatgctccaggtcttcgatttgagaagaattcttatccggtactatataaagtcaatcatctattacatggtgacctcacctaaactgttgtcctggattaaaaatgagtccttgctaaagagtctccagcccttcgctaaatggcactatatagaaagggatctcgcgatgttcaatatcaacatcgacgatgattacgtcccgtgcctgcaaggtattactagagcttccttttgcaacgtgtatcttgagtggatacagcattgcgcacggaagcgccaggaaccatctacgacccttgactcagacgaagactcccccctcgtgactctgtcctttgcactctgtaccctcggccgaagagcgctggggacggcagcacataatatggccatctctctagacagtttcctttacggtctgcatgtgctgtttaagggagactttcgtatcacagccagagacgagtgggtattcgccgacatggatctgctccacaaggtcgtggcgccagccatacgcatgtccctaaaactgcatcaagatcagtttacatgtccagacgaatatgaagacccggctgttctttatgaagctattcagtcatttgaaaagaaagtcgtgatttgtcacgagggagacccagcttggcgcggagctgtcctgagtaacaaggaggaacttctcactctgagacatgtcgtggacgagggagccgatgaatacaaagtgataatgctgcacaggagcttcttgagttttaaagtgatcaaggtgaataaagaatgcgtccgcggtctgtgggccggtcagcaacaagaacttatttttctccgtaatagaaatccagagcggggatctattcaaaacaacaagcaggtgttgaggaatttaatcaacagttcctgcgaccagcccctgggatacccgatgtacgtctcccctctgacaacctcttatctcggcacccaccgccagctgaaaaatatctggggcggaccaattactttggaccggataaggacttggttttggaccaagtgggtgaggatgaggaaagactgcaacgcccgacagcattctggagggaacatcgaagatgtggacggcggtggcgctcccactaccgggggtaacaacgccccatccgggggatcccaggagtccagtgccgagcaaccccgaaaggggggtgcccaacatggggtctctagctgtgaaggaacccagagaaccggtcgacgcaaaggcaggtcacaatcggtgcaggcccactccgcgctgagccagaggcctccaatgctaagctctagcggcccaatcctagagagccggcagacatttcttcagaccagcacatcagtacacgagctggcccaaaggttatcagggtcccgcttaagcttgcacgcttcagccacatccttgcattcccagcctcctcctgttacgactactggtcacctctcagttagagaacgtgccgaggctctgattcggagcagtttggggtcaagcacttcatcaaccctgtccttcttattcgggaagagaagtttttcatcagccctggtgatctccggccttagtgccgctgagggaggaaatacgagcgacacccagtcttctagtagcgtgaatatcgtcatgggcccatctgcccgtgccgcatcacaggccactcgggtcagaggctgggcgggattaacccggaccgggtgggacggtggcactgggtcttggccggaacgtgggacgtgcctcgccttccctcccttctgtttacagaatcccatcccgtttagcatgggcttaccagagtag

SEQ ID NO: 52712 - DNA, 861 bp, Artificial Sequence
  Description of Artificial Sequence: Synthetic coding sequence
atgcatgtttttatagatgaacacggggaaattcgctcatgttacctgaagagcgggaatcagaaagagggaccgttgcaaccgctgcccagcaacaacgattgcctgtctcaggccagagagatgcaggtctcctctagttctaccactaccagcgagagccaggatccttcctccggggaccctgccgtatcagccttacagcaacagctgttattaatggtggcgaggcggactcagagcgaaacgcctcggcacgtgtcccaggatctcgaggcatcctcttgttctagcacccaaggaaagtttaacagggaacagttttataaattcattatctttccaggcaaatggattaaagtctggtatgatcgacttactcttctggctctgctggatcggaccgaggatattaaagaaaacgtcctcgccatactgctcattgtactggtttcgctcctggggttcttgactctctcccagggcttttgtaaagacatgtgggttctactcttttgtcttgtgatggcttcatgccaatacagtttgctgaagagcgtgcaaccagacccggctagccctatacacgggcacaatcagatcattacatactctaggcccatctacttctgcgtcttgtgtggactaatcctcctgttagacaccggagcaaaggcgaggcacccgccatcatatgtggtctatgggctgaagctgttctccccagttttcctccaaagcgctcgtgactatctgatcgggaaaataatgaattctcataaggacttctttaccagtgaaaagaaaaaggacaaaatcattagcgcaataagctctgtgatctttctcaagtcttggtag

SEQ ID NO: 52713 - DNA, 6104 bp, Artificial Sequence
  Description of Artificial Sequence: Synthetic coding sequence
atgggctctcaggtactccagatactacggcagggggtttgggccagtctgactggagggtggttctttgaccctcatcaatccaccttcagcaattgtttccacctctacgtatggattttcctactaatctttccatttttgttgtatatggtcctgccaccctctctgatggtcgctggtgtctactgtttggtggttgccgttatcttcgcgacaatcaaaacagtgaattaccggctgcacgcaatgtttgaccagggcgagattgttgagaaaagaagctccacaatgggggaactcgaagaggaacccgctcagggcgattcgaacccaccacgtgaccccggagttgagatgactgtttttcggaaggtgagctccacgcccccagtgaggtgcagttcccagcacagcgtgttcggatttaatcaggtgagcgaactcctgccgaggatggaggacagcggacctttgcgggatataaaagagctcgtgcgggagcaaggatcgaacaacgtgatagttaccagcgctgacagggaaatgctgaaactgagcagccaggagaaactgataggcgatctgccccagacgcctccaggggcagtccctgatccatcactggcatctaccgatagcagcgagccttcgcccctggctggcgatggggctccttggtcaggcagctcaatggccgacacaccaatgagtcccctgttaaaaggatctctgtctcaggaactgagtaaatctttcttaacccttactcagcctgaccgggcattggtccgaacctcgtcccgacgtgagcagcgtaggggggcagggggatatcagcctctggaccggaggggttccggagagcctactccgcagaaggctggctcttctgattcctgctttagcggcaccgatcgcgagacactttctagcttcaaaagcgaaaagacgaattcaacccacctggactcccccccaggaggccctgctccggagggctctgacaccgatcctcccagtgaagctgaattaccagccagtcccgatgctggagttccttcggatgacacccttagatctttcgataccgtcataggtgccggtaccccgcctgggctggccgagcctctgctggtcgtgcggcctaaggacctcgcgctcctgcgcccatctaaacggcagccacctctccgaaggcactcccctccgggtagagccccacgcaggcccctgcttgaagggggaggcttcttcgaggatgaggacacgagcgagggctccgagctgtctccagcctcaagcctcaggagtcagcgtagatactccacggattctagcagcagcacttcttgctacagtcctgagtcttcgcggggagcagctggcggtcctcggaagcgcagggcgcctcacggagctgaagagggaacggccgtacctccgaagcgcccttatggcacacaaagaacaccctccacagcctctgccaagacccacgcgagggtgttatccatggacggtgctggaggggacgtgcttagacctcccctcgccggatgtaaagccgaactcgaggcacaggtgggggtggaacaggctgccagtgagccggtagtactgcctgccgaagccagaaggggtcccgctgctaaccaacccggttggcgtggtgagctgcaagaagagggcgctgtgggaggcgctgccgaggagacaggcaggcgggaccggtcttcatccgttcgccgaacccaggcgatccgacgacggcacaatgctggatctaatcctacccctccagctagtgtcatgggaagtcctccatccagcctgcaagaggcacaaagggggagggctgctagtcactccagagccctgacactgccttcagcactgcactttgcgagctcactactgctaacacgcgctggcgcaaacgtccatgaagcctgtaccttcgacgatacctccgaaggagctgtgcactatttctacgacgagagcggtgtcaggaggagttacacttttgggctggccggtggtggttacgagaaccctgtgggccagcaaggtgagcagaccgccaacggcgcatgggatcgccattctcatagttctagtttccacagcgccgacgtgcctgaagcaacaggaggcctgaacttgttgcagcctcgcccagtggtccttcagggaatgcaggtgcgacgagtgcctctcgagattccagaggagcagacactcatggaggaggcccctcctagagctcaacactcttacaagtactggctgcttcccggaaggtggacctcggtgagatacgagaggttagcactgctggcgctgctggataggaccagaggggtgctagagaatatatttggtgtgggcctcagcagcctcgtcgctttcctgggctacttgctcctactgaagggtttttttacagatatctgggtgttccagttttgtttggtgatagcaagctgccagtacagtctgctgaaaagcgttcagccggatgcagcctcgccaatgcacgggcataattgggtgatagcatattcccgccctgtgtacttctgcatctgttgcctgctgatctggctgttagatgctctgggcagcgcccagcccttccccccagtctcattatacggcctaacccttttcagtgctagcttcttcttttgtgcacgagacgtggccactgtgttcaccctgtgttttcctttcgtgtttctgctgggtttgctgcctcaggtgaacacatgcctgatgtatcttctggagcaaattgatatgcacggttttggtggaacggccgcaacttcccctctgactgcagtgttttccttgagcaggtctctgctcgcggctgctctgctgtatgggttctgtcttggagccatcaagactccatggcctgaacagcacgtacccgtcctgttcagcgtgttctgcggactattggtcgccctctcataccatctctcgcgccagtcctccgatcctacggtgctatggtccctcattaggtccaaactcttcccagaattggaggaacggtctctcgagaccgctagagcagaacctcccgatcccctccccgacaagatgcggcagtcagttagagaggtgttgcactctgatcttgttatgtgcgttgtgatcgccgtgctcaccttcgctattagtgcctctaccgtcttcatagctctcaagtccgtactaggcttcgtgctctacgcgctggcaggggctgtgggcttttttacgcattacttgctccctcagctgagaaaacagctcccatggttctgcctgagtcaacctgtccttaagccattggagtactctcagtacgaagtgcgtggagcagcacaagtgatgtggtttgaaaaattatacgctggcttacagtgtgtcgagaaatatttgatctacccagcggtcgttctgaatgccttgacagtcgacgcccataccgttgtgagccaccccgataagtactgcttctattgcagagctctgctcatgactgttgcagggctgaaactactgcggagtgctttttgctgccctccccaacaatacctgaccctggcatttaccgttttgctctttcactttgactatcctagactgtctcagggtttcctgttagattatttcttgatgtcattgctgtgttctaagctgtgggatctgctgtacaagctgcgatttgtgttgacctacatcgccccatggcagatcacgtggggaagtgctttccatgctttcgcgcagcctttcgctgtgcctcattcagccatgctctttgtgcaggctctcctgtcgggtttgttctccaccccactaaatccacttctcgggagtgccgtgttcatcatgtcatacgccaggccactaaagttctgggagcgggactataacacaaagcgggtagaccactcgaatacaagactggttactcagctggacaggaacccaggcgctgacgacaacaacctgaactccattttttatgaacacctcacccggtctctgcaacatacattatgtggcgatctcgtgctgggaagatgggggaactatgggcctggtgattgtttcgtcctcgcctccgattacctgaacgctctggtccacctgatcgaagttggcaacggcctggtgaccttccaactacgcggtttagaattccggggaacctactgccagcaacgcgaagtcgaggctatcacagagggggtggaggaagatgagggctgttgctgttgtgagcccggtcaccttcccagagtccttagtttcaacgctgcctttggtcagagatggctcgcatgggaagtaaccgcctcaaaatacgtactcgagggctactctatctcagacaacaacgcggcaagtatgcttcaggtgtttgatctgcgtaagatcttaatcacctattatgtcaaatctattatttactacgtgtcccggagtcccaaactggaggtctggcttagtcacgagggtatcactgcggctttgaggccggttcgtgtcccaggatacgctgatagcgaccccaccttttctctgtccgtggatgaagactacgacttgcggctgagtggattgtcgctcccttcattctgcgcagtacacctagaatggatccaatactgcgccagtcggagaagtcagcccgtcgaccaggactggaacagtccattagtgaccctgtgctttggactgtgtgtcttgggcagaagggccctggggacagctagtcatagtatgtctgcatcactggaaccattcttgtacggactccatgcgctgttcaagggcgactttcggatcacatcacccagagatgagtgggtgttcgccgacatggacctgttgcatagggtggtggccccaggggtccggatggccttgaagctacaccaggatcactttaccagccctgacgaatatgaagaaccagccgctctctacgacgcaattgccgcaaacgaggagcgtttggtcatttcacacgagggagatcccgcatggagaagtgctatcctgtctaacacaccatccctgctggctttgcgtcatgttcttgatgacgcctcagatgagtacaagataatcatgctgaatagacgccacctgtcattcagggtgattaaagtaaatagagagtgtgtacggggtctatgggcaggtcagcaacaggaattggtgttcctgcggaacaggaatcccgaaaggggatctatccaaaacgctaagcaggccctgcgcaatatgattaactcctcatgtgaccagcctctcggatacccgatttatgtatcgcctctgaccactagcctagctggtagtcaccctcaactaagggctctgtggggcggacccattagcctcggggcaattgcccactggctgctaaggacatgggagcggctccataaaggctgcggggctggttgtaatagtggtggaaacgttgatgacagcgattgtagcgggggaggcggacttacctctttgtcaaacaaccctcctgtagcgcatcctactcctgaaaacactgcagggaatggtgatcagcctctcccccctggcccaggatggggcccaaggtcaagcctgagcggctctggcgatggcagacccccacctctattacagtggccgcctccacggctgccgggtccccctccggcttctcccattcctacagaagggccaaggacctcccggcctccgggacccggactcctgtcgagcgagggcccatcaggtaaatggtccctaggagggagaaaagggctgggtggctccgatggagagcccgcttccgggtccccaaagggcggtacacccaaatctcaggccccactggacctgagtctctccctgtccctgagcctgagtcccgacgtcagtaccgaggcttcccccccacgagcgtcacaagatattccttgcctggactcaagtgcccctgagtccggcacccctatgggggcactgggagactggcccgctccgattgaggagcgggagtcgccggctgcacagcctctgttagagcaccagtacta

SEQ ID NO: 52714 - DNA, 1167 bp, Artificial Sequence
  Description of Artificial Sequence: Synthetic coding sequence
atggtgagggacagcatggccgcagctttcagaccaagcaatagagtgcttctacaggccctgcagatattggtatacccgggtgtcggaggctcgggcagcgtgtcttgtcgatgtccactgggagctaaaaggtatttgttgaccgacaacgttgtcaaattgaaagagttccagcaaaagaaggtggccgtggcatgtaatctgtccggtacaaaggagacatattttcggaatctcaaaaaaaaattaactcagaacaaacttatcctgaagggtgaactcattacattgcttcatctctgtgagtcaagggatcacgtcgagctcgccaagaacgtgatttatcggtatcatgcagagaataagaatttcacactgggcgagtataagttcggaccactcttcgtcaggttgtgctacgaattagacctggaggagagcgctgtggaactgatgaaggaccaacacctcagaggattttttagtgacagcacgagcttcaacatcctgatggacatgctgttcatcaaaggcaagtacaaatctgcactccaggtgcttattgagatgaaaaatcaggatgtgaagtttactaaggacacatatgtattagctttcgccatttgttacaaactcaactcgccggagtcattcaaaatttgtactacactgagggaggaagcgcttctcaaaggagagatcctgtctcggagggctagttgctttgccgtggctcttgccttaaaccagaacgagatggctaaagctgtgagcatattctcccagattatgaaccctgagtccattgcatgcattaacctcaacatcattatccatatccaatctaatatgcttgaaaatctgattaaaacgctgaaaaatgcagctgaaggaaacctcagcaagttcgtgaagcgccacgtgttctctgaagaagtactagcaaaagtgcgtgagaaggtgaaggacgtgccggcactggtggcaaagtttgatgagatttacggaaccctgcacatcacaggtcaagtcacgacagactccttggatgcggtgctgtgccatactcccagggatcggaaatcccatactctcctactcaacaagagaatggtctcccggcgtacatttcagcccctgtctcagagcctactggctgagtag

SEQ ID NO: 52715 - DNA, 1167 bp, Artificial Sequence
  Description of Artificial Sequence: Synthetic coding sequence
atggtccgagactcgatggcagccgctttccgaccatctaatcgggtgctgctgcaagccctgcaaatcttagtgtatcctggggtcgggggttcgggttctgtgagctgccgttgtccgctgggagctaagcgctatttactgactgacaacgtcgtaaagttgaaggagttccagcagaaaaaagttgccgtggcttgcaatctgtccgggacaaaagaaacgtacttccgaaacctaaagaaaaagctcacccagaacaaactgatcctgaagggcgaactgatcacactgctccacctctgtgagtcccgcgaccacgtcgagctggctaagaacgtgatctaccgttaccacgctgagaataaaaactttacattgggggaatataaattcggaccactcttcgtccgcctatgttatgaattagacctggaggagagcgcggttgaactgatgaaggatcaacatttacggggtttcttcagtgactcaacctcctttaatatcctgatggatatgctgttcattaagggcaagtacaaaagtgctctgcaggtactgatagaaatgaagaaccaagacgttaagtttactaaggacacttacgttctggccttcgccatctgctacaaacttaactctccagagtcattcaagatttgtaccaccctgcgggaagaggctctgttaaagggagaaatcctctccagaagagccagctgctttgctgtggctctggccctgaaccagaatgaaatggcaaaggctgtgagcatttttagtcagattatgaaccctgaatccatcgcttgcattaatctcaacatcattattcatatccagtccaatatgctggagaaccttattaagactctgaagaacgccgcagagggcaacctctctaagtttgttaaacggcacgtgttttcagaagaagtcctggccaaagtccgagaaaaggttaaggacgttcccgcactcgttgccaaatttgacgagatctatgggacactgcacataacaggtcaagtcaccacggattctctcgatgccgtcttatgccataccccaagggacaggaaatctcacactttgctactgaacaaacggatggtatcccgcaggactttccagccgctgagccagagtcttctcgcagagtag

SEQ ID NO: 52716 - DNA, 651 bp, Artificial Sequence
  Description of Artificial Sequence: Synthetic coding sequence
atgtggaattggctgaagatgtcgttcaccggagccctccaggttctaatcgagatgaagaaccaagatgtgaagtttactaaagacacttatgtcctggccttcgcaatttgttataagctgaattctcccgagtccttcaaaatctgtacaactctgcgtgaagaggcgctgctcaaaggcgaaattctcagtcggagggctagttgtttcgccgtggccctcgcacttaatcaaaacgaaatggcaaaggctgtatcgatcttttcacagattatgaatcccgagagtatcgcatgcataaacttgaacattattattcatattcagtcgaatatgctcgaaaacttgataaaaaccctgaagaacgcagcggaaggtaacctgtctaaattcgtgaagcggcacgtgttctcagaagaagtgctggccaaggtgagggagaaagttaaagatgtgcctgccctcgtcgccaagtttgatgagatttacgggactctgcacattacgggacaggtgacgaccgatagccttgacgcggtgctctgtcacacacccagggatagaaagtcgcatactctgctgctgaataagcggatggtgtcgcggaggacattccagcccctctcacaatccctcttggccgaatag

SEQ ID NO: 52717 - DNA, 486 bp, Artificial Sequence
  Description of Artificial Sequence: Synthetic coding sequence
atggttcgcgacagtatggccgctgccttccgcccttcaaacagggtgctcctgcaagccttacaaatccttgtgtaccctggcgtgggagggagtggtagcgtctcctgcagatgcccgttgggggctaaacgatacctgctgaccgacaacgtggtgaaactgaaagaatttcagcagaagaaggtggctgtggcatgcaacctatctggaaccaaagagacttacttccggaacctgaagaaaaagctgacccagaataagcttatcctgaagggcgaactcatcactttgctgcatctttgtgagtcacgagaccatgttgagctcgctaaaaacgtcatctacaggtaccatgccgagaataagaattttacactgggcgagtacaaatttggccctctgtttgtcagactttgctatgaactcgatcttgaggagtccgccgtggagctgatgaaagatcaggtcctgtgcaagtattag

SEQ ID NO: 52718 - DNA, 2070 bp, Artificial Sequence
  Description of Artificial Sequence: Synthetic coding sequence
atggccgtcgtgagcgccgtgaggtggcttggcctcaggagcagacttggtcagcctcttacaggtcgcagggcagggttatgcgagcaggcgaggagctgccggttttattcaggatcagccactctgtctaaggttgaagggacagacgtgaccggcatcgaagaagtggtaatccctaagaagaaaacctgggataaagtggccgtgttgcaagctctcgcaagcaccgttaacagggacactacagcagtgccttacgtttttcaggacgatccatatctgatgcccgctagctctctcgaaagcaggtcttttctcctcgccaaaaagagcggagagaacgtagcaaagttcattatcaatagctatccaaagtacttccaaaaggatatcgccgaaccgcacatcccatgcctaatgccggagtactttgagccccagatcaaggatattagcgaagcagctctgaaggagaggatcgagctgcggaaggttaaggcatctgtcgacatgtttgaccagctccttcaggcgggtaccactgtttccttagaaaccaccaactcactcctcgacctgttgtgctactatggagaccaggagcctagtaccgactaccacttccagcagactgggcaaagcgaggcccttgaagaagaaaatgacgaaacatctcgacggaaagccggacaccagttcggcgtcacatggagagctaagaataatgctgagcgcatcttctctctcatgcccgagaagaatgagcattcttactgcacgatgatcaggggcatggttaagcaccgcgcatatgaacaggcattgaatttgtatactgagctgttaaacaatcgactgcacgctgacgtttacaccttcaacgctctcattgaggctaccgtctgtgccataaacgagaaattcgaagagaagtggtcaaagattctggaactgcttcgccacatggtcgcccaaaaggtgaagcctaaccttcagaccttcaacaccatactgaagtgcctgcggcgatttcacgtgtttgcgcgatcccccgctctacaggtgttgagagagatgaaggcaattggtatcgagccgtcactggctacataccatcacattatccgcctcttcgaccaaccaggtgaccctctgaaacgtagctcttttataatttacgacattatgaacgagctgatggggaagcgattttcgccaaaggacccagatgacgataaattctttcaaagcgcaatgtccatttgctctagcctgagagatctcgaactggcatatcaggttcatggcctcttaaagaccggagataactggaagtttattgggccagaccagcaccgcaatttctactattccaaattctttgatcttatctgcctcatggaacaaatcgacgtcacactcaagtggtatgaagacctcattccgagtgcctacttcccacacagtcaaaccatgatccacctgcttcaggcccttgacgtggcaaaccgactcgaagtgatcccgaaaatttggaaggacagcaaagaatacgggcatacattcagatcagacttacgggaggagattcttatgctcatggccagagataagcatcccccagagcttcaggtggcctttgccgactgtgcagccgatattaaatcagcatacgagtcgcaaccaatacgacaaacagcccaggattggccagcgactagcctaaactgcatcgctattctgttcttaagggctggacggactcaggaggcctggaaaatgttaggtctttttagaaagcataataagattccacgctccgaactgcttaatgaactaatggactcagccaaggtgagtaactctcctagccaggccatagaagtcgtagaactcgcaagtgcctttagcttacctatttgcgaaggactcacccaacgcgtgatgtctgacttcgccataaaccaggagcagaaggaagctctctccaacctgaccgcattgacttccgattctgataccgactccagttcggactcggatagtgacaccagcgagggtaaatag

SEQ ID NO: 52719 - DNA, 627 bp, Artificial Sequence
  Description of Artificial Sequence: Synthetic coding sequence
atggctgttgtttctgctgtgcggtggctcgggctgcggagccgactgggacaacccctgacaggacggcgagctggtctgtgcgaacaggccaggtcatgcagattctattctggcagtgcaaccctctccaaagtcgaagggacagacgtgacgggcatagaggaagtcgttattcctaaaaaaaagacttgggacaaagtggcagtccttcaggccctggcctctacagtgaatagggataccaccgctgtgccttacgtgttccaggatgacccctacctcatgcctgcctcctcacttgagagccgctcattcctccttgccaagaagtccggagagaacgtcgccaaatttattattaattcatacccaaaatattttcagaaggacattgcagagcctcatatacctgaacccttgtgcctgctgaagcagcaaatcgtgtcatggatatactgcgtcacaatggtaaccagatcccctcagttaatcacgatctttaataaactggattcccaaaaacattggaaacgtaaaatgatgaggcacctgggtggcaagctcgtcatttcgctcgagcttcacggagagcagaagactacactgcgcgagtccttcctgtag

SEQ ID NO: 52720 - DNA, 1470 bp, Artificial Sequence
  Description of Artificial Sequence: Synthetic coding sequence
atggcagcggctgcagccagagtggtgctctcttcggccgcacgcaggcgactatggggattcagcgaaagtcttcttatccggggtgcggcaggtcgctccctttactttggtgagaaccggctaagaagcacccaggcagctacacaggtggtgctgaatgtgcctgagaccagggtaacttgcctggaatccggtctgcgggtggcgtccgaagatagtggtttgtccacgtgcaccgtagggctttggattgatgccggatccaggtatgaaaatgagaagaacaatggcaccgcccatttcctggagcacatggcgtttaagggcaccaaaaagaggagtcagctggacctggagctagaaatcgagaatatgggcgctcatctgaatgcatataccagccgtgaacagacagtgtactacgcaaaagcattctctaaagacttgcccagggcagttgagatcctggcagacatcattcagaatagcacgctgggagaggccgaaattgagagggagagaggcgttattcttcgcgagatgcaagaggtcgaaacaaatctccaagaggtggtctttgactatcttcatgcgacagcgtatcagaatacagctctgggtcggactattctaggacctactgaaaatataaaatccatcagcagaaaggatctggtagactacatcacaacgcactacaaagggcctagaatagtgcttgctgctgcagggggtgtctcacacgacgaactactggatctggcaaagtttcacttcggggactctctctgtactcacaaaggagaaattcctgctctacccccatgcaagttcacagggtcagaaatacgggtcagggacgataaaatgccactggcccatctggctatcgctgtcgaagctgtaggctgggcccaccccgataccatatgtcttatggtcgcgaacacactcattggaaactgggataggagttttggagggggaatgaacctatcttcaaagttggctcagctgacatgtcacgggaatctctgtcatagctttcagagcttcaacaccagttacactgacaccggtctgtggggactgtacatggtgtgtgaaagctctacagtcgctgatatgttgcatgtcgtgcagaaagagtggatgagactgtgcacctcagtgactgagtcagaggtggcacgggctaggaatttactcaagactaatatgctcctccaactggacggaagcacacctatctgcgaggacatcggcaggcagatgctctgctacaatcgacgcataccaatccccgagctggaggccaggatcgacgccgtgaatgccgaaacaatccgggaggtgtgcactaagtatatttataaccggtctcctgcaatagctgccgtggggcctatcaagcagcttccagattttaagcagatacggagcaatatgtgttggctccgcgattag

SEQ ID NO: 52721 - DNA, 1212 bp, Artificial Sequence
  Description of Artificial Sequence: Synthetic coding sequence
atggcctttaagggcacgaaaaagagatcacagctggacctcgagctggagatcgagaacatgggcgctcatctaaatgcgtatactagtagagagcagacggtgtattacgctaaggcttttagcaaagacctccctagagccgtcgaaatccttgcagatattatccagaatagtaccctgggagaggccgagattgagcgggagcgaggtgtgattcttagggagatgcaggaagtggagaccaatcttcaggaagtggttttcgactatcttcacgctacggcttaccaaaatactgcactgggcaggaccattctgggtccaactgaaaacatcaaatcaatttcccggaaggacctggttgactacattaccacacactacaagggcccaaggattgtgctggctgctgccggaggagtgtcccacgatgaacttctggatctggccaagtttcacttcggtgactccctgtgtactcacaagggggaaattccagccttacctccctgtaaattcaccggctcagagatacgggttcgggatgataagatgcctttggcacacctcgcaattgccgtcgaagctgttggatgggctcacccagataccatttgcctgatggtggcaaacactctgatcggaaactgggatcgaagctttgggggaggcatgaatctttcatcgaagctcgctcagttgacttgtcatggcaatctttgtcactctttccaaagcttcaacaccagctatacggataccggcctgtggggcctgtacatggtgtgcgaatcaagtacggtggcggatatgctgcacgtcgtccaaaaagagtggatgcgcctgtgcaccagtgtgaccgagtccgaggtggctcgcgcaaggaacctgctaaagacaaatatgctcctgcagttggatgggtcaacgccgatctgcgaggatatcggaaggcagatgttgtgttacaacaggcgcatcccgatccccgaacttgaggcccgaattgacgcagtcaacgcagaaactattagagaagtgtgcactaaatatatctataatagatccccagcaatcgctgccgtcggatataatcacaggagtgagctgcacgaatggaaatggaataaactgttttcgaagcgccagacaattagttacagctacgttaatatcctgttaccacagccccagccccaatacgtgtag

SEQ ID NO: 52722 - DNA, 645 bp, Artificial Sequence
  Description of Artificial Sequence: Synthetic coding sequence
atgcggccaggtggtttcctcggggctggacagagactctccagggccatgtccagatgcgtgctcgaacctcggcctcctggcaagaggtggatggtcgcgggactgggcaatccgggacttccaggcacccggcactcagtgggcatggccgtcctgggacagctagccagaagacttggcgttgctgagagttggactcgggaccgtcactgtgccgctgatctggcactggccccactgggcgacgcgcagctggtgctcctgaggcctaggagactcatgaatgccaatggtcggtccgtcgctagggccgcagagctatttggtctgaccgctgaggaagtatatctagtgcacgacgaactggataaacctctgggaaggctggccttaaagctggggggttcagcacgcggacacaacggcgtgcgtagctgcattagttgtttgaactcaaatgccatgcctaggctgcgcgtgggaatcggtcgccctgctcaccccgaggcagtgcaggctcatgtccttggctgcttctcacccgctgagcaagagctgttacctttactgctcgatcgggctaccgatttgattctggatcatattagagaacgatcccaaggaccttccttaggcccttag

SEQ ID NO: 52723 - DNA, 645 bp, Artificial Sequence
  Description of Artificial Sequence: Synthetic coding sequence
atgcgccctggcggattcctgggcgcaggccagcgactgtctagggctatgtcccgatgtgtcctcgaacccagacctcccggtaaacggtggatggtagctggtcttggcaaccccggtctgcctggcacgaggcattctgtaggaatggcagtcctgggccaattagctagaaggctaggtgtcgccgagtcatggactcgcgatcggcactgtgcagcagatcttgccctggcaccactcggagacgcccagctcgtcctgttacggccaaggcggttaatgaacgcgaatggacgatcagtagctcgagcggctgagctttttggactgaccgccgaagaggtctacctggtacatgacgagcttgacaaaccattaggcaggcttgctttaaagcttggaggctccgcacgagggcacaacggggtgcgctcatgcattagttgtctgaactctaatgccatgcctaggctccgggtggggatcgggaggccggcacatcctgaagcagttcaggcccacgttctcgggtgcttctcgccagcagagcaggaactgcttcccctccttctggatagagcaacagatctaatcctcgatcacattagagagcggagtcagggacccagcttaggaccctag

SEQ ID NO: 52724 - DNA, 4074 bp, Artificial Sequence
  Description of Artificial Sequence: Synthetic coding sequence
atgcagacactgggcagctttttcggcagtctgcctggctttagcagtgccagaaacctcgtagcaaacgcacactcatctgccagggccaggcccgcagcagatcctactggcgcaccggctgcagaggccgctcagccacaggcccaggttgcagcccatcccgaacagacagccccatggactgagaaggaacttcagcccagtgagaaacaaatggtgagcggggctaaggacctggtgtgctcaaagatgtctcgggctaaagatgctgtctcctctggcgttgctagcgtcgtggatgtggctaaaggggtcgtgcagggcggactggatactaccagaagcgcacttaccggtactaaggaagtggtgtctagcggagttactggggcaatggacatggctaaaggggcagtgcagggcggactcgatacatcgaaggccgtgcttacagggacgaaggacactgtaagcacaggtttgactggggctgttaatgtggcaaagggaaccgtacaggccggagttgatacgacgaagactgtgctcactggtacgaaggataccgttactacaggagtcatgggagcagtaaatctggccaagggcaccgttcagactggtgtggagaccagcaaagccgtgcttactggcaccaaggatgctgtgtcaaccggattgacgggagccgtgaatgtcgcgagaggctccatccagactggggtggacacctccaaaactgttctgacaggaacaaaggatacagtgtgttctggtgtcacgggggctatgaacgtggccaaaggcactatccagacgggagtcgacacttcaaagacggtgttaactgggaccaaggacaccgtgtgctctggtgtgacgggcgcaatgaacgtcgcaaaggggacaatacagaccggagttgatactagtaaaaccgtgttgaccgggaccaaggacaccgtgtgctctggagtgacgggcgcaatgaacgtggctaaaggaacaattcagaccggagtcgataccactaaaactgtgctcacaggcacgaagaacacggtctgtagtggtgtgacgggcgctgtcaacctggccaaggaggcgattcagggcggattagacacaaccaagtcaatggttatggggacgaaggacaccatgagtaccggacttacaggcgctgctaatgttgcgaaaggggcaatgcagactggactcaatacaacccaaaacatcgcgacgggcaccaaggatacggtctgtagtggagtgacaggagcgatgaacctggctagagggacaatacaaaccggtgtcgacaccaccaaaattgtcctgacagggacaaaagataccgtttgcagtggcgttacaggagccgctaatgtggctaaaggcgcagtgcagggtggactggatacaacaaagtcagtgttgactggtactaaagacgcggtgagtaccgggcttaccggtgcggtcaacgtggctaaaggcaccgtccagaccggggttgacacaaccaaaaccgttctgaccggcactaaagatactgtgtgttcaggagtcacatccgccgtgaacgtagctaagggtgccgtgcagggtgggctggataccacgaaatcagtcgtgatcggcaccaaagacactatgagtacggggctgacgggcgcagcgaacgtagccaagggagccgtacagacgggcgttgataccgcaaaaaccgtcctgacgggcacaaaggataccgttaccaccggtcttgtgggagccgtgaacgtcgcgaagggcaccgtgcagacgggcatggatacaactaagaccgtcctcacagggaccaaggacaccatatatagtggagtcaccagcgccgtgaacgtggccaaaggtgccgtgcaaacaggtttaaagaccacccaaaatattgccactggaacaaagaacacctttggatctggcgtgacgtctgccgtgaacgtggccaaaggcgcagcccagactggcgttgatacagcaaagaccgtgctcacagggactaaggacacagttacgactgggttaatgggtgcagttaatgtggcgaaggggaccgttcagacttctgtggacacaactaaaaccgtgctgactggcacaaaggacacagtctgttctggcgtgaccggggctgcaaatgtggcaaaaggggcaatccaaggtggcctggacacgactaagagcgtgctgaccggcacgaaagatgcagtctctaccggcctaacaggagctgtaaagctcgctaaaggaaccgtccaaacaggaatggacaccacaaagactgtcctcacgggcactaaagatgctgtgtgcagcggggttacgggcgcagctaacgtcgctaaaggcgctgtgcagatgggcgtggatacagcaaaaacggtgctcacaggtaccaaagatacggtgtgctccggggtgacaggcgctgccaatgtggcgaagggcgctgtgcagacagggctgaagaccactcagaacatcgctacagggactaaaaataccctcggttcaggcgtgacaggagctgctaaggtggccaagggggcagtgcagggcggattggacaccactaagagtgtgctgacaggtactaaagatgcagtgtcaaccggcctcacaggcgctgtcaacttagccaaggggacagttcaaactggcgtcgacactagcaagaccgtgttgacggggactaaagacacagtgtgttcaggggtgaccggagccgtcaatgtggcgaaaggaactgtacaaacaggggtggacacagccaaaaccgttttatccggcgctaaagatgctgttaccaccggggtgaccggagctgtgaacgtggccaagggcacggtccagaccggcgtagatgcatcaaaagctgtgctcatgggcactaaagacactgtgttcagcggggtgaccggagctatgagtatggcgaagggggctgtccaaggaggcttagacacaacgaaaaccgtacttacaggcactaaagacgcagtgagcgcaggcctcatgggatccgggaatgtcgctacgggcgcaactcacacaggactgtccacctttcaaaattggcttccatcaacaccggcaactagctgggggggactgacgtcgtcccgtactacagataatggcggagagcagactgctctctcaccccaagaggcacccttcagcgggatttccaccccgccagacgttctgagcgtgggtcccgaaccggcttgggaggctgcagccacaaccaagggtctagccacagatgtggcgacgtttactcagggtgctgccccaggcagggaggatactgggctcctggcaactacacacgggccagaagaggcaccgaggctggcgatgctccagaatgaactcgaaggcctcggggacatctttcatcctatgaatgctgaggagcaggctcagctggccgcatcacagcccggacccaaggtcctgagcgctgaacagggctcctacttcgtgcggttaggcgaccttggcccaagctttcgccagagggcctttgaacacgctgtgtcacacctccagcacggccagttccaggccagagatacgctcgcccagctccaggattgcttcagattaatcgagaaggcccaacaagccccagagggccaacctagactggatcagggctccggtgcttcggccgaagatgccgctgtgcaggaggagcgtgatgccggagtgttgagtagggtgtgcggattgctgaggcagctccatacggcgtattcagggctggtgagttcacttcagggtctgcccgctgaattgcagcagccggtcggtcgcgctcgccactcactgtgtgagctttacgggatcgttgccagcgccggaagcgttgaagagctacctgccgaaaggctggtgcagtctcgagagggggtgcatcaagcctggcagggtctggagcagctgctggagggcctgcaacacaatcctcccctgtcctggctcgtagggccattcgcactgccagccggaggccagtag

SEQ ID NO: 52725 - DNA, 780 bp, Artificial Sequence
  Description of Artificial Sequence: Synthetic coding sequence
atggacgcctgggtgcggtttagtgcacagtcgcaagccagagaacggctgtgtagagctgctcaatacgcttgttccctcctgggccacgctcttcagcgtcatggtgcaagccctgagctgcagaagcagatccggcagctcgagagtcatctgagtctggggagaaaactgcttcggctgggaaactccgctgacgccttggagagtgctaaaagggccgtgcatctgtccgatgttgtgctgagattttgcataactgtctcgcacttaaaccgcgctctgtatttcgcatgtgacaacgtgctttgggcaggaaagtcaggtctggctccccgagtcgaccaagagaagtgggcccagaggagcttcaggtactatttgttttccctgattatgaacctgtcacgggatgcttacgagatacgcttactcatggagcaagaatcaagcgcatgttctcgacgactcaaaggaagcggaggaggtgtgccaggtggtagcgagactggcggtctagggggtccagggactccgggtgggggtttgccacagttggcccttaagctgcgcttgcaagtactgctattggcacgggtcctgcggggacacccgccactgctcctggacgtggtgcgcaacgcctgtgatttatttattcctttggataagctcggcctctggcgctgtggtcccggaatcgttggcttatgcggcctggtatcttcaatcctgagcatcctgactctcatctatccttggttgcggctgaagccctag

SEQ ID NO: 52726 - DNA, 246 bp, Artificial Sequence
  Description of Artificial Sequence: Synthetic coding sequence
ccaggaggcggactgcctcagcttgcgcttaaattgaggttacaagtactcctcctagctcgagttctgcgcggtcatcctcctttgctcttggacgttgttcgtaatgcttgcgatctgtttataccacttgataagctcggtctgtggaggtgcggtccaggaatcgtcgggctgtgcgggctcgttagttcaattctgtccattctgactctgatctacccttggttgcgtctcaagccatag

SEQ ID NO: 52727 - DNA, 738 bp, Artificial Sequence
  Description of Artificial Sequence: Synthetic coding sequence
atgggcaaattgagagccgcacagtacgcttgcagcttacttggccacgcgctgcagcgccacggggcatctccagagctccagaagcagattcgtcagctggaatctcacctgtcccttggcagaaaattgctcagattgggcaacagcgccgatgccctggaatctgcgaagcgggctgtgcatttaagcgacgtagtgctgaggttctgcataactgttagccatttgaatcgagcactgtactttgcatgtgacaatgtgttgtgggctggaaaatctggcctggcaccgcgtgttgaccaagagaaatgggctcagcggagcttcagatattacctcttcagcctgattatgaatctttctagagatgcgtatgaaatccgcctgctgatggaacaggaatcgagtgcatgttctcgacggctgaagggatccggcggaggagtgcctggcggatccgagactgggggactggggggtccgggtacccctggagggggactgccacagctggcactgaagctgcgcttgcaagtattacttttagcgcgtgtgctgagagggcacccaccactgctgctcgacgtcgtacggaacgcttgcgacctctttatccccctggacaaactgggattatggagatgcggccctgggattgtgggattgtgcggtttggtatcttctattctctccattttaacattgatatatccatggctgcgccttaaaccatag

SEQ ID NO: 52728 - DNA, 297 bp, Artificial Sequence
  Description of Artificial Sequence: Synthetic coding sequence
atgaaagtgagtgccgtccttctgtgccttctattaatgaccgcagcttttaacccacaaggtctcgctcagcccgatgccctaaatgttccaagcacttgctgcttcactttttctagcaaaaagatttccctgcagcgtctgaaatcctatgtgatcaccacatctcgttgcccccaaaaagcagtgatctttagaacaaagttggggaaagagatctgcgcagacccaaaggagaagtgggtgcagaattatatgaaacatctgggcaggaaagctcatacactgaagacatag

SEQ ID NO: 52729 - DNA, 975 bp, Artificial Sequence
  Description of Artificial Sequence: Synthetic coding sequence
atggccgagcacggggcacacttcacagcagcaagcgtcgcggacgaccagccctcaatctttgaggtggtggcccaagattccttaatgactgccgtgcggcctgcccttcagcacgtagtcaaagtcctcgccgagagcaaccctacacactatgggttcctgtggcggtggttcgacgaaattttcactctgcttgatctgctattacaacaacattatctgtcgagaacctcagcttctttctctgagaacttctacggcctcaagagaatagtcatgggcgacactcataagagccagcggctggccagcgccggactgcctaagcaacagctttggaaatccattatgtttcttgtgttattaccatatttgaaggtcaagcttgagaaattggtatcatcccttagagaggaagatgaatactccattcaccctccctctagcagatggaaaagattttacagagccttcctggcagcctatccttttgtgaatatggcctgggaagggtggtttcttgtgcagcagctgcgatacattctgggcaaagcacaacatcattcacccctcttaagattagcgggtgtgcagctcggcagacttaccgtacaggatatccaggcacttgaacacaagcccgctaaagcctctatgatgcagcagcctgcaagaagcgtgtccgagaaaattaattcagcactcaagaaggctgtcggcggagtggcgctctccctcagcaccggactgtctgttggcgtgtttttcttgcagttcctggattggtggtattcatcagagaaccaggagaccattaagtctttgacggccctgccgacgcctcccccaccagtacacctcgattataattccgactcacccctgctccccaagatgaaaacagtgtgccccaagaaaaaaaagaagaaggaaagaaagaaaaagaaagaacgaaagaaggaacgtcggtag

SEQ ID NO: 52730 - DNA, 588 bp, Artificial Sequence
  Description of Artificial Sequence: Synthetic coding sequence
atggcccctgcagcatcccggttgagggcggaagcgggactaggtgccctgcctaggcgagccttggcacaatatctcctgtttctgcgcttgtacccagttttgactaaggcagcaacctcaggtatattgtccgccctgggcaatttcctggcgcagatgattgagaaaaagagaaagaaggaaaattcgcgctcactcgatgttggtggaccgcttcgctacgcagtgtacggtttcttcttcactggcccattgagccacttcttctacttctttatggaacactggattccccctgaagtaccgcttgccggtctccggcgtctactgctggaccgactggtgtttgctccagccttcctcatgctatttttccttattatgaacttcctggaaggcaaggatgccagcgctttcgctgcgaagatgaggggcggattctggcccgctttgcgcatgaattggcgggtttggaccccccttcagtttatcaatattaactacgtgcccctgaagttcagggtactgtttgccaatctggcagccctgttttggtacgcttatctcgcgtctcttgggaaatag

SEQ ID NO: 52731 - DNA, 504 bp, Artificial Sequence
  Description of Artificial Sequence: Synthetic coding sequence
atgcctttcacgggcgaacgtagactttccttacggcgtcaagacgaaggaggcctgcttgccggagctgaagacgagctcgccggagtggacgccactacggtgcatcaacaccaactgcgaccttctgaggttcccggtgccctgagacagccaggatcaagcgtcttagtgtgcctacccggattactcggggaggtcacaaccgccggacggacctccggggctttgtggacatgggtgtgggggtcccatccgccaagcgagtcacgcaccaaccctgttcgaatgtcacttactctcaaccaggcccgaactaccgtctctgatcaaagggccgaggaggaacggggtatttggggaagaagagccggagtgcaggccggtccactgcagagccaggggcacgccgctcacctaccacaccaggcattccctgtgccacggggatggctgccaggcgaggggccacacagtgatcctgccggtagcggcgctggctag

SEQ ID NO: 52732 - DNA, 216 bp, Artificial Sequence
  Description of Artificial Sequence: Synthetic coding sequence
atggctgctcctccacaattgcgggcactccttgtggttgttaatgctttgttacgaaagcgaaggtaccatgccgctctcgctgtgctcaagggatttcgcaatggcgcagtctatggcgctaagatccgggctccccatgccctcgtgatgacttttctgtttcggaacgggcgttcaacatgcacttgctgccacgcttcttgtctcccatag

SEQ ID NO: 52733 - DNA, 639 bp, Artificial Sequence
  Description of Artificial Sequence: Synthetic coding sequence
atggctgcaccccctcagcttagggcactgctggtcgtcgtgaacgctctgcttagaaaacggagatatcatgcagcgctcgccgttttgaaggggttcagaaacggggctgtttatggggctaagatccgcgcaccacatgccctggtgatgacctttctcttccgaaacggatctctgcaggaaaagctatgggctattctgcaggctacttacatacactcttggaacttggcaagatttgttttcacttataaaggcctgcgagctctgcagtcgtacattcaaggaaagacttaccccgctcacgcctttctcgccgctttcctcggtgggatcctcgtctttggagaaaataacaacatcaattcccagatcaacatgtacttgcttagcagagtgctgtttgcattgagccgtctcgcagttgaaaagggttatattcccgaaccacggtgggatccttttcctctgctgactgcagtagtatggggcctggtcttgtggctgtttgagtatcacagatccacccttcaaccgtctctgcaatctagcatgacctacctttacgaagatagcaatgtctggcatgacattagtgattttctggtgtacaacaaatcccggccaagtaactag

SEQ ID NO: 52734 - DNA, 528 bp, Artificial Sequence
  Description of Artificial Sequence: Synthetic coding sequence
atgattcgctgcggcttagcatgtgaaagatgccgatggatcctgccgctcctgctcctatccgaccatgggcagacgagctccttgtggtggaagtgctcccaggagggaggagggagtgggtcctatgaggagggatgccaatcactgatggaatatgcatggggaagagcggcagctgccatgctcttttgtggttttatcatcctggtcatatgctttatcctgtcctttttcgctctttgtgggccacaaatgttggtcttcctaagagttattgggggtctcctggccttggccgctgtatttcagatcatttctctggtaatatacccagtgaagtatacacagacatttactctgcacgcaaacccggctgttacatacatctacaattgggcctatggttttggatgggcggcaactataattctgattggctgcgccttttttttttgttgcctccccaactatgaagatgacctgcttggtaacgcaaagcccagatatttctacacctctgcctag

SEQ ID NO: 52735 - DNA, 582 bp, Artificial Sequence
  Description of Artificial Sequence: Synthetic coding sequence
atgatcaggtgcggacttgcctgcgaacgttgcagatggatcctcccactcctgttgctgtcagccattgctttcgacatcatcgccctggcagggaggggatggctccaaagcagtgatcacggtcaaacctcttccctgtggtggaagtgcagccaggagggaggcggttctggatcctatgaggagggttgtcagagtttaatggagtatgcgtggggtcgggctgcagccgctatgctcttttgcgggtttatcatcctcgtgatctgttttatcctttccttttttgccctctgtggtccccaaatgcttgtatttctgcgagtgattggagggctgctcgccctggccgctgtcttccagataatttcattggtgatctaccccgttaagtatactcagactttcacgctccacgctaatcctgcagttacatacatctataattgggcttacggatttgggtgggccgcaactattatcctcatcggctgcgccttcttcttctgttgtcttcccaactatgaagacgatctgctcggaaatgcaaagccccgttacttttacacttccgcatag

SEQ ID NO: 52736 - DNA, 1674 bp, Artificial Sequence
  Description of Artificial Sequence: Synthetic coding sequence
atggccgcaccaatgctgaggtgggggtgccggggacgtcggtgggcattcgctcgggttgatggcggttcgtgccacaggcgcggtgcccctactggatccacatccaatcagattaggggggaatctagcgtggcacagcaacctttgcacaccgcgcagaagacccggaagggcgagcacaaatgggcagccgtggtggggctggagattcacgcacagatttcttccaatagcaagctattcagcgggtctcaagttcggttttctgctccacccaatagtttagtgtcattctttgatgcaagtttgccagggaccctcccggtgctgaatcggcgatgcgtggaggccgctgtcatgactggtctcgcactgaactgccacataaacaagaaatctctgttcgacagaaaacactacttctatgccgacctgcctgccggataccaaattactcagcaacgattacccatcgcagttaacggctccctcatctatggggtgtgtgctgggaagaaacagagtcaggtcatcccaaagacagtcaggatcaaacaaattcaattggaacaggattctggaaagtcgttacatgacaacttaaggtcccagacccttattgatttaaatagggcaggcgtggggctgctggaagttgtgctggagcccgacatgtcatgtggggaggaggctgccactgccgtcagggaactacagcttatattgcaggccctcggaacttcgcaggcaaacatggctgagggccagctgcgagtggacgctaacatcagcgtgcaccaccccggtgaacccctgggcgtgcggacggaagtaaagaatttaaatagcatccggtttctggcaaaagccattgactacgagatccaacggcagataaacgagttggaaaatggcggagaaatcctgaatgagacaaggtcgtttcaccataaactgggctgcacaatgtccatgcgggacaaggagggtaaacaggattatcgtttcatgcccgagcctaatctgccccctctggtcctctacgatgccaccagcctccccgctggtgcagatccccagcaggtcattaacatcgaccagattagagaaaccctgcccgagcttccttcagtgacccgcgagaagctagtccaacagtatggcatgctcttggagcacagctttactcttcttaatgaggtgggcctcttggaatttttccagaacgtgatcaaggaaactcgggcagaacccaaaaaagtgacatcatgggtcttgaatacatttctgggctatctgaagcagcagaatcttgcggtatcggagtcgcccgtcacaccatcagcactcgcagaacttcttgaccttcttgatagcagaacaatcagcagtagtgcggcaaaacaggtctttgaggagttgtggaagagagagggcaaaacaccaggtcagattgtgtccgaaaaacaactcgagctgatgcaggatcagggagctctggagcagctatgccattcagtcatggaagctcacccccaggtagtcatggatgttaaaaacagaaatcctcgagcgatcaataagctaatcgggctcgtgaggaaggcaacacaatcacgtgcagatcctgtgatgatcaaggagatattggagaaaaagctgtccctgtag

SEQ ID NO: 52737 - DNA, 786 bp, Artificial Sequence
  Description of Artificial Sequence: Synthetic coding sequence
atgcatggaataggaccctccgggagcttcaccgaattcctggaccctttccagcgcgtcattcagccggaggagatctggctgtacaaaaatcctctcgtgcagtctgataacatccctactcggctgatgtttgccatctcattcctgacaccactggccgtgatctgcgtggtcaaaatcatccgcagaaccgataaaaccgaaattaaggaggcgtttctggcggtttcacttgccctggccctgaatggtgtatgcacgaatacaattaagctgatcgtgggcaggcccagacccgattttttttataggtgcttcccagatggagtcatgaattctgagatgcactgcaccggtgatcctgacctggtgtccgagggcaggaaatcttttccaagcatccacagcagtttcgctttttccggcttgggattcaccacgttttatctggcgggaaagctgcactgctttactgagtcaggcaggggaaagtcctggaggctctgcgccgctattctgccgttatactgcgccatgatgattgccctatccaggatgtgcgactacaaacaccactggcaggatagctttgttggcggagtcatcggtcttattttcgcttacatctgctatagacagcactacccccctctggccaacaccgcttgccacaaaccatacgttagcctgagagtgccagccagtctgaaaaaggaggaaagacccaccgcagattccgccccaagcttgcccctcgagggcatcacggaggggcctgtttag

SEQ ID NO: 52738 - DNA, 291 bp, Artificial Sequence
  Description of Artificial Sequence: Synthetic coding sequence
atgagagagctggcgatagaaatcggcgtgagggcactcctcttcggagtgttcgtgtttactgagtttctggatccctttcagagagttatacaaccagaggaaatatggctttataagaatcctctagtccagtctgataatattcccacccgcttaatgttcatacccctctgggtcgaatctagcgctagctttctccacacgtttgctactgactccactatcctcctttggcccacgcagctggccattaacccaaccttagtttgcgaatcacaaccacactag

SEQ ID NO: 52739 - DNA, 816 bp, Artificial Sequence
  Description of Artificial Sequence: Synthetic coding sequence
atgcgggagttggcaattgagattggcgttcgcgcactgctgttcggcgtgtttgtatttaccgaattcctggacccatttcaacgagttatccagcctgaggaaatctggttatacaagaatccactggtgcagagcgataacatccctacgaggttgatgtttgccatttcttttctgaccccactggctgtgatctgcgtggttaaaatcattcggagaaccgacaaaactgagatcaaggaggccttcctggctgtcagcctggcattagctctgaatggggtttgcaccaataccatcaaactgatagtgggcagaccacgacctgatttcttctatagatgctttcctgatggcgtcatgaactcggaaatgcattgcacgggtgatccagacctggtcagcgagggtaggaaaagctttccatcaatccatagctcattcgcctttagtggcttggggttcacaacattctacctggcaggcaaactgcactgttttacggaaagcggccgaggcaagtcttggaggctctgtgcagccattctgccactgtactgtgctatgatgatcgccctttcccgcatgtgcgactacaaacaccattggcaggactcattcgtggggggagtgattgggctaatctttgcttacatttgttaccggcagcattacccacccctcgccaataccgcgtgccataaaccatatgttagcctgagagttccagcttctctgaaaaaagaggaacggccaaccgccgattctgctccgtcactccctctggaagggatcaccgagggcccagtctag

SEQ ID NO: 52740 - DNA, 804 bp, Artificial Sequence
  Description of Artificial Sequence: Synthetic coding sequence
atgcgggaactggccattgagattggggtccgtgcattactgttcggggtgttcgttttcacggagttccttgacccattccagagggtaattcagcccgaagaaatctggctctataaaaatccactcgtgcagagcgataatataccaacaaggctgatgttcgctatctcattcctgacgcccctggcagtgatatgtgttgttaagattatcaggcggacagacaagactgaaatcaaggaggccttcctggcagtgtcactcgcgctggctctcaacggagtgtgtacaaacacaatcaagctgattgtaggaagaccccgtccagacttcttttatcgttgcttccctgatggggttatgaactcggagatgcattgcacgggtgatccagacttggtctccgaaggaagaaaatcctttccgagtattcattcatctttcgccttttcaggactcggttttacaaccttctacctcgccggaaaactccactgctttacggaaagtggaagaggaaaaagctggaggctatgtgccgctatccttcctttgtattgcgcaatgatgatagctctgagcaggatgtgtgactacaagcatcactggcaggacagctttgttggaggtgtgatcggtctgatctttgcttacatttgctatagacaacactacccacctctggctaataccgcgtgtcacaagccctatgtcagccttagagttcctgcttccttgaagaaggaggagcgccctactgctgactcagcgccttcgctccctctggaaggcatcacatag

SEQ ID NO: 52741 - DNA, 627 bp, Artificial Sequence
  Description of Artificial Sequence: Synthetic coding sequence
atgcgggaactggccatcgagatcggggttcgtgcactactctttggcgtgtttgtattcactgagttcctggaccccttccaacgggtaattcagccagaggagatttggctgtacaagaatcccctggtgcagagcgacaatatccctacccgtttaatgtttgcaatctcatttcttacgccattggccgtaatctgcgtggtcaagattataaggcgaacggacaagaccgaaataaaagaagcctttctggttgccttttctggcctagggttcaccactttctacttagctggcaagctgcactgctttacagagagtggacgtggcaagtcttggcggctgtgcgccgctatcctcccactctattgcgccatgatgatagctctgtccaggatgtgcgattacaagcaccactggcaagatagcttcgttggcggtgttatcggcctgatctttgcatatatctgttatcgtcagcattaccccccactggcgaacactgcctgccataaaccgtacgtgtctctgcgggtcccagcatccctcaaaaaggaggaaagaccaaccgccgacagtgcgccttcgctcccccttgagggaatcacagaaggcccagtgtag

SEQ ID NO: 52742 - DNA, 702 bp, Artificial Sequence
  Description of Artificial Sequence: Synthetic coding sequence
atgagagaattagctattgagatcggggtccgtgctctgttgtttggggtgttcgtgtttaccgagtttttggaccccttccagcgggtgatccagccggaagagatttggctgtacaagaaccctctcgtgcagagcgataatatcccaacacgtcttatgttcgccattagcttcctaacccccctagcggtgatctgcgtggtcaagatcatccggaggaccgataagaccgaaatcaaggaagcatttctggcggtcagcctagccttagcgttaaatggtgtttgcactaataccatcaaattaatcgtgggccgaccacgacccgatttcttctatcggtgtttccctgacggagttatgaacagcgagatgcattgtaccggagacccagacttggtctccgaaggccgtaagtctttccctagtattcacagctccttcgccttcagcggtctgggtttcaccaccttctacctcgcgggtaaactccattgctttactgagagcggacgtggcaaaagttggaggctgtgcgcagcaatcctcccgctgtactgcgccatgatgatcgccctgagccgaatgtgcgattacaagcaccactggcaggttgggtgctgtgtttggcagggtccacagtctcaccttccgtcggccgcaaaccctcggctgtgcttagggacttcagaaccatag

SEQ ID NO: 52743 - DNA, 456 bp, Artificial Sequence
  Description of Artificial Sequence: Synthetic coding sequence
atgcccgctagccagagtcgggctagggctcgcgacaggaacaatgttcttaatagggcggagtttctcagtcttaatcagcccccaaagggtggaccggaaccacgctcttccggcaggaaggccagtggaccgtccgctcagcctcccccagctggcgacggagccagggagaggcggcagagtcagcagctgccggaagaggactgcatgcaactgaacccttcctttaaaggcattgcctttaacagcctgctcgctatcgacatctgtatgagcaagagactcggagtctgtgccggtcgtgccgctagctgggcctccgcgaggtctatggtcaagcttattgggatcaccgggcatggaatcccttggattggaggcactatattatgtctggttaaatccagcacacttgcagggcaggaagttctgatgaacctgctgctggattag

SEQ ID NO: 52744 - DNA, 816 bp, Artificial Sequence
  Description of Artificial Sequence: Synthetic coding sequence
atgcccgcttctcagagcagagctcgcgcacgcgacaggaacaatgtattgaatcgtgcagagtttctcagtctgaaccagccaccaaagggagggccagagcccagaagtagcggcagaaaagcctccggaccctcagcacagcccccaccagcaggcgacggagcgcgagaacggaggcagagccagcagctgcctgaggaagattgtatgcaactaaatccctcttttaaaggaatcgcgtttaatagcctgttggccattgatatttgcatgtcaaagcggctcggggtctgtgctggcagggcagctagctgggcctctgcgaggtctatggtcaaacttatcggcattaccggacacggcataccctggataggcggaaccattctgtgtctggttaaaagctctactctcgctggtcaagaggtgcttatgaacttacttctggctctgttgcttgatattatgacggttgcaggcgtgcagaagctgattaaacgtaggggcccttacgagacgtccccaagtttgctcgactatctgacgatggacatctacgctttccctgcgggacacgccagccgtgccgcaatggtaagcaagtttttcttaagtcacctcgtgctggccgtgcctctgcgtgtcctcctggtcctctgggccctttgcgtaggcctttcacgggttatgatcggtaggcatcacgtaacggatgtgttgtccggctttgtcatcggctatctgcagtttaggttggtggagctagtatggatgccatcctccacctgtcagatgttgatcagcgcctggtag

SEQ ID NO: 52745 - DNA, 858 bp, Artificial Sequence
  Description of Artificial Sequence: Synthetic coding sequence
atgttcgacaagaccagactcccctacgtggctttagatgtgttgtgtgtactgttagcgtcaatgccaatggccgtgttgaagctggggcagatctacccatttcagagagggttcttctgcaaagacaacagtatcaattacccgtaccacgatagtacagtcacttctacagttctcattctcgtgggagtcggcctgcccatctcatccatcatcctcggagaaaccctgtccgtgtactgcaacctgttgcattcgaattctttcatccgaaataattacatcgccaccatctacaaagctatcggtacatttctgtttggagctgcagcctcccaatcccttacagatatcgccaaatactcgatagggagactgaggccgcatttcctagatgtatgcgaccccgactggagcaaaattaactgctctgatgggtatattgaatactatatatgtaggggtaatgccgagagggtaaaggaaggccgtctgtcattctatagcggccactcttctttctctatgtactgcatgctttttgtggctctgtacttgcaagccagaatgaagggggactgggctaggctgctcagacctacccttcagtttggcctcgtggcagtgtccatctacgtcggactgagcagggtttccgattataaacatcactggtctgacgtgttaaccgggctaattcagggcgcactggtggccatcctggtggccgtgtatgtatcagatttcttcaaggagcgcacctcattcaaggaacgcaaagaagaagacagtcacaccacactccacgaaacacctactactggcaaccattacccctcgaaccatcagccctag

SEQ ID NO: 52746 - DNA, 855 bp, Artificial Sequence
  Description of Artificial Sequence: Synthetic coding sequence
atgtttgacaaaacccggttgccctacgttgccttagacgtcctgtgtgtcttactagcaggcctgcctttcgcgatcctcaccagtcgtcatacaccgtttcagcgcggagtcttctgtaatgacgaatccatcaaatacccctacaaggaagacaccatcccctacgctctcctcggtggcatcattataccttttagcattatcgttatcatacttggagaaaccttatccgtatattgcaaccttttgcattctaacagctttatccggaataactacattgctacgatttataaggcgatcgggacattcctgttcggagccgcagcttctcagtctctgactgatattgccaaatattcaatcgggaggctacgcccacatttcctcgacgtgtgtgaccccgattggtcaaagatcaactgcagtgacggctatattgagtattacatctgccggggaaacgcggaacgggttaaggaaggtcgcctcagtttttatagcgggcactccagctttagcatgtattgcatgttgtttgttgccctctacttgcaggcgaggatgaagggagattgggcgaggctgctgcgacccaccttacaattcggactcgtcgccgtttcaatctacgttggactgagcagagtttcagattacaaacatcattggagtgatgtgttgacaggactgattcagggcgctctggtggctattctggtagctgtttacgttagtgattttttcaaggaacgtacaagcttcaaagagaggaaagaagaggatagtcacacaacactccacgagactccaactaccggtaaccattacccttccaaccaccagccttag

SEQ ID NO: 52747 - DNA, 936 bp, Artificial Sequence
  Description of Artificial Sequence: Synthetic coding sequence
atgcagaattacaaatatgacaaagctatagtgcccgaatccaagaatggcggttcccccgctttgaataacaatccacgcaggagtgggtctaaaagagttttactgatctgcctggacctattctgcctatttatggcaggtctccctttcctgatcatcgaaactagtaccattaaaccctatcatagagggttttattgcaatgatgagtcaatcaaataccctctgaaaacaggggagacaattaacgatgctgtgttgtgtgcagtcgggattgtgattgcaatccttgccataattacgggcgagttctaccggatttattatcttaagaagtccagatcaacgatccagaacccatacgtcgctgccctctacaaacaggtgggatgcttcttgttcggctgcgccattagccagtcctttaccgacatcgcaaaggtcagcattgggagactgcgcccacatttcctgagtgtttgcaacccagatttcagccaaattaattgctcagaagggtatatccagaattatagatgtagaggagatgacagcaaagtgcaggaagcaaggaaatctttcttttccgggcacgccagcttttccatgtacactatgctgtatttggtcctgtatctgcaggcacggttcacctggcgaggcgctcggttactccggccactgctgcagtttactctgataatgatggccttctacacaggactttcacgagtctccgatcataaacatcacccatctgatgtcctcgccggtttcgcccagggtgctctggtagcctgctgtattgtctttttcgtctctgacctgttcaagacaaaaacaaccctttccttgcccgcacccgcaattcggaaggagatccttagcccagtcgacatcattgatcgcaataaccatcacaacatgatgtag

SEQ ID NO: 52748 - DNA, 867 bp, Artificial Sequence
  Description of Artificial Sequence: Synthetic coding sequence
atgcagcgcaggtgggtcttcgtgctcctcgacgtcttgtgcctcctggtggcgtccctaccatttgcaatcttgacgctcgtcaacgccccttacaagagaggcttttattgcggcgacgactccatcagatacccatacaggcccgataccatcacacacggactgatggctggtgttacaataactgccacagtcatactggtctccgccggagaggcatatctcgtatataccgatagactgtattctcgatccgattttaacaattatgtcgccgctgtttacaaagtcctgggcacttttttatttggcgctgctgtatcacagtctctgactgatctggctaagtatatgatcgggcgattaaggcctaatttcctcgctgtgtgcgacccagattggagccgcgtgaattgttcagtgtatgtgcaactggagaaagtgtgtcggggaaacccagctgacgtaaccgaggcccgattatctttttactcaggccactcctcatttgggatgtactgtatggtgtttctggccctgtatgttcaggcccgactgtgctggaagtgggccagactgctgcgcccaaccgtccagttcttccttgttgcctttgctctctacgtgggttacacacgagtcagcgattacaagcaccattggtcggatgtgcttgtgggcctcctccagggcgctttagttgccgctctcacagtctgttatatatcggatttcttcaaggccaggccgcctcagcactgcctgaaagaagaagaattggagcgcaagcccagcctgtctctaactctaactctcggcgaggcagaccacaatcactatggttaccctcattcatcctcctag

SEQ ID NO: 52749 - DNA, 930 bp, Artificial Sequence
  Description of Artificial Sequence: Synthetic coding sequence
atgggagtagctagaggacctggcagccgtggtcagcacccacccccaagacagcaggaggtatgtgcagagggaccccgagcgaggctccatcccgcaccacccggactgggggcttctctgccatttgccatcctgacactagtgaatgcaccttataaaaggggattttattgcggtgacgattcaatcaggtatccttatcgaccagatacaattacgcacggcctgatggccggagtgaccataaccgcaactgtgattctggtgagcgccggtgaagcttatttggtctacaccgaccggctgtactcccgcagtgattttaacaactatgttgccgcagtctacaaggttttgggcacattcctgttcggcgcagccgtatcccaatctctcaccgatctcgccaaatatatgatcggtaggttgcgcccaaacttcctcgccgtgtgtgatcctgactggtctagagtcaactgtagcgtctacgtgcagttggaaaaggtgtgtagaggcaaccctgccgatgttaccgaggcaagactgtctttctattcaggacatagctcttttggcatgtattgtatggtcttccttgctctatacgttcaagctcggttgtgttggaaatgggcgcgacttctccgccctacagtgcaattctttctggtggcatttgccctttatgtggggtacactcgagtgagcgactataagcatcactggtcagacgtgcttgtcggcctgctgcagggggcactggtcgcagccctgaccgtgtgttatatctcagactttttcaaggcacggccaccccagcactgtttgaaagaagaagaactggaacgtaagccttcgttgagtctgactcttaccctgggggaagcagatcataatcactatggctacccacacagcagtagctag

SEQ ID NO: 52750 - DNA, 699 bp, Artificial Sequence
  Description of Artificial Sequence: Synthetic coding sequence
atggctggtgtcactataacggctactgtaatcttggtttccgccggagaggcatacctggtgtataccgatcgactttactccagatctgacttcaacaattacgtggctgccgtctacaaagttcttggcacattccttttcggtgccgctgtcagccaatccctcaccgacttggctaagtatatgataggcaggcttcggccaaactttctagccgtgtgtgatccagactggtccagagtcaactgttccgtatatgtgcagttggaaaaggtttgcaggggtaacccagccgacgtgactgaagcaagactgagtttctactcagggcattcaagttttggaatgtattgcatggtatttttggcattatacgtgcaggcgaggctctgctggaagtgggcaaggctccttcggccaacagttcagtttttcctcgtagcttttgccctgtatgtgggctacacgcgggtttctgattacaaacaccactggagtgatgtgttggtgggcctccttcagggggctctggtagccgctctgacggtctgttacatctctgacttcttcaaggcacggcctcctcaacactgtttaaaggaggaggagttggaaaggaagccctctctcagtctgacattgacgctgggcgaggccgaccacaaccactatggctacccgcatagctcttcgtag

SEQ ID NO: 52751 - DNA, 711 bp, Artificial Sequence
  Description of Artificial Sequence: Synthetic coding sequence
atgaaaaggagcgggaatccaggtgcagaggtcactaacagctcagtggccggtccagactgctgtggagggttgggtaacatcgattttaggcaggccgatttctgcgtgatgacccgcctgctcggttacgtcgatcctctggatccatccttcgtggctgccgtaatcaccatcacttttaaccctctttactggaatgtggtagcacgctgggagcacaaaaccagaaaactcagtagggcatttgggtctccttacttggcctgctactcgctttctgtcaccattttgttactcaatttcctccgctcacactgtttcacccaggcaatgctgtctcagcccagaatggagagccttgatactccggcagcctactccctgggtttggccctcttgggcctaggagtggtgttggtgttgtctagcttcttcgccctcgggtttgcgggtacgttccttggtgattatttcggaattttgaaggaagcaagggtcacagtgtttccgtttaatatcttggacaaccccatgtactgggggtctacggctaattacctaggatgggctataatgcatgccagtcccaccgggcttctccttaccgttctggtggccctaacttatatcgttgcgctgctctatgaggagccttttacagccgaaatttacaggcagaaggctagcgggtcgcacaaacgttcctag

SEQ ID NO: 52752 - DNA, 699 bp, Artificial Sequence
  Description of Artificial Sequence: Synthetic coding sequence
atgaagcggagtggcaaccccggtgccgaagttacgaatagtagcgtggcaggacctgattgttgtggtgggctcggcaatatcgatttcagacaggcagatttttgcgtgatgacacgcctcctggggtacgtggaccctctggatcccagttttgtggccgcagtgattacaatcacatttaacccactgtattggaacgtggtagcacgttgggagcacaaaaccagaaaactcagcagggctttcgggagcccatatctggcctgctattcactttctgtaaccatcctgctgctgaatttcctgcgcagccactgttttacccaggccatgctgagtcagccaagaatggaatcactggataccccagccgcatattccctgggactggctctccttggcctgggagtagtactcgttctgtcaagcttctttgccctgggctttgctggcacctttctgggtgattatttcggaattctgaaggaggccagggtcacagttttcccattcaacattttagacaatcctatgtactggggttcaactgctaattatctgggctgggccattattcccgctcctgcaggcgcagtgggctccgaagccaggcaaccacatggtcccgctccggacggagcaggaggccctcatctgcactctgggtcccctattcgtcgtgcactgcaccggtag

SEQ ID NO: 52753 - DNA, 600 bp, Artificial Sequence
  Description of Artificial Sequence: Synthetic coding sequence
atgacccgcctgctgggttatgtggaccctctcgacccatcttttgtagccgcagtgatcacgatcacgtttaatcccctctattggaacgttgtcgcaagatgggagcacaaaactcggaaattgtctcgggcattcgggtccccatatctggcttgctactccctcagcgtcacgattctgttactgaatttcctccgcagtcattgcttcacccaggccatgctcagccagccgagaatggagtctctggataccccggcagcttacagcctcgggctggctctcctgggactcggcgtggtgctggttctgagcagcttctttgctctggggtttgcaggaactttcctgggcgattactttggcattcttaaggaagccagagttactgtgttccccttcaacatactggacaacccgatgtactggggttctaccgcaaattatctggggtgggctataatgcacgcaagccctactggattgctgctgaccgtgctggtggctctcacctatatcgtggctctgctatacgaggagcccttcacagccgagatctatcgccaaaaggccagcggaagccataagagaagttag

SEQ ID NO: 52754 - DNA, 600 bp, Artificial Sequence
  Description of Artificial Sequence: Synthetic coding sequence
atgaccagattgctggggtacgtcgacccgctggatccatctttcgtggcggctgtgataactatcaccttcaaccctctctattggaatgtcgttgccagatgggaacataaaaccagaaaattatctcgtgctttcggctccccatacctggcttgctactccctgtctgtgacgattctgctccttaatttcctgaggtctcattgttttactcaggcaatgttgtcccaaccccgaatggagagtctcgacactcccgctgcctacagcttgggcctggccctgctgggtctcggggtagtgttggttctgagctcattcttcgcgcttggtttcgctggcacattcctaggagactattttggcatacttaaggaggctcgcgtgactgtgttcccttttaatatcttggacaatcccatgtattggggctctactgccaactatctgggatgggccatcatgcatgcttccccaaccggacttctcttgacagtgttggtggccctgacttatattgttgccctcttgtacgaagaaccgtttacagcagaaatctatagacagaaagcatctgggtcacacaaacggtcatag

SEQ ID NO: 52755 - DNA, 642 bp, Artificial Sequence
  Description of Artificial Sequence: Synthetic coding sequence
atgaaaagatctggcaatcccggagctgaggtaacaaactcctcagttgcaggccctgactgttgtgggggtctgggtaacatcgactttagacaggccgacttctgtgtgatgaccaggctgctcggttatgtggatcccttggacccttcttttgtcgctgcagtgattacaatcacgttcaatcctctgtactggaatgtggttgcgagatgggaacacaaaacaaggaaactctctcgtgcttttggttccccttacctggcctgttattcactgagcgtgactattctcctactgaactttctacgctcccattgttttactcaggccatgctgtcccagccccgaatggagtcacttgacactcccgcagcctactctctcggactcgctttgttggggctgggtgtggtacttgtgctgagtagtttctttgcccttggattcgctgggaccttcctgggcgattatttcgggatcctcaaggaggcccgagtaactgtgttccctttcaacattctggacaaccccatgtattggggctccactgccaactatctgggatgggccatcattctgtgcccatgcggccgatatccctttccccagcgcggaccacgcgcaatgagagaggcttag

SEQ ID NO: 52756 - DNA, 636 bp, Artificial Sequence
  Description of Artificial Sequence: Synthetic coding sequence
atgaaacgtagcggaaatcctggggctgaggctgatttttgcgtgatgactcggctgctgggttacgtggatcccctggacccttctttcgtcgctgctgtgataacaatcactttcaatccattgtactggaatgtcgtggcgagatgggaacacaaaacgaggaaactgtcccgggcattcggctccccttatcttgcttgctattccctaagcgtgacgatcctgctcttaaatttcctcaggtcacattgcttcacacaggccatgctctcccagccaaggatggagagcctcgacaccccagcagcttacagtttgggactggctctgttgggtttaggagtggttctggtactctcttccttctttgcacttggatttgctgggacattcctgggagactattttggtatccttaaagaagctagagtgactgtcttcccatttaatatcctggataatcccatgtactggggatccacagcaaattacctgggttgggccattataagtccagccccagccggagccgtcgggagcgaggctcggcagccacatggcccagcgccagatggggctggcggaccccacctacattctggaagtcccatcaggagagcattgcaccggtag

SEQ ID NO: 52757 - DNA, 684 bp, Artificial Sequence
  Description of Artificial Sequence: Synthetic coding sequence
atgggctggactatgcggctggtgaccgctgccctcctcctcggactgatgatggtggtgaccggagacgaagatgaaaatagcccctgcgcacacgaagctcttctcgacgaagatactctcttttgccagggattggaagttttctaccctgagttaggtaatatcggatgtaaagtggtccccgattgcaataactaccgacaaaagattaccagctggatggaacctatcgtcaaattccctggggcagttgatggcgctacatatattttggtgatggtggacccagacgcaccatctcgcgcagagcccagacaacgcttttggcggcattggctcgtgaccgacattaaaggcgcagacttaaaaaagggcaaaatccaggggcaggagctgtccgcttaccaagccccaagtccaccagcgcactccggattccatcgttaccaattcttcgtatatctgcaggaggggaaagttatctcactactacctaaggagaacaaaacaagaggcagttggaaaatggaccgctttttaaaccgtttccatctgggcgagcctgaagcgtccacgcagttcatgacacagaactaccaggattcacccaccttgcaggcacccagagaacgtgcttctgagcctaaacataagaaccaggcggagattgccgcatgttag

SEQ ID NO: 52758 - DNA, 1671 bp, Artificial Sequence
  Description of Artificial Sequence: Synthetic coding sequence
atggccgtggcagccgctgcagctgccggtccagtgttctggcgcaggctgctcggcctcctgccgggacgccctgggcttgcagcccttcttggacgcctgtctgaccgtttggggcgaaacagagacaggcagagacgacgctctccttggctgctcctggcccctctgctgagcccggctgtgcctcaggtgaccagcccaccgtgttgtctgtgccccgaaggtgtccaccgttttcagtggataaggaacctggtccccgagttcggcgtgagcagctcccatgtgcgtgtcctttcgagccccgctgaattcttcgagctgatgaaagggcagattcgagtggccaagcgtagggtagttatggccagtctgtacctgggcaccggcccactggagcaagagttagtcgactgtctcgagtccactctcgagaagagccttcaagccaagtttccaagcaatctgaaggtgagcatccttttggacttcaccagaggatcaaggggtaggaagaacagtagaactatgcttctgcctctcctccggaggttcccagagcaggtgcgggtcagcctcttccacacgccgcatcttcgcggactcctccgcttgctgattccggaacgcttcaacgaaacaatcggtctgcagcacattaaagtgtatttatttgacaattctgtgatcctttccggcgctaacctgagcgactcttattttaccaacagacaggaccgctacgtcttcctccaagattgtgccgaaatcgccgattttttcacggaactcgttgatgcggtgggggacgtctcattgcagctacagggagacgataccgtccaagtagtggacggtatggtgcatccatacaaaggtgaccgcgcagagtattgtaaggcagctaataagagagtaatggacgtcattaacagtgcaagaacccggcaacagatgctgcacgctcaaacatttcatagcaatagcctcctcacccaagaagacgctgctgccgctggggaccgtcggcctgccccagatacatggatatacccgctcattcagatgaaaccattcgagatccagattgatgagatagtaacagagactctacttactgaagctgaacggggagcaaaagtctacctgacgacgggctattttaatctcacacaggcttatatggatctagtgttaggaacccgggctgaatatcaaattctgctagcaagtcccgaagtgaatggctttttcggggcaaagggcgttgcgggtgccatccccgctgcctacgtccatattgaaaggcaatttttttcggaggtgtgttccctggggcagcaggaaagagtccaactccaggaatattggcggagagggtggacttttcatgcgaagggcctgtggttatacctggccggtagctcattgccttgcctgaccttgattgggagtcccaactttggatacagatcggttcacagagatctggaggcgcagattgccattgtgaccgaaaaccaggccctgcagcagcagttacaccaggaacaggagcagctttacctccggtctggcgtcgtctcctctgctacatttgagcagccatctcggcaggtgaaactctgggtgaaaatggtgactcctctcattaaaaatttcttctag

SEQ ID NO: 52759 - DNA, 1266 bp, Artificial Sequence
  Description of Artificial Sequence: Synthetic coding sequence
atgaaagtggattgcctcgaatctaccttagagaaatctcttcaggcaaaattcccttcaaatctcaaagtaagcatactgttagacttcacaagaggatccagaggcagaaagaactcaaggactatgttgttgcctctattacgtaggtttccggagcaggtgagggtatccttgttccacacacctcacctcagggggttgctcagactgttaattcccgagcgctttaatgaaacaattggcctacagcacatcaaagtgtatctgttcgataatagtgtgatcctgagcggggctaatctaagcgacagctattttacgaaccgacaggataggtacgttttcctccaagattgcgctgaaattgccgacttcttcacagagcttgtggatgctgtgggggacgtaagccttcagctgcagggagacgataccgtgcaggtggtcgacggtatggtgcatccctacaagggggaccgggctgaatattgcaaggccgcaaacaaaagggtcatggacgtaattaatagcgcccgtacacgccagcagatgctgcacgctcaaaccttccatagtaactctcttctgacacaggaagacgcggctgccgcaggagatcgtcgtccggcaccagacacgtggatctatcccctaatccagatgaaaccatttgagatacagattgacgaaattgttaccgagactcttttgaccgaggcagaacgaggagccaaagtctatctcacaaccggctatttcaatctcactcaggcgtatatggatctggtgctcggaactagggcggaataccagatcctgttggcctcccccgaagtgaacgggttttttggcgctaagggagtagctggcgctatccccgctgcctatgtgcatattgagcgccagtttttctcggaggtgtgttccttgggccagcaggagcgcgtccagttgcaggaatattggcgaagagggtggacctttcatgctaaggggctgtggttatacctggccggatcgtccctaccgtgcctcacactcatcgggagcccaaacttcgggtacagatctgtgcacagagatctcgaagcccagattgccattgtgaccgagaaccaggccctgcaacagcagctgcatcaagaacaggaacagctctaccttcgcagcggcgtggtgagtagtgctacattcgagcaaccgtcccgtcaagtgaagctgtgggtcaagatggtgacccctctgatcaaaaattttttttag

SEQ ID NO: 52760 - DNA, 807 bp, Artificial Sequence
  Description of Artificial Sequence: Synthetic coding sequence
atgaaggtggattgcttggaaagtacattagaaaagtcactgcaggctaaatttccatctaatctgaaggtctctatccttttggacttcaccagaggaagtcgtggcagaaaaaactctaggaccatgctgctgcctctcctccgcaggttccctgagcaggtacgcgtctcccttttccacactccacatctccgaggattactccgcctactgataccagagagattcaatgaaactatcgggttacagcatattaaagtgtatctcttcgataattccgtaatcctctcgggggcaaacttatctgattcgtactttacaaaccgccaggataggtatgttttcctccaggattgtgcagaaattgccgacttttttaccgagctggtggacgccgttggcgatgtctctctacagttgcaaggcgacgacactgtgcaggtggtagacggcatggtccacccatacaagggcgaccgcgctgagtattgcaaggccgctaacaagcgagttatggatgtgatcaactctgctagaacacggcagcagatgctacacgcacaaactttccactctaactctttactgacacaggaggacgccgctgccgctggcgaccgacggcctgcaccagacacttggatatacccgctgatacagatgaagcctttcgaaatccagatagacgagatcgtgaccgagaccttgctgaccgaggctgaaaggggggctaaagtatatctgaccaccggctattttaacttaacccaggcttatatgcctggcttgggccattctggctag

SEQ ID NO: 52761 - DNA, 900 bp, Artificial Sequence
  Description of Artificial Sequence: Synthetic coding sequence
atgccgtacaccacttatttagtggagaaaggagcttctcacagctttgtggcagaggccaagcccccaacagtaaccatgccacgcattaaagccctgatgaccggcagtctgccaggattcgtggacgtgatcagaaacctgaatagccctgctttgctggaggattccgttatccgccaggccaaggccgctggaaaaaggatcgtcttctatggtgacgaaacctgggtcaaactattccccaagcatttcgtggagtacgatgggaccactagcttttttgtttcggattacaccgaagtggataataatgtgactagacacctggataaggtgctcaagcgcggagactgggatatcctgattctacactaccttgggctcgaccatattggacatatatctgggcctaactcacctctgatcgggcagaagctgtctgagatggacagcgtgctgatgaaaatccatacctctcttcagagcaaggagcgtgaaacccctctaccaaatttgctcgtgctgtgtggggaccatggaatgtccgaaaccggctcccatggagcttcatctactgaagaagtgaacacacctttaattttaattagttccgccttcgaaagaaagccgggagacataaggcatcccaagcatgtccagcagacagatgtggccgcaacgcttgccatcgcacttgggctgcccatccctaaggactcagtgggctcattgttgtttcccgtcgtcgaaggccgtcctatgagggagcagcttcgtttcctacatctgaacactgtgcagttgtcaaagctgttgcaggagaatgtcccaagctatgagaaaggcagccacccggctcccgcacagaggcctactggaaccgcccagaaggggtag

SEQ ID NO: 52762 - DNA, 2928 bp, Artificial Sequence
  Description of Artificial Sequence: Synthetic coding sequence
atgaggctggggagcgggactttcgctacatgctgtgtggccatcgaggtgctggggatcgctgttttcctgcgaggcttttttcccgctcctgttcgcagcagcgccagagcagagcacggggcagagcccccagccccagagccttctgctggggctagttccaattggaccaccctgccaccacccctgttcagcaaggtagtgatagtgctcattgacgccctacgggatgatttcgtattcggctcaaaaggagtgaaattcatgccatatactacctacctcgtggaaaagggcgcttctcattcttttgttgccgaagccaagccgccaacagttacgatgcccaggatcaaggcgctgatgactggatccctacccggtttcgtcgatgtaatccggaatttgaactctccggcactgttggaagactcagtgattcggcaggctaaggcagccggaaagaggattgtgttttacggggacgagacgtgggttaaactcttccctaaacacttcgtggagtatgacgggacaacaagcttcttcgtgtcagactacactgaggtcgacaacaatgtcacgcggcatctggacaaggttcttaagagaggcgactgggacattctgattctgcactaccttggactcgatcacatcggtcacatctcaggcccaaactctccgcttataggacaaaagctgagtgagatggactcagttctgatgaagatccatacttcgctccagagtaaagagagagaaacacccctgccaaacttgcttgtgctatgtggcgatcacggaatgagcgaaactggatctcacggcgcaagctccaccgaggaagttaatactcctctgattcttatctcttctgcctttgaaagaaagccaggggacatcaggcacccgaagcacgtccagcagaccgacgtggccgctacactggccatagccctgggcctgccaatccccaaggatagcgtaggatcactcctgtttcccgttgtggaggggaggccaatgcgggaacagttacgcttcctgcacctgaacaccgtgcagttatcgaagttgctccaggagaacgtaccctcctatgagaaggaccctggcttcgaacagttcaagatgtccgaaaggctccacggaaattggattaggttgtacctcgaagagaagcactccgaggttctgttcaatctcgggagcaaagtcttgaggcaatatttagacgccctcaagaccctctccctctcgctcagtgcccaggttgcacagtacgacatctattccatgatggtcctgactctgctcctcctcagcgtgccccaagcactgcgcagaaaagccgagctggaggttccactgtcaagtcctggattctccctgttgttttatttagtgatactcgtgctttctgccgtccacgtcatagtgtgcacatcggcggagtctagctgctatttctgcggcctgagctggctggccgctggaggggtgatggtgttggccagtgcgcttttgtgcgtgatcgtatctgtccttacaaatgtgctagttggcggaaacaccccacgcaagaatcccatgcaccctagctctaggtggagcgagctcgacttgctgattcttttggggaccgccggacatgtcctgtccctgggcgcttcaagttttgtagaggaggaacaccaaacttggtattttctggttaatacgctttgtctggccctctctcaagagacatacagaaactatttcttgggtgacgacggcgagccaccatgtggtctctgtgtggagcaggggcatgacggggctaccgccgcatggcaggacggcccaggatgtgacgttcttgagcgggacaagggacacggatcgccaagcaccagtgaagtcctgaggggtagggagaaatggatggtccttgcctccccctggcttatcctggcgtgttgccgcctgctgcgatctctcaaccagacaggagtgcagtgggcgcaccgccctgacttgggccactggcttactagcagcgatcacaaggccgaactgtctgttctcgctgctctttcactgttagtggtcttcgtcctagttcagagggggtgctcccctgtgtccaaagctgccctggccctcggcctcttgggcgtttactgctatcgcgcagcaattgggtcagtgcgatttccctggcgtcccgattccaaagatatatctaaaggaattattgaggccaggttcgtatatgtgtttgtccttgggattctgtttacgggaaccaaagatctgttgaaaagtcaggtgatcgccgcagacttcaaattgaagacggtggggctgtgggagatttatagcggcctcgtcctcctagccgcactgctcttccgccctcacaatctcccagtcctggccttttctttactgatccagacactgatgacaaaatttatctggaaaccgctgaggcatgacgccgcagaaatcacagtcatgcactactggttcggccaggcatttttttactttcaagggaattcgaataacattgctaccgtggatatctccgcaggttttgtgggactggacacttacgtcgaaattccggctgttctgctgaccgcttttggaacatatgccggtcccgtgctgtgggcctcccatcttgtccacttcctcagctcggagacacggtcaggatccgccctatcgcacgcatgtttttgctacgccctcatttgctccatccctgtattcacctacatagtgctcgttacctcactgcgataccacctctttatttggtcggtattcagtcctaagctgctttatgaagggatgcatctgctgataaccgctgctgtgtgcgtgttttttacagccatggatcaaacaagattaacgcaaagttag

SEQ ID NO: 52763 - DNA, 2553 bp, Artificial Sequence
  Description of Artificial Sequence: Synthetic coding sequence
atgcgcttgggaagtggaactttcgcaacctgctgcgtcgcaattgaggtgctggggatagctgtcttcctgcggggtttcttcccagcacccgtgaggagcagtgcgagagccgaacatggcgctgaacccccagccccagaaccaagcgctggcgcaagctccaactggaccacccttccccctcccttgttctcaaaggtcgttatagttctgattgatgctctgcgcgacgacttcgtctttggatccaagggcgtgaagtttatgccctatactacctatttagtggaaaagggagcgagccattcattcgtagccgaggcgaagccaccaactgtcaccatgccgaggattaaagaaagagaaaccccgctgcctaatctgttagtactctgtggcgaccacggtatgagtgaaaccgggtcacatggagcctccagtaccgaagaggtgaacacccccctcatcctgatttcatccgctttcgaaaggaagccaggagacatacgccacccaaaacatgtccaacagactgatgttgccgcaactctggcaatagcactggggctgcccatccccaaggattctgttggctccctgctttttcccgtcgtggaggggaggcctatgagagaacagctgcgctttctgcatctgaatacggtgcagctttccaagctgctgcaagagaatgtcccatcttacgagaaggacccaggattcgagcaatttaaaatgtccgaacggcttcacggaaactggatccggctgtatctcgaggagaaacattccgaagtcctcttcaatctgggatcaaaagtcctgagacagtatttggacgcactgaagacacttagcttgtccctgtctgcacaggtcgcgcagtacgatatatattctatgatggtgggcacagtggtcgtgcttgaggtcctgactttgctgctgctgtctgtgcctcaagctctccgcaggaaagctgaactcgaggtgccattgtctagtcccggtttctccctgcttttttacctggtgatactcgtgctgagcgcggtgcatgttatcgtatgcacatccgccgagtctagctgttacttttgcggtctttcctggctggctgctggcggtgtgatggtccttgcgtctgcactgctgtgtgtcatagtctctgtcctgactaatgtgttagtggggggtaacactcctcgaaagaaccccatgcacccgtcatcgaggtggtccgaacttgatctacttattttgctcggcactgctgggcacgtcctgtccctgggagcctctagcttcgtcgaggaggagcaccaaacttggtatttcttggtgaatactctgtgcctggcactatcccaggaaacctataggaactacttcctcggtgacgatggggagccaccctgtggactctgcgttgagcaggggcacgatggggcaacagctgcatggcaggatggaccaggatgtgatgtcctggagagagacaagggccatggttccccttctacctcggaggtactgcggggtcgggaaaagtggatggtgctcgcctctccttggctaatcctggcatgctgtagattattgcgctctcttaatcagactggggtgcagtgggctcaccggcctgaccttggtcactggctgacaagcagtgaccacaaagccgaattaagcgtgctggctgcgttgagcctgttggtcgtcttcgtgctggtacagagaggctgcagcccggtcagcaaggccgcattggcactgggactgctgggcgtttactgctatagggccgcaattggcagcgttaggtttccatggagacccgactccaaggacataagtaagggcatcatcgaggccaggtttgtctacgtctttgtgttgggaatcctgtttacaggcacaaaagatctgcttaagagccaggtgatcgctgcagacttcaagttgaaaacggttggactgtgggagatttattccggactggtattgctggcagctctgctctttaggccacacaacctaccggtgctcgcctttagcctgctgatccagacgctgatgactaagttcatctggaaaccactgcgccatgacgccgcagaaataactgtgatgcattactggtttggtcaagctttcttctatttccaggggaactctaataatattgcgacggtcgacatttctgctggctttgtcggcttggatacatatgttgagattcccgctgtcttactgacggccttcggtacttatgccggtcccgttctgtgggcctctcaccttgttcacttcctatcgagcgaaacacgctcagggtctgcgttatcacacgcctgcttctgttatgcgctcatatgctctatccccgtgtttacgtacatcgttctcgttacaagcctgcggtaccatttgtttatctggtccgtattttcccctaagttactctatgaaggaatgcacctcctgatcaccgctgctgtgtgtgtgttcttcacagccatggaccagacacgcctcacacaatcatag

SEQ ID NO: 52764 - DNA, 2952 bp, Artificial Sequence
  Description of Artificial Sequence: Synthetic coding sequence
atgcggcttgggagtgggaccttcgctacctgctgtgtggccatcgaagtgttgggaattgcagtgttcttgaggggtttctttcctgctcccgtaaggtcgtcagccagagctgaacacggagccgagccccctgcgccagagcctagtgcaggtgcctcgtctaattggacaacgctgccacctccactattctcgaaggtggtaattgtgcttatcgacgcactgcgcgatgatttcgtctttggcagcaagggtgtcaagttcatgccatacaccacctatctcgtggagaagggagcttcgcacagcttcgttgctgaggcgaagcccccaacagtgacgatgccacgtatcaaagcgctgatgacaggcagcctgcctggctttgttgacgttatccgtaacttgaactctccagcactgctggaggatagtgtgatccggcaggccaaagcggcaggcaaacgcattgttttttacggtgatgaaacctgggtgaagctgttcccaaagcacttcgttgagtatgacggcaccacgagcttttttgtcagcgattacacggaagttgataacaacgtgacaagacacctggataaagtgcttaaaagaggcgactgggacatcctaatcctgcattatctggggttggaccacataggccacatctctgggccaaattcccccctaattgggcaaaaactgtccgagatggacagcgtgctgatgaagatccatacaagtctgcagagtaaggagcgcgaaaccccgcttccaaacctcctcgtgctgtgcggtgatcacggaatgagcgagaccgggagtcatggcgcttcctcgaccgaagaggttaatacaccccttatacttatatctagcgcttttgagcgcaaaccaggagacataagacatcccaagcatgtgcagcagacggacgtggccgctactctggcaattgcactgggcctccctatccctaaagactcagtgggaagtttactattcccggtggtggagggtcgtcccatgcgggaacaactccgctttctccacctgaataccgttcagctgtccaaacttctgcaggaaaatgtgccttcttacgaaaaagatccagggttcgagcagttcaagatgtccgagagactgcacggtaactggataaggctataccttgaggagaaacacagtgaagtgctctttaatctcggttcgaaagtactccggcaatatctggatgccctcaagaccctgagcctgtcgctctctgctcaagtggcccaatatgacatatactcgatgatggttggaacggtggtggtgctggaggtactcaccctactgctcttatccgtgccacaggccctgaggcgcaaggccgaactggaagtgccacttagttcaccagggttttcactgctgttttacctggtgatcctggttctgtctgcagtacacgttattgtgtgcacttctgctgagtcttcctgctacttctgcggactgagctggttggcagccggaggcgtgatggtcctggcctctgcactgctgtgcgtcatcgtcagcgtgctgacaaatgtcctagtgggcggaaatacgccccgtaagaatcccatgcatcccagctctcgctggtccgagctcgaccttttgattttactcggtactgcaggtcacgttctgagtcttggcgcaagctcatttgtcgaggaagaacaccagacctggtatttcctcgtcaacactttatgcttggccttgtcacaagagacctatcgcaattactttctaggagatgacggggaacccccttgtggcctatgcgtggagcagggccatgatggagctactgccgcttggcaggatggaccaggctgtgatgtgctggagagggataaaggtcacgggagtccatcaacatccgaggtccttagaggcagggaaaaatggatggtgctggcttccccttggctcattctcgcttgctgccgcttactgagaagcctaaatcagaccggcgtccagtgggctcatcgcccagatctaggccactggttgaccagctctgaccataaggcggaactctccgttctggctgctctgtccctcctggttgtttttgtgctagtccagcgaggatgttcccccgttagtaaggcagctctcgccctagggctcctgggggtgtattgctacagagccgctataggttcagtgagatttccttggcgtcctgactcaaaggacataagcaaaggtatcattgaggcacgctttgtatacgtcttcgtcctggggatcctctttacaggcacaaaggacttgttgaaaagccaggtcattgccgcagactttaagctaaaaacggttggcctgtgggagatctactccgggctcgtgcttttagcggcactgttattccgtccacacaacttgccagtgctggctttctctctgttaattcagaccctgatgacgaaatttatttggaagcctctgaggcatgatgcggctgagattacggtcatgcattattggtttggtcaggccttcttttacttccagggcaacagtaataacattgctacagtggacatctctgccggtttcgtgggcttggacacttacgtcgagattccggctgttctcctgacagcgttcggaacttacgctggccctgttttgtgggcatcacatctagttcacttcttatcctccgaaacccgaagcgggtctgcactttcacatgcgtgcttctgctatgccttgatctgtagtatccctgtattcacttatatcgtgcttgttacaagcctcaggtatcacctctttatttggagtgtcttttcacctaagctgctgtatgaagggatgcacctccttataaccgccgcagtgtgtgtgttttttactgctatggatcagacccgccttacccaatcctag

SEQ ID NO: 52765 - DNA, 426 bp, Artificial Sequence
  Description of Artificial Sequence: Synthetic coding sequence
atgcattattggtttggccaggcttttttttacttccagggcaactccaacaacatcgctactgtggatattagtgccggattcgtcggtcttgatacctatgtggagatccctgctgtgcttttgacagcctttggcacctatgccggacccgtcctgtgggcctcccacctcgtacacttccttagttcggaaactagaagcgggtccgctctctctcacgcctgcttctgctacgccttgatatgtagcattcctgtctttacatacatcgtcttagtcacctcactgaggtaccacctgttcatatggagcgtgttttctccaaagctgctgtatgaggggatgcacctgctgattactgccgcagtatgcgtctttttcacctggataaagcctgactcacactcgctgcgactcagctag

SEQ ID NO: 52766 - DNA, 900 bp, Artificial Sequence
  Description of Artificial Sequence: Synthetic coding sequence
atgccttacaccacctatctggttgaaaagggggcatctcactccttcgtagccgaggctaagccgccaactgtaactatgcctcggatcaaagcattaatgaccggttccctgcccggatttgtggatgtaattcgaaaccttaactcacccgctctgctggaggattctgtgattcgacaagccaaagccgctgggaaacgcatcgtcttctacggtgacgaaacgtgggtcaagctttttcccaaacacttcgtcgagtacgacggaaccacaagtttcttcgtgtccgactatacagaggtagacaacaatgtcacacgacaccttgacaaggtcttgaagcggggagactgggacatcctgattctccactacctggggcttgaccatattggacacatctccggacccaactctccactaattggtcagaagctgtccgagatggacagcgtactgatgaagattcatacctcactgcagagcaaagaacgcgaaacaccactgccaaatctgctagtactctgtggcgaccatgggatgagtgagactggctcacacggcgctagttcaacagaagaggtgaacacaccgctgattctcataagcagtgcttttgaaaggaaacccggagacatccgacacccaaaacacgtgcagcaaacggacgtagctgccacactggctatcgcactggggctcccaattcccaaagattcagtgggctccttgctgttccccgtggttgaagggaggcccatgagagaacagttacggttcctgcatcttaacactgtgcagctttctaagcttctgcaagagaatgtccctagctatgagaaaggcagtcatcccgcacccgcacagcgcccaacaggaacggcccagaaaggttag

SEQ ID NO: 52767 - DNA, 1026 bp, Artificial Sequence
  Description of Artificial Sequence: Synthetic coding sequence
atgacaggctcactccccggtttcgtcgatgtaatacgtaatctgaatagtcctgccctgttggaggattccgtgatcagacaggccaaggcagctggaaagagaattgtgttctatggtgacgagacatgggtgaagctcttccctaagcacttcgtggagtacgatggcacgacctccttcttcgtgtctgactatacggaagtggataacaacgtgacccgtcacctggacaaggtccttaaacgaggtgactgggatatattaattctccattatcttggtctggaccacatcggtcacatatctggacctaactcgcctcttatcggccagaaactgtctgagatggacagcgtgctcatgaagatccacacgtctctccagagcaaggagagagagactcccctgccaaatctcctggttctatgcggcgatcacggcatgagcgagacaggcagtcatggcgcttccagcaccgaggaggtgaacacacctcttattctgatatcatccgcgtttgagcggaagccgggagacattaggcatcccaagcatgtccagcagacagatgtggcagcgaccctggcaattgctcttgggcttcccatccccaaggacagcgtgggatcactcttattccccgtggtcgaaggacgacctatgagagagcagcttagattcctccacctgaatacagtgcagcttagcaagctgcttcaggagaatgtaccaagctacgagaaagacccaggcttcgaacagttcaagatgagcgagaggctgcacgggaattggatccgcctctacctggaggaaaaacactccgaggtcctgttcaatctgggatcgaaggtgctgcgccaatacctggacgcattgaagacattgtccttgtcgctgtctgctcaggttgcgcaattctctccctgttcttgctccgcttcccatagacactgtgccgagcgcctgtcctggaaaagtcattgtcacctgttagggtttttatgctcattcatatggtag

SEQ ID NO: 52768 - DNA, 2019 bp, Artificial Sequence
  Description of Artificial Sequence: Synthetic coding sequence
atgcagaaggcctccgtcctgttgttccttgcctgggtctgcttcctcttctacgccggaattgcccttttcacatctggttttctgctcacacggctggaattgactaaccatagcagttgccaggagcctcctggaccgggttccttaccatgggggtctcagggaaaacccggagcatgttggatggcttcgagattcagcagggtcgtgctggtcctcatcgatgctctcagattcgattttgcgcagcctcaacatagtcacgtccctcgagaaccaccggtcagcctacccttcctcggcaagctgagttctctgcaacggatcctggaaattcagcctcatcacgctagactgtatcgatctcaagttgacccacccacaacaacgatgcagcgtctcaaagctttaactacaggctccttgcccaccttcattgatgccggaagcaacttcgcctcacacgccattgtggaagacaatctgatcaagcagttgacatctgcaggcagacgagtcgttttcatgggcgatgacacttggaaggatttgtttcccggtgcctttagtaaagccttcttttttccatcttttaacgtccgcgatttagataccgtagacaatggcatcctggaacacctttacccgacaatggatagcggagaatgggacgtgctgatcgcacacttcttaggagtcgaccattgtgggcataaacacggccctcatcatcccgaaatggccaaaaaactctcccaaatggaccaggtgattcaggggcttgttgaaagactggaaaacgataccttgttagttgtcgccggagaccatggaatgaccactaacggagatcacggcggtgatagcgaattggaagtatcagccgcactgtttctctacagtccaactgctgtcttccctagtactcctcctgaggagccagaagtaattccccaagttagcctggtgccaacactggcattactgttgggtctgccgatcccgttcgggaatattggcgaggtcatggcagagcttttctctggaggcgaggatagccagccccactcctccgcccttgcacaggcatccgctctgcatctcaacgcacagcaggtcagtcggtttcttcatacctacagcgctgcaactcaggatctgcaggcaaaggaacttcatcaattgcaaaacttgttttcgaaagcatctgccgattaccaatggctattgcagagcccaaaaggcgcagaagccactctaccaacagtgatcgctgagcttcagcagttcctgcggggtgcccgagctatgtgcatcgaaagttgggcgaggttttccctgtcattcctgctccttcacctcttggcagccggaattcctgttactacacctgggccttttaccgtgccatggcaagccgttagcgcctgggccctgatggccactcagacgttttacagcaccggccaccagcctgtatttcccgcaattcactggcatgccgcatttgtgggcttccctgagggtcacgggtcatgcacatggttgccagccctcctggtgggtgccaacactttcgcgagccatctgctgtttgcagtgggttgcccgctgctactgctgtggccgtttttgtgtgaatcccaaggccttaggaagcgtcagcaacctccgggtaatgaggctgatgccagggtccgccctgaggaagaggaggaacctctgatggagatgcggctgcgtgatgcacctcagcacttttatgctgccttgctgcagctcgggctgaagtatctttttatcctgggcatccagatcctggcctgcgctctggctgctagtatactgaggagacacctaatggtctggaaagttttcgctcctaagtttatcttcgaggcagtcggtttcatagtgtcctcagttgggctattgctgggcatcgcgctcgtcatgagagtggacggtgccgtttcttcatggttccggcagttgtttttggcacagcagagatag

SEQ ID NO: 52769 - DNA, 3270 bp, Artificial Sequence
  Description of Artificial Sequence: Synthetic coding sequence
atgcaaaaagcgtctgttcttctgttcctggcgtgggtgtgctttctgttttacgcagggatcgccctgtttacctccgggttcctgctgacaagactggagctcaccaaccactcgtcatgccaggagccaccagggccaggatccttgccctggggaagtcaaggaaagcctggagcatgttggatggcctcccgttttagtcgtgtcgtcttggtattaatagacgccctccggttcgacttcgcgcagccccagcatagccacgtgcccagagagccaccagtgagcctgcctttccttggtaaacttagctccctgcaacgaattttggagatacaacctcaccacgctaggctgtatcgtagccaagttgatccgcctacaacgacaatgcaacggcttaaagccctaacgactggatctcttccaacatttattgatgctggctccaacttcgcctcccatgccatcgtggaggacaacttgattaaacagctgactagtgctggcaggcgtgtggtattcatgggcgatgatacttggaaagacctgttccctggggcattcagcaaggcgttcttctttccatccttcaatgtgagagacttggacaccgtagataacggaatactcgagcatctgtaccctactatggacagtggggagtgggacgtcctgatcgcgcatttcctgggtgtggatcactgcggacataaacatggtcctcaccatcctgaaatggccaagaaactcagtcaaatggaccaagttatacagggacttgtcgagaggctcgagaacgacacactgcttgtggttgcaggtgatcacgggatgactactaatggagatcacgggggtgacagcgagcttgaagtgtctgcggctctgtttttgtatagtcccaccgctgtgtttccatctactccacccgaggaacccgaggttatcccccaagtatcattagtaccgaccttggcgctcctacttggacttcctattcccttcggaaacatcggggaggtcatggccgaacttttttccggaggggaggactcacaacctcattcctctgcattggcacaagcctctgccctgcatctgaatgctcagcaggtcagtcgatttttgcatacctacagcgccgctacacaggacctgcaagcaaaagaactgcaccagctgcaaaacctgtttagcaaagccagcgccgattatcagtggttgctgcagtcccccaagggcgctgaagcgaccttgcctactgtcatcgccgagctgcaacagttccttcggggagcacgggctatgtgcatcgaaagctgggctaggtttagcttagtgagaatggctggcggtacagcccttttggccgctagctgcttcatctgtctactggccagtcagtgggcaatctcacccggttttccgttttgtcctcttctattaacccccgtggcctgggggttggtgggcgctatagcttatgccggtttgttgggtacaatagaactgaaattggatctggtcttgttgggcgctgtcgctgccgtttcatcattcctccctttcttgtggaaggcctgggccggatggggcagcaaacgtcctttggctactctgttccctattccaggtccagtgctgttactccttctgtttcgactggctgttttctttagtgactcctttgttgtcgctgaggccagagccaccccattcctgctggggtcgtttatcctgcttttggtggtccaactgcactgggagggccaattacttcctccaaagctcctgacaatgcccaggctgggcacctccgccacaaccaatcctcccagacacaacggagcctacgccctccgccttggcatcgggctcctcctttgcacacgcctggctgggttgtttcatcgctgcccagaagagactccagtgtgccacagctccccttggctctccccactggcatcaatggtcggaggtcgagccaagaacttatggtacggggcttgtgtcgcagctctggtcgctctgctcgctgctgtgcgcctttggttgcgccgatacggtaatctcaaaagtcccgaacctcccatgctgtttgtgcgatggggtttaccgctgatggcactgggcaccgccgcttactgggcactggcatcaggtgccgatgaagcacctccacgcctgagagtgctagtgtcaggggctagtatggtcctgccccgagctgttgcgggattagctgcctccgggctcgccttactcctgtggaaacccgtcaccgtgctagtgaaagcaggggctggcgctcccaggacacgaacagttctaacacccttctcaggccctcccacctctcaagccgatctggattacgtggttccgcagatctacagacatatgcaagaggaatttagaggcaggctcgagcgaacaaagagtcaggggccactcactgtcgcagcttatcaactgggtagcgtgtacagtgccgcaatggtcaccgctctcaccttacttgcgtttcccttgttgttactgcacgccgagagaataagtctggtctttctccttcttttcctccagagcttcctgttgctgcacctcctggcggctggcatccctgtcaccacacccggaccttttactgtgccatggcaggcggtctctgcatgggctctcatggccacccagacgttttacagcacaggccatcaaccggtgtttccggctatccattggcacgccgcatttgtgggctttcccgagggacatggatcgtgtacctggctgccagcgctgctggtgggcgctaacacttttgcctcacatctgctctttgctgttgggtgtccactgctgctcctgtggcctttcctttgcgagtctcaaggcctccgtaagcgccaacagcccccagggaacgaggccgatgctcgcgtccgccctgaagaggaagaggaaccattgatggaaatgcgactccgtgatgccccacaacacttttacgctgcattgctgcaactaggcctgaaatacctgtttatcctcgggatacagatcctcgcctgcgccctagctgcttctattctaagacggcacctcatggtgtggaaggttttcgcacccaagttcattttcgaagctgtgggattcatcgtctcttctgtggggctactattaggtatcgcactcgtcatgagggtagatggtgccgtatcatcctggttccgtcagctgtttttggcccagcaacggtag

SEQ ID NO: 52770 - DNA, 2019 bp, Artificial Sequence
  Description of Artificial Sequence: Synthetic coding sequence
atgcagaaggctagcgtcctgctgttcctggcgtgggtgtgcttcctgttctacgctggaatcgctctgtttacatccggcttcctgctgacacgactcgagctgactaaccattcttcatgtcaggaacctccagggcctggttcactcccctggggtagccagggaaaacccggagcttgctggatggcgtccagattctcacgcgttgtcctcgtccttatagatgccctgaggttcgattttgcccagccccagcactcccatgtgcctcgcgagccgcctgtatctctgccatttttgggaaagctttcatccctccagcggattctcgaaatccaaccccaccatgccagattgtacagatcacaggtagatccacctacaaccacaatgcagaggctgaaggctctcacaactggctccctgcctacattcatcgacgctggcagcaactttgccagtcatgcaattgttgaggataatttgataaaacagctcacctcagcgggaaggagagtcgtcttcatgggcgatgatacttggaaggacctgtttcccggagcattcagcaaggcttttttcttcccttcctttaacgtgcgggaccttgataccgtcgataacggtattctcgaacacctgtacccgacaatggattccggagaatgggacgtcctgatcgctcacttcctgggtgtcgaccattgcggccacaaacacggcccacatcaccctgagatggctaagaagctgagtcagatggaccaggtcatccagggtctcgtcgaacgcttggagaatgataccctcctcgtcgtcgcaggtgaccacggcatgaccaccaacggcgatcatggtggagattcagaactggaagtgagtgccgctttgttcctctacagtcctaccgctgtgtttccatccactccacccgaggaaccagaggtcattcctcaggtatcactcgtccccacactggccctgcttttaggattgccaatcccatttgggaacatcggcgaagtcatggctgaattgtttagtggcggagaagattctcagcctcattcgtccgcgctggctcaggctagcgccttgcatctgaacgctcaacaggtgtctcgttttctgcacacatattccgctgccactcaagacctccaggcgaaagaactgcatcagttacagaatttattctcgaaggccagcgccgattatcagtggctcttgcagagccccaagggggcagaagccacactgcctaccgtaatcgcagagttgcagcagttcctgagaggggctcgggcaatgtgcattgagagttgggctcgattctctttgtcttttctgcttcttcacctcctggccgcaggaattcctgtcactactccgggaccgttcaccgttccgtggcaggccgtttctgcctgggcactgatggcgacccagaccttctattcaacaggccatcaaccagtgttccctgcaatccattggcacgcagccttcgtcggcttccctgagggacacggcagttgtacatggctgcctgctctcttagtgggcgcaaataccttcgcttcccatcttcttttcgcagtgggctgtcctctcctcttactctggccttttctgtgtgaatctcagggtctgcgtaagcgccaacagccccctgggaacgaggctgatgcccgagtccgcccagaagaggaagaagagcctctgatggagatgcgactccgagatgcaccacagcacttctacgctgccctgttgcagttggggctgaagtatcttttcatcctggggatccaaatcctggcctgtgccctggccgcttcaattctgcgtcgtcatttgatggtctggaaggtgttcgctcctaagttcatcttcgaagcggtggggttcatagtttctagcgtgggactgcttctggggattgccttggtaatgcgcgtggatggcgctgtctcatcttggttcagacaactgttcctggcccagcaacgatag

SEQ ID NO: 52771 - DNA, 3270 bp, Artificial Sequence
  Description of Artificial Sequence: Synthetic coding sequence
atgcagaaggcctctgtgctgctcttcctcgcttgggtgtgtttcttgttctacgcaggaattgcgctgttcacttccggattcctactgactaggttagagctgactaatcattccagctgtcaagagccacctggtccagggagtttgccgtgggggagtcagggaaagccaggagcctgctggatggctagtcgctttagcagggtagttctggtgcttatcgatgccctaaggttcgacttcgcccagcctcaacactcacacgttcctcgggaacctcctgtctctctgccctttctgggaaaactgagttccctgcagagaatccttgagattcagccccaccacgcccgtttgtaccgttcccaagtcgatccccctactacaaccatgcagcgtctgaaggcacttactactgggagcctgccaacatttatcgacgccggatcaaatttcgcgagtcacgctattgttgaggataatctcatcaagcagctaacctctgccggacgccgagtggtctttatgggtgacgacacatggaaggatctctttcctggcgcattttcaaaggctttcttctttccctccttcaacgtacgcgacctggatactgtggataatgggattctggaacatctgtatcccactatggactccggcgaatgggacgtgctcatagcccacttcctaggcgtggatcactgcgggcataagcacggaccacatcatcccgagatggctaagaagcttagccagatggatcaggtgatacaggggctcgtagaaagattagaaaatgacactctcctggtggtggctggcgaccacggtatgactaccaacggagaccacggtggcgattcagaactggaggtctccgctgcacttttcctctattcgccgaccgctgtcttccccagcactcctccagaggagcccgaagtcatcccccaggtcagcctcgttcccacccttgctctcctgctcggactcccaatcccgttcgggaatattggcgaagtgatggctgagctgttttccggcggagaggattcacaaccacactcctcagctttggctcaagcctctgccctgcaccttaacgcacagcaggtctccagattcctgcacacctattctgctgcaacccaggacctgcaggccaaggaacttcatcagttgcagaatctgttctcaaaggcctccgcggattaccaatggctactccagagcccaaaaggagcagaggcaactctacctacggtgatcgccgagctgcagcagttccttcggggagcgcgagcaatgtgcatcgaaagctgggccagattcagcctggtcagaatggccggaggcacagctcttctggccgcttcatgcttcatttgtctgttggcttctcagtgggctattagccctgggtttcctttctgcccgctccttctcacaccagtcgcttgggggttggtgggtgcgattgcttacgcagggttgctcggcactatcgaactaaagctggacctagtccttctgggagccgtcgcagctgtttccagtttcctgccattcttatggaaagcctgggcaggctggggaagcaagcgccctctcgctacgctttttccgataccaggcccagtgttgctcctgctgctgtttaggctggcagtgttcttcagcgactctttcgtggtcgctgaggctagggcaaccccatttctgctgggaagttttatccttctgctggtcgttcagctgcactgggaaggccagctgttgccacccaagttactgactatgccgcgactcggcacctctgccactactaatcctccacgccataacggggcttacgctctgcggctcgggatcgggctcttgctgtgcaccagactggcaggactgttccacaggtgtcccgaggagacccccgtctgccactcaagcccctggttgtccccattagccagcatggtcggcggtcgagccaaaaacctgtggtatggcgcttgtgtcgccgcattggttgcactactggcggcagtcagactgtggctgcggagatacggcaatctgaagtcccccgagccaccgatgctctttgtgagatgggggctgcctctcatggcccttgggacggcggcatactgggccctggcttcaggtgctgacgaggctccccctaggctgcgtgtattagtatccggcgcaagcatggtacttccgagggctgtggccggtctggccgcatccggcctcgcccttttgctgtggaagcccgtgacagttctcgtgaaggctggcgctggggctccgcgaactcgcaccgtcctgaccccattttctggtccccctactagccaagcggatctggactatgtggtgccccaaatttaccgacatatgcaggaggaattccgcggacgtttagagagaaccaaatcacaaggaccactgaccgttgccgcttaccaactgggtagcgtgtatagtgccgctatggtcaccgctttaacccttcttgccttcccactgttgctgctgcatgccgagaggatttcactcgtgttcctattgctgtttctccagtcctttcttttgctccacctcctcgcagccggaataccagttactactcccggtccatttactgtaccatggcaggctgtgtctgcctgggccctgatggccacacagactttttattccactggacaccagccagtgttcccagcgattcattggcacgcagcattcgttggatttccggagggacatggctcttgtacttggttgcctgcactactcgtgggcgctaacaccttcgcctcacatctcctctttgccgtgggatgcccactactgctcttatggccctttctgtgcgaaagccaaggcctccgaaagcggcagcagccgcctggaaatgaagctgatgccagagtcagacctgaagaggaggaggaacctctcatggagatgaggcttagggacgccccacagcatttctatgccgcactcttgcagttgggcctcaagtacctgttcatactcggtattcaaatcttggcctgcgccctggctgcctcaatactgaggaggcatcttatggtatggaaggtgtttgcgcctaagttcatttttgaggcggttggcttcatcgtctcaagcgtgggactgttactgggcatcgccctcgtgatgagggtggatggggcagtgtcctcatggttccggcagttattcctggctcagcagcggtag

SEQ ID NO: 52772 - DNA, 2283 bp, Artificial Sequence
  Description of Artificial Sequence: Synthetic coding sequence
atggtccttaaagctttcttcccaacatgctgtgtgagcacagacagtggtctcctcgtgggcaggtgggtccccgaacagagctccgctgtagtgctagcagtgctgcacttcccattcatccctattcaggtgaaacagctgctggcgcaggtgcgccaggcaagccaggttggcgttgcagtccttggaacctggtgccactgtcgccaggagcctgaggaaagtctgggacggttcctggagtcactcggcgcagtgttcccacatgagccctggctcaggctgtgtcgagaaagggggggtaccttctggtcctgcgaggccactcacagacaagccccaacagctccaggtgctcctggtgaagaccaggtaatgttgattttttacgatcagcggcaagtcctcctttctcagctccatttacccaccgtgttgcccgaccgacaggccggagcaactaccgccagcactggtggcttggccgctgtgttcgacacggttgccagatcagaagtactgttcaggagtgaccggttcgatgaaggaccagtgcgcctttcacattggcagtccgagggcgtcgaggccagtatactagccgagctggccaggcgtgcctcaggacctatttgtctcctgctggcgtccctgcttagcttggtcagtgcagtaagcgcttgccgcgtcttcaagctctggcctttatccttccttggcagcaaattgagcacttgcgagcagctaagacataggctggaacaccttacgctgatcttcagtacccgaaaggctgagaaccccgcacagctcatgcggaaggctaacactgttgctagtgtgctcctcgacgtggcgctgggactgatgctactgagttggctccacggaaggtccagaatcgggcatctggccgatgctctagtccctgtcgcggaccacgtcgccgaagagctgcaacacctgcttcagtggctgatgggcgctccagcaggattgaaaatgaaccgggctctcgatcaggttctcgggagatttttcttataccacatccatctgtggatttcctacatacacctgatgagtcctttcgttgagcacattctgtggcatgttggactcagcgcttgtctcgggctgaccgtcgctctcagcttactaagcgatattatagccctgttgaccttccatatttactgtttttatgtctatggcgctcgcctatattgtctgaagattcacgggctgagtagcctgtggcgactcttcagagggaagaagtggaatgtcctgaggcaaagggtggattcatgttcctacgatctagatcagctgttcataggaaccctcctctttacaatattactctttctcttgcccacaactgcgctgtactacttggtcttcacactgctgcgcctgttggtcgtggccgtccagggactgatccatctcctggtggaccttattaactcgctgccactgtactcgttgggcctccgattatgcaggccctacaggcttgcggataagcccaccgcgttgcagcccaggggcgctcatctcccgccaccgcagctgtggttgccccctcaggccttgctgggtagacctgtcccacaagctgtgccgtggggggctcatctgcccctggaggccgaacgaggacaagccggacttagggagttgctggcaagactcgctccccctcatggacacagtcagccatcagctctgccaggctggcaccagttatcctggcgcatgagctgtgccttgtggaccttactgtgcgccccagagcacgggaggccctgctatcatacgctggggctggaggttattgggagtgagcaaatgtggggttggccagcaagattggcagcactgcaccactggcactgcttgccatgggacccactccccacatgctgtggccatcatgggggagagcatagcaaccccaggtgtcctgagcactgtcccatgcccacactatgtactcaggtgcagcgtgtgcgcccaccgcaacagccccaggtggaagggtggagcccatggggactcccaagcggttcagcgttagcagtcggagttgagggaccctgccaggacgagcccccttcgccacgtcaccccctcgcgccttcagccgaacagcacccagcatcagggggtctaaagcagtccctgaccccagtacctagcgggccaggccctagtttaccggaaccccacggggtctacctgagaatgttccctggggaggtggctctctag

SEQ ID NO: 52773 - DNA, 447 bp, Artificial Sequence
  Description of Artificial Sequence: Synthetic coding sequence
atggttctgaaagctttcttccctacatgttgtgtttccacagactctggactcctggtggggaggtgggtaccagagcagtcaagtgccgtcgttttagccgtcctgcacttcccttttatacccatccaggtgaaacagctgcttgctcaggtgcgacaggcctctcaagtcggcgtcgctgtgctgggcacctggtgtcattgtaggcaggagcccgaagaaagtctcggcaggtttctggagtcccttggggctgtcttcccacacgagccctggttgagactttgtcgtgagaggggcggaaccttttggtcttgtgaggctactcatagacaggcgccaacagcgcctggtgcccctggtgaagatcaggtcatgcttatattctacgatcaacgacaggtgctgttgagccagctacaccttccaacagtgcttccctag

SEQ ID NO: 52774 - DNA, 1746 bp, Artificial Sequence
  Description of Artificial Sequence: Synthetic coding sequence
atggtactcaaagccttctttccaacatgttgcgtgtctaccgactcaggtttactggtcggtaggtgggtacctgaacagtctagcgccgttgtgttagccgtacttcattttccttttatcccgatccaggtcaaacaactcctggcccaggtccgtcaagcctctcaggtaggcgtagccgttcttggcacttggtgtcactgccgtcaggaaccggaagaatctcttggtagattcctggagagcctgggagcagtgtttcctcacgaaccatggctgcgcctctgccgagaacgcggaggaacgttttggtcctgcgaggcaacacacagacaggcccctaccgctccgggagctccgggtgaggaccaggtgatgctcattttttatgaccaacgacaggtgttgctgtctcagctgcacttacccacagttctgcccgatcgacaagccggtgccactaccgcatcaacaggaggcctggctgccgtttttgacactgtggcaagaagtgaggtgctgtttcggtctgaccggttcgacgaagggcctgttcgcctgagtcattggcagagtgaaggggtagaggcatctattctcgccgaactcgcgagaagggccagtgggcctatctgtctccttcttgcctccctgctcagcctcgtctctgccgtatccgcatgccgagtgttcaaactgtggccacttagcttcctcggaagcaagctgtccacctgtgaacaactgagacacaggctcgagcacttgactctgatattctcgaccagaaaggctgaaaatcccgcacagttgatgagaaaggccaacacggttgccagcgttctcttggatgttgcccttggcttgatgctgttgtcttggctccacggtagatctcggattgggcacctcgccgacgcactggtgcccgtggccgaccatgtggctgaggagcttcagcatctgctgcagtggctgatgggggctcctgccggactgaaaatgaatcgcgctttggatcaagtgctgggcagattcttcctgtaccacatacatctgtggattagttatatccatttgatgtctccatttgtcgagcatatcctttggcacgtggggttatctgcctgcctgggcctgactgtggctctctccctgctgtcagacattatcgcgcttttaaccttccacatttactgcttttacgtgtacggggcaaggttgtattgtttgaagatccatggcctctcttcgctgtggaggctgttccgcggaaaaaagtggaatgtcctcagacagagagtcgactcatgcagctatgacctcgaccaactctttattggcactctcctattcaccatcctgcttttcctgctccccactactgccttgtactacttagtcttcacactgctaagacttctggtcgtcgccgtacaaggtctgattcacctactcgtcgacttgatcaattctctgcccctctactctctgggcctccgcctgtgccgcccatatcgactggcagctggcgtgaaattcagagttcttcgccatgaggcaggcagacccctcagactcttaatgcagattaaccccctaccctacagtagggtggtgcatacatacaggctgccctcttgtggttgtcacccgaagcacagctggggcgctctgtgcagaaagcttttcttgggtgaactgatttacccttggaggcaaaggggggacaaacaagactag

SEQ ID NO: 52775 - DNA, 756 bp, Artificial Sequence
  Description of Artificial Sequence: Synthetic coding sequence
atggtgctaaaagctttcttcccaacctgttgtgtgtcaacagatagtggccttctggtaggcagatgggttccagaacagtcaagtgcagtggtcctggccgtgctgcacttccctttcataccaattcaggtcaagcaactcctcgcccaagtgagacaagcgtctcaggttggcgtcgcggtgcttggaacctggtgtcattgtaggcaagagcccgaggagtccctgggcaggtttctcgagtctctaggcgctgtatttccgcacgaaccctggctgagactgtgtcgcgagagaggcggtacattctggtcatgtgaagcaacccacagacaggctcccactgcaccaggtgcaccgggtgaggaccaggttatgcttatcttctacgaccagaggcaggtgctcttaagccagctgcaccttccaaccgtcctgcctgatagacaagctggggctactaccgcgtcaactggaggactggccgctgtatttgacaccgttgccaggagcgaggttctatttcgaagcgacagattcgacgagggtcctgtacgcctatcccattggcaatcagagggagtggaggcgtctatattggcggagctggccagaagagccagcggcccaatatgtcttctcttggcctcgctgctgtccttggtgagcgccgtcagcgcatgcagggtgttcaagctatggccactgtcttttctggggagcaaactatctacttgcgagcaacttaggtag

SEQ ID NO: 52776 - DNA, 1746 bp, Artificial Sequence
  Description of Artificial Sequence: Synthetic coding sequence
atggtgctcaaggcattttttcccacatgttgtgtcagcaccgactctggactgctggtgggcagatgggtacctgaacagtcatctgccgtggttctggccgttctccacttcccctttatacccattcaggtgaagcaactgctggcccaggtgcggcaggcatcacaggtgggggtcgctgtcctgggcacttggtgccactgcagacaggagcccgaagagtccctaggtcgatttctggagtcactcggcgcagtttttccccacgagccctggctgcgcctgtgtcgagagagaggcggtacattttggtcttgcgaggcgacccataggcaagctcctaccgcacctggggctccaggggaagatcaagtgatgcttatattctatgatcagcggcaggtacttttgtctcagcttcatctccctacggtcctgcctgataggcaggcaggagcgactacagcatctaccgggggacttgcggcagtgtttgacactgttgcccgatctgaggtactgttcagaagcgatcgcttcgacgaaggtcctgttagactgtctcactggcagagtgaaggagtcgaggcatctatcctagcagagctcgctcgtcgcgcttctggacccatctgtctactccttgctagcttgttgagcctcgtgtctgcagtctcggcttgccgtgtatttaaactctggccactgtcattcctgggaagcaagcttagcacttgcgaacagctcaggcatcggctcgaacatttgacattgatctttagtacgagaaaagctgagaatccagcccagttgatgcgaaaagccaacactgtcgcgtccgtgctgctcgatgtagctttgggcctcatgcttctttcatggctccatggtcggtcacgcatcgggcatctagcagacgccctagtgcctgtggcagaccacgtggccgaggagctgcagcaccttctccaatggctgatgggggcaccagccggtctgaaaatgaaccgggctttggaccaagttctaggacgattctttctctaccatattcacttatggatctcctatatccacctcatgagcccattcgttgaacatattctctggcatgtggggctgagcgcttgcttgggcctgactgtggctcttagcctgttgtcagatatcatcgccctgctgacatttcacatctactgcttctacgtttacggggctaggctgtattgcctcaagattcatgggctgagctccctctggcgtctgtttaggggcaagaaatggaacgtactccgccaaagggtagattcatgtagctacgacctggatcagcttttcatcggtacgcttctgtttactatcctgctttttttactccccaccactgccctgtattacctggtttttacgctcttaaggctcctggtcgtggctgtacagggcctgatccatctactagtggacctgattaactctctaccactctactccctgggcctgaggctgtgtagaccttaccgtcttgctgcgggtgtaaagttcagggttctccggcatgaggctggtcgccctttgcggctattaatgcagattaatcctctgccgtattcacgggtcgtccacacgtacagactgccctcctgcggctgtcacccgaaacatagctggggggctctttgtcgtaagttgttcctaggcgagctgatctatccttggcgccaaaggggtgacaagcaggattag

SEQ ID NO: 52777 - DNA, 945 bp, Artificial Sequence
  Description of Artificial Sequence: Synthetic coding sequence
atggtcctgaaagccttctttccaacttgttgtgtgtccactgactcaggactcctggtcggaaggtgggtgcctgagcagtctagtgctgtcgtgctggccgtcctgcactttccatttatcccgatccaggtcaagcagctgttggcacaagtccgccaagcgtcacaagtcggggtagccgtgctgggtacctggtgccattgccgccaggagcctgaggaatcacttggtcgtttcttagagtcccttggagcagtgtttcctcatgagccgtggctccggctctgccgtgagcgaggtggaactttttggagctgtgaagccacccatagacaagcacctaccgctcctggagcccctggtgaggaccaggtgatgctgatcttctacgaccagaggcaagtccttctttcccagcttcatttgcctactgtcctcccagatagacaggccggtgccaccacagccagcactggaggcctagccgcagtttttgatactgtcgcccgtagcgaagtattgttcaggtcagataggttcgatgaaggaccagtccggctgtcccattggcagagcgagggagtggaagcctcaattctggccgagctcgcaaggagggcaagcgggcctatttgtctacttttggcctctcttctgtccttggtatctgctgtttccgcctgcagagtttttaagctttggcctctgtcctttctcggcagcaagctttcaacctgcgaacaattgcgccatcgactcgagcacctgacactcatcttcagcaccagaaaggccgagaaccctgctcaactgatgaggaaagccaacacagtcgcgagtgtgcttctagatgtggcattagggctcatgctactgtcctggctccatggcaggagccggatcggccatctcgccgatgccctcgtgccagtggcggactag

SEQ ID NO: 52778 - DNA, 339 bp, Artificial Sequence
  Description of Artificial Sequence: Synthetic coding sequence
atggtgctcaaggcttttttcccaacatgctgtgtgtccacagattcagggttactggttggcaggtgggtcccagagcagtcgtcagctgtggtactcgctgtattgcactttccattcatccctatccaggtcaaacaattgctggcacaggtgcgacaggcctcacaggtaggggtagctgtcctgggcacttggtgccactgcagacaggagccagaagagagtttaggcaggttcctggagtctctcggagcggtcttcccccacgagccctggctccggctctgtcgggagagagggggaaccttttggagctgcgaggccactcatagatag

SEQ ID NO: 52779 - DNA, 1725 bp, Artificial Sequence
  Description of Artificial Sequence: Synthetic coding sequence
atgtggtgggccctgcgccctcctggcattctcccccctgggatggttttgaaggccttcttccccacctgttgtgtgagcaccgatagcggcctgttagtcgggaggtgggtcccagagcagtcctccgcagtagtcctggccgtacttcactttccattcatccctattcaggtcaaacagcttcttgcacaagttaggcaggcctcccaggttggggtcgcagttctaggtacctggtgtcactgccgtcaggaaccggaagaatcgcttgggaggtttttggaatctctcggagcagttttcccccacgaaccctggttaagactatgcagagagagggggggaaccttttggtcctgtgaagcaactcaccgacaggcacctactgcccctggcgctcccggagaggaccaagtgatgctgatattctatgaccaaaggcaagtgttactaagccagctgcatctgccaaccgttctgcccgacaggcaggcgggagctacaactgctagtaccggaggtttggccgctgtgtttgatacagttgcgaggagcgaggtcctgtttcgatccgatcgcttcgatgagggccctgtccggctctcccattggcagagtgaaggcgtcgaagcaagcattttagccgaacttgccaggcgcgcatccggccctatttgcctactgctcgcatccctgctgtcactggtgtccgccgtcagcgcttgcagggtattcaaactatggccattgagtttcttgggcagcaagctgtcgacctgcgagcagttgcgccatcgactggaacaccttaccctgatctttagcactcgcaaggccgaaaatcctgcacagctcatgagaaaggctaatacggtggcttcagtattgctcgacgtggcactgggcctgatgctactaagttggctgcatgggagatcacgcattggacacttagcagacgctcttgtgcctgtggccgatcatgtcgctgaagagctgcagcatctcctgcaatggctgatgggtgctcccgcagggcttaagatgaatcgggctctagaccaggtgctaggtcggttttttctctatcatatccatttgtggatcagctacatccacctgatgtcaccatttgtggagcatattctctggcatgtgggattatcagcctgcttgggcttaacggtggccctgtccctgctgtccgatataattgcactgctgacattccacatatattgtttctacgtgtacggcgcacggctgtattgtctgaagatccacggactgtcctctctctggcgcttattcaggggtaaaaaatggaacgtgctgcgacagagagtggattcctgctcatacgacctagatcagcttttcatcggaacactacttttcactattctgcttttcctgctccccaccaccgccctgtactacctggtgttcaccctgctgagactgcttgtggtcgcggtgcagggactgattcatttgctggtagatcttatcaactccttgcctctgtattcgctggggctccgactgtgtagaccttacagactggctggctctgaaccatggcgaccggaggctaccggcttgtgttcaagcgccctcggattctctggacttgggtctctcaactgcagaccaggggctaagaggggtaaggttcgcggaacccgctcacagcagggagggcatcatcctctagcttag

SEQ ID NO: 52780 - DNA, 900 bp, Artificial Sequence
  Description of Artificial Sequence: Synthetic coding sequence
atggtgctgaaggcctttttccccacctgttgtgtgtccacagacagtggcctgctggttggcagatgggtgccggagcagagttcagccgttgtcctggccgtgctgcacttcccttttattcccatacaggtgaaacagctgttagcgcaggtgcggcaggccagccaagtgggcgttgccgtgctaggtacatggtgccattgcagacaggagcccgaggagagtctcggcaggttcttggaaagcctcggtgcagttttcccacatgagccctggctgcggttgtgcagagagcgcggaggtaccttttggtcatgtgaagcaacgcaccggcaagctccaaccgccccaggggctccgggagaggatcaggtaatgctcatcttttacgatcaacggcaagttctcttgtcacagctgcatctgcccactgtattgcctgaccgccaggccggtgcaaccacagcaagcacgggcggtctagccgctgtatttgatactgtggctcgttctgaggttctgttccgatccgataggtttgacgagggcccagttagactgtcacattggcagtctgagggagtggaggcctcgatcttggctgaacttgccaggagagcgagtgggccaatttgtctgctgttagctagcctgctgtcactcgtgagtgccgtgtccgcatgcagggtctttaagctctggccactgagcttcctcggaagtaaactgagcacttgcgagcagcttaggcatcgactcgaacatctcactctgattttttcaacacggaaagccgaaaatcctgcccagctaatgaggtgtggacctgcgttggtcagtgccggactaggggcttgccccctggcgccatccccttcgccatctgcaccaaggtag

SEQ ID NO: 52781 - DNA, 480 bp, Artificial Sequence
  Description of Artificial Sequence: Synthetic coding sequence
caacctttcttgaacgctttaggcgcagctcttttatgcggcttatctgatagcctcttgtgcaacgtgggcggtgagtcgccgctcacccagcttccacccgctaccatttggacatgtacagcaagccccatgtctagcacacagtggtctcccggttgggatcccgtgcttccaccatgcaccctgtgttcaactttctacagtacttgcctttctctccacacccaccgctgcacgttcagaacgaggatggccttgcagtggccaccaatgccatccatcgtgccagctggtgtaggatctctggtgtacaatgtggactctaaaacttacaacgctagtgtgctgccagtgagagtggaggtggacatggtgaggtggaggtgctcctggcattcatgtggctgtagcttgggtctgttatcgccatcatgcctccaaaacgcttgtttccagggcttacgggtcaaagggtag

SEQ ID NO: 52782 - DNA, 1668 bp, Artificial Sequence
  Description of Artificial Sequence: Synthetic coding sequence
atggctgcagcaggcgcagccgcaactcacctggaagtagcacgcggtaaacgggctgccctcttctttgcagctgtcgcgatagtactgggtttacctttgtggtggaaaaccacagagacataccgcgcttctctgccctacagccagatttctggcctaaacgccctgcagctacgtctgatggtccccgtcaccgtagtgttcaccagggagtctgtgcctctggacgaccaagaaaaactacccttcactgttgtgcacgagagggaaatcccattgaaatacaagatgaagatcaagtgccgcttccaaaaggcctacaggcgcgctctcgaccatgaggaggaagccctgagttcggggtccgtgcaggaggctgaggccatgctcgacgaaccacaggagcaagccgagggctccctgacggtatacgtcatcagcgagcattcttcactgctcccccaggacatgatgtcatatattgggccaaagcggacagcggtggtcagaggtatcatgcacagggaagccttcaacattatcgggcgacggatcgtacaggttgctcaagctatgagcctgaccgaagacgtcttagctgccgcactggctgaccacctccccgaagataagtggtccgctgaaaaacgaagaccgctgaaaagttcactcggctacgagattacgttctccctattgaaccccgacccaaagagccacgacgtgtattgggacatcgagggagctgtacgacgatatgtacagccgttcctgaacgcactcggcgctgcaggtaatttttccgtggactctcagattctatactatgccatgcttggagtcaaccccagattcgattcggcctcatccagttattatttagatatgcactcgctccctcatgtgatcaatcccgtcgagagccggcttggcagctccgctgcttccctgtatcccgtgctcaacttcttgctctacgtgccggaattggcccactccccgctttatattcaggataaagatggagcacctgttgcaaccaacgcttttcattctcctcgttggggcggtataatggtgtataatgtggactcgaagacatacaacgctagcgtacttcctgtcagggtggaagtggacatggtaagagtcatggaagtattcctggcgcagctgaggttactatttggcatcgctcagcctcagttgccccctaaatgcttgctgtcgggccctaccagcgagggcctcatgacgtgggagttagacaggctcctctgggccagaagcgtcgagaacctcgcaaccgcaacaaccactctcacaagcctggcacaacttctgggaaagatctcaaacatcgtcattaaggacgatgtggcctctgaggtgtacaaagctgtcgccgcagtacagaagtctgccgaggaacttgcttcaggacacttggcgagcgcgttcgttgccagccaggaagctgtgaccagtagtgaactcgcttttttcgatccaagcctcctccatcttttatatttccctgatgaccaaaagtttgccatttacatcccattatttctcccgatggctgttcctatcttgctgagtctagttaaaatattccttgaaacaaggaagagctggcggaagcctgaaaagaccgactag

SEQ ID NO: 52783 - DNA, 1644 bp, Artificial Sequence
  Description of Artificial Sequence: Synthetic coding sequence
atgccctccgaagtggcaagagggaaacgagctgcactcttcttcgctgctgtagcgatagtgttagggttacccttgtggtggaagaccaccgagacctatcgtgctagcttgccatacagtcagatatccgggctgaacgctctccaattgcgtctgatggtgccagtcacagttgtgtttacaagggagtccgtccccctggacgaccaggagaaattgccctttacagttgttcacgagcgagagattcccctgaagtacaagatgaaaataaagtgcagattccaaaaggcataccgcagggccctagaccatgaagaagaagccttaagctccggatccgtccaagaggcggaagcaatgctcgatgagcctcaggagcaggccgagggatcacttaccgtgtacgttatcagtgagcacagttctctgctgccacaagacatgatgtcctacatcggacccaagcgcacagcggtagttcggggaatcatgcatagggaggcattcaacatcatcggcagaaggatcgtacaggtcgcccaagccatgtctctgactgaagatgtgctggcagctgccctggccgatcacctccctgaggataagtggtctgctgaaaaacggagacccctaaagtcgtcactgggatacgagatcacttttagcctgttaaaccccgacccaaagtcccatgacgtgtattgggatattgaaggggcagtcagaagatacgtgcagcctttccttaacgccctaggggctgcaggcaacttctccgtcgactctcagattctctactacgctatgctgggcgtcaatccaaggttcgacagcgcaagttcatcgtactatttggatatgcatagcctgccccacgtcattaatccggttgagtcgcggctgggaagttccgccgcttccctctacccggttctgaacttcctgctgtacgtgccagagctggcccattcccctctttatatccaagataaggacggcgcacctgtggccacaaacgcgttccatagcccgcgatggggcggaattatggtttataacgtcgattctaaaacgtataacgcttcagtgctacccgtgagggtagaggtggacatggtgcgcgtgatggaggtattcttggctcaactccgcctcctctttggcatagcgcagccacagctaccgcctaaatgcctcctgtcaggtcccacctctgaaggcctcatgacttgggaactcgatagactcctttgggcaaggtccgttgagaatctggccacggcaacaacgaccctaaccagcctcgcccagctgctcggaaagattagcaatattgtgattaaagatgacgtcgcttctgaagtctataaggccgtcgctgctgtccagaaatcggcggaggagctggcgtctggccatctcgcttctgcatttgtggcttcacaagaagctgtgacctcaagtgaactggctttctttgatccttctctgctacacctgctctactttcccgacgaccagaaatttgctatttatattcctctgtttctcccaatggctgtaccaattttgctctcgctggtgaagatctttctggaaaccaggaagagctggcggaagcctgagaagactgattag

SEQ ID NO: 52784 - DNA, 1485 bp, Artificial Sequence
  Description of Artificial Sequence: Synthetic coding sequence
atggtacccgtgacggttgtgttcactcgcgagtcagtacctctggatgatcaggagaagcttccttttacggtggtgcacgagcgggagatccctcttaaatacaaaatgaaaattaagtgccgcttccaaaaagcatatagacgcgctctcgatcatgaagaggaggcactttccagcgggtccgtccaggaagctgaggccatgctggacgaaccccaggagcaagccgagggatctcttaccgtgtatgtcatctctgagcacagctccctgctgccccaggatatgatgtcctacatcggaccgaaacggacagccgtggttagaggcatcatgcacagagaagcatttaacatcatcggccgacggatcgtacaggtagctcaagcaatgtcactcacagaggacgtgttggcagcagcgcttgcagaccatctgcctgaggacaaatggagtgccgaaaaaagacgaccgctaaagagttccctcgggtacgagattactttctcacttttgaaccccgatcctaaatcacatgatgtctactgggacatagaaggagccgtaaggcgttacgttcagcctttcctgaatgccctgggcgcagccggtaacttctccgtggatagccaaattctatactatgccatgctcggggtaaatcccagatttgactctgcctcaagcagctattatctggacatgcattctctcccacacgtgatcaaccccgtggagtcccggctaggttcttctgcagctagcctctatccagtactgaactttttgctttatgtgcctgagctggctcacagtccgctctacatacaggacaaggatggagcaccagtagcaaccaacgcattccacagtccccgttggggaggcattatggtatataacgtggatagcaagacatataatgccagcgttttgccggtcagagttgaggtagatatggttcgcgttatggaggtgttcctggcccagctgcggctactcttcggaatcgcgcagccccagctgcctcccaagtgtcttctttcaggccctacaagcgagggactcatgacatgggaattggaccggctcctttgggccaggtccgtcgagaatttggccacagccaccacaacccttacttctctggcacaattgttggggaagatcagtaacatcgtgatcaaagacgacgtggccagtgaggtctacaaagccgtcgccgcagtccaaaagagcgcggaagaactagccagcgggcaccttgccagtgctttcgtggccagccaggaagctgtgacgagttcggagttggcgttttttgatcccagcctgctccacctcttgtacttccccgacgatcaaaagtttgcaatatacatccctctgttcctccccatggccgttccaatcttgctgtctctcgtgaagatctttctcgaaactaggaagagttggagaaaacctgaaaagaccgattag

SEQ ID NO: 52785 - DNA, 1431 bp, Artificial Sequence
  Description of Artificial Sequence: Synthetic coding sequence
atggctgccgctatgcctctggccctgctcgtgcttctcctcttaggacccggagggtggtgtttagctgagccgcctcgcgacagcctcagagaagaactcgtgatcacacctttacccagtggcgacgtggcagccacctttcagtttcgcactcgttgggatagcgaacttcagcgcgagggagatactgaccactactttctgcgttatgccgtcctgccaagggaagtggtgtgtactgagaatctaaccccctggaaaaagctcctcccatgttcttcaaaagcgggattgagcgtgctcctcaaagccgatcggctttttcatacctcctatcacagccaggcagtgcacatccgtccagtttgccgcaatgcacgctgtacttccatcagctgggaattgaggcagaccctctctgtggtttttgatgcgttcataaccggccaggggaagaaggactggtctctgttccgcatgttttccagaacgctgactgaaccctgccccctggcctcagagagtcgcgtgtacgttgacattaccacatataaccaagacaatgaaacactcgaggtccatccaccgccaactaccacctaccaggatgtcatcttggggacacgtaaaacctacgcaatatatgatctgctggataccgccatgattaataacagcagaaacctgaatattcagctgaagtggaagaggcctcccgaaaacgaggcaccgccagtgccctttctccatgcacagagatacgttagtgggtatggattacagaagggggaattatcaactttgctctataacactcatccttacagagccttcccagtcctgcttctggacaccgtgccgtggtacctccgactgtatgtacacaccctgactatcacttccaagggaaaagagaataagccatcctacattcattaccaacccgcacaggatcggttgcaacctcaccttttggagatgctcatacagcttccagcgaactcggtcacaaaggtaagcatccagttcgaacgagctctgctgaagtggaccgagtacactccggatcccaaccacggcttctacgtcagcccttccgttctgtccgccctcgtccccagcatggtggcagctaagcctgtggattgggaagaatcaccactatttaatagcctgtttcccgtcagtgatggaagtaattactttgtgcgattgtatactgaacctctactagtgaatctccccacccccgacttttctatgccatacaatgttatatgcctcacttgcactgtcgtagccgtttgctatggctcgttttacaatctgcttacaagaactttccacatagaagaacccagaactggcggattggctaaacgtttagctaatctgatccgtagagcccgtggtgtcccaccattgtag

SEQ ID NO: 52786 - DNA, 1737 bp, Artificial Sequence
  Description of Artificial Sequence: Synthetic coding sequence
atggcagccgctatgcccctggccctccttgtactccttctgcttggacccggtggctggtgcctagcagaaccacctcgggatagtcttagggaagagttggtgatcacgcccttaccctctggagacgttgcagcaacctttcaatttaggacccgctgggattctgagctgcaaagggagggggtgtctcactacagactgtttcccaaagctctgggccagttgatctcaaagtattcactcagagagttacacttgagcttcacccaaggattttggcgcactcgctactggggtcctcctttcttgcaggcgccaagcggcgcagaactgtgggtatggttccaggatactgttacagacgtggacaagagttggaaagaactgagtaatgtactgtcagggattttctgcgcctcgctcaacttcatcgattccaccaatactgtgactccgacggccagttttaaacctttagggctcgctaacgatacagaccattactttctccgctacgccgtgctgccccgtgaagtcgtgtgcaccgagaatctaaccccttggaaaaaactgctaccctgttcttctaaggccggactcagcgtgttgctgaaagcagaccgtctcttccacaccagctaccactcccaagccgtacatatcagacctgtttgccgcaatgccagatgcacctctatatcatgggagttaaggcagactttatcggtcgtgtttgatgcgtttattacaggacaaggcaaaaaagactggagcctgtttcggatgttctcgcgtactctgacagaaccatgtcccctggccagtgagtctagagtatacgttgacatcacaacatataaccaggataacgagacattggaggtgcatcccccaccaaccaccacataccaggatgtgatcctgggcactcgaaaaacttacgccatctatgacctgctcgacaccgccatgataaataatagtcgaaacctgaatatccagctgaaatggaagcgcccacccgaaaacgaggctccccctgtccctttcctacacgcccagcgatatgtaagtggatatgggttgcagaaaggcgagctgagtacgcttctgtacaatacgcacccgtaccgagcctttcctgtgctgctgctcgatactgtcccgtggtatctcagactctacgttcatacactgaccattacttccaaagggaaagaaaacaaacccagttatattcattatcagcccgctcaagatcggcttcagccccacctgctcgaaatgctgattcaactgcctgcaaactctgtaacgaaggtatccatccagtttgaacgcgcactcctcaagtggaccgagtataccccggacccaaaccacgggttctatgtttccccatccgtgctttcagcgctcgtgcccagcatggttgcggctaagcccgttgactgggaagagagcccactattcaacagcttgtttcccgtatccgacggatcaaattatttcgtgagattgtacactgaaccgttactggtaaacctacctacacctgacttttctatgccatacaacgtaatttgcctcacttgtacggtcgtggctgtttgttatgggagcttctacaatctgttgacgcgcactttccacattgaggagcctcgtaccggcggactggcaaaacgtctggccaatttgattagacgtgccaggggtgtccccccactgtag

SEQ ID NO: 52787 - DNA, 1155 bp, Artificial Sequence
  Description of Artificial Sequence: Synthetic coding sequence
atggccgcagccatgccacttgcgctcctagtactccttttgctcgggccagggggatggtgcctggctgagccaccgagagatagcctgagggaggagctagttattacccctctaccatcaggggacgtggcagcgacgtttcagttcagaacccgctgggattcagaactgcaacgggaaggagattggtcccttttccggatgttttcccgtacactgacagagccatgcccacttgcgtccgagtccagggtgtatgttgacattaccacgtataatcaggataatgagacgcttgaagtgcatccaccacctacgacaacctatcaggacgtgatattaggcacaagaaagacttacgcgatctacgacctgctggacactgcgatgatcaataatagtcgcaatctcaatattcagctcaaatggaagcggcctcccgagaatgaagcgcctccagtacccttcttgcacgcgcagaggtacgtgtcgggatacggcctgcagaagggcgagctgtccacactgctgtacaatacccatccctatagagcctttcctgtcctgttattggatacagtgccctggtacctgaggttatacgtgcacacgcttaccattacttcgaaagggaaagaaaacaaaccctcgtacatacactatcagccagctcaagaccgattgcaaccacacctcttggaaatgctgatacaactccctgcaaatagcgtgactaaagtgtccatccagttcgagagagcactgctgaaatggactgagtatacacctgatccaaatcatggcttttatgtttcgccgtcagtactctctgcgctggttccttccatggtcgcagcaaaacctgtggactgggaagagagcccactcttcaattcattatttcctgtgagtgatggcagcaactacttcgtacgattatacacagagccgctgctcgtgaacctgccgacgcccgatttttctatgccatacaatgtgatctgcctgacctgtactgtcgttgctgtgtgttatggctccttctacaatctgctgaccagaaccttccatatcgaggaaccacggactggcggtcttgcgaagagactggctaaccttattaggagagctaggggcgtgccacctctctag

SEQ ID NO: 52788 - DNA, 1536 bp, Artificial Sequence
  Description of Artificial Sequence: Synthetic coding sequence
atggctgcagccatgccattggctctgctggtgttgcttttgctcggccctggagggtggtgcttggcagagcctcctcgagattcgcttcgagaagagttggtcatcacccctctgccttctggggatgttgccgctaccttccagtttaggacacgctgggactccgagctgcagcgcgagggggtcagccactatcggttgtttccgaaagccctgggccagctaatctccaagtacagcctccgcgaactgcacttgagcttcacccaggggttttggcgcacccggtattgggggcctccctttctgcaggccccatcaggtgccgagctgtgggtatggtttcaagataccgtgacggacgtggacaaatcgtggaaggaactgagcaatgttctctctgggatcttctgtgccagcctaaatttcatcgacagcacaaacacagtgaccccaactgcctcatttaagccactcggtctggccaatgatacagaccactacttccttaggtacgcggttctgcctagggaggttgtgtgcacggagaatttaacaccttggaaaaagttgcttccctgcagttccaaagctggactcagcgttctgctcaaggccgacagactgtttcacactagctaccactcgcaagccgttcacatccggcctgtgtgtcgcaacgccaggtgcaccagtatcagctgggaattaagacaaacactttctgtcgtttttgacgccttcattacaggacagggcaaaaaagattggagtcttttccggatgttctcacggactcttaccgaaccttgtcccttggcttctgaaagccgggtgtacgtcgatattaccacgtataaccaggacaacgagacacttgaagtccatccgccaccaaccacaacctatcaggacgtaatcctaggcactagaaagacgtatgcgatctatgatcttttggatactgccatgattaataattcacgcaacttaaacatccagctcaagtggaaacgccctcctgagaacgggtacatccactaccagcccgctcaggatcgactgcagcctcatttgctggaaatgctaattcaactcccagctaacagtgtgaccaaggttagcatccagttcgagagagccctcctcaagtggactgagtacaccccagacccgaaccacggattctatgtgtcgcctagcgtcttgagcgcactggtgccaagcatggtggcagcgaaaccagtggattgggaagaaagccccttattcaactccctgttccctgtgagtgacgggtcaaattacttcgtgcgcctttacacggagcctctgctggtgaatctgcctacacctgatttctcaatgccatacaatgtgatctgtctgacctgtaccgtggttgccgtctgctacggaagcttttacaacttactgaccagaactttccacatagaggaaccacggaccggcggtcttgcgaagagactggctaatttgattcgtcgcgcacgaggcgtccctcccctctag

SEQ ID NO: 52789 - DNA, 1272 bp, Artificial Sequence
  Description of Artificial Sequence: Synthetic coding sequence
atgtggataaatctggggcgttcctctgtgatgtcgtctcaggggagcagtgccccattgagcacctcctccacgcctcctacacagagtctgccacttccaccatctaacccctgggtttggccaatggccggactcagcgttctgctgaaggcagaccgcctgttccacacctcttatcattcccaggccgtgcacattcgcccagtctgtcgtaacgcacggtgcacaagcattagttgggagctgagacagaccctgagcgttgtgttcgacgcctttataacaggacagggaaaaaaggactggagcttattcagaatgttcagccggacactcaccgagccgtgccccttagcaagtgagtctcgggtgtacgtcgatattactacctacaatcaggacaacgaaaccctggaggtccacccacccccaactaccacctaccaggatgtgatactcggcacccgaaagacatacgctatctacgatctgctggataccgccatgattaacaactcacgcaatttaaatatccagttgaaatggaagaggcctcccgagaatgaggctcctccggtgccattcctccacgcccagagatatgtgtccggttacgggttgcagaagggagaattgagtacccttctgtacaacacgcatccatatcgcgctttccctgtgctcctattagacacagttccatggtacttacggctgtacgtccacacactgacaataacttccaaggggaaggagaataaaccttcctacattcactaccagcccgcacaggaccgtctacagccccatttgttggaaatgctcatccaactccccgctaactctgttaccaaggtgagtattcagttcgagcgggctctattaaagtggactgaatatacaccagacccaaatcatggcttctatgtctctcctagtgttctgtctgcccttgtgccatcaatggtagcagctaagcctgtcgattgggaagaaagccctctgtttaactctctgttccccgtctcagacggatcgaattatttcgtgaggctgtacactgaaccccttctcgttaacctccccacccctgatttttccatgccctataacgtaatttgcctcacttgcaccgtcgtcgcagtgtgttacggttccttctataacctcttgacaagaacttttcacatcgaggaacctagaaccggcggtttggccaaacggttggcaaatctgatccgccgagcacggggagttcctcccctgtag

SEQ ID NO: 52790 - DNA, 1569 bp, Artificial Sequence
  Description of Artificial Sequence: Synthetic coding sequence
atggccgctgcaatgcctctcgcccttttggtgctgctgcttttagggccaggaggttggtgcctagctgaaccccctcgggacagccttcgggaggaattggtgattacgcctctgccgtcaggggatgtggctgcaacattccagtttagaacgaggtgggacagcgaattgcaaagggaaggcgtaagccactataggctgttccccaaagccctgggccagctgataagtaagtactctcttcgcgaacttcacctgtccttcacgcaaggcttctggcggacccgctattggggccctccttttctccaggccccttctgataccgaccattacttcctgcggtatgccgtgctgcctagagaagtcgtgtgtactgaaaacctgacaccatggaaaaaacttctcccttgttcttccaaagccggattgtcagtgcttctgaaggcagatcgccttttccatacatcgtatcactcccaggctgttcacatccggccagtctgtcgtaatgctagatgtaccagtatctcttgggaactcaggcaaactctgagtgtagtatttgacgcctttatcacgggtcagggaaagaaagattggagcttgtttagaatgtttagccggacactcacagagccatgtccactggcatccgagagcagagtgtacgttgacatcaccacctataaccaggacaatgagacactcgaggtgcacccaccacccactaccacttatcaggatgtcatcctcgggactcggaaaacctacgcaatctacgatctgcttgatacggcaatgataaataatagtcgcaatctcaatatacagcttaagtggaagcgaccgccagagaatgaagccccacctgtgccttttctgcatgcccagagatacgtgtccgggtacggactacagaagggcgaactgtccacactgctttataatacacacccgtatcgagctttccccgtgttgttgctggatactgtgccttggtatctgaggctgtatgttcacacactgacaattacctctaagggcaaagagaataagccctcatacattcactatcagcctgctcaggacagattgcagcctcatttgctagagatgctgatccagctccctgccaattccgtgaccaaggttagcatccagtttgagcgtgccctcttaaaatggacagaatatacgcccgacccaaatcacggcttttatgttagcccttctgttctctcagccctcgtgcccagtatggtggcagccaagcctgtggattgggaggaaagccccctcttcaattctctattcccagtgagtgacgggtcaaactatttcgtcaggctctatacggaacctctgctagtgaatctaccaacccctgattttagcatgccctacaatgtgatctgtctgacatgcactgtcgttgctgtttgctacggctccttttacaacttgttaactcggaccttccacattgaggagcctcggactgggggacttgctaagaggctcgctaatctgattaggagagctcgtggagtgccccctctatag

SEQ ID NO: 52791 - DNA, 951 bp, Artificial Sequence
  Description of Artificial Sequence: Synthetic coding sequence
atgttttcccgaacacttactgaaccttgcccgttagctagtgagtcgagagtgtacgttgacataacaacatataaccaagacaacgagactcttgaagtacatcccccaccgactacaacgtaccaagacgtgatcctcggcaccagaaaaacgtatgccatctacgaccttctggataccgctatgataaataactcaagaaatttgaatattcagctgaagtggaaacggccaccggagaacgaggcacctcctgtaccatttctacacgcccagaggtatgtgagcgggtacggcctccaaaagggcgaactcagtaccctgctgtacaatacacatccgtaccgtgcatttccagtgctgctcttggataccgtcccatggtatctgcggttgtatgtgcacacattgacaataacaagtaaagggaaggagaataaaccatcgtatatacactaccagcctgcacaggaccgcctccaaccgcacttactggagatgcttattcaactgcccgctaattctgtgacaaaagtgagcatccagttcgagagagcactgctgaaatggacggaatacactcctgatcccaatcatggtttttatgtgtcaccatcagtcttatcggctctcgttcccagcatggtggcagcaaagccagtcgactgggaagagagcccactcttcaattctttgttcccagtgtccgatgggagcaactactttgtcagattgtatacagagcctcttctcgtgaaccttcccacccctgacttctccatgccctacaatgtcatttgcctcacttgcaccgtggttgctgtttgttatggctcattctataacctcctgacacgtacgtttcatattgaggagcccaggacagggggactggccaagaggctcgctaatcttatcaggcgagccaggggtgtgcctccattatag

SEQ ID NO: 52792 - DNA, 345 bp, Artificial Sequence
  Description of Artificial Sequence: Synthetic coding sequence
atgctctcaggcgctcgctgtcgtctggcgtccgctcttaggggaacaagagccccacctagtgcagtagcacggaggtgcttgcacgcatcaggcagccgtcctcttgcagacagagggaagaagacagaagaacccccacgtgatttcgacccggctctgctcgagtttctcgtctgtccacttagcaagaagccattgcgatacgaagcgagcactaatgagttaatcaacgaagaactgggtattgcctaccccatcattgatggtattcccaatatgattccacaggctgctcggatgactcgccaaagtaaaaaacaagaggaggtagaacagcgctag

SEQ ID NO: 52793 - DNA, 216 bp, Artificial Sequence
  Description of Artificial Sequence: Synthetic coding sequence
atgtttctctctctgcctactctgactgtgctgattcccctggtgagtctggccggtctgttttattctgcttcagtggaagagaattttccacagggatgtacctcaactgctagcttatgtttttactcattgcttctcccaatcaccatccccgtgtacgtgttcttccacctctggacatggatgggtatcaagctgtttcgacacaattag

SEQ ID NO: 52794 - DNA, 4032 bp, Artificial Sequence
  Description of Artificial Sequence: Synthetic coding sequence
atgattatcaaggagtatcggattccattgcccatgacggtggaggaatatcgaatcgcccagctttatatgatccaaaagaaatcccgtaatgagacctatggagagggctcaggagtggagattctggagaataggccctacaccgatgggccaggaggcagcggacagtacactcacaaggtctaccacgtaggcatgcacatccctagctggttcagatcaattctgcccaaagctgccttgcgtgtggtggaagagagctggaacgcctatccgtatacacggactagattcacctgtccattcgtggagaaattcagtatagatatcgaaacattctacaaaactgatgccggtgaaaatccagatgtgttcaatttgtctcccgtcgaaaagaaccagctgacgatcgactttattgacattgtgaaggatccagtgccccacaatgaatacaaaacagaggaggatcctaagttgtttcaatcgactaaaacccagagagggcctctgtccgagaactggatcgaggagtataagaaacaggtgttccctattatgtgcgcctataagttgtgcaaggttgagtttaggtactggggaatgcagagcaaaattgagagattcattcacgataccggcctgaggagagttatggtgcgggcacacaggcaggcctggtgctggcaggacgagtggtacgggctgagcatggagaatatacgggagctggaaaaggaggcacagcttatgttgtctagaaaaatggcccaattcaatgaagatggtgaagaggcgaccgagcttgttaaacatgaggctgtctctgatcagacgtccggggaacccccagaaccttcttccagcaatggagagccgctggtgggcagaggcctgaaaaaacagtggtctaccagctcaaagtcaagtaggtcatcgaagagaggagcctctccatctaggcattccatctcggagtggcggatgcagagtattgctcgggatagcgatgagtcatctgacgacgaattcttcgacgcgcatgaggatctgagtgacactgaggagatgttccctaaggacatcacgaagtggagctcaaatgacctgatggacaaaatcgaatcacctgagcctgaggatactcaggacggcctgtatagacagggtgccccagaattcagagtggcgtccagcgtcgaacagctgaacatcattgaagacgaggtttcacaacctttagctgctcctccctctaagattcacgtgctgctcctggtactccatgggggtaccatccttgatactggagccggagacccaagctccaaaaagggcgacgccaataccatcgccaatgtattcgatacggtcatgcgagtccactacccctcagccttaggcaggctcgcgatcagactcgtgccttgccctccagtttgtagtgacgcctttgcgttggtgtccaatctcagtccatacagtcatgatgaaggctgtctttcatctagccaggatcacattcctctggccgcactgcctctccttgctacatcaagccctcagtaccaggaggcggttgccactgtgatccagagggctaacctggcctacggcgatttcataaaaagccaggaaggtatgacctttaacggacaagtgtgcctgataggagactgcgtgggcggtattcttgcctttgacgctctttgttactccaatcagcctgtgtccgaatctcagtcatctagtcgcagagggagcgtcgtgagcatgcaggataacgaccttctgagcccgggaattctgatgaatgccgctcactgctgcggcggaggtggaggaggagggggagggggagggtccagcgggggagggggaagttctggaggctcatcactggaatcttctcgccacttatccaggtctaacgtggatatccctagatcaaatggaaccgaagaccccaaacggcagcttcctcgaaagaggtcagatagcagcacctatgaattggacactatccagcaacatcaggctttcctgtccagcctgcacgcttcagtgctgcgcacagaaccctgtagcagacactcctcgtcatctaccatgttggacggcaccggggcactgggcaggtttgactttgagataaccgacttgttcctgttcgggtgcccactcggcttggtactcgcgcttcgcaagacagtgataccggctctggatgtttttcagttgcgcccagcctgccagcaggtttacaacttgttccatcccgctgatccctctgcttcacggcttgagcctcttctggagagacggtttcacgcgttgccaccctttagcgtaccacgatatcagagatatcctcttggcgacgggtgctctacgctccttgtggagactgtgcagcgcaatccggagctggttctggagggcggaccgttagctccacttccgcacggggacggcttcctcgaaacttccatgccagtgccagcccctacgtggcaagacggtccccgaccaggctgcgccgaaagtgacgtcctccaaacccacaatgccgcttttcaagagcatggcgctccctccagccccggtaccgcccctgcaagtaggggcttccgcagggcttcggagatatccattgcttcccaggtctccggcatggcagagtcttacactgcctcatcaatcgctcagatcgcggcaaaatggtggggccagaagaggattgactatgcactgtactgtcccgatgcactgaccgcctttcccacggtggctctaccccacctgtttcacgcctcctactgggaatcaacagatgttgtctcatttctcctgcgtcaggttatgaggcatgacaacagtagtattctcgagctagatggaaaggaggtatcagtgtttaccccatcaaaaccaagagaaaaatggcaacggaagagaacccacgtcaagctcagaaacgttactgcaaaccataggataaacgatgccttagcgaatgaggatggaccgcaggtgctgaccggccgatttatgtacggcccactggacatggtcaccctgactggcgaaaaagttgacgtccacattatgacccagccgccttccggggagtggctctatctcgacaccttggtgaccaacaattccggaagggtgtcttacacgatcccagagtcccaccggctgggagtgggtgtctacccaattaagatggttgttagaggagaccatacgtttgctgatagctacattacagttctgccaaagggcactgaatttgtggtatttagcattgacggatcatttgccgcaagcgtgtccatcatggggtcagacccaaaagtgcgggcaggagcggtggacgtagtgcgacactggcaggatctgggatacctcattatctatgtgaccgggcgacctgatatgcagaagcaaagggtggtggcctggctcgctcagcacaacttcccccacggcgttgtgtcattttgcgacggactcgtgcatgacccccttaggcacaaagccaactttctcaaattacttataagcgagctacacttaagggtccatgccgcttacgggtccacaaaagatgtggccgtgtactccgccattagtctgtctcccatgcagatttacattgtggggagaccaacgaagaaactgcagcaacagtgccagttcatcactgatggttacgcggcacacttagcccagctgaaatactcccaccgagcaaggcctgcgaggaacaccgccaccagaatggcattacgaaaagggtccttcgggctgcctggacaaggcgattttcttaggagtagaaatcacctactgagaacaatctccgcgcaaccatcaggcccaagccaccgccacgagaggacacagtcgcaggccgacggcgagcaacgcggtcagaggtcaatgtctgtggcggcaggctgttggggacgggcaatgactgggcgtctggagccaggtgcagccgcaggcccaaaatag

SEQ ID NO: 52795 - DNA, 4050 bp, Artificial Sequence
  Description of Artificial Sequence: Synthetic coding sequence
atgattattaaggagtaccgcatccctctgcccatgaccgtagaggagtaccgaattgctcagctatacatgattcagaaaaaatcccggaatgagacatacggggagggctcgggggtcgaaatacttgagaacagaccctatacagacgggccagggggttctggccagtacacccacaaggtctaccatgtggggatgcacatcccgtcatggttccgcagcatcctaccaaaggccgctttgcgcgtggtggaggagtcctggaacgcatacccttatacacgcactcggtttacctgcccattcgtcgaaaagttctcaattgatatcgagaccttctacaagacagatgccggagagaaccctgacgtcttcaatctttcgccagttgagaagaaccagttaacaatcgatttcatcgatatcgtaaaggatcccgtgccacataatgaatataaaaccgaagaggaccctaagttattccaaagcactaagacgcagagggggcctctcagcgaaaattggattgaggagtacaagaaacaagtgtttccaattatgtgcgcctacaaattatgcaaggtcgagtttagatactggggaatgcagtccaaaattgagcgttttatccacgatactggcctaaggagagtgatggtgcgcgctcaccggcaggcatggtgctggcaggatgaatggtacgggctctccatggagaatattagggaattagagaaagaggcgcagctcatgctcagccggaaaatggctcaattcaatgaggatggagaggaagctactgaactcgttaagcacgaagcagtgtccgatcaaacctcgggggagcccccagagcccagcagcagtaacggtgagcctctggtaggacgaggtctgaaaaagcagtggtccacttcatcgaagtctagtagaagttctaaacgcggagctagtccctcaagacatagtatctctgaatggaggatgcaatccattgcacgggatagtgatgaaagcagcgatgatgagttttttgacgcacacgaggatctctccgacaccgaagaaatgtttcccaaggatattaccaaatggtctagtaacgatctgatggacaagatcgaatccccagagccggaagacacccaggacggattgtatagacaaggagccccagagttccgggtcgccagcagcgttgagcaactcaacatcatcgaggacgaggtcagccaacctctggcagccccaccctcaaaaattcatgttctgctcttggtattacacggagggaccatcttggatacaggcgctggtgaccctagctcgaagaagggtgatgccaacacaatagcaaacgtcttcgacaccgtgatgagggtccattaccccagcgcgttgggcaggttggcaatccggctggtgccttgtcctccagtatgttccgacgcgttcgccctagtctcaaacttgagcccttactcacacgatgaggggtgtttgagtagctcccaggaccacatacccctggctgccttacctttgctcgcaacctcaagcccacagtaccaggaagctgttgccaccgtcattcaacgtgcaaatcttgcttacggcgactttattaagtcccaggagggcatgacattcaacggtcaggtatgtctgattggtgattgcgtgggcggtatcttagcatttgacgctttgtgttattcaaaccagccagtcagcgagtcacagtcctcaagtcgccgaggaagcgtcgtgagcatgcaggacaacgatctcttaagccctggaatactgatgaatgctgcgcactgttgtggcggtggcggaggtggcggtggaggaggaggcagttccggcggaggcggttcaagtggagggagctctctcgagtcatctcgacaccttagtcggagcaacgtggatattccccgaagcaatgggactgaagacccaaaaaggcaactgcctcgaaagcgatctgattctagcacctacgagctggataccattcagcagcaccaagcttttctgagtagtctccatgcatccgtccttcgcaccgagccctgttctcggcacagcagtagctcaaccatgttggatggcactggggcactcggacgattcgatttcgagattactgatcttttcctattcggctgtcccctggggctcgtcctcgctctgagaaaaactgtcatacccgctctggacgtgttccagctccgccctgcctgccagcaagtctacaacctgtttcatcccgctgacccttccgccagcagattggagccgctgcttgaacgacgatttcacgccctcccacctttctccgtaccaaggtaccaaagatacccactgggcgacggttgctctactttgctggcagatgttctgcagacccacaatgcagcattccaagaacatggggcaccatctagcccgggaaccgcgcctgctagccgagggttcaggcgggcaagtgagatctccatcgcaagtcaagtttccgggatggcagagagctacactgcaagcagcatcgcccagaaggctccagacgcactctcccacacaccatccgtgagacggctgagtctgctggctctacccgctcctagcccgacaacacccggaccacatcctcctgccagaaaagccagcccaggcctggaaagagccccaggtctgcctgagctagatatcggagaggttgctgccaaatggtggggtcaaaaacgcattgactatgcactctattgtccagacgccctgacagcttttcctacagtggccttgccgcacctctttcacgcttcttactgggagtccaccgatgtagtaagttttctgttgaggcaggtgatgcgacatgacaactcgagcattctcgagctcgatgggaaagaggtcagtgtgtttaccccaagcaaaccgagagaaaaatggcagcgaaaaagaacacacgttaagctgagaaatgtgacagccaaccaccgcatcaatgacgctctcgcaaatgaggacggcccacaggtgttaacgggcagattcatgtatggccctctggacatggtcaccctcaccggagaaaaggtggacgttcacattatgacccaacctccaagtggagaatggctatatctcgacacactggtaacaaacaattccggacgcgtcagctacacaatccccgagtcccatcgtcttggagttggcgtgtaccctatcaaaatggtggttagaggtgaccacacttttgctgattcctacatcaccgttctgcctaaggggaccgagtttgtggttttcagcatcgacgggagttttgccgcatcagtctcaattatgggatctgatcctaaggtgcgcgctggagccgtggacgtggtgaggcactggcaggatttaggctatcttattatttacgtcacaggacgccctgacatgcagaagcaacgtgttgtcgcatggcttgctcagcacaattttccccacggtgtagtgtccttttgtgatggccttgtccacgatcctctccgccacaaggcaaacttcctgaaactcttaatatcagaactccacctgagggtgcacgcagcatacggatctactaaagacgtggccgtctacagcgctatttcactgagtccaatgcagatttatatagttggaagacctaccaagaagctgcagcaacaatgtcagttcatcaccgacggctacgctgcccacctggctcagttaaagtactcccatcgcgcacgccctgcaagaaataccgctactcgaatggcactgcggaagggcagctttgggctgcctgggcagggagacttcttacgcagtaggaaccatctactacggacaatctcagcacagcctagtggtcctagccacaggcacgagcgcactcagagccaagctgatggagagcagcgaggtcagcggtccatgtctgtcgccgctggctgttggggacgcgcaatgactggacgcttggagccaggtgccgctgcagggcctaagtag

SEQ ID NO: 52796 - DNA, 3213 bp, Artificial Sequence
  Description of Artificial Sequence: Synthetic coding sequence
atgatcataaaagagtaccgaatccctctgcctatgacagtcgaggaataccgcatagctcaactgtatatgatccagaagaaatctcgcaatgagacctacggggagggatccggggttgagatcctagaaaatcgccctttctggcggatgcagtccatagcgcgtgacagtgacgagtccagcgacgacgagtttttcgatgcccacgaggacctgtccgatacagaagaaatgtttcctaaagacatcactaaatggtcttctaacgacctgatggataagatagaaagcccagagcccgaggatacccaggacggactataccgtcaaggcgcacctgagttcagagtagcctcctcggtggagcagctgaacatcatagaggatgaggtttcccaaccgctggcagcccctccctctaaaattcacgtgctgttgctagtgctgcacgggggtaccattctggataccggtgcgggtgaccctagttccaagaaaggtgacgcgaatactatcgctaacgtcttcgatacagtgatgagggtgcattacccctccgccctaggaagactggccattcggttagtcccttgcccccctgtttgtagtgatgcctttgccctagtgtctaacctgagtccttattctcacgacgaaggatgtttgtcttcttcccaggaccacatcccccttgctgccctgcccctcctcgccacttcgtcaccccagtaccaggaagcagtggcgaccgttattcaaagggcaaacttggcctatggggattttattaaaagccaggaaggcatgacatttaatgggcaggtgtgtctcatcggggactgcgtaggcggaatcctagcctttgatgccctgtgctattctaaccaacccgtaagcgaatcccagagcagtagtaggaggggttccgtggtatcaatgcaggacaatgatttactgagccctggaatcctgatgaatgccgctcactgttgcggaggcggtggagggggtggcggagggggaggctcctcaggagggggaggttcgtccggcggatcctctctggagtcttctcgtcacctgagccgatctaacgttgatatccctaggtccaacgggaccgaagacccaaagcgacagcttccgaggaagaggtccgactcatccacctacgaactagataccattcaacagcatcaggctttcttaagtagcttgcacgcaagcgtgctcagaaccgagccatgctctaggcacagctcatcctccacaatgctggatggcacgggagctctgggacggttcgatttcgaaattaccgacttatttctatttggctgcccccttggcttggttctggccctgagaaagacggtcatacctgccctggatgtgtttcagctgcggcctgcttgtcaacaagtctacaacctattccaccccgctgacccaagcgccagccgcctagagcctctgctggaacggagattccacgctctgcccccattctccgtccctcggtaccaaaggtatcccctcggtgatggatgctctactttgcttgctgatgtgctgcagacccacaatgccgctttccaggagcatggagcgccttcgagcccaggcaccgcaccagcaagcagggggttcaggagagctagcgagatctctatagcaagtcaagtgagcgggatggccgagagctacacagcatccagcattgcccagaaagctcctgacgccctgagtcataccccgtctgtgagacgcctctcgcttctggcactgcccgctcctagtcccactacccctggaccccatcctcccgcacgtaaggccagtcccggactggagagggcacccggactgcctgagttggatattggggaggtcgccgctaaatggtggggtcagaagcggatagactatgccctctattgccccgatgcccttactgcattccctaccgtagctctgcctcacctgtttcatgcctcatactgggagtcaacggatgttgtctccttcttgctccgccaggtgatgcggcacgataacagctcaatcctggagctggacgggaaagaggtatccgtatttacccccagcaaacctagagaaaagtggcagagaaagagaactcacgtgaagctgcgcaatgttactgctaatcacagaataaacgacgctcttgctaatgaagacggccctcaggtcttgactggaagattcatgtatggacccctcgatatggttaccctaacgggagagaaagtcgatgtgcacatcatgactcaaccaccttccggcgagtggctgtatctggataccctggtgactaacaacagtggaagggtttcgtatacaattccggagtcgcacaggctgggcgttggcgtttaccccattaagatggtcgttaggggcgaccacacgttcgcagattcttacataaccgtgttgcccaagggtacagagtttgttgtttttagcatcgatggctcttttgccgcaagtgtcagcatcatggggagtgaccccaaggtgagagcaggcgctgtggatgtggttagacattggcaggacttgggctacttaatcatctacgtgactgggcgacccgatatgcaaaagcaaagggtcgtggcctggctggcgcaacacaattttccacatggggtagtgtcattctgcgacggattggtgcacgatcctctgcgtcataaggcgaactttttgaaactgctgatatccgaactccatttgagggtacacgccgcttacggctccaccaaggatgttgccgtatattcggccatatcccttagtcctatgcagatctacattgtgggacggcctactaaaaagcttcagcagcagtgccagtttattactgacgggtatgcggctcatctggcccagttaaagtattcgcaccgcgcacgtcccgctcgaaataccgcaactaggatggccctccgtaaaggaagctttggactgcctggccagggcgacttccttcgatcgaggaatcatcttctgaggactatcagtgcccagccaagcggcccttcccacagacacgagagaacacagagccaagccgacggggagcaaaggggccagaggtcaatgagcgtcgccgcaggatgttggggaagagccatgactggacggctggaacccggagcagcagctggaccgaagtag

SEQ ID NO: 52797 - DNA, 48 bp, Artificial Sequence
  Description of Artificial Sequence: Synthetic coding sequence
atgataatcaaagagtataggattccgctccccatgaccgtagagtag

SEQ ID NO: 52798 - DNA, 126 bp, Artificial Sequence
  Description of Artificial Sequence: Synthetic coding sequence
atgattattaaggaatatcgaattcctcttcctatgaccgtagaggaatatcgcatcgcccagctctacatgattcagaaaaaaagccgcaacgagacctacggtgagggaagtggagtagaatag

SEQ ID NO: 52799 - DNA, 4050 bp, Artificial Sequence
  Description of Artificial Sequence: Synthetic coding sequence
atgataatcaaggagtaccgcatccccctgcctatgacggtagaggaatatcgtatagcccagctctacatgatccaaaagaaaagtcggaatgaaacctatggagaaggcagcggtgtggaaattctggaaaaccggccttacacagacggtcctggcggttcgggacagtacacccataaggtttatcatgtcggaatgcatatcccatcctggttcaggagtatcctgcccaaggccgctttacgggtagtcgaagagtcctggaacgcgtacccatacacacgcacaagattcacatgccctttcgtggaaaaattcagcatcgatatagaaactttttacaagacagacgccggagagaaccccgacgtttttaacctttcgcccgtggaaaagaatcagttgactatcgacttcattgacatagttaaagatccagtacctcacaacgagtataaaaccgaggaagaccctaagctgttccagagcaccaagacacagcggggacccctgtccgagaattggattgaggaatacaagaagcaggtgttccccatcatgtgcgcctataagttgtgtaaagtcgagtttagatactgggggatgcagagcaagattgaacgcttcatacacgataccggtctccggagggttatggtgagggcacatcggcaagcatggtgttggcaggacgagtggtacggtttatccatggaaaacatccgcgaactagagaaggaagcacagctgatgctctctcggaaaatggctcagttcaacgaggatggagaggaggcgaccgagcttgtgaaacatgaagcagttagtgaccagacctcaggggagccacctgagccaagtagtagcaacggcgaacccctcgttgggagaggcctcaaaaaacagtggtcaacctcttcaaaatcgagccggtcaagcaaacgcggtgcttccccatcccgtcactccatcagtgagtggcgaatgcagtctatcgctagggattctgacgaaagctccgacgatgagttttttgacgcccacgaggacctgtccgacacagaggaaatgttccctaaagatatcactaaatggtcctctaatgatctcatggataaaattgagtccccggagccagaagatactcaagatggactctaccgtcaaggcgctccagagtttagggttgcttcatccgttgaacaattaaatatcatcgaagacgaggtctcacaaccactggccgcacctccctcaaaaatacatgtccttttgttagtgctccatggcggtacaattctcgacactggggctggagatccaagttccaagaaaggcgatgcgaacacaattgcgaacgtattcgatacagtgatgagagtccactacccatcagccctggggcgtctagcaattcggctcgtcccttgtccaccagtttgctccgatgcattcgccctggtctcaaatttatctccatacagccacgacgagggttgtctctcaagtagccaagaccacattcccctcgctgcactgcctctccttgccaccagtagcccacagtaccaggaagctgtggccaccgttatccagcgcgcaaacctggcctacggcgattttatcaagtctcaagaagggatgacctttaacggacaggtttgcctcatcggcgattgtgttgggggtattctggcctttgacgctctttgctacagcaatcaacctgtttctgagagccagtcgagctcaagacggggaagtgtggtctcgatgcaggacaatgatttactaagtccagggatacttatgaacgctgcccattgttgtggcggaggcggtgggggtggtggaggtgggggaagttcaggcggtggtgggtcttctgggggaagctctcttgagtctagccgtcatctgtcccggagtaatgtggatatcccaagaagcaacggcaccgaagatccaaaaaggcaactgcctagaaagcgcagcgacagctccacatatgagcttgacaccatccaacaacatcaggcttttctctcgagtctgcacgcttcggtgttgcgcactgaaccctgctcaagacattcatcatcaagcacaatgctagatgggacgggggctctcggcagatttgatttcgagattaccgatctgtttctgttcggatgcccgctgggtcttgtgctggccctgcgaaaaacagtgatacccgcattagatgtgtttcagctgcgacccgcatgccagcaggtctacaatctcttccacccggcagacccatctgcttcccgcctcgagcctctcctagaacggaggtttcacgctctgccaccttttagcgttcctaggtatcaaaggtatcccctcggcgatggctgctccactctcctcgctgacgtgctacagacacacaacgccgcttttcaagagcacggcgcaccaagttcacctggaaccgcgccagcgtcccggggttttcgccgagcctctgaaattagtattgcatcgcaggtctctggcatggcggaatcttatacagcttcttccattgcacaaaaagcccctgacgctttgtcacacactcctagtgtgagacgcctgtcactgctcgctctgccagcccctagccctacgacacccggtccacatcctcctgctagaaaggcaagcccagggctggaaagagcgcctggattgcccgagcttgatatcggggaagtggctgcaaagtggtggggtcaaaaacgtattgactacgcactgtactgccccgacgcccttactgcctttcccacagtggccctcccccacctttttcatgcgtcctattgggagtccaccgacgtggtttctttcttgctgaggcaggtgatgagacacgataattcatcaatcttggagctcgatggaaaagaggtatctgtgttcaccccttcaaagcccagggagaaatggcagcggaagcgcacacacgtgaagttacggaacgtgaccgccaatcaccgcattaatgacgcccttgctaatgaggacggtccccaggtgcttactgggcgatttatgtatggtccactcgatatggtcacattaacgggcgagaaggtcgacgtgcatatcatgacacaaccaccgtcgggggagtggctgtacttggacaccctcgtcacaaataactctgggagagttagctatacaatccccgagtcacacagactcggtgtaggcgtgtatcctatcaaaatggtggtccgaggggaccatacttttgccgatagttacatcaccgtgctgcccaaaggaactgagttcgtggtgttcagcatcgacgggagttttgctgcctcagtgtcaattatgggatcagaccctaaggtaagggctggagccgtggacgtggtgcgacattggcaagacctagggtatctcatcatttacgtaaccggacgaccagacatgcagaagcagagggttgtggcatggctggcacaacacaattttccccacggcgtggttagtttttgcgacggtttagtgcacgacccgctgaggcacaaggccaatttcctgaaactgctgatctccgaactccacctgagggtgcatgcggcttatgggagcacgaaagacgtagccgtttacagcgctataagtctctctcctatgcagatttacatcgtgggacggcctacgaagaagcttcagcagcagtgccaatttattaccgacggctacgccgcacatttagctcaactcaagtactctcaccgagcacgaccagccaggaataccgcaactcgcatggccttacggaaaggctcctttggtctgccagggcagggggatttcctgcgttcccgcaaccatttgcttcgcacaattagcgcacagccctccggtccatctcaccgtcacgaacgcacacaatctcaggctgacggagagcagcgcggacagagatcgatgtctgtggcagcgggatgctggggcagagccatgactggacggctggagccgggtgctgccgcaggtcctaaatag

SEQ ID NO: 52800 - DNA, 1251 bp, Artificial Sequence
  Description of Artificial Sequence: Synthetic coding sequence
atgtcatccaattgcactagcactactgccgtggccgtggctcccctctccgcctctaagaccaagaccaagaagaaacattttgtgtgccagaaggttaagttgtttagagcttccgagcccattttgtccgttttgatgtggggcgttaaccataccataaatgagctcagtaatgtccctgtgcccgtgatgctcatgccagatgacttcaaggcatacagcaaaataaaggtcgacaatcatctgttcaacaaggaaaacctgccctcccgtttcaaattcaaggaatactgtccgatggtcttccgcaacctgagggagcgtttcggaattgacgatcaggactaccagaactctgtgacacggtcagccccaattaactctgacagtcagggcaggtgcggtactaggtttctgacaacctatgatagacggttcgtgatcaaaactgtctcttctgaagacgtcgcagaaatgcacaacattctcaagaagtaccaccaatttattgtggaatgccacggtaatactctgctgccgcaatttctgggaatgtacagacttactgtcgatggcgtggagacctatatggtcgtgactcgaaatgtgtttagtcatcgccttactgtgcatagaaaatacgatctaaaggggagtactgtcgctcgagaggcctctgacaaagagaaggccaaagacttgccaacctttaaggataatgactttctgaatgaaggccagaagctccatgtgggagaggaatccaagaaaaatttcttggaaaaattaaagagagacgtagagtttctggcacaattgaagatcatggactattctctcctggtcggtatccatgatgtagaccgggctgagcaagaggaaatggaagtggaagagagagcagaggacgaggagtgcgagaacgacggagtcgggggtaatctcctttgctcctacgggactccccctgacagccccggaaatctcctgtcctttccacgattcttcggccctggggaatttgatccttcagtggacgtttatgccatgaaaagtcatgagagcagccctaagaaggaagtgtactttatggcaatcatagatattttgaccccctatgacaccaaaaagaaggctgcgcacgcagccaaaactgtgaagcacggggctggcgctgaaatcagcacagtcaatcccgaacagtattcaaagcggttcaatgaatttatgtccaacatcttgacatag

SEQ ID NO: 52801 - DNA, 834 bp, Artificial Sequence
  Description of Artificial Sequence: Synthetic coding sequence
atgagcagcaattgtacctctactaccgccgtcgccgttgcccctctgtctgcgagcaagacaaagaccaagaagaaacacttcgtctgtcagaaagtcaagctgttccgggcatctgaacctatcctctctgtcctgatgtggggcgtcaaccacacaatcaatgaattgagcaacgtccccgtaccggtaatgctgatgcctgatgactttaaagcctatagtaaaatcaaagtcgacaaccacctctttaataaagagaacctgccctctcggttcaagttcaaggagtactgccccatggtgttccgcaaccttagagagaggttcggaatcgatgaccaagactatcaaaacagcgtgactaggtcagccccaattaatagcgacagtcaaggtcgatgcggcacccgattccttacaacctacgaccgccgtttcgtgataaagactgtctctagtgaggatgtcgccgaaatgcacaacatactgaagaagtaccaccagtttatcgtcgagtgccatggcaatactctcctgcctcagtttttaggaatgtaccggcttacggtcgacggagtggagacctacatggtggtaactaggaatgtgttctcgcaccgcctgacagtccacaggaagtatgacctcaagggatccaccgtcgcaagagaagcctctgataaggaaaaggctaaggacctcccaacctttaaggataacgacttcctcaatgaaggtcagaaattgcatgtgggcgaagaatctaagaaaaatttcctcgagaaactgaagagagatgtcgaggagattctggtcctgagtcctggttag

SEQ ID NO: 52802 - DNA, 1830 bp, Artificial Sequence
  Description of Artificial Sequence: Synthetic coding sequence
atgtggcggctgcctggcgctcgtgcagccctgcgcgttatccggaccgccgtggagaagctcagccgtgcagaagccggttcccagactgctgccggagccatggaaagggctgttgtccgctgtgtgccttcagaacctaaactctcccttagctttgcactcgctgatggctcacataagaacatgcaacgcgatcagagcgaaccactcgggagggtattaagtagaatcgccacaaatgctctgaaaggccacgcaaaagccgcagccgcaaaaaagtcaagaaaatcccgcccaaatgcgagcggcggtgccgcatgctcaggaccaggaccagaacctgccgtgttctgcgagcctgtggtcaagctttactatcgagaggaggctgtggccgaggatgtcctgaacgtcgacgcttggcaggatggcgcagtcttgcagattggcgatgttaagtacaaggttgaacgaaacccaccggcatttactgagctccagctgcccaggtatatcatggcagggttccccgtgtgccctaagctatcccttgagttcggagaccctgcatcctcgctcttcaggtggtacaaagaagcgaagcccggagccgctgaacctgaggttggagtgccaagctcattgtcaccgtcctccccctcatccagctggaccgagaccgacgtggaggaaagggtgtacacaccatctaatgccgacatcgggttacgacttaaacttcattgtacacctggcgatgggcaaaggttcggtcacagtagagaactggaaagtgtttgcgttgtggaggctggtccgggaacatgtacttttgaccacaggcacctgtacactaaaaaggtgaccgaagatgcccttatcaggacagtgtcatataatattctcgctgacacttatgcccagacagagttctccaggaccgttctgtacccttactgcgctccatacgcgctggaactggactataggcaaaatttaattcagaaggaactgactgggtacaacgctgatgttatctgcctgcaagaggtggatcgggctgtattcagcgacagcctggtgccagcgctggaggccttcgggcttgagggggtgtttaggatcaagcagcacgaggggctggccacattttatcggaaatccaagttctctcttctctcacaacatgatatctccttttatgaggcgctggaatctgacccgttgcacaaagaactgttggaaaagcttgtgctgtaccccagcgcacaggaaaaagtgctccagaggagtagcgttctgcaggtgtcagttctacaaagcacgaaagactccagtaagcgaatttgtgtcgccaacacacacctatattggcatcccaagggcggatacatcaggctgatccagatggccgtagccctggctcatattagacacgtgtcttgtgacctatacccaggtatcccggtcatattttgtggcgatttcaacagtacccctagcaccgggatgtatcattttgtgattaacggctccatccccgaagaccacgaagactgggcgtccaacggggaagaagagagatgcaatatgagcctgacacatttcttcaaacttaagtctgcctgtggtgagcccgcttacacgaactatgtcgggggattccacggctgtctcgactacattttcattgacctgaacgctctagaagttgagcaagtgattcctttgccctcacacgaggaggtgaccacccatcaggccctgcctagtgtgagtcatccatccgaccacatcgccttggtgtgtgacctgaagtggaaatag

SEQ ID NO: 52803 - DNA, 1419 bp, Artificial Sequence
  Description of Artificial Sequence: Synthetic coding sequence
atgtggcgcttacccggtgctagagccgctctacgagtgatccgtacagcagtggagaagctgtcccgagcggaagcagggtcccaaactgcggctggagccatggagagggcagtcgtgcggtgtgtgccatcagaacccaagctctccctgagcttcgctctcgctgatggcagtcataaaaatatgcaacgagaccaaagcgagccattggggagggtgctcagcaggatcgccacaaacgcactgaaaggccatgctaaggctgccgcagccaagaaatcacgcaagtctcgacctaatgcgtctggaggcgctgcctgtagcggaccagggccagagcccgcagtgttctgcgagccagtggtgaaattgtattatagagaggaggccgttgccgaagacgtgttgaacgtcgacgcttggcaagatggcgcagtgttgcagattggagatgttaagtacaaggtggaaaggaaccctccagcttttacagagttgcagctccccagatacatcatggctggctttccggtgtgcccgaagctcagtttagagtttggcgatccagcctcaagcctatttaggtggtacaaagaggcgaaaccaggagcagccgaacctgaggtgggcgttccctcgtcactaagtcccagcagtccgagttcatcctggacagaaacagatgtcgaggaaagagtatataccccctctaatgcagacatcggactgcggctaaaactgcattgtacacccggtgatggccagcgtttcggccacagccgcgaactagagagcgtttgcgtggtcgaggccggacctggtacctgtacattcgaccatagacacctctatacaaagaaagtgaccgaggatgcgctcatcagaacagtgagttacaacatccttgccgacacctacgcgcagaccgagttttcaaggacagttttgtacccatactgtgcaccttacgctctggaactggattataggcagaatctgatccagaaggaactcacaggttataatgccgatgtgatctgcctgcaggaagtagatcgcgctgtgttttccgacagcctggtccctgcactggaagcctttggcctggaaggggtgtttcgtataaaacaacacgaaggcctcgccacattctaccgcaagtcgaagtttagcctgctgtcccagcacgatatcagcttctacgaggctctcgaatcagacccactacacaaggaactgctggagaagctggttctgtatccctctgctcaggagaaagttttacaacggagctcggtacttcaggtgagcgtcctccagtcgactaaggattcaagcaagagaatctgcgtggccaatacgcatctttactggcatcctaaaggcaggttctatctcgtgtcacaagtcacctag

SEQ ID NO: 52804 - DNA, 2826 bp, Artificial Sequence
  Description of Artificial Sequence: Synthetic coding sequence
atggggcaggcctgtggtcactctatcctctgccggtcccagcagtacccagctgctcggccagcggagccgagggggcagcaggtgttcctgaaacctgatgagccaccaccccctccccagccatgtgctgatagcctacaagatgccctgctgtccctcggctccgtaatcgatatctctggtctacagcgggcagtcaaagaagccctgagcgctgttcttccacgtgtggagactgtatatacctatctgctggacggtgagagtcaactggtctgcgaggaccctcctcatgaactgccgcaggagggtaaggtgagggaggccattattagccaaaaacgcctcggctgcaacggcttaggtttctccgatctgccgggtaaaccactcgctagactagtggctcctctcgccccagacacccaggttcttgtcatgccattggccgacaaagaagcaggggctgtcgcggctgtgattctggtgcactgtggtcagttgagcgacaacgaggaatggtccctgcaggccgtggaaaaacatacactggttgccctgcggagggtgcaggtcctgcagcaacgaggaccgagagaagcccctcgagctgttcaaaatccacccgagggaacagccgaggaccagaagggaggtgcagcctatactgatcgtgacagaaaaatcctccagctctgcggtgagttatatgatctggacgccagtagcttgcagctgaaggtgttacaatatctgcagcaggaaactagagcctcccggtgttgtttgttgctagtcagcgaggacaatctacaactgtcatgtaaggttatcggtgataaggtgctgggagaagaggtgtcattccctctcacgggctgcctaggacaggtcgtggaggacaagaagagtatccaattgaaggatcttacctctgaggatgtccagcagttacaaagcatgctgggttgcgagcttcaggctatgctgtgcgtgcctgtcatcagccgcgcaactgaccaagtggttgctctggcatgcgctttcaacaaactcgagggagacctgttcacagacgaggatgagcatgtcattcagcactgttttcactacacaagcacagttttaacatctactctagcctttcaaaaggaacagaagttgaaatgcgagtgtcaggccctgctccaggtggctaagaatctctttactcatctggatgatgtgtccgtgctgttacaggagatcatcacagaggcaaggaatttgtccaatgcagagatctgctccgtctttctgctggaccaaaacgaactcgttgcgaaggtgttcgatggcggtgtggtggacgacgagtcctacgagatcagaattcccgcagatcagggcattgccggtcacgtggcaacaactggacagattctaaatatccctgacgcgtatgcccacccgctcttttatcgcggtgtggacgattccaccggcttccggacccggaacatcctttgttttcctattaaaaacgaaaaccaggaggtgattggcgttgcagaactcgttaacaagatcaacggaccctggttttcaaaatttgatgaagacttggccactgccttctcaatatattgtgggattagtatagctcatagcctactgtacaaaaaagtaaacgaagcccaataccgctcacaccttgccaacgagatgatgatgtatcacatgaaagtatcggacgatgagtatacaaagcttctgcacgatggcatacaacctgtggccgctattgattcaaattttgcatcgtttacttatacacccaggagtctcccagaagatgatacatccatggcgatcctaagcatgctgcaggacatgaacttcatcaacaattacaagatagattgcccgacactggctagattttgcctaatggtaaaaaaggggtaccgggatcccccttaccataactggatgcatgccttttccgtgtcccacttttgctatcttttgtacaaaaatctggagttgaccaattatttagaagatattgaaattttcgcactcttcatctcctgcatgtgccatgatctagaccaccggggtactaacaatagcttccaggttgctagcaaaagcgtgttggccgctctgtattcctccgagggaagtgtgatggagaggcaccactttgcccaggctattgccatactcaatacccacgggtgcaacatttttgaccacttctctcgtaaggattatcagaggatgttggacctcatgcgcgatattatcttggccaccgacttagcccaccacctgcgaatctttaaagacctgcagaagatggccgaggtaggctatgatcgaaacaataagcagcaccacagacttctactgtgtttactgatgactagctgcgacctgtccgaccagacgaaaggatggaagactactagaaaaattgccgaactgatctacaaagagttcttttcgcagggagacttggagaaagcaatgggaaatcggcctatggagatgatggatcgcgaaaaagcatatatacctgaattgcagatcagttttatggagcacatcgcaatgcccatttataagctacttcaggatctgtttcccaaggcagccgagctgtacgagagagtagcatccaatagagagcactggactaaggtatctcacaaatttactatcaggggcctcccatccaataactcacttgactttctcgatgaggaatacgaagtgccagacctggatgggacccgggctccgatcaacggctgttgttccctggacgcagagtag

SEQ ID NO: 52805 - DNA, 2058 bp, Artificial Sequence
  Description of Artificial Sequence: Synthetic coding sequence
atggtactggtcctgcaccatatccttatcgctgtggtccagtttcttaggagaggccagcaggtgtttctgaaaccagatgagccacctccgcctcctcagccttgcgccgatagcctgcaagacgcactgctgagtcttggatctgtaattgatatatcggggctccagcgcgctgtaaaggaggctctctcagccgtactgcctcgggtcgaaaccgtctatacatatttgttagatggggagtcacagttggtttgtgaggatcctccccacgagctgccacaggagggtaaggttcggttcaccgatgaagacgagcacgtgatccaacactgtttccactacacatctactgtcctgacaagtaccctcgcattccagaaagaacaaaagctgaaatgtgagtgccaggccctgcttcaggtcgccaaaaacttgttcacccacctcgacgatgtgtcggtcttgcttcaggagattattactgaggctcgaaacctcagcaacgcggagatttgctcagtctttctgctggatcagaacgaactggtggctaaggtttttgacggtggggttgtggacgacgaaagctacgaaatccgtattcctgccgatcagggtatcgcgggacacgtggcgacaacgggtcaaatcctgaacattcccgatgcttacgctcacccgctgttctaccgcggagtggacgactccacaggatttagaaccagaaacatcctctgtttccccattaaaaatgagaaccaggaggtgattggagttgcagaactcgtcaacaagattaatggcccttggttcagcaagtttgatgaggatttagctacagcctttagcatttactgtgggatttcgattgcccattccttgctttacaagaaagttaatgaagcacagtaccgcagccacctggccaatgaaatgatgatgtatcatatgaaggtgagcgacgatgaatatactaaactgctgcacgatggtatccaaccggttgccgctattgacagcaacttcgcgtcttttacctacactcccaggagcctgcccgaggacgataccagtatggcaatcctgtccatgctacaggacatgaactttataaataattacaagatcgattgcccaactctagccaggttctgcctaatggtgaagaaaggctaccgggacccgccttatcacaactggatgcacgctttctcggtgtctcacttttgctatctcctttacaagaacctggagctcacaaattatctagaggatatagagatctttgctctattcatctcctgtatgtgtcacgaccttgatcaccgcggaacaaacaacagcttccaggtagcgtccaagtccgttcttgccgctctctatagctccgagggctctgtgatggagcggcaccactttgcccaagctatcgctattctgaacacgcacggatgcaacatcttcgaccacttctcccgcaaagattaccagcgaatgttggacctgatgcgcgatatcatcctggcaactgatctggcacaccaccttaggattttcaaggatttgcaaaagatggccgaagtaggttacgataggaataataagcagcatcataggctgcttttgtgtctcttaatgacgtcatgtgatctgtcagaccaaacgaagggctggaaaactacacgaaagattgccgagttaatttacaaggagtttttcagccagggtgacctggagaaagctatgggaaacagacccatggagatgatggacagagaaaaagcctacatccctgagctccaaattagctttatggagcatattgctatgccaatttacaaactgcttcaggatctgtttcctaaagccgcagaattgtacgaacgcgtcgcatctaatagagaacattggaccaaggtgtctcataagttcacaattaggggcctgccaagcaacaactcattggacttcttggatgaagagtatgaagttccagatctggacggcacgagggcccctatcaacggttgctgtagcctggatgctgagtag

SEQ ID NO: 52806 - DNA, 2853 bp, Artificial Sequence
  Description of Artificial Sequence: Synthetic coding sequence
atgagctatatcctgaagatgccaggaacttgcctgccaggggaaggcaccacctacgagcttcccccaagctctctccacccatcatccgcgcctgtgacatccggaggaacctgcccggcactgcttacggaggcgggatgggaggccccaataatggcattcactgaggcagcatctgctgtgggacctagctggacacactccagggcttcagtgtcaagtactgtaaaaacagaaaggaggcggagggtcttacaagcatgcggcatggtgaggcgaggccagcaggtgttcttaaagcctgatgagccacccccacccccacagccctgcgctgatagccttcaggatgccctgctgtccctgggcagcgtgatcgacatcagcgggttgcaacgcgctgtgaaagaggctctctctgcagtgctgcctagagtggaaactgtgtatacctatttactagatggggagtcgcagctggtatgcgaggacccgccacacgagctcccacaggagggcaaggtgcgcgaggctatcattagccagaagagactcggctgcaacggcttaggtttttccgacttgcccggaaagcccctcgcccgtctggtggcccctctggccccagatactcaagtcctggtgatgcctttggctgacaaggaggctggcgctgtggctgccgtcatcctagtccactgcggccaactctccgacaacgaggaatggagtttacaggctgtggagaaacacactctcgtggccttgcgcagagtgcaagtgcttcagcagcgcggaccgagagaagctccgagggcagtgcagaatccacccgagggtactgcagaggatcagaaagggggtgctgcatataccgatcgagatcgaaagatactgcagctatgtggcgaactgtacgacctggacgcaagttccctgcaacttaaagtgctccagtaccttcagcaggagaccagagcttcaagatgttgcttactcctggtatccgaagataatcttcagttgtcttgcaaggtcatcggcgacaaggtacttggagaggaggtgagtttccccctcaccggttgtctgggtcaagtcgtagaggacaagaagtccattcaacttaaggacctcaccagcgaagacgtgcagcagctgcaaagtatgctcgggtgcgaattgcaagccatgctgtgcgtgcctgtgatatcgagagcaaccgatcaggtggtggcgctggcatgcgcattcaataagctggaaggtgatctctttacagatgaagatgagcatgtcatccagcactgcttccattatacctcaactgtgctgacgtctactctcgccttccagaaggagcaaaagctcaagtgcgaatgccaggctctgctacaggttgccaaaaatttgtttacacatctggatgacgtgagcgtgctgttacaagaaatcataactgaagctcggaacctgagcaatgcggaaatctgcagtgtctttctcctcgatcagaacgaactggtggccaaggtgtttgacggtggagtcgtcgatgacgagtcctatgaaatccgaatccctgccgatcagggcattgccggacacgtcgcgactaccggccagatcctgaatatacctgatgcctacgcacatcccctgttttatcgcggagtagatgatagcaccgggttccgcactcgaaatatcttgtgtttcccgatcaaaaacgagaaccaggaggtgatcggtgttgccgagttggtgaacaaaatcaacggcccttggtttagtaaattcgacgaggacttagccacagccttctctatctattgtggcatttccatcgcccactcactcctctataaaaaggttaacgaagcacagtatcggtcacacctggccaacgagatgatgatgtatcacatgaaagtgagcgacgacgaatacaccaagttacttcacgacggaatacagccagttgcagcgattgactctaatttcgcgagctttacgtacaccccacggtccctgcccgaggacgacacttccatggccattctcagcatgctgcaggacatgaactttatcaacaactataagattgactgccctactctcgctagattttgtctcatggtcaagaagggatacagagatccaccttaccacaattggatgcacgcatttagtgtgtcccacttctgctatctgctctataagaaccttgaacttacgaattatctcgaagatatcgaaatctttgccctcttcatttcctgtatgtgccacgacttagaccacaggggaacaaacaacagtttccaggttgcttcaaagtccgtattggccgctctctatagtagtgagggctccgtcatggaacgccaccatttcgcgcaggctatcgcaatactgaatacccatggctgtaacatcttcgaccacttctcacggaaggattaccagagaatgctggatctgatgcgcgatataatcctcgccacagatttagcccatcatctaagaatctttaaagatcttcagaaaatggcagaggtgggctatgaccgtaataacaaacagcaccacagactgcttctctgtctgctgatgacctcctgcgatctcagcgaccagactaaaggatggaagaccaccagaaaaatcgctgagctaatctataaagaattcttctctcagggcgaccttgagaaggcaatgggcaatagacctatggagatgatggaccgggagaaagcctatattcctgagctgcaaatatccttcatggagcatatagccatgcctatatacaagctccttcaggacctgttcccaaaggcatag

SEQ ID NO: 52807 - DNA, 2799 bp, Artificial Sequence
  Description of Artificial Sequence: Synthetic coding sequence
atgaagaaacaaaggatccaggaaggaaagtctctggctcatcgaagaggtcagcaggtgttcttgaagcctgacgaacctccacctccgccacagccctgcgccgacagcctgcaggacgctctgttgtccttaggatccgtaatcgacatcagcggactgcaaagagccgtaaaagaagcattaagtgccgtgctgccacgcgtagagaccgtctacacatatttactggatggcgagagccagctcgtgtgcgaagacccaccccatgagctgccccaggaaggcaaggtccgtgaagctatcatttcccagaagagactaggatgtaacggactgggcttttccgatctgccgggtaaacccctagcccgattggttgccccactcgcccctgatacccaagtgttggtgatgcccttggccgataaggaggctggcgctgtagctgctgtgattctggtgcactgcggacagctgtctgataatgaagagtggtcactgcaggccgttgagaaacacacactcgtggccttacgcagagtgcaggtgctgcagcagcgcggacccagagaggcaccgcgagccgttcagaatcctcccgaggggaccgctgaggatcagaagggaggcgctgcctacacagatagagatcggaaaatcctgcagttatgcggtgagttgtatgatctcgacgccagcagcctccagttaaaggtgctgcagtatttacagcaggaaacacgcgcatctcgctgctgcttactactggtgtccgaagacaacctgcagctgagctgtaaggtgattggggacaaggtgcttggcgaggaagtcagctttccgcttacgggctgcttgggacaagtcgtggaagacaagaagagtatccagttaaaagatctgacaagtgaggatgtgcagcagttacaatcaatgctcggatgcgaactccaagctatgctctgcgtgccagttatcagccgtgccaccgaccaggtggtagccctggcctgcgcattcaacaagctcgagggagatctgtttactgatgaggatgaacatgtcatccagcactgcttccactatacatcaacagtgcttaccagcaccttagcattccagaaggagcagaagctgaaatgtgagtgtcaggctttgcttcaggtagcaaagaatctgttcacgcatttagatgacgtcagcgtgttgctgcaggaaattatcacagaggctagaaatctgagcaatgcggagatatgctcagtgtttcttcttgatcagaatgagctggtagccaaagtgtttgacgggggtgtagtggacgacgaaagctacgagatcagaatcccggcagatcagggcattgccggacatgtagccacaaccggacagatcctcaacatccctgacgcctatgctcatccactgttctataggggtgttgatgattccacgggatttcgaactcgcaacatactgtgtttcccgataaagaacgaaaatcaggaagttattggagttgcagaattggtgaacaaaatcaacggaccctggttctccaagttcgatgaagacctggcaaccgcattcagcatctattgcgggatttccatcgcccacagcttgctgtacaaaaaagtgaatgaggcacagtacagatcacacttggcaaatgagatgatgatgtatcatatgaaggtgtctgatgatgagtatacaaaattacttcacgacggcatccagccagtagctgcaattgactccaactttgcatccttcacatatacacctcgaagtcttcccgaagatgacacgagcatggccatcttatctatgctgcaggacatgaactttatcaacaactacaaaatagattgtcctacactggcccgtttttgcttaatggtgaagaaaggatatcgggacccgccttaccacaactggatgcatgcattcagcgtgtcacatttctgctatctgctgtataagaatctggagctcaccaattatttggaagatattgaaatctttgccctgttcatttcttgtatgtgtcatgatttggaccatcgcggtaccaacaatagctttcaggtagcaagcaagtctgttctggccgctctgtacagctctgagggatctgtgatggaacgccatcacttcgctcaagcgattgcgattctcaatacacatggttgtaatatattcgaccatttttctcgcaaggactaccagagaatgcttgacttgatgcgggatattatattggcaactgatttggcacatcacttacggatctttaaggacttacagaagatggcggaggtgggctacgatcgtaacaataagcagcaccatcgcctcctcctttgtctacttatgaccagctgcgacctgtcagatcaaacaaaagggtggaaaacaacccgaaaaatcgccgagttgatctacaaggagttcttctcgcagggggacttagaaaaggccatggggaatcgacccatggaaatgatggatagggagaaagcttatatccccgagctccagatcagctttatggaacacatcgccatgcctatctacaaactattgcaggacttgttcccaaaagccgctgaactgtacgagagggtggccagcaaccgggaacattggaccaaagttagtcacaagttcaccatacgcggactacccagcaataatagcctggatttcttggacgaagagtacgaggttcccgatttagatggcactcgggctcccataaatggatgctgctctcttgacgccgagtag

SEQ ID NO: 52808 - DNA, 2805 bp, Artificial Sequence
  Description of Artificial Sequence: Synthetic coding sequence
atggtcctggtactgcaccatatccttatcgctgtagtgcagttcctgcggagaggccagcaggtgtttctgaaaccggacgagccccctccacccccacagccgtgcgctgactcactgcaggacgccctcctgtcactgggaagcgtgattgatatctccggccttcagagagctgtgaaggaggcacttagtgctgtactacccagagtggagacagtgtacacttacttactagacggtgagagtcagctcgtgtgcgaggatccccctcatgaactgccacaagaagggaaagttcgagaagctattatctctcagaagcgacttggctgcaacggattgggcttttcagacctccccggaaaacctctggcacgcctggtcgcacctctggctcccgacactcaggtgctggttatgccgttagccgacaaagaggcaggtgctgttgccgctgttatcctagtccattgtggtcagctgagcgacaacgaggagtggtcacttcaagctgtcgagaagcatacattggtggccctgcggagggtgcaggtgctgcagcagcggggacccagggaggcaccacgcgctgttcagaaccctccagagggaactgccgaggatcagaagggcggagctgcctataccgatcgcgacaggaaaatcctccagctgtgtggagagctgtacgatttggacgctagcagcttacagctgaaggtactccagtacttacagcaggagactcgcgcttcacgctgttgtttgctattggtatccgaggacaatcttcagctgtcctgtaaagtgatcggcgataaggtgttaggtgaggaggtgagcttcccattaacaggttgcttggggcaagtggtggaagataagaagtccatccagctcaaggacctcacttccgaagacgtgcagcagctccaaagtatgctcggatgcgagctgcaggcaatgctttgcgtgcctgtgatctcgagggccaccgatcaagtggtcgccttggcctgcgccttcaacaaactcgagggcgacctgtttacagatgaagacgagcacgttatccagcactgttttcattatacatctacagtgcttacaagtacccttgccttccagaaggagcagaagcttaaatgcgaatgtcaggcactgctgcaggttgctaagaatctgtttactcacctcgatgatgtgtccgttctccttcaggaaataattactgaagccagaaatttgagcaacgcagagatatgctctgtatttctgttagaccaaaatgagcttgtcgcaaaggtttttgatggaggtgtggtggatgatgaaagctacgagattagaatacccgctgaccagggaattgcagggcatgtagccacaaccgggcagattctgaatattcccgacgcatatgcccacccattgttctaccgtggagttgacgattcgactggtttcaggacccggaacattctttgctttccgatcaagaacgagaatcaggaggtcattggagtggccgagctggtgaacaaaattaacggaccatggttttctaagttcgacgaggatctcgcaaccgctttctccatatattgcgggattagcatcgcacacagcctcttgtacaagaaagttaacgaggcacagtaccgctctcacctggcaaacgaaatgatgatgtaccacatgaaggtatcggatgacgagtacaccaagctgctgcacgatggaatacagccagttgcagccatcgacagcaattttgctagcttcacatataccccgagatcactgccagaggatgatacctccatggccatattatcaatgcttcaggatatgaattttatcaataactataagatagactgtccaaccctcgctcggttttgccttatggtaaaaaagggctatagagatccgccataccacaattggatgcacgccttttccgtttcccacttctgctaccttctgtataagaaccttgagctcacaaattacctggaagacatagaaatatttgccttgttcatcagctgcatgtgccacgaccttgaccatcgaggcacaaacaactccttccaggtggcctcaaaaagcgttctggctgcactctactcatcggaaggctctgtgatggaacgccatcacttcgcccaggcaatcgccattcttaacacacatgggtgcaacatcttcgaccatttctcccggaaagactaccagaggatgctggatcttatgagagacatcattctggccaccgatctggcacaccacctgagaattttcaaagacctgcagaaaatggcagaggtaggatacgaccgtaataataagcagcatcaccgattgctgctatgtctcctgatgacttcctgtgacctgagtgatcagactaaaggatggaagacaacacgcaaaatcgccgagctgatctataaagaattctttagccaaggtgacttagagaaagctatgggcaacagaccaatggaaatgatggatcgagagaaagcctacatcccagagttgcagattagttttatggaacacattgcgatgcccatctacaaattgttgcaggacctgtttcctaaggccgcagagctttatgagcgagttgcgtctaatagggagcactggaccaaggtctcccataagttcactattcggggtcttccctctaacaactccttagatttcctggatgaggagtacgaggtgcctgatctcgacggtactcgggcaccaatcaatggctgctgctctttagacgctgagtag

SEQ ID NO: 52809 - DNA, 3426 bp, Artificial Sequence
  Description of Artificial Sequence: Synthetic coding sequence
atggcagtaccgggagatgcagctcgggttagagacaaacccgtccattctggagtatctcaggcccctaccgctgggagggactgccaccatagagcagaccccgctagccctagagatagcggttgtaggggctgttggggggaccttgtgcttcagcccctacggtcttcccggaagctgagttcagcattatgcgccggatcgctgtcattcttgctggcactgctagttaggcttgtcaggggggaagtgggatgtgacctggagcagtgcaaagaggctgccgcagccgaagaggaagaagccgcacctggagccgagggtggtgtgttccctgggcctcggggaggggctccagggggaggcgcaagactaagcccatggctgcagcccagcgcgctgcttttttccctcctctgcgcttttttctggatgggattgtatttactgcgtgctggagtgagattgcccttagctgttgccctgctcgcagcctgctgcggcggagaggcactagtacagataggcttgggtgtgggggaggaccacctgcttagcctgcccgcagccggagtcgtgctttcttgcctggccgcagcaacttggctagtacttaggctacgtcttggggtgctgatgattgccctcacgagcgccgtgaggaccgtgtccctcatctctttggaacggttcaaggtcgcttggcgaccctatctggcgtatctagctggtgtgcttggaattctgcttgcccgttatgtggaacagatactcccccagtcagcggaggccgctccaagagaacatctgggctcccagctgattgccggaaccaaagaggatatccccgttttcaagcggagaaggagatcaagcagtgtcgtaagcgccgagatgagcggttgttcctcaaaatcccacaggcgcacatctctcccttgcatcccacgcgagcaacttatgggccactctgagtgggaccacaaaagggggcctcgcggaagccaatcctctggaacgtcaatcacagtggacatcgcagtgatgggtgaggctcacggcctcatcaccgacctcctcgctgacccttctctcccgcctaacgtttgcaccagtctgcgcgctgttagcaacctgctgtccacccaactgacattccaggcaatacacaaacctcgtgtgaatccagtcaccagtctatcagaaaattatacgtgcagtgactctgaagagagttccgaaaaagacaagttggctatcccaaagcggttaaggcgatctctacctcccggtctgctgaggcgagtgtcctctacctggacaacaaccacttccgcgaccggtctacctacattagagccagcacctgtacggagggaccgatccacaagcatcaaattgcaggaggctccatcctccagtccggattcctggaacaatcctgtgatgatgacactgactaaatcccgctcgtttacctcttcatacgccatctccgcagcgaaccatgtgaaagctaagaagcagtcaagaccaggagccctggcaaagatcagtccattgtcctctccttgctcatccccactgcaggggactcccgcttcctccctcgtgtctaaaatttcagcggtgcagttcccggaatcagccgacactactgcgaagcagagcctagggagtcatcgagccctaacctatacccagtctgcccctgatctttccccccagatcttgacacctcccgtcatctgttcttcctgtggccgtccctacagtcaaggaaaccccgctgacgaaccattggaacgcagcggcgtggcaacgaggacgccttcccggaccgacgatacggcgcaggtcaccagcgactacgaaaccaataataactccgatagttcagacatcgtgcagaacgaagacgagacggagtgcctgcgtgagccactgcgaaaggctagcgcctgcagtacatatgccccagagacaatgatgtttctggacaaacccatcctggcaccagagcccttagtgatggacaatctggactcaattatggaacagctgaatacatggaatttcccaatttttgacctggttgagaacattggcagaaagtgtggcaggatcttaagccaagtctcttacaggctgtttgaggatatggggctgtttgaagccttcaaaatccccatacgcgagtttatgaactatttccatgcgttggagattggctaccgtgatattccttatcacaaccgaattcacgccacggacgttctacacgccgtatggtatctgacgactcagcccatcccaggcctttccaccgtgattaacgatcatggatctacgtcggattccgatagcgattccggtttcacacacggccacatggggtacgtgttttccaagacatacaacgtaactgacgataagtacgggtgcctcagtggaaacatcccagccctcgagctgatggcactgtatgtggccgcagcaatgcacgattatgatcatcccggtcgcaccaatgccttcttagtggccaccagtgccccacaggcggtactctacaacgatcggtctgtcttagagaatcaccatgctgccgctgcttggaacttatttatgtcccggccagagtacaattttctgataaacctcgatcacgtcgaattcaagcattttcgctttctcgtgattgaggccatcctggccaccgatctaaagaaacatttcgactttgtagctaagttcaatggcaaggtcaatgacgatgtgggcatcgactggactaacgagaatgatcgactgctggtttgccagatgtgcatcaaactggcagatattaatggacccgctaaatgcaaggagctgcacttacagtggaccgacggcattgtaaacgaattttacgagcagggcgatgaagaggcaagccttggcttacctataagcccatttatggaccgctcggctccgcagcttgcgaacctgcaagagtcattcattagccacatcgtgggccctctgtgtaactcttacgactccgcaggactcatgccaggcaagtgggtggaggactcagatgaatccggggacactgacgaccccgaagaggaggaagaggaggcccctgctcctaacgaagaagagacctgcgaaaataatgaatcgcctaagaagaagacctttaaacgccgaaaaatctactgtcagattacacagcacctgttgcagaaccacaagatgtggaagaaggtgatcgaggaggagcagagacttgccggaattgagaatcagagtttggaccagaccccacagagtcacagctcagaacagattcaggccataaaggaggaggaagaggaaaagggtaagcccagaggcgaagagatcccaactcagaagcctgatcaatag

SEQ ID NO: 52810 - DNA, 2670 bp, Artificial Sequence
  Description of Artificial Sequence: Synthetic coding sequence
atggccgaaaggggtagattaggactccctggagcacccggagcccttaatacaccagtgcccatgaatctgttcgcaacctgggaagtggatggatcatcaccgagctgtgtgcccaggctttgcagccttaccctgaaaaaattggtcgtgtttaaggagctcgagaaagagctgattagcgtcgttatcgcagtcaagatgcagggttcaaaaagaatcctgaggtctcatgagatcgtcctgcctccaagtggccaggtagagactgatttggcgttaacatttagtctacaatatccgcactttctgaaacgcgaggggaataaactgcagatcatgctccagcgcagaaaaagatacaaaaaccggacaattctgggctacaagactctggctgccggaagcattagtatggccgaagtaatgcagcacccgagcgaggggggacaggtgctatccctgtgttcatctataaaggaagcccctgttaaggcagctgagatttggattgcgagcctttcatctcagcccattgatcacgaggatagcaccatgcaggcgggaccaaaagccaagagtacagacaactacagtgaagaggaatacgaaagcttcagtagcgagcaggaggcctcagacgatgctgtacagggtcaagatctcgatgaggacgatttcgatgttggtaagccaaagaaacaacgcaggtctatagttagaaccacgtccatgaccaggcaacaaaacttcaagcagaaggtagtggccctcctgagaagatttaaggtgtcagatgaggtcttggactcagaacaagacccagccgagcatattccagaagccgaggaggatttagatctgctctatgacacacttgatatggaacatccttccgatagcggccctgacatggaggatgacgattcggtgctctccacaccgaaaccgaagcttcgcccttatttcgaggggctgtcccactcttcctctcagaccgagatcggctccatccattcggcgaggagccataaagagccacctagccccgctgacgtgcctgaaaagactcggtcactgggcggacggcagcctagcgattctgtttctgatacagtggcattaggagttcctggtcccagggagcaccctgggcaaccagaagatagccccgaagcagaagcctctaccttagacgtgtttactgagcgccttcctccaagcggtcggataacgaagactgagagcttggtgatcccaagtacaaggtctgaaggaaagcaagccggaaggcgcggtcgttcgaccagcttaaaggagcggcaggctgccagaccgcagaatgaaagagccaattccctcgataacgagcgctgtcccgacgccaggtctcagctgcagattccccgtaaaacagtatatgaccagcttaaccatatcctgatcagtgatgatcagctgcccgaaaacatcatcctggtgaacaccagcgattggcagggccaattcctctctgatgttttgcaacggcataccctgccggtcgtgtgcacatgctcaccagccgacgtgcaggcagccttttcgacaatagtgtcccggatccagagatactgcaattgtaacagccagccgcctaccccagtcaagatagcggtcgccggtgcacagcactacctgagcgctatactgcgtctgttcgtggagcaactgtctcataaaactccggattggctggggtacatgcggttcctcgtcatcccactcgggagtcatcccgttgctagatacctcggcagcgtagactaccggtacaacaacttcttccaggatttagcgtggcgggacctgttcaacaagctggaagcccagagtgcggtgcaggataccccagacatcgtctcgcgaattacccagtatatcgccggagctaactgtgcccaccagcttccaattgcggaagccatgctaacgtataagcagaagtcaccagatgaggagtcttctcaaaagtttataccatttgttggggtcgtgaaagttggtatcgtggagccctcaagtgctacttccggggactctgacgatgccgcaccatctgggagcgggacgctctccagcactccccctagcgcctctccagctgctaaagaagcttccccgacaccgccaagtagtccttctgtaagtggaggcctttcttcgccatcccaaggtgttggagcggaactcatgggtctacaggtagattattggaccgccgctcagcctgccgatcggaagcgggacgccgaaaaaaaggatctgcctgtcactaagaatactctcaagtgcacattccgctcactgcaagtgtctcgcttaccatcatcgggggaagccgcagccacacccaccatgtccatgacagtggtcacaaaggagaagaataagaaggtaatgttcctcccaaagaaggccaaggacaaggatgtggagtcgaagtcccagtgtattgagggaattagtaggctcatttgcactgctagacagcaacaaaatatgctaagggtcctgattgatggtgtggagtgctcagatgtgaagttttttcagctagcggcacagtggagttcgcacgttaaacacttccctatttgtatctttgggcactccaaagccactttttag

SEQ ID NO: 52811 - DNA, 2682 bp, Artificial Sequence
  Description of Artificial Sequence: Synthetic coding sequence
atggccgaacggggaagactcggcctcccaggcgcacctggcgctctaaacacccctgttccaatgaacttattcgccacatgggaggtggacggttcatcaccatcctgtgttccccgtctgtgttccctgacattaaaaaagctagtcgtgtttaaagaactagaaaaggagttgatctcagtcgtaatcgcagtcaagatgcaggggagcaaacggattctgcgctctcacgagatcgttctgccaccttcagggcaggtggaaacagacttggcactgactttttccctgcagtacccacacttcctgaagcgggaggggaacaagctccagatcatgcttcagcgcagaaaacgctacaaaaatcggaccatcttgggctacaagaccctggcagccggatccatatccatggcagaggtgatgcagcatccttcggaaggtggccaggtcttatcactgtgttcatctattaaggaggcccctgtgaaggcagcggaaatttggattgcaagcctgagctcacagccaatcgaccacgaggactcaactatgcaggcaggcccaaaggctaagagcactgataattacagcgaggaggagtatgagagcttttctagtgagcaggaggcttctgacgacgccgtgcaaggccaggacctcgatgaagacgatttcgacgtggggaagcctaagaaacagcgcaggtcaattgttaggaccacgtccatgacaaggcaacagaacttcaaacagaaggtagtagcgctcctgcgtagatttaaagtcagtgatgaagtgctggatagtgagcaagacccagccgaacacattccggaagcagaagaggatctcgatctcttatacgacaccctggacatggaacatccctccgattcaggccctgacatggaagacgatgacagtgtcctgtccactccaaaacctaaactgagaccatacttcgaagggcttagtcactcttcgagccagaccgagatcggcagcatacacagtgccaggagtcacaaagagcccccatcccctgccgatgtcccagagaaaactcgatcacttgggggacgacaaccatccgacagtgtgtccgataccgtggccctgggagtgcctggccctcgagagcatcctggccagcctgaggactctccagaggccgaggcatcgacgttggacgtctttaccgaacggcttccgccatctggcaggattaccaagaccgaatcacttgtcatacccagcaccagatcggagggcaagcaagccggaaggagaggaagatctaccagcctgaaggaacgtcaagccgcaaggcctcagaacgaaagggccaattcactcgacaacgagcgctgtccagacgcgagatcccagttacaggtgcagcttcagattccgaggaaaaccgtgtacgaccaactgaaccatattttgattagcgacgatcagctgcccgagaatattattcttgtcaacacgagcgactggcagggtcagtttttgtcagacgtgctgcagcgacacaccctgcccgtggtgtgcacttgtagtcccgcagatgtgcaggccgcattctctactattgtgagcagaattcaaagatactgtaattgtaacagtcagccccctacgcccgttaaaattgctgtggcaggagcccagcattacctgagcgccattttacgcctatttgtggagcagctgagccataagacccctgattggctaggttatatgcgcttcctggtcattccactgggcagtcacccagtggccaggtatcttgggtcagtggactatagatacaacaatttctttcaggaccttgcttggcgggatctgtttaacaaactggaagctcagtcagccgtgcaggacactcctgatattgtgtctcgtatcacacagtatattgcaggtgctaattgtgctcaccagttacctatcgctgaagcaatgcttacatataagcaaaagtctccagacgaggagagttcccagaagttcataccattcgtgggcgttgtgaaagtcgggattgtggagcccagcagtgctacctccggtgattctgatgatgccgctccatcaggtagcggcacactgtcatcaacccctccgtccgcaagccctgctgctaaagaggcgagccctactccccctagctcaccaagcgttagtggtggcctctcatcgccaagccagggcgtaggtgctgagctgatggggctgcaagtggactactggactgctgctcagcctgcagatcggaagcgagacgcggaaaaaaaagacctccctgttaccaaaaacaccctcaaatgtacctttaggtccttgcaagtcagccgactgcctagtagtggggaagcagctgcaacccccaccatgagcatgacagttgtgaccaaggagaagaataagaaagtcatgttccttcccaagaaggctaaggataaagatgtggaatctaagtctcagtgtatcgaaggaatctctaggctcatctgcacagctcgtcagcagcagaatatgctgcgggtgctgattgacggcgtggagtgttcggacgttaagttttttcagctcgctgcacagtggtcctcacacgtgaaacactttccaatctgcatcttcggacactctaaggctactttttag

SEQ ID NO: 52812 - DNA, 2715 bp, Artificial Sequence
  Description of Artificial Sequence: Synthetic coding sequence
atggccgagcgcggtcggctgggactccccggagccccaggggcactgaacaccccagttcctatgaatcttttcgccacttgggaagtcgacggaagttccccgtcgtgcgtcccacgactatgtagtctcaccctgaaaaagctcgtcgtcttcaaggagttggaaaaagagcttatctccgttgttatcgcagtgaaaatgcagggctcaaagcggatcctgcggtctcacgagatcgtgctgcctccgagcggccaggtggagacagatctcgccctcacattctcactgcagtatccccactttcttaagcgtgaggggaacaaactccagataatgcttcaacggaggaaacgctacaagaatcgcactattttaggctacaagaccctagcagcaggatctatctctatggcagaggtaatgcaacacccatctgaagggggtcaggtcctttccctttgctctagcataaaagaggccccagtcaaagccgcagagatttggatcgcctccctctccagtcagcctatagatcacgaggactccactatgcaggccggacctaaagcaaagtccaccgacaattactctgaggaagaatatgagagcttttcctcagagcaggaggccagtgatgacgccgtgcaaggacaggatttggacgaagatgatttcgacgtgggcaagcccaagaagcagcgcaggtccatagtccgaaccacctcaatgaccaggcagcaaaacttcaaacagaaagtggtagctttgctgaggagattcaaggtttcagatgaggtcttggatagtgaacaggacccagctgagcatattccggaagccgaggaggacctagatctgctgtacgacactctagatatggaacatccatccgatagcgggccagacatggaggatgatgattccgtgctcagcactcccaaacctaagctgagaccttacttcgagggattatcccactctagttcccagactgaaatcggttccatccactccgcacggtcacataaagaacccccatctccagcagatgtgccagaaaagaccaggagcctaggcggtcgccagcccagtgactcagtcagcgataccgtcgccttaggcgtgccaggacctcgcgaacacccaggccaacccgaggattcacctgaagccgaggcttcaactctggatgtcttcacggagagactccccccttcaggcaggatcactaagacggagagtctggtgattccctctacacgctctgaaggcaagcaggctggtcggcgtggccgatctaccagtttgaaagagcgacaggcggctcggcctcagaatgagagggctaatagcctggacaacgaaagatgtcctgatgcgagatcccaactccaggtccagctgcagataccacgcaagaccgtgtacgaccaactgaatcacattctgatctccgacgatcaactgcctgaaaacataattctcgtgaatacctcagattggcagggacagttcctctcggacgtgctgcagcgacataccctgccggtggtctgcacttgctcccctgccgatgtccaggcggcattcagcacgatagtgtccagaattcagagatactgtaactgcaactcccagcctccgacccccgtgaaaatagctgtggccggagcccaacattaccttagcgcgatactccgactctttgtggagcagctgtcgcacaaaactccagactggctcggatatatgaggtttctcgttattcccctgggctcccaccctgtagccaggtatcttggtagcgttgactacagatataacaacttcttccaggatttggcttggagagatcttttcaacaagttagaagcccagagcgcagtgcaagatacacccgacattgtcagtagaattacacagtacatcgcaggcgctaattgcgctcaccaattgcccatcgccgaggccatgctgacctacaaacagaaaagaaaaaagcacttccactttgacttcaccctgtcacccgacgaggagtcaagccagaaattcataccgtttgttggggtggttaaggtgggtatagtggagccctccagcgccacgagcggagattctgacgatgcggcaccttctggctcgggcactctgtccagcacccccccttccgcatctccggctgcaaaagaagctagtccaacccccccaagctccccaagcgtaagtggcggactctccagccctagccagggggtgggagctgagttgatggggctccaagtcgattattggacagccgctcagcccgctgaccggaagagagacgccgagaagaaggacctccccgtgaccaaaaatacgctcaaatgtacattcaggtcattgcaggtgagcaggctaccctccagtggggaagcggctgcaactcccactatgagtatgaccgtagtgaccaaggagaagaacaaaaaggttatgttcctcccgaaaaaggcgaaggacaaggacgtggaatctaaaagtcagtgtatagagggaatatcccgcctaatctgcaccgcacgccagcagcagaatatgctgcgagtcctgatcgatggcgtagagtgttctgacgtgaaattttttcagttggctgctcagtggtcctcacacgtgaaacattttcccatatgcattttcggccactcaaaggcgaccttctag

SEQ ID NO: 52813 - DNA, 768 bp, Artificial Sequence
  Description of Artificial Sequence: Synthetic coding sequence
atggcgtttagacaggctttgcagctggctgcctgtggcctggccggaggctcagccgcagtgctttttagcgcagtggccgtggggaaacccagagccggtggcgacgctgagcccagacccgctgagccaccggcatgggcagggggagccagacctggcccaggggtctgggaccccaactgggacaggagagagccactctccctgatcaatgtcagaaaaaggaatgtcgagtctggagaagaggagttagcctctaaactcgaccattataaggcaaaggccacgagacatatctttctcattcggcattcccaatatcacgtggatggatcactggagaaggatagaacactaacacctctcgggagggagcaggccgagttaacgggcctcaggcttgcatcgcttggcctaaaatttaacaagattgtgcattcatctatgactcgggctattgagaccaccgatattataagccgtcatctgcctggagtttgtaaggtgagcacagaccttctgagagaaggggctcctattgagccagacccccctgttagccactggaaaccagaggcggtccagtattacgaggatggggcacggattgaagccgctttccggaactatatccaccgggctgatgccaggcaggaggaggactcgtatgaaatcttcatttgtcacgctaacgtgatccggtatatcgtctgtagcatcccacccctgctctccgcaggagactttgtgttgctgggcagctag

SEQ ID NO: 52814 - DNA, 870 bp, Artificial Sequence
  Description of Artificial Sequence: Synthetic coding sequence
atggccttccgtcaagcactgcagctggccgcatgtggtcttgcgggtggcagcgctgccgtactcttctcggccgtggccgttggcaaaccacgagcagggggtgacgccgagcccagacccgctgagcccccagcttgggctgggggtgctagacctggtccaggggtgtgggacccgaactgggacaggcgtgagcctctgagcctgatcaacgtcagaaagagaaacgtcgaaagcggggaggaggagctcgctagcaaactcgatcactataaggcaaaggccactcgccacatctttttgattagacactctcagtaccatgtggatggatcactggagaaagacaggaccctcacgcccctgggaagagaacaggctgaactaacaggcctccgtttggcgtcactcggactcaagtttaacaagatcgttcatagctccatgacacgggctatcgaaacaactgacataattagcagacacttgccgggagtttgtaaggtgagcacggatctgcttcgcgaaggtgctcctattgagcctgatcccccagtgagccattggaagccggaagccgtgcagtactatgaggatggtgctcgtattgaagcggctttcaggaactacatccacagagcagacgcccgacaggaagaagacagctacgaaattttcatttgccacgctaatgtcatcagatatatagtgtgtcgcgctctccagttccctccggaagggtggctcagattgtcgctgaacaatggaagcataacacatcttgtcatcagaccaaatgggagagtcgccctgagaactctaggtgataccggcttcatgcctccagacaaaattacccgatcctag

SEQ ID NO: 52815 - DNA, 2418 bp, Artificial Sequence
  Description of Artificial Sequence: Synthetic coding sequence
atggccgctagcggggtcccacggggttgtgacattctaattgtgtattcaccagatgctgaggaatggtgccagtatctgcagactctcttcctgtcttctcgccaggtccggtctcagaagattttgactcataggctggggcctgaagcctccttttcagccgaagatctgtcactgttcctgagcacacgatgcgtggtggtgctgctgtccgccgagcttgtacagcattttcacaaaccagcattactgcctctgctccagcgggcttttcatccaccccacagggttgtcaggctgctgtgtggagtcagagactcggaagaatttctggacttcttccccgactgggcccattggcaggagctcacttgtgacgatgaaccggagacctatgtggccgctgtgaaaaaggccatctctgaggacagtgggtgcgattctgttacggacacagagccggaagatgaaaaggttgtaagttacagtaaacagcaaaacctgccaacagtgacctcacccggtaacctgatggtagtgcagcctgaccgcatcaggtgcggcgcagagactactgtctacgtgattgtaagatgtaagctggatgaccgagtggccaccgaagccgaatttagcccggaggattcccctagcgttcggatggaagcaaaggtggaaaatgaatataccatctccgtgaaagccccaaatctaagcagtggcaatgtgagtctcaaaatctatagtggagatctcgtggtttgcgagacggtgatctcttattacacagacatggaggagataggcaatttactctcgaatgctgctaaccctgtcgaatttatgtgtcaggctttcaagattgtcccatataacacagaaacgctcgacaagttgctgaccgagagcctcaagaataacatacccgcttcagggctgcacctctttgggattaaccaactggaagaggaagacatgatgaccaatcaacgtgatgaagagctacctaccctgctgcattttgcagcgaagtatggactcaagaacctgaccgcactgttgctgacttgcccaggagcactgcaggcctattctgtcgctaacaagcacggccactaccccaataccattgctgagaagcacggattccgggacctgaggcagtttatagatgagtacgtggaaaccgtggatatgctgaagtcgcacatcaaggaagagctgatgcacggggaagaggctgatgctgtctacgagagcatggcgcacctcagtacggacttgttgatgaaatgcagtctgaaccccggttgcgacgaggacctgtacgaaagcatggccgcattcgtacccgctgcaacagaggacctttacgtggaaatgctgcaagcttccacctccaaccccattcccggagacgggttctccagggctacgaaagatagcatgattagaaagttcctcgagggcaacagcatgggcatgactaacctagagcgcgaccagtgtcatttgggacaagaagaggatgtttaccatactgtggacgacgatgaagcgttttctgttgatcttgcgagccgacctccagtacctgtgcccaggccagagacgaccgcccctggcgctcaccagctccccgataatgagccatacatttttaaagtgtttgccgaaaagtcccaggagcggccaggaaacttttatgtgtcatctgagtctatccgaaagggacccccagtgcgcccatggcgggataggccgcagagctcaatctacgacccatttgctggtatgaagaccccaggtcagcggcaattgatcacactccaggaacaggtgaaacttggcattgtcaacgtggacgaagctgtgctgcacttcaaagaatggcagctgaatcagaagaagaggagcgaatctttccggtttcaacaagagaatctgaagcggctgagagactccatcactcgccgacagagggagaagcaaaaaagcggaaaacaaacggatctagagatcaccgtacctattagacattcacagcatctgcctgcgaaagtagagttcggcgtctatgagtccggaccccgaaagtctgtcatccccccaagaacagaactaaggcgtggtgactggaagactgatagtaccagctccactgcctccagcacgtccaatcgctcttcgactcggtcgttactgtccgttagctctggcatggaaggagacaacgaggataacgaggtacccgaggtgactagatctagatcgcccggacccccacaagtcgacggaacacccactatgtccctggagcggcctccaagagtaccacctcgggcagcttcccaacggcctcctacgcgggagacctttcacccacccccaccagtgccccctagagggaggtag

SEQ ID NO: 52816 - DNA, 1215 bp, Artificial Sequence
  Description of Artificial Sequence: Synthetic coding sequence
atgcggttcttcacatcagtggcctgttatggtagctgtctatttgcatccgagttactgatacgatgtaaagactggcttaaaggaagaccagctctctttactgccctgctggcatgcgtcttgtacctgtgcgaatggactggggcaaagcacgtgccaggctcttcctacgtagagatgttgcaggccagcacaagtaacccaataccaggtgatggattttcccgtgcgaccaaggattctatgatccggaagttcctcgaagggaattcaatgggcatgacaaacttggaacgggaccagtgtcatcttggtcaagaagaagatgtgtaccataccgtcgacgacgatgaagcattttcggtggacttagcgtctcgaccccctgtgcctgtgcccagacccgagacaacggcacccggtgcgcaccagctgcccgacaacgaaccttatatctttaaggtgttcgccgagaaatcacaggagcggcctgggaacttttatgtgtcctccgagtctatccggaaaggaccaccagtgaggccctggcgcgacaggccgcaatcttcaatttacgacccatttgccggaatgaagacacccggacagcggcagctgattacactgcaggagcaagtgaaacttggcattgtaaatgtcgacgaggcagttctccatttcaaagagtggcaactaaatcagaagaagagaagcgagagtttcaggtttcagcaagagaatttaaagcgactgagagatagtataacgcggaggcagcgagagaaacagaaaagcggaaagcaaactgacctcgaaattacagtccctattagacattctcagcacctcccggcaaaggtcgaattcggtgtatacgaatctggaccccgtaagagtgttattccgccaaggaccgaactccggagaggtgattggaagaccgattccacatcatctacggcctccagcacttctaacaggagcagcacccgaagcttgttatccgtgtctagcggcatggagggtgataatgaggataatgaagttccggaagtcacccgatctcgctcgcccggtccccctcaggtggatggtacgccaaccatgagtctcgaacggccacccagggtgcccccacgggctgccagccaacgccctcctaccagggagactttccatccaccaccacccgttccacctagaggcaggtag

SEQ ID NO: 52817 - DNA, 1884 bp, Artificial Sequence
  Description of Artificial Sequence: Synthetic coding sequence
atggtagtccaaccagaccgaatccgatgcggagcagagactacagtgtacgtgattgttcgctgtaaacttgatgatcgggtcgctacagaagccgagttcagcccggaagatagcccctcagtccgtatggaggccaaggtggaaaacgaatacactatctctgttaaggcgcctaacctgtcttcaggcaatgtctccctaaaaatctatagcggcgatcttgtggtttgtgaaacagttattagctactacaccgacatggaggaaattgggaatctgctttccaacgctgctaaccctgtggagttcatgtgtcaggcttttaagattgtgccgtacaatactgaaaccctggacaaactcctcaccgaaagcctgaaaaacaatatcccggcaagcggactccacctgttcggaatcaaccaattggaggaggaggacatgatgacaaatcagagggacgaagagctgcctacactgctgcacttcgccgctaaatacggcctcaagaaccttaccgcgctgctgctgacatgccccggagcgctacaagcttactcggtcgccaacaaacatggtcactacccaaacacaatcgcagagaaacacggtttcagagacctgcggcagtttatagacgaatatgtggaaactgtggacatgttaaaaagccatatcaaagaggagctgatgcatggcgaggaggctgacgctgtatatgaaagcatggcccatctgagcaccgatcttttaatgaagtgttctcttaatcctggatgcgacgaagacttatacgagtcgatggcggcttttgtgcccgcagccacggaggacctctacgtggaaatgctgcaagcttccactagtaaccctatccctggagatggattctctagggccactaaagacagcatgattcgaaagttcctcgaaggtaacagtatgggcatgaccaacctggagcgcgaccagtgtcacttgggacaggaggaagatgtttaccacacagtggatgatgacgaggcctttagtgttgatctggcgtctaggcctcccgttcctgtgccacgccctgaaaccacagctcctggcgctcatcagcttccggataatgaaccctatattttcaaggtgtttgctgaaaaatcgcaggagcggccaggcaacttttacgtgagctcagagtctatccggaaggggcctcccgtacgcccttggagagacagacctcagagctccatttacgatcccttcgccggaatgaaaacgccagggcagcgccagctgattactctccaagaacaggtgaagctggggattgtcaacgtagatgaagccgtcctccactttaaggaatggcagttgaaccagaaaaagcgatcagaatcatttagattccaacaggagaacttaaagcggctccgcgattccataacacggaggcagcgggaaaaacaaaagagcgggaaacaaacagacctggagatcacagtccccatcagacacagccagcacttgcccgctaaagtggaattcggagtgtatgagtctggtcctcggaaatctgtgattccccctcggacagagcttcgacgtggtgactggaagaccgacagtacctcctccacagcctcctctacgagcaaccgttcatcgactcgcagccttctttccgtgagttccggaatggagggtgataatgaggacaatgaggtccctgaggtcacccgaagtcgcagcccaggacctcctcaggtcgacgggacccctactatgtctctggaacgtcctcccagagtgccgccacgggcagcctcgcagagacctcccacacgagaaactttccatccccctccgcctgttcccccacgcggacgttag

SEQ ID NO: 52818 - DNA, 408 bp, Artificial Sequence
  Description of Artificial Sequence: Synthetic coding sequence
atggcctgcggattagtggccagcaatctaaacctgaaacctggcgagtgcttgcgggtgcgcggagaggtcgcgcctgatgcaaaatcgtttgtactgaatttggggaaggacagcaacaatctgtgcctccactttaaccctcgatttaacgcacacggagatgccaacaccatcgtctgcaatagcaaggacggtggtgcatggggtaccgaacaaagagaagcggtattccccttccagccaggttccgtggctgaggtttgcattacctttgatcaggcaaatctgacagtgaagttgcccgacggatacgaattcaagtttcctaataggctgaacctggaagcaatcaattatatggccgctgatggggacttcaaaatcaagtgtgtggctttcgactag

SEQ ID NO: 52819 - DNA, 705 bp, Artificial Sequence
  Description of Artificial Sequence: Synthetic coding sequence
atgttgctggcttgggtgcaggcatttctggtctctaatatgctcctggcggaagcgtacggcagcggtggttgtttctgggacaatggacatttatacagagaggaccagacttcacccgcacctgggctgaggtgccttaactggttggacgctcagagcggtctagctagtgcaccagtgtccggtgcagggaaccactcttactgtcgtaatccagatgaggatcctcggggaccatggtgctacgtgagcggtgaagccggagtgcccgagaaaaggccctgcgaagatctacggtgtccagagacaaccagccaggcgctccctgctttcactaccgagatccaggaagctagcgagggaccaggcgcagatgaggtacaagtgttcgcacctgccaacgccctgcctgctagaagcgaggcagccgcagtgcaacccgtgattggaatctcccagagagttaggatgaactcaaaagagaaaaaggatctgggcactctcggatacgtgctgggaatcaccatgatggtcataataatcgctatcggcgcaggtatcatcctgggatactcttacaagagatccgttgcatccctgctcgggcctctgcgcagacgaggcggacgatataccaagtccaacttcgttgccttcttacccaagcgcaaacaagatgtcgagaaccagctgaaaatgtag

SEQ ID NO: 52820 - DNA, 726 bp, Artificial Sequence
  Description of Artificial Sequence: Synthetic coding sequence
atgttgttggcttgggttcaggcctttctggtgtccaacatgctgctggcagaggcctatggatccgggggatgtttttgggataatggccatctataccgggaagaccaaactagtcccgctcccggactccgctgtctgaactggcttgacgctcagtccggcctcgcctccgctcctgtatcaggtgctggaaaccactcctactgccgaaacccgggtgaggatctgcggtgccccgaaacaacttcccaggctctgcccgctttcacgaccgagattcaggaggcctccgaaggacctggcgcagacgaggtgcaagtctttgctcccgcaaatgcactgcccgcaaggtcagaggcggcagcagtccagcccgtgataggcatctctcagagagtgcggatgaattcgaaagagaagaaggatctgggcacccttggctatgttctgggtatcacaatgatggttatcatcatagcgatcggagcgggaataattctgggctatagctataagcgaggaaaagacctgaaagagcagcatgatcagaaggtgtgtgaacgggagatgcagcgcatcacccttcccctgagcgccttcaccaatcccacgtgtgaaatcgtggatgaaaagaccgtcgtcgtgcatacatctcagaccccagtggatccccaggagggaactactcccctgatgggtcaggcaggcacgcctggggcatag

SEQ ID NO: 52821 - DNA, 522 bp, Artificial Sequence
  Description of Artificial Sequence: Synthetic coding sequence
atgttacttgcatgggtgcaggcctttctagtgagcaacatgctgctcgcagaagcgtatggttctggagggtgcttctgggataatggtcacctctaccgggaggaccagactagtcccgctcccggactaagatgcttaaactggctggacgcccagtccggcctggcttctgcccctgtcagtggagccggtaaccacagttattgtagaaatcccgatgaggatcctcggggtccctggtgttatgttagtggcgaggcaggggtgccagagaaacgaccctgtgaagatctccgttgccctgaaacgacatcccaggcgctgccagcttttacgactgagatccaggaagcctccgaggggccaggagccgatgaggttcaggtttttgcacccgcaaacgcactgcctgcgagaagcgaagcagcggcagtccagccggtaattggaattagtcagcgtgtgcgcatgaatagtaaagaaaagaaggatctggggacattaggaggccgaatttag

SEQ ID NO: 52822 - DNA, 555 bp, Artificial Sequence
  Description of Artificial Sequence: Synthetic coding sequence
atgcttttggcctgggttcaggccttcctcgtgagcaacatgctgctcgccgaggcatacgggtcaggtgaaacaacaagccaggccctccccgcttttactactgagatccaagaggcctcagagggcccaggagcagacgaggttcaagtttttgcccctgcaaacgccctccccgcacgctctgaggccgcagcagtccagcctgtgatcggtattagtcagagagtgcgcatgaattcaaaggagaagaaagacctgggcaccctggggtacgttctgggcattactatgatggtgatcatcattgccattggggcaggcatcatcctgggatatagctataagcgtggcaaagacctgaaggagcagcacgaccagaaggtttgcgaacgggagatgcaacgcatcaccttgcctctgtccgcattcaccaaccctacctgcgagattgttgatgaaaaaactgtggtagtgcacacaagccagactcccgtggatccacaagaggggaccacccctctgatggggcaagctgggacgcccggtgcatag

SEQ ID NO: 52823 - DNA, 2538 bp, Artificial Sequence
  Description of Artificial Sequence: Synthetic coding sequence
cagttcgtgcagcccgaggaacgcagacaaggatcacttttgggacctggcttgcccagccatgcactcggaacactcgctaaggtggcaggccgacaagatgctgctccccctggcggttccgccgctagcgaggaacgcgaagagggacctagcgttgaggccctcgccgtatccaaggcagactgctacgtgcagctgtggctacccaccgcttctcctagcccagcccagaccaggatcgtcgctaactgctccgatccggagtggaatgagacctttcattaccagatccatggtgccgtcaaaaatgtgctcgagctgaccttgtacgacaaagacatcctcggtagtgatcaactttctttgcttctgtttgatctgcggagcctaaagtgcggacagccccacaagcatacatttcctctcaatcaccaggattctcaggagcttcaggtcgaattcgtgctggagaaatctcaggttccggcatccgaggtgatcaccaacggtgtgctggtcgcacacccttgtcttaggatccaaggcaccctccgcggtgatgggaccgctcccagggaggagtacggttctcgtcaattacagctagcggtccccggagcctatgagaagcctcaactgttgccactgcagccacctactgagcctggactcccgccaacctttacattccacgtgaatcccgtgctgtctagtagactgcatgtagaattgatggagcttctcgccgctgtgcagtctggaccatccgcggagctggaagctcagaccagcaagctcggagaggggggtatactccttagctcactgcctttagggcaggaggagcagtgttcagtcgccttgggggaggggcaggaggtcgccctgtctatgaaggtggaaatgagcagcggggacctcgacctgcgcctcgggttcgacctttctgacggagaacaggaattcctagatcgcagaaagcaggtggtaagcaaagccttgcagcaggtcttgggactttcagaagctctggactcaggccaggtgcccgtcgtagcggtgctgggctccgggggaggcacccgagcaatgtcaagcctctacggttcattagctggcctgcaagagttaggcctgctggataccgtgacatacctctccggggtatccggaagcacttggtgcatctccacattgtaccgagatcctgcatggtcgcaagtggccttacagggccctattgagcgcgctcaggtgcacgtgtgttccagcaagatgggcgcattaagtaccgagagactgcagtattacacacaagagctgggagttcgggagaggtctggccacagcgtttccctgatcgacctgtggggcctgcttgtagaatacctcctctatcaggaagaaaacccggcaaaactgtcagatcagcaagaggctgtgaggcagggacagaacccttatccaatatatacatccgttaatgtaaggactaacttatcaggagaggattttgcagagtggtgcgaattcacaccatacgaggttgggttccctaagtacggggcatacgtccccacagagctgttcggcagcgagctgtttatggggaggttgcttcaacttcaacccgagcctcgtatttgctacttgcagggaatgtggggctcagcttttgcaacctctttggatgagattttcctgaagactgcaggctccggcttgagcttcctggaatggtataggggctcagtcaacatcactgacgactgccagaaaccacagctgcacaatcccagtaggctcagaacgcggctgctgaccccccagggtccgttttcacaagcagtccttgacatatttacctctaggttcacaagcgctcagtcgttcaatttcacacgcggtctctgtcttcataaggattacgtggccggtagggagttcgtcgcatggaaggatacacaccccgatgcattccccaaccagctcacacctatgagagattgcctgtatttagttgatggcggtttcgcaatcaatagtccgttccccctggcccttctccctcagcgtgccgttgacctgatactatcattcgactatagcttggaggccccattcgaagtgttaaagatgaccgagaagtactgccttgatagaggcattcctttcccgtctatcgaggtgggaccagaagatatggaggaagcccgtgaatgctacctgttcgccaaagccgaagacccaagaagccccattgtcctgcattttccgctcgtcaataggactttccgcacacaccttgcccctggagttgaacgtcagacagccgaagagaaggcttttggcgacttcgtgatcaataggcctgacaccccatatggtatgatgaactttacttatgaaccccaggatttctaccggcttgtggcactctctcgttacaatgtcctgaacaatgtggagacactgaaatgcgctctgcagctcgctctcgaccgtcatcaggctagggagcgagccggagcatag

SEQ ID NO: 52824 - DNA, 1365 bp, Artificial Sequence
  Description of Artificial Sequence: Synthetic coding sequence
atgttatgggctctgtggcctagatggcttgccgataagatgcttccccttctcggtgctgttctgcttcaaaaacgcgagaagaggggacccctttggagacactggaggagggagacttacccttactatgatctacaagttaaagtcttgcgggcaacaaacattcgaggaacagacctcttgagtaaagctgactgttatgttcagctgtggctccccacagcctccccctcccctgcccaaacgagaatcgtcgccaactgttctgatccagagtggaatgaaacatttcactaccaaattcacggcgcagttaaaaatgtgctcgagctgacactgtacgacaaagacatactgggcagcgaccaactgtctctgctgttgtttgacctcagatccttaaaatgtggccagccccacaaacacacattcccactgaatcaccaggactctcaagaactgcaggtggagtttgtgctggagaagagccaggttcctgcatctgaagtcatcactaatggtgtactggtcgcccacccttgcctgcggatccagggtactcttcgaggagatggaactgccccacgggaggagtatgggtcgcgacaactccaattggccgttccaggggcatatgagaagcctcagttgctccctctccagcctcccactgagcccggtctgcccccaacatttacttttcatgtgaacccagtgctgtccagtcggctgcacgtagaattgatggagctattggccgcagtccagtctggtcctagcgctgagctagaagcccaaacaagtaagctgggggaaggaggcattctgctcagcagtttgcctcttggccaggaagagcagtgtagcgtagccctcggtgagggtcaagaggtggccctgagcatgaaggtggagatgtctagtggagaccttgaccttaggctgggattcgatcttagcgacggagagcaagaatttctggacagaaggaaacaggtggtgtctaaagctctccagcaagttttaggtctttccgaggctctcgattccggccaggtcccggtggtcgcagtacttggttctggaggcggaactcgcgcaatgagctctctgtacggctcgttggcagggctgcaggaactcggcctcctcgacacagtcacctatctcagcggtgtgtccggctctacttggtgcatttccacattgtatcgtgatccagcctggagtcaggtagccctgcaggggcctatcgagcgggctcaggtgcatgtttgtagtagcaaggtgggagatgtccgcgtgagcccctgccagctaccgcgactgcacagctccaacttggaccattccctctggtag

SEQ ID NO: 52825 - DNA, 2550 bp, Artificial Sequence
  Description of Artificial Sequence: Synthetic coding sequence
atgctgtgggcgctatggccacggtggctggctgataagatgttacccttgctcggcgcagtacttctacagaagagggagaagcggggaccattatggcgccattggcgcagggagacatacccctactacgatctgcaagtgaaggtcctcagggcaacaaatatccggggaactgatctactttccaaagctgattgttacgtgcagctttggctgccaaccgccagtccctccccagcacaaacccggatagtagctaattgttccgaccctgagtggaacgagactttccactaccagattcatggcgctgtcaagaatgtattggaactcactctatatgacaaagacatcctgggatctgaccaactctcccttcttctgtttgacctcaggtcactcaaatgtggacaaccccataagcataccttccctctgaaccaccaggattctcaggaactgcaggtggagtttgtcttggagaagtcacaggtgcctgcctccgaggtcattactaacggcgttctggtcgcacatccatgtctgaggatccaggggacactcagaggagatggcaccgctccacgagaagaatacggatccaggcaactccagctagccgtgcccggagcttacgaaaaaccacaactgctccctctacagcccccaactgagccagggctaccccctactttcacgtttcatgtgaatcctgttctctcttcacgcctccatgtcgaacttatggaacttcttgctgctgttcagtcagggccatcagcggagctcgaggcccagaccagtaagcttggagaggggggaatactcctgtcctcacttcctctgggacaggaagagcaatgtagtgtcgcactgggcgaagggcaggaggtggctttgtctatgaaggtggagatgagtagtggcgacctggatcttcgactgggatttgacttgagcgacggcgagcaggaatttctggatagaagaaagcaggtcgttagtaaggctctgcagcaggtactcggtctcagtgaggccttggactctggccaggtacccgtcgtggccgtcttaggttcgggagggggaacgagagctatgagctccctctatggctccttggcaggactgcaagagctcggtctgcttgacaccgtaacttacttgagtggtgtctcaggatcaacctggtgcatttctaccctctaccgggaccctgcgtggtcccaagtcgctttgcagggccctattgagagggcccaggtgcacgtgtgctcaagcaaaatgggagctcttagtacagaacgcctgcaatattacacccaagaactaggcgtgagagagaggagcggacatagtgtgtctctcattgacctgtggggtctgctggttgaatatttgttgtaccaagaagagaaccccgcaaaactgtctgaccagcaggaagcagtgcgccagggccaaaacccttacccaatctacacaagtgtcaacgtgcggacaaatttaagcggcgaggacttcgctgagtggtgcgaatttactccttatgaagttgggtttcctaaatacggtgcgtacgtcccaacagagctgttcggctcggagctctttatggggaggctcttacagttgcagcctgagcctaggatctgttaccttcaagggatgtgggggtccgcctttgccacaagcttggacgaaatttttcttaaaacggcagggagcggactgagcttcctggaatggtacaggggctctgtcaacatcaccgatgattgtcagaaaccccagctccataacccgtcccggttgcgaacccgcctgctgaccccgcaaggccctttctcacaagcggttcttgacatctttacatctaggttcacaagcgctcagagtttcaacttcacgcgtggactttgtctccataaggactacgtggccggaagggaatttgtcgcatggaaagatacacatcctgacgcatttcccaaccaactcacccccatgcgtgattgtctatatttggtggacggcggattcgctattaattccccttttcccctcgccctgctgcctcagcgagccgtagacctaatcttaagtttcgattatagcctggaggctcctttcgaggtgctaaagatgaccgagaagtattgcctggacagaggcattcccttcccctctattgaggtgggacctgaagatatggaggaggccagagagtgttacctgttcgcgaaagctgaggatcctcgctctcctatcgtgctacattttcccttagtgaaccggaccttcagaacacacctcgcccctggcgtcgaaagacagaccgccgaagagaaggcctttggtgactttgtgattaaccgcccagatacgccatatggcatgatgaattttacatatgagccgcaggatttttacagactcgtcgcactgtctcggtataacgtcctcaacaacgtcgaaactctcaagtgtgctctgcagctggccctggaccgccaccaggcaagagaaagagccggagcctag

SEQ ID NO: 52826 - DNA, 2556 bp, Artificial Sequence
  Description of Artificial Sequence: Synthetic coding sequence
atgctgtgggcgctgtggccccgatggttggctgacaaaatgctgcccctactaggggcagtcttactgcaaaagcgcgaaaaacggggacctctgtggagacactggcggagagagacatatccttactatgatctgcaggtcaaggttctgcgggctacaaacatccgaggaaccgacctgctctctaaggccgactgctacgtgcagctctggcttcctactgcctctccgagtcccgcacagacccgcattgtggcaaactgtagtgatccagaatggaatgagactttccactaccagatacacggggctgtcaaaaacgttcttgagctgaccttgtacgacaaagacattttgggatccgaccagttgagtctgttgctgtttgacctcagatcacttaagtgcgggcagccacacaagcatacctttcccttaaaccatcaagattcccaagaattgcaggtcgaattcgtcttggaaaagagccaagtccccgctagtgaggttattacaaatggtgtgctggtggcccacccctgcttaagaattcagggcactttgaggggcgatggtacagcccctagagaggaatacggatctcggcagttacagctggccgtccctggcgcttatgagaagcctcaattgttgcctctccagccccctacagagccaggtttgccacccacgttcacattccatgttaatccggtcctgagttcacgtctccacgtagaattaatggagctgctcgctgccgttcagtccgggccttctgcagaactcgaggctcagacttctaagctgggagaaggcggtattcttttgagctccctgcctctgggacaggaagagcagtgttctgtggcattgggagagggtcaggaagtggcactgagcatgaaggtcgagatgtcatccggagacttagaccttcgtttgggatttgacctcagcgacggagagcaggagtttctggatagacgaaaacaggtcgtgtccaaggcactccaacaggtgctgggtctgagcgaggcacttgattccgggcagacacaggtgcccgtggtcgcagttttgggcagcgggggaggaacaagagctatgagctccctttacggatccctggctggactgcaggaactgggcctacttgacaccgtcacctatctttcaggagtgagcggctctacttggtgcatatcgaccttgtaccgggaccccgcatggtcacaggtggcgttgcagggtccaatagaacgggctcaggtacatgtgtgtagtagtaaaatgggcgctcttagtaccgagcgcttgcagtactacactcaggagctgggagtacgtgagaggagtggacactcagtttctttaatcgacctgtggggcctgctggtggagtacctgctctatcaggaagagaatcccgctaagttgagtgaccagcaggaggcagtccgccagggtcaaaacccttaccctatatacacttcggtcaacgtgcggaccaatctgtctggggaagactttgctgagtggtgtgagtttaccccctatgaggttggatttcctaagtacggtgcgtatgtccctactgagctgttcggttccgagctttttatggggaggctcctgcagctgcaaccggaaccacgcatctgctaccttcagggtatgtggggttctgccttcgccacttctctggatgagatcttcctaaagaccgcgggatcaggtttaagcttcctcgagtggtatagaggcagcgtgaatataaccgacgattgtcagaagccacaactgcacaatccctctagattgagaacacgcctgctgacaccccagggcccattctctcaagccgtgttagatattttcacctcaagatttacgagcgcgcagagctttaatttcactcggggtttgtgtctgcacaaggactacgtggctggcagggagttcgtggcttggaaggacacacatccggacgcttttcctaatcaactgacaccaatgcgcgactgtctgtaccttgtggatgggggattcgcaatcaactcaccgtttcccctagccttgctgcctcagcgggcagtggatctgatcctgtcattcgattatagcctggaggctccttttgaagtgctaaaaatgaccgagaagtattgtctggatagagggatcccgtttccaagtatagaggtgggtcctgaagatatggaggaagccagggaatgttacttatttgcaaaagctgaggatcccagatctccgatcgtgttacacttcccgttagtaaacagaactttccgcacccacctcgcaccgggagtcgagcggcagaccgccgaggaaaaggcatttggcgacttcgtgatcaatagaccagataccccttacgggatgatgaactttacatatgaaccacaggacttctaccgtcttgttgcactgtcgcggtacaatgttctaaacaacgtcgaaacacttaagtgtgctttgcagctggcactcgacagacaccaggctcgcgaaagggctggagcatag

SEQ ID NO: 52827 - DNA, 2598 bp, Artificial Sequence
  Description of Artificial Sequence: Synthetic coding sequence
atgctgtgggcattgtggcctcgctggcttgcagataagatgctccccctccttggagccgtccttttacagaagcgcgaaaaaagaggtcctctgtggaggcattggcgaagagagacctacccatattacgatctgcaggtgaaggtgctacgcgcaacgaacatcaggggcacagatctattgtcaaaggccgactgctacgtccagctgtggttaccaaccgcctcgccaagcccagcacagaccaggatcgttgccaactgttccgaccctgaatggaacgagacctttcattatcagattcatggagcagtgaaaaacgttctggagctgacactctatgataaggacatactggggtcggaccaactcagcttgctcttgtttgatctgcgatctctgaaatgcggtcaaccacataagcacacctttcctctcaatcaccaggactcccaagagctgcaagtcgaattcgttctcgaaaagtcacaggtgccggcttctgaggtcattaccaacggtgtgctggtggcccacccttgccttcggattcagggcacattaagaggcgatggcactgctcctagggaggagtacgggagccgtcagctccagctcgccgtgcctggagcctatgaaaaaccccaactcctcccactgcaaccaccaacagaacctgggttacctcccactttcactttccacgtaaacccagtgttgtcgtcccgcctgcatgtagagctgatggaattactggccgctgtgcagtctggtccaagtgccgaactggaggcacagacttccaagttaggagaagggggaatcttgctgtcttccctgcccttaggacaggaggagcaatgcagtgtagcactaggagagggacaggaggttgccctgtcaatgaaggtcgagatgagttcgggcgacctggatcttcgcctcggcttcgacctttcagatggcgagcaggagtttctagatcggcgaaagcaggtggtcagtaaagccctgcagcaggtgttaggtctgagtgaggctctggactctggtcaggtaccagtggtggccgtgttaggctcaggtgggggtacaagagccatgagtagcctctacggttctctggcaggattgcaggagctcgggctgctggacacagtcacatatttaagcggcgtcagcggatcaacatggtgcattagtactctgtaccgggatcccgcatggtcccaggtggcacttcaaggaccgatcgagcgcgcacaggtgcatgtctgcagtagtaagatgggtgctctgtcgacagaaaggctgcagtactacacacaggaactgggcgtcagggaacgaagcggccatagtgtgtcattgatagatttgtgggggttgctggtggagtatcttctttaccaggaagaaaacccggcaaagctgagcgatcaacaggaagccgtgagacagggccaaaacccttatcccatctacacaagcgtaaacgtccggaccaacctctcaggcgaagatttcgctgagtggtgtgaattcactccttatgaagttggctttcctaaatatggcgcatacgtacctactgagctctttggtagtgagctgttcatgggaaggctgctgcaactgcagcctgaacctagaatctgttacttgcagggcatgtggggaagtgcctttgctacttccctcgacgaaatcttcctgaaaactgcgggatccgggctctccttcctcgagtggtacaggggttctgtgaatatcactgacgactgccaaaagcctcagctgcacaatccatctcgcctaagaacaagactgctgacaccacagggacctttctctcaagcagtgctggacattttcacaagccgctttacctcagcccagtccttcaattttactcgcggactgtgtctgcataaggattatgtggctggccgtgaattcgttgcttggaaggacacacaccctgacgcgttcccgaatcagctaactccaatgagggattgcttatacctagtggatgggggattcgccataaactctccattccctctcgcgttactaccacagagggcagtggatctgatcctgagctttgattactctttggaagcgccattcgaagtcctcaagatgaccgagaagtattgtctcgatagagggatcccttttccgagcatcgaggttgggccagaagatatggaggaagcacgggaatgctatctgttcgcaaaggcagaggatccaaggagtcccattgtcctgcatttcccccttgtgaaccgcacttttaggactcacctcgccccaggagtggagaggcagactgctgaggagaaggccttcggagactttgtgatcaaccgccctgacaccccctatgggatgatgaatttcacctacgagccacaggacttctaccgactggtcgctttgtcaaggtataatgtattgaataacgtggagactctcaagtgtgcccacccgagacataggaggacctccgaaggacccagccctcaaacccacaccgagcagggactacgagccttgcgatcccagcttagctccctgcattag

SEQ ID NO: 52828 - DNA, 1770 bp, Artificial Sequence
  Description of Artificial Sequence: Synthetic coding sequence
atggtgggacagatgtactgttaccctggttcacacttagccagggctctgactagagccctagcactcgcccttgtcctcgccctgctggttggacccttcctgtccggcctcgccggagcaatcccggctcccggaggtcgatgggccagagacggccaagtgcctcccgctagccggtctaggtccgtgctgcttgatgtgagcgcgggacagctgctgatggtcgacgggaggcatcctgacgcggttgcttgggcgaatctgaccaacgccatccgtgagacaggctgggcctttttggaactggggaccagcggacagtataatgactcactgcaggcctatgccgcaggcgtagtggaggcggctgtttcagaagaacttatatatatgcattggatgaatacagtcgtgaactactgtggtccctttgaatatgaggttggttattgcgaacggcttaaatctttcctggaagccaacctggagtggatgcaagaggaaatggagagcaaccccgacagcccatattggcatcaggtgcgactcactcttctgcagttaaaaggactcgaggatagctacgaaggaagagtcagttttcccgctgggaaattcacaatcaagccgctgggattccttcttttgcagctgagcggtgacctggaggatctggagctggctctgaacaaaactaagatcaaaccatccttgggcagcggctcctgctccgctctaatcaaactgctcccaggccagtccgacttgctggtggctcacaatacctggaataattatcagcacatgctgagagtgatcaaaaagtattggctgcagttccgcgaagggccatggggtgactatcccctggtccctggaaataaattagtcttttcatcgtaccctgggacgatcttctcctgtgatgacttttacattttagggtcagggctcgttacattggagacgacgataggaaataagaaccccgctctctggaaatatgtgcgcccacgaggttgcgtactcgagtgggtgaggaatatcgtggcaaatagactggcctcagatggcgctacctgggccgatatttttaaaaggtttaatagtggcacgtataataatcagtggatgatcgtagattacaaagctttcatcccaggaggaccttctcccggatcgcgagtgctgaccatcttagagcaaattcctggaatggtggtggtggctgacaagacgtctgagctgtaccagaaaacctactgggcatcttacaacataccctcctttgagaccgtgttcaatgcatccggtctgcaggcacttgtcgcacagtatggggattggtttagctacgacggctctcctagggctcagatcttcaggcgtaatcagtccctggttcaggacatggacagcatggtcagactgatgcggtacaacgactttctgcacgaccctctcagcttatgcaaggcttgcaatccccagccgaacggggagaatgccattagcgcgaggtcagacctgaatcctgctaacggcagttatccttttcaggcccttagacaaagaagccacggagggattgacgtgaaggtgacatcaatgtcccttgcacgcattctcagtctgttagcagccagcgggcctacttgggatcaggtgcccccattccaatggtccacatcacccttctccggactcctgcacatgggccaaccagatctatggaagtttgccccagtgaaggtgtcctgggactag

SEQ ID NO: 52829 - DNA, 1674 bp, Artificial Sequence
  Description of Artificial Sequence: Synthetic coding sequence
atggttggacagatgtactgttaccccggatcccatctggctcgcgctctgacccgggctctggccttagccttggtgctcgccctgctcgtaggcccatttttatctggtttggccggagcgatccctgcccctggaggacgctgggcaagggatgggcaagtgccgccagcaagcagatctcggagtgtcctacttgatgtgagcgccggacaactcctgatggtggatgggagacatcctgacgcagttgcctgggccaatctgacaaacgccattcgtgaaacagggtgggcatttctggagctagggacaagcggccagtacaacgactccctgcaggcttacgcagctggggtcgtcgaggcagctgtgtccgaggagcttatctatatgcactggatgaacactgtggtgaactattgcggccctttcgaatatgaggtcggttattgcgagcggctgaagagtttcctggaggcaaacttggagtggatgcaggaggagatggagagtaaccctgacagcccttactggcatcaggtgagactgaccttgctacaactgaaggggctggaggactcttacgaggggagggtaagcttccctgccggaaagttcacaatcaagcctctcggcttcctccttctccaattgagtggcgacttggaagacttggaactggccctgaataaaacgaagataaagccctcactgggctcagggtcttgttcagcactcattaagctcttgccaggccagagcgatctgcttgtggctcacaatacatggaataactatcaacatatgctgagagtaattaagaaatactggctgcagttcagggaaggcccatggggcgactaccccttggtccctggcaacaagttggtgttcagcagttacccaggcaccatcttttcatgtgatgatttctatatcctggggtcaggactggtgacactagagaccactattggcaataagaatcccgctttgtggaaatacgtccgaccacggggatgtgtgctggaatgggtcagaaatatcgtagcaaatcggttggcttctgacggcgcaacatgggctgacatattcaaaagatttaactcaggtacgggaatggtcgtggtggcagacaagacttctgaactgtaccagaagacatattgggcttcttataacatccccagctttgagaccgtgttcaatgcttccggactccaggccctggtggctcaatatggggactggtttagttacgatggaagtccacgcgctcaaatcttccgcaggaaccaatccttggtgcaggatatggactcaatggttaggctgatgcgctataatgacttcttacacgacccactatcactgtgcaaggcctgcaatccgcagcccaatggtgagaatgccatatctgccaggagcgatctgaaccccgctaacggcagttatccatttcaggcattaaggcagaggtcccacggaggcatagatgtgaaggtgacatctatgtctctggcacgtatactttccctcctggcagcctctggccctacttgggaccaggttcctccctttcaatggtctaccagtccatttagcggtcttcttcatatgggccagcctgacctgtggaagttcgcaccggtcaaggtctcctgggactag

SEQ ID NO: 52830 - DNA, 1473 bp, Artificial Sequence
  Description of Artificial Sequence: Synthetic coding sequence
atgaagcccaagcttatgtaccaggagctgaaggtgcccgcagaggagcccgcaaacgagctgcctatgaacgagattgaggcctggaaggccgctgagaaaaaggcaagatgggtgctattggtactgatcctcgcggttgtgggtttcggggcactcatgacacaattatttctctgggaatacggcgatctgcacctcttcgggccaaaccagaggcccgctccctgctacgatccttgtgaagcagtgcttgtagagtcaattcctgaaggccttgatttccctaatgcgtccactggtaacccaagcacctctcaagcatggctgggcctgcttgcgggagctcattcatcactggacatcgcgagtttttactggactctgaccaataacgatactcatacgcaggaacccagcgctcagcaaggggaggaggtcctgcgacaactgcaaacattggcccctaaaggcgtgaacgtgcgaatcgcagtgtctaaaccctctggaccacagcctcaggcagatctgcaggccctgctgcagtcaggagcccaggttcgaatggtggacatgcaaaagctcacacacggagtcttacatacaaagttttgggttgtggatcagacacatttttatttaggttcagctaacatggactggaggagcttgacccaggtgaaggagcttggtgtggttatgtacaattgctcttgcctagcccgagatttgacgaaaattttcgaggcatactggttcctgggtcaggccggtagtagcataccaagtacatggccccgtttctacgacacaagatacaaccaggaaaccccaatggaaatttgcctaaacggaacacccgcattagcgtatctggcttctgccccaccacccttgtgcccatctggcagaacgccagacctgaaagccctcctgaatgtagtggataacgctcgatccttcatatatgtagccgtcatgaactatctgcccaccctggaattcagccacccccaccgattttggccagccattgacgacggattaaggagagccacttacgagcgaggagttaaagtgcgattactgattagctgctggggccactccgagccatccatgagggcattcttgctgtccttggctgcgctgcgcgataatcacactcactcagatatccaggtgaaactgttcgtcgtgccagcagacgaagcccaggctcggattccctacgcgagggttaaccacaataaatatatggtgacggagagagctacctacatcgggacctccaactggtccggcaactatttcaccgagactgccggtacaagtttactggttactcagaatggccgtggcggacttcgatcgcagctcgaagctatcttcctcagggattgggattctccctatagccacgacttggacacttccgccgactccgtaggcaacgcatgtcgcctgctttag

SEQ ID NO: 52831 - DNA, 534 bp, Artificial Sequence
  Description of Artificial Sequence: Synthetic coding sequence
atgaagccaaagctgatgtaccaggagctgaaggttcccgctgaggaacccgctaatgaactaccgatgaacgaaatcgaagcatggaaggcagcagagaaaaaggctcgctgggtcctccttgtgctcatccttgctgtggtgggctttggagcacttatgacacaattattcctgtgggagtacggcgatctgcacctcttcgggccaaatcagagacctgccccttgttatgacccatgcgaggctgtgctcgtcgaaagcattcccgagggactcgattttcccaatgcatcaaccggcaacccaagcacctctcaggcatggctgggactgctcgcgggagcccactcaagtctggacattgcctcattttattggactttaaccaacaacgacacccacactcaagaaccctctgctcagcagggagaagaagtcctgaggcagttgcaaactttggcacctaaaggagtgaacgtccgtatcgctgtctctaagcccagcggccctcagccccaggcagatctctag

SEQ ID NO: 52832 - DNA, 390 bp, Artificial Sequence
  Description of Artificial Sequence: Synthetic coding sequence
atgaaacccaagttgatgtatcaagagctgaaggtgcccgctgaggaaccagctaatgaactgccgatgaatgagatcgaagcttggaaggctgcagaaaagaaagcccgatgggtactgttagttcttattcttgccgtggttggcttcggcgctctcatgactcagctttttctgtgggaatatggggacctgcatttgttcggccctaaccagcggcctgccccatgttacgacccttgtgaagctgttctcgtggagtccatcccagaaggcctcgatttccctaacgccagcaccggcaacccatcaacatcccaggcttggcttggtctcctggctggagcccattcctccctggacatcgcatccttctattggactttatag

SEQ ID NO: 52833 - DNA, 1473 bp, Artificial Sequence
  Description of Artificial Sequence: Synthetic coding sequence
atgaagcccaaactgatgtaccaggaacttaaggtgcccgcagaagaacccgctaacgagttgcccatgaacgaaattgaggcctggaaggccgctgaaaaaaaggccaggtgggttttattggtcctcattctggccgtagttggatttggagctttaatgacacagctgttcctctgggaatacggagatctgcatttgttcggtcctaaccagaggccagccccttgttacgatccctgtgaggccgttctcgttgaaagtattcctgaggggttggattttcctaatgctagcaccggtaacccatcaacaagtcaggcttggctcggtctgcttgccggtgctcacagctctcttgacatcgcttcattctattggactctcactaataacgacacgcatacccaggagccctcggcacagcagggcgaggaagtgctgcgccagctccaaactctcgcccctaaaggggtaaatgttcgcatcgcggtgtctaaacctagtgggccacagccccaggccgacctccaggcacttctgcaatcaggtgctcaagtgcggatggttgacatgcaaaagcttacccacggcgtgcttcacacaaaattttgggtagtggaccagacacatttctatctggggtcagctaacatggactggagatcgttgacccaggttaaagaactgggagtggttatgtacaattgctcttgcctggcgagagaccttactaaaattttcgaggcatactggtttctgggtcaagccggttcttccataccttcgacatggcctcggttttacgatactcggtacaatcaggaaaccccaatggaaatttgcctcaacggtacacctgccctagcgtatctcgcttctgcaccaccgccactctgccctagcggtcgtacccccgatttgaaagcactcttaaatgtggtcgacaacgctcggagtttcatctacgtcgccgtgatgaactatctgcctacgctggagtttagccacccgcatcggttttggcccgctatagatgacggcctccgacgtgccacgtacgaacgcggtgtgaaagtcaggctgttgatttcctgttggggtcatagtgagccctctatgagggcatttctgctgtctcttgcggctcttcgcgacaaccacactcatagcgacatccaggtcaagctgtttgtagtaccggctgacgaggcacaggctagaattccctatgccagagtcaatcacaataaatatatggttactgagcgagcaacctatatcggcacaagcaactggtccggaaattatttcaccgagacggcgggaactagcctgttggtcacacaaaacgggaggggcggactacgttcccagctggaggcaatctttctgcgagactgggactccccatatagtcacgacctcgacactagcgccgatagcgtgggcaatgcgtgccggcttctttag

SEQ ID NO: 52834 - DNA, 1473 bp, Artificial Sequence
  Description of Artificial Sequence: Synthetic coding sequence
atgaaacctaaacttatgtaccaggagctgaaggtccccgctgaagagcccgctaacgaactcccaatgaatgagatcgaggcttggaaggcagcagaaaaaaaagccagatgggttctgttagtattgatcctggccgtcgtcggcttcggcgctttgatgacccagttgttcttatgggaatacggtgacctgcatctcttcggccctaaccagcgtcccgctccttgctacgatccctgcgaagcggttctggtggagtcgattccagagggccttgatttccctaacgcctcgacgggcaatccaagcactagccaggcttggctgggactgctagcaggagcccacagttcactggacattgcctcgttctattggacactcaccaataacgatacacacacccaggaaccttcggctcagcagggcgaggaggtgttacgacagctgcagactctcgcaccaaagggcgtcaacgtacggatcgccgtgtccaagccttctggcccacaaccgcaagcagatctgcaggccctgcttcagagcggtgcccaggttaggatggtcgatatgcagaagctcacacacggcgtcctccatacaaaattctgggtggttgatcaaactcacttctatctggggtccgcaaatatggattggcgaagcctgacccaggttaaagagctgggcgtggtgatgtataattgtagctgcctggcaagggatctgactaagatcttcgaggcgtactggtttctggggcaagcaggctccagcatcccaagtacctggcccaggttctacgacaccaggtataaccaggagactcccatggaaatctgtttgaacggcacacccgctttggcgtatctggcatccgcccctccgcctctgtgtcccagcggcagaacgcctgatctcaaggctctgctgaatgtcgtggacaatgcgaggtcatttatctacgtggccgtcatgaactatctgcctactctggagtttagtcacccacataggttctggcccgcaattgatgacgggcttcgccgagctacatacgagcgaggcgtgaaggtgcgtttgctgatcagttgttgggggcatagtgaaccctcaatgcgcgcttttctactctctctcgccgctctccgtgacaatcatacacattctgacattcaggtcaagttattcgttgtcccagccgatgaggcgcaggcaaggatcccttatgctagggtcaatcataataaatatatggtcaccgaacgcgcaacctatatcggaacctcaaattggtccggcaactatttcactgagaccgcgggtacttcgctactggttactcagaacggaagaggcggtttacggagtcaactggaggcaatcttccttagggattgggactccccatactcacacgacttagacacttcagctgattccgttggaaatgcttgtagactgctctag

SEQ ID NO: 52835 - DNA, 1473 bp, Artificial Sequence
  Description of Artificial Sequence: Synthetic coding sequence
atgaagccaaagctgatgtaccaggaattaaaggtaccagctgaagaacctgctaacgagctccccatgaacgaaatagaggcatggaaggcggctgagaagaaggccagatgggtgttgctggtcctgattttggcggttgtgggcttcggtgccctgatgacccagctctttctgtgggagtatggggatctgcatctatttgggcctaaccaaaggccagccccttgctatgacccttgtgaagccgtactggtcgaatccattcctgagggcctggattttccgaatgcaagcaccggaaacccctccactagccaagcttggctgggcctactggccggtgcccactccagccttgatattgctagtttctactggacactcacgaacaatgacactcacacccaggaaccaagtgcacaacagggagaagaagtgcttaggcagctccaaacactcgcacctaagggcgttaatgtcaggattgcagttagcaagccatccggaccacaaccccaagccgaccttcaagccttactccagtccggtgcacaggtccgcatggtggacatgcagaaactgactcatggggtgctgcacacaaagttctgggtggtggaccaaacgcacttctatcttggatcagccaatatggactggcgttctctgacccaggtcaaagaactaggggtggtgatgtacaattgtagttgcctggctagggacctgaccaaaatatttgaagcatactggtttttgggacaggccggaagcagcatcccatcaacctggccacgattttacgatactcgctacaaccaggagacgccgatggaaatctgccttaacggcactcctgccctcgcatacctggcgtccgcccctcccccactttgccccagcggtcgtacaccagacctcaaagccctgctgaatgtcgtagacaacgcgagatctttcatttatgtcgctgtaatgaattatctccctaccctggaattctcccatcctcaccgtttttggccagccattgacgacgggctccgtagagccacttacgagagaggcgtaaaagttagactgctgatatcctgttggggacactccgagccctccatgcgggcattcctgctaagcctggcggcattgcgtgataaccatacccattccgacattcaagttaaattatttgttgtgcctgccgatgaggctcaagctcgtatcccatatgcccgtgttaatcacaataaatacatggtgacggagagagccacttatatcgggacttcaaattggagtggcaattactttacggaaacagcgggtactagcctgctggttacccaaaatggaagaggtggcctcaggtcacagctggaagctattttcttgagagactgggattctccgtactcccacgatctggacacatctgcagacagtgttggaaatgcctgccgactattatag

SEQ ID NO: 52836 - DNA, 1473 bp, Artificial Sequence
  Description of Artificial Sequence: Synthetic coding sequence
atgaaacctaagcttatgtaccaggagctgaaggtaccggctgaggagcccgcaaatgagcttccaatgaatgagattgaagcatggaaggccgctgagaagaaagcccgatgggtgctgctagtgcttattctggcggttgtcgggtttggagctttgatgacacaattgtttctctgggaatatggagatctgcacctcttcggacccaaccaacgtcctgctccctgctacgatccctgcgaggccgtgttggtagaatctatcccggaaggtttggatttcccaaacgcatccaccgggaacccatctacatcccaggcctggttagggctccttgcaggggcacactccagtctggacatagcctctttctattggactttgactaacaatgacactcacacccaggaaccctcggcacagcaaggagaggaagtgttacgccagcttcaaactctggctccaaaaggcgtgaacgtgaggatagctgtttcaaagccaagtgggcctcaacctcaggccgatttacaagctctgctgcagagcggcgctcaggtgaggatggtagatatgcagaagttgacacacggggtgttgcacactaagttctgggtggttgatcagacacacttctacttgggaagcgccaatatggattggaggtccttgacgcaggtgaaggagttaggggtggtcatgtacaattgctcctgcctggccagagatctgacaaagatcttcgaggcatattggtttctgggccaagcgggtagctccattccctctacctggcctcgcttctacgatactaggtacaatcaagaaacacccatggagatttgtctgaatggcaccccagccttggcatacctggcatctgctcccccaccattgtgtccctctggtcggacaccagatctcaaagcactgttgaacgtggtagacaacgccaggtcttttatttatgtggccgtgatgaactacctacctaccctcgagttttcacacccacaccggttttggccagccatcgacgatggcctgagaagggccacgtatgagcggggagttaaggtccggttgttgatctcctgttggggacacagcgagccttctatgcgagcattcctgctgagtctggcggctctgcgcgacaatcatacccatagcgacattcaagttaagcttttcgtagttcctgctgacgaagcacaggccagaatcccatacgcaagagtgaaccataataagtatatggtgacggagagagcaacttacatcggaacctcaaactggagtggaaactatttcacagaaacagctggaaccagcctactcgtgacccagaatggccgtggtgggctgcggtcacagctggaagctatcttcctcagggactgggacagtccttacagtcatgatttagacacaagtgcagattcagtgggtaatgcatgcagactcctttag

SEQ ID NO: 52837 - DNA, 1209 bp, Artificial Sequence
  Description of Artificial Sequence: Synthetic coding sequence
atgaagccaaaactgatgtatcaagagttgaaagttcctgcggaagaaccagcaaacgaactgcctatgaatgaaattgaggcctggaaggccgcagagaagaaagcacgctgggttctactggttctgatcctcgctgttgtagggtttggggcactgatgacccagctcttcctttgggagtacggggacttacatctttttggcccaaatcagcgacccgcaccctgctacgatccatgtgaggccgtgctggtcgaaagcatcccggagggcctgctggcaggagctcactcctccctggacattgcctcattctattggactctgacgaataatgacacgcatacccaggagccaagcgcccagcagggagaggaagtactgcgacagctacaaacacttgcaccaaagggagttaatgtccgcatagcagtgagtaagccatccgggccacagccccaagcagacctccaggctcttcttcaatcaggtgctcaggtccgtatggtcgacatgcagaaactgacacacggagtactgcatacgaagttctgggtcgtcgaccagactcatttctatctgggcagcgccaatatggattggcgctctctgacccaagttaaagagttgggcgtagtcatgtataattgttcatgtttggcacgggatctgacaaagatcttcgaggcatactggttcctgggacaagctggctccagcatcccctcgacctggccacggttctacgacactcgctacaatcaggagacccccatggagatatgccttaatgggacaccagccctggcctacctggcctcagcacctcccccactttgccctagcggcagaaccccagacctgaaggcgctcctaaacgtggtagacaacgcccgaagcttcatctacgtggctgtcatgaattacctgcctaccctcgaattctctcacccacacaggttctggcctgctatagacgatggtctgaggagagcgacatacgagcgcggtgttaaggtcaggctgctgatcagctgctgggggcactctgagccgtcaatgcgcgcattcctgctgagcctcgccgcactccgtgacaaccacacccattcagacatccaggttaagctgttcgtggtccccgctgatgaggcccaggcactgtcaccagctctccctccactgcctccccctccccctgcctag

SEQ ID NO: 52838 - DNA, 1521 bp, Artificial Sequence
  Description of Artificial Sequence: Synthetic coding sequence
atgcttaagcccctctggaaagctgcagtcgccccaacatggccgtgtagcatgccacccaggcgcccatgggacagagaggcgggaaccctgcaggtgctgggagccctggccgtgctttggctggggagtgtcgcattaatttgcctcttgtggcaagtgccacggccacctacatgggggcaggtacagccaaaggacgtgccgcgatcatgggaacacggctcttcacccgcatgggaacccctcgaggctgaggctcgacagcagcgtgatagttgccagctggtcctggtggagtcaattcctcaggacctcccgtccgcagcaggaagccctagtgctcaaccactgggccaggcctggcttcaactactcgacacggcacaagagagtgtgcacgtcgctagctattattggtctctgaccggtccggacattggcgtcaatgactcatcctcccaactcggagaggccctactgcagaagctgcagcagctgttgggccgtaacatttctttggccgtagccactagttctccaaccttagctcggacctcaacggacctccaagtgctagcagcccgtggtgcacacgtacgtcaggtgcctatgggacggctgacccgcggagtgcttcactctaaattctgggttgtcgatgggaggcacatctacatggggagtgccaacatggactggcgctccctaactcaggtgaaagagttgggagctgtgatttataactgtagccaccttgcacaagatctggaaaagactttccaaacttactgggtgcttggggtgcccaaagccgtcttacctaagacctggccacagaatttttcttcgcacttcaaccggtttcaacccttccacggtctgtttgatggtgtccccacgacggcctacttttcagcatcccctcccgctctatgtccccagggcagaactagagacttagaggctctgctggctgtgatgggatccgcacaagaatttatctacgcctccgtcatggagtactttccgacaactaggtttagtcatcctcccagatattggccagtcctggacaatgcgctgcgcgcagctgctttcggaaagggggtacgggtgcgacttcttgtcgggtgcggacttaacaccgatcctacaatgttcccttatctgaggtcccttcaggccctgtccaatcccgcagctaatgtcagcgtggatgtgaaagtgtttattgtgcctgtaggcaatcattctaatattccattctcacgcgtgaaccacagtaaatttatggtgaccgagaaagcggcttacattggcacctccaattggtctgaagattatttttcctcaacagccggtgttggacttgtggtcacccagtcacccggtgcccagccagctggggctaccgtgcaggagcaattgcggcagctgtttgaacgggactggtcttcccggtacgcagttgggctggatggacaggcccctggccaggactgtgtgtggcagggctag

SEQ ID NO: 52839 - DNA, 1542 bp, Artificial Sequence
  Description of Artificial Sequence: Synthetic coding sequence
atgccagggtgccctgtgcagatgttaaaaccactttggaaagctgcagtggcgcctacatggccttgttctatgcccccaagaaggccctgggacagggaggccggtacgctccaggtgctcggggctctggcagtcctgtggctgggcagtgtcgcacttatctgcttactctggcaggttccacggccacctacatggggacaagttcagcctaaggacgtcccccgaagctgggagcatggctcctcccctgcctgggaacccctagaagccgaagctcgccagcagagagacagctgccaactggtcctggtcgagtccattccacaggatcttccttccgccgctgggtccccaagcgctcagcctctgggccaggcttggctgcaactcctggacacggctcaggagagtgtgcacgtagcatcgtattattggtcccttaccggtccagacattggtgttaatgactctagtagtcaactgggggaagcactcctgcagaagcttcagcaattactgggccgtaacatcagtctggcagtggccacttcaagtccaactctcgcccgaacctccaccgacctgcaagtgctggcagctcgcggtgcacacgtccgacaagtgccaatgggtagattgacaagaggagttttgcattccaaattctgggtcgtagatggtaggcacatttatatggggtccgctaatatggactggaggtctcttacacaggtaaaggagctgggggctgtgatatataattgctctcacttagcacaggacttagagaagaccttccagacctattgggtactcggagtccctaaggccgtgctgccaaaaacatggccacagaacttctcgtcccactttaacaggttccagccattccacggcttgtttgacggtgtgccaacaaccgcatatttcagtgcctcaccgcctgctctatgtcctcagggcagaaccagagacctggaagctctgctggctgttatggggagtgcccaggagtttatatatgccagtgtcatggagtattttcccaccactagattctcccacccgcctcggtactggcccgtgctggacaatgctctgcgggctgccgcatttggaaagggggtgagagtccgcctgctggtgggctgtgggttgaatacggaccccacaatgtttccttatctccgatcacttcaggcccttagcaatcctgctgccaacgtgagtgtggacgtgaaagtatttattgtaccggtgggaaatcatagcaacatccctttttcccgagtgaaccacagtaagtttatggtcactgagaaagctgcctacattgggacatctaactggagtgaggactatttctcgtcaactgccggagtgggattggttgtcacacaatcgcctggcgctcagcccgcaggagcaacagtgcaggagcagctcaggcaattgttcgagagggactggagctcgcgctatgcggtaggtctagacggccaggccccaggccaggattgtgtgtggcaagggtag

SEQ ID NO: 52840 - DNA, 1425 bp, Artificial Sequence
  Description of Artificial Sequence: Synthetic coding sequence
atgagtcagcagaaatgcatcgtgattttcgcactggtgtgctgttttgctatcctagtcgctcttattttctctgcagtcgatattatgggcgaggatgaggatggattgtcggaaaagaattgccagaataagtgccggatcgccctggttgaaaatattccggaagggctgaattactctgaaaacgcacctttccatctgtcactgttccaggggtggatgaatctgctgaatatggcgaagaaaagcgttgatatcgtgtcctctcactgggacttaaaccatacacacccctcagcttgccaagggcagcggctcttcgaaaaactccttcagctcactagtcagaatatcgaaatcaagctggtttctgatgtgactgcagatagtaaagtgctggaggcactgaagcttaaaggagctgaggtgacctatatgaatatgacagcctataacaagggcaggctccagtcatcattttggatcgttgataaacaacacgtgtacattggatcggcaggtctcgactggcaaagtctcgggcagatgaaggagctgggtgttattttctataactgttcatgtctggtcctcgatttgcagcgcattttcgcgctgtactctagcctgaagttcaaatccagggtgccacagacatggagcaaaaggctatacggcgtgtatgacaatgagaaaaaactgcagttgcagttgaacgagaccaagagccaggcttttgttagcaattccccaaaactgttctgcccaaaaaacagaagttttgatatagacgcgatctactccgtgatcgacgacgcaaaacaatacgtctacattgctgtaatggattacctcccaatcagctccacaagcaccaagcggacctactggccggacctcgatgctaagatcagagaggccctcgtgctgcgctctgtgcgagtgcgtctgttgctgtccttctggaaagaaaccgatcccctgacattcaacttcatctcctccctcaaggccatttgcaccgagattgcgaactgcagcctgaaggtgaaatttttcgatcttgagcgcgaaaacgcttgtgcaaccaaggaacagaagaatcatacctttccgaggctaaatcgcaataaatacatggtgacagacggcgcagcctatatcggcaatttcgactgggtcggcaacgattttactcaaaacgccggaacaggcttggtgatcaaccaggcggacgtaagaaataaccgcagcatcatcaaacagctgaaagacgttttcgagagagactggtatagcccatatgccaagaccctgcagcccacgaagcagccaaactgctcaagtctgttcaagttaaagcccctgtctaataagaccgcaactgatgacaccgggggtaaggacccccgtaacgtatag

SEQ ID NO: 52841 - DNA, 1335 bp, Artificial Sequence
  Description of Artificial Sequence: Synthetic coding sequence
atgagaatggactcccagaagaaaatcgctaaaatcaacgtggggaaacgaatagctctcgtcgaaaacattcccgaagggctcaattatagtgagaatgccccatttcatctgtcgctgttccagggatggatgaatctcctgaacatggcgaaaaagtccgttgatatcgtgagttcacactgggatctgaatcatacccatccttccgcctgccaggggcagagactgttcgaaaaattactgcagttaactagccaaaatatcgaaattaagctcgtctccgacgtgacagcggactctaaggtgttagaggctttaaaactaaaaggtgctgaggtgacatatatgaacatgaccgcttataacaaaggcagattacagtcttctttttggatcgtggataagcagcacgtgtatatcggcagcgccggtctcgattggcagtcactggggcagatgaaggaactgggcgtgatattctataattgttcttgcttggtgctcgatctgcagcggatctttgctctttattcatccctgaagttcaagagccgcgttccacagacctggtccaaaaggttgtacggggtgtacgacaatgagaaaaagctgcagctccagcttaacgagaccaaaagtcaagcttttgtgagtaacagccccaagttattctgcccaaagaacaggagcttcgatattgatgcaatctatagtgtcattgatgatgccaaacagtatgtgtacatcgcagtcatggactaccttcctatctcttccacttccactaaacgcacctattggcctgatctggatgccaagatcagggaagcactggtcctgagatctgttagggtgagactactgctttctttttggaaagagaccgacccactgaccttcaacttcattagcagcctgaaagccatttgcacagagatcgctaattgtagtctcaaggtaaaattcttcgacttggagcgcgagaatgcttgtgccaccaaggagcagaaaaaccacaccttccctcgcctgaatcgaaacaaatatatggtcaccgacggggcagcctacattggtaattttgactgggttggcaacgactttacgcaaaacgccggtacagggttggtgatcaatcaggcggatgtgcgtaataacagatccattattaagcagcttaaggacgtgtttgaacgagattggtattctccttatgccaaaacattgcagccaacaaaacagcccaattgttcttcgctttttaagctgaagcccctgtccaataagacggcaacggacgacactggcggaaaggatccacggaacgtatag

SEQ ID NO: 52842 - DNA, 1611 bp, Artificial Sequence
  Description of Artificial Sequence: Synthetic coding sequence
atggagataaggcagcacgaatggctgtctgcatcgccgcacgagggctttgagcagatgagattaaaaagcaggcccaaggagccatcaccttccctgactcgagtcggagcgaatttctattcttcggtgaaacagcaagactatagcgcaagcgtatggcttcgcagaaaagataagcttgaacattcgcagcagaaatgcatcgtgattttcgcactcgtctgttgctttgctatcctggtagccctgatattctctgccgttgacataatgggagaggatgaggacggcttgtcagaaaagaattgccagaacaaatgccggatcgctctagtagagaatatacccgagggactgaactacagcgagaatgcaccgttccacttatccctcttccagggctggatgaatctgttgaatatggcgaaaaagagtgtggacatcgtgagctcccactgggacctcaaccacacacaccctagtgcttgccagggccagaggctgttcgagaaactgctccagttgacgtctcaaaatatcgagatcaaactggtatctgatgtcactgccgacagcaaggtgctggaagcacttaagctgaagggagccgaggttacctatatgaacatgaccgcatataataagggtagactgcagtctagtttttggatagtggacaagcagcatgtgtacattgggagcgctgggctggactggcagtccttagggcagatgaaagagctgggcgtgatattttacaactgttcatgtctcgtcctggacctgcagaggattttcgcactgtacagttctctaaagttcaagagtcgagtgccccagacgtggagcaaaagactgtatggagtgtatgacaatgaaaaaaagttacagttgcagttaaacgagaccaagagccaggcgtttgtctctaattctccaaagctcttttgtccaaagaaccgctcctttgatattgatgcaatctattccgtgatcgatgatgctaagcagtatgtttacattgctgtgatggactatctccctatctcaagcacgagcacaaagcgcacgtactggccagacctcgatgccaagataagggaagctctcgtactgcgctcggtgcgcgttcgcctcctattaagtttctggaaggagaccgaccctctcaccttcaacttcattagttccttgaaagctatttgtacggaaattgcgaattgttccctcaaggttaagttcttcgaccttgagcgagaaaacgcatgtgcgacaaaggaacagaagaaccacaccttcccaaggctgaacaggaacaagtatatggtgaccgatggtgctgcctatatcggcaattttgattgggtgggcaatgacttcacccaaaacgctggaacagggttagtgataaaccaagcagacgtgcgtaacaatagatcgattattaagcagctgaaggatgtgttcgagagggactggtatagcccatacgccaaaactctccagcctaccaagcagcctaattgttcatcactcttcaagttaaagcctctgtccaataagaccgctaccgatgataccggaggtaaagaccctcgcaacgtgtag

SEQ ID NO: 52843 - DNA, 759 bp, Artificial Sequence
  Description of Artificial Sequence: Synthetic coding sequence
atggggcgtctgtcatggcaggtggctgccgcagctgcggtcggcttggccttgacactagaggccctgccatgggtgttgaggtggttgcggagtcggagacggcgaccgcgtcgcgaagctttgtttttccctagtcaggttacgtgcacagaggccttacttcgtgctcctggggctgagcttgccgagctgcctgagggttgcccttgcgggctcccacacggtgaaagcgccctctccaggttactccgagctctgttagcagcacgggcatctctcgacctctgtctgttcgccttttcttccccacagttgggtagagctgtgcagctcctccaccaaagaggcgtaagagtgcgcgtcgtcaccgactgtgactatatggccctgaatggtagtcagatcggtctgctaagaaaggcagggattcaagtgcgacacgaccaggatcctgggtacatgcaccataaatttgctattgttgacaagcgggtgcttatcaccggctcacttaattggaccacccaggccatccaaaacaatagggaaaacgtgttgattacggaagacgacgagtatgttcgtcttttcttagaggagttcgagagaatttgggagcagttcaatcctactaagtatacttttttccccccaaagaagagtcatggcagctgtgccccacccgtatcccgggcaggcggtcgcctcctgtcctggcacagaacctgcggcacttcctctgaatcccagacgtag

SEQ ID NO: 52844 - DNA, 528 bp, Artificial Sequence
  Description of Artificial Sequence: Synthetic coding sequence
atgggacgactgagctggcaggtcgccgctgctgcaagaggagcagtcttacctgtgtcaggagacttatacaggggacctgctgccggaagcggtaggggcgctgggcgtgcccctcgcggtcttcctgtacgacctgctcccagacgggaacgcgcaaaaccaccagccgcatgccctgctgggcgaccgaggcagccgggatctctgcctgtgagactgctgcaacccgcagccggacccagacgcgctgtcgccgctccagcctggggggcatctgctggcagacacagactgaggttgcacggaccccagcgcctcgccaaccgatctgctgctcaaggacgggacccaggacctgccaggtcccgtcccaggttgcacgcttcacaggtttgccacagaggacaggagggagcacatcactggctcgcccagctcgaccatgcgtctcatcccgaacagcagggtgagtgctcgcatcatgggggtcgaagagtaagagctgctttttctggaaggatctag

SEQ ID NO: 52845 - DNA, 678 bp, Artificial Sequence
  Description of Artificial Sequence: Synthetic coding sequence
atggtgtcccacagcgagctgcgcaagctcttttacagcgccgatgcagtatgcttcgacgtagactccacagtgatcagagaagaaggaattgatgagctcgctaagatctgcggggtggaagatgcagtgtcagagatgaccagaagggctatggggggtgctgttccatttaaggccgcactcactgaacgattagcgctgattcaacccagtcgggagcaggtccaaagactgattgctgaacagccccctcatctgactccgggtatcagagaactggttagtaggctacaggagaggaacgtgcaagttttcctgatttcgggtgggttccggtccatcgttgagcatgtagcaagcaaactgaatattccagctacaaacgtatttgccaaccgattaaagttctacttcaacggggagtatgctgggtttgacgaaacgcagcctacagccgaaagcggcggaaagggcaaggtcattaaactcctgaaggagaaattccattttaagaagattatcatgataggagacggggcaactgatatggaggcatgccctcctgcagacgccttcattggcttcgggggtaacgtcattcgtcagcaggtgaaggataacgctaagtggtatataacagatttcgtggaactactgggagagctggaggaatag

SEQ ID NO: 52846 - DNA, 678 bp, Artificial Sequence
  Description of Artificial Sequence: Synthetic coding sequence
atggtgagccacagcgaactgcggaaattgttctactccgccgatgctgtttgtttcgatgtggacagcaccgtaattagggaagaagggatagacgaactagctaagatctgtggcgttgaggacgctgtatctgagatgacccggagagccatggggggagcagtgccattcaaggctgccctgaccgagcgactggccctcatccagccgtcgcgggaacaagtgcagcgcctcatcgctgagcagccgccacatttgactcctggcattagggagttagtttctcgcctgcaggagaggaatgtgcaggtattcttgatatcagggggtttccgttccattgtcgaacacgtggccagcaagctaaatattcctgctactaacgtgtttgccaatagacttaagttctattttaatggggagtatgcagggttcgacgagacccagcctacagcagagtccggcggaaagggcaaggtcatcaaactgctcaaagaaaagtttcattttaaaaagatcattatgatcggagacggcgcaacggacatggaggcttgtcctcccgctgatgcctttattgggttcggcggtaacgtgatacggcagcaggtgaaggataatgcgaagtggtacatcactgattttgtggagctcctgggagagctcgaagaatag

SEQ ID NO: 52847 - DNA, 9 bp, Artificial Sequence
  Description of Artificial Sequence: Synthetic coding sequence
atggtctag

SEQ ID NO: 52848 - DNA, 9 bp, Artificial Sequence
  Description of Artificial Sequence: Synthetic coding sequence
atggtgtag

SEQ ID NO: 52849 - DNA, 141 bp, Artificial Sequence
  Description of Artificial Sequence: Synthetic coding sequence
atggtgagtcattccgaactccgaaaactgttctacagcgccgacgccgtgtgtttcgatgtggacagtactgttataagggaggagggaatagacgagctagctaagatctgcggggttgaggacgccgtatctgaatag

SEQ ID NO: 52850 - DNA, 141 bp, Artificial Sequence
  Description of Artificial Sequence: Synthetic coding sequence
atggtgagtcactcagagcttcgcaaacttttttattcggccgatgccgtgtgttttgatgtcgatagcactgtcattcgcgaggagggtattgacgagctggccaaaatctgcggcgtagaagacgcagttagcgagtag

SEQ ID NO: 52851 - DNA, 564 bp, Artificial Sequence
  Description of Artificial Sequence: Synthetic coding sequence
atggtcagtcattccgagttacgaaagctgttctacagtgcagacgcagtgtgtttcgacgtggactctaccgttattagggaggagggcatagacgaactggcgaagatctgtggcgtcgaagatgcagtgtcagagatgacccggagggccatggggggtgctgtgccttttaaggcagccctcaccgagaggctcgccctgatccagccatccagggaacaggtccagcgcttgattgcagagcagcccccacacctgacaccaggtatacgggagttggtgagccgccttcaagaaagaaacgtgcaggtttttctcatctctggaggctttagatcaatcgtggaacatgttgcatcaaaactcaatatcccagccaccaacgtgtttgcgaatcggctgaaattctactttaacggggaatatgctggattcgacgagacacaacctactgccgaaagcggcggtaagggaaaagtgatcaagctgctcaaggagaaatttcacttcaagaagataatcatgataggcgatggggcaacagacatggaagcatgttag

SEQ ID NO: 52852 - DNA, 33 bp, Artificial Sequence
  Description of Artificial Sequence: Synthetic coding sequence
atggtgtctcattcagaactcagaaagctttag

SEQ ID NO: 52853 - DNA, 678 bp, Artificial Sequence
  Description of Artificial Sequence: Synthetic coding sequence
atggtgagccacagtgagcttcgcaagctcttctatagtgccgacgccgtctgcttcgatgtcgattctacagtgattagggaggagggtatcgacgagctagctaagatttgtggcgttgaggacgccgtgagcgaaatgactaggcgcgcaatgggaggagccgtaccctttaaagccgctctgacggagcggttggccctgatccagccgtctcgagagcaggtacagcgcttaatcgccgaacaaccacctcatctgactccgggtatcagggaactggtatctcgcctccaggagaggaatgtacaggtcttcctgatttcgggcggttttaggtccatcgttgagcacgtggccagcaagcttaacattcctgccacaaacgtctttgccaaccgccttaagttctactttaacggggaatatgccggatttgatgagacgcagcctacggctgaaagcggaggaaaaggcaaagtgataaaattgctgaaagaaaagttccatttcaaaaaaattatcatgataggagacggggcaactgacatggaagcatgtccccctgcagacgcatttattggcttcggaggtaatgtcataaggcagcaggtgaaggataacgctaagtggtacatcacggatttcgtggagctgctgggtgaactagaagaatag

SEQ ID NO: 52854 - DNA, 1047 bp, Artificial Sequence
  Description of Artificial Sequence: Synthetic coding sequence
atgaaaacagccgaaaacatcagagggactgggagtgacggaccccgaaaacgcggtttgtgtgtgctgtgcgggttacccgcagcaggcaagagcactttcgctcgggcactggctcatcgcctgcaacaggagcagggctgggcgataggggtcgtggcatacgacgatgtgatgcctgacgcctttcttgccggagcgcgagcccgtcctgccccatcccagtggaagctcctgcgccaggaactccttaaatatctggaatatttcctcatggcagtgatcaatgggtgtcagatgagcgttcctcctaatcggacggaggctatgtgggaggacttcatcacttgtctcaaggatcaggacctcatcttcagcgccgcatttgaggcccagagttgttacctgctgaccaagaccgcagtttcgcgccctctttttctggtcctggacgacaacttttactatcagtcgatgcgatatgaggtttatcagttagcaagaaagtattccctgggtttttgccagcttttccttgactgcccactggagacctgccttcaacgaaatggacaacggcctcaggccctgccaccagaaacgatacacctcatgggtaggaaactcgagaagcctaacccagaaaaaaacgcatgggaacataacagccttacgatcccatctccggcatgcgcatctgaggcttccctggaggtaacagatctgcttttaaccgccctggaaaatcccgtaaagtacgccgaggacaacatggagcagaaggacacagacagaattatctgctcaactaatatcctgcataaaacagaccagactcttcgtcggatcgtttcccagacaatgaaagaggccaagggcaatcaggaagcatttagtgaaatgacatttaaacagaggtgggtgcgcgcaaaccacgctgccatctggcgcatcattttgggtaacgagcatataaagtgccgctccgccaaagtaggttggctgcagtgctgtagaatcgaaaaacggccactgagcactggctag

SEQ ID NO: 52855 - DNA, 870 bp, Artificial Sequence
  Description of Artificial Sequence: Synthetic coding sequence
atgaagacggccgagaatatcaggggtaccgggtccgatggtccccgtaaaagagggctctgcgtgctatgcggactgccagcagccggaaaatctacgtttgcacgtgccttggcacaccgacttcagcaggaacaagggtgggccataggagtggtggcttatgacgacgtgatgcccgacgcgtttctggcaggagctagagcgcgacccgctccttcacagtggaaactgctgagacaagaattgctcaagtatctggagtatttcctcatggccgtgatcaacgggtgtcagatgagtgtgccccctaatcggactgaggctatgtgggaagactttatcacctgtcttaaggaccaggacctcattttttccgctgcttttgaggcacaaagttgttatctgcttacaaaaactgccgtttctaggcctctgttcttggtgctggatgataacttctactaccagagcatgagatatgaagtttatcagctcgctaggaagtactccctcggcttctgtcaactctttctcgactgccccctagagacctgtctgcaaagaaatgggcagaggcctcaggccctgccccctgaaaccatccatctgatgggcagaaaattggagaaaccaaatcctgaaaagaatgcctgggagcacaacagcttgacgatcccatccccagcatgcgcaagcgaggccagcttagaggtgaccgacttgttgctgaccgccttggagaaccccgtgaagtatgctgaggataatatggagcagaaggtgaatttccagtgtaagttcaacgttaacgagaaagagcaacttttcgtcggcaggagtttcgaacctaacattaagtgcgagtag

SEQ ID NO: 52856 - DNA, 1080 bp, Artificial Sequence
  Description of Artificial Sequence: Synthetic coding sequence
taaatgaaaactgccgagaacatcagaggtacaggatcagacggtcccaggaaaagggggctttgtgtgttgtgtggtctacctgctgccggaaagagtacctttgcacgagccctggcgcacaggttgcaacaagaacaaggatgggccattggtgtggtggcatacgatgatgtgatgccagacgcttttctagcaggcgctcgggctcgaccagccccatcccagtggaagttgctgagacaagaactcttgaaatacctcgagtacttcctgatggctgtcatcaacggatgtcagatgtcagtgccaccaaacagaacggaagccatgtgggaagatttcattacttgcctgaaagaccaggatctgatcttctcagccgcttttgaagcacagtcatgttacctgctgacaaaaaccgccgttagccgtccactttttctcgtccttgacgacaatttctattaccaaagcatgcgatatgaagtgtaccagctcgcccgtaagtattcactgggtttttgccagctgtttcttgattgccctttggaaacctgcttgcagcgcaatggccagcgccctcaggccctgccccctgagacaatccatttgatgggacggaaactcgagaaacctaaccccgagaaaaacgcttgggagcataactccctgacaattcctagtccagcatgcgcaagcgaggcgagccttgaggtaaccgatctgctgctaaccgcattggagaatccagtgaagtacgcagaagataatatggaacagaaagatacagatcggataatctgcagtaccaatatccttcacaagactgaccagacactccggcgaatcgtttctcaaactatgaaggaagccaaagacgaacaagtactacctcacaacttaaagctcctagccgaagagctgaataaactcaaggccgagttccttgaagacctgaaacaggggaacaagaaatatctttgcttccagcagacaatcgatattccagacgtaatttccttctttcattatgaaaaggacaacatcgtacagaagtacttctctaaacaacattag

SEQ ID NO: 52857 - DNA, 7565 bp, Artificial Sequence
  Description of Artificial Sequence: Synthetic coding sequence
atggagccccacgttctcggagcagttctgtactggctgctcctgccctgtgcccttcttgccgcatgtctgttgaggttctctggccttagtctggtgtatttgttgtttctcctgctgctgccctggttcccaggacccactaggtgtgggctgcagggccatactgggaggctgctgcgcgctctacttggcctgtcactactttttctggtggcccacttggctctccaaatctgtctgcacatcgtgcctcgactggaccagcttctgggaccatcatgcagcagatgggaaacgttatcccgccatataggtgtcactcggctcgatctaaaggacatcccgaacgcaatccggctggtggcgccagatctgggtattttggttgtgtcttctgtctgtcttggaatctgcggaaggctggcccgtaatacgcgtcaatccccacaccccagagagctggatgatgacgagagagatgtggatgcaagtcctaccgccggactccaagaagctgcaactctagcccctactaggcggtcaagactcgcggctcgatttagggtgacggcccactggcttctcgtcgctgccggtagggtgcttgccgttacactgctggctctcgccggaatcgcccatccttcggcactgagcagcgtgtacctcctgcttttcctggccctgtgcacgtggtgggcctgccatttccccattagtacccggggtttctccagactgtgcgtcgctgtggggtgcttcggcgcaggacacctaatatgcctgtactgttatcagatgccactggcacaggctctgctgcctcccgcaggaatctgggccagagtgttagggctgaaagactttgtaggcccaactaattgctcctctccccatgcactagttttaaataccggcctggactggcccgtgtacgcctcccccggagtcctgttgctgctgtgctacgccaccgcctcattgcgaaagctgcgggcttacagaccttcagggcaaagaaaagaagccgctaaaggatacgaggccagggaactggaactggccgagctggaccagtggcctcaggagcgcgagtccgaccagcatgtggtacctaccgctcccgatacggaggccgataattgcatagtgcacgagctgacaggccagtcttcggtacttcgacgacctgtgcggccaaaacgcgcagagccacgcgaggcttctcccctgcactcactgggccaccttattatggatcaaagctacgtttgcgcactgatcgccatgatggtgtggagtattacataccattcttggctgaccttcgtgttgttattgtgggcctgccttatctggacagtgcgatctagacaccagcttgcgatgctgtgctcgccttgtatcttgctttatggcatgaccctgtgctgtctgaggtatgtgtgggctatggatcttcgccctgaactccctacgaccctgggtccagtgtccctaaggcagctggggctagaacacacccggtatccttgcttggatctcggtgccatgctcttgtatactctgactttctggctcctcctccgtcaattcgtcaaggaaaagctgcttaaatgggccgaatccccagctgcgctgaccgaggtgaccgtcgctgacacagagcctactcgcacacagactctccttcaaagtttgggcgagctcgttaagggggtgtacgccaaatactggatttatgtgtgtgcagggatgtttattgtggtctcattcgccggacgattggtggtgtacaagatcgtttacatgtttctctttttgctttgcctgaccctttttcaggtgtactacagcttgtggagaaaactccttaaagccttttggtggctagtggttgcgtacactatgctcgtactaatcgccgtgtatactttccagttccaggattttcctgcttactggagaaacctcaccggctttactgatgaacagcttggcgacctaggattggaacagtttagtgtgtcggaactctttagttccatcctcgtacccggatttttcctgctcgcctgcatcctacagctgcattacttccaccggcctttcatgcagctcacagacatggagcacgtatccctcccaggtactagactgccaagatgggcccaccggcaagacgccgtcagcggcacccccctcctaagagaagaacagcaggagcatcagcagcagcaacaagaagaggaagaagaggaggaagacagcagagatgaagggcttggagtggccactccccatcaggctacccaggttccggagggggcagctaaatggggactagtggccgagcgtctcctggagctcgccgcaggtttttctgacgtgctgagtagagtgcaggtctttctgcgcagactgttggaactccacgtattcaagctggttgccctgtacaccgtttgggtcgccttgaaagaggtatccgtgatgaatctactcctggtcgtgctatgggcttttgccctgccttaccctagattccgccctatggcctcttgtcttagcactgtgtggacctgtgtcataatcgtctgcaaaatgctgtatcagctgaaagttgttaacccccaggagtactctagcaattgtacggagcccttcccaaactccacaaatttattgccgaccgagatatcccagtctctcctctataggggaccggtggaccccgcaaattggttcggtgtgcgtaaggggttcccaaacctgggatacatacagaaccatctgcaggtattactcctgctggtgttcgaagcaattgtttatcggagacaagagcattatcggcgacaacaccagctggctccattgcccgcacaggccgtgttcgctagcggaacccgccagcaacttgaccaggacttgctgggatgcttgaagtacttcatcaacttcttcttttacaagttcggtttagagatctgctttctgatggctgtcaatgtaatcggacagcggatgaactttctggtaacattgcatggatgttggctggtggccatcttaacccgcaggcacagacaggccatagctagattgtggcctaattactgtctgtttctggctctgttcctgctgtatcagtatttattatgtcttggaatgccacccgctttatgtatcgactacccatggcggtggtcccgtgcagttcctatgaattccgcactcataaaatggttgtacctccccgacttcttccgcgctcctaatagcaccaacctgattagcgacttcttgcttctgttgtgtgcctctcagcagtggcaagtgttctcggccgaacggacagaagaatggcagaggatggccggtgttaacaccgataggctcgaacctctgagaggggaacctaaccccgtccctaattttattcactgccgctcctatctggacatgttaaaagtggccgtgttcagatacctattttggctggtgctggtggtggtattcgtaacgggcgctacgcggatctctattttcggcttggggtatctcctggcctgcttctacctgttgcttttcgggaccgccttgttacaacgtgatacgagagctcggctcgtgctatgggattgtttaattctatacaatgtgacagtcatcatttcaaagaacatgctaagcctgttggcatgcgtgttcgtggaacaaatgcagacaggtttctgctgggtgatacaactgttctccctcgtatgcacagtgaaggggtactatgaccccaaagaaatgatggatagggatcaagactgcctgctcccagtggaggaggcaggcattatatgggactcagtgtgcttcttctttctgctgctgcaaaggcgagtctttttgtctcattactacctgcacgtgcgggctgacttgcaagccacagcattgttggcatcccggggttttgcactgtacaacgctgctaacttaaagtctatcgatttccaccggagaatagaggaaaaatctctcgctcagctgaagcgccagatggagcggatcagggctaagcaggagaagcatcgccagggcagggttgacagaagtagaccccaggatactcttggaccaaaagaccctgggcttgagccagggcctgactcacccggaggcagttctcccccaagaaggcaatggtggcgcccttggttggatcacgccacagtgattcacagtggcgattactttctgtttgagtctgactctgaagaagaggaggaagcagtcccagaggacccacgcccatcggcccaatctgcctttcagctggcttatcaggcttgggttaccaacgcccaggctgttctccgtcgtcgtcagcaggagcaggaacaagccaggcaggagcaggccggacagctccccactggcggaggaccatcccaggaagtggagcctgccgagggcccagaagaagccgctgccggacgctctcatgtggtgcaaagagtactgtccacagctcagttcctgtggatgctgggacaggctctagttgatgagctcacacgatggctccaagagttcacgcggcatcacggcactatgtctgatgtgctaagggctgagcgttatcttctaacacaagaacttctgcaagggggtgaagttcatagaggagtgctggatcagttatatacctctcaggcggaagcgaccctcccgggtcccacagaagctcccaacgccccatccactgtatctagcgggctcggagccgaggagccactaagtagtatgactgacgatatgggtagtcctctttcaacaggttatcacaccagaagcgggagcgaggaggccgtgaccgaccctggggagcgcgaggccggtgctagtttgtaccagggccttatgagaaccgcatcggaacttttgttggaccggaggcttaggatcccagagctcgaggaggccgagctgttcgcagaaggccagggtagggcactccgcctgctccgcgcagtgtaccagtgcgtcgccgctcactccgagcttctctgctatttcatcattatattgaatcatatggtgacagcttcagccggtagcctcgtgctgcctgtgcttgttttcctctgggctatgctgtccattccccgtccctccaaacgtttctggatgaccgcgatcgtgttcaccgaaattgcagtggtggttaagtacctgttccagttcgggtttttcccatggaattcccatgtggtgcttagacggtatgagaataagccctattttcctccaaggattctcgggctcgaaaagacagacggttacattaagtatgatctggtgcaactgatggcactcttttttcacagaagccaactcctgtgttacggcctctgggatcacgaggaggatagtccttctaaagaacacgacaaaagcggcgaagaggaacaaggggcagaggaaggtcctggcgttccagcggctacaaccgaggaccatattcaggtggaagcaagggtcggcccaactgatggaacccccgagccccaggtcgagctgaggcccagggacacccgcagaattagcctgaggttccgccgtcgcaaaaaggagggaccggcaaggaagggggctgcagcaatagaggcggaggatcgggaggaggaggagggcgaggaagaaaaagaggccccaactgggagagagaaaagaccaagccgctccgggggacgggtccgggctgcaggcagaaggctgcagggattttgtctttcactagcccaggggacatatagacccctgcggaggttttttcacgacattttacacactaagtatcgcgcagcgactgatgtgtatgccctgatgtttctggcagacgttgtggatttcataattatcatcttcggcttctgggcctttggaaagcactctgcagccacagacataacatcctccctgagcgatgatcaggtccctgaggccttcttagtgatgttgctcatacagttttcaaccatggtggtggatcgggcactttaccttagaaagactgtgcttggaaaactcgcattccaggtggccctggtgctggcaatccacttatggatgtttttcattttaccggctgtgacagagcgtatgtttaatcagaatgtcgtggcgcaactatggtacttcgtcaagtgcatctactttgcactgtctgcctatcaaatccgatgcggctaccctacaagaattttgggaaacttcctcacaaaaaagtataatcacctgaacctgttcttgtttcagggctttagactagtcccctttctggtcgagctccgagccgtcatggattgggtgtggacagacacaacgctgtctttgtcctcctggatgtgtgttgaggatatctatgccaacatttttataatcaaatgcagccgcgaaactgaaaaaaagtaccctcagcccaaagggcaaaaaaagaaaaaaatagtgaaatacggcatggggggtctcattatcctgtttctgatagccatcatctggtttccactcctcttcatgtctctcgtcaggtcagtcgtgggagtcgtgaaccagcctattgatgtgaccgtgaccctcaaactgggcggatatgaaccactgtttacgatgagtgcccaacagccatctataattcccttcacagctcaggcgtacgaggagctgtcccgacagtttgacccccagcccctcgcgatgcaatttattagccagtactctccagaggacatcgttactgctcagattgaggggagcagcggtgctctttggaggatttctccaccttctcgcgcacaaatgaagcgtgagctgtacaatggaaccgcagacatcacactgagatttacatggaacttccagcgcgacctggccaagggtggaaccgttgagtacgctaatgagaaacatatgttggctctagcacctaacagcaccgcaaggcgtcaactggcgtccctgcttgaaggtaccagtgatcagtccgtggtgatccctaatctgttcccaaaatatatccgtgcacccaatgggccagaagccaatcccgtaaagcagttgcagccaaatgaagaggcagactatctcggggtgcggatccaattgcgaagagagcagggggcaggagcaaccgggttcctagagtggtgggtcatcgagctccaggaatgcaggacagactgtaatcttctgcccatggttattttttcagacaaagtgtcaccgccaagtcttggcttcttagccggttacggtataatgggactgtatgtgagtatagtgttggtgattggtaaattcgtgaggggctttttctcagagataagccattccatcatgtttgaggaactcccatgcgttgatcggattctaaagctgtgccaggacattttccttgtccgggagaccagagagctcgagctggaagaagaactctatgccaaactcattttcctgtatagatcgcccgaaaccatgatcaagtggactagagagaaagagta

SEQ ID NO: 52858 - DNA, 1122 bp, Artificial Sequence
  Description of Artificial Sequence: Synthetic coding sequence
atgaagatttgccccttttcaagcaagagcagcattgtcctggcactgaagtttcgatctttgattcattttgagaagtacccccagccaaaggggcagaagaaaaagaaaatcgtgaagtatggcatgggagggctgatcattctgtttctcatcgctataatttggtttcccctgctgttcatgtctcttgtcaggtccgtcgtgggcgtggtgaatcagcccatcgacgtgaccgtgacattgaagctgggaggatacgaaccgttatttacaatgtctgcacaacagccttctataattccttttacagcacaagcttacgaagagttatcaagacagtttgatccgcaacctctggccatgcaattcatatcacagtactcgcctgaagatatcgtaaccgctcagatcgagggcagtagtggcgctctttggcggattagtccgccatccagagcccagatgaagagggaactctataatggtacagctgatatcactctgcgctttacgtggaattttcagcgcgacttagctaagggcggaactgtcgagtacgccaatgagaaacatatgctcgcactggcacccaactccaccgctaggcgacagctggcttcgctgttagaaggcacaagcgatcagagcgtggtaataccaaacttgttccctaaatacatcagagctccgaatgggcctgaggctaaccctgtgaagcaactccagccaaacgaggaggcagattacctgggcgtgaggatccagctgagaagagaacagggagccggagctaccgggtttctggaatggtgggtgatcgagttgcaggaatgcagaactgattgtaacctgctgcctatggttattttttccgataaacaccacggagccgtgagagtgcacagagctgggcaccgccaggtgagagcacgcattctgcagcgagaccttgcactgcactatgtacgcggagctgctgtacgcggacctcatccacaggccctgccaggacacctgcccggagctggtgattccggagcaggcgctgggggtggagtagtgaggcaggcccacctccctttgccgctgacaggcgaccacgatcaggttgatagctag

SEQ ID NO: 52859 - DNA, 7403 bp, Artificial Sequence
  Description of Artificial Sequence: Synthetic coding sequence
tagacaggcaggttgctacgagcactgctcgggctctcactgctgttccttgtggctcacctagctctgcagatctgccttcacatagttccaagactggaccagttgctgggaccatcttgcagccggtgggagaccttatcccggcacatcggagtgactcggctggatctcaaggacatccctaacgctatccgattggtcgctcctgatctaggtatccttgtggtttccagcgtgtgcctggggatttgtggtcgactagcaaggaacacccggcagagcccccatccacgcgagttagacgacgacgagcgtgacgtcgatgcaagtcctaccgccggactgcaggaggcagctacactagcgccaacgcgcaggtcgcggctggcggcaaggttcagagtgacagcccattggctcctggtcgctgctggtcgcgtgttggctgtcacgctcctggccttggcaggcatcgcacaccctagtgccctgtcctctgtctacctgcttctgtttctcgctttgtgtacctggtgggcctgccactttcctatctccacaaggggcttctcgcggctgtgcgtggctgtgggttgctttggagccggacatctgatctgcctctactgttaccagatgcctctggcccaggctttgctccccccagcaggtatttgggcgagggtgctgggcctgaaagattttgtagggccaacaaattgcagctcaccccatgcactggttttaaacactggtctggactggcccgtgtatgcctcacccggtgtgttattgctgctgtgctatgctaccgcatctttgcgaaagcttagggcctaccgaccgtccggccagcggaaagaagccgctaaaggctatgaggcccgagagcttgagctggctgagctggaccagtggcctcaggaaagagagtctgaccaacatgtggtccctaccgcccctgacacagaggcagacaactgtattgtgcacgagctcacaggacaaagttcagttctccggagacctgtccggcctaagagagcagagccacgagaagcctcccctctgcactctctcggccatcttatcatggaccaatcgtacgtctgtgccctgatagcaatgatggtgtggagtatcacttaccactcgtggctcacttttgtgctcctgctctgggcctgcttaatctggacggtgaggtcaagacatcagcttgctatgctgtgtagcccatgcatcttattatacggcatgaccctgtgttgcctgcgttacgtttgggcgatggatctgcgacccgagctgccgacaactttaggccctgtctccctacgccagctgggtctggaacatactcgatatccgtgccttgatttgggcgcaatgttgctctatacactgaccttctggcttttacttcgccagtttgtgaaggagaagctgctcaaatgggctgaatcacccgctgccttgaccgaggttaccgtcgcagatacggagccaaccagaacacagacgctgcttcagagcctgggtgagctggttaagggagtttatgctaagtattggatatatgtatgtgcaggcatgttcattgtggtgtccttcgccggaagactagtcgtgtacaagatcgtttatatgtttctgtttctgttgtgcctgactcttttccaggtgtattactctctgtggcgtaaactactgaaggctttctggtggctagtcgttgcttacacaatgcttgtcctcattgctgtgtacacattccaatttcaggattttcctgcctattggcggaatcttactggattcactgacgaacagctgggagatttagggcttgagcagtttagtgtcagcgaattgttttcttcaatcttggtgccaggctttttccttctggcttgcatacttcagttacactactttcacagacccttcatgcagctgactgacatggagcatgtgtcactgcctggaacaagactgcctcgctgggcccaccgtcaggatgccgtgtcagggacacctttactaagagaagaacagcaggagcatcagcagcagcagcaggaagaagaggaggaagaagaggatagccgggacgagggcctgggggttgctaccccacaccaggcaactcaggttcccgagggcgctgccaagtggggacttgttgctgaaaggctcctagagcttgccgctggattttccgacgtgttgagccgggtccaggtctttctgcgccgactgctggagcttcatgtgtttaaactcgttgccttgtataccgtgtgggtggccctgaaggaagtgtcagtgatgaacctcctgcttgttgttctgtgggccttcgccttgccttatccgcgtttcagacctatggcatcgtgtttgtccacagtttggacttgtgtcataattgtttgcaagatgttgtaccagctgaaggttgtcaatccccaggagtattcctcgaactgcactgagcctttcccaaactccactaacctgcttccgactgagatttctcaatctctgttgtaccggggacccgtggacccggctaattggtttggggtgcggaagggttttcctaatctgggatatattcagaaccaccttcaggttctccttctccttgtgttcgaggctattgtataccgccgtcaggagcactaccgacgccaacatcaactggctcctctgccggcacaagccgtattcgctagcggtaccagacagcaattagatcaggacctgctgggatgtttgaaatacttcatcaactttttcttctacaagttcggtctggaaatctgtttcctcatggcagtgaatgtcattggacagcggatgaattttctggtgacactgcacggatgctggctagtggccatcctcacccgacgccaccggcaggcgattgcacgactctggcccaattactgtctgttcctggcactctttcttttataccagtatttgttgtgtctgggaatgccgccagcattgtgtatcgattatccctggaggtggagcagagccgttccaatgaattctgctctgataaagtggctctatctccccgattttttccgcgctcccaacagtactaatctgatttctgatttccttctgctgctttgcgcttcccagcaatggcaagtgttctctgctgaacggacagaggaatggcaacgcatggccggagttaacaccgatcggctggagccactgcgcggagagcccaacccagtgcctaacttcatccactgccggagctatctggacatgctgaaagtcgcagtgtttaggtatctcttctggttagtgctggttgttgttttcgtcactggtgcgactagaatcagcattttcggcttaggctacctgctggcctgtttctacctcctgctgtttggcacagccctgctccagcgggatacccgcgctcgactggtcctgtgggactgtcttatcctgtataatgtaaccgtcattatcagcaagaatatgttgtcactgctcgcttgtgttttcgtggagcagatgcagaccggattttgctgggtcatccaactcttcagcctcgtatgcacagtgaaagggtactatgaccctaaagaaatgatggatcgcgaccaggactgcctgctgcctgtggaggaggcgggaatcatttgggacagcgtctgctttttcttcctccttttacagcgtcgggtgtttctcagccattattacttgcacgtgagagccgatctacaggccacagctctactggcgagcagaggcttcgccttgtacaatgccgctaaccttaagtctattgacttccaccggcgaatcgaagagaaaagcctagcccaattgaagaggcagatggagagaataagagctaagcaggagaagcacaggcagggaagagtcgaccggtcccggccacaggacacactgggaccgaaagaccccggactcgagcccggaccagactccccgggtgggagcagcccacctaggcgtcagtggtggcgaccctggttagaccacgcaactgtgatacactcgggtgattatttcctgttcgaaagtgattccgaggaggaagaggaggcggtgccagaggaccccagaccatccgcccagtctgccttccagctcgcttaccaggcctgggtcactaatgcgcaggctgtccttagaaggcgacagcaggaacaggagcaggccagacaagaacaagctgggcaattaccgacaggaggagggccttcacaagaggtggagccagcagagggtcccgaagaagccgcagccggacgatcccacgttgtccaacgtgtgctaagtacagcccaattcctttggatgctgggtcaggctctggtggacgagctcactcgatggctgcaggaatttacgcggcaccacggcactatgtcagacgtgctgcgggcagaaaggtacctcctaacccaggagttgctgcagggaggagaggtccacaggggagtgcttgatcaactgtacacctcacaggctgaggctacactcccaggcccaactgaggcccctaatgccccaagtacagtgagttcagggctaggggctgaggaacccctgagtagcatgacggacgatatgggcagtcctctctctacaggctaccataccaggtctggtagtgaagaagcggtcacggacccaggggagcgggaggccggagccagcctgtaccaaggcttgatgcggactgctagcgagttactacttgatcgcagactgaggatacctgagctagaagaagctgaattgttcgctgaaggccaggggagggccttacgcctgttgagagcagtttaccagtgtgtggctgcacattccgagctcctgtgctattttatcataatacttaatcatatggtgacggcctccgctgggtcccttgtactgccagttcttgtgttcctttgggcaatgctgtctataccaaggcccagtaagcgattttggatgacggctatcgtgttcacagagattgcagtagtggttaaatatctttttcagttcggatttttcccctggaacagtcatgtggtcctgagacgctatgaaaacaaaccatatttccctcccaggatcttagggttggaaaagacagacgggtacatcaaatatgacctggttcaattaatggccctcttcttccaccgttcgcaactgctgtgttacggtctctgggaccatgaagaggacagcccatccaaggagcatgataagtctggggaagaggaacagggtgccgaggaggggccaggggtccctgccgcaaccaccgaggaccatattcaagttgaggcgagagtcggtcccaccgacgggactcctgaacctcaagtggaactcaggcccagagacactcgacgtatcagtttaaggtttagaaggcggaagaaggagggcccagcccgaaaaggcgcagccgcaatcgaagccgaggaccgcgaggaggaggaaggagaagaagaaaaagaggcaccaacaggaagggaaaagcggccaagtcgatctggcggtagggtaagggccgctggccgaagacttcagggcttttgcctgtcgcttgcacaaggtacatacaggccgctccgtcgctttttccacgacatccttcatacgaagtatagagccgcaactgacgtgtacgccctgatgttcctcgccgacgtcgtcgacttcattataatcatctttgggttctgggcttttgggaaacacagtgccgcaacggatattacatcctctcttagcgatgatcaggtccccgaggccttcctggttatgttgctcatccaattttctacaatggtcgtggaccgcgcattgtatctcaggaaaactgtcttgggcaagctggcctttcaggtcgccctggtcttagcaatacacctgtggatgtttttcatcctgccagccgttaccgaacgcatgttcaatcagaatgtcgtggctcagctgtggtactttgtaaagtgcatctactttgcattaagtgcctatcaaatacgttgcgggtatcccacacggatcctgggtaatttcctaactaagaaatacaaccacctgaacttgttcctgttccaggggtttcgactggtcccgttcctcgtagaacttagagccgttatggattgggtgtggacggacaccacactaagccttagttcctggatgtgcgtggaagatatctacgccaacatctttatcattaaatgctcccgagagactgagaagaaatatccccagcccaagggccagaaaaagaagaaaatcgtgaaatacgggatggggggtttgatcattctctttctaatcgccatcatttggttccccctgttattcatgtctttagtgcgttccgtggtgggagttgtgaatcaaccaattgacgtcacagtgaccctgaagctcgggggttatgaaccactgttcaccatgtccgcacagcagccctctattatccccttcaccgctcaggcttatgaagagctcagtcggcagtttgatccacagcctctggcaatgcaattcatatcccagtatagtcccgaggatatcgtgactgcccagatcgagggaagtagtggcgcactctggaggatttccccacccagcagagctcagatgaagcgtgagttgtacaacggcactgctgacattaccttgaggtttacatggaacttccagcgggacttggccaaaggaggcacggtggagtacgccaatgaaaagcacatgttggccctggccccaaattcgacagcccgtcggcagcttgcctctctgttggaggggactagtgatcaaagcgtagtgattcctaacttgttccctaagtacatacgagctcccaacggcccagaagctaaccccgttaaacaacttcagcctaatgaagaggcagattatctaggtgtgcggatccaactccggagggaacagggggcaggggcaaccgggttcctggaatggtgggtaatcgagttacaggaatgccgcaccgattgcaaccttctgccaatggtgatcttttcggataaggtatctcctccaagtctggggtttttagctggttacggcatcatggggctgtatgttagtattgtgctggtgatagggaagttcgtacgcggttttttttccgaaatttcccattctataatgttcgaagaactgccttgcgtcgatagaattttgaaactgtgtcaggacatttttctggtgcgagaaacccgcgagctcgagctggaagaggaattgtatgctaaattgatattcctgtatagatcaccggagaccatgattaaatggactagggaaaaggagta

SEQ ID NO: 52860 - DNA, 1665 bp, Artificial Sequence
  Description of Artificial Sequence: Synthetic coding sequence
atgccagattacaggactagggctctgtttgtgcagtccaccctgggcgattcagccggacctgagctccagctgctatccatcgttccgggaagagacctacagccaagcgactcctttactgctagttcaagcccgccaccgtccgtctggagcgagctggaacatattaggggtaaatccgaggccactactgagctgaaacgcccttctctgccaggaagtatacattcttgcctatgcggagtctggtgtggggtggggaagcgcacaccatcatccttggtgtcctcccttcaggacctggaactcttgggccagcgccagcggcagctgtggatggagtctactcctcgccctccctataaccccttcttggtgccttgcacacctgtcgggaagctttcggctgaacacggcggacccactcggaagatgccgccatccgcatccgccgttgacttttttcagctgtttgttcctgacaatgttttgaaaaacatggtggtacagaccaatatgtacgcgaagaagtttcaggaacggttcggatcagatggagcctgggtagaagtcacactgaccgaaatgaaggcatttcttggatacatgatctcaacctctatttctcattgcgagtccgttctgtcaatctggtccggtggtttctactctaaccgctctcttgccctggtgatgagccaggccagatttgagaaaattttaaagtacttccatgtggtggcgttccggagctcacaaacgactcacgggctgtataaagtccaaccatttctcgacagcctgcagaattcttttgactccgcattccggccaagtcagactcaggtcctccacgagcccctgattgatgaggacccagtttttattgccacatgtacagagagagagttgaggaaacgtaagaaacgaaagtttagcctttgggtccggcagtgtagctccactggtttcatcatccagatctacgtacatctcaaagagggcggtggcccagacgggttggacgctctgaaaaataaaccccaactgcactcaatggtggcaagatcactctgtcggaatgctgcgggtaagaattacattatcttcacgggaccttccataacatctctcacgctgtttgaagagtttgaaaagcagggcatctattgttgtggcctgctgagagcgaggaaatccgattgtacaggactcccactctccatgctcacaaatcccgctacgcccccagcgcgaggccagtaccagatcaagatgaaaggcaatatgagcctgatctgttggtataacaaaggccatttcaggtttctaacgaacgcttacagccctgtccagcagggagtaattatcaagcgaaaaagcggggagatcccctgtccactcgcagtggaggctttcgctgcccacctgagctatatttgccgctacgatgataaatacagtaaatacttcataagccataaacctaacaagacatggcagcaggtcttctggtttgcgatcagtatcgccatcaataatgcgtacatcctgtacaagatgagcgatgcttatcatgtaaaaaggtactcccgcgctcagttcggcgaacgactggtacgggagctgttagggctggaggacgcctctccgacacattag

SEQ ID NO: 52861 - DNA, 1368 bp, Artificial Sequence
  Description of Artificial Sequence: Synthetic coding sequence
atgccagattaccgcactcgcgctctgtttgtgcaatctaccctcggcgactcagccggtcctgagctccagctactcagcattgtgccaggacgcgatctgcaaccttctgattcattcacggggcctacgcggaagatgcccccttctgcttcagcagtggactttttccagctcttcgttccagataacgtgttaaagaacatggtcgtccagaccaacatgtatgccaagaaatttcaggagcgtttcggctctgacggcgcatgggtggaggtgacactgactgagatgaaggcatttctggggtacatgatttctacgtcaatctcgcattgtgagtctgtgctcagcatttggtccggcggtttctactccaaccgtagtctggcccttgtcatgagccaggctcgcttcgagaaaattctcaagtatttccacgtcgttgccttcagaagctctcagaccacccatggactctacaaggtacaaccatttttagattcactgcagaattcttttgatagtgcattccgaccttctcagacacaggttctccatgagcctctcatcgatgaagacccggtgtttatcgccacatgcacagagagagagcttaggaagaggaaaaagcggaaattctctttgtgggtcaggcagtgcagttcaacaggattcattatccagatatacgttcacctcaaggagggcggagggccagatggacttgacgctctgaaaaataagccacagttgcattcgatggtcgctcgcagcctgtgtaggaatgccgcaggcaagaattatatcatatttacaggcccatccataacgtccttgactctgttcgaggagtttgaaaagcaggggatctactgctgtggcctgttaagggccaggaagagcgattgcactggtctgccactgtccatgctgaccaacccagctacccctcctgcccgaggccagtaccagataaagatgaaaggtaacatgtccctgatctgctggtacaacaaaggtcacttccgcttcctcaccaatgcctattcacccgtccagcagggggtgatcattaagcggaagtccggagagatcccatgcccgctagccgtcgaagcctttgcagctcacctctcctacatctgtcggtacgatgataagtatagtaagtactttatctctcacaagccgaataaaacttggcagcaggtgttctggttcgccattagtatcgctatcaataacgcatacattttgtataagatgagcgatgcttaccacgtgaagcggtatagtcgcgcacagttcggagagagattagttagagagcttctgggccttgaagatgcaagcccgacccactag

SEQ ID NO: 52862 - DNA, 3114 bp, Artificial Sequence
  Description of Artificial Sequence: Synthetic coding sequence
atgagcccgccactctgtccactcctgctgctggccgtaggcctaaggttagcaggaacgctgaatccctcagatcccaacacctgttcattctgggagtcattcactacaactacaaaggagagccactccaggccttttagtttactgccttctgaaccatgtgagcgcccttgggagggaccccacacctgtccacagccaactgttgtttatagaacagtatatcggcaggtggtgaagacagatcataggcaaagactgcagtgttgccatgggttctacgaaagtcggggattctgcgtgccactatgtgctcaggagtgtgtgcatgggaggtgcgtcgcacctaatcagtgccagtgcgtgccaggatggaggggggacgactgtagctctgaatgtgcaccaggaatgtggggacctcagtgcgataaaccttgcagttgcggcaacaacagcagctgtgatccaaagagcggagtgtgctcttgtccatccggactgcaaccacctaattgcctgcagccttgcactccaggatattacggccctgcgtgccaattccgctgccagtgccacggagcaccgtgcgacccccagacaggagcctgtttttgcccagcagagcggaccggaccatcctgcgatgtttcctgttcccagggcacctccggctttttttgtccttctacccacagttgccagaatgggggtgtattccagacaccacagggaagttgctcttgcccgccaggctggatgggcacaatttgcagcctgccttgcccggaagggttccacgggccaaactgtagccaggagtgtcgctgtcataatggaggcttatgtgacaggttcacggggcagtgtaggtgcgcgccaggctacactggcgatcgctgccgggaggaatgccccgtcggcaggttcggtcaggattgcgccgagacttgtgattgcgcacccgacgccaggtgctttcccgctaatggcgcttgtctttgcgaacacggttttacgggcgatcgctgcacggatcgcttatgcccagatggattctatggactgagctgtcaggccccatgcacctgcgatagagagcactcgctcagctgccacccgatgaatggcgagtgtagctgtctgcccggatgggcaggcttgcattgtaacgaaagctgcccccaggatacacacggaccaggctgccaggaacattgcctgtgtctacacgggggagtgtgtcaggcgacttccggcctgtgtcagtgtgctccagggtacacaggaccacactgtgctagcctatgtcctcccgacacttacggtgtgaactgttcggcccgatgctcctgcgaaaacgctattgcatgctccccaatagacggagagtgcgtgtgcaaagaagggtggcagcgcggaaactgttcggtcccgtgcccccctgggacgtggggattcagttgtaatgcatcctgtcagtgtgctcacgaagctgtttgctcccctcagactggcgcttgcacttgtactcccggatggcacggcgctcactgccagcttccatgccctaaagggcaatttggtgagggctgcgcctcccgatgtgactgtgaccacagcgatggttgcgaccccgttcacggcagatgccaatgccaggcaggctggatgggagccaggtgccatctgtcctgcccagagggcctgtggggcgtgaactgttctaacacctgcacatgtaagaacggaggtacctgtctgcccgaaaatgggaattgtgtctgtgcacctgggttccggggtccttcatgtcaacggtcttgccagcccggaagatacggaaaacggtgtgttccatgtaagtgcgctaaccattctttctgccatcctagcaacggcacctgctactgcttggcgggatggacaggccctgactgcagtcagccttgcccacctggtcattggggcgaaaactgtgcgcagacgtgccaatgccatcacggcggtacttgtcaccctcaagatggttcctgcatttgcccgctgggttggaccggtcaccactgtctggagggatgtcccctaggaaccttcggggcaaactgctcccagccctgtcagtgtggacccggagagaagtgtcatcccgagacaggcgcttgcgtatgtccccctggtcacagcggagccccttgtcggattggcatacaggaaccttttaccgtgatgcctactacccctgtggcctataattcgctgggggctgtgatcgggatcgccgtgctaggatccctggtggtggcactggtcgcactgttcatcggctacagacattggcaaaagggcaaagaacatcaccacttggccgtagcctactcatccggcagactggacggtagcgagtacgtgatgccggacgtgcccccatcgtatagccattactatagcaacccaagttatcacaccctttctcaatgcagcccaaatccaccccctcccaacaaggtcccaggtccactcttcgccagcctccagaaccccgaacggccaggaggggctcaaggccacgacaatcacaccacactgccagcggactggaaacatagaagagaaccccctccaggtccgctggatcggggatcttccagattagaccgctcttacagctactcttattccaatggccctggcccattttataacaagggcctaatttcagaggaggagctcggcgcttctgtcgccagcttgagcagtgagaacccatatgctaccatccgagacttaccatccctccctggtggacccagagaatccagttatatggagatgaaaggcccaccctctgggtcgccacccagacaacccccacagttctgggactctcagagacgcaggcaaccccagcctcagcgggatagtggcacgtacgaacagccatcccccttgatccacgaccgggacagcgtcggtagccagccaccacttcccccaggcctgccccctggccattacgatagccctaagaattcccatatcccaggccattatgatttgccgccagtgagacacccaccatctccgccactaagacgtcaggaccgatag

SEQ ID NO: 52863 - DNA, 3114 bp, Artificial Sequence
  Description of Artificial Sequence: Synthetic coding sequence
atgtctcccccactctgtcccttgctactgctggccgtaggcctgagactggctggtactctcaacccaagcgaccctaacacatgctccttctgggagtccttcaccacaacaaccaaggagagccattcaagaccattcagccttctgccttcagagccatgcgagcgcccttgggagggcccacatacttgccctcagccgaccgttgtataccgcaccgtgtaccgacaggtcgtcaaaacagaccacagacagcggctgcagtgttgccacggcttttacgaatctcggggattttgtgttccactgtgtgcccaggaatgtgttcatggcaggtgtgtggctcccaaccagtgccaatgtgtgcccggatggagaggcgatgattgtagttcagagtgtgctccagggatgtggggcccacagtgcgacaaaccatgctcctgcggaaataactcctcctgcgaccccaagtcgggtgtgtgtagttgccccagcggcctccaaccccctaactgtttgcagccttgtacaccagggtattacgggcctgcatgccagtttaggtgtcagtgccacggggctccttgcgacccccagacaggagcttgcttctgtcctgcagaacgcaccggccctagttgcgacgtgtcctgttctcaaggtaccagcgggttcttctgtccaagcactcacagttgtcagaacgggggagttttccagacaccgcagggctcctgctcatgcccgcctggatggatggggaccatctgtagtcttccctgtcctgagggtttccatggtcccaactgctcgcaggagtgcagatgccacaatggaggactgtgtgaccggttcaccggccaatgcaggtgcgcacccggatacactggcgaccgatgtagggaggagtgccctgttggcagattcgggcaggactgcgcggagacatgcgactgcgccccagatgcccgatgcttccctgcaaacggggcttgtttgtgcgagcacggcttcaccggagatcggtgtacggataggctgtgccccgatggattttatgggctgagctgccaggccccttgtacctgtgatcgggaacacagcctcagctgccatccaatgaacggggagtgtagctgcctcccaggttgggccggattacattgtaatgagtcttgcccacaggacactcacggccctgggtgccaagagcactgtctttgtctacacggaggcgtatgccaggccacctccggactctgtcagtgcgccccaggatacacgggccctcactgcgcatcgttgtgcccacccgatacatacggagttaattgctcagctcgatgctcatgtgagaatgcgatagcctgtagtcctatcgacggggaatgcgtatgcaaggaaggctggcagcggggaaactgctccgtgccttgccctccaggcacatggggattcagctgcaatgcttcttgtcaatgtgctcacgaggctgtgtgtagtccccaaacaggggcatgtacctgcacccctggatggcacggagctcattgtcagctcccctgcccgaagggacagttcggcgagggttgcgccagcagatgcgattgcgatcactcagatgggtgcgaccccgtccacgggaggtgccagtgtcaggccggttggatgggcgctcgttgccacttgtcctgtcctgagggactctggggtgtgaattgctctaatacatgcacttgtaagaatggcggtacatgccttccagagaatggcaactgcgtctgtgcccctggcttccggggaccatcatgccaaaggagttgtcagcctggccgttatgggaagcgatgcgtcccttgtaaatgtgctaaccactcattttgtcacccatctaacggaacttgctactgtctcgcaggatggactgggcctgactgctctcagccctgccccccaggtcactggggggaaaactgtgctcagacttgtcagtgtcaccacgggggaacgtgtcatccacaggacggaagctgtatttgtcctctcgggtggactggccaccattgtttggaagggtgtccgttgggaacgttcggagctaattgttcccagccctgccagtgcggcccaggagagaagtgccatcccgagaccggggcatgtgtgtgtccaccgggtcattcaggagctccatgccgtatcggtatccaggagccctttaccgtgatgccaaccacaccggtcgcctacaactctctgggggctgtgattgggatcgcggtgcttggctcccttgtggtcgcactggtggccctctttataggatataggcactggcagaaagggaaagagcaccatcatctggcagtggcctattcatctggcaggctggacgggtcagaatacgttatgcccgatgtcccgccaagctatagtcattattactcgaatccctcataccataccctaagccagtgttcacccaacccgccaccccctaataaagtgcccggacctctctttgcctctctgcagaaccctgaacgtcctggcggagcacagggccacgataatcatacgactctgcctgcggactggaaacatcggagagaaccccctcccggacccctcgacagaggcagttcgcgccttgaccggtcctactcctactcttacagcaatggacctggaccgttttataataaggggcttatcagcgaggaagagttaggcgcaagtgttgctagtctgtcgtctgaaaatccctacgccaccatccgtgacctgccatccttacccggtgggccacgagagtcctcttatatggagatgaaaggacctccgtcaggatcgccgcctcggcagcctcctcagttttgggattcccagcgcagacgacagccacagccacagcgagactccggaacatacgagcagcccagccctctcatacacgacagagatagcgtcggtagtcagcccccactccctccaggcctgcccccaggacactatgattcaccaaaaaactcacacatccctggacactacgatctcccacctgtgcggcaccctccgtccccacctctccgtaggcaggacagatag

SEQ ID NO: 52864 - DNA, 522 bp, Artificial Sequence
  Description of Artificial Sequence: Synthetic coding sequence
atgagcccccctctgtgtcccttactgctcttggcagtaggcctccggctggcgggtaccttgaacccttctgacccaaatacgtgttccttttgggagtcattcactactactaccaaggagagtcactctcggcctttcagcctgctgccgtcggaaccatgcgagagaccttgggaggggcctcacacctgcccccagccgactgtggtctatcgtaccgtctataggcaggtcgtgaagacagaccaccgacagaggctgcaatgctgtcatggcttctatgagagccggggtttttgcgtacccctctgtgcccaagagtgcgtgcacggacggtgtgtcgccccaaatcagtgtcagtgcgttcccggatggagaggcgacgactgctccagcgagtgcgcccctgggatgtggggccctcagtgtgacaagccttgctcatgtggaaataattcttcctgcgatcctaagtccggcgtttgttcctgtccttcaggcctgcagccaccaaactag

SEQ ID NO: 52865 - DNA, 2316 bp, Artificial Sequence
  Description of Artificial Sequence: Synthetic coding sequence
atggaagaggataaactgttgagcgcggtgccggaggagggggatgctacacgcgaccccggtcctgaaccagaggaagaacccggagtgaggaacggaatggctagcgaaggcctgaatagcagcctgtgctctcctggccatgagcggcgagggaccccagctgacaccgaggagcctaccaaggacccggacgtcgcgttccatggcctttcactggggctttccctgacaaacggactagctctcggacccgaccttaacattctcgaagattctgccgagtcgcgaccatggcgcgctggcgttctggccgaaggggacaacgcatctaggtccctttaccccgatgccgaggatcctcagctgggcctcgacggccctggggaacccgatgtcagggatggcttctcagctaccttcgaaaagatcctcgagtccgaattgctacggggtacccagtattcttcactggacagcctcgatggcctgagcctgacagacgagtccgacagttgtgtgtcattcgaggctccactgactccacttattcaacagcgggcacgcgactcacctgagccaggagccggactcggcattggagacatggccttcgagggcgacatgggggcagccggaggcgacggtgaattgggaagccctcttagacgatcaatttcctcttccagatctgagaatgtgctcagtagactttctttgatggcaatgcctaacggcttccatgaggacggtccccaaggaccaggcggagacgaggatgacgacgaggaagacaccgataaacttcttaacagcgcatctgacccgagcctgaaagatggactttctgattccgatagtgagctgtccagttctgaggggcttgagcccggttccgccgacccactggcaaacgggtgccaaggagtgtccgaagccgctcatcgtctcgccaggcgcctgtatcacttagagggatttcagcggtgtgatgtcgcccgtcagctggggaaaaacaatgagttcagccgactcgtggcaggggagtacttaagtttttttgatttttctggattgactctggatggggcacttcggacattcctgaaggcctttcccttgatgggtgaaactcaagagagggagcgagtgctgacccatttttctcggagatactgtcaatgtaaccccgacgatagtacgagcgaagacggcatccacacactgacgtgtgctcttatgctccttaacactgacctgcacggacataacatcgggaagaagatgagttgtcagcagttcattgctaacttagatcaactgaatgatgggcaagatttcgcgaaagatttgttgaaaacgttgtataacagtatcaagaacgaaaagttggaatgggccattgatgaagatgagttgcgaaaatcactatctgagctggtcgacgataaatttggcactggcactaagaaagtcaccaggattctggacggcggaaacccctttctagatgtcccgcaggctctgtcagccaccacttataaacacggcgttttgactagaaaaacacatgcagatatggatggtaaaagaacaccccgtggacgccgtggctggaaaaaattctacgccgtgcttaaaggtactatcctgtacctgcaaaaagatgagtatcggccagataaggcgctgagtgagggcgatctgaagaacgccatccgcgtgcatcatgctctggccactcgcgcttccgattacagcaagaaaagtaacgtactgaaactgaagacagcagattggagggtgttcctattccaggccccaagcaaggaggagatgctaagctggatactccgaatcaaccttgtggctgcgatcttctccgctcccgcatttcccgcagcagtttcatcaatgaaaaagttctgccgacccttactgcccagttgtaccacaaggctctgtcaggaagaacagcttcgctcccacgaaaataagcttagacagctgacggccgagctggccgagcaccgctgccacccggttgagcggggtataaaatcaaaagaagctgaggaataccggttaaaggagcactatctcactttcgaaaagagccgttacgaaacatatattcacctgcttgcaatgaagatcaaggtgggatccgacgatcttgagcgtattgaggctagactggcgactctggagggggatgatccgagtcttcgcaaaacccattcttccccggcactctcgcagggccacgttacagggtctaaaacgaccaaggacgctaccggcccagatacgtag

SEQ ID NO: 52866 - DNA, 2601 bp, Artificial Sequence
  Description of Artificial Sequence: Synthetic coding sequence
atggaggaggaggacaccaagagggaggtgcccaaagaagatggagtcggtgacgtccagcatttcgatagctctaaaatcatggaggaacattcatacattcagaaagagctggatttgcagaatgggtcattagaggaggacagtgtagtgcattctgtcgagaacgactcccagaacatgatggaatctctctcaccaaagaaatactcgagctcactgcgctttaaggccaatggagattatagtggaagttatctcacgctgtctcaaccggtaccagcaaagagaagcccatctccactggggacgtccgtgagatcctcacctagtctggcgaagatacaaggaagcaagcagttttcctatgatggaaccgacaagaatatccccatgaagccaccaacgcccctgctcaacaccaccagttctctgtccggatatccactgggacgggcagacttcgaccactacaccggacgagacagtgagcgagccctcaggctgtctgagaagcccccatacagcaagtattctagcaggcacaaatctcatgataatgtgtattcacttggcggactcgaagggcgaaaagccagtgggtccctgctcgcaatgtggaacgggtccagcctcagcgatgccggtcccccaccaatcagccgatcaggagccgcaagtatgccctcctctccaaagcaagccaggaagatgagtattcaagattcattggccctgcaacctaagctgacacgccacaaagagctcgcaagcgagaacataaatcttcgcacgcgaaaatattcatcctcaagcctctcccacatgggggcttatagccgatcactgccaagactgtaccgggcaaccgaaaaccaattgacaccattatccctgccaccccgtaactctttgggaaacagtaaaagaacaaagctcggagagaaggaccttccacactccgttattgataacgataattacctgaatttcagcagtctcagctcaggcgctctgccttacaaaacatccgcctctgagggaaacccttacgtgagcagcacgctttcagtgcccgcaagcccacgggtggcaaggaagatgctcctcgcatctacgagtagctgcgcatcagacgatttcgaccaggcttcgtatgtcggtaccaacccatcacacagtctgttggctggagagagtgacagagtgtttgccaccagacgaaatttttcctgtggaagtgtggaattcgacgaagccgacctggagtcactcagacaggcaagtggcaccccacaacctgccctcagggagagaaaatcctccatctcatctatttccgggcgagacgacctcatggactatcaccgcagacaaagggaagaacgacttagagaacaggaaatggagcggctggagaggcagagattagagaccatcctgtcgctctgtgcggagtacaccaagcccgacagcaggctgtcaacaggcactactgtggaagatgttcaaaaaatcaacaaggagcttgagaaactgcagctgtctgatgaagagtctgtttttgaagaagcactcatgtcaccggatacccgatatcggtgccacaggaaagattcccttcctgatgccgacctagcgtcttgcggctccctatcacaatctagcgcgtcttttttcaccccaagatcgactcgcaacgacgagttactctctgacctcacacggactcctccacctcccagcagcacctttcctaaagctagtagcgagtcaagctatcttagtatactccctaagacacccgaaggaatcagtgaggaacagagatcccaagaactcgctgccatggaagagaccagaattgtgatcctaaacaatctggaggagctgaagcagaaaattaaagacatcaacgatcagatggacgagagcttcagagaactggatatggagtgtgcgttgcttgatggcgagcagaagtccgagacaaccgagctcatgaaggaaaaagaaatacttgatcacctgaatcgaaagatcgctgaactggaaaagaacattgtgggagaaaagaccaaagatgccgaccttctagacgttgagagcaagcattttgaagatctggaatttcagcagctggaacacgagtcccgcttggacgaggagaaagaaaatctgacgcaacagttgttaagggaggtcgctgaataccagagaaacatagtcagtcgaaaagagaagatcagcgcactgaaaaaacaggctaaccatatcgtgcaacaggcacagcgcgaacaagatcacttcgtaaaagagaagaacaatctcattatgatgcttcaacgcgaaaaggagaatctgtgcaacctcgagaaaaaatactcatctctatccggaggaaagggcttcccagtgaacccaaacactctaaaggaaggatatatcagtgttaatgagatcaacgaaccttgcggcaactctacaaatctgagtccctctacacaattccctgccgatgcagacgccgttgccactgagccggcaactgcagttctagcatcccagcctcaatcaaaggagcacttccagggcccatag

SEQ ID NO: 52867 - DNA, 3714 bp, Artificial Sequence
  Description of Artificial Sequence: Synthetic coding sequence
atggaggaagaggatacaaagcgagaggttccaaaggaggatggtgtgggtgacgtgcaacatttcgactctagtaagattatggaggagcacagctacatccaaaaagaactggacctccaaaatgggtccctcgaggaagacagcgtcgtgcatagtgtagaaaatgattctcagaatatgatggaaagccttagtccaaaaaagtatagctccagtctgcggttcaaagcaaacggagattatagcggctcctacctgacactttcacagcctgtgccagcaaagcgctcccctagtcccctgggaacgtctgtccggtcgagtccaagcttggccaaaatccaagggagcaagcagttctcctatgacggtaccgataaaaacatacccatgaaacccccaacccccctgctgaacacaacatccagcctctccggctatccactggggcgtgcagacttcgatcattataccggtagggattctgagcgggcactccgtctgtccgagaaacccccttacagtaaatattcatctagacacaagagccatgacaacgtgtattcactgggagggctcgagggccgtaaggcctcaggcagtctgcttgcgatgtggaacgggtcctccttgtctgatgcgggacctccacctatctcccgctctggcgctgcatcaatgccgtcatcccctaagcaggctcggaagatgagtattcaagacagtcttgcccttcagcccaagctcactagacataaagaactggcatcagagaatatcaatctaaggacccgcaaatactcctccagtagtctgtcacatatgggtgcctattctcgatccctgcccagattatatcgcgctaccgaaaatcaactcacaccactgagcctgcctcctcgcaatagtctcgggaactcgaagagaaccaaattgggtgaaaaggatctgccccactcagtcatcgataatgataattacttaaacttcagttctctctcaagcggcgctttgccatataaaacatcagcctctgagggcaatccttacgtgtcctctaccttaagcgtgcctgctagcccccgagtggctcgtaaaatgttactcgccagcaccagttcttgcgcgtccgacgatttcgaccaggcaagctacgtggggaccaacccaagtcactcactcttagcgggtgaatctgatcgagtattcgctacaaggaggaactttagctgtggatcggtggagttcgatgaagctgacctcgagtctcttcgacaggcctcaggtaccccacagccagctctgagggagagaaagtcttcaatctccagcatctctggccgagacgatctcatggactatcaccggaggcagagagaggaacgcttgcgggaacaagaaatggagaggttagagagacagaggctggaaacaattcttagcctctgcgcagaatacaccaaacccgacagccggctgagcacgggtaccaccgtcgaggacgtccagaagattaacaaagagctggagaagctgcagctgtcagacgaggagagtgtgttcgaggaagccctgatgagcccagatactcgctatagatgtcatagaaaagacagcctgcccgatgccgacctggcatcttgcgggagcctgtcccagagtagcgcctcttttttcacaccacggtcgacaagaaacgacgagcttctgtcggatttaacacggacaccgcctccacccagcagtactttccccaaagcaagttcagagagtagctacctctctattctcccgaagacaccagagggcattagcgaggagcaaaggtctcaggaacttgccgctatggaggagacgagaattgtgattctgaataatttggaggaactcaagcagaagatcaaagacataaatgaccaaatggacgagtccttccgcgagctcgacatggagtgcgccttactcgacggggagcagaaaagcgagaccaccgagctgatgaaagagaaagaaatcctggaccacctgaaccgtaaaattgcggaactggagaagaacattgtgggcgaaaaaacgaaggacgcggacttgcttgatgtggagagtaaacattttgaggatctggagttccagcagttagagcacgaaagtcggttagatgaagaaaaagagaatcttacacagcagttactaagggaggtagcggagtatcagcggaacatcgtgtcacggaaagagaaaatttctgctttgaagaagcaagccaatcacatagtccaacaggcccagagggagcaagaccattttgtgaaggagaagaataacctaatcatgatgctgcaacgcgagaaggaaaatctgtgcaatttggaaaagaaatactcctcgctgtcgggaggaaagggatttccagtcaaccctaacactttaaaagaggggtatatcagtgtaaacgagatcaatgagccttgtggcaattcaactaacctgagcccaagtactcagttcccagctgatgccgacgccgtggcgaccgagcctgctactgccgtactggcctcacagccgcagagcaaagaacacttcaggtcactggaggagcggaaaaagcagcacaaagagggcctgtacttgagtgatacactgccacggaaaaaaactacatcctccatctccccgcacttttctagcgcaactatgggaaggtccattacacctaaagcccacctaccgctgggccagagtaatagctgcgggtccgtgctgccaccatccctggcggcaatggctaaagacagcgaaagccgtaggatgctgcggggatacaaccatcagcaaatgagcgaggggcatagacagaagagtgagttctacaaccggacggcttccgagtccaatgtttacttaaattccttccattaccctgatcacagctataaagatcaggcctttgatacgttatctttggacagcagcgacagcatggaaacaagcatctccgcttgctctccggataatatcagctctgccagtacctccaacatcgcacggattgaagagatggaacgccttctcaagcaggcccatgctgagaaaacaagacttcttgagagccgagaaagagaaatggaagccaaaaagcgagctctggaagaagaaaagcggaggcgcgagatcctggagaaacggctgcaagaagagacatctcagagacagaagctgattgaaaaggaagtgaagatccgcgagcgacagagggcccaagccagaccgctgactcggtacctgccggtcaggaaagaggactttgaccttcgcagtcatgtggagacagctggacataacatcgacacttgctaccatgtgtccatcacagaaaagacatgtaggggattcctgattaaaatgggtgggaaaataaagacttggaaaaaacgttggttcgtttttgacaggaacaagcgtaccttcagttactatgcggataaacacgagactaagttaaaaggagtaatctactttcaggccatcgaagaagtgtactacgaccacctaaaaaatgcgaataagagcccaaatcctctcttaactttttcggtgaagacccatgacagaatctactatatggtggctcctagccccgaagctatgcggatctggatggacgttattgttaccggggcagaaggatatactcacttcctattatag

SEQ ID NO: 52868 - DNA, 3762 bp, Artificial Sequence
  Description of Artificial Sequence: Synthetic coding sequence
atggaggagcatagctacatccagaaggaattggacctccagaatggctccctcgaagaagactcggtggtgcactccgttgagaatgactctcagaacatgatggaatcactatcaccaaaaaagtactctagttcactaaggtttaaggctaatggcgactactcagggtcttatttaaccttatcccaacccgttcccgctaagagatccccctctccactcggaacatctgtgcggagctccccgtctcttgcaaaaattcaaggctcaaaacagttttcgtatgatggaaccgacaaaaatatacccatgaagcctcctaccccactgttaaatacaacatcatctctctcaggctatcctctcggacgggcagatttcgaccattacaccggcagagactcagagcgcgcattgcggcttagcgagaaacccccttactcaaaatacagttccaggcacaagagccatgataacgtttattcgctcggaggtctggaaggcagaaaggcatccggctccctcctcgctatgtggaatggatcctctctgagcgatgctgggcctcctcccatctccagatcgggcgcagcttctatgcctagtagcccaaagcaggctcgaaagatgtctatccaagattcccttgctttacagccgaaacttacccgacataaggagctggcctctgagaacataaatctgcgaactcggaaatatagttcttcatcactatctcacatgggcgcttatagtagatcactgcctcgcttatacagagctactgaaaaccagttgacgccactttctctcccaccgcgaaactctctgggaaactccaaaaggactaagttgggagaaaaggaccttccccattcagtgattgacaacgataattatctcaactttagcagcctgtcttcgggagccctgccatacaagacttctgcatcagaaggcaatccttacgtatcgtctactcttagcgtaccagcctcaccaagggtggccagaaaaatgcttctcgcgtccacctcatcttgcgcatccgatgatttcgatcaggcttcatatgtcgggactaatccatcccatagtctcctggccggtgagtcggatcgagtctttgcaactagacgaaacttttcttgtgggtccgtggagttcgatgaagccgatctggagagcctgagacaagcctctggcactcctcaaccagctctgcgcgagcgtaagtcttcaatctcaagcatttcaggcagggatgacctcatggattaccatcgcagacagagggaggagaggttgcgggagcaggaaatggagcggctagagagacagcgcctagaaaccatcctctccctctgcgccgaatatacgaagcctgattcccgcttatctacaggaacgactgtcgaagatgtccagaaaatcaataaagagcttgagaagctgcagctgtctgacgaagaaagcgtttttgaggaagcactaatgagtcccgatacaaggtatcgttgccacagaaaagactcattgccggacgctgacctagctagctgcggctccttaagccaatcatctgcatcattctttaccccacgctctacgcggaacgacgaacttctctctgatctgacccgtacccccccaccaccaagctcaacatttcctaaggcctcttctgaatcgtcttacctgagcattcttcccaagacccctgagggtattagcgaagaacagcgttctcaagaactggccgcaatggaggagacacgcattgtgatcctgaataatttggaggagctcaagcagaaaatcaaggatattaatgatcagatggacgagtccttccgtgagctcgacatggagtgtgcccttctcgatggcgagcaaaagagcgagactactgagctcatgaaggagaaggaaattttagatcatcttaataggaaaatagccgagctggaaaaaaatattgtcggagagaaaacaaaagagaaagtcaaactcgacgctgaaagagagaagctggaacggttacaggagttgtatagcgagcagaaaacacagctcgacaattgtcctgagagtatgcgcgagcagttgcagcagcagcttaagagagatgccgacctacttgacgtggaatcgaagcacttcgaggacctggaattccagcagcttgagcatgaatctaggctggacgaagagaaagagaatttaacccaacagctgcttcgcgaagtagccgagtatcaaagaaatattgttagccgtaaggagaaaatcagcgcgttaaaaaaacaggctaatcatattgtgcagcaagcgcagcgcgagcaggaccactttgtcaaggagaagaataacctaataatgatgttgcaaagggaaaaggagaatctgtgcaatctggagaaaaaatatagcagcctgagtggtggaaaaggattccccgtgaaccctaacactctgaaggaaggatatatttcggtgaatgaaatcaacgagccttgcggcaattccaccaacctatctcctagcactcaatttcctgccgacgccgacgccgtcgccacagaacccgcaacagcagtgctagcttcgcagccccagtctaaggaacacttccgaagcctggaggaacgaaagaaacaacacaaggaaggattatacctatcggatacgcttcctcggaaaaagacgactagtagcatctcacctcattttagctcggcgacaatgggtaggagtatcacccctaaggcacatttgcctctgggacagtctaacagttgcggatctgttcttcctccaagcctggccgcaatggccaaagacagtgaatcccggagaatgcttcgtggatataaccatcagcagatgtctgaagggcatcggcagaagagtgagttctacaacagaaccgcgtccgagtccaatgtgtacctgaattccttccactatcctgatcactcatataaggaccaggcctttgacacactgagcctggacagctctgacagcatggagaccagcatcagcgcctgttctcctgataatatctccagcgcctccacttctaatattgcgcgtatcgaggagatggaacgcttgctcaaacaggcccacgctgagaaaacccgcctactggagtctcgcgagcgcgaaatggaggccaaaaagagggctctggaggaggaaaagcggcgacgagaaatcctagagaagcgcctccaggaggaaactagccaaagacagaaactgatagagaaggaggtgaagattagggagagacaaagagctcaggctcgcccattgacccggtacctgcctgttcgcaaggaggattttgacctgcgaagtcacgtggaaaccgccggacacaacatagatacgtgctatcacgtgtccatcactgaaaaaacctgccgcggtttcctgatcaagatggggggtaagatcaagacatggaaaaaacggtggttcgtgtttgatcgaaataaaagaaccttcagttattatgccgataaacacgagactaagctgaagggagttatttattttcaggccatcgaagaagtgtattatgatcacctcaagaacgccaacaagtcccccaatcccttgcttactttttctgttaagacccacgacaggatatactacatggtggctcctagcccagaggccatgcgcatatggatggatgtgatcgttactggtgcggaaggctacactcacttcctgttgtag

SEQ ID NO: 52869 - DNA, 3633 bp, Artificial Sequence
  Description of Artificial Sequence: Synthetic coding sequence
atggaagagcattcttatattcagaaggagctagatctgcagaatggaagtctagaagaggattcggtggtgcacagcgttgagaacgactcacaaaacatgatggaatctctgagtccgaaaaaatactcatcctcacttaggttcaaggctaacggcgactattctgggagctacctcaccctgtcccagcccgtgccggctaagcgtagcccaagtcccctgggcactagcgttaggtcatcaccgtcactagcaaaaattcagggaagcaaacagttttcctacgacggaacagacaagaacatcccaatgaagccacccacccctctgctgaacactaccagtagcttgagtggctacccactggggagagccgacttcgaccactacactggacgggactctgaaagggctttacgactgagcgaaaaaccaccctattccaagtattcgtcaagacataaaagccatgataacgtttactctctgggcggactggagggccgtaaagcttccggcagtctcctggctatgtggaatgggagtagtctgtcggacgcaggtcccccacccatctctaggagcggtgccgcatctatgccctcgagccctaagcaggcccgaaaaatgagcattcaggattcgcttgctctacagccaaagctgacccgtcacaaagagctagcaagtgagaacatcaacttacggacccgtaaatattcatcatctagcctctcccacatgggggcatacagtcgctcacttccccgactgtacagagctacggagaaccagctgacacctctctctcttcctcctagaaactccctgggcaattctaagcggactaaactgggcgagaaagaccttcctcacagtgtcattgataatgataattacctcaacttctctagcctgtctagcggtgctctgccatataagacctccgcatctgagggaaacccctacgtcagcagtactctgagcgttcccgcatctccacgggtcgcccgaaagatgctacttgcgagtacctcaagttgtgcctccgatgattttgaccaggcaagctacgttggcactaacccctcccatagtttgctggccggagagtctgaccgcgtgttcgcaaccaggcgcaatttctcatgcggcagcgtagaattcgatgaggcagacttagagtctttaaggcaagcctccggaacaccccagcccgcattgcgagaaagaaaaagctctatatcatcgattagcgggagagacgacctcatggattaccatagaaggcagagggaagaacggctccgggaacaagagatggaaagactggagagacagagactggaaacgatcttatccctctgtgcagagtacacaaagcccgacagtagactcagcaccggcacaactgtggaggacgttcaaaaaataaacaaggaactcgagaagctccagttgtcggatgaggagtccgtgttcgaggaggcccttatgtccccagacacccgctataggtgccataggaaagacagtttaccagatgcagacttagcttcgtgtggatctctgtcccagtctagcgcttctttttttacaccacggagtacccgaaatgacgaactcctctccgatctgactcggaccccgcctcctccctcctctacttttcccaaagcctcctcagagtcttcttatctcagcatcctgcctaagactccagaaggaatctcggaggaacagcggtcccaagaattagcagcaatggaagagacccggatcgttattctgaacaatctggaggagctgaagcaaaagataaaggatatcaatgaccaaatggatgagtcttttcgcgaactggacatggaatgcgccctcctcgatggagaacaaaagtctgaaaccaccgaactgatgaaggagaaggaaatcctggatcatctgaatcgcaagatagcagaactagaaaagaatatagtcggtgagaagacaaaagatgctgacctgctcgacgttgaatccaaacatttcgaggacctggagttccagcagcttgagcacgaaagccgcttggatgaggaaaaggaaaatctgacacaacagctgctgagagaggtagccgagtatcagcggaatatcgtgagtaggaaggagaagatttccgcactgaagaagcaggccaaccatattgtgcagcaggctcagcgcgaacaggaccattttgtcaaggaaaaaaacaatttgatcatgatgcttcagcgtgagaaggagaatctctgcaatctagaaaaaaaatactcctccctctctgggggaaagggttttccagtgaacccgaacaccctcaaagaggggtacatttccgtgaacgagattaatgaaccatgcggcaacagcacgaatctcagtccgtctacccaattccccgctgatgccgatgctgtcgcaacagagcctgctacggctgtactggctagccagcctcagagcaaggagcacttccgaagtctggaggagaggaagaagcaacacaaggaggggctctatttgtcggatacgctacctaggaagaaaactacttccagcataagtccccattttagttcggctacaatggggagatctatcaccccaaaggcccatctgccactggggcaaagcaactcgtgcggttcggtgctgcctccttccctggctgcgatggcgaaggacagtgaatcccggcgtatgctgcgagggtacaatcatcagcagatgagcgagggacatcggcagaagtccgagttttataacagaactgccagcgagtcgaacgtatatctgaactcattccattacccagatcactcttataaagatcaggcctttgacactctgagcctggacagttcggactctatggagacgtcaatttcagcatgctcccccgataacatatcgagtgcgagcacatcaaatatcgccaggatcgaggaaatggagcgattactaaagcaggcacatgccgaaaaaacaaggctgttggaaagccgagaaagagagatggaagctaagaagcgtgcccttgaagaggaaaaaagacgtcgggaaatcctcgagaagcggctgcaggaggaaaccagccagcggcagaagttaatcgaaaaggaggttaagatccgggagcggcagagagcacaggcaagacccctaacccgctacctgcccgtgaggaaggaggacttcgacctgagaagtcacgtggaaacagcgggtcacaatattgacacctgctatcacgtttctatcactgagaagacctgtaggggtttcttgatcaagatgggcggaaaaattaaaacttggaaaaaaagatggtttgtttttgatcggaataagcggactttttcctactatgctgataagcacgagaccaagctgaaaggagtaatctatttccaggccattgaagaggtgtactatgaccatctgaaaaacgccaataagtctcccaaccctttacttaccttctccgtcaagacacacgaccgcatttactacatggttgcaccgtccccagaggcaatgcgtatttggatggacgttatcgtaactggcgctgaggggtatactcacttcctgctgtag

SEQ ID NO: 52870 - DNA, 3762 bp, Artificial Sequence
  Description of Artificial Sequence: Synthetic coding sequence
atggaggagcactcctacatccaaaaggagttagacttgcagaacgggagtctggaggaggactctgtggtgcattcagttgaaaatgattcccagaatatgatggagtcactgagtcccaagaaatattcctcgtcccttcggttcaaggccaatggcgattattctggcagctacctgacactcagccagccagttccagctaaacgctcaccaagcccattgggaacctctgtacgatcaagtccaagtctcgccaaaatccagggcagcaagcagttcagttatgacggaaccgacaaaaacattccgatgaagccaccaactccactactaaacaccactagctctctttccgggtatccactcggcagggcagacttcgaccactataccggaagagattccgaaagggccctgcgcctgagcgagaagcccccatactcaaaatactcttcaaggcacaagtcacacgacaatgtgtattcattaggtggcctggaaggccgaaaggcctccggctccctgctcgcaatgtggaatggctcaagtctgtctgacgcaggtccccctcccatatcccgcagtggagccgctagtatgccctcctccccaaaacaagctagaaaaatgagcattcaggatagtctggccctgcaaccaaaactgaccagacacaaagagctggcgtccgaaaatatcaatctacggacccgcaagtactcctcctcctcactttcacatatgggcgcatattcgaggtccttacctagactctaccgtgctacagagaatcagctaactccactgagtttgcctcctagaaacagccttggcaacagtaagcgcaccaaactgggggagaaggatctgccacattcagtaattgacaatgacaactatctgaatttttcatccttgtcttctggggctctcccgtacaaaacatccgctagcgaggggaacccatacgtcagctccactctgagcgtgccggcatccccccgagtagcccgaaagatgttgctcgcttctacgtcatcatgcgcttccgatgactttgatcaggcctcctacgtaggcacaaatccaagccacagtttgctggcgggagaaagcgatagagttttcgctactcgcaggaacttctcgtgcggtagcgtggaattcgatgaggctgaccttgagtctctacgtcaagcatccggaaccccccagcctgccttacgagagcgtaagagctccatcagcagcatttcagggagggacgacctgatggattaccaccgcaggcagagggaagaaagacttagggagcaggaaatggaaagactggaacgacagagactggagaccatactctcactctgcgcggagtatacaaaacctgacagtagactgtctaccggaacgactgtggaagatgttcagaaaattaataaagagcttgaaaaactccagttgagtgacgaggagtcagtgtttgaggaagccctgatgtctcccgacaccagatataggtgccacagaaaggattcactgcctgatgcggatttggcaagttgtgggtccctgtctcagtcatccgctagtttttttaccccaaggagcacaaggaacgacgaattactcagcgacctcactcgaacacctcctcccccttcgagtacttttcccaaggcctctagcgagtcaagctatctctccattcttccaaaaactcccgagggaatcagcgaggaacaaagaagccaggagctcgctgcgatggaggaaacccggattgtcatactcaacaatttggaggagcttaaacagaaaattaaggatatcaatgaccagatggacgaatccttccgggagttggatatggagtgcgccctgttggatggcgagcagaaatcagaaacgaccgaactcatgaaggaaaaggaaatcctagaccacctgaataggaagattgcagaactggagaagaacatcgtgggcgaaaaaactaaggaaaaagtcaagctggacgccgagcgggagaaactcgagcgccttcaggaattgtacagcgagcaaaaaactcagctggataactgtcctgagtctatgcgtgagcagttgcagcagcaacttaagagagatgccgatctgctggatgtagaaagtaaacattttgaagatctcgagttccaacagctcgagcacgaatcccgtctcgatgaagaaaaggagaacctgacacaacaactgctccgagaggtcgctgagtatcagaggaacattgtgtctcgtaaggagaaaatttcagcactgaaaaagcaagccaatcacattgttcagcaagcacagcgggagcaggaccatttcgtcaaggagaagaacaacctgattatgatgctgcagcgagaaaaggagaacctgtgcaatctggaaaaaaagtactcctccttgagtggaggcaagggctttccagtgaatcctaatacgttgaaggaagggtacatttccgtaaatgagatcaatgagccctgtggtaacagcacaaacctctccccatccacccagtttccggctgacgccgatgcggtagctaccgaacccgctaccgccgtgctggcctcccagccacagtctaaggaacacttcagaagcctggaggagcgaaagaagcagcataaagagggcctgtaccttagcgacacgctcccgcgaaaaaagaccacgagttcaatttcaccccatttctccagtgcaacaatgggcaggtctattacgcctaaagcacatttgccactcggccaatcgaattcatgtggtagtgtgctgcccccttcacttgccgcaatggctaaggattctgaaagtcgccgtatgctgaggggctacaaccatcagcaaatgagcgagggacatagacagaagagtgaattttacaacaggacagcaagcgagagtaatgtttacctcaacagcttccactacccagaccactcctataaagatcaggcctttgacactctcagtctggattcttcagattccatggagacatcgatttccgcttgctctcctgacaatatcagttccgcaagtacttctaacattgcaaggatcgaggagatggagcgacttttaaaacaggcccatgctgaaaagactcgtttactcgagagcagggagagggagatggaggcaaagaagcgtgccctggaagaagaaaaacgcaggcgcgaaatcctggagaaacggcttcaggaggaaacctctcagcggcagaagctgatcgagaaagaggtcaagatcagagaacgccagagggcacaagccagaccattgaccaggtatctccccgtcaggaaggaagacttcgatctgcggagtcacgtggagaccgctggccataatatcgacacctgttaccatgtgtccattacagagaaaacatgccgcggattcttgatcaaaatggggggtaaaatcaagacctggaagaagcgatggtttgtctttgacagaaacaaacgcacattctcctactacgctgacaaacacgagacaaaacttaaaggcgtgatctacttccaggctatcgaagaggtttactatgaccacttaaagaatgctaacaagtctcctaatcccttgctgaccttcagcgtaaaaacccacgacaggatctactatatggttgccccatcccctgaggccatgagaatttggatggatgtgatcgtgacaggtgcagaaggctacacacatttcctcctgtag

SEQ ID NO: 52871 - DNA, 3633 bp, Artificial Sequence
  Description of Artificial Sequence: Synthetic coding sequence
atggaggagcatagctacattcagaaggaactggatctccaaaatggaagcttggaagaggacagtgtcgtgcattcagtcgagaacgattcccagaacatgatggaatcactctctcccaaaaagtacagctcatctcttcgctttaaagcgaatggcgactacagtgggagttatctcacactgagtcagcccgtgcctgctaaacgcagcccctccccactcggcacctccgttcgatctagcccatctctggccaaaatccagggatcgaaacagttcagctatgacggaactgacaaaaacattccgatgaagccacctacccctttgcttaacaccacgagtagtctttccggctatcctctgggcagagcagatttcgaccattatacaggacgggatagtgaaagggctctgcgtttgtcagagaaacctccctactccaagtattccagccgccacaagagtcacgacaacgtgtatagcctgggaggcctggagggaaggaaggcttccggctctcttcttgcaatgtggaacggttcaagcctgtccgatgcaggaccacccccaatatcccgatccggtgctgcctctatgcccagcagccctaaacaggccaggaagatgtccatccaggactcactagcgctccaacctaagctgacacgacataaagagctggcctccgagaatataaacttgcggactagaaaatattcttcttcaagtctaagccacatgggggcttacagtagatcactccctcgtctttatcgggcaactgagaatcagctgacaccgctgagtctgcctccccgtaacagcctcggcaacagcaagagaaccaaactcggcgaaaaggacctcccacactcagtcattgacaacgataattatctgaattttagttccctgagttcaggcgctttaccctataagacaagtgcgtcagaagggaacccatacgtctcaagtaccttatcagtgcccgcaagtccaagggtggcgcgtaagatgttactggcctcaactagttcttgcgccagtgacgacttcgatcaggccagctacgtggggaccaaccccagccatagtctgctcgccggagagagcgatcgcgtgttcgccacaaggcgaaatttcagctgcggaagcgttgagttcgacgaagctgacctcgaatctttacgtcaagcttccggtaccccacagcctgcgctgcgcgaaagaaaaagcagcataagcagtatcagtggcagagatgacctgatggattatcatcgacggcaaagggaagagaggctccgggagcaagaaatggagagattagagaggcagcggctcgagactatcttgtcactgtgcgccgagtacaccaagcctgactcacggctttcaacaggtactactgtggaggatgtgcagaagatcaataaagaacttgaaaaactgcagttatcagatgaagagtcagttttcgaggaagccctaatgtcccctgacacccgctatcggtgccaccgcaaggacagccttccagacgcggatctggcctcttgtggatctctgagccagtcttctgcttcattcttcacgcccaggagcactcgtaacgacgagctcctgagcgacctgaccaggaccccacctcccccttcaagtacatttccaaaggcatcaagtgagtctagctacctgagcatactcccaaaaacaccagagggaatctctgaagaacagcggagtcaggagctggccgcaatggaagaaaccagaatcgttattctgaataacttagaggagcttaaacaaaagatcaaggacatcaatgatcaaatggacgagtcattccgcgaactggacatggagtgcgctcttctggacggcgagcagaaaagcgaaacgactgagttgatgaaggagaaagaaatcttagaccacctcaaccgcaaaattgccgagctcgagaagaatatcgtcggggagaaaacaaaggacgcggacctcctggatgtggagtcaaagcactttgaggatcttgaatttcagcagctggagcacgagagtcggctggacgaagaaaaggagaatctgacacagcagttgttgagagaggtcgctgaataccaaaggaatatcgtgtcccggaaagagaaaatcagtgcccttaaaaagcaggccaatcacatagtgcagcaggcccagcgcgagcaagaccattttgtcaaggagaagaacaacctgatcatgatgttgcagcgcgaaaaagagaacctctgcaacctggagaaaaagtactcctctctgtctggcggaaaagggtttccagttaatccaaacacccttaaggaggggtacatctccgtcaacgagattaacgagccatgcgggaacagcactaatctgtcgcccagcacccaatttcctgcggacgctgacgccgtggctactgaacccgctactgctgtgcttgcttcccaaccacagagcaaagaacattttcgaagccttgaagagaggaaaaagcaacataaggaaggactctacctgtccgatacactccctcgaaagaaaacaacatcctccataagtccccatttctccagcgccacaatggggagaagcattacccctaaggctcatctccctctggggcagagcaatagctgcggctccgtactcccgccatcgttagccgcaatggccaaagatagtgaatctcggcgtatgctgagggggtataaccatcaacagatgagtgaaggacaccgacaaaaaagtgagttttacaacagaacggcctccgaaagtaacgtgtacctaaattcgttccactaccctgaccatagctacaaagatcaggccttcgacacgctgtctctggactcatcagatagtatggagaccagcataagtgcctgttcccccgacaatataagcagcgccagtactagtaacatcgcaagaattgaagagatggagaggctgctgaagcaggcccacgctgagaaaacaaggctgttggagtcaagggagagagagatggaagccaaaaagcgcgctttggaggaggagaagagaagacgcgagattctggaaaaaagactccaggaagaaacttcccagagacagaaacttatcgagaaagaagtgaagatccgtgaacggcagcgtgcccaggccaggcctctcacgcgctacttgcccgtaaggaaggaggacttcgacctccgctcccatgtggagacagccggacacaacatcgatacatgttaccacgtgagcatcactgagaagacctgtcgaggtttcctcattaagatggggggaaaaatcaagacttggaagaaacgatggttcgtgttcgaccggaataagaggacttttagctattacgctgataagcatgagaccaagctcaagggagttatctattttcaggctatcgaggaggtgtattatgaccacctcaagaatgctaataaaagtccaaatccccttttgaccttcagtgtgaagacacacgaccggatttattacatggtggcacctagccccgaggcaatgcggatctggatggatgtgatcgttacaggtgccgagggttacacccacttcctgctctag

SEQ ID NO: 52872 - DNA, 3348 bp, Artificial Sequence
  Description of Artificial Sequence: Synthetic coding sequence
atggaggaacattcttatatccagaaagagcttgacttgcagaacgggtcactggaagaggattccgtggtgcactccgtcgagaatgacagccagaatatgatggaatcccttagccctaagaagtactcctcctcgctgcgattcaaggccaatggggattactccggcagctatctaactctgtctcaacccgtgcctgcaaaacgatcaccgagtccactgggcacctccgtgagatcctctcctagtctggctaaaattcagggatcaaagcagttctcctatgacggaacagacaagaatatccccatgaagcccccaactcctttactgaacacaacttcctctctcagcggctacccactgggccgagcagatttcgatcattacactggcagggacagcgagagagcactgagactctctgaaaaacccccatatagcaagtactcttcccggcacaagagccatgataatgtgtacagcctcggaggactggaaggccgaaaagcctccggcagtctcttggccatgtggaatggatcctctctgagtgacgctggtcctcctcccatttcaaggtctggcgcagccagcatgccttcctcccctaagcaggcccgtaagatgtcgatccaggacagtctcgcactgcagccaaaacttacacgccacaaagagttggcatctgaaaatatcaacttaaggacacgcaagtacagctcctctagcctgagtcatatgggtgcctactctcgatctctcccacgtctgtatagagccacggagaaccagttgacacccctatccttaccccctcgcaattcgctagggaattccaagaggacaaaactcggcgagaaggatctgccacactctgtgatcgacaacgataactatctaaactttagctcactaagttctggggctcttccttacaagacgagcgcatctgaagggaatccctacgtgtcttcaacactaagtgtgccagcgtctcccagagtagcccgaaagatgttgctggcttccacctcaagctgcgcttcagacgactttgaccaggcgtcatacgtggggacgaatccctcccattctctcctggccggagagtccgatcgggttttcgccacaagacgcaatttctcctgtggaagcgtagagtttgacgaagcggatctggagtctctgagacaggccagcggcaccccacaaccagctttacgggagcgtaagtcttccatcagcagtatttcaggcagggatgaccttatggattatcacaggaggcagcgggaggagcggctgagagaacaagaaatggaacgccttgaacgccagcgtctcgagactatactgtccctctgcgcagaatacaccaaacctgacagcaggttgagtacaggaactacagtcgaggatgtccagaaaattaacaaagaactcgagaagttacagctgagtgatgaggaaagcgtattcgaagaagccttaatgagccccgatacacggtaccgttgccataggaaagatagtctgcctgacgccgatttggcttcgtgcggaagtctgagccagagtagcgccagtttttttacacctagatcaacccgtaatgatgagctgctgtcggatctcacacgcacgcccccacctcccagttcaaccttcccgaaagcttcctcggaatccagttatttatccatcctgcccaaaacacccgaggggataagcgaggagcagaggtcccaagaattggcggctatggaagagacaagaatagtcattcttaacaatttggaggaactgaagcaaaaaatcaaagatattaatgaccagatggacgaatcttttcgggagctcgacatggagtgcgccctgctcgacggcgagcaaaaatcagaaaccactgagctgatgaaggaaaaagagatactggaccatttgaatagaaaaattgccgagcttgaaaagaacatcgtcggtgagaagaccaaagatgccgatctgttggatgtggagtccaagcatttcgaggatctggagttccagcagctggagcatgaatcgcgcctggacgaagaaaaggagaatctgacacagcaactcctgcgcgaggtagccgagtatcaacgaaacattgtcagcagaaaggaaaaaatctccgctctgaagaaacaggctaaccacattgttcagcaggcacagagggagcaggatcatttcgttaaagagaagaataatctgattatgatgctgcaaagagaaaaagaaaacctctgcaatttagagaaaaaatactctagcttaagtgggggaaagggctttcctgtgaaccctaacactttaaaagaaggttatatctcggtgaatgagataaatgagccttgcggtaatagcaccaatctgtcccctagtactcagttccccgctgacgccgatgctgttgctactgaacctgccactgctgtgcttgctagtcaaccacaaagtaaggagcatttccgctctctggaggagcgcaagaagcagcacaaggaaggtctctacctaagcgacactctgccacgcaaaaaaaccaccagttctatcagtccccacttctcctccgctacaatgggcaggtccataaccccaaaggctcacctgccgctgggtcagtcaaacagctgcgggagcgtgctgccaccttccctggccgctatggccaaagactctgagtcaaggcgcatgctaaggggatacaatcatcagcagatgagcgaagggcatcgtcaaaagagcgaattctataatcgtactgccagcgagtccaacgtgtatcttaatagcttccattatcctgaccactcatataaggatcaggcattcgatacactgtccctcgattcatctgacagcatggaaacgagtatatcagcctgcagccctgataatatctctagtgcaagtacatccaatatcgcacgcattgaagagatggaaagactgctgaaacaggctcatgcagagaagaccaggctgctggagagtcgggagcgtgagatggaagccaagaagcgcgctttagaagaggagaagcgcaggcgagagatcctggaaaaaagactgcaggaggagacttcacagaggcagaaactgatcgagaaagaagttaagattagagagagacagcgagctcaggccagaccgctcactaggtatttaccagtgcgtaaggaggactttgacctccggtcgcacgtggaaaccgcaggccacaatatagatacatgctaccacgtgagtataacagagaaaacttgtagaggctttctcatcaagatgggagggaagattaagtag

SEQ ID NO: 52873 - DNA, 5615 bp, Artificial Sequence
  Description of Artificial Sequence: Synthetic coding sequence
atgcccagtgtgtgcctgcttcttttgctctttcttgccgtcggaggagcacttggaaaccggcctttcagggcattcgtggtgaccgacacaactctcacccacctcgccgttcatagggtgaccggagaggtttttgtgggtgctgtaaacagggtgtttaagttggccccaaatctgactgaattacgtgcccacgtcacaggtccagtagaagataacgcacggtgttatccgcctcccagtatgagagtatgcgcacataggctcgcaccagtcgataacattaataagctgctccttatcgattatgctgctcgacgcctcgtggcgtgcggctccatctggcagggcatttgtcagttcctgagattggacgacctgtttaaattgggcgaacctcatcatagaaaggaacactaccttagcggcgcacaggaacccgatagcatggccggtgttatagttgagcaggggcaggggccatcgaagctgttcgtgggtacagccgtcgacggcaaaagtgaatatttccccacccttagttcaaggaaactgatttcagacgaagactctgccgatatgttcagcctggtttaccaggacgagtttgtatccagtcagatcaagattcctagcgataccctgagcctgtaccctgcttttgacatttattacatatacgggttcgtcagtgccagcttcgtctatttcctgacacttcaactcgacacccagcagacattgctcgacaccgccggagagaagttcttcactagcaaaatcgtgcgcatgtgtgctggcgacagtgagttctactcatacgtggaatttccgatcggctgctcctggcggggtgtagaataccggctcgtgcaatccgctcacctggcaaagcctggtcttttgctcgctcaagccctcggggtgcccgctgacgaggacgttctctttaccatcttttcacaggggcagaagaaccgggcaagccctcccaggcagactatattgtgccttttcacgctgtccaatattaacgctcacattcgaaggcgcattcaaagctgttatcggggagaaggaacactcgccctgccatggctactgaacaaagaattaccttgcatcaatacgcctatgcagatcaacggaaatttctgcgggctcgtgctgaatcagcccctcggtgggttgcatgtaatcgagggcttaccacttctggcggactccaccgatgggatggcctctgttgccgcttatacctatcgacagcattccgtagtgtttattggaactagaagcggctccctcaaaaaggtacgagtagacggattccaagacgcacatctgtatgaaaccgtccctgtggtggacggcagccccatccttcgcgatctgctattctcccccgatcatcgtcatatctacctgctgtctgaaaagcaggtcagccagctcccagtggagacttgtgagcagtaccagtcctgcgctgcctgcttggggtctggggacccgcattgtggatggtgcgtactgcgtcacaggtgctgcagagaaggcgcttgtcttggtgctagcgccccacacggtttcgcggaagagctatccaaatgtgtacaagttcgagttaggcctaataatgtttctgtaacctcccctggggtccaactcacggtcacactacataacgtgcccgacctgtctgcaggcgtctcatgcgcttttgaagccgctgctgagaacgaggccgtcctgcttccaagtggcgagctgctttgtcctagtccatcgctgcaggagctacgagccctcactagggggcatggagcgactagaaccgtgagattgcagctgctgagcaaagagaccggggttcgatttgcaggagctgatttcgtgttttataattgtagtgtactacagtcttgtatgtcatgtgtggggtccccatacccctgccattggtgcaaataccggcacacctgcacatctaggcctcacgagtgttcctttcaggaaggccgtgtgcattcccccgaaggttgtcccgaaatcctgccctcaggggatctcctcattccggttggcgtaatgcagcctttgacgctccgggctaaaaatctcccccagccccagagcggacagaagaattatgagtgtgtggtgagggtacagggcagacaacagcgggtgccagcagttcggttcaatagtagctccgttcagtgtcagaatgcttcctactcttacgaaggggacgagcacggtgacacggagctagattttagcgtcgtctgggatggggatttccccatcgacaaacctcctagcttccgtgcactgctatataaatgttgggcccagcgaccgtcatgtggcctgtgcctcaaagctgatccaaggttcaattgtgggtggtgtatttccgagcacaggtgccagttgcgcacccactgccctgcccctaaaaccaattggatgcacttgtctcaaaaggggacaagatgttctcaccctcggataacccaaattcatcctctggtgggcccaaaagagggtggcacgcgtgtgaccatagtcggtgataatctgggactgctgtctagggaggtgggactgcgggtggcgggtgtcagatgcaactctatcccagccgaatacatttctgccgaaagaattgtttgtgaaatggaggaatcactggtcccctcccccccacctggccctgtcgaactgtgcgtcggagactgtagcgctgactttcggacacaaagtgaacaggtgtacagtttcgtgacccccacatttgaccaggtcagtccttctcgtggtcctgctagcggcggtacaaggctgaccatctcagggagtagtttagacgccggaagtcgcgtaactgtaacggtgagagatagtgagtgccaatttgtgagacgtgacgcgaaggctattgtgtgcatatcgcctttatcgaccctgggaccgagccaggctccaatcacactggcgattgaccgcgcaaatatttcttccccaggactcatatatacctacacacaggaccccactgtaacccgtttggaacctacatggtctatcattaatggctcgactgctattacagtatcaggaacacacctgctgactgttcaggagcctcgggttagagccaagtatcggggaatcgaaaccacaaatacatgtcaagttatcaacgacacggccatgctctgcaaagctcccggtatattcctggggaggccgcagccacgggctcagggggagcatcctgacgaattcgggtttttgctggaccacgtgcagacagcacgaagtctgaaccgctcttctttcacctattacccagaccctagcttcgaacctctcggacccagtggtgtcctcgatgtgaaaccaggctcacacgtggttctcaagggcaaaaatcttataccagctgctgctgggtcgtccagactgaactataccgtcttgatcgggggacaaccctgcagccttaccgtgtccgacacccaacttctgtgtgattcacccagccagacaggcaggcagcccgttatggttcttgtaggaggtctggagttctggctgggcacactgcacatttctgccgagcgcgctctcaccttacccgcaatgatggggctggccgcagggggtgggctgctcctgctggccatcactgcagtccttgtagcatacaagcgtaagactcaggacgcagatcgcacactgaagcggttgcagctccaaatggacaacctcgaatctagagtggctctagagtgtaaggaagccttcgccgagcttcagacagatatcaacgagcttactaatcatatggacgaggtgcagataccatttctcgactatcggacatacgccgtccgcgtcctttttcccggtatagaggctcaccctgtgcttaaggagctcgacacaccacctaacgtcgaaaaggccctgagactgtttgggcagctgctccactcacgtgccttcgtacttacatttattcatacgttggaggcccagtcatccttctccatgagagatcggggtactgtcgcgtctttaactatggtggccctccagtccagactcgattacgccaccggcttacttaaacaacttctggccgatctgatcgaaaaaaacctggagagcaaaaaccacccaaaattactactgcgccgaactgaatccgtcgccgagaagatgttgaccaattggtttacatttctgctgcataaatttctgaaggagtgtgcaggggaacccttatttttgctgtattgtgcgatcaagcagcaaatggagaaaggtcccatcgatgcgataacgggcgaagcacggtactccctgtcagaggacaaattgattcggcagcaaatagattacaagaccctcactcttcattgtgtgtgccctgaaaacgaggggagcgcccaagtgcccgtgaaggtgttgaattgcgactccatcacgcaggctaaggacaagctgttggataccgtctacaaaggaataccctactcacagcgtccaaaggctgaagatatggacttagaatggcggcagggcagaatgacccgtatcatactccaggatgaagacgtgacaaccaaaatcgagtgcgactggaagcgcctcaattctctggcacactaccaggtgacagacgggagcctcgtggccctggtgccaaagcaggtcagcgcctataacatggccaattcctttacgtttactcgcagccttagccgttatgaaagccttctacggactgcttcaagccccgattcactaagaagtagggcaccgatgattacccccgaccaagagactggcaccaagctgtggcatctcgtaaaaaaccacgatcacgccgaccatagggaaggggatcggggtagcaagatggtttccgagatttatcttactcggctactcgccaccaaaggaactctacagaagttcgttgacgatctgtttgagaccgttttttccaccgctcaccgcggatccgcgctccctctggcaataaaatacatgttcgatttcctcgatgagcaggccgaccagcgacagatatccgatcccgacgtacgtcacacctggaagtctaactgcctccctttgagattttgggttaatgtaatcaagaaccctcagtttgtgttcgatattcataaaaacagtatcaccgacgcctgtctgagcgtggttgcccaaacatttatggattcctgttccacctctgagcataggctcggtaaagactctccttctaacaaattattgtacgccaaggacattccaaactataaaagttgggttgaacgatactacagggacatcgcgaagatggcctccatctccgaccaggacatggacgcttatctcgtcgagcaatcgagactgcatgccagtgacttcagcgttctaagcgcccttaatgaactctatttttatgtcacgaagtatcggcaggaaattttgaccgccttagaccgggacgccagctgcagaaaacacaagctgcggcaaaagcttgaacaaatcattagcctggtgtctagtgacagcta

SEQ ID NO: 52874 - DNA, 4707 bp, Artificial Sequence
  Description of Artificial Sequence: Synthetic coding sequence
atggaggtgtcccgcagaaaagcccctcctcggccaccaaggcctgccgctccactcccattgctcgcatatctgttggccttggctgctcctgggagaggggcagatgaacccgtgtggcggagcgaacaggccattggggctattgccgctagtcaggaagatggagtgtttgttgcctctggatcctgcctggaccagctcgactactccctggaacatagcctatctcgactgtacagagatcaagccggtaattgcaccgagcctgtttctctagctccccctgctcgtcccagaccaggaagttccttcagtaagttgctcctgccttacagggaaggggctgccggactagggggattgctgttaactgggtggacatttgacaggggcgcttgcgaagtccggccattggggaacttgtcgcgcaatagcttgcgcaacggtaccgaggttgtgtcatgtcatccacaggggagcaccgctggcgtggtctatcgtgccggaaggaataatcgctggtacctggctgtcgcggcaacttacgtgttgccggagcccgaaaccgcttcccggtgcaatccagcagcatctgaccatgacacggccatcgctctgaaggatacagagggcagatcactcgctacccaggagctgggacgcctcaaactgtgtgaaggcgctgggtccctgcattttgtcgatgccttcctgtggaatggatccatttacttcccatattacccttataactacactagtggggcagccacggggtggccttccatggccagaatcgcccaaagtacggaggtgctgttccagggacaagctagtctggattgtgggcacggtcaccctgacggaagaagactccttctttcttcttcccttgtcgaggcactggacgtgtgggctggtgttttctccgcagcagcaggagagggccaggagcggagatcgcccaccacaactgcactgtgcctttttcggatgagtgaaattcaggcgagagcaaaaagagtgagctgggactttaaaactgccgagtctcactgcaaggaaggtgatcagccggagcgtgtgcagcccattgcttccagtactctgattcatagcgatctgacaagcgtgtacggaactgtggtgatgaatcgcactgtgctgttcctcggtactggggacggccaactcctcaaggtgattctcggggagaatctgacatcaaactgccccgaggtgatttacgagataaaggaggaaacaccggtgttctacaaattggtgcctgatccagtgaagaacatttatatttatctgactgctggtaaggaggtcagaagaattcgagtggccaattgtaataagcacaagtcgtgctcggaatgcttaactgccactgatcctcactgtgggtggtgtcacagcttacagagatgcaccttccagggtgactgtgttcactccgagaacttggagaattggctcgatatcagctcaggggctaagaagtgccccaaaatccaaattataaggtctagcaaggaaaaaaccacggtgacaatggtgggctctttctcaccacggcatagcaaatgtatggttaaaaacgtagacagttcacgagagctctgccagaataagtcacagcccaataggacctgcacctgctcaattcctactcgcgcaacgtacaaggacgtctctgtggtcaacgttatgttcagctttggctcatggaacctctctgatagatttaatttcactaactgtagctccctcaaggaatgtcctgcctgcgtcgagactggatgtgcctggtgcaagagcgcaagaaggtgtatacacccattcactgcgtgcgatccctctgattacgagagaaatcaggaacagtgccccgtcgctgtggagaagacaagtgggggaggcagaccgaaagaaaacaagggcaacaggacaaatcaggccctccaggttttttatattaaatccatcgaaccccaaaaagtgtctacactgggtaaatctaacgtgatcgtgacaggcgctaattttacccgggcaagcaacattaccatgattcttaaagggacttctacatgcgacaaagacgtgattcaagtttcccatgtgctgaatgatacacatatgaaattcagcctgccgtcatcccggaaagagatgaaggatgtctgcatccagttcgacggcggaaattgctcctccgttgggtccctgtcttatatcgccttgccccactgctctctgatttttccggcaactacctggatctccggcggacagaatatcaccatgatggggagaaacttcgacgtcattgataatcttatcatctcacacgagttgaagggcaatattaatgttagtgaatattgtgtggcaacctattgtgggtttctagcgccttcacttaagagctctaaggtgcgaaccaatgtgacggtgaaattaagagtacaggacacgtatctggactgtggtaccctccaatacagggaggacccacgcttcaccggctaccgggtggagagcgaagtagatacagagctggaggtgaagattcagaaggaaaatgataattttaacatcagcaagaaggatatcgaaatcaccctttttcatggagagaatgggcagttgaactgctcgtttgaaaatataactagaaatcaggacctgaccacaattctgtgcaaaatcaagggaattaaaactgcctccaccatcgccaacagttccaagaaagtccgcgtaaagcttggtaatctcgagctgtacgtcgagcaggagagcgtcccctcaacctggtacttcctaatcgtgcttcccgtgcttctggtcatcgtcatcttcgctgccgtgggtgtgacaaggcacaaaagtaaggagcttagtcgaaagcagtcccagcaattagagttactagagagcgagctgaggaaggagatcagggatgggttcgctgaactgcaaatggacaaactcgatgttgtcgacagctttggaaccgtaccgttcctggattacaagcacttcgccctgaggacctttttcccagagagtggaggattcactcacatttttacggaagacatgcataacagggacgccaacgataagaatgaatcccttaccgccctagacgcactcatttgcaataaatcgttccttgtcaccgtgatccacaccttggaaaagcagaagaatttctccgtcaaggatcgttgcctgtttgcttccttcctgactatcgcccttcaaacgaaattggtatacctgacttcgattctcgaggtcctcacgagagatctgatggagcagtgttctaatatgcaacctaagcttatgctccgaaggaccgaaagcgtggtggagaagttgctgactaactggatgagcgtgtgcctctcaggcttcttacgcgagaccgttggagaacccttttatctgctagtgaccaccctgaatcagaaaattaacaagggtcctgtggatgttattacttgtaaggcactctacactctgaatgaggactggttactgtggcaggtgccagaatttagcaccgtggcactgaatgtggtgttcgaaaagattcccgagaacgaaagcgccgatgtttgtagaaacatatccgtgaacgtattggactgcgacactattggacaggctaaggaaaaaattttccaggctttcctgtccaaaaatgggagcccatatggtttgcaactgaacgagatcgggctggagttacagatgggcacccgccagaaggaactactggatattgacagcagctcagtcatactggaagatgggattaccaaacttaacaccatcggtcactacgaaatttctaatgggtccaccatcaaggtcttcaagaagatagccaacttcacaagtgatgtggagtacagtgatgaccactgccatctgattttgccagattctgaggccttccaggatgttcaagggaaaaggcaccggggaaagcataaatttaaggtcaaggagatgtacctgacaaagttgttaagcacaaaggtcgcgatccattctgttctcgaaaagctgttccggagcatctggtccctgcctaattctcgagcacccttcgccatcaagtatttctttgattttctggatgctcaggccgaaaataagaagattacagacccggacgttgtgcacatttggaagaccaacagtctgccactgcggttctgggttaacatcctcaagaatccccaatttgtgttcgatattaagaaaactccccatatcgatggttgtctgagtgtgatcgcacaggcgtttatggacgcgttttctctaaccgagcaacagctaggcaaggaggcccctacaaataagctgctctacgccaaagacatccccacatacaaagaagaggtgaaaagctattacaaggccatcagagacttgcctcctctatccagcagcgaaatggaagagttccttacccaggagagcaagaagcatgaaaacgaattcaatgaggaagtagcactgacagagatctataagtacatcgtcaaatacttcgatgagatcctgaataaactggaaagagaacggggtctggaagaggcacagaagcagctgctccacgtgaaggttctcttcgacgagaagaagaaatgcaaatggatgtag

SEQ ID NO: 52875 - DNA, 1848 bp, Artificial Sequence
  Description of Artificial Sequence: Synthetic coding sequence
atgcagcacctgtgtttgctggctgcggtaggggtcacgaggcataagtctaaagagctgtcccgcaagcagtcacaacagttagagctgctggaatctgagctgaggaaggaaatccgcgacgggttcgctgaactgcagatggataaacttgacgttgtcgactcttttggaacagtgccgtttctggattacaagcactttgctctgaggactttcttccctgaatctggtgggtttacccacatttttactgaggacatgcacaaccgggatgccaatgataagaacgagtccctgaccgccctcgacgcactcatttgcaataaatcttttcttgtcactgtcattcacaccctggaaaaacagaagaatttttcagtcaaagacaggtgtctcttcgcctccttcctgaccatcgctctccagacgaaattggtctatctgacaagcatactggaggtcctgacacgagacctcatggagcaatgctctaatatgcagcccaagctcatgttgcgtcgaactgagtcggtcgtggagaagctcctcacgaactggatgagcgtttgcttgtccggctttctccgggagaccgtcggggagcctttctatctgttggttactactttgaaccaaaaaataaataaggggccagtagatgtaatcacctgtaaggctctgtatactctaaatgaggactggctgctctggcaagtcccagagttttcaaccgtagcattaaacgtcgtgttcgaaaagatcccagaaaatgagagtgccgacgtttgtcgaaacatctcagtcaacgtactggactgcgacaccatcggacaggccaaggaaaaaatcttccaggcgttcctttctaaaaacggcagtccatatgggctacagctgaatgagattgggctcgagctgcaaatgggaacccgtcagaaggaactgctcgacatagattcttcctcggtgatcctagaggatggaataacaaagctgaatactatcgggcattacgagatttcaaatggaagtactattaaagtgtttaagaagattgcgaatttcaccagcgacgtggagtactccgatgaccactgtcatctgatcttgccagattctgaagccttccaggatgtacagggaaagcgccatagaggtaaacacaagttcaaggtgaaggagatgtatctgacgaagctgctcagcacaaaagtcgcgattcacagtgtcttagagaagttattcagatctatatggtcactgccaaacagtagagcaccctttgcaattaagtactttttcgatttcctagacgcccaggccgagaacaagaagatcacagatccagacgtggtgcatatatggaagaccaactctctgcctctccggttctgggtgaacatattaaagaatcctcaatttgtcttcgatatcaaaaaaacaccccacatcgatggatgcctcagcgttattgcccaggcctttatggacgctttttcccttacggagcagcagctggggaaggaggctccaaccaacaagctcctgtacgctaaggacattcctacttacaaggaggaggtaaaatcctactacaaagccattcgcgacctgccacctttgagctcttcagagatggaagagttcctgactcaagagagcaaaaaacacgagaatgaatttaacgaggaggtcgctctcactgaaatctataagtacatagtaaagtatttcgacgagatactcaataagctcgaaagggagcgtggcctggaggaggcccaaaagcagctgctacatgtcaaagtgctttttgacgagaaaaagaaatgcaagtggatgtag

SEQ ID NO: 52876 - DNA, 1593 bp, Artificial Sequence
  Description of Artificial Sequence: Synthetic coding sequence
atgggcaggcttctgcgagccgcacgactgcccccattgctttctcccctcttgctcctgttggtcggcggagctttcttgggggcttgtgttgctggaagcgatgagcccggaccagaagggttgaccagcacctctcttctcgatctgctcctgccaacaggcctagagcccctggattccgaagaacctagtgagaccatgggactcggtgccggtctgggagcccctggtagtggcttcccgtctgaggagaatgaagagtctcggattctgcaaccacctcagtacttctgggaagaggaggaggagttaaacgatagttcgctggatctgggaccgacggcagactatgtttttcctgatctcactgaaaaggcgggaagtattgaggacacctcgcaggctcaggaactaccaaatctcccctctcctcttcccaaaatgaatctggtggaaccaccatggcacatgcctcccagagaagaggaagaagaggaagaggaagaagaggaacgagaaaaggaagaagtggagaagcaagaggaggaagaggaagaggagctgctgcctgtgaacggctcccaggaagaagcaaagcctcaggtccgtgacttcagcctgacctctagctctcagacgccaggcgcaaccaagtcgaggcacgaagatagtggcgatcaagcatcctcaggggtggaagtagaatcctcaatggggccatcactactactccccagtgtgactcccacaaccgtgactccaggggaccaggacagcacctcccaggaagccgaagccactgtactgcccgctgcgggactgggagttgagtttgaggcccctcaagaggcatccgaggaagcaacggccggagcggctggcttgtctggtcagcacgaagaagtgcctgccctgccctccttcccccagacaactgcaccctctggtgcagaacatcccgacgaagatccactgggatcccggacaagcgcttcttccccccctcaactcctggcacttgtcgaggaagtgttacccagacacggaagcgggcaccacggggcttggcatatatccttatccaagccctctgagaaggaacagcacctgctcatgactctagtgggagagcagggtgtggtcccgacacaggacgtgttatctatgctgggcgacatacgcaggagcctcgaggagataggcattcagaactactccactacgagcagttgtcaggcccgagcctcccaggtgaggtctgactatggtaccctgtttgtagtgttggtcgtcatcggggctatctgcattatcataattgccctgggactcctatacaactgctggcagaggcgcctcccaaagcttaagcacgtgagtcacggagaggaactgaggtttgtcgagaatggatgccacgacaatcccactctggatgtggctagtgatagccagtcagagatgcaggaaaagcacccgtcccttaatggtggaggcgctctgaatgggccaggctcgtggggagctctgatgggcggaaagcgtgacccagaagactctgatgtgtttgaggaagatacccatctatag

SEQ ID NO: 52877 - DNA, 1818 bp, Artificial Sequence
  Description of Artificial Sequence: Synthetic coding sequence
atgggcaggctgctgagggccgctagattgcccccactgctgagtccgctgctgctgttgcttgtggggggtgcttttctcggggcttgtgtggcgggaagcgacgaacccggacctgaaggtctaactagcacgagtctgctggatctgctccttccaaccggcttagagccactcgatagtgaagagccatccgagactatgggcttgggcgcaggcctgggggcaccagggtcaggctttcccagcgaggaaaacgaagaatcccgcatcctgcagccgcctcagtatttttgggaggaggaggaggagctgaatgactcctccctggacttaggccctactgccgactatgttttccctgacctgaccgaaaaggctggatcaatagaagatacctctcaggcacaggaacttcctaatctaccaagccctctgcccaagatgaacctggtagagcccccatggcacatgcctccacgggaggaggaagaggaggaggaagaagaggaggagagggagaaggaagaagttgagaaacaggaagaggaagaggaggaagaactgctccccgtgaacgggtcacaggaggaggccaaaccgcaggtgagggatttcagtctcacctcttcaagccagaccccaggcgctacaaaatctcgtcacgaggactcaggagaccaggcatcctccggggtcgaagtagaatccagcatgggaccaagcctgctgctaccttccgtgacacctacaactgtgactccaggggaccaggactctacgtctcaagaagctgaagccaccgtcttgcccgctgctgggctaggtgtagaattcgaagcccctcaggaggcctcagaggaggcgaccgcgggtgccgcaggcctcagcgggcagcacgaagaggttccagcattgcctagcttcccccaaacaacagcgcctagcggcgcagaacatcctgatgaggatcctctggggagtaggacaagcgcatcctctccacttgcacccggagacatggagttgacgcctagctccgctaccctcgggcaagaagatctgaatcaacaacttctggaggggcaggcggctgaagctcagtcccgcatcccttgggacagtacacaagtcatctgtaaggactggagcaacctagccggaaagaactatatcattctgaatatgacagagaacattgattgtgaggtcttccgccaacacaggggtcctcagctattagcacttgtggaggaagttttgccacgccacgggtccggccaccacggtgcctggcacatctctctgtcaaagccctcagagaaagagcagcatctcctcatgactctggtgggcgaacagggggttgtgccgacacaggatgttttgtcaatgctcggcgacattagacggagtctggaggagatcggaatccagaattactccaccacctcatcttgtcaggcccgagcgtcccaggtgcggtccgattacggcacactgtttgtagtcctggtggtcatcggagcaatctgcatcataatcatcgccctggggctgctgtacaactgctggcagaggcgcctccctaaactcaaacatgtttcccatggggaagaactgcgtttcgtcgaaaacgggtgccacgacaaccccaccctcgatgtggcctcagattctcagagcgagatgcaagagaaacaccccagcttgaatgggggtggagctctgaacgggcctggatcttggggagcgctgatgggcggaaaacgagacccggaggacagcgacgtttttgaagaagacactcacctgtag

SEQ ID NO: 52878 - DNA, 717 bp, Artificial Sequence
  Description of Artificial Sequence: Synthetic coding sequence
atgctgactccactaggtaaatttagcaccgcgaaattcgccgtgagacttccgcgagtttgggaggcgagagctccatcgctttcaggtgctccagctcccacccccccagctccaccacctagcaggagcagccgactcggattatggcccagatgctttctcattttcccccagctgcgcatcctgctgctcggtcctcaggaatccaacaactccacagggaccatgtggaaagtgagtgctctgctcttcgttctggggtcagcatcactgtgggtcctggccgaaggagcgtctactggacagcccgaggacgatacggaaaccaccgggcttgaaggcggtgtggctatgcccggagccgaggatgatgtagtgacaccaggaacgagcgaagaccgctacaaatcgggtctgactacgctggttgccacaagcgtcaactccgtaacaggcattcgcatcgaggacctgcccacatctgagtctactgttcacgctcaggagcagtcccctagtgctacagcctccaatgtcgcaaccagccattccaccgaaaaagtcgatggggacacccagactactgtggaaaaggacggactttccaccgttaccttggtgggcataatagtgggcgtgctactggccattggattcatcggggctatcatcgtggttgtcatgagaaagatgagtgggagatactcaccttag

SEQ ID NO: 52879 - DNA, 711 bp, Artificial Sequence
  Description of Artificial Sequence: Synthetic coding sequence
atgctgacacccctcggtaaatttagtactgccaagtttgcggttagactgcctcgcgtgtgggaagccagagcacccagtctgagtggcgcacctgcccctactccacctgcacctccaccatcacggagctctcgcctcggcctttggcccagatgtttcctcattttcccgcagttacgtattctgctcctcgggcctcaggagtctaataatagcaccggaaccatgtggaaagtcagcgccctgttatttgtgcttggcagtgcgtcattatgggtcctcgccgagggggcttccacaggccagcctgaggatgatactgagaccacgggtctggagggcggagtggcgatgccaggtgccgaggatgacgtcgtgacccccggtacaagcgaagaccgctacaagtcaggtctgacaacactggtggccacatctgtaaattccgtgacaggcattcgtattgaagacctgccaacctcagaatccacagtccacgcacaagaacagtccccttctgcgacggcctccaacgttgctacaagccatagcacggagaaggttgatggggacacccagaccactgtggaaaaagacggcctgtccacggtgacacttgttggaatcatcgttggagtgttgctggctattggctttatcggggcaataattgtcgtggtaatgaggaaaatgagtggacggccatag

SEQ ID NO: 52880 - DNA, 363 bp, Artificial Sequence
  Description of Artificial Sequence: Synthetic coding sequence
atgcccggtgcggaagacgatgtcgtgacacctggtaccagtgaggatagatataagagcggactgaccactttagtggcaacctccgtgaatagcgttaccgggatacgaatcgaagacctgccaacctccgaatctactgttcacgctcaggagcagagcccgtctgctactgcgtccaacgttgcaacctctcattcgactgagaaagttgacggagatacacaaaccacagtcgagaaagatggcctttcaacagtgactctggtgggaataattgtcggggtactcttagccataggtttcataggagcgatcattgtggtggtgatgcgtaagatgagcggtcgatacagcccctag

SEQ ID NO: 52881 - DNA, 357 bp, Artificial Sequence
  Description of Artificial Sequence: Synthetic coding sequence
atgcctggagccgaggacgatgtggtgactcccggaacgtctgaggaccgctacaaatccggcctgacgaccctggtcgctactagcgttaatagtgtaaccgggatccggattgaggatctacccacttccgagagtacagtacacgcccaagagcagtctccttccgctactgcgtcaaacgtggcaaccagccatagtacagagaaagtggacggcgacacccagacaactgtggagaaagacggcctcagcaccgttaccctggtcggaatcatcgtgggcgttctgctggctattgggttcatcggcgctattatcgtggtcgttatgagaaaaatgagtggaaggccttag

SEQ ID NO: 52882 - DNA, 363 bp, Artificial Sequence
  Description of Artificial Sequence: Synthetic coding sequence
atgccgggtgccgaagacgatgttgttacccccggaacctccgaagaccgctacaaaagcgggctcactaccctcgtagcaactagcgtgaattctgtaacagggatacgcatcgaggacctccccaccagcgaaagtactgtgcacgcacaggaacagagtccgagcgctacagcaagtaatgtggctactagccattcaactgaaaaggtggatggcgatacacaaactactgtggaaaaggacggtttgtccactgtgaccttagtcgggatcatcgtaggagttctcctggctataggttttataggcgctattatagtcgttgtgatgcggaagatgtcaggtagatactcaccgtag

SEQ ID NO: 52883 - DNA, 363 bp, Artificial Sequence
  Description of Artificial Sequence: Synthetic coding sequence
atgcccggagccgaggatgacgtggtgactcccggtacgtccgaggatagatataagtctggcctgaccaccttggtcgcaaccagcgtgaattctgtgacgggaattaggattgaggatttgcccacatctgagtcgaccgtccatgcccaggagcagtcaccttcggccaccgcaagtaatgtggccaccagtcactccacagagaaggtggacggcgatactcaaaccacggtggagaaagacggcttgagcacggtcacccttgtgggaatcatcgtgggggtgttgttggccattggattcatcggagccataattgtcgtggttatgagaaagatgtcgggaagatacagcccttag

SEQ ID NO: 52884 - DNA, 981 bp, Artificial Sequence
  Description of Artificial Sequence: Synthetic coding sequence
atgaggactgaagcccaggtaccagcactccagccccctgaacccggactggaaggagcaatgggccaccgtaccttagtactgccttgggtgctactcacattgtgtgttaccgcaggcactccggaggtatgggtccaggtgcgcatggaggccaccgagttatcttctttcacgatcagatgcggatttctgggaagcgggtctatttctctcgtgacggtatcctgggggggaccaaacggtgcgggaggcaccacactggcggttctgcacccagagcgcggaattcgtcagtgggctccagctcggcaggctagatgggaaacccagtcctccatcagtctcattctggaaggcagcggagccagctcaccttgcgcaaatacaactttctgttgcaagttcgcgagctttcctgagggctcctgggaagcctgcggttctcttccaccctcttccgatccaggcctctcagccccaccaacccctgcaccaatcctgcgagccgatctcgctgggatcctgggggtctccggagtcctgctgtttggctgtgtctacttactgcacttgctgcgcaggcacaagcaccggccagcccctagactgcagccctcaaggacctcccctcaggcacccagggcgcgtgcttgggcaccctcgcaagcctcacaggctgctttacacgtgccgtatgccactatcaacaccagttgccgccctgcgaccctggatacagcgcatccgcatgggggtccaagctggtgggcaagcctgcctactcacgctgcccaccgacctcaggggccagcggcttgggctagtacacctatccccgcacgcggttctttcgtatcagtcgaaaacgggttatatgcccaagccggagaaaggccccctcacactggccctggactgaccctgttccccgatcctcgagggccacgcgctatggagggccctctcggggttagatag

SEQ ID NO: 52885 - DNA, 972 bp, Artificial Sequence
  Description of Artificial Sequence: Synthetic coding sequence
atgcagccctccgggtgggccgcagcgcgtgaggccgctggcagggatatgctggcggctgatctccgctgcagtctgtttgcctcagctttgcagtcttacaaacgtgacagtgtgcttcgtcccttccctgcctcatacgcccgaggggactgcaaggacttcgaggccctgctcgcggatgctagcaagctacccaacctaaaagagctgctccagtcaagtggcgataatcataagcgcgcttgggatctggtgagctggatcttatcatctaaagtgctcaccattcactccgctggtaaagctgaattcgaaaaaatccagaagctcaccggagcgccacacactcctgtgccagccccagattttctttttgagattgaatacttcgatcccgcaaatgcaaagttctatgagactaagggagagcgtgatctcatctatgccttccatggatcgaggctggaaaacttccactcaataattcacaacggcttgcactgccatctgaataagacgtctcttttcggggaagggacatatctgacaagtgacctgagcctcgctcttatatattccccacacggccacggatggcaacactccctgcttgggcctatcttatcctgcgtggcagtgtgcgaagtaatcgaccatcccgatgtcaagtgtcagacaaaaaaaaaagatagcaaggagatcgacaggcggcgtgccaggatcaaacatagcgagggaggtgatatacccccaaaatatttcgtcgtgaccaataatcaactcctgagggttaagtaccttctcgtttacagtcaaaagccaccaaaatcaagagctagctcccagctgtcctggttcagctcacactggtttaccgtgatgatttccctgtacctgctactgttgctgatagtatcggtaatcaactcctccgcatttcagcatttctggaatcgagccaagcgctag

SEQ ID NO: 52886 - DNA, 1563 bp, Artificial Sequence
  Description of Artificial Sequence: Synthetic coding sequence
atgttctgcacacggggactgctgtttttcgcattccttgctggtcttgatatcgaatttacaggcctacggagcaatttgagtggacctcagcagatatccctgttcgatcttccgtctgagtggtacctgaaaaccagacaatctgtgcaacagttcacagtatgtcaaattggcctgtcggtcttctccgcaattgaaggggaagcaaataaatatattgcccacagctgcaacttttacctgttccccacgaccttcggtatacttgatagtgaattctcattccaagcgagtagtgtccagtttctgaatcaatatggcttcaattataataagttcctaaagaatggcataccctacatgaacgaggaacaggagaagaaaatcaggcacgatatattgacgggcaattggcgggtccggagcagtcctgataaggaccagatcaaagtagtgattgacgaagttacgcggtggttggaactggctaaggagggcgattggatgaccctgcccggaatcacaggctttcaggccttcgaagtccaactggtgctgcgacaggccctccccaatatttggactgtgcttaaggatgaaggcgtcgtggtgaagaaggtttcaaaacagcaccggtggtatctccaaaacacatcttgtgatagagagtcttgctggaaggagaacatcttgctctccgcacggggtttttctgtttttttccagatgctggttaaggcccagaaacccctggttgggcataacatgatgatggacctgctgcacttacatgaaaaatttttccggcctttgcccgaatcgtacgatcaatttaagcagaatatccactctctgtttcctgtgttgattgataccaaaagtgtgacaaaagatatttggaaagagatgaactttccgagggtgtctaacctttctgaagtttacgaagtattgaatagtgatctgaaccccactaagaatagcggacccgagatcgtgcatgccagccgatgcgagaaatacgttgagacaaagtgtcctcatgaagcagcatatgacgccttcctctgtggctcagtcttgcttaaagtcgctcatctgctgcttcagaaaatttaccacattgaccctgtgcccgagtcgtccttccctcagtacctggatgtattggccccttacgttaaccaggttaacctgatccgggctggagtccccaaaatcaacttttcaggaccagactatccttcgatccgccctcctatcttgatcctctctgttaagcgatggcctggtgtgagcgagcagcaggtctaccacaaattccaaaacctctgcaaattcgacgtgcggaggctgacgcggtcacagttcctgctgctgacaaacaaattcaaggacgcaaggaacatcctcaaagagtacagggatcaccctacgttgtgcataagcttgtataggtattggcggcattcaccgaatgtcaactgtttgctacaggtatgtggcattgttacggcgtgggcgttgttggccttcattctgggacgtagcgggacctag

SEQ ID NO: 52887 - DNA, 792 bp, Artificial Sequence
  Description of Artificial Sequence: Synthetic coding sequence
atggataactcatggcgcctcgggcctgctataggactgtctgccggacagtcgcagctccttgtctctctgctgcttctgttgacaagggtgcaacccggtacggacgtcgctgcccctgaacacattagctacgtgcctcagctttctaatgacacacttgccggtaggttgacactctctactttcacgttggagcagccactcggtcaattctcctcacataacatttcggacctcgacacaatctggctcgtagtagccctgagcaacgctacgcagtccttcactgctcctcggacaaaccaggacatccccgcacctgcgaattttagtcagagaggttactatctaacgttgcgggctaaccgggtattgtaccagacccgtggccagctccatgtgctccgggtcggcaacgatacgcattgtcaacctacaaagatcggatgtaatcaccccctgcctgggcctggaccttaccgggtcaagttcttagtgatgaacgacgaggggcctgtcgcggagacgaaatggagctccgacactcgccttcagcaggctcaggctttgcgtgccgtgcccggtccacagtcccccggtacagtagtcattatcgccatcctgtccatcttgctggctgtgcttctcaccgtcctgcttgccgtgctgatatatacctgcttcaacagctgtcggagtacaagcctttcaggtccggaagaggccggatccgtccgccgttacacaacccatctggctttttcaacaccagcagaaggagctagctag

SEQ ID NO: 52888 - DNA, 2352 bp, Artificial Sequence
  Description of Artificial Sequence: Synthetic coding sequence
atggccgcttgccgttattgctgtagttgcctcaggttgaggcctctgagcgacggcccattcctccttccacggagggacagagctctcactcagctgcaggtacgagctctctggtcctcagctgggtcccgggcagtggcagtggaccttggcaaccgcaaactcgagatcagcagtggcaagttggcacggttcgcagatggctctgctgtggtccagtccggcgacacagccgtgatggtcactgccgtctcaaagaccaagccttccccctcccagtttatgcctctggtcgttgattatcgacagaaagcagccgcagccggtagaattcccaccaactatttgcggagggagattggtacatccgacaaggagatcttgacctctaggatcatagaccggagtatacgccctctgttccctgccggttatttctacgatactcaagtgctgtgtaacctgttggctgttgacggggtaaacgagcctgatgttttagctattaatggagcgtcggtagccctgagcctcagcgatatcccctggaatggccctgtgggagctgtgaggatcgggataatcgatggtgagtacgtagtgaatcctaccaggaaagagatgtcatcctctaccctcaatctggtggtcgcgggagcaccaaagtctcagattgtgatgttggaggcctcggctgagaacatcctccagcaggatttctgccacgctattaaggttggtgtcaaatacacgcagcaaattattcaggggatccaacagcttgtcaaggagactggagtgacaaaacgaaccccgcagaaactcttcacgccttcacctgaaatcgtcaaatatacacacaaactcgctatggagcgcctgtacgctgtattcactgactacgaacacgataaagtgtccagggatgaggcagtgaataagattagattagacactgaggagcagttgaaagaaaagtttcccgaggctgacccatacgaaattattgagagctttaatgtcgtcgccaaagaagtcttcagatcaatcgtactgaacgagtacaagcgctgcgacgggagggacctcacatctctgcgaaacgtgtcatgcgaggtggatatgtttaaaacacttcacgggtcagcactcttccagaggggacagacgcaggtgctctgtaccgtaacctttgactccctcgaaagcggtataaagtccgaccaggtgatcactgcgatcaatggcattaaggacaaaaatttcatgctgcattacgaattcccgccttacgctaccaatgagattggtaaagtgaccgggctgaatcgcagagagttgggccatggagctctggcagaaaaagctctgtatcccgtgattccacgagattttccattcacaattcgcgtgacctcggaagtactcgaatccaacggcagcagttccatggcaagtgcatgcggaggaagtctggccctgatggacagtggcgtgcctataagctccgccgttgctggcgtcgctattggactcgtgaccaagaccgatcctgagaagggcgaaatcgaagactatcgcctgctgaccgacatcttgggtatcgaggattataatggcgacatggattttaaaatagccggaactaacaagggaataaccgccctccaggccgatattaagttgcctgggattccaatcaaaattgtgatggaagcaatccagcaagcttctgtcgctaagaaggagatactgcagatcatgaacaagacaattagtaagcctcgggcttcccgcaaggaaaacggacccgtggtagagaccgtgcaggttccgctgtctaaacgcgcaaaattcgtcggacctggagggtataacctaaagaagttgcaggcggagaccggtgtcactatctcccaggtggacgaagaaacgttcagtgtcttcgccccaactccaagtgctatgcacgaagcgagagatttcataaccgaaatttgcaaagatgatcaggagcagcagctagagttcggagctgtatataccgcgaccatcacagagatcagagataccggcgtgatggtgaaactatacccaaacatgaccgccgtgctgctgcataacacacagctggaccagaggaagatcaagcaccctaccgcacttggcctggaggtcggccaagagatacaggtaaagtacttcggcagggatcctgcagatggacgaatgcgcctttcacgcaaggttctacaatcaccggcaacaacagtggtccgcacgctaaatgacaggtcctctattgtaatgggagagcctatttctcagtcttcctccaacagccaatag

SEQ ID NO: 52889 - DNA, 2352 bp, Artificial Sequence
  Description of Artificial Sequence: Synthetic coding sequence
atggccgcttgccggtactgctgtagctgtcttcggctccgtcctctgagtgacggaccctttctcctgcccagacgagaccgggcactcacccagttacaagtccgggcactttggtcctcagccggaagtagagccgtagctgtggatctggggaaccggaaactggagatcagttctgggaagctggcccgattcgccgacggaagcgcggtggtgcaatccggggatactgcagtgatggttacagccgtgtcgaagactaagccctctccaagtcagtttatgccactagtggtggactatcgacagaaggccgcagctgccggaagaattccaacgaattatctcagacgcgagataggcacatcagacaaagagattcttacgtcgcggattattgatcgttctatccgaccgctctttccggctggctacttttatgacactcaagtactgtgtaacctgctggctgtggacggagtcaacgagcccgatgtccttgccataaacggggcttcagttgctctcagtctcagcgacatcccttggaacgggccagtgggagccgtccgaatcggaattatcgacggcgagtatgtggtgaatccaactcggaaagagatgtcatctagcaccctcaacttggtcgtggcaggagctcccaaaagtcaaatagtcatgctcgaagccagcgctgagaatatcctgcagcaggacttctgccacgccatcaaagtgggcgtgaagtacacacagcagattatacagggcatacagcagttggtcaaagagaccggggtgacaaagagaactccccaaaaactttttacccccagtcccgagatagttaagtatactcataagttagcgatggagcgactctacgccgtcttcactgattatgagcacgacaaggtatctcgggacgaggccgttaacaaaatacgtctggacaccgaggagcaactgaaggagaagttcccagaagccgacccatatgaaatcattgaaagtttcaacgtcgttgccaaagaggtctttagatcgattgtgttaaacgagtacaagaggtgcgacggccgagatttgacatcactgcgcaacgtgagctgcgaagtcgatatgttcaaaaccctccatgggagtgcactctttcagcggggacaaacccaggttctttgtactgtaactttcgatagtctagagtccggcattaagtccgaccaggttatcaccgcaattaatggtataaaggataagaattttatgctgcattatgaattcccgccttacgccactaatgaaatcggaaaggtgaccgggctcaatagacgggaacttggccacggggctctggccgagaaagccctgtaccctgttatacctcgtgatttcccctttacaatccgtgtgacttcagaggttctagaatccaacggatcctcctctatggcttctgcctgtgggggttcccttgccctgatggattccggtgtgccaatatctagcgcggtcgccggagtagccattggactggtcactaagactgatccggagaaaggcgagatcgaagattataggctactcaccgatattttaggcatcgaagattataacggggacatggatttcaaaatagcaggcactaacaaaggcattaccgctctccaggccgacataaagttgcccggaatcccaattaaaattgtcatggaagccatccaacaagcatccgtcgcaaaaaaggaaatcctgcaaatcatgaataaaaccatcagcaagcccagagccagccggaaagaaaacggcccagtggtggagaccgtccaggtgcctctgtctaagcgcgctaagttcgtgggcccaggcggttacaacctgaaaaaactgcaggcagagacaggtgttaccatatcacaggtagacgaagaaacattcagcgtgttcgccccaacccctagcgcaatgcacgaagcgagggattttatcacagaaatctgcaaggacgatcaggagcagcagctggagtttggcgcagtttacaccgctaccataacagagattagggacacgggagtgatggtgaagttgtaccctaatatgacagccgtgctgttacacaacacacaattggaccagagaaagatcaagcacccaacagccctcggtctcgaggttggccaggaaatccaggtaaaatattttggccgtgatccagctgatggccgaatgcggttgagcagaaaggtgcttcaatccccagctacgacagtggtgaggacactgaatgaccgttcaagcattgtgatgggagaaccgataagccaatcttcttccaacagccagtag

SEQ ID NO: 52890 - DNA, 2955 bp, Artificial Sequence
  Description of Artificial Sequence: Synthetic coding sequence
atggtctgtagcccagttactgtgaggatagcgccacccgatcggaggtttagccgcagtgcaatccccgagcaaattatatctagcaccctctcttccccctcttctaacgctcccgacccttgtgcgaaagagaccgttttgtctgcgctcaaagaaaaggagaaaaaaagaacagtagaggaggaggatcagatcttccttgacgggcaggaaaacaagcggagaagacacgatagctccggcagtggccattccgcctttgaaccccttgtcgcaaatggcgtgcctgcctcgtttgtccccaagccaggaagtctgaaacggggtctgaacagtcaatctagcgatgaccatttgaacaagaggtctagaagctccagtatgtccagtctgactggggcatatgcctccggaattccctcaagctctagaaatgccataacaagcagctacagctccaccagaggaatttcacagctgtggaaacggaacggccctagctcttccccgttcagttcgccagcatcatcaaggtcgcagacgcccgagcggcctgctaagaagatcagggaggaggagctctgtcatcatagctcttcttcaacacccctggctgccgatcgcgaatcccaaggggaaaaagctgccgacacaactcccagaaagaagcagaacagcaattcccaaagcaccccaggctcctcgggacagcggaaacgcaaagtacagttactgccatcccgacgaggcgagcaactcactttaccacctcccccacagttaggatactcgatcactgccgaagacttggacctggagaaaaaagcttctctgcagtggttcaaccaggccctggaggataaaagcgacgctgcctccaactccgttacggaaaccccacccatcacccagccatccttcacgttcacactgcctgctgccgctccggctagtcctccgacctccctgctggcgccttctaccaatccgctgctcgaaagcttgaagaagatgcaaactccgcctagccttcctccttgtcctgagtccgctggtgccgctacaactgaggcactgtcaccgccaaaaaccccaagtctgctgccccctctggggctcagccagtctggccctcccggacttctcccaagccctagcttcgactcaaagccccctactaccctccttggacttatccctgctcccagcatggttccagccactgatacaaaagctcctccgaccctccaagctgaaacggcaaccaaaccccaggcaacctcagccccatcccctgctcccaagcagtcttttctgtttggaacccagaatacatccccaagctcccccgctgcacccgcagcaagctccgccccacccatgttcaagccaatattcaccgctcccccaaagagcgagaaggaaggacctacgcccccagggccttcggtgactgcaaccgctccaagtagcagttcattgcccacaaccacttctacgaccgcgccaactttccagccagtgttctcctcaatgggtccaccggcttcagttcccctgccggctcctttcttcaagcagactactactcccgcaacagcgcctacaaccacggctcctctctttacaggactagcctccgctacctccgcagttgcccctatcacatccgcgagcccttccacggatagtgccagtaagccagccttcggcttcggcattaactcagtgtccagctcctctgtatcaaccactacgtcaacagcaacggccgctagtcagccattcctgtttggagctcctcaggcatcagcagcgtctttcactcctgcaatgggctccatctttcagtttgggaagcccccagcgctgcctaccactaccactgtgactactttctcccagtcgctgcacaccgcagtcccaacagctaccagtagctccgccgcagacttttcgggcttcggctctactctggccacttccgcccctgcaacttcaagccagccaactctcacctttagcaatacttcaactccgacttttaacatccctttcggcagctcagctaagagccctctgccaagctaccccggagccaaccctcagccggcattcggcgctgcagagggccaaccaccaggggcagccaagccagcactagccccttcgttcggttcttccttcacattcggtaacagtgccgctccggctgctgccccaacacctgctccaccatccatgattaaggtggttccagcctacgtgcccactccgatccatcccattttcggcggagcaacccactccgcgtttggtctgaaggcaactgcctccgccttcggggcacccgcaagcagtcagcctgcttttgggggatcgaccgccgtgttcttcggagctgccacctcaagcgggtttggagcaaccacacagaccgccagttccggcagctctagctctgtcttcggttccactacacccagcccattcacctttggtggttccgcagcccctgcgggttccggttccttcggcattaacgtcgccacccccggatccagtaccaccaccggagcattctctttcggggctggccagtcaggatctacagccactagcactccttttgcgggagggttgggccaaaatgccctcgggacgacggggcaaagcactccgttcgcattcaatgtgtctagcacaaccgaaagcaagccagtgttcggtggcaccgccaccccaaccttcggactgaacacaccagcaccaggcgtgggcactagcggttcaagtctttccttcggagcctcctccgcacctgcccaaggattcgtgggagtggccccatttggcagcgccgctctgtcattttccataggagccggatctaaaacaccaggagctagacagagactacaggcccgaagacagcacacgaggaaaaaatag

SEQ ID NO: 52891 - DNA, 2955 bp, Artificial Sequence
  Description of Artificial Sequence: Synthetic coding sequence
atggtctgctcacccgtgaccgtgaggattgccccacccgatagaaggttttccagatctgcaatccctgagcaaataatcagcagcactctgagctctccgtctagcaacgcgcctgatccgtgtgcaaaagagacggtgctttcagccctgaaggagaaggagaagaagcgcacagtcgaagaggaagatcagatatttctcgacgggcaagaaaataagcgacgacgacatgactcgtctgggagcggacactctgccttcgagccactggttgccaacggagtgcctgcctcatttgtccctaagcccggttccctgaagaggggattaaactctcagtcttccgacgaccatctgaacaaacgctcaaggtcatcctccatgtctagcttaaccggcgcttacgcatcaggcattccttcatcttccagaaacgccatcacttcaagttatagctccaccagggggatctcacagttatggaaaagaaacggtcccagttcaagcccattttcctcacccgcttctagccggtcccaaacaccagaacgacccgcaaagaagattcgagaagaagaactttgccaccactcttccagttccacacctttagcagccgaccgggaatcccagggcgagaaagccgcagacaccactccgaggaaaaaacagaattctaactcccaaagtacgccgggatcctctggacagcgcaagcgcaaggtccagcttctgccgagccgtagaggcgaacagctcaccctgccgccacctcctcagcttgggtattccatcactgcggaggatcttgaccttgaaaaaaaggcttctctgcaatggtttaaccaagcactggaagacaagagtgacgctgcaagtaactctgtcactgagacacccccaatcactcagccttcatttactttcacactgccagcggcagcccctgcatctccccctacctccttactggctccttctaccaatccactgctggaatctctcaaaaagatgcagacccctccttccttacctccttgccctgagtctgccggagcagctacgactgaggctctaagcccgcctaaaacaccctccctgctgccaccacttgggcttagccagtccggcccacctggtcttctgccctctcccagttttgatagcaagccacctacaactctgttggggctgatacccgctcctagcatggtgccagccactgatactaaggccccacctactctgcaggcagaaacagctacaaaaccccaggctaccagtgccccaagccctgctcctaagcagagcttcttgtttggcactcagaacaccagtccttcaagcccggcagcacccgctgccagtagcgctccaccaatgttcaagcctatcttcaccgcaccacccaaaagtgaaaaggaaggcccaacacctccgggaccaagcgttacagcaacagccccatcatcttctagtctgcctacaacaacgtctactacagcccctactttccagcccgtgttttctagtatgggaccccctgccagtgtcccattgccagcccctttctttaagcagaccacaaccccagccaccgcccctacaacaacggcccctcttttcacaggtttggcgtccgcaacttctgcagttgctccaattacctccgcgagtcccagtactgactctgcaagcaagcctgcctttggtttcggcatcaatagcgttagtagctctagtgtgtcaactaccacgtcaaccgctacagcggcaagccagccctttctgttcggggctcctcaagcgtccgccgcaagcttcacgcccgcaatgggaagcatttttcagtttgggaagccacctgcacttcctaccaccacaacagtgacaacctttagccagtctctgcacactgctgtccctacagcaacaagctccagcgctgcggacttctcgggctttggatccacccttgccacctccgccccagccacatcatcccagccaactctcacattttcaaatacttcaacgcctacttttaacatccctttcggctcttcagccaaatcgcccctgccctcgtacccaggagcaaatcctcaacccgcatttggagcggcagaaggacagccaccaggagctgctaagcctgctctggcaccctcctttggaagtagttttacatttgggaatagcgctgcgccagccgcagcacccactccggctccgccttctatgattaaggtcgtcccagcttacgtgccaactcctatccacccaatcttcgggggagcgacccacagcgctttcggcctcaaagccaccgcctctgcttttggggcaccagcctctagccagcctgcattcggcggatccaccgcggtattctttggcgctgcaacaagttcgggattcggggcaacgacacagaccgccagttccggatctagcagcagcgtttttggtagcacgacgccttccccattcacctttggcggaagcgctgccccagccggatctggaagcttcggcatcaatgtggctactcctggctctagcacaactacaggcgcattttcattcggcgcaggacagtccggtagcaccgcaactagtaccccattcgccggaggattagggcaaaatgctcttggaactacgggccaaagcaccccttttgcctttaacgtgtcctccaccacagagtcgaagcccgtgttcggcggtactgccacaccaactttcgggctgaatacacccgctcctggagtaggcacttcaggatcttcactgtcctttggcgcatcctcagctccagcccagggattcgtgggagtggctccttttgggagtgctgcattatcctttagtataggagcaggtagcaaaacgccaggggctcgccagagattgcaggctcggcgacagcatacgcggaagaagtag

SEQ ID NO: 52892 - DNA, 3000 bp, Artificial Sequence
  Description of Artificial Sequence: Synthetic coding sequence
atggtctgtagtcctgtgacagtgaggattgcccctcccgatcgcagattcagtcgatccgccattcccgagcaaattatctcatccaccctatctagcccaagctccaatgcccctgacccatgtgctaaggagaccgtcctcagtgcactcaaggagaaagagaagaaaaggaccgtggaagaggaagatcagatttttcttgacggtcaggagaacaagagacggaggcatgactcttcaggttcagggcactccgcttttgaacccctggtcgctaatggcgtgcccgcatctttcgtgccaaagcctggcagccttaagaggggattgaattcccaatcttccgatgaccacctcaacaaacgcagtaggagctcctcaatgtcatctctgaccggagcctatgcgtctggaattccgtcttccagccgaaacgccattaccagcagctactcgagcactcggggtatcagtcagttatggaagcgaaatggtcccagttcaagccctttcagcagcccggcatccagtagatcccagacccctgaacggccagcaaaaaagatacgagaggaggagctatgtcaccatagtagttcttcaacccctctggccgcagacagggagtcccagggcgagaaggccgcagatacaactcccaggaaaaagcagaactccaactcccagtctacccccggaagctctgggcaacgcaaaaggaaggtgcaactgctgccttcccgcaggggcgagcagttaactctgccaccgcctccccagttggggtatagcataaccgctgaagacctcgaccttgagaagaaagcctcgctgcagtggttcaaccaagccctggaagataagtccgacgccgctagcaattcagtgactgagacaccaccaattacacagccaagtttcacttttactctgcctgctgccgctccagcttccccccctaccagtttgctcgcaccgagcacaaatcctctgctcgaatctttaaagaaaatgcagacccctcccagcctgcccccatgtccagaaagcgctggtgccgcaacaacagaagccttgtcgccacctaagacaccgtcgcttctgcctccacttggtttgagccagtccgggccacccggactgctgcccagtcctagcttcgattcgaagccaccgaccacgctgctgggactgattccggctccatctatggttcctgccactgataccaaagcacctcccacactgcaggccgagacggctaccaagccacaggccacatcagctccttcaccagcccctaaacagagcttcctgttcggcacccagaacacttccccttcaagtccagccgcaccagccgcatcaagtgcccctcctatgtttaagcctatcttcacagccccacctaaatcagagaaagaaggaccaacgccacccggaccatccgtgaccgccacggccccatcttcatccagccttcccactacaacaagcacgaccgcccctacctttcaacccgtatttagttccatgggacccccagcttctgtacctctgccagctcctttctttaagcagacaacaactcccgcaacagcccctacgacgactgcacccctctttactggattagcctcagccactagtgccgtcgcacctattacctctgctagtccctccaccgactcagcctccaaaccggcttttggttttggcatcaatagcgtgagttcatctagtgtttctacaacgacaagtacagctacagctgcttcacaaccctttctgtttggcgctcctcaggcgagcgccgcaagctttacgcccgcaatgggctcgatctttcagtttggaaaacccccagccctgcccacaaccaccacagtaactaccttcagccagagcctccatactgccgttcccaccgccacttcctcaagcgctgccgacttctccgggtttggaagcacactggctacgagtgcaccagccacatcatcccagcccacacttacatttagtaatactagtaccccgacctttaacatccccttcgggtcctccgccaaatcacctctgccctcctacccaggggcaaacccccagcctgccttcggcgcagcggagggacaacctccgggagcagcgaagccggctcttgccccttcatttgggtcatctttcacttttggaaattctgcagccccagccgctgcccctactcctgctccgccaagcatgatcaaggtggtgccagcgtacgtgcccacccccatacaccccattttcggtggcgcaacacattctgctttcgggcttaaggccacagcgagtgcattcggcgcaccagcaagctcacagcctgctttcggcggaagcacggccgtgttttttggcgcagccacatcctccggctttggcgctaccacacagacggcaagcagcggatcatctagcagcgtgtttggcagcacaactcccagtcctttcacatttggaggcagcgctgctcctgctggatctggatcttttggaatcaacgtcgcaaccccgggaagctctaccactacgggggctttctccttcggagcaggacagtctggctcaactgccacatctacgccgttcgccggagggttaggtcagaacgcgttgggcaccaccggccagtctacacccttcgcgttcaacgtgtcgagtactaccgagtcaaaacctgtgtttggcggtacggccactcccacttttggtctgaacacgccagctcccggtgtcggcacaagtgggagttcccttagttttggggcttcgagtgcacctgcacaaggcttcgttggagttgcaccatttggaaacacgtttgcccaccagcaggaacacagcccgagaaaagggccaaataacctgtctaagcgcaaattactgcctgctgtcagggcgcaaggtcttcctcgccgaggacaggctagcagctttcccacacgcaaggaatag

SEQ ID NO: 52893 - DNA, 3750 bp, Artificial Sequence
  Description of Artificial Sequence: Synthetic coding sequence
atgagtcctgcagcagcggcagcaggagcaggggaaaggcgacgtcctatcgcttctgtcagagatgggcgtgggagaggatgtgggggtcccgctcgagctgttcttcttggcctgtctctagtagggctcctcctgtacctcgtgccggctgccgctgcccttgcgtggcttaccgtcggggctaccgccgcatggtggggactgtcccgcgaaccccgtggatctagacctctgtcctcctttgtgcggaaggctcgccatcgcagacccctcagttccttcgtaagaaaggccaggcaccggagaacactctttgccagcccactggctaaatccaccgccaacggaaaccttttggagccccgtacgctgctagaaggacccgaccccgctgagctcctgctcatgggcagttatcttggaaagcctgggccaccacagccagcagctgccccagaaggccaggacctgcgggatcggcctggacggaggcctccagcccgacccgctcctaggtcacccccaccacgctcccctccaccaagatccccacctcccagtccaccaactcaccgtgcgcaccacgtgtacccctcgttgcccacgcctctgctccgaccttcaaggcggccttctcctcgtgactgtggcaccctgcctaacagatttgtgatcactcccaggcggcgataccccatacatcaggcccagtacagttgtctgggcgtgcttcccaccgtgtgttggaacgggtatcataagaaagcggtgcttagccccaggaactcgcgcatggtgtgttctcccgttactgtgcgaattgccccacctgatcggagattcagtcgaagcgcaattccagagcagatcattagcagcacgttgagctctccaagctcgaacgcacccgacccttgcgcaaaggaaacggtcctgagtgcccttaaggagaaggagaaaaagaggactgttgaagaggaagatcaaattttcctggatgggcaagaaaataagaggcgaaggcacgactcttcgggatccggccattctgcatttgagccgctcgtggcaaatggggtgcctgcctcgtttgttcctaaacctggctcccttaagagaggccttaacagccagagctctgatgaccatttaaacaaaaggtcccgcagcagcagtatgagtagcctgaccggtgcatatgcctctgggatcccctctagctctcggaacgccattacaagctcctattcgtcaacgaggggtatctctcaactgtggaaacgcaacggacccagctctagtccattctcctcacctgccagttctaggtcacagacccccgaacgtcctgctaaaaagatccgcgaagaggagctctgtcaccacagcagctcgtctactcctctggcagcagatcgtgaatcccagggcgagaaggctgctgacacaactccacgaaaaaaacagaacagcaacagccagtcgacacctggatcatcaggccaaaggaagcgaaaagttcagctgttgccaagccggcgtggcgagcagttaacacttccaccccctccccagcttgggtactctatcaccgcagaagacctcgacctggagaagaaggctagcttgcagtggtttaaccaggccctggaggataagtcagatgccgcttccaatagcgtgacagaaactccaccaattacacagccatcattcacatttacactacctgccgcagccccagcgtcacctcctacctcactcctggccccatctacaaaccctcttctcgaatctctgaagaagatgcagacacctccaagtctgcccccatgccctgagtcagcgggtgcagcgaccactgaggcacttagccctcctaagacacccagcctgttgcctcctctcggacttagccaaagtggacctcctggactcctgccatcgccgagtttcgacagcaaaccgccaaccacactattagggctgatcccggctcctagcatggtgcctgccaccgacacgaaagccccacccacactgcaggccgagacagccaccaagccccaggccacttccgccccttcccctgcccctaagcagtcctttctgtttggcacccagaatacatctccctcctctcccgctgcgcctgcagcctccagtgcccctcctatgttcaagcccattttcacagcccctccgaagagcgagaaggaggggcctacacccccaggtccctccgtgacggctaccgcaccgtcctccagttctctgcctacaactacatccacaaccgcacccacttttcaaccagtgttttcctcaatggggccacctgccagcgtgcccttgccagcaccattttttaaacaaaccacaacccccgctactgcaccaacaacaactgcacctctgtttacaggtttagcctcagctactagtgctgtcgcacctattacatcagcatccccctctacggacagcgcctctaagccagccttcgggtttggcattaactccgtctcgagttccagcgtctccacaacaacatcaaccgccaccgccgcatcacagcctttcctttttggtgctcctcaagcttccgccgcttcctttacccccgcaatgggaagtatcttccaattcgggaaacccccagcactgccgactactacaaccgtgacgacttttagccagtccctacatacggccgtccccacagccaccagcagcagtgcagcggacttctctggattcggctctactctggctacttcggcacctgcgaccagctcccagccaaccctgacattttctaatacttctacacctacattcaacattcctttcggatctagcgcaaaaagtccactgccttcctaccccggagcaaacccccaacctgcgtttggcgcagccgagggacagccccctggcgcagccaagcctgctctcgctccctcattcggctcttcctttacatttgggaactccgccgctcccgctgccgcacctactcctgcccctccgtcaatgatcaaggtggtgcctgcctatgtacccacacccatccatcccatatttggcggtgctacccactctgcctttggattgaaggcaactgcctcagcattcggcgcaccagcctcctctcagcctgcttttggcggttctacggctgtcttcttcggggctgccacatcttcaggttttggcgctacgacgcaaaccgcaagctccggctcgtcttcaagcgtcttcgggagcacgacgccgtccccattcacttttggcggtagtgccgcacctgctggctcaggatcattcggaatcaatgtagcaaccccaggctctagcactaccaccggtgccttctcattcggcgcaggccaaagcggcagcacagccacctccacgcctttcgcaggaggcctgggtcagaatgccctgggtactaccggacagtcaactccatttgcgtttaatgtgtcgtccactacagagtccaagcccgtgttcggagggacagcgactccaaccttcggattgaatacccccgctccaggggtgggcacctcagggtcctccttgtccttcggcgcaagcagcgctccggctcaggggttcgtgggagtcgcaccattcggatccgctgctctcagcttttccatcggcgctggctctaagaccccgggagcaaggcagcgcttacaggcgcgacgtcaacatacaaggaagaagtag

SEQ ID NO: 52894 - DNA, 3000 bp, Artificial Sequence
  Description of Artificial Sequence: Synthetic coding sequence
atggtgtgttctccagttaccgtgagaatcgcgccacccgaccgtagattttcccgttcagccataccagagcagatcatctcaagtaccctttccagcccaagctctaatgctcctgatccctgtgccaaagagaccgttctgtctgccctcaaggaaaaagagaagaagaggactgtagaggaggaagatcagatatttctcgacggtcaggaaaacaaaagacggagacatgactccagcggttccggccactccgccttcgagcccctggtcgccaacggtgttcctgcctcttttgtgcctaaaccaggctcgctgaaacgcggactgaattcccaaagcagcgacgatcacttaaataagcgaagtagatcatcttccatgagctctctgaccggagcttacgccagcggtataccaagttcaagcaggaacgctattacttcttcatactcgtcaactcggggaatttcccagctatggaagagaaacgggccttcctcttcccccttctcgtcccccgcaagcagccgtagtcagacccccgagagacccgctaaaaagattcgggaagaagagctttgtcatcacagttccagctctactccacttgccgcagacagggaaagccagggagagaaggctgcagacactactccccgtaaaaagcagaattccaactcccagtctacacctggaagctccggccagagaaagcggaaggttcagcttttacccagtaggcgcggagagcagctcacccttccccctccccctcaacttggttatagcatcaccgccgaagacctcgacctggagaagaaggcgtcattacaatggtttaaccaggccctagaggacaaaagtgatgctgcctcgaattccgtcacagaaacgccccctatcacacagccttctttcacgttcacactgccggcagctgccccagcatccccccctacatcactcctggccccttcgacgaatccacttctcgagagtctgaaaaaaatgcaaaccccaccatcgttgccaccttgccctgaaagcgctggtgcagcaaccacagaagccctctcccctccgaaaactccttcactcctcccgccactggggctgagtcagagcggacccccaggcctgctgccgtcccccagtttcgatagcaagccacccaccacactgctggggctcatccctgctccctctatggtgcccgcaactgacacaaaggcccctcccacccttcaggccgagacagccactaaaccgcaggccacatccgcaccttcacccgctcccaagcaatcattcctgttcgggactcagaatactagtccgagctcacctgccgcacccgcagccagctccgcaccacctatgtttaagcccattttcactgcccctcccaagagcgagaaggaaggcccaacgcccccaggccctagcgtgacagccacagcccctagttctagctctctccctactaccacgtcgacaacagcccctacatttcagcccgtcttcagcagcatgggcccaccagcttcagtgccgctccccgcacccttctttaagcagaccaccacccccgcaaccgcccctaccaccactgctcccctctttactggtctcgcctccgctactagtgccgttgcacctatcacgtcagcctcaccgtcaactgactctgcgtccaaacctgccttcggattcggcatcaacagcgtgagctcctcatcagtttctacaacaacttctaccgccaccgctgctagccagcctttcctgtttggagctccacaggcctccgcagctagtttcactcctgcaatggggagtatttttcagtttgggaagccacccgcactgccgacgactaccacggtaactacgttctctcaatcacttcacacggccgttcctacggctacgtcttcatctgcagcagatttcagtgggtttggctcaacgctagcgacaagcgcccctgccacatcttctcaacctaccctgactttttctaacaccagcacccctacgttcaacatccctttcggcagctcagcgaagtccccactgccaagctaccccggagctaatccacaaccagccttcggtgccgctgaaggtcaacccccaggagccgcaaagcccgctctcgcccctagctttggttcgtcattcacgtttggcaatagtgcagcgcctgcagccgcacctacacctgcgccaccctcaatgataaaggtagtgcctgcatacgtacccacccctatacaccccatctttggcggtgccactcattcggcttttggtctgaaggcaactgccagtgctttcggggctcccgcatcctcccagcctgctttcggagggagtacagctgttttcttcggcgcagcaacctcgtctggattcggcgcaacaacacagacagcctcatctggatcttctagcagtgtttttggttcaacaacacctagccccttcactttcggaggaagcgcagctcccgcagggagcggcagcttcggcattaatgtggcaacccccggtagctcaacaacaaccggagcgttctccttcggcgctggccaatctgggtcgactgcaactagtacccctttcgccggaggcctgggacagaacgcactcggtactacaggtcagtcgaccccctttgcattcaatgtgtcctccaccacagagtccaagccagtgtttggcggaactgcaactcctaccttcggattgaacacccccgctcctggggtgggcacttcaggctctagcctgagcttcggagcaagctctgcgccagcgcagggattcgtgggcgttgctccattcggaaacacgttcgctcatcagcaagaacattcgcctagaaaaggccctaacaatctaagtaagaggaagctcctgcccgctgtgagggcccaggggctgcccaggagagggcaagcatcaagcttccccactcgaaaggagtag

SEQ ID NO: 52895 - DNA, 3690 bp, Artificial Sequence
  Description of Artificial Sequence: Synthetic coding sequence
atgagccccgcagcagccgcagcaggtgccggtgagcggcgacggcctatcgccagtgtgcgggatggcagagggagaggctgtggcggacctgcaggcgctgcactgcttggcttgagcctcgttggcctgctgctctatttagtgcccgctgcggcagccctggcttggctcgctgtgggcaccactgcggcttggtggggcctgtctcgcgaacccagggggtcacgtccgctgagcagtttcgtacagaaggccaggcatcgccgtaccctgtttgcctcccctcccgcaaaatcgaccgcaaacggtaacctgctggagccgaggaccctcctcgagggcccagaccctgcggagctgcttcttatgggctcatatttaggtaaaccaggtcctccacagcccgctccggcaccggaaggccaggacctgcgtaatcgacctggacggcgtcccccagctaggcccgcacctcggtcaacgcccccttctccacccacacatcgggtccaccacttttacccttcccttccgacccccctgttacgtccgtctggcagaccctccccacgtgaccggggtacgcttcccgatcgatttgtgattacgccaaggcggcgatatcccatacatcagacacagtactcttgtcccggagtccttcccaccgtgtgctggaacggctaccataagaaagcggtactcagcccaaggaatagcaggatggtgtgttcccccgtgaccgtgcgcattgcacctccagatcgcagatttagtaggtcagcaatcccggaacagattatctcatccacgttgtctagccccagtagtaatgcccctgacccatgtgcaaaggaaacggtcttaagcgcactgaaagagaaaaagaagaaacgaacggttgaagaggaagaccagatcttccttgatgggcaggaaaacaaaagaagacgacacgatagctctggctcaggccattctgcctttgagcctctggtggcatcaggcgtcccagccagctttgttccgaaacctggctcattgaagcgcggactgaattcgcagagcagcgacgatcatctcaacaaacgcagcaggtctagtagcatgagctctctcactggggcttacacaagcgggattccatcatcgagccggaatgcaatcaccagtagttactcaagcactagaggaatctcacaactgtggaaaaggaatggcccaagctcaagtccattttcaagcccggcatcttctcggagtcagaccccagagagacctgccaaaaagattcgtgaggaagaactgtgccatcactcctccagctctaccccattggcagcggacaaggagtcacagggcgaaaaagctgccgacactacccccagaaaaaagcaaaacagtaattctcagtccactcctgggtcatcaggtcagcgcaagcggaaagtgcagcttctcccatctcgtaggggggagcaactgaccctgccgccaccgccacagcttggatatagcatcactgctgaagatttggacttggaaaagaaagcgtctcttcagtggtttaaccaggcactagaagataagtcagacgccgcaagcaattctgttaccgaaaccccacctaccacacagccctcattcacctttacattacccgctgccgcaaccgcttctccgccaaccagtttactggccccttcaaccaatcccctactggaatccctgaagaaaatgcagaccccaccttctcttcctccttgccccgagtccgcaggtgccgcaacaaccgaggcactatcccctcctaagacaccttcccttctgcctcctctgggactttcccagagcgggccacccggtttgctgccctcaccatcatttgattcaaagcctccaacaaccctcctgggtcttatcccagccccaagcatggtgcccgctacagacactaaggcccctccgactctgcaagcagagacagctaccaagcctcaggccaccagcgcacctagcccagcccctaaacagtcatttctatttggcacccagaacacatcaccttcttcccccgcagctcccgcagcctcgagtgcctctcccatgtttaagcctatcttcacagctccacctaaatccgagaaagagggtccaacccctcccggaccgtccgtcacggccaccgctccctccagttctagtctgccgaccaccacctcaactacagcaccaaccttccagccagttttttcttccatggggccaccagccagcgtcccattgcccgcacctttttttaaacaaactaccacaccagctaccgccccaactacgaccgcacctctctttacagggctcgcctctgctacatcggctgttgcccctataacctccgcatcgccctcaacagatagtgccagcaagcccgctttcggcttcggaataaatagtgtgagctcttcttctgtatccacaacaactagcaccgccacagccgcatctcagcccttcctcttcggagctcctcaggcctctgcggcatccttcacccccgcaatgggatcgatttttcagtttggtaagcctccggcactgccgaccacgaccaccgtgactacctttagccaatcattgccaactgctgtacctactgcgacctcctcctctgcagcagacttttcaggatttggatctaccctagccacttctgctccggctacatcttcccagccaacattgactttttccaataccagcacacccacatttaacatacctttcgggtcatctgccaagagtcctctgccttcataccctggcgctaatccacaacctgcgttcggtgccgctgagggacaaccccctggagccgctaaacccgcactcacaccttcatttggttcttcctttactttcggaaattcagccgctccagcacccgctaccgccccaacccctgcacctgcctccactattaagatcgtccccgctcatgtcccgactccaatccagcctaccttcgggggagctacgcattcagctttcggactgaaggccaccgcgtcagccttcggagctccagcctcctcgcagcccgcatttggagggtctactgcagtgttttcgtttggggctgcgacctcgtccggcttcggcgctactacacagacagcatcttctgggagctcatcgtcagttttcggaagtactaccccctcaccctttacttttgggggaagcgccgctcccgcaggcagcggctcattcggtatcaacgtcgctacccctggctcctctgccactacgggggctttttcattcggggcaggccaatcagggtccacagccacaagcaccccatttaccggaggattggggcaaaacgcgctagggactactggccaaagtacccctttcgcattcaatgtgggcagcacaactgagagcaagccagttttcgggggaacagccactcccactttcgggcaaaacacaccggctcctggggtcggcacgtcaggttcaagtctgtcattcggcgcaagcagtgcacctgcccaggggtttgtcggagtgggacctttcgggagcgcagccccatccttctccattggggctggctcaaaaacaccgggtgcgagacagcggttgcaggcccgacggcagcacacacgtaagaagtag

SEQ ID NO: 52896 - DNA, 129 bp, Artificial Sequence
  Description of Artificial Sequence: Synthetic coding sequence
atggtttgttctcctgtgactgtgcgaatcgctcctcctgacaggcgcttctctcgttcagccatacccgagcagatcatcagctctaccctgtcaagtccaagttcgaatgccccagatccctgctag

SEQ ID NO: 52897 - DNA, 2964 bp, Artificial Sequence
  Description of Artificial Sequence: Synthetic coding sequence
atggtgtgcagtcctgtaacagtgcgcattgctccccctgatcgtcgctttagtaggagtgctataccagagcaaattatatccagcacccttagcagcccatccagtaatgcgcctgacccctgtgccaaagagactgtcctgtcagccttgaaagaaaaaaagaagaagaggaccgtcgaggaagaagatcagatcttcctcgatggccaagagaataaacgcaggagacacgacagttctgggtccggacactccgcttttgagccgctggttgcttctggcgtgccagcctcctttgtgcctaagcccggatcactcaagaggggactgaacagccagagcagcgacgaccaccttaacaagaggagccgaagtagctccatgtctagtcttacaggagcctatacctctggaatcccgagttcttctcgaaatgccattacctctagctatagctctactagggggatcagccagctttggaaaagaaacggcccatctagcagtcccttctcctcgcccgctagcagccgctctcagacccctgagcgcccagcaaagaaaatccgggaagaggaactatgccatcactcatctagctccacgcccctggcagccgacaaggaaagtcaaggcgagaaagcagctgacacaactcctcggaagaaacagaattctaatagccagtcgaccccagggagcagcggccagaggaagcgtaaagtccagctgttgccgtcgcgcagaggcgagcaactgaccctccccccaccgcctcagctcggttactctataaccgccgaggacttagacctggagaaaaaggcctcacttcagtggttcaaccaggcactggaggataagagcgacgccgcatctaactctgtcactgaaactccccctacaacacagccttctttcacttttacccttcctgctgctgccaccgccagcccccctacgagcctcttagccccatcaactaacccccttctggagagcttgaagaagatgcaaacccctccctcactgccgccttgcccggagagcgccggagccgctaccactgaagccctgagcccaccaaagacgccttctctgctccctcccttgggtctaagccagagtggtccacctggcctgctcccaagtcccagctttgactctaaaccccctaccacactgctggggttaattccggcaccctctatggtgccggcaaccgatacgaaagccccaccaacccttcaggccgagaccgcaaccaaacctcaggctacctccgcaccatctccagctccaaagcagtccttcctgtttggcactcagaatacaagcccgtcttcccccgctgccccagccgcttcaagcgcttcccccatgttcaaaccgatattcactgccccacctaagtcagaaaaagaaggtcccacacccccaggaccgtcagtgaccgctaccgccccatccagtagttccctgccaacgacgacttctacgactgcgccaactttccagcctgtcttctcctctatgggccctcctgctagtgtgccactaccagccccatttttcaaacagaccaccacacctgcaaccgctcccacaacaaccgcacccctgttcacggggctggcctcagccacttctgccgtggcacccattacctccgcctccccctccacggattccgcatcaaaaccagcctttggctttggaattaatagcgtcagttctagctcggtctcaacaactaccagcactgcaactgctgcaagccagccttttctgtttggggctccacaggccagtgctgcttcctttacccctgccatggggtccattttccagtttgggaaaccccctgcactgcctacgactactaccgtgaccacattttcacagtcactgccgaccgccgttcccactgcaacttcgtcttctgcggctgacttcagcggtttcgggtccactctggcaaccagcgcccctgccacatcgtctcagccaactctcactttttctaacacctcaacacccacattcaatattccgttcggctcttctgccaaaagccctcttcccagctatcctggggctaacccgcagcctgcctttggggcagccgaagggcagcccccaggcgctgccaaacctgccctgacccccagtttcggcagctcatttacttttggaaacagcgccgcaccagcccctgccactgctccaacaccagcgcctgcgtctacaattaaaatcgtcccggctcatgtcccgacacctattcagcccaccttcggaggggcaacccactccgccttcgggctgaaagccacagcttcagcatttggagcccctgctagttcgcaacctgccttcggcggttccacagccgtgtttagtttcggagcagccacaagcagcggctttggagccactacacagactgcttcttcagggtctagttcttccgtgttcggtagcaccaccccttcccccttcacatttgggggtagcgcagcacctgccggttcagggtcatttggtataaacgtcgccacccctggcagctccgccaccaccggtgcattctcatttggcgcaggccaatccgggtccacagcaacctcaaccccctttactggcggactgggacagaatgcccttgggactacagggcagtcaactccattcgcctttaacgtcggctctacgacagagagtaaacccgtttttggaggaaccgctacccccactttcggccagaatacaccagcgccaggcgtggggacaagcggctcaagcctgtccttcggagccagctccgccccagcgcaaggatttgtcggggtcgggcctttcggctcggccgcaccatcctttagtataggagcgggatccaaaaccccaggagcgagacagcggctgcaggcgaggcggcagcatactcgcaagaagtag

SEQ ID NO: 52898 - DNA, 948 bp, Artificial Sequence
  Description of Artificial Sequence: Synthetic coding sequence
atgtatcaggtcccgctgccgctggaccgcgacggaaccctggtacgtctccgcttcaccatggttgctctggtgactgtgtgctgccccctagtggcgttcttgttttgtatactgtggtcactcctctttcactttaaggagactacagccactcactgtggtgctactccgtgcagaatgttttctgccgcttctcagccacttgaccccgacggaacccttttccgactgaggttcacagcaatggtgtggtgggcaattacctttccggtctttgggtttttcttctgtattatctggagtctggtcttccatttcgagtatacagtcgctacagactgtggggttccgaattaccttccaagcgtctcctcagccattggaggggaggtaccgcagagatacgtctggagattctgcattgggctccatagtgcccctcgatttctggtggccttcgcctactggaatcactatctgtcttgcacctccccctgctcttgttatagaccactctgtcgtttgaatttcggtctcaacgtggtagagaacctggcgctcctcgtcctgacatatgtgagcagcagcgaagacttcaccatccacgagaacgcctttattgtgttcattgcctccagtctggggcacatgctcctaacctgtatcctgtggcgacttaccaagaaacacaccgtgagtcaagaggatcgcaaaagctactcctggaaacaacgcctgttcatcattaattttatttcttttttctcagccttagccgtctatttccggcataacatgtattgtgaagccggagtgtatacaattttcgcgatcttagagtatacagtcgtgctaactaatatggccttccacatgacggcatggtgggatttcggcaataaggaactcctgatcaccagtcagcccgaagaaaagagattctag

SEQ ID NO: 52899 - DNA, 924 bp, Artificial Sequence
  Description of Artificial Sequence: Synthetic coding sequence
atggcgaggctcggcagcactggcggtgtgagtggacgtgtggttacccagcaccgcgactctgcccctttcctaggagcgcctcggttaggactcagggaactcgggccaatcaggggaaccgcacctgaatggcacggcagatggaacgccgctgagcgctctgataagatgtaccaggtgcctcttccgttggaccgggacggaacactggttaggctgagattcaccatggttgcactggtcactgtgtgttgcccacttgtagcttttctcttttgtatcctctggtccctactgtttcatttcaaggagaccactgccactcactgtggggtgcctaattacctgccatctgtgtcgtccgcaatcggtggagaagtcccgcagagatatgtgtggaggttctgcatcggattgcattctgccccacggtttctcgtcgcattcgcatactggaaccactacttgtcatgtaccagcccatgtagttgttaccggccactatgccgactcaactttggactgaacgttgtcgagaatcttgcactcttggtcctcacttacgtcagtagctccgaagacttcactattcacgaaaacgccttcatcgtgtttatcgcttctagcctcggccacatgctgctgacgtgtattctgtggcggctcactaagaaacacacggacagaaagtcttactcctggaagcagcggctcttcatcatcaatttcatatcattcttctctgcactggccgtttactttcgccacaacatgtattgcgaagctggggtctacacaatctttgctatccttgaatacaccgtggttctgaccaacatggctttccatatgaccgcctggtgggattttggcaataaggagttgctgataaccagtcagcccgaggaaaaacggttttag

SEQ ID NO: 52900 - DNA, 948 bp, Artificial Sequence
  Description of Artificial Sequence: Synthetic coding sequence
atgtatcaagtccccctcccacttgatcgagacggcaccctcgtgcggctgaggttcactatggtcgccctggtgacggtctgttgtcccctggtcgctttcctcttttgtattctgtggtccctactttttcactttaaggagaccactgccactcactgcggtgccaccccctgcagaatgttttccgccgctagccagcctctggacccggacggaacactttttagactaagattcaccgcaatggtatggtgggcaataacatttccagtgtttggatttttcttctgcattatctggtcgctggtctttcatttcgaatatacggtcgccaccgattgcggggtgccaaactatctgccctccgtctcttccgccatcggcggagaagtgccccagcggtatgtgtggaggttctgtatcgggctccactctgcccctaggtttcttgtggcctttgcttattggaatcactatctgtcgtgtacatccccatgcagttgttatcggcctctgtgcaggcttaatttcggtttaaacgtcgtggagaacttagccctgctggtcttgacctacgtgtctagtagcgaggatttcactatccacgaaaacgcgttcatcgtgttcatagcatcgagtctcgggcatatgctgctcacctgtattctgtggagactgactaagaaacatactgttagccaggaagatcggaagtcttacagctggaaacagcggctgttcataattaatttcatttccttctttagtgctctggccgtttatttccggcacaacatgtattgcgaagccggtgtgtacactatatttgctattctcgagtacacggtcgtcctcactaacatggcgtttcacatgactgcttggtgggactttggcaacaaagagcttctgattacctcacagcccgaggaaaaacgattctag

SEQ ID NO: 52901 - DNA, 486 bp, Artificial Sequence
  Description of Artificial Sequence: Synthetic coding sequence
atggtcgatggtactcagctgcggggagcccagttgcctgcactgggagagttgagccaccggcgaggaggggcaccagcacttcgcgtggccttccttcacaggccagccctgggagcatcacttctgggtggcctccgccttctcgaacctctgccccagttgcacctgcccgtgtttctcctcagccccgctctgcctcctcagctgcgtcctcagtgtcgcggagaacctcgcgttgcttccgcacatctgtgcctattgcttaggggtctgcaccatcccaggaaatgctttcactgcgtccactgcctgattccacgcgctcacgctccgcatctgcatagcttggcagtagaccaggaagcgcacagtaagagtggcggtagccaggttctgcagttagagactgccgctctgcatcatcagcttcacctgctgttgcttggggctggatgtttattatctgcccagcacgttctttag

SEQ ID NO: 52902 - DNA, 765 bp, Artificial Sequence
  Description of Artificial Sequence: Synthetic coding sequence
atgtaccaggtgccgctgccactggatcgggatggcaccctggtgcgactgcggtttaccatggtggcgttggtgaccgtttgctgccctttggtggcattcttgttctgcatattatggagcctgctttttcacttcaaagagacgacagccacccactgcggagtcccaaactacttgccctctgtcagctccgccatcggcggagaggtgccccagaggtacgtgtggagattttgtatcggattacatagcgcgcctcgctttctcgtggctttcgcgtactggaaccactacctctcctgcacttcaccatgttcctgctatagacctctgtgccgcctaaactttgggcttaatgtcgtggaaaatcttgctcttttggttctgacctacgtgtcgagttctgaagattttaccattcacgagaatgctttcatcgtttttattgcatcttccctagggcacatgctgctgacctgtatcctgtggcgtctgacaaagaagcacacggtcagccaagaggaccggaaatcctatagctggaagcagcgacttttcatcattaatttcatcagctttttctccgctttggcagtgtactttcgccataatatgtattgcgaggctggggtatacaccattttcgcaattctcgagtataccgtggttctgacgaacatggcctttcatatgaccgcttggtgggatttcggcaataaggagctgctcatcacttcccaacccgaggaaaagcgcttctag

SEQ ID NO: 52903 - DNA, 1038 bp, Artificial Sequence
  Description of Artificial Sequence: Synthetic coding sequence
tgacgccttggcctaagagaattgggacccattcgcggaacagcccctgaatggcacggacgatggaacgccgctgagcgtagcgacaaaatgtatcaggttcccctgcctttagacagagacgggacactggtcaggctgcgctttactatggttgctttggtcactgtctgctgcccccttgtggccttcctgttctgtattctatggagtctgttatttcactttaaagaaaccacagccacccactgtggggctactccttgtaggatgtttagtgcagcctcccagccactcgaccctgacggtaccctcttccgcctgcgatttacggctatggtgtggtgggcaattacctttcctgtgttcggctttttcttttgtattatctggagtctggtgtttcactttgagtatacagtcgcaacggactgcggcgtcccaaactatctaccctccgtctctagcgccattgggggtgaggttccacagcgttatgtctggcggttttgtatcgggttgcacagcgcacctagatttttggtcgcctttgcctactggaatcactatctctcctgtacaagcccctgctcttgttacagacctctctgccgtctgaacttcggactgaacgtggtcgagaacctagccttactagtactcacctatgtgtcaagtagtgaagactttaccattcatgagaacgctttcatcgtattcattgcttcttctctcgggcacatgctcttgacatgtattctttggaggttaacaaagaagcacacggtttctcaggaagacaggaaatcctacagctggaagcaacgccttttcattatcaactttatctcttttttctcggcacttgccgtctattttcgccacaatatgtactgcgaggccggagtttataccatctttgctatcctcgagtataccgtggtcctcactaacatggcttttcacatgacagcgtggtgggattttggtaacaaggagctactgatcactagtcagcctgaggagaagcggttctag

SEQ ID NO: 52904 - DNA, 624 bp, Artificial Sequence
  Description of Artificial Sequence: Synthetic coding sequence
atgttctctgccgctagccaacccctggaccccgacggtacactctttcgcctgagatttaccgcaatggtatggtgggccattacatttcccgtgttcggcttttttttctgcatcatctggtcgcttgtctttcacttcgagtacaccgtggcaacagattgcggagtaagcgctagttcccctgctcctggatctggcccaggccaagaagttgccgttagagtggagcttgactccggcgaggaagtcgaagaccagcgcgagggtaaaggacagggggacggagggcgagtggggaaaagtgagagcgagattatccatggtgggcgtttaagagagaataggatcaccgtattaccagaattagaggacgatgaccgcaacgctcgcgagatgaccggcgctgtcgctcacacctgcaacctatccacgtcaggcggtcgttcacagtggataacccgcgtacaattcgagacatcattaggaaatatggtgaaaccacgcctgtataaaaagtgtaagaagattagctgggtcccgtggcacgcacctgtggtcccagctacctgggaggcaaaggcaggagagctgctggaagctggcaggtggaccttccaatag

SEQ ID NO: 52905 - DNA, 936 bp, Artificial Sequence
  Description of Artificial Sequence: Synthetic coding sequence
atggctagactgggctccacgggcggtgtgtcgggccgagtggtgacacagcacagagattccgccccatttttaggagccccacgactgggccttcgcgaactgggccctattcggggaacggcaccagaatggcacgggagatggaacgccgctgagcggtctgataagatgtaccaggtgcccctcccccttgatcgtgatggaacgctggtaagactgcggttcactatggtggccctggttacagtttgttgtcctttagtggcttttctgttttgtatcttatggtctctgctgttccatttcaaggagacaacagccacccattgcggggtaccaaactacttgccctccgtttcctccgcgatcgggggagaggtgccccagcgctatgtctggaggttttgtattggcctgcatagtgccccaaggttcctcgtggcctttgcctactggaaccactatctgtcgtgcacttccccatgttcctgctaccggcctctttgtcgactgaatttcgggctgaatgtggtggagaacctcgctctgctggtactgacgtacgtgtcaagttccgaagacttcacaatccatgagaatgctttcatagtgtttattgcctcctcactgggacacatgcttctgacatgcatcttgtggcgtcttacgaagaagcacacggtatcacaagaagacagaaagagctattcatggaagcagagactcttcatcattaatttcattagctttttctcggccctcgcagtgtacttcaggcacaacatgtactgtgaggccggtgtgtataccatcttcgcaatcctcgaatatacggttgttctaaccaacatggcatttcatatgacagcctggtgggattttgggaacaaggagctcctgattacaagccagcctgaggagaagaggttttag

SEQ ID NO: 52906 - DNA, 699 bp, Artificial Sequence
  Description of Artificial Sequence: Synthetic coding sequence
atgtatcaggtgccgctgcctctcgacagggacggcaccctggtgcgtttgagattcaccatggtggcgctagttactgtgtgttgtccactcgtcgctttcctgttttgtattctatggtcactgcttttccattttaaggagaccaccgctacacactgcggggtccccaactatttgccctcggtgtccagtgctattggaggcgaagtgccccaaagatatgtttggcggttctgtatcggactccattccgcccctcggtttttagttgctttcgcatactggaatcattatctctcctgcaccagcccctgctcatgctatcgacccctgtgccgactcaatttcggtctgaacgtggtggagaatctcgcactattggtgctgacttacgtcagtagttcagaggattttaccatacatgaaaatgctttcatcgtcttcatcgcatctagcctgggccacatgctgctgacctgcatcctctggaggctcactaaaaagcatacagtctcccaggaggtccggtcaattccaagcggcggttcaaaggcggctcagaagaagatcaaagatatctgcccacaagactccggctcccaggtcctccagttggaaactgccgctttgcaccaccagcttcacctactcttgcttggagccggatgtttgttgtctgcacaacacgtgctatag

SEQ ID NO: 52907 - DNA, 171 bp, Artificial Sequence
  Description of Artificial Sequence: Synthetic coding sequence
atgtaccaagtgccgctgcccctggatagggacggaaccctggtgcgcctgagattcacaatggttgcattggttaccgtttgttgcccccttgtcgccttcctcttttgtatattatggtcattattgttccactttaaggagacaactgctacgcactgcggagactag

SEQ ID NO: 52908 - DNA, 963 bp, Artificial Sequence
  Description of Artificial Sequence: Synthetic coding sequence
atggctggcctggcggcaaggttagtgctgctggccggtgcagcagcgcttgctagcggttcacagggcgaccgcgagccagtgtatcgggattgcgtcctccagtgcgaggagcagaattgcagcggtggagccctgaatcactttaggtctagacaaccaatctatatgtctctcgctgggtggacgtgcagagatgactgcaagtacgaatgcatgtgggtgactgttggcctttacctgcaggagggtcataaggtgcctcagtttcatggaaagtggcctttctcacgattcttattcttccaggaacctgccagcgcggtcgctagttttctaaatgggctcgcctcacttgtgatgctctgcagatataggacattcgtgcccgcaagctcacccatgtatcacacgtgcgttgccttcgcttgggtgagcctcaatgcctggttctggagcacggtctttcatacgcgggacacagacctgacagaaaaaatggactacttctgcgcttccaccgtcatcctgcactctatctacctgtgttgtgtgcgaacagttggcctgcagcatccagcggtggtctctgcatttagagccctcctccttctcatgctcacagtgcacgtctcctacttatctctgatacgatttgattacggatataacctggtggcaaatgtggcaatcggcttagtgaacgtagtttggtggctagcttggtgcctgtggaatcagagacgcctgccacatgttaggaaatgcgtcgtagtggtgttactattgcagggtctgtcacttctggagctgctggactttccacctctcttctgggtgttggacgcccacgcaatttggcatatatcaaccatccccgtccacgttctcttcttttccttcctcgaggacgattcactctacctgctcaaggagtctgaggataagttcaagctggactag

SEQ ID NO: 52909 - DNA, 795 bp, Artificial Sequence
  Description of Artificial Sequence: Synthetic coding sequence
atgtctttggctggctggacatgtcgcgatgattgcaagtatgagtgtatgtgggtgactgtggggctctatctgcaggagggacataaagtgccgcagttccacggcaaatggccattctcacgttttctctttttccaggagccagcaagtgcggtggctagcttcctgaacggactggcctcgcttgtgatgctgtgtcgctatagaacattcgtcccagctagctctcccatgtaccacacgtgtgttgcttttgcctgggtgtccctcaatgcctggttctggagcaccgtgtttcacaccagagacactgacctcactgagaagatggattatttttgcgcttctacagtgatcctgcattccatttacttatgttgtgtccggactgtgggccttcaacatcctgctgttgtctccgcttttcgcgcattactgctcctgatgttaacagtgcatgtttcctatctttcactgattaggtttgactacggatataacctggttgccaacgtggccataggcctcgtcaacgtggtttggtggctggcgtggtgtctctggaatcagcggcgactgcctcacgtcagaaaatgtgtggttgtcgtgttgctcctgcagggtctctcattgctggagctgctggactttcccccactgttctgggtgctcgacgcccatgccatttggcacattagtactatccccgtccatgttctgttcttcagtttccttgaggacgacagcttgtacctcctgaaggagtcagaggataaattcaaacttgactag

SEQ ID NO: 52910 - DNA, 810 bp, Artificial Sequence
  Description of Artificial Sequence: Synthetic coding sequence
atggccggactggctgcgagactggtattgctggctggcgcagccgcactcgcttccgggagccaaggagacagggagcccgtatatcgcgattgcgtccttcaatgcgaggaacagaattgttccgggggagcgttaaatcatttcaggtctcgacagcccatctacatgtctttagccggatggacctgcagggatgactgcaagtatgaatgtatgtgggtgactgtgggtctgtatctgcaagagggacacaaagttccccaattccatggaaaagtgtccctaaatgcatggttctggagcaccgtgtttcacacaagagatactgacctgacagagaagatggactacttctgcgcgagtactgtgattctgcatagtatttacctgtgttgcgtcaggacagtgggcctgcagcaccctgccgtggtgagtgccttcagggcactgctcctcctcatgctgaccgtacatgtgagttatttaagtttgattaggttcgactatggctacaacctcgttgccaatgtggctataggactggtgaatgtggtctggtggcttgcatggtgtctttggaaccaaagaaggctgccccatgtgagaaagtgtgttgtcgtggtcctcctcctgcaggggctcagtctactggagctgttagacttcccccctctcttttgggtgctcgacgcgcatgcaatctggcacatctcaaccataccagtccatgttctgttttttagcttcctagaagacgattcactgtatttgctcaaggaaagtgaggacaaatttaagctggactag

SEQ ID NO: 52911 - DNA, 900 bp, Artificial Sequence
  Description of Artificial Sequence: Synthetic coding sequence
atggccggtctggccgctagactggttctgctggcaggggcagccgcattggcctccggctcccaaggagacagagaacccgtgtacagagattgcgtgctgcaatgcgaagagcagaactgttcaggcggagccctgaaccattttcggtcaaggcagcccatctacatgtcgttggccggatggacatgtcgagacgactgtaaatacgaatgcatgtgggttaccgtgggtttgtatctgcaggaagggcataaggtaccccagtttcacgggaaatggccattctctcggttcctgttttttcaggaacccgcaagtgcagttgcgtctttcctaaacggtctcgcctccctagtaatgctgtgcaggtatcgcacattcgtccccgctagtagccccatgtaccatacatgtgttgcttttgcctggaagatggattacttctgtgccagtacagtaattctgcatagcatttatctctgctgcgttaggactgtgggcttgcagcacccggcagtggtttccgcttttcgcgctctactgctcttaatgctcaccgtgcatgtctcctacctctccctgataagattcgattacggctacaatctggttgctaacgttgctatcggacttgtgaatgtggtttggtggctagcctggtgtctctggaaccagcgacggctgccccatgtgaggaagtgtgtagtggtggtacttctcttgcagggcctgagccttctggaattgctggacttcccccctctgttctgggttttagacgcacacgctatttggcacatctctacaattccggtgcacgtgctctttttctcctttctggaggacgattcactgtacctgctcaaggaatctgaggacaagttcaaactggattag

SEQ ID NO: 52912 - DNA, 819 bp, Artificial Sequence
  Description of Artificial Sequence: Synthetic coding sequence
atgtcgtctcaggagttggtgactctgaacgtcggtggaaagatctttactaccagattttctacaatcaagcagttcccggcttcaaggctggctcgaatgttagacggaagggaccaggaatttaaaatggttggcggtcagattttcgtggatcgagatggggatctcttttcatttatcttggatttccttaggactcatcagctgctactgcccactgaattcagtgattacttgagactccaaagagaagctctgttctatgagctgcggtctcttgtagatcttctgaacccctatcttttacagccccgtcccgcactcgtggaagttcattttctctcgcgcaatactcaggccttctttagggtgtttggctcctgctccaaaaccatcgagatgctgactggaagaataactgtgtttaccgagcagccaagtgcaccaacctggaatggaaatttcttcccaccccagatgaccctgttgccactccccccacagagacccagttatcacgacctcgtatttcaatgcggtagcgactctacaaccgacaatcagacaggggtccggtatgtctctataaagccagacaatcgaaagctcgcaaacggaactaatgtactgggactgttgatagatactctcctgaaagagggtttccatttagtcagcactcggactgtgtccagtgaggacaaaaccgagtgctacagcttcgagaggatcaagagcccagaggtcctaatcactaacgagacaccaaaaccggaaactattatcatccctgagcagtcacagatcaaaaagtag

SEQ ID NO: 52913 - DNA, 690 bp, Artificial Sequence
  Description of Artificial Sequence: Synthetic coding sequence
atgtcctctcaggagctcgttacgctgaacgtgggcggtaaaatcttcacaacacgattcagcaccattaaacagttcccggctagccgcttggcaagaatgttggatgggcgagaccaggaattcaagatggtgggtggccaaatcttcgtggaccgcgatggtgaccttttttcttttatcttggactttctgcggacgcatcagttgcttcttcccacggagttcagcgactatttgcggctccagcgagaggccctgttctatgaacttagatcgctcgtagacctcctgaacccttacctccttcagcctcggccagcccttgtagaagtccattttctgtcccgtaatactcaggcattcttcagagtcttcggttcctgctccaagaccatcgagatgctcacaggccgtatcaccgttttcacagaacaaccttccgccccaacctggaacggaaacttctttcctcctcagatgacacttctcccgctgcctccacaaaggccatcttaccacgacctcgtcttccagtgcggatctgacagcacgaccgataaccagaccggcgtccggctggtttgcaatggagtcatcagcgctcaccacaacttgagactgtggggatccagtgatagccctgcttctgcctctagggtggccggaattacgggaatgttcctatag

SEQ ID NO: 52914 - DNA, 978 bp, Artificial Sequence
  Description of Artificial Sequence: Synthetic coding sequence
atggcattagcggactcaacgagaggcctcccaaacgggggtgggggaggcggaggtagcggcagttcttctagctccgctgagcccccactctttcctgatatagtggagctgaatgtgggaggtcaggtctacgtcaccaggagatgcacagtcgtgagcgtgcctgacagcttactatggaggatgtttactcaacagcagccacaggaactcgcacgcgactctaagggacgcttttttttagaccgggatggcttccttttccggtacatcttggattaccttagagatctgcaattggtgctccccgactattttcctgagcggtcaaggttgcaacgggaggctgagtatttcgagttgcccgagctcgtgcggaggctgggagccccacagcagcctggacccggtccgcctcctagtcgaaggggtgttcacaaagaggggagtcttggagacgagctgttacccctagggtatagtgaacccgaacagcaggagggtgcatcagccggagcgccaagtccgactctcgagttggcctccaggagcccctcaggcggagccgcaggccctctcctaaccccatctcagtcactggatggaagcaggcgctcagggtatataacgatcggctacagggggagttataccattgggagggacgcccaggctgacgcaaagtttaggcgggtggcgcgtatcactgtgtgcgggaaaaccagtttagcaaaggaggtcttcggcgatacacttaacgaatctcgcgacccggacaggccacccgagcggtacacctcccggtactatcttaaattcaactttctagagcaggcatttgacaagcttagcgaaagtgggttccacatggttgcatgttccagcacaggaacctgcgctttcgcgtcatctacagaccagagcgaagataagatctggaccagttataccgaatacgtgttttgcagggagtag

SEQ ID NO: 52915 - DNA, 978 bp, Artificial Sequence
  Description of Artificial Sequence: Synthetic coding sequence
atggctctggccgactccacccgcggactgcccaatgggggaggtggtggcggtggctctgggagtagcagtagctcagcagagcctccactctttccagacatagtggaactaaatgtaggcggtcaagtgtatgtaacccgtcgctgcacggtggtttccgtccctgactctctgctgtggagaatgttcacacagcagcagccccaagaactcgccagagactcaaaaggcagattctttttggatcgggacggtttcctctttaggtatatactcgattatctgagggatctccagttggtgctgcctgactattttccggaaagatctcgtcttcagagagaggctgagtatttcgagctgcccgaactcgtccggcgactcggtgccccacaacagccaggacctggcccacccccttcacggagaggagtgcacaaagaggggtcactgggcgacgagctgctccctctcgggtatagtgaaccagaacagcaggaaggtgctagcgccggagccccttcacccaccctcgagttagcatctaggtctcccagtggcggagccgcaggaccattgctgactccatctcagtcacttgacggctcacgccgatcaggatacataacaattggttatcgaggaagttataccattggcagagatgcccaggctgatgctaagttccgcagagtcgctaggatcaccgtgtgcggcaaaaccagcttggcaaaagaggtgttcggggacacattgaatgagtctcgggatcccgatcggccacctgagcgttatacaagccgctactatctcaaatttaattttctggagcaagcctttgacaaattatccgaatccgggtttcatatggtcgcttgctcatcgactggtacatgtgccttcgcctcttccacagatcagtctgaagataagatttggacctcctatacggagtacgtcttctgtcgtgagtag

SEQ ID NO: 52916 - DNA, 768 bp, Artificial Sequence
  Description of Artificial Sequence: Synthetic coding sequence
atgtggcaaggctgtgccgtcgagcgaccagtgggaaggatgacatcacagacacctcttcctcagtccccgcgaccaaggagaccaacgatgagtaccgtagtcgagctgaacgttggcggagaatttcacacgacaacactggggactcttaggaagttcccgggttctaaactcgctgaaatgtttagcagtttggctaaagccagcacagatgcggagggcaggttcttcatcgaccggccaagtacttatttccgcccaattctagactacctgagaacagggcaggtcccaacacagcacatcccagaggtgtatcgagaggctcaattttatgagattaagccgctagttaagcttctggaggacatgccgcagatttttggcgagcaagtctcacggaagcaattccttttgcaggttccgggatacagcgagaatctggagctcatggtacgcctcgctagagccgaagccatcacagctcgaaaaagtagtgtgcttgtctgtctggttgagaccgaggaacaagatgcttattattccgaagtgttatgctttctccaagacaaaaaaatgtttaaatcagtagttaagtttggcccatggaaggcggtcctggataacagcgacctgatgcattgcttagagatggacatcaaagctcagggttacaaggtattttccaaattttacctgacctatccaaccaaaaggaatgagtttcactttaatatttactcttttacgttcacctggtggtag

SEQ ID NO: 52917 - DNA, 678 bp, Artificial Sequence
  Description of Artificial Sequence: Synthetic coding sequence
atgagtaccgtagtggagcttaacgtgggaggcgagttccatactactactctgggcacactgagaaagtttccagggtcgaagctggcagagatgttttcctctttggcaaaggcctctacggatgcagagggcagattctttattgatagaccctccacatattttaggccgatcctcgactacctgaggaccggccaggtccctactcagcacatccccgaggtttaccgcgaagctcagttttacgagatcaaaccactcgtgaaacttctggaggatatgcctcaaattttcggggaacaagtgagtcgcaagcagtttctgctgcaggttcccggttactccgaaaatttggagctgatggtgagactggcccgtgccgaggccatcaccgcaaggaagagtagcgtactagtgtgcctcgtggaaaccgaagagcaggacgcttattacagtgaggtgctctgtttccttcaggacaaaaaaatgttcaagagcgtggtgaagtttggaccatggaaagcggtgttagataacagtgacttaatgcattgcctggagatggatattaaggcccagggctacaaggtgttctcaaaattttatctgacataccccacaaagcgcaatgaatttcactttaacatttatagttttactttcacctggtggtag

SEQ ID NO: 52918 - DNA, 861 bp, Artificial Sequence
  Description of Artificial Sequence: Synthetic coding sequence
gacgcccagatgccccacagaaaggagcgcccatctgggtcatccctccatactcacggatcgactggaaccgccgaaggagggaacatgtcacgactaagcctgacaaggagccctgtctctccattagctgcacagggaatccccctgcccgcacagttgactaaaagtaacgcgcctgtccacattgacgtgggaggacatatgtacacctcctcccttgcaactctgaccaagtatcctgactcacgtatcagtcggttgtttaacgggacagagcccatcgtgctggactcactgaagcagcattactttattgaccgggacggagaaattttcagatacgtcctgagcttcctccgaacctccaaactgctcctgccagatgattttaaagacttcagcctgctatacgaggaggctaggtactaccagctccagccaatggtgagagaattagagagatggcaacaggagcaagaacagagacgcaggtcgagggcctgcgattgcctagtagtgagagttacacctgatctaggtgaacgtattgccctgtcgggggaaaaggccctcattgaggaagtgttccccgaaactggcgacgtgatgtgcaactctgtaaatgccggatggaatcaggaccccacccatgtgatacggtttcctctgaacggctattgtcgcctgaactctgtccaggtgctggaaaggctgttccagcgaggcttttcggtggccgcaagctgcggcggtggcgtggatagttctcagttttcagagtatgtgctgtgccgggaggagcgcaggccccaaccgaccccgactgccgttaggatcaaacaggagccactggactag

SEQ ID NO: 52919 - DNA, 852 bp, Artificial Sequence
  Description of Artificial Sequence: Synthetic coding sequence
atgccccataggaaggagaggccgtccggatcctcactccatactcacggttcaacagggacagccgagggtgggaatatgtcaagactgtctcttacccgctcacccgtgtcccccctggctgcccaggggatacccttaccagctcagctgacgaaatctaatgcccctgttcacattgacgtgggaggccatatgtataccagcagtctcgcaaccctaaccaagtatccagactctcgaatatccaggctcttcaatggaacagaaccaatcgtgctcgacagtcttaaacagcattattttattgaccgggatggagagatattccggtacgtgctgtcattcctaaggacctcaaagcttctattgccagacgatttcaaagactttagtctgctgtatgaagaagctagatattatcaactgcagcccatggttagggagctggagcgatggcagcaggagcaggaacagcgtcgcaggagtcgggcttgtgattgtcttgtggtgcgcgtgacccccgacctcggtgagcgaattgccctttccggagagaaagcccttattgaggaagtgtttccggagacaggggatgtgatgtgcaactctgtcaatgcagggtggaatcaggaccccacccacgtcatcaggtttcctcttaacgggtattgtcgcctcaacagcgtacaagtgttggagcgactcttccagaggggatttagcgttgccgcaagctgtgggggaggggtggattcctcccagtttagcgagtacgtcctatgccgtgaggaaagaaggcctcagcctaccccaaccgctgtgcgtattaagcaggagccgcttgactag

SEQ ID NO: 52920 - DNA, 894 bp, Artificial Sequence
  Description of Artificial Sequence: Synthetic coding sequence
atgcagaccccccgacctgctatgcgtatggaagctggggaagctgcgcctccggctggtgctggtggacgggctgccggtggctggggcaagtgggtcagactgaacgttggtgggacggttttcctgaccacccggcagacgctgtgccgcgaacaaaaatcctttctcagccgcctctgccagggagaggaactacagagcgaccgggacgagacgggtgcctaccttattgatcgtgaccctacttatttcggtccaatattgaactttctgcgccatggaaagctggtgttggacaaagacatggccgaagagggagtcctcgaggaagcagagttctataatattggcccactgattcggatcatcaaggaccggatggaggagaaagactataccgtgacccaggtgcccccaaagcatgtgtaccgggttttgcagtgccaggaggaagagttgacacagatggtgtccacaatgagcgatggctggagattcgaacaattagtcaacatcgggagctcttacaactatggaagtgaggatcaggcagagttcctgtgcgtagttagcaaagagctacatagcacaccaaatggcttgtccagcgagagcagtagaaaaactaaaagtacagaggaacaattagaggagcagcagcagcaggaggaagaggtcgaggaggttgaggttgagcaggttcaagtagaggctgacgcccaggagaagggtagcaggccccaccctcttaggccggaagccgagctggcggtcagagcttcccctagacccctggccagacctcagagttgtcacccgtgttgttacaagcccgaggccccaggatgtgaggctcctgatcacctgcagggactcggagttcctatctag

SEQ ID NO: 52921 - DNA, 966 bp, Artificial Sequence
  Description of Artificial Sequence: Synthetic coding sequence
atgcaaacacccagaccggcaatgcggatggaggccggagaggctgcccctcccgctggtgctggcggacgcgctgctgggggatggggcaagtgggtgagacttaacgtgggcggtaccgtgtttttaacaaccagacaaactctttgcagagagcagaaaagcttcctctctcgcctgtgtcaaggtgaggaacttcagagtgatcgcgacgaaacaggtgcgtatcttattgaccgggatcccacatatttcgggcctatcctcaacttcctgcgacacggtaagcttgtgttagataaggacatggccgaggaaggcgtgctcgaagaagccgaattttataacatcgggcctcttatcagaatcattaaggaccggatggaagagaaggactatacagttacacaggttccacccaaacatgtttatagagtgctccagtgtcaagaggaagaacttacacagatggtgagcacgatgagcgacggatggagattcgaacagctggtgaacatcggtagttcctacaattacggctctgaagaccaggcggagtttctctgcgttgtctcaaaagagctgcactcaacaccaaacggcctgagttcggagtcctcccggaaaacaaaatcaacagaggaacagctggaggagcaacaacaacaggaagaggaagtcgaagaagtggaggtggaacaggttcaagtcgaggccgatgcacaagagaaggcccaaagttctcaggatcctgcaaacctgttttctttgcctccactaccacccccacctctgccagccggaggcagcaggccccaccccctacgcccagaagcagagctggctgtaagggcttcaccaagaccattagcacggccacagagctgtcatccatgctgctacaagccagaagcacccggatgcgaggcacctgatcacctgcagggtctgggcgtcccaatctag

SEQ ID NO: 52922 - DNA, 192 bp, Artificial Sequence
  Description of Artificial Sequence: Synthetic coding sequence
atgacttctaaagtttcttgccccccttccgtgacgctacgatgctgcggactgtggcaagtggcctcccccctgaatgtgagtgacctgagtgatgagacaggagcatatctgattgacagggatcccacctatttcgggcctatcctgaacttccttaggcacggtaaattagtgctcgacaaggattag

SEQ ID NO: 52923 - DNA, 543 bp, Artificial Sequence
  Description of Artificial Sequence: Synthetic coding sequence
tagcaaacactgtgtcgggagcagaagtctttcctatccagactgtgccagggagaagagttgcaaagtgacagggatgaaaccggagcctacctgatcgacagggatcctacgtatttcgggccaatactaaacttcttacggcacgggaagctcgtcttggacaaggacatggccgaagagggtgttctcgaggaggccgagttctataatatcggcccactgattaggattatcaaggacaggatggaggagaaggattacacggtaacccaggtgccccctaagcacgtgtatcgagtcctccagtgtcaggaagaggagctgactcagatggtgtcaaccatgagcgacggatggaggtttgaacagctggtgaacatcggctcctcttacaattacggctctgaggatcaggccgagttcttgtgcgttgtgtccaaggaacttcactccaccccaaacgggttgagttccgaaagcagcagaaagaccaaagtgcctgtgcgcacactgtccgacctgagactctcgctccagtag

SEQ ID NO: 52924 - DNA, 1281 bp, Artificial Sequence
  Description of Artificial Sequence: Synthetic coding sequence
atggagggacacaaggccgaggaggaggtgctcgatgtcctgagactaaacgtcggaggctgcatttataccgcccgaagagagtcactctgccgtttcaaagattccatgcttgcttctatgttctccgggaggtttcctttaaagactgatgagtccggcgcttgcgttattgatcgagatggacgtctgtttaagtacctgctggattatctgcacggagaagtgcagatacctaccgatgagcaaactagaatcgcgttacaggaggaggccgactacttcggaatcccatacccgtacagtctaagtgaccacctggcgaatgaaatggagacatattccctgcgctccaacattgagttgaagaaggcgctgaccgatttttgcgactcctatggcctcgtgtgtaacaagccaacagtgtgggtgctgcactaccttaacacgtccggggcatcttgcgagtccagaattattggcgtgtacgctacgaagactgacgggacagatgcgatcgagaaacagctgggcggacgtatacacagcaaggggatattcaagcgggaagctggcaacaacgtgcaatacatctggtcttactattccgtggccgaactgaaaaaaatgatggacgcctttgacgcatgggagggtaagggggtttcatactggagggtgcctcacgaactgatcgaatgttggaccctcgaagagagacctcttcttgggtcacttcgccatatggcacctatcaggaagcgtcgactgattaccttcaacgaagccgacgagagcgtgaattacaaaacgggacctaagccagtccggttcctgggtcccagcacatcaactcagatcaaagtcaagaattctgccagtgtgacagtttcccctgcttctgccatccagactagcgccggtgccacggctaacaggttccaaagtgggtcgcgccgaaaggccgcacaacgctctgctccttctagagcgactgccttagtgggaacaggggctcctggtcaccctcaggcgtcaccaggggcagcgtcagccgagaacggcggtacacacctgccacctgctaaggtgctgttgtctgataagaagcccacaccacaacgggtgatcaaattaaaaagaaccccactgtgtgctaccgcgccttgcctgccatctcctacagctacaagacaggccaattcactcaagcctttacctggtgaggccgctcgggctctgggcgtccgaacagagaacggtaagaataagggcaactag

SEQ ID NO: 52925 - DNA, 1281 bp, Artificial Sequence
  Description of Artificial Sequence: Synthetic coding sequence
atggaggggcacaaagctgaagaagaagtgttggacgtgctgcgacttaatgtcggaggatgtatatacacggctcggagagagtcactctgcaggttcaaagactccatgctagcatctatgttcagcggtcgattcccgctgaaaaccgacgagagcggggcatgcgtgattgatagggatggcagactgtttaaataccttttagactatctacacggcgaggttcagatcccgaccgatgagcagacgagaatcgcattacaggaagaggctgactatttcgggattccgtatccatattcattgagtgaccacctggctaatgagatggaaacctatagcctgcgaagtaatatcgaacttaagaaggctctaaccgacttctgcgacagctatggcctggtgtgcaataaacccactgtgtgggttctgcattatctaaacacgtccggagccagttgtgagtccaggataattggcgtttacgcgactaagaccgatggaacagacgccattgaaaagcagctgggaggtaggatccactcaaagggaatttttaagcgcgaggcaggaaataatgtgcaatatatttggtcttattactccgtagctgagctgaaaaagatgatggatgcctttgatgcgtgggagggcaagggggttagctactggcgggtaccccatgaactgattgagtgctggacactggaagagagaccgctgctcggcagcctgcgacatatggctcctatccgcaagcggaggcttatcactttcaatgaagccgacgaatcagtcaattataagacaggaccaaagcctgtgcgattcttgggcccaagcacaagtacacagatcaaggttaagaactccgcgtctgtcactgtgtccccagcctctgcgatccagacaagtgccggtgctactgccaaccggtttcagtcagggagtcggagaaaggcggctcagcggtccgctccctccagggctactgccctggtgggtacgggagctcctggacacccgcaggccagtccaggagcagctagcgccgaaaacggtgggacgcatttgcccccagctaaggtactgctctctgacaaaaagcctacaccgcagagggtgataaagttaaagaggactccactgtgcgcaactgcaccatgcctaccatctcccactgctacgagacaagcgaattctctgaaaccgctgccaggggaagccgctcgggctttgggcgttaggaccgagaatggcaagaacaagggcaattag

SEQ ID NO: 52926 - DNA, 2781 bp, Artificial Sequence
  Description of Artificial Sequence: Synthetic coding sequence
atggaggagtcgggaatggctcatgaatctgccgaagacctgttccactttaatgtgggcggttggcacttcagcgtgcctcgctctaagctgagccagtttcccgactctctgctatggaaagaagcgtccgcactcacctcctctgagtctcaacgcttgttcatcgatagggacgggagcactttcagacatgttcactattacctgtacacaagtaagctgtctttttctagctgtgctgagttgaacttgctctacgagcaagcgctgggcctccagctcatgccattgctccaaacgttagataacctcaaggagggcaagcaccacctccgcgtgagacccgcagatctgcctgtcgccgaacgcgcatccctgaattactggcggacctggaagtgcatctcaaaaccctcagaattccctataaagtctcctgccttcaccgggttacacgataaggctcctttagggttgatggacactcccctgttagacactgaagaggaagtgcactactgctttctccctctcgatctggtcgcaaagtacccatctctcgttaccgaggataatctgctgtggcttgccgagaccgtagcattgatcgaatgtgaatgttccgagtttcgatttatagtaaacttcctgcgatcccaaaagattctcttgccagataacttctcaaacatagatgtcctggaggctgaggtagagatcctggagattccagcactgaccgaggcagtgcgatggtaccgcatgaacatgggcggatgttctccaacaacctgctcgcctctatctccgggtaaaggcgctcgtactgcatccctggagtcagtcaaacccttgtatactatggccctgggcctgctcgtgaagtatcccgactctgccctggggcagctgagaatcgagtctaccctggatggcagcagattatatattactggcaatggtgtgcttttccagcacgtgaagaactggctgggaacttgtaggctgcctctgaccgagacaatcagtgaggtgtatgagctttgcgctttccttgataaaagggacatcacatacgaacctataaaagtcgcccttaagacccaccttgagccccgaaccctagccccaatggatgtgcttaatgagtggaccgccgaaatcactgtttattccccccagcaaatcatcaaggtctacgtgggcagccattggtatgccaccacgctacagactcttcttaagtaccctgagctgctgtctaacccccagcgcgtctactggatcacctacgggcagacgctcctgatacatggggacggacagatgtttcggcacatcctaaacttcctgcgcctgggcaaattattcttgcctagcgaatttaaagagtggccattattctgccaagaggtcgaagagtaccacattccatccctttccgaggcactggcccagtgtgaagcctacaagtcctggactcaggagaaagaatcagagaatgaggaagcttttagtatccggaggcttcacgtcgtcaccgaaggccctggatctttagtggaattcagcagggataccaaggaaaccactgcctatatgccagttgacttcgaggactgttccgaccgtacgccgtggaataaggcgaaggggaatctggtgcggtcgaaccagatggacgaggccgagcagtatactagacccatccaagtgtccctctgccggaatgctaagcgcgctggtaatccatccacgtatagccattgccgcggtctctgtacaaacccgggacactggggatcccacccagagtctcccccaaaaaagaagtgtaccaccataaacctcacccaaaagtccgaaactaaagaccccccagccacaccaatgcagaagttaatctcgctggttcgcgaatgggacatggttaactgcaaacagtgggaatttcagcctttaaccgcaacacgtagctcaccgttagaagaggccaccttgcagctccctctgggcagtgaggcagcctcacagccgtctacctctgctgcctggaaggctcactctaccgccagcgagaaggatccgggtccgcaggccggagctggcgctggtgcaaaggataaggggcctgagccaacttttaaaccatatttgccacccaagcgggcaggcacattgaaggattggagcaagcagcgtaccaaggaacgcgagtccccagcacctgagcagcccctcccagaggcaagcgaggtggattcactcggcgttatacttaaagtgacccaccccccagtcgtcggcagcgacgggttttgtatgttcttcgaggatagcataatttacacgactgaaatggataacctgcggcatacaacccctactgcgtctccccagccacaggaggtcacattcttgtcgttctctttatcttgggaggaaatgttctacgcgcagaaatgccactgcttcctagccgatattatcatggatagcatccggcagaaggatcccaaggccatcaccgcaaaggtggtgtccctcgccaaccgcctgtggactctgcatattagcccaaaacagtttgtggtggatctgctcgccataacaggcttcaaggacgataggcatactcaggagaggctctactcatgggtggagctcactctaccttttgccagaaaatacggcaggtgcatggacttgttaatccaacggggtctgtcaagatcggttagttattcaatactgggcaagtacctccaggaagactag

SEQ ID NO: 52927 - DNA, 1260 bp, Artificial Sequence
  Description of Artificial Sequence: Synthetic coding sequence
atgaacgtgcacaggggtagcgacagtgaccgactccttcgtcaggaagcttcatgcctggttgatgacaccttggcggtcgcccaggaaaaagaggccaactccctcgctagctctggtccacacaatctcacctatcccctgggcccacgaaacgaggatctcagcctagactacgcctcccagcccgctaacctccagttcccgcatatcatgcctttggccgaggacattaagggctcatgtttccagagcggaaataagaggaaccacgaaccattcatcgctcctgaaaggtttgggaatagctccgtcgggtttggcagtaattcacacagtcaggcccctgaaaaggttacactgctcgtcgatggcacccggtttgtggtcaaccctcagatttttacagcacacccagacaccatgctcggcagaatgtttggccctggtcgcgaatataattttacaagacctaacgagaaaggagaatatgaaattgctgaagggatttccgcgactgtgttccgcaccgtactagactattacaaaacaggcataattaattgcccggacggcatcagcattcctgatttgcgagacacttgcgattatctttgtattaacttcgacttcaataccatcagatgtcaggatctatcagccctgctccacgagctaagtaacgacggggctcacaagcagttcgaccactacctggaagagctcattttgccgatcatggtcggttgtgcaaaaaaaggagagcgagaatgtcatatcgtagtgttaacagacgaggactctgtggactgggatgaggaccacccccctcctatgggagaggagtactcccagattctgtactcgtcaaaactttaccggttttttaagtacatagagaaccgtgacgtggctaaaaccgtgttgaaagagagagggctcaagaatattcggatcggtatcgagggctatcccacttgcaaggagaagatcaagcgcaggcccggtggacggtcagaggtcatatataactatgtgcagagacctttcatccagatgtcctgggagaaggaggaaggaaaatcgcggcacgtagattttcaatgcgtgagaagtaaaagtctcacaaatctggttgccgcaggagacgacgtgcttgaagaccaggagatcctgatgcatcatccgccacaggttgatgaattagatagattaaacgcgcctctgagccaaatggcctccaacgactttcaggattag

SEQ ID NO: 52928 - DNA, 762 bp, Artificial Sequence
  Description of Artificial Sequence: Synthetic coding sequence
atgaatgtccacagggggtctgattccgacaggctgttgcggcaggaggccagttgtcttgtagatgatactctggcagtggcccaggaaaaggaagctaattctctggcctccagcggtccccacaatctgacgtacccactgggcccacgaaacgagggagcactgcttcatgagctctcgaatgatggcgcacacaaacagtttgaccactatcttgaggagcttattctccctatcatggttggttgcgctaagaaaggcgagcgtgagtgccatattgtggtcctgactgacgaggattccgtagattgggacgaggaccatcctcctcccatgggggaagaatatagtcagattctctattccagtaagctctatcgcttcttcaaatatattgagaatagggatgtggcaaaaacagtgttaaaggagagagggctcaaaaatattcggatcggcattgagggctatccaacctgtaaagaaaagatcaagcgtagacccggagggcgtagtgaggtgatctacaattacgtccaaagacctttcattcaaatgagttgggagaaggaagaggggaaaagtaggcacgtcgatttccagtgcgtccgatcaaagtccctgaccaatctggtagccgcaggggatgacgtcctagaagatcaggagattctcatgcatcacccaccgcaggtcgatgaattggatagactgaacgctcctctttcgcaaatggctagtaacgattttcaggattag

SEQ ID NO: 52929 - DNA, 264 bp, Artificial Sequence
  Description of Artificial Sequence: Synthetic coding sequence
atgaatgtgcatcggggaagcgacagtgaccggctccttaggcaggaagcaagttgtctagtagatgatacactcgcggtagcacaggagaaggaggctaattcccttgctagctcaggaccccacaatttgacatacccgttagggcctcgaaacgaagacctctctctggattatgcaagccaacccgctaatttacagttccctcacatcatgcctctcgctgaggacataaagggcagctgtttccagtccggcaattag

SEQ ID NO: 52930 - DNA, 330 bp, Artificial Sequence
  Description of Artificial Sequence: Synthetic coding sequence
atgaatgtgcatcgcggatcagacagcgacaggttgctccggcaggaggccagctgccttgtcgacgatacactggccgttgcccaagaaaaggaggctaactcactggccagtagtggtccacataatctaacctatcctctggggcctcgcaatgaggacttaagcttggactatgcctctcagccggctaaccttcagtttccacacataatgcctttagccgaggacattaaaggctcttgcttccagtcaggcaataagagaaatcacgagccatttatcgcacccgaacggttcgggaatagctcagtggggtttggctcctag

SEQ ID NO: 52931 - DNA, 294 bp, Artificial Sequence
  Description of Artificial Sequence: Synthetic coding sequence
atgaatgttcatagagggtctgatagcgataggctcttaaggcaggaggcttcctgtctcgtggacgatacccttgccgtcgcccaggaaaaggaggctaatagcttagcatcttccgggcctcataatctgacctatcctctgggccctaggaatgaagatttgtctctcgactatgcaagccagccagccaacctccagtttccacacattatgccactcgcagaagatattaaaggctcatgcttccaatctggcaataagcggaatcacgaacccttcatcgccccttag

SEQ ID NO: 52932 - DNA, 825 bp, Artificial Sequence
  Description of Artificial Sequence: Synthetic coding sequence
atgtttggccctgggcgagaatacaacttcactcgtccaaatgagaagggggagtacgaaatcgctgaggggatctcggctacagtgttccggacagtgctggactattacaagaccggtattatcaattgcccggacggcattagtatccccgacctgcgagatacttgtgactatctgtgtataaatttcgattttaacacgataagatgccaggacctgagcgcactactgcacgagctatccaacgatggtgcgcataagcaatttgaccattatttggaggaactaatcctgcctattatggttggctgcgccaagaaaggtgagcgggagtgtcacatcgtggttttgaccgacgaagattccgtggattgggacgaggaccatccacctccaatgggcgaggaatacagccagatcttatacagttccaagctttatagattcttcaaatacatcgaaaatcgggatgtcgcgaagactgtcttgaaggaaaggggtctgaaaaacatccggatcgggatcgaaggttaccctacttgtaaggaaaagatcaagcgcaggccaggaggtaggagcgaagtgatctacaactacgttcagaggccatttattcaaatgagttgggagaaggaggaggggaagagtagacatgtcgattttcaatgcgtgcgatccaagagccttacaaacctggttgccgctggagatgatgtcctcgaggaccaggaaatactgatgcaccacccccctcaggtggatgagcttgacaggctcaatgctcctctgagccagatggcctcaaacgacttccaagactag

SEQ ID NO: 52933 - DNA, 522 bp, Artificial Sequence
  Description of Artificial Sequence: Synthetic coding sequence
atggtcggctgtgccaaaaaaggtgagcgggagtgccatattgttgtcctgaccgacgaggactctgtggattgggatgaagaccatccgccacctatgggtgaggaatacagtcagatactgtatagctccaagctgtacaggttctttaagtatatcgagaaccgggatgtggcaaagacggtactaaaggaacgcggacttaaaaatatacgaataggaatagaaggctatcccacctgcaaggaaaagatcaagcgtagaccgggtggccgttccgaggtcatatataactatgtgcagcgccctttcattcagatgtcatgggagaaggaggagggcaaaagccggcatgtggactttcagtgcgttcggagtaagagcttaacgaatctggttgcagccggtgacgatgtgctcgaggatcaggagatcctcatgcatcacccaccgcaagtggacgagctagaccgcttgaacgccccattgtcacagatggcctctaatgatttccaggactag

SEQ ID NO: 52934 - DNA, 783 bp, Artificial Sequence
  Description of Artificial Sequence: Synthetic coding sequence
atgagtgaccctatcactctgaatgtaggaggtaagctgtacaccacctcgcttgccactttgacctcctttcctgactctatgctcggggctatgttctccggaaagatgccaacaaaacgcgattcccagggcaattgttttattgaccgcgacggcaaagtgtttaggtatatcctgaacttcctacggacttcccacctggacctccctgaggattttcaagaaatgggcctgttaaggcgggaagccgacttctatcaagtccaaccactgattgaggcccttcaggagaaagaggttgagctgagtaaagccgaaaaaaatgcaatgctgaacatcaccctgaaccagcgcgtacaaacagttcattttacggtccgggaagccccacagatctacagtttatccagctcatccatggaagtgttcaacgcaaatatattctccacttcttgcctttttctcaaattgcttggaagtaagttgttctattgctccaacggcaatctcagctctatcacctctcacctgcaggatcccaaccacctgaccttggattgggtggccaatgtcgaaggtctgccagaggaggaatacactaagcagaatttaaaaaggctgtgggtggtaccagcaaataaacagattaacagttttcaggttttcgtcgaggaggtcctcaaaattgctctgagcgacggcttttgcatcgactcttcccatccacacgccttggatttcatgaataataagattatccggctaattcgataccgttag

SEQ ID NO: 52935 - DNA, 423 bp, Artificial Sequence
  Description of Artificial Sequence: Synthetic coding sequence
atgagcgaccccattacccttaatgtcggaggtaagttatataccacatctctcgctactctgacctcattccccgacagtatgctcggtgccatgttcagcggcaaaatgccgactaaacgggatagccaggggaactgcttcatagatcgtgacggaaaagtcttccgttatattctcaatttcttgaggacttcacatcttgatctgccggaggactttcaggaaatgggcctgttgcgacgggaggctgatttctatcaggtccagcctctgattgaagcgctgcaagagaaagaggtagaacttagtaaggccgagaaaaatgcaatgctgaacatcaccctgaatcagcgggtccagactgtccatttcacggtgagagaggccccacagatttattccttaagttcgagttcatag

SEQ ID NO: 52936 - DNA, 780 bp, Artificial Sequence
  Description of Artificial Sequence: Synthetic coding sequence
atggaaagaaagattaatcgtagggagaaggagaaagagtacgagggaaaacacaacagcttagaggacaccgatcaggggaagaactgtaaaagtactctgatgacactgaatgttggcggatacttatacattacacagaagcaaacactgaccaaatatccagacactttcctggagggaattgtgaacggtaagatcttgtgtccattcgacgctgatgggcactatttcattgaccgggatgggctcttgtttaggcatgtactgaatttcctgagaaatggcgagctcttgttgcccgaggggttccgcgaaaaccagctgctggcacaggaggccgagttctttcagctgaaggggcttgccgaggaagtgaaaagtagatgggaaaaggagcaattaacccctcgggaaactacattcctggaaatcactgacaaccacgataggagccagggtctgcggatattttgcaatgcacctgatttcatttcaaaaattaaaagtagaatcgttctcgttagtaaatcaaggttagatgggttccccgaggaattctccatctctagcaacattatccagtttaaatattttatcaaatcagaaaatggcaccaggttggtgctgaaggaagacaacactttcgtgtgtaccctcgagaccctaaagttcgaggcaattatgatggcactgaagtgcgggtttcggcttctgacctctcttgactgctccaaagggtccatagtgcacagtgacgcattacacttcatcaagtag

SEQ ID NO: 52937 - DNA, 780 bp, Artificial Sequence
  Description of Artificial Sequence: Synthetic coding sequence
atggagagaaagattaacaggcgggagaaggagaaagaatacgagggtaagcataattctctggaggacactgatcaagggaaaaattgcaaatccactcttatgaccttaaatgtgggcggatacctgtacatcacccagaaacagaccctgacaaagtaccccgataccttcctggaaggcatcgtcaacggaaagatcctctgtccatttgacgccgatgggcactacttcattgatagggacggcttattgtttagacacgtgctgaatttcctgagaaacggtgaactgttgcttcccgagggattccgcgagaatcagctgctagcccaggaagcagagtttttccagcttaaagggcttgcagaggaagtgaagagtagatgggaaaaggaacagcttacaccgagggagacgacattcttggagatcaccgacaaccatgacaggtcccaagggttgcgcatattctgcaacgcgccagacttcatctctaagattaagtcgcgcattgtcctagtcagtaagagtcggctggatggctttcctgaagagttcagtatcagcagcaacattattcagtttaagtacttcatcaaatcggagaatgggacgcggctcgttctcaaggaagataacacatttgtgtgtactctggagacacttaagttcgaggctattatgatggccctcaagtgtgggttcagactgctgacatccctggattgctccaaggggtcaatcgttcactccgatgctctccacttcataaaatag

SEQ ID NO: 52938 - DNA, 705 bp, Artificial Sequence
  Description of Artificial Sequence: Synthetic coding sequence
atggccgagaaccattgcgaacttctatcccccgcacggggtggcatcggcgctggcctgggcggagggctgtgcagacgctgcagtgccggactgggcgctctggcccagaggccaggttccgttagcaaatgggtccgattgaacgtaggtggaacgtactttttgaccaccaggcagacgctgtgtcgggaccctaaatctttcttgtaccgtctttgccaggctgaccccgacctggattccgataaagatgagaccggggcatatctcatagatcgtgaccctacatatttcgggcctgttttgaattacctgaggcacggcaagttggtgattaacaaagacctggctgaagagggggttttagaggaggccgaattctacaacatcacctccctgattaagctggtgaaggacaaaattcgcgagcgagactccaagaccagtcaagtgcccgtgaagcatgtctaccgggtcttgcagtgccaggaggaagagctgactcagatggtgagtaccatgagcgatggctggaaatttgagcagctcgtcagcatcggcagtagctataattatggtaatgaggatcaggccgaatttctgtgcgtggtctcaaaggaacttcataacacaccatacggcaccgcctcagagccctccgagaaggccaagatcctgcaggagcggggatctcggatgtag

SEQ ID NO: 52939 - DNA, 714 bp, Artificial Sequence
  Description of Artificial Sequence: Synthetic coding sequence
atggataatggcgactgggggtacatgatgactgaccccgtgacactcaatgtcggcggacacttatacacaacgagcctcacaacactgacacggtacccagatagcatgttgggggcaatgtttggcggagattttccgacggcaagggacccacagggtaattacttcattgatcgagacggccctctctttcgctacgttctcaactttctccgcaccagcgagctgacactgcctttggattttaaggagtttgacttgcttaggaaagaggctgacttctaccagatcgaacctttgattcagtgcctcaatgacccgaagcctctttatcctatggacaccttcgaagaggttgtggagctctcttccacccggaagctctccaagtatagcaaccccgtggccgtcatcatcactcaactgactatcaccactaaagttcattctcttcttgaaggaatcagtaattacttcaccaaatggaacaaacatatgatggacactagggattgccaagtatcctttacctttgggccatgcgactaccatcaggaagtcagcctcagagtccacctcatggaatacataactaagcaagggtttaccatacggaacacacgagtccaccacatgtcagaacgggcaaatgagaacactgttgagcacaactggactttttgccgccttgcacgcaagaccgacgactag

SEQ ID NO: 52940 - DNA, 714 bp, Artificial Sequence
  Description of Artificial Sequence: Synthetic coding sequence
atggataacggggattgggggtacatgatgaccgaccctgtgactctcaacgtgggcggtcacctatacaccacgagtttgaccaccctcactaggtatcccgattctatgttgggggcaatgtttggcggagatttccctacagcaagagacccacagggcaactacttcatagaccgtgacgggcctttgtttaggtacgtactgaactttctcaggacatcggagctcacccttccactcgattttaaagagtttgacctattgcggaaagaagccgacttctaccagatcgaaccactgatccagtgtctcaacgatccaaaacccctgtaccctatggatacgttcgaagaggttgtagagctgagctccacccgcaaactgtccaaatatagcaatcccgtggccgtgattattacacagcttacaatcactacgaaggtacactctctgctcgagggcatttccaattatttcacaaagtggaataaacacatgatggacacacgcgactgtcaggtgagctttaccttcgggccttgcgactaccaccaagaagtgtccctacgagtgcatctaatggagtacatcacaaaacaggggttcaccattcgtaatactcgagtccatcatatgtctgaacgagctaatgagaacactgtcgagcacaattggacattttgccggctggctcggaaaaccgacgactag

SEQ ID NO: 52941 - DNA, 30 bp, Artificial Sequence
  Description of Artificial Sequence: Synthetic coding sequence
atggataacggtgattggggctatatgtag

SEQ ID NO: 52942 - DNA, 714 bp, Artificial Sequence
  Description of Artificial Sequence: Synthetic coding sequence
atggacaatggcgactggggctacatgatgacggacccagtgactttgaacgtgggcggacacctgtacaccacctccttgacgactcttaccaggtatccagactcaatgctgggtgccatgtttggaggcgactttccaactgctcgtgacccacagggaaactacttcattgatcgtgacggtcccctcttcaggtatgttctaaattttctgaggacaagtgaattgactcttccccttgacttcaaagaattcgaccttttgagaaaagaggccgacttctaccagatcgaacccctgatccagtgcctcaacgaccccaagccactctaccccatggacactttcgaggaggtcgtggagttgtcttccacccgcaagttatccaagtattccaacccggtcgcggtcatcattacccaactgacgattactaccaaagtgcattcactactggaggggatctcgaactattttactaagtggaataagcatatgatggatacacgagactgccaggtttccttcaccttcggcccatgtgattaccaccaggaggtgtccctgcgggtccatctgatggagtatatcaccaagcagggattcaccattcgcaataccagagtgcaccacatgagcgaacgtgctaatgaaaacacagtcgagcacaactggactttttgcagactggctagaaagactgacgactag

SEQ ID NO: 52943 - DNA, 1422 bp, Artificial Sequence
  Description of Artificial Sequence: Synthetic coding sequence
atggctcttaaagatacaggtagcggaggcagcaccatcctgcccatctctgagatggtttcctcctcgtcttcacccggagcttctgcggctgcagccccaggaccctgtgctccttcacctttccccgaagtcgtggagttgaatgtggggggacaggtgtatgtgaccaagcactccactctgcttagtgtaccagatagtaccctagcgtccatgttctcaccatcatccccacgcggaggggctagacggcgaggggagttacccagggactctcgcgctaggttttttatcgacagggatgggttcctgtttcgctacgtcttggattacctgcgagacaagcagctggcgctgccggaacatttccctgaaaaggaacgtctattgcgggaggccgagtactttcaactaacggacttagtgaagttactgtccccgaaggtcactaaacagaactccctcaacgacgaagggtgccagtccgacctggaggacaacgtctctcagggatcttcagacgccctgttattgagaggggctgctgccgcagtcccttccggtccaggcgctcacggaggaggcggtggcggtggagcgcaggacaaacggtctggattcctgacacttggataccgagggtcttacaccaccgtgagagacaatcaggctgacgccaagttcaggcgtgttgcccgaattatggtttgcggaaggatagcgctagccaaagaggtgtttggggatacgctgaatgaatcccgggaccccgatcgacagccagagaagtatacatctcggttctatctgaaatttacgtacttggagcaggccttcgataggttgtccgaggctggtttccatatggtcgcatgtaattcaagcggtaccgcagcgtttgttaaccaataccgagatgataagatctggagttcatatacagaatacatcttttttcgaccccctcaaaaaattgtctcccccaagcaagagcacgaggatcggaaacatgataaggtgaccgacaaaggctcagaatctggcactagctgcaacgaattgtctacaagcagctgtgacagtcactccgaggcctctacaccacaggacaacccttcctctgcacaacaggccacagcacaccaacccaatacccttacactggacagaccctcaaaaaaggcccctgtgcagtggatcccccctcctgataaacgcaggaactcggaactattccagaccttaatctctaagagcagggagacaaatctctcaaagaagaaagtctgcgaaaaattgtccgtggaggaggagatgaagaagtgtattcaggattttaagaaaattcatattcctgactacttcccagaaagaaagcgtcaatggcagtccgagcttctgcagaagtatggactttag

SEQ ID NO: 52944 - DNA, 2751 bp, Artificial Sequence
  Description of Artificial Sequence: Synthetic coding sequence
atgtcctacactctcgacagcctggggaatccttctgcctataggagagtgaccgagacacgttcctcctttagccgggtttccgggagcccttcctcagggttccggagtcagagctggagcagaggatcgccaagcacagtgagctcttcatacaagagatctatgctggcgccaaggcttgcatactctagcgctatgctctcttcagcagaatcctccctggatttctcccaatcttcaagtttgttgaacggaggctctgggccaggtggtgactacaaactcagtcgcagcaacgagaaagagcagttgcaagggttgaacgataggtttgccggatatatcgagaaggtacactatttagaacagcagaacaaagaaattgaggcagaaatacaggctctgcggcagaagcaggcctcacatgcccagttgggtgacgcttatgatcaggaaatccgcgagctgcgagcaaccctggaaatggttaatcacgagaaagcgcaggtgcaactggatagcgaccatttggaagaggatatccacaggctgaaagagaggtttgaagaggaggcacgtctccgcgatgataccgaggccgctatacgggctttgagaaaggacattgaggaagcatccctcgtcaaagttgagctggataagaaggtccagagcctgcaggacgaggtcgccttcctgcgttctaatcacgaagaagaggtggctgacctcctggcacaaatccaagccagccatatcactgtggaacggaaggattatctcaaaacggacatatctactgcactcaaagagatcagatcacagctcgagtcccatagtgaccagaacatgcatcaggctgaggagtggtttaagtgtcgctacgcaaagctgactgaggctgccgaacagaacaaagaagccatccggtccgcgaaagaagagatcgcagagtacaggagacaattgcagagcaaatctatagagttagaaagcgtcaggggcactaaagagtctctggaaaggcagctgagcgatatcgaggaaaggcacaatcatgatttgagctcataccaggataccatccaacaacttgaaaacgaactgcgtgggaccaagtgggaaatggctcggcacctgagggagtatcaggacttgctcaacgtgaaaatggcactggacatcgagattgctgcctaccggaaacttctcgaaggggaagagacgaggttctccacctttgcaggaagcattacggggccactgtatacccaccgccctcctattacaatcagcagcaagattcaaaagcccaaagtggaagctcccaaactgaaagtccagcacaagttcgttgaagagatcatagaggagaccaaggtggaggatgaaaagtcagagatggaggaggccttgaccgcgattacagaagagctggctgtctcaatgaaggaagagaaaaaagaggctgccgaagaaaaagaggaggaacctgaagccgaagaggaggaggtagctgccaaaaaatcccctgtcaaagcgaccgctcctgaggtgaaggaggaggaaggcgagaaggaagaagaggagggccaggaggaggaggaggaggaggatgagggagccaaaagtgaccaagcagaggagggcggaagcgagaaggaggggagttccgaaaaagaggaaggcgaacaagaagaaggcgagactgaggcagaagccgagggagaagaagccgaggctaaggaggaaaaaaaggtggaggaaaagagcgaagaggtagcaaccaaggaggaactcgtggcggatgccaaagttgaaaagccagagaaggccaagagcccggtgcccaagtcacccgtggaggagaaaggcaagtctcctgtgccaaaatccccagtggaagaaaagggcaagtccccagtgccaaagagtccagttgaggagaaagggaaatctcccgtaccaaagtcgcccgtggaggaaaagggaaagtcccccgttagcaaatcaccggtggaagaaaaagctaagagccccgtgccgaaatctccagtggaggaggctaagtctaaagcagaagtcggcaagggagaacagaaagaggaggaggagaaagaggtcaaggaggctcccaaggaggaaaaagtcgagaaaaaagaggagaaaccaaaggacgtacccgagaagaaaaaagccgaatcgccagttaaagaggaagcagtggccgaagtagtgacaatcactaagagtgtaaaagttcacctcgaaaaggagacaaaagaggagggaaagcccctacagcaggagaaggagaaggagaaagccggtggggaggggggttctgaggaagagggttctgataagggagcaaagggcagcaggaaagaagacattgctgttaatggcgaggtcgagggtaaggaggaggtggaacaggagactaaagaaaaaggcagtgggagagaggaggagaaaggggtcgtgaccaacggactggacctttcaccagccgatgaaaagaagggcggagacaagagtgaagagaaggtggtagttactaagactgtggagaagattacctctgagggaggcgatggcgcaaccaaatacattaccaaaagcgttacggtcactcagaaagtggaagagcatgaagagacatttgaggagaagctggtcagcacaaagaaggtggagaaagtgacctcccacgccatagtcaaagaagtaactcagtccgactag

SEQ ID NO: 52945 - DNA, 1932 bp, Artificial Sequence
  Description of Artificial Sequence: Synthetic coding sequence
atggaagccgtcgagacaggggaaagaccaactttcggagcttgggattacggggtcttcgcattgatgcttttggtgtccacgggaatcggattgtgggtggggctcgctagaggcggacagaggagtgccgaggacttcttcacagggggtagacgactagccgctctcccagtgggcttgtcactatccgcctctttcatgagtgctgttcaggtgctgggtgtgccttccgaagcctatcggtacggacttaagtttctttggatgtgcctcgggcagctcttgaacagcgtgctcaccgctctgttgttcatgcctgtgttttaccggctgggacttacatccacctacgaatatctcgaaatgagattttcaagggcagtacgtctttgtggtacactgcagtacatcgtggccactatgctgtacactggaatcgtgatttacgctcccgcattgattctcaatcaggtgacgggcctcgacatctgggcctctttgctttccactgggatcatttgcaccttttacaccgccgtggggggtatgaaggccgtcgtatggacagatgtgtttcaggtggttgtcatgctttcaggtttctgggtagttctggccagaggcgtgatgctagttgggggaccgagacaggtactcactctcgcgcagaaccacagccggattaatctgatggattttaaccccgatccacggtcccggtacacattctggacttttgtggtggggggtactttagtatggctctcgatgtatggcgtgaaccaggcacaggtgcaaaggtacgtggcctgtaggaccgagaagcaagctaagctcgctctcctgatcaatcaagtggggctcttccttattgtctcgtcagccgcttgttgtgggatcgtcatgtttgtcttctacactgactgtgaccctctgcttttaggccgaattagtgcacctgatcagtatatgcctctcctcgtgctcgatatctttgaggacctgccgggagtccccggtctgttcctcgcttgcgcgtattctgggaccctgagcaccgcgagcacctccatcaacgccatggccgctgtgacagttgaagatttgatcaaacccagacttagaagcttagcgccaagaaaactggttatcattagcaagggcttgtctctgatttacggctcagcctgtctcaccgtcgcagcgctctcctcactgcttggaggcggagtcctgcaaggttcatttacggtgatgggcgttatttccgggcctcttctcggcgctttcattctcggtatgttcctgccagcatgtaatacacccggtgtgttagcagggctgggagccggactcgctctttcactctgggtagcactgggtgctaccctctaccctccgtcagagcaaaccatgagggtcttaccatcttcagccgctcgttgtgtcgcgcttagtgtgaatgccagcggattgctggatcctgcactgcttcccgctaacgattctagccgcgcaccctccagtgggatggacgccagcagaccggcactagccgattcattttatgctattagttatctctactacggggcactcggtaccctcacaacagtattatgtggtgcccttatctcatgccttaccggcccaacgaaacgatccacattggcacccggacttctgtggtgggacctcgccaggcagacagccagcgtagcgccaaaagaggaagtcgctattcttgacgataacctggtcaagggacccgaggagctcccaacaggcaacaagaaaccccctggatttttgcctactaatgaggacagactctttttcctaggtcagaaggagctagaaggtgccggatcctggacaccatgcgtgggtcacgacggcggacgggatcagcaggaaacaaacttgtag

SEQ ID NO: 52946 - DNA, 1230 bp, Artificial Sequence
  Description of Artificial Sequence: Synthetic coding sequence
atgaactcccactcctacaacgggagcgtcgggaggcctctggggtctgggcctggcgctctgggtcgagacccaccagatcctgaagccggtcacccaccccagccgcctcactctcccggtttacaggtggtggttgctaagagcgaacctgcaaggccttcacccggttctcctcggggacagccccaagatcaagatgacgacgaagatgatgaggaagacgaagctgggcgtcagcgggcttcaggcaagcccagcaacgtgggccaccggttaggacatcgcagggcccttttcgagaagaggaaacgactcagcgactacgccctgatatttggcatgtttggaatagtggttatggttacggagactgagcttagctggggcgtctacacaaaggagagcctgtattcatttgctctgaagtgtttgattagtctttctaccgcaatactgctgggcttagtggtgctgtatcatgcacgagagattcagctgtttatggtggacaacggggcagatgattggaggatcgcgatgacctgtgagcgtgtattcctcatatctctcgaattggcagtctgtgctatccacccggtacccggtcattaccgcttcacctggaccgccagactcgccttcacttacgccccatccgtcgccgaagctgatgtggacgtcctgctttcaattcctatgtttcttagactctacctcttgggcagggtgatgttgctgcattccaaaatcttcacagacgctagttccaggtcgataggggcactgaataaaatcacttttaatacacggttcgttatgaaaactctgatgactatctgtccaggcacggtgttgctggtgttttcaattagctcatggattatcgctgcctggacggtgagggtatgtgaacgctatcacgacaaacaagaggtgacatcgaattttctgggagcaatgtggctcatctctattacattcttaagcatcggctatggcgatatggtgcctcatacatactgcggcaagggggtatgtctgttgactggaatcatgggcgcaggatgcactgcactggtagttgccgtggtggccaggaaacttgagctcactaaagcggaaaagcacgtacataactttatgatggatacccagcttaccaagcgagtgaaaaacgctgccgcaaacgttctccgcgaaacgtggcttatttgcaagatgggttag

SEQ ID NO: 52947 - DNA, 1311 bp, Artificial Sequence
  Description of Artificial Sequence: Synthetic coding sequence
atgggattagcacgtgcgttgcggcgattaagcggagcgcttgactccggggactctcgtgccggtgacgaggaggaagcaggtcccggtctctgtcggaatgggtgggcaccagctcctgtgcagtccccagtaggccgtcgccgtggacgcttcgtgaaaaaggacggacattgtaacgtgcggttcgtaaatctcggcggtcaaggcgcacggtacctgagtgacctatttaccacgtgcgtagacgtaaggtggcggtggatgtgtctgctgttctcctgtagcttcttagcttcatggctgcttttcggacttgccttctggttgatcgccagtctgcacggcgacctcgctgcacccccaccaccagccccttgcttctctcacgtagcctcctttctcgctgcttttttgtttgccctcgaaacgcagacttccattggttacggcgtccgaagcgtaacagaagagtgcccggcagcagtggcagcagtggtgctgcagtgcatcgccggatgtgtccttgatgccttcgtagtgggtgccgtgatggccaaaatggctaagcccaagaaaagaaatgagaccctcgtcttctcagagaatgccgtcgtggcgctgagagatcataggctgtgtctgatgtggcgcgttgggaacctccgaaggtcccatctggttgaggctcatgtgagggcacagttgctgcaacctagagttaccccagagggggaatatatcccattagatcaccaggacgtggacgttggcttcgatgggggaactgatagaattttcctcgtctcacctattactatcgtgcatgagattgacagtgcctcgccactctatgagctgggacgggctgagctggcgagagctgacttcgagctcgtggtcattctagaagggatggtcgaggctacagcaatgacaacccaatgtcgctcttcttacctgcccggagaattgctgtggggacacaggttcgagcctgttctttttcaacggggtagccagtacgaagttgactaccgacatttccacagaacttatgaggtgcctggcacgcctgtgtgttcagccaaggagctggatgagcgagcagaacaagcttcacactccctgaaaagttctttccccggaagtctaaccgcgttctgctacgagaacgaactggccttaagctgctgccaggaagaagatgaagatgatgaaactgaagaagggaatggcgttgagaccgaggatggagccgcatctccccgtgtgctcacgcccacgctcgccctgactcttccaccttag

SEQ ID NO: 52948 - DNA, 1311 bp, Artificial Sequence
  Description of Artificial Sequence: Synthetic coding sequence
atgggacttgccagggcgctacgccgtctgtctggggctctagacagcggtgactcacgagcaggcgatgaggaggaagcaggtcccggactgtgccgaaacggttgggcgcctgccccagtacagagccccgttggacggcgtagaggccgttttgtgaagaaggacggacactgtaatgtgcggtttgtgaacctcggcggacaaggtgccaggtatctgtccgacctattcaccacatgtgtggatgtgcggtggcgatggatgtgccttttattctcgtgttctttcctggcctcatggctgctcttcggactggcattttggctgattgccagcctccacggggatctggccgcaccacctcctccggctccttgctttagccacgtggcaagcttcctggcagcctttctgttcgctctggaaacacagacctcgatcggatacggggtgcgcagtgtgacagaagaatgcccagcagcagtggctgctgttgtactccagtgtattgccggatgcgtactggatgccttcgtggttggcgctgtgatggccaagatggcaaaacccaaaaagaggaatgaaacactggtcttctctgaaaatgccgtggttgctctgagggaccatcgcctctgtctgatgtggcgggtcggtaatttaagaagaagtcatttggtggaggcccatgtgcgcgctcagttgttgcagccacgtgtgacccccgaaggagagtatatccctctcgatcatcaagatgttgacgtcggtttcgacggaggaaccgaccgaattttcttagtctcccccattactatcgtgcacgagattgacagcgccagccctctctacgagcttggcagagctgaactcgccagggcagatttcgagctggttgttattttagaggggatggttgaagctaccgcaatgacgacacaatgccgttctagctacctccccggagaacttctctggggccatcgcttcgaacccgtgctctttcaaaggggctctcagtacgaggtggactacaggcattttcatcggacctacgaggtccctggcactcccgtctgttccgctaaggaattggacgagagagccgagcaggcaagccacagtctgaagagttcctttcctgggtctttgacagcattctgttacgaaaatgagttagcgcttagttgttgtcaagaagaggacgaggatgacgagaccgaagaaggaaatggcgtggaaactgaagacggggcagctagtccacgcgtgctcaccccgaccttggccctgacccttcccccatag

SEQ ID NO: 52949 - DNA, 1182 bp, Artificial Sequence
  Description of Artificial Sequence: Synthetic coding sequence
atggctcaagagaacgccgcattttcaccgggtcaggaggagcccccaaggcggaggggccgtcaacggtatgtggagaaagacggccgatgcaatgtccaacagggcaacgtgcgggagacctacaggtacttaactgacctttttacgactctcgtggatctgcaatggcggctatctctgcttttcttcgtgctggcctacgcactcacatggcttttctttggcgcaatctggtggttgatcgcatatggtagaggggatctggaacacctggaggacactgcatggacgccatgtgtcaataatcttaacgggtttgtggccgcatttctgttctctatcgaaacagagactactatcggatacggccatcgagttattaccgatcagtgcccggaggggattgtgctactgctactgcaggccattttgggatctatggtcaatgccttcatggtgggctgcatgttcgttaagatctcacagcctaacaagcgagcggcaacattagtgtttagcagtcacgccgtcgtgagtctgagagacggcagactatgtctgatgttcagggtcggagacctcagatcctcccacatcgtcgaggcaagtataagggcaaagctgattagatccaggcagaccctggaaggtgaatttatccctctgcatcagaccgatctatccgtgggcttcgacacaggagatgatcgcctgtttctggtgtcgccccttgtgatctcacacgaaattgatgccgcatctccattttgggaggcgtcacggagggctctggagcgggacgatttcgagatagtcgtcatactggaagggatggtcgaagcaactggtatgacctgtcaagcgagaagcagttatctggtggacgaggtgctttgggggcacagatttacaagtgtgctgactttagaagatggtttttacgaggttgactatgcttccttccatgaaacgttcgaggtgccgacccctagctgttctgccagagaactagccgaggcggctgcacgcctggacgctcacctttattggagcatccctagtagactagatgagaaggtcgaggaagagggcgcaggagagggggcaggaggagaggccggagccgacaaagagcagaatgggtgtttacctcctccagagtcagagagtaaggtgtag

SEQ ID NO: 52950 - DNA, 708 bp, Artificial Sequence
  Description of Artificial Sequence: Synthetic coding sequence
atgttcatctggacatccggccgaacgagttcctcgtatagacatgacgagaagaggaacatttaccagaagattagggatcacgacttgctcgacaagcgaaaaacagtgacagccctgaaggctggagaagaccgtgcaatactgctggggttggccatgatggtctgctcgatcatgatgtattttctcctggggattacactcctccgatcttacatgcagagcgtctggaccgaagagtcccagtgcactcttctgaacgcctcgatcacagaaacgttcaattgctctttttcatgtggcccagattgttggaagctttcacaatatccgtgtttgcaagtctacgtcaatctgaccagtagtggggagaagttattactgtaccataccgaagaaaccattaaaatcaatcaaaagtgctcctacattccaaaatgcggcaaaaatttcgaggaatcaatgtctttggtgaatgtagtgatggagaactttaggaaatatcaacacttcagttgctattcagacccagagggcaaccagaagtctgtgattctcaccaaactttactcgtctaacgtattatttcactcactattttggcctacatgcatgatggccggaggggtagccatcgtcgctatggtaaagcttacccagtatctgtctctactgtgcgagagaatccaacgcattaatagatag

SEQ ID NO: 52951 - DNA, 708 bp, Artificial Sequence
  Description of Artificial Sequence: Synthetic coding sequence
atgtttatctggaccagcggaaggacttcttcttcctatagacacgatgagaaaagaaacatctatcagaagattcgagaccacgatctgctggacaaaaggaagacggtgacagctctcaaagctggtgaggacagagccatactgctgggccttgctatgatggtgtgcagtatcatgatgtacttcctgttgggcattactctcctgagatcctatatgcagtccgtctggacagaggaaagtcagtgtaccctgctgaacgcgagtattacagaaacttttaactgtagcttcagctgtgggccagattgttggaagctgtctcagtacccatgtctccaagtctatgtgaatttaacaagttcaggcgagaagcttctgctgtatcataccgaagagaccattaagattaatcagaagtgcagttatatacctaagtgcggcaaaaacttcgaagagtctatgtcactggtgaacgtggtgatggagaatttcagaaagtaccaacacttctcttgttacagtgacccagagggtaatcagaaaagtgtgatcctgactaaattgtactcatcaaacgtgctgtttcactcattgttctggccaacatgtatgatggccggaggggtggctatcgtggccatggttaagctcacccagtatctgtcactgctgtgcgagaggatccagaggatcaataggtag

SEQ ID NO: 52952 - DNA, 708 bp, Artificial Sequence
  Description of Artificial Sequence: Synthetic coding sequence
atgtttatatggacgagcgggagaacttcatcctcttacagacatgatgagaagcgcaatatctatcagaagatacgcgatcatgacctgctcgacaaacgaaagactgtgaccgcactgaaggccggtgaggatagggctattctgcttggcctggctatgatggtgtgctcaataatgatgtacttcctgttgggcattacgttacttcggagctacatgcaatccgtttggacagaggagtctcagtgcactttgctgaacgctagcatcacagagacttttaactgttccttcagctgtggacctgactgctggaagttatcacagtatccatgtctacaagtgtacgtgaatctgactagctctggagagaaacttctgctttatcatacagaggagactatcaagattaaccagaaatgctcctacattcccaagtgcggcaaaaactttgaggaaagtatgtcacttgtgaatgtggtaatggagaatttcagaaaatatcagcacttctcttgttactcagaccccgaaggaaaccagaaatcagttatcctgaccaagctgtacagcagtaacgtgctgtttcactcactcttttggcccacttgcatgatggccggtggggtggcaatcgtggcgatggtgaaactgacgcagtacctgagtttgttgtgcgagaggattcagcggatcaatcgctag

SEQ ID NO: 52953 - DNA, 414 bp, Artificial Sequence
  Description of Artificial Sequence: Synthetic coding sequence
atgtttatatggacctcaggcagaacttcctccagctatcgacacgacgaaaagagaaatatttaccaaaagattcgcgatcacgacctcctcgacaagcggaagactgtgaccgctctgaaggccggagaggaccgggcaatactcttggggcttgccatgatggtctgttcaatcatgatgtactttttgctgggaatcactctgctcagatcctacatgcaatctgtgtggactgaagagtcacaatgcaccctgctgaacgctagtataactgagactttcaattgtagtttttcttgtggacctgattgttggaagctgagtcagtacccctgcctccaggtgtacgtgaacctcacctcatctggggagaaattgctgctttaccacacagaggaaactattaagtag

SEQ ID NO: 52954 - DNA, 708 bp, Artificial Sequence
  Description of Artificial Sequence: Synthetic coding sequence
atgtttatctggacatctggcagaacatcctcaagttacaggcacgacgaaaagagaaatatttatcagaagatacgggaccatgacctgctggataagcgaaagaccgtgaccgccctcaaggctggggaggaccgcgctatcctgctgggcctggctatgatggtttgcagtatcatgatgtattttctattgggtattactctactcaggtcctatatgcagtcagtctggacagaggagtcccagtgcactttactcaacgcttccatcactgaaacatttaattgttccttctcctgtgggcctgattgctggaagttatcacagtatccttgcctgcaggtatacgtgaacctgacttctagtggcgaaaagctgttactgtatcatactgaagaaaccatcaagattaaccagaaatgttcctacattcctaagtgcgggaaaaatttcgaagaatcaatgagtctggtgaacgtagtgatggaaaattttaggaaataccagcacttctcttgctattcagatccagagggtaaccaaaaaagtgtgatcctgacgaagctgtatagctcaaacgtactctttcattctctcttctggcctacatgcatgatggccggaggcgtagccattgtggctatggttaaactaacccagtacttaagtctcctatgtgaaaggattcagcgaattaaccgctag

SEQ ID NO: 52955 - DNA, 303 bp, Artificial Sequence
  Description of Artificial Sequence: Synthetic coding sequence
atgttcatctggacctctggcaggacatcctcaagctatcgacacgacgagaaaaggaacatctatcaaaagattagagatcatgatcttcttgataagaggaagacagttacagctttaaaggccggagaggatcgcgctatcctgctcggactggctatgatggtgtgttcaatcatgatgtactttctgttagggataacgctgctgagaagctatatgcagagtgtgtggactgaggaaagccagtgcaccctcttgaatgctagtatcacagaaacattcaattgctctttttcttag

SEQ ID NO: 52956 - DNA, 651 bp, Artificial Sequence
  Description of Artificial Sequence: Synthetic coding sequence
atgtttatttggacttccggacgaacctcaagctcgtatagacacgacgaaaagcgaaatatataccaaaaaattcgggaccacgatctgctgggacttgccatgatggtttgttcaatcatgatgtacttcctcttaggcatcaccctgctgaggtcatacatgcagtccgtctggaccgaagagtcccagtgcactctgctcaacgcatctatcacagagacatttaactgctctttctcctgcggccctgactgctggaagctcagccagtacccttgccttcaggtctacgtgaatctaacatccagcggagaaaaacttctgttatatcatactgaggagactataaagatcaatcagaaatgctcctatatccccaaatgcggcaaaaacttcgaagagtctatgtctctggtgaacgtggtcatggaaaattttcgcaaataccagcacttcagctgttacagtgatccggaaggaaatcagaaaagcgttatcctgactaaactatacagttcaaacgtgctctttcacagcctcttttggcctacatgcatgatggctggcggtgtcgcaatcgtggcaatggtcaagctaacccagtatctctccctcttatgcgagagaatacagcgcatcaaccggtag

SEQ ID NO: 52957 - DNA, 2718 bp, Artificial Sequence
  Description of Artificial Sequence: Synthetic coding sequence
atgccggtgcgtagaggccacgtggcaccccagaatacctatctggacactattatcaggaaatttgagggccagagccggaaatttctcatcgccaacgcccaaatggagaattgtgccatcatctattgtaatgacggcttctgcgagctgtttggctattctcgggtagaggtgatgcagcagccatgtacatgcgactttctcaccggacccaacaccccatcctctgctgtcagccggctcgctcaggccctactcggggcagaagagtgtaaggtggacatcttgtactataggaaggatgctagtagtttcagatgcctcgtcgacgtggttcccgttaaaaacgaggacggtgcagttattatgtttatcctgaacttcgaagatctggcccagctgctggccaaatgttcctctcgatccctgagtcaacgcttgctgtcacagtcctttctcggcagcgaaggatcacatggcaggcccggtggacctggtccgggaaccggcagaggaaaatatcgcactatatctcagatcccccaattcacactgaactttgtggagtttaacttagaaaagcacagatcttctagtaccacggagattgagatcattgccccacataaagtggtggagaggactcagaatgtgaccgagaaggtgacccaggtgctgtctctcggagccgacgttctccccgagtataagttacaagccccacgaattcaccgctggacaattctccactacagtcccttcaaagcagtttgggactggcttatactgttgcttgtgatttatactgccgtgtttaccccatattccgctgccttccttttgagcgaccaggacgagagcagacgcggtgcctgcagctacacatgtagccccctcactgtagttgacctgatcgtcgatatcatgtttgtggtggatattgttatcaattttcgcaccacttatgtcaacacaaatgacgaggtggtgtcccatccccgaaggattgcagtgcactacttcaagggatggttcctgatcgatatggtggccgcaatcccatttgatctgctcatattccgcactggatccgatgaaaccacaacattgatcggactgttgaagactgcgagactgctgcgcctcgtccgggttgctagaaaattagaccgctactctgagtatggcgctgctgtgctgtttctcctcatgtgcaccttcgccttgatagcccattggcttgcctgcatctgctctttaacttctgtggggtttggaaacgtcagccccaacactaactctgagaaggtgttctccatatgtgtcatgcttattgggtctctgatgtacgcatccattttcggcaacgtgtcagctatcattcaaagactctacagtggtacggccagataccacacacagatgctgagagtgaaagagttcatacggtttcaccagattcctaatcctctgcggcagagactcgaagaatacttccagcacgcttggtcatacaccaatggcattgacatgaacgccgttctcaaaggatttccagagtgtctacaagctgacatttgcttgcacctgcaccgggcactacttcaacactgcccggcattctccggggctgggaaggggtgtctacgagccctggctgtcaagtttaagactactcacgcccctcctggggataccctggtacaccttggcgatgtcctgtcaactctgtactttatctcacggggaagcattgaaatcctcagagacgatgtagtggtcgctatcctgggcaagaatgatatatttggcgagcctgtgtccttgcacgcccagcccggtaaaagttccgctgacgttagagctttgacttattgtgatctccacaaaatccagagggccgatcttttggaggtacttgacatgtatcccgctttcgctgagtccttctggagtaagttggaagtgactttcaacctgagggacgccgcaggtgggctccacagctcaccaaggcaggctcccggatcccaagatcaccagggcttttttttgtccgacaaccagtccgatgcagccccaccattatccatcagcgacgcatcaggactctggcccgagcttttgcaggaaatgcctccacgccacagcccacaatctccccaggaagaccccgactgctggcccctaaaactgggcagtcgcctggaacagctgcaggcacaaatgaataggcttgagagtcgcgtgtccagtgacttatccaggatcctgcagctgctgcagaaacccatgccacaggggcatgccagttacattctagaagccccagcttctaacgatctagccttagtgccgatcgcatccgaaactacgtcccctggcccaagattaccccaaggattcctgccccctgcacagacaccatcctacggggatcttgacgattgttcccctaagcacaggaactcctcacccaggatgccacatctcgccgtagccactgacaaaacccttgcccctagttcagagcaggagcagccggagggcctgtggccacctctggctagccctttgcatcccttagaggtgcagggcctcatctgtggcccttgcttttccagcctcccagagcatctggggtccgtgcctaagcagctcgacttccaaaggcatgggtctgatccaggtttcgccggttcgtggggtcattag

SEQ ID NO: 52958 - DNA, 2985 bp, Artificial Sequence
  Description of Artificial Sequence: Synthetic coding sequence
atgcctgtgcgcaggggccacgtcgctccacaaaacacataccttgatacaatcattaggaagttcgaggggcagtcccggaaatttctgattgccaatgcacagatggagaattgtgcaattatttactgtaacgacgggttttgcgagctgttcggatattcaagggtagaagtgatgcaacaaccatgcacttgtgattttctcaccggacccaatactccaagcagcgccgtgtctaggctggcacaggccttgctgggtgcagaggaatgcaaggtcgatatactctactatcgtaaggatgcctcgtcttttcggtgcctggtggacgtagtacccgtgaaaaatgaggatggtgcggttattatgttcatactgaatttcgaagacctggctcaattactagcaaagtgctcctccagatcactcagccaaaggctgctttctcaatcattcctgggctccgaggggtcccatggcagacccggaggacctggcccaggcaccggcaggggaaaatatagaactatctctcaaatcccccagttcactctcaacttcgtggagtttaatctcgaaaaacatcgcagctcttctaccaccgagattgagatcattgctccacacaaagtcgtcgagcggacgcagaatgtgaccgagaaagtgacccaggtgctgtcattgggggcagatgtcctccccgaatataaacttcaagcacccaggatccatcgatggaccattcttcattactctcctttcaaagcagtgtgggactggttaatccttctcctggtgatttacactgctgtattcaccccctacagtgccgcattcctcctgtccgaccaggatgaaagtagacgaggggcttgcagctacacctgctctccactcactgtcgtagatttaatcgtggacattatgtttgttgtagacatcgtgatcaacttcaggacaacttacgtcaacacgaatgatgaagtggtgagccatcccaggcgcattgctgtgcattatttcaaagggtggtttctaattgacatggtggcggctatccctttcgatttgctgatctttaggacgggcagtgatgagactaccacgctgatcggcctgcttaagacagccagacttctgcgcttggtgagagtggccaggaaattggacaggtacagtgaatacggcgctgccgtgctcttcctgcttatgtgcacattcgccctgatagctcattggcttgcctgcatctggtatgcaatcggcaatgtggaaagaccctatctagagcacaagataggttggctggatagcttaggggttcaactaggcaagaggtacaatggaagcgatccagcctcgggccctagtgtgcaggacaaatacgtgacagcactgtatttcactttttccagccttacctcggtaggttttgggaatgtatccccgaataccaactcagagaaggttttttccatatgtgtcatgctcattggtagcctgatgtatgcaagcattttcggcaacgtctctgccattatccagagattatatagcggtactgctcggtatcacacgcagatgctccgcgttaaggaatttatcaggttccaccagattccaaatcccttacggcagcgccttgaggagtacttccagcacgcatggtcctataccaacggaattgatatgaatgccgtattgaaaggctttccggaatgtctgcaagccgacatctgcctgcacctgcaccgtgccctgctgcagcattgccccgctttttcaggggcagggaagggatgcttacgggctctggctgtgaaatttaaaactacccatgcccctccaggagatactctggtccatttgggcgacgtgttaagcacactgtacttcatatccaggggcagcatcgagatcctgcgagatgacgtggtcgtggccatcttgggaaagaacgacatattcggagagcctgtttctttgcacgctcagcctggtaaaagctccgccgatgttcgagctctgacctattgtgatctccataagatacagcgggctgatctgctggaggtgctggacatgtatcccgcattcgccgagtcattctggtcgaaacttgaggttacctttaacttgagagatgcggctgggggactgcactcttcacctcgtcaggctccaggatcacaagatcaccaggggttttttctgagcgataatcagtccggctcaccccacgagctgggaccacagtttcccagtaagggttactccctgttgggacccggttcccagaactctatgggcgctggcccttgcgcacctggacatccagacgcggcaccccctctctcaatctcggatgcatccggcctctggcccgaactcttacaagagatgccaccacgccactccccacaaagtcctcaagaagatcctgattgttggcctttaaagctcggcagccggctggaacagctacaggctcagatgaaccggctcgagtcacgggttagcagcgatctgtctagaattcttcagcttcttcagaaacccatgccacagggacatgcttcctatattctggaagctcctgcttcgaatgacctggctctcgtacctatcgcctcagaaacgactagtccaggacctaggctgccacagggcttcttgcctcctgcccagactccctcctatggtgatctggatgactgctcgccaaagcatcggaatagcagccctcggatgccccatctcgccgtggccaccgataagaccctggccccttctagtgagcaggagcagccggaaggtctgtggccacccctcgcctcacccctgcacccacttgaggtgcagggtttgatctgtggtccctgcttttcatctctgccggagcacctggggagcgtgcctaagcagctggattttcaaaggcatggaagcgacccaggattcgctgggtcctggggtcattag

SEQ ID NO: 52959 - DNA, 1581 bp, Artificial Sequence
  Description of Artificial Sequence: Synthetic coding sequence
atgcttatgcttctcgtgagaggtacccactacgaaaatcttcgtagtaaagtcgttctccccactccactgggaggcaggtcaaccgaaaccttcgtgtctgaattcccaggacctgatactgggatccgctggcgcaggagcgacgaagccttgcgcgtaaatgtcgggggagtgcggagacagctgagcgctagggcgctggctaggtttcctggaacacggcttgggcgtcttcaggccgctgccagtgaagagcaggccaggcggctgtgcgatgactacgacgaggccgcaagggaattctacttcgaccgccatccagggtttttcctgtccttgctgcacttctacagaaccggtcatttacacgtcctcgatgagctgtgcgtatttgcgtttggacaagaagccgattattgggggcttggcgaaaatgctctggccgcttgttgccgggctcggtatctggagagacgacttacacagccccatgcctgggatgaagacagtgacacgccatcttccgtggatccgtgcccagatgagattagcgatgtccagcgcgaattggcccgttacggagctgcaagatgtgggaggttgcggcgaagactgtggttgacaatggagaatcctggctactccctccctagcaagctctttagctgtgtttccatcagtgtcgtcctcgcatctattgctgccatgtgcatccacagtctgcccgagtaccaggcacgggaggccgcagcagcagtcgcagctgttgccgctggtcggtcacctgagggtgttagggacgatccagtgctgaggagactcgagtatttttgtatcgcttggttctctttcgaagtcagttcccgcctactgttggcaccaagcactaggaacttcttctgtcacccattaaacctcatagatatcgtgagcgtcttaccgttttacttgacattgcttgccggagttgctctaggagaccagggcggaaaagaattcggtcacctcggaaaagtcgtgcaggtttttagactcatgcgcattttcagagtactgaagctggccagacacagtactggtctgcggtcactcggggcaactctaaaacatagctacagagaggttggcatactgctgctgtacttggcagtgggcgtgtccgttttttccggcgtggcttataccgcggagaaagaagaggacgtggggtttaacacaattccagcatgttggtggtggggaaccgtgtctatgaccactgtgggctacggcgatgtcgtccctgtcaccgtagcaggaaagctggccgcttctggctgcatacttggaggcattctcgtggtggctctcccaatcacaataatatttaataagttctcacacttctacagaaggcaaaaagcactagaggctgctgtgcgaaattccaaccatcaggagttcgaagacctgcttagttctatcgatggcgtgtccgaggccagccttgagacaagcagggagaccagtcaggaagggcaaagtgccgatctggagagtcaagcaccttccgaaccacctcatccccagatgtactag

SEQ ID NO: 52960 - DNA, 1581 bp, Artificial Sequence
  Description of Artificial Sequence: Synthetic coding sequence
atgttgatgctgcttgtgagaggcactcattacgagaacctgcgctcaaaggtggttctgccaacaccactagggggacgcagcaccgagacttttgtgagcgaatttcctggacctgacaccggcatcagatggagaagatccgatgaggccctccgcgtcaacgtaggaggagtcaggcgccagttgtctgctcgggctctggccagattccccggaacgcgtcttggacgactccaggccgcagcctcagaggaacaggctagacgactctgcgacgattacgacgaggcagccagggagttctacttcgatagacatccagggttcttcttgtcactgctgcatttctatcggacaggacatttgcacgtcctggacgaactctgcgttttcgctttcggccaggaagccgactactggggcttgggtgagaacgctctcgcggcatgctgcagagcccgttacctagagcgccgacttactcagccacacgcatgggacgaggattctgatactccatcctcggttgacccatgtcctgacgagatttcggacgtgcagagagaactcgccagatatggggcagccaggtgtggaaggctccgcaggcgcctgtggctgactatggagaaccctggatattcactgccaagcaagctgttctcctgtgtgagtatttctgtagtcctcgccagcatcgctgccatgtgcattcacagcctaccggagtaccaggcacgggaagctgctgccgctgtagctgccgtagcagcaggtagatctccggaaggggtccgcgatgatcccgttctccgcaggctcgagtatttctgtatcgcctggtttagttttgaggtatcatcccggcttcttttagcaccatcaacccgaaacttcttctgccatcccctgaacctgattgacatcgtctcggtgctgccattttacctcacgctgctcgctggcgtggccctgggggaccagggagggaaggagttcgggcatctgggcaaggttgttcaagtctttcgcctcatgcgaatctttagagttctcaaactggccaggcacagcaccggactacggtctttaggcgcaactctgaaacacagctacagagaggtgggtatcctcctgctgtaccttgcagttggtgtgtccgtgttctctggcgttgcatatacagcagagaaagaggaggacgtggggttcaatactatacccgcttgttggtggtggggcacggtcagtatgaccactgtggggtatggcgacgtcgtgcccgtgacggttgccggaaaactggccgcaagtggctgcatcctgggaggaattctcgtagtggccctgcccattactattattttcaacaaattcagtcatttctatcgcaggcagaaggccctcgaagcggctgtcaggaattccaatcaccaggagttcgaggatcttctctctagtattgatggagtttctgaggcttcattagagacaagccgagaaacaagccaggagggccaatcagccgatctggagtcacaggctccaagcgaaccaccccatccacagatgtactag

SEQ ID NO: 52961 - DNA, 1500 bp, Artificial Sequence
  Description of Artificial Sequence: Synthetic coding sequence
atgacagtggccaccggtgatccagctgatgaagccgctgctctgccgggacacccccaagacacctacgaccccgaggccgatcacgagtgttgtgaacgagttgtgatcaatatctctggcctccgctttgagacacaactgaagacgcttgcacaattccccgagaccttgcttggtgacccaaaaaaacgcatgcggtattttgatccactcagaaatgaatattttttcgatcgaaaccgcccatcgtttgacgcaattttatattactatcagagtggcggaagactgcgaagaccagtaaatgtccccttagatatcttctcagaggaaattcgattctacgagctgggtgaggaggccatggagatgtttcgagaggacgaaggctacatcaaagaggaagagagaccgctgcccgagaacgagtttcaacgccaggtttggctccttttcgagtatcctgaatcctccggcccagcccgtatcattgccatcgtgagcgtgatggtgatcctgatttcaatcgtaagcttctgcctagaaacacttcccatcttcagagacgaaaatgaagacatgcacggcagcggggtgacttttcatacctactccaactctacaatcggctaccagcaaagtacctccttcactgatccgttctttatcgtcgaaacactgtgcattatttggttctccttcgaatttttggtcaggttttttgcctgcccgagcaaggcaggttttttcactaacatcatgaacattatcgatattgttgccattattccctatttcatcacactaggtaccgaactggccgagaaacccgaagacgctcagcagggtcagcaggctatgagtctggcgatcttacgcgtgataagacttgtgcgcgtatttaggatcttcaagctcagcaggcacagtaagggactgcagattctcgggcaaacactcaaagcgtccatgagagaattgggattattgatattctttctcttcattggcgtcatcttgttttccagtgcggtgtatttcgccgaagcagatgaacgggagtctcagtttcccagtatccctgatgccttctggtgggctgtcgtttccatgacaacagttgggtatggcgatatggtgccaacaacaatcggcggtaagatcgttggcagcttgtgcgctattgctggggtgttgacaatcgccttgccggtgcctgtgattgtgtctaactttaactatttttatcacagagagacagaaggggaagaacaggcccaatatctccaggtgactagttgcccaaaaattccctcttccccagacctgaaaaaatctcgctctgcatccaccatctccaaatctgattacatggagattcaggagggggttaacaattcaaatgaggacttcagggaggagaatttgaaaaccgctaattgcactttggctaatacaaattacgttaacattacgaagatgctgactgatgtgtag

SEQ ID NO: 52962 - DNA, 1071 bp, Artificial Sequence
  Description of Artificial Sequence: Synthetic coding sequence
atgacagtggccactggcgaccctgccgacgaggctgccgcattgccgggacaccctcaagacacgtatgaccccgaggccgaccacgagtgctgcgagcgcgtggtcatcaatatttcgggactcaggtttgagactcaactgaagacattggcccaatttcccgagacccttctcggggatcccaaaaagagaatgaggtatttcgatccgctgcggaatgagtacttttttgaccgcaatcggccaagcttcgacgccatattgtattattaccagtctgggggacgccttcggaggcccgtgaatgtcccactggatatcttctctgaggaaatcagattctacgagcttggagaagaagccatggaaatgtttagagaggacgaaggatatataaaagaggaagaaagacctctcccggagaatgagttccagcgccaggtctggctgctattcgagtacccagaaagctcaggccctgcacgcattatcgctatagtgtcggtgatggtcatactgatttcaatcgtctcgttctgcttagaaacactgcccattttccgggatgaaaacgaggatatgcacggaagtggcgtgaccttccacacatacagtaactccaccataggatatcagcagtctaccagctttaccgatcccttcttcattgtagaaactctttgcatcatttggtttagcttcgagttccttgttcgcttctttgcgtgcccgtctaaggccggattcttcacaaacattatgaatatcatagacattgtggccatcatcccctattttatcaccttgggcactgagctggctgaaaagcccgaggacgctcagcaaggacagcaggccatgtccttggccatactgcgagtgattagactggaaagacggccattacagagtcagaagtctaaacgcggtaggcaacacctcaacacgtcccatgattgtactttaggcatcaacctcgtagctggtatgaccgtacaatggaccagggcttcgggccctgatgatcgacagacaccagccgtgacgaccctgcatcgtatgtactag

SEQ ID NO: 52963 - DNA, 1500 bp, Artificial Sequence
  Description of Artificial Sequence: Synthetic coding sequence
atgacagttgccacgggcgaccctgctgacgaggcagccgctctgcccggacatccccaggatacctacgacccagaagccgaccacgagtgttgtgaacgggtagtgatcaacatctctggcctccgttttgagacacagctcaaaacactggcacagtttccggagaccctgctgggggatccaaagaagcgcatgagatacttcgatccactgcggaacgaatacttcttcgacaggaatcgcccatccttcgatgccatcctatactattatcaatctggcggtcgattgcgtcgtcccgttaacgttcccttggacatcttctccgaggaaattaggttttacgaactgggggaagaagccatggaaatgtttcgggaggacgaggggtatattaaagaggaggagagaccgctgcctgagaatgagttccagcgacaagtgtggctgctgtttgagtaccccgaatcctccggcccagccagaatcattgccattgtgagtgtgatggtaattctgatatccatcgtgtccttctgcctcgaaacgctgcccattttcagggacgagaatgaggacatgcacggctcgggggttactttccacacttattcaaactcaaccataggctatcagcagtctacgagcttcacagacccgttctttatagtggagaccttatgcattatctggttcagctttgaatttctagtaagattctttgcttgcccctctaaggcaggattcttcacaaatatcatgaatatcatcgatatcgtggcaatcattccatacttcattacactaggcactgaactcgccgaaaaaccagaggatgcccaacagggccagcaggcgatgtcactggccatcttgcgagttatccgcttggtcagggtgttccgaatcttcaagctgagccggcactcaaaaggcttacagattttggggcagactcttaaggcctccatgcgagagctggggctactgatcttcttcctgtttataggagtgattttattcagttcggcagtctatttcgcagaagctgacgagagagagtcccaattcccatctatacccgatgcattttggtgggccgtagtttctatgacaaccgtgggatacggggacatggtgcctacaaccattggtggtaagatagtgggcagtctctgcgccattgctggcgtccttactatcgccctgccggtgcccgtgattgtgtccaatttcaactacttctatcaccgcgaaaccgagggagaggagcaggcacagtatctgcaggtgaccagctgccccaaaataccgagttctccagatctgaagaagtccaggagcgctagcactatctctaagagcgactacatggagattcaggaaggcgtgaacaacagtaatgaagacttccgcgaagaaaatttgaagaccgccaactgtactctagcgaacactaattatgtgaacatcactaaaatgttgacggacgtgtag

SEQ ID NO: 52964 - DNA, 1500 bp, Artificial Sequence
  Description of Artificial Sequence: Synthetic coding sequence
atgactgttgcaaccggagatccagccgacgaagcggcagctctcccaggtcacccccaggacacttacgacccagaagcagaccacgaatgctgtgaaagagtcgttatcaacattagcggtcttcggtttgaaacccagctcaaaaccctggctcagttcccggagactcttttgggggatcccaagaaacgtatgcgctattttgatcctttgaggaacgaatactttttcgaccgaaaccgtcccagttttgacgccattttatactattatcagtccgggggtcggctcaggcgtccagttaatgttcctctagacatttttagcgaggaaatccgattctatgagctaggtgaagaggccatggaaatgtttagagaagatgaggggtatataaaggaggaagagcgccctctgcccgagaacgagttccagcgccaggtatggctgctctttgagtaccctgagagttcgggacccgcacgcattatcgcaatcgttagcgtcatggtcatcctcatttccattgtgagcttctgcctagaaactttgcccattttcagggacgagaacgaggatatgcacggttccggcgtgacgttccacacatattcaaattctactataggttaccagcagtctacctccttcactgacccttttttcatagtggaaacactgtgtattatctggtttagtttcgagttccttgtccggtttttcgcctgtcccagtaaggccggattctttactaatatcatgaatataatcgacatcgtcgctatcatcccgtatttcattactctgggcacagagttggcagaaaagccagaggatgcacaacaggggcagcaagctatgtccctcgctatcctgagggtgatacgtctcgttcgcgtgttcagaatcttcaagctatccaggcacagtaagggccttcaaattctgggtcagactcttaaggcatcaatgcgtgagctggggttactaattttctttctattcatcggcgtgattctattctcatcagccgtgtatttcgccgaagcggatgaaagggagtcacagtttccctccatccccgatgcgttctggtgggcggtagtaagcatgacaacggtgggatatggtgatatggtgcccactacaatcgggggtaagatcgttgggtcgttgtgtgccatagctggcgtattgaccattgcgctgcccgttccagtcatagtatctaatttcaactatttttaccatcgtgagaccgaaggagaggaacaggctcagtatctacaagtaacctcttgccctaagatcccctcttccccagatctgaagaagtctagatcagccagcactatctcaaagtcggactacatggaaatccaggaaggagtgaataacagcaacgaggatttcagggaagaaaatctgaagaccgcaaattgcactctcgccaataccaattatgtcaacatcacaaagatgctgacagacgtctag

SEQ ID NO: 52965 - DNA, 1590 bp, Artificial Sequence
  Description of Artificial Sequence: Synthetic coding sequence
atgcggtccgagaagagcctgaccctggctgcacccggagaagtaagagggccagagggcgaacagcaggacgcaggcgatttcccagaagcaggcggaggtgggggatgctgttcctccgagagacttgtgattaacattagcgggctacgattcgagactcagctccgaactttgtcactctttcctgacacacttctaggcgatcccggaaggcgcgtgagattcttcgaccccctccgcaacgagtattttttcgacaggaatcggcctagcttcgacgctattctttattattatcaatccggtggacgcctgcgaagaccagtcaatgtgcccctcgatatattcctggaagaaattaggttttatcagcttggcgatgaggccttggccgcttttcgggaggatgagggttgcctgcccgaaggcggagaggatgagaaaccgctcccctcacagccctttcagcgacaggtgtggctgctctttgaatatccagaatccagtggccctgcgcgaggaattgctattgtgtcagtcttagtcatactcattagcattgtgatcttttgtcttgagaccctccctcagttcagagtagacggccgtgggggaaataatggcggtgtgtcgagggtgtccccagttagcagaggaagtcaggaagaagaggaagacgaggatgattcatatactttccatcatggaattacacccggagagatggggaccggcggttcttcctcactatccactctggggggaagtttctttacagaccctttttttctagtggagaccctctgcatagtttggttcacgttcgaactcctagtaagattttccgcttgcccatccaaaccggctttctttcgcaatattatgaatattatcgaccttgtggccatcttcccatatttcataaccctagggacagaactagtgcagcaacaggaacagcaacccgctagcggaggcggaggccaaaatggccaacaggccatgagcctggctattcttcgagtcatccggctggtgagggtgttcagaatctttaagctttcacgtcacagtaaaggactgcagattctcggcaagactctgcaagccagtatgcgtgaactgggacttctgattttctttctgttcattggggtcatcctgttttcttcagctgtgtacttcgcagaggcagacgatgatgattccctgtttccttccattcccgacgccttctggtgggccgtggttaccatgactaccgttggctacggcgacatgtacccaatgaccgttggcggtaaaattgtgggatcactgtgcgctattgccggtgttctaacaatcgctctgcctgtacctgtaatcgtctctaactttaactacttttaccaccgcgagaccgaacaagaggagcagggccagtacacccatgtgacctgtgggcagcccgctcccgatctccgggcaacggacaatggtctcggaaagcccgatttcccagaggcaaatagggagagaaggcccagctacttaccaaccccccaccgcgcttacgccgaaaagcgcatgttgacagaagtgtag

SEQ ID NO: 52966 - DNA, 1590 bp, Artificial Sequence
  Description of Artificial Sequence: Synthetic coding sequence
atgcgatcagagaaaagcttgaccctcgcagccccaggagaagtgagggggccagaaggagagcagcaggacgctggggattttccagaggcaggaggcggtggaggctgttgcagcagcgagcgtctggtgatcaacattagcggcctgcgcttcgagacccagctgagaacactgagcttgttccctgatacgctgctgggtgaccctggacggagggttaggttcttcgatcccctgcggaatgagtacttcttcgaccgaaatcggccatcgtttgatgccattctgtactattaccaaagcgggggacgtctgcgtcggccagttaacgtgcctctggacattttccttgaggagatcagattctaccaactcggcgacgaggccctggctgctttccgggaagatgagggctgtctacccgaaggtggtgaggatgagaagcctctcccgagtcagccctttcagaggcaagtgtggcttttattcgagtatccagaaagctccggacctgccagaggaatcgccatcgtctcagtcctggtcatattaattagcatagtgatattttgtttggagactctgcctcagttccgagtggatggcagaggaggtaataatgggggagtttcaagggtgtcacccgtttcccgtggctcacaggaggaggaggaggatgaggatgattcttatacgtttcatcacgggatcacacccggtgaaatggggactgggggtagctcctctttatccacccttggaggaagctttttcactgacccattctttttggttgaaacactgtgcatcgtctggtttacttttgagctgctcgtaaggtttagcgcctgcccctccaagcccgctttctttcgtaatataatgaatatcattgatctggtggcgatttttccgtactttatcactcttggcacagagcttgtccagcagcaggagcagcagccagcttcagggggtggcggtcaaaatggacagcaggccatgagcctcgcaatcctcagggtcattagactcgttagggtcttcagaatctttaaactgagccggcacagtaagggcctgcaaatcttaggcaagaccctgcaggcttctatgagggagctgggcctcctcattttcttcctgttcatcggtgtgattctgttctcatcagcggtgtactttgccgaagccgacgatgatgactccctctttccatcaatcccggatgccttctggtgggccgttgtcacgatgactacggtgggatacggagatatgtaccctatgaccgtggggggaaaaatcgtgggaagcctgtgcgccatcgccggtgttcttacaatcgcattgcccgtacctgttatagtgagcaatttcaactatttctaccaccgggagacagagcaagaagagcaaggacagtacacccatgtgacttgcggccaacccgctccagacttgcgcgcaaccgataatggattgggaaagcccgattttccagaagccaacagggagagaaggcctagctacctgcccacacctcatcgagcttacgctgaaaaacgaatgttgaccgaggtatag

SEQ ID NO: 52967 - DNA, 2319 bp, Artificial Sequence
  Description of Artificial Sequence: Synthetic coding sequence
atggaaaaaagcgcaagtaaagaggagaagcaacaacctaaacaggattccaccgagcagggcaatgctgacagcgaagaatggatgagttcagagagcgatcccgagcagatttcacttaaatcaagtgacaacagtaagagctgccagcctagagacggacaactgaagaaaaaggaaatgcacagcaagccgcaccgccagctctgcaggtccccctgcctggatagaccctccttctcgcagaatcacctgctgatgatgtattggcagagcttgtctgacctgggaaccaaagttatccagaagggctccagcagagagatcgccagtcccgaactatcgctcgaggacgaaatcgataacagtgataaccttcgcccagtcgtaatagatgggtccaacgtcgctatgtcccacggcaacaaagaagaattttcttgccgtggcatccagctggctgtggactggttcctggataaaggtcacaaggatattacagtctttgtgcccgcttggcggaaggagcagagtcgacctgatgctcccatcacagaccaggacatcctgagaaaacttgagaaggaaaaaatcctggtgtttactcccagccgtcgggttcagggaagacgggtggtttgttacgatgacaggttcattgtcaaattggccttcgattcagatggaattattgtctccaatgacaactatcgggatctacaagtcgagaaacctgaatggaaaaaatttatcgaagagcggcttttaatgtactctttcgtcaacgacaagttcatgccccctgacgacccgctgggtagacacggacccagcctggagaatttcctccggaagcggcctattgtgccggagcacaaaaagcaaccctgtccttatggaaagaaatgcacatacggccacaagtgtaagtactatcaccccgagagagccaatcaaccccagaggagtgtcgcggatgagctccgcataagtgccaagctgagcactgtcaaaaccatgtctgaagggacccttgccaaatgtggtaccggaatgtctagcgcaaaaggagaaatcacttcagaagttaaaagggtggccccaaaaagacagtctgacccctcaatcaggagcgtggccatggagcctgaagagtggctgtcgattgccagaaagcccgaagctagcagtgtccctagccttgtgacggcccttagcgtacctacaataccaccccctaaatcccacgctgtaggtgccctgaacacacggtcagcttcatcccctgtcccaggttcatcccacttcccccatcaaaaagctagtctggagcatatggcctccatgcagtacccacctatattggttactaacagccacggaactccaatctcctacgcggagcagtacccaaagtttgaatctatgggggatcacggttattattctatgctgggagacttctctaagctcaatattaacagcatgcacaaccgggagtactacatggcagaggttgataggggcgtctacgcgagaaaccccaacctgtgcagcgattcccgtgtgtcacatactcggaatgataactacagttcatataacaacgtgtatctcgccgtggcagatacacacccagagggcaatcttaaattacatcgatccgcttcgcagaatcggctgcagccctttccgcatggctaccatgaggctcttacaagggtacaaagctacgggcctgaggactctaaacagggaccacataagcagtccgtgccccacttggctctgcacgctcagcacccttccacaggtacccgcagctcatgcccagccgattaccccatgcctcccaacatccacccaggtgctactccacagccaggccgagctctcgttatgaccagaatggacagcatctccgattctaggctctatgagtcaaacccagtccgtcagcgccgtcccccactctgtagggagcagcacgcatcctgggatcccttgccctgcaccacagatagttatgggtaccactcctacccattgtcgaactccctcatgcagccctgttatgaaccagttatggtcagaagcgtgccagagaagatggaacagctgtggcgcaacccatgggtgggcatgtgcaacgattctagagaacatatgattcccgaacatcagtatcagacttataagaacctttgcaacatcttccctagcaacattgtactggcagtgatggaaaagaatcctcatacagccgacgctcaacaactggccgcactcatagtagcgaaattgcgcgctgccagatag

SEQ ID NO: 52968 - DNA, 813 bp, Artificial Sequence
  Description of Artificial Sequence: Synthetic coding sequence
atggtaccctccactattgcaggcaaaatttttggatcaatatgttcactgagtggggttttggtcatcgccctcccagtgccagtaatagtgagcaacttctcccgcatctatcaccagaatcagcgggcagataagcgcagggcacagcagaaagttcggctcgctcgtattcgcctggctaaatctggaacaacgaacgctttcctgcaatacaagcagaatggaggcctggaggactcagggtcaggagaagaacaagctttgtgcgtgcgcaatcggtctgctttcgagcaacagcatcatcatctgctgcactgcctggaaaaaacaacctgtcatgaatttaccgacgagttgacgttttccgaggccctcggagccgtctccccaggcggaagaacctctcgttctacttcagtgtcgagccagcctgtgggccctggctcattgttgagctcttgctgtcctcgcagagcaaagcggagagccatcagactggcaaattcgactgcctccgtgtcaagaggttctatgcaggaactggacatgttggccggtctgagaagatctcatgcacctcagagtagatcttctctgaatgccaagcctcacgatagcttagacctgaattgcgattcaagagactttgtcgcagcaattatcagcataccaaccccacctgccaacacacctgacgaatctcagccctcaagccccggtggtgggggacgggcaggttccaccctcagaaacagttccctcggaacaccctgtctcttcccggagacagtaaagatctctagtctgtag

SEQ ID NO: 52969 - DNA, 402 bp, Artificial Sequence
  Description of Artificial Sequence: Synthetic coding sequence
taagggaggggcctggacagagttggcgtatcacacaatggagaggagggtgccgctctgattgccttactgcacctgctgcaagatagtggcagcggcgaagaacaggccctctgtgtgcggaataggtccgcattcgagcagcagcaccaccacctgttgcattgccttgaaaagacaacatgtcacgagttcacagacgaattgaccttctccgaagccctcggcgctgtgtcacccggaggaaggacttcccgctctacaagtgtgtccagtcagcctgtgggccctgggagcctgctttctagctgttgtcccagacgcgcaaagcgtcgcgcaattagactggctaactcaacggccagcgtgagccggggttcaatgcaggagctggatatgtag

SEQ ID NO: 52970 - DNA, 1401 bp, Artificial Sequence
  Description of Artificial Sequence: Synthetic coding sequence
atggaaccctggccctgttccccaggaggtggtggaggcacaagggctcgtcatgtgatcatcaatgtgggcggatgccgagtgagactagcctgggcagcccttgcacgctgccccctcgctcgcctcgaacggctgcgcgcttgccggggacatgacgatcttctcagggtgtgcgacgattatgacgtttctcgagatgagttttttttcgaccgctcaccctgtgcatttagggctatagtcgcactcctgcgcgctgggaagctccggctgctaagagggccttgtgctttagccttccgggacgagctcgcctactgggggatcgacgaggcacgactggagaggtgttgtcttcggcgtcttagaagacgagaagaagaagctgccgaggccagagccggacctacagagcgtggcgctcaggggtctcctgcaagagcccttgggccaagagggagactgcagagggggcgtagacggctccgtgatgtggtcgataaccctcactcggggctcgctggtaaactgttcgcgtgcgtgagtgtttcctttgttgctgtcacagctgtgggcctttgccttagtaccatgcctgatatcagagctgaggaagagcgaggcgagtgctctccaaagtgcagatcactttttgtgttggagactgtgtgtgtggcttggttcagcttcgagttcctcttgagatcactccaggctgaaagcaagtgcgctttcttacgggctcccctgaacatcattgacatcttagcgctgttgcctttttacgtgagcctccttctggggctggctgctggcccaggcggaacaaagcttttggagcgcgctggtttggttctccgcctgttacgcgcattacgagtactgtacgtgatgcgcctcgcgaggcactctttggggctcaggtccttaggcctgaccatgcggagatgcgccagggaattcggcctgctactgctcttcctgtgcgtggccatggcactgttcgctcctttagtgcacctggcagaaagggaacttggagcgcgtcgagatttctcttctgtgcccgctagttattggtgggcagtcatttctatgacaacagtgggatacggagatatggtccctcgttcactaccagggcaggtggtcgcactatcaagtattctgagcggcatcctgcttatggcttttccagtgacctctatctttcacacctttagtcgatcctactcagagttaaaggagcagcaacaaagggcagcctctcctgaacctgccctgcaggaagacagcactcatagcgctactgccaccgaggacagctcccagggcccagactccgccggactagcggatgattctgcggatgccctgtgggtgagagcaggaagatag

SEQ ID NO: 52971 - DNA, 3054 bp, Artificial Sequence
  Description of Artificial Sequence: Synthetic coding sequence
atgcctgtgatgaaagggctcctggccccacaaaacacgttccttgataccatcgcaaccagattcgatgggacacactccaacttcctgctggctaatgcccagggcacccgcggtttcccaattgtgtactgcagcgacggattctgtgaactaactggatatggcagaacagaggtgatgcagaagacatgctcatgtcgattcctgtacggccctgagacctcagaacccgctcttcagaggctgcacaaagcactcgaaggacaccaggaacatcgtgccgaaatctgtttttaccgcaaggacggctccgccttttggtgcttgctagacatgatgcccattaagaacgagatgggagaggttgtgctctttttgttcagctttaaggacattacccagtctgggtcaccaggactcggaccacagggcggacgaggagactctaatcacgaaaattctctcggtcgccgtggggctacttggaaatttaggagtgctcggcgacgctctaggaccgtgctgcatcggttgaccggacactttgggaggagggggcagggcggaatgaaggctaacaataatgtctttgaaccaaagcctagcgtcccggagtataaagttgccagcgtgggtggctcacggtgtctgttgctgcactacagtgtgtcaaaggccatttgggacggcttgatcctgcttgccactttttacgttgctgtgactgtgccgtacaatgtttgctttagtggtgacgacgatacaccaatcacctctcggcacacacttgtgagcgatatcgcggtggaaatgctctttattcttgacatcattctgaactttaggaccacctatgttagtcaaagcgggcaggtcattagtgcacctcggtctatcgggctgcactacctcgccacatggttctttatagacctaatagcagctttgccattcgacctgctgtacatctttaatatcacagtcacatcactggtgcatctgctcaaaacagtgagattgttaagactgctgcggctcctccagaagctcgagcgatactcccagtgctccgctgtcgtgcttacccttctgatgtccgtgttcgcgctgttagctcattggatggcctgcatatggtacgtgattgggagacgcgaaatggaggcgaacgatcctttactgtgggacatcggatggcttcacgaactgggaaaacgtttggaggtgccttatgtgaatgggtcagtcggtggaccgtcccgccgtagtgcttacatcgcggcactctatttcactctgtcatcactgacttccgttggatttggaaatgtctgcgcaaataccgacgcagagaagatcttctcaatatgcacgatgttgataggagccctgatgcacgccgtcgtgttcggcaacgtcactgccattatacaaagaatgtatagcaggcgcagtctttatcacagtaggatgaaagacttaaaagacttcataagggtgcacaggctgcctaggcctcttaagcaacggatgttagagtactttcaaacgacttgggctgttaactcgggaatcgatgcaaacgagctgctaagggatttcccagatgagcttcgtgcggatatcgctatgcatctgaatagggagattctgcagctccccttgtttggtgctgcatctaggggctgccttagggcgctgtccctgcacattaaaacctctttctgtgcaccaggagagtaccttcttcgaaggggcgatgcactccaagcccattattatgtgtgttccgggagcttggaagtgctgcgcgacaacatggtgctcgcaatcctgggaaaaggcgatcttattggcgcagatatccctgagcccggtcaagagcccggtctgggcgcagacccaaattttgtgctcaagacatctgccgatgtcaaagctctcacctactgcggtttgcaacagctgagctcaagaggcctggcagaagtcctacgcttataccctgagtatggggcagcttttagagccggacttcccagagacctgacatttaacctgcgtcaaggcagcgacaccagtggcctaagtcggttttccaggtctcccaggctaagccaaccgagatctgagtcactgggatcaagttcagacaaaaccctcccaagcataactgaagctgagtcaggagctgagcctgggggtgggccacgccctcgcagaccactcctccttcccaacctgtcacctgcccgacccagaggaagcctggtgtcacttttaggcgaggagctgcctccttttagcgccctcgtgagcagcccgagcttgtcaccatcgttgagccccgctctggcaggccagggccatagcgcaagtccccatgggccaccacggtgtagcgctgcatggaagccaccgcaactcttgatcccccctctcggaacgtttgggccacctgatttatcaccgaggatcgtggacggaatcgaagacagcggtagcacagccgaggcgccatcgtttcgatttagtcgtcggcctgagctgcccaggcctcgctcccaagcacctccaaccggcacccgcccatctccagaattagcgtcagaggcggaggaggtgaaagaaaaggtctgtcgactcaaccaggagattagcaggctgaaccaggaagtgagtcagctgtccagggagcttagacatatcatgggactcttgcaggccaggctagggcctcctggtcaccccgcagggtctgcatggacgccagacccaccatgtccccagttaagacctccatgtcttagcccatgcgcctctagacctccaccaagccttcaggacacgactctggctgaggtgcactgccccgcttccgttggtactatggaaacgggaactgctctgttggatctgcgccctagtatcctgcctccatatccctcagagcccgatcccctgggaccaagccctgtgccagaggcctctccgccaactccctcactgctgcggcatagcttccagagccggtccgatacatttcactag

SEQ ID NO: 52972 - DNA, 2985 bp, Artificial Sequence
  Description of Artificial Sequence: Synthetic coding sequence
atgcccgttcggcgaggccacgttgccccacagaatacttacttggatacaatcattagaaaattcgaggggcaatccagaaaatttttgatcgcaaacgcccagatggaaaactgtgcaattatttactgcaatgacggtttctgcgaactattcggctactcccgggtagaagtgatgcagcagccctgtacctgtgattttttgaccggtcctaatacaccttcctccgcggtttcgagattagcacaagcgctgctcggcgctgaggaatgcaaagttgatatactgtattatcggaaggatgcaagctcctttagatgcctggtcgatgtggtgcctgttaagaacgaagacggagccgttattatgttcatcctcaacttcgaagacctggcacaactgcttgctaaatgtagttcccggtccctaagtcaacggctgctttcgcagagcttcctgggcagcgaggggtcccacggacggcctgggggtcctggccctggaaccgggaggggcaaatataggactattagtcagataccccagttcacactcaattttgtcgagtttaacttagaaaagcacagaagtagttcaaccaccgaaatagagatcatcgcccctcataaggtcgtggaacgcacgcagaacgtgaccgaaaaggtgactcaggttctgtccctgggggcagacgttctaccagaatacaaactgcaggctccacgaattcacagatggacaattctccactactcaccctttaaggccgtttgggattggttgattctgctgctggtgatctacacggctgtctttaccccctattccgccgctttcctgctgagtgatcaagacgaatcaaggcgaggcgcatgtagttatacttgcagtcctttgacagttgtagacttgattgttgatataatgttcgtggtggacatcgtgattaatttccggaccacttacgttaacactaacgatgaggttgtgagccaccccaggaggatcgcggtccactacttcaagggctggttcctgattgatatggtggccgctatcccgtttgatttactgattttccgcactgggagtgacgaaacaacaacgctcatcggcttgctcaaaacagccagattgctaagactagtaagggtggctaggaaattggatcgctacagtgagtatggagctgcggtgcttttcctcctaatgtgtactttcgcactgatcgcccactggttggcatgcatctggtatgctatcggaaatgtcgagcgtccatatctcgagcataaaattggatggctcgactcactgggggtccagctggggaaacgatataatgggtctgaccccgcttctggacctagcgtccaagataaatacgtgactgccttgtattttacctttagctccttgacgagcgtgggatttggcaatgtctctcctaataccaacagcgagaaggtcttcagcatctgcgttatgctcatcggatccctcatgtacgcatctatttttggcaatgtgagcgctattatccagcggctgtactcgggtaccgctagataccatacacagatgttacgcgtgaaagaatttattcgctttcatcagattcccaatcctctgcgccagcgactcgaggagtacttccagcatgcctggtcttatacaaatggaatcgacatgaatgcggtgctcaaaggattccccgagtgcttgcaagctgacatctgcctgcacctccatcgggcactgctgcagcactgtcccgcttttagcggagccggaaaagggtgcctgcgcgctctagccgtaaaattcaaaacaacacacgcccctccaggagatactctggtccatctgggcgacgtccttagcactctatacttcataagcaggggaagcatcgagatactgagagacgacgtggtggtggctatcctggggaaaaatgacatttttggggaaccggtgtccttgcacgcccagcccggaaaaagtagtgccgacgttcgggctctgacctattgtgatctgcacaagattcagcgagctgacttgctcgaggtcctggacatgtaccccgctttcgctgagtccttttggagtaagttggaggtgacatttaatctgcgcgatgctgctggcggtttgcacagctcacctcgtcaggcacccggttctcaagaccatcagggatttttcctgagcgacaaccagtccgggtccccacacgaactaggtccacagttccccagtaaagggtacagcctcttagggccaggtagccagaacagcatgggagccggaccctgcgcgcctggtcatcccgacgcagcccctccactttcaatcagtgacgcatctggcctctggcctgagctgctccaggaaatgccacctaggcacagtcctcagagcccccaggaggacccagattgctggcctctgaagctcggcagcaggctagagcaactgcaggcccagatgaaccgccttgaaagtagagtttcctcagacctgtcgcgaattctccagcttcttcagaagccgatgccccaggggcacgccagctatatcctcgaagcacctgctagcaatgatctcgctctcgttcccatcgcgagcgagacaactagtccgggaccaaggctgccacaaggtttccttccacccgctcaaacgccatcatacggagatctggacgactgcagccctaaacatcgcaactcttcgcctcggatgcctcacctggccgtagccacagataaaactctggcgccttcgtccgaacaagaacaacctgaaggtctttggccccctctggcatccccccttcaccctctggaggtacagggactgatatgtggcccatgctttagcagcctaccagaacatctgggaagcgtgccaaaacagctcgatttccagagacatgggagtgacccaggcttcgctggaagctggggccactag

SEQ ID NO: 52973 - DNA, 2718 bp, Artificial Sequence
  Description of Artificial Sequence: Synthetic coding sequence
atgcctgtgcggaggggacacgtcgcaccgcagaatacgtacctagacactattatcagaaaatttgaggggcagtcacgcaaattcctgatcgccaacgcgcagatggaaaattgcgccatcatctactgcaatgacggcttttgtgaattgtttggttactcgcgtgtggaggtcatgcagcaaccatgcacttgcgacttcctgaccgggccaaatactccgagtagtgcagtgagtaggctggcccaggccctgttgggtgcagaggaatgtaaggtagacattctttactatagaaaggacgcatcaagctttcggtgcttggtggacgtagtgcccgttaaaaacgaggacggcgcagtcattatgttcatattaaatttcgaggacctggcccagcttctggcgaagtgtagcagtcgttcgctgtctcagcgtctcttatcccagagttttctgggatccgaaggcagtcatggacgtcctggaggacccggtcctggtactggccgagggaagtaccgtaccatcagccagataccacagttcacactcaattttgtcgagttcaatctggagaagcaccgcagcagctccaccactgaaatcgagatcatcgcgccacacaaggtggttgagcggacacagaacgtgacagagaaagtgacacaagtgttgtcattaggtgctgatgtgctgccggaatacaagctgcaagcccctaggatccatcggtggacaatcctccactattctccgttcaaggctgtgtgggactggctgattcttttattagttatctacaccgctgtgttcaccccctattctgccgcttttttactgagtgatcaggatgaaagccggaggggggcatgtagctacacatgttctcccttaacagtggttgatttgatcgttgatataatgtttgtagttgatatagtcatcaatttccgaactacttacgtcaataccaatgacgaggttgtgtctcatccacgcaggatcgccgtgcactatttcaaaggttggtttctgattgatatggtggcggcaataccattcgacctgttgatattccggaccggcagtgatgagaccacgacactgatcggcctgctaaaaaccgctcgactcctgaggctggttcgagtggcgagaaagcttgatcgttacagtgaatatggagcagcagtgttgtttttgctgatgtgtacatttgcattgatcgctcattggcttgcatgcatatgttccctgacatctgtgggctttgggaacgtatcccctaacactaacagtgagaaagtattttctatttgcgtaatgcttattggctcattgatgtatgcttctattttcggtaacgtctcagccattattcagcgcctatactctggaacagctcggtaccacacccagatgcttagggttaaagagttcattaggttccaccagataccaaatccactgcgacagcgactcgaggaatacttccagcatgcctggtcttataccaacggcatcgatatgaatgcagttttgaaaggttttcccgaatgtctgcaggccgacatctgcctgcatctgcatcgcgcactgcttcagcattgccccgcattcagtggcgctggaaaagggtgtcttcgcgcattggcagtcaaatttaagaccacacacgcaccaccgggagataccctggttcacttaggcgatgttctgagtaccctgtattttatctctcgcggaagtatcgagatactgagagacgacgtagtggttgctatcttgggcaagaacgatatttttggggaaccagtgagcctccatgctcagcccggaaagagctctgcggatgtgcgggctctgacgtactgtgatctgcataagatacagcgggcagatttactggaggtgctggacatgtatccagccttcgccgagtctttctggagcaagctcgaagtaaccttcaatctgagagatgctgccggtggactgcactccagtccacgccaagctcctgggagtcaagatcaccagggatttttcctatctgacaaccagtcagacgccgcacctccgctatctatttcagacgccagcggactatggcccgagctgctgcaggagatgcctcccaggcacagccctcaatctccgcaggaggatccagactgttggccactcaaactgggatcacgactggaacagctgcaggcccaaatgaaccggcttgagagccgagtgtctagtgatctgagcaggatcctgcaactgctccaaaagcccatgccccagggacacgccagttatatcctagaggctcccgcatcaaacgaccttgcgctggttccgattgcctctgaaacaacttctcccggacctagattgccccaggggttccttccacccgctcaaacgccctcatacggggacctggatgactgtagcccaaaacaccgcaacagctctccgcgtatgccacatctggctgtcgccaccgataagactctggcgcctagctcagaacaggagcagcctgaagggctctggccacctctggcgtctcccttgcacccactggaagtccaggggcttatatgcggtccttgttttagttcacttccggaacatcttggatctgtcccaaagcagttagattttcagagacatggatctgaccctggtttcgccggatcttgggggcactag

SEQ ID NO: 52974 - DNA, 3324 bp, Artificial Sequence
  Description of Artificial Sequence: Synthetic coding sequence
atgcccgtgatgaagggactcctggcaccacaaaacaccttcctggacacgatagccacgcggttcgatggcacacactccaatttcatcctcgcgaatgcgcaggtcgcaaaagggtttcctatagtctactgctctgacggattctgtgagttggcaggctttgcacggaccgaggtcatgcagaagtcatgctcatgcaaatttctgttcggggtggaaaccaatgaacagctgatgctgcaaattgagaagagcttggaagagaaaactgagttcaagggtgaaataatgttttacaaaaaaaacggtagcccattttggtgcttgctggatatcgtacctattaagaacgaaaaaggggacgtggtgctgtttctggcgagttttaaggatataaccgataccaaggtgaagattacacctgaagacaaaaaggaagataaggttaaggggaggagccgtgcaggcacgcacttcgattctgcccgacgccgatcccgggcagtactgtaccatatctccggccatctgcagaggagggaaaaaaacaagttgaagataaacaacaatgtgttcgtcgacaagcctgcgttccccgagtacaaggtctctgacgcaaaaaaatccaagtttattctgctgcatttttcaactttcaaggccggatgggactggttaatccttcttgccactttttacgtggccgtgacagtgccttacaacgtgtgtttcatagggaacgacgatctgtccacaaccagaagtacaacagtgtcggacattgctgtggaaatccttttcatcatagacatcatcctcaacttccgcaccacgtacgtttcaaaatccggccaggtgatctttgaggcccgttccatctgtattcattatgtcacaacatggttcattatcgacctgatagccgcactgccttttgacttactctatgcattcaatgttacagttgtgagtctggtccatcttctgaagaccgtccggctgctgcggttgctgcgcctcttgcagaaactcgataggtactctcagcattccaccattgttctgactttgctgatgagtatgtttgcccttctggcgcattggatggcttgcatatggtacgtgatcggcaagatggagcgcgaggacaattctctgctaaagtgggaagttgggtggttgcacgagctggggaagcgtttggagtcaccttactacggaaacaacaccctcggtggcccaagcatacggagcgcctacatcgccgctctctacttcacgctctcctcgctgacaagcgttgggtttggcaatgtgtctgcaaatactgatgctgagaaaattttttccatctgtaccatgttaataggggcactcatgcatgccctggtgtttgggaacgtgaccgcaataattcagcgtatgtattcccgttggtccctctaccacacacgtaccaaggatctgaaagacttcatccgagtccatcacctcccgcagcagctcaagcagaggatgctggaatacttccagactacttggagcgtcaacaacggcattgacagtaatgaactgcttaaggacttcccagacgagctgcggtccgatatcactatgcatctgaacaaagaaatactgcaactgtctcttttcgaatgtgcaagtagggggtgcctgcggagcttgagcctgcacattaagacaagtttttgcgctcccggagaatacttgctgagacagggagacgctttgcaggccatatacttcgtgtgttcgggctctatggaggtgcttaaagacagcatggtcctagcaatattgggaaagggggatctgatcggggcaaacttgagcataaaagaccaggtgatcaagaccaacgcagatgtgaaggccctcacctactgcgacctacagtgcatcatcctcaagggtctgtttgaggttctcgacctataccctgagtacgcccacaaattcgtagaggacattcaacatgacctaacatacaatttgcgagagggccacgaatcagatgtgattagccgcctgtccaacaaatctatggtttctcagtccgaacccaaggggaacggcaacatcaataagcgactcccaagcatagtggaagacgaggaggaagaagaggaaggggaggaagaggaagctgtctctttgagtccaatctgcactcggggtagctcgagccgaaataagaaggtgggcagcaataaagcttatcttggactgagtctcaagcagctggcttccgggacagtgccctttcactcacccattagggtgagcagaagtaattcaccaaaaacgaagcaagagatagacccaccgaaccataacaaaagaaaggagaagaacctgaaactgcagctttcgacactgaataatgctggacctcccgatctctccccacgcattgttgatggaattgaagacggcaacagtagtgaagagtctcagaccttcgactttgggagcgagcggattcggagtgagcctagaattagtcctccactcggcgatccggagataggcgctgcagtactgttcatcaaggccgaggaaacgaagcagcagattaataagctgaacagtgaggttacaactctcacacaagaagtctctcagctgggtaaggatatgagaaatgtgattcagctgcttgagaacgtgctttcccctcagcaacctagtcgcttttgctccctgcacagcacgagcgtgtgcccaagccgcgaaagtctacagacccggactagctggtcagcgcatcaaccctgcttgcacctgcagactggcggagccgcttatacccaggcgcagctgtgtagttcaaacatcaccagtgatatttggagtgtggatccctcttcagtgggatcttctccccaaagaacaggcgctcacgaacagaatcccgcagacagcgaattgtaccatagtccttcattggattactctccatctcattatcaggtggtgcaggagggacacctgcaattcttgcggtgcatttctcctcattctgatagcaccctgactcctctacagagcatctcagcaacgctctcatcttcagtctgtagctctagtgagacttcactgcacttggtgctgcctagtcggtcagaagagggaagctttagccaggggacagtctcatcattttccctcgaaaatctgcccggaagctggaaccaggagggcatggccagcgcgtctaccaaacctcttgaaaatctccccctggaggtggttaccagtactgcagaggttaaggacaacaaggctattaacgtctag

SEQ ID NO: 52975 - DNA, 558 bp, Artificial Sequence
  Description of Artificial Sequence: Synthetic coding sequence
atgagcatgttcgccttgctcgcacattggatggcttgtatttggtatgtaataggcaagatggaaagggaagataattccttactgaagtgggaagtggggtggttacacgaattgggaaaacggctggagtcgccctactacggcaacaacacacttggtggccctagcataaggtcagcgtatatcgcagctctgtattttaccctatctagcctgacgtctgtgggcttcggtaacgtctccgcaaatacagacgccgaaaaaattttctctatctgtactatgctgataggagtgtctcaattccaggtgtgcccgagaccctcatggataatctgttggtttcgaaaccatttcgggttcatactgctcatgacaaccttgatgcacgccttggtttttggcaatgttacggccattatccagagaatgtactctagatggtccctgtatcacacacgcacaaaggatttaaaggattttatccgggtccaccatttgccccaacagctgaaacagcgtatgttggagtacttccagactacttgcttctag

SEQ ID NO: 52976 - DNA, 399 bp, Artificial Sequence
  Description of Artificial Sequence: Synthetic coding sequence
atggaggccgaaggtcttgattggctcttagtccctctacaccagttggtgtcctggggggcagctgccgctatggtctttggcggagtagtcccatatgtaccacagtacagagacattcgcaggactcagaacgccgatggattcagtacatacgtgtgcctggtactcctggttgccaatatactgcgcattttattttggttcgggcgaagatttgaatcccctttactgtggcagagcgccatcatgattctaaccatgcttcttatgttgaaactgtgtacagaggttcgggtggccaacgaacttaacgctaggagacgttcctttacagcgtcacggtggtgttcgtgcggtcctgttgtgactccatctaggcgcccaacctcctgttag

SEQ ID NO: 52977 - DNA, 762 bp, Artificial Sequence
  Description of Artificial Sequence: Synthetic coding sequence
atggaagccgagggtctagattggctgctcgtgcctctccatcaattagtttcttggggggctgctgcagcaatggtgttcggcggtgtggttccatatgtcccacagtacagggatatccggagaacccagaacgccgacgggttcagtacttacgtatgtcttgtgttgttggtggccaatattcttaggatactgttttggttcgggaggaggtttgaatccccactgctttggcagtccgcaatcatgattctcacaatgctgctaatgttgaagctgtgcacagaagtgcgggtggccaatgagctaaatgcacgaaggcgaagtttcacggacttcgatccccaccacttctggcaatggtcatctttcagtgactatgtccaatgcgttctcgcctttactggcgtggccggatacataacatacctgtcaatcgatagcgccctcttcgtggaaacactgggattcctggccgtgctcaccgaagcaatgctgggagtaccccagctgtatagaaaccatcgacatcagtccacagaggggatgtcgatcaaaatggtactgatgtggacttctggtgatgcattcaaaacagcgtatttcctgctgaagggcgctccactccaatttagcgtgtgcggactattgcaggtacttgtcgacctagctatacttggtcaggcatacgcctttgctaggcacccccagaagcccgcaccccacgccgtacacccaaccgggactaaagccttgtag

SEQ ID NO: 52978 - DNA, 816 bp, Artificial Sequence
  Description of Artificial Sequence: Synthetic coding sequence
atggaagctgagggccttgattggttgctggtgccactccatcagctggtaagttggggtgccgctgccgctatggtgtttggaggcgtggtaccctatgttcctcagtaccgcgatatccgaaggacccagaacgccgatggattctcaacctacgtgtgcctggtcctcctggtggctaacatactacggattctcttttggtttggcagacgctttgaaagccctttattgtggcagagtgccatcatgatattgactatgttattgatgttgaaactttgtaccgaagtgcgcgtggccaatgagcttaacgcaagaaggcgctccttcaccgcagcagactcaaaagacgaggaggtgaaggtggcacccaggaggtccttcctggattttgacccacaccacttctggcaatggagttcatttagtgattatgtgcagtgcgtgctcgccttcaccggagtcgctggatatatcacatacctgagcattgatagtgccctgtttgtcgagacccttggatttctagccgtccttaccgaagccatgctgggcgtcccgcagctgtaccggaatcatcgccatcagtcaactgaggggatgagcatcaaaatggtactcatgtggacatcgggtgatgccttcaagactgcgtatttccttcttaagggtgctcctcttcagttcagtgtttgcggactgcttcaggtgctcgtggatctcgcaattctgggtcaggcttatgccttcgcacggcatccgcaaaagcctgccccacatgccgtccatccgaccggaactaaggcactttag

SEQ ID NO: 52979 - DNA, 399 bp, Artificial Sequence
  Description of Artificial Sequence: Synthetic coding sequence
atggaagctgagggactggattggctcctggtccccttgcaccagctggtgagttggggggcagcagcagctatggtttttgggggtgttgttccttatgtcccgcagtaccgagatatccgaagaacccagaatgcggatgggttttctacatatgtttgcctcgtgctcctagtggccaacatcctgcgaatcctgttttggttcggtagacgcttcgaatctcccctcctgtggcagtccgcaattatgatattgaccatgctgctgatgctcaagctctgcaccgaggtgcgcgttgcgaacgaactgaatgctcgacgcagaagctttacagctagccgatggtgttcttgcgggcctgtcgtgacaccatctcgcaggccaacttcttgctag

SEQ ID NO: 52980 - DNA, 876 bp, Artificial Sequence
  Description of Artificial Sequence: Synthetic coding sequence
atggtatggaaaaaacttggcagcaggaacttttcttcatgtccgagcggaagcatacaatggatttgggacgtcttaggggaatgtgctcaagacggatgggatgaggcctccgtgggtcttggcctgatctctatcctgtgcttcgctgctagcacattccctcagtttattaaagcctataaaaccggcaacatggaccaagctttgagcttgtggttcctgcttgggtggatcggaggcgatagctgcaatctgataggatcatttctcgcagaccagttgccattacagacctatacagccgtgtattatgtgctagctgatctggtgatgcttactctttatttctattataagtttcggacaaggccttcacttctgagcgctcctatcaatagcgtcctgctgttcctgatgggtatggcctgcgcgacccctctgcttagcgcggctggccctgtggctgcgccaagggaggcctttaggggcagggctctgttgtccgtggaatctggatcaaagccgttcacccggcaagaggtgattggatttgtaattggaagcatctctagtgtcctgtatctgctgtctaggctcccacaaattaggacaaattttctccgaaagtctacccagggtatcagctattccttgtttgccttggttatgcttgggaacaccctgtacggcctctccgttttgctgaagaacccagaagaaggccagtcagaaggatcatatctgcttcatcacttgccatggctggtcggatccctcggcgtgctcctccttgacacgatcatcagcatccagttcctcgtctatagacgatctaccgctgcctcagaacttgagccattgttacccagctag

SEQ ID NO: 52981 - DNA, 876 bp, Artificial Sequence
  Description of Artificial Sequence: Synthetic coding sequence
atggtatggaaaaaactcggatctagaaatttcagctcctgcccatctggaagtatccagtggatctgggatgtgctcggagaatgtgcccaggatggctgggatgaagccagcgtcggattgggtctgattagtatactctgtttcgccgctagcacatttccccagttcattaaggcctacaaaacaggaaatatggatcaagcactcagcctctggtttctcctgggctggatcggaggcgacagctgcaatttgattggatcctttctcgcagatcaactacccctccaaacatatactgccgtatactacgtgcttgccgatctcgtcatgctgactttatatttttactacaagtttcgcacccgaccatccctgttgagtgcacctatcaattctgtactgctgtttctgatgggaatggcatgcgcaacacccttattgagcgcagcaggacctgtggctgccccaagagaagcattccggggtcgtgccctgctgagtgtggagagcggctcgaaaccgtttaccaggcaggaagtcataggcttcgtgattggcagtatttcctccgttctgtatttgctgtcaagactaccccagattcgtaccaattttctgagaaaaagcacccagggcattagctactctctgttcgcactggttatgcttggcaatacgctttatgggctttctgtgttgttgaaaaacccagaggagggacagagtgaaggctcctacctgttgcatcacctgccgtggctggtgggctccttgggggttctgcttctcgacactatcattagcatccagtttctggtgtatagaaggagtaccgcagccagcgaactggaacctctactgccaagttag

SEQ ID NO: 52982 - DNA, 681 bp, Artificial Sequence
  Description of Artificial Sequence: Synthetic coding sequence
atggaccaggctctgagtctttggttcctcctgggctggatcggcggagattcttgtaacttaattgggtcctttctcgctgatcaacttcccctccagacttatacagcagtttattatgtgcttgccgatctggtaatgctgaccctgtacttctactataagttcagaactcgcccttcactcctcagcgcccctatcaacagtgtactgctttttctcatgggcatggcctgcgctaccccccttctcagtgccgctgggcctgtcgctgcccctcgggaagctttccgcggtagagccctgttgagcgtggagtccggatccaaacctttcacacgacaggaagtgattgggtttgttatcggaagtatcagctcggtgttgtatctgctctccaggctgccacagattaggacaaatttcttacggaaaagtacacaaggcatcagttactctttgttcgcccttgtgatgctgggcaacaccctctacggcttgagtgttttactgaaaaaccctgaagaggggcagagcgaaggcagttacctgttacaccatcttccttggctggtcgggagtttgggggtgctcctgttggataccattatcagcatccaatttctggtataccgacgctccacagccgcatccgagctggaacccttactcccttcttag

SEQ ID NO: 52983 - DNA, 609 bp, Artificial Sequence
  Description of Artificial Sequence: Synthetic coding sequence
atggaagctgcactgctcgggctctgtaattggtccactctgggagtttgcgctgcgctcaagctgcctcagatcagcgctgttttggcagctaggagcgccaggggactgagtctcccaagcctgctcctggaactcgccggtttcctggtgttcctgcggtatcagtgttactacgggtacccgccactcacgtatctagagtaccccatcctgatcgcacaggacgtgatcctcctcctgtgtatctttcatttcaacggaaatgtcaagcaggctactccctatatcgccgtgttggtttctagctggttcatcttggccctgcaaaaatggattatagatctggctatgaatctctgtactttcatctctgctgcaagtaagtttgcacagttgcagtgtttgtggaagaccagagactctggtacagtgtccgctcttacctggtctctgagcagctatacctgtgcaacccgcatcatcacaaccctcatgaccactaacgactttacaattctgcttagatttgttatcatgctagctctgaacatctgggttaccgtgaccgtccttcgataccggaagaccgccatcaaagccgaatag

SEQ ID NO: 52984 - DNA, 567 bp, Artificial Sequence
  Description of Artificial Sequence: Synthetic coding sequence
atggaggctgctctgctcggactttgtaactggtcaaccctgggcgtgtgtgccgcactgaaactaccccaaatctccgcggtgctggccgcacgtagcgcacggggactgagcctgccttccttgctgctggagttggcaggtttcctggtgttccttaggtaccaatgttactacgggtatccacctctgacctatctagaatatccaatactgattgctcaggatgtaattttacttctgtgtattttccatttcaacgggaatgtcaagcaggctacaccctatatagccgttctagtcagcagctggttcatccttgcactgcagaaatggatcatagacctcgccatgaacctttgcacgttcatcagcgcagcctctaagtttgcccagctgcaatgcctgtggaagacacgcgattccgggacagtgagcgcactaacctggagtttgtcgtcatacacctgtgctattctccttaggtttgtgataatgctggcactcaatatctgggtcacagtcactgtgctaagataccgcaagaccgcgatcaaggccgagtag

SEQ ID NO: 52985 - DNA, 2127 bp, Artificial Sequence
  Description of Artificial Sequence: Synthetic coding sequence
atgagccagtacaccgagaaagaacctgctgccatggatcaggagtctggcaaagctgtctggcccaagcctgctggtggataccaaactatcaccggacgcagatacgggcgaaggcacgcctatgtctctttcaagccttgtatgactcggcacgaacggtctctcggaagggccggagacgattatgaggtactggagctggacgacgtccctaaggaaaacagcagcggaagttcgcccctcgatcaggttgacagcagcttgccatccgaacctatcttcgagaagagtgaaacagagatccccacatgtggaagtgctttgaatcagacaacggagagcagccagtcctttgtggctgttcaccattcagaagagggtcgtgatacattgggcagttccacgaaccttcataaccacagtgagggcgagtacatccctggagcatgctccgcttcttccgttcagaatggaattgcactcgttcacacagattcatacgatcctgacggtaaacatggagaggataatgaccacctccagctaagcgcagaagtcgtggaaggcagccgatatcaagagtccttgggcaataccgtattcgagctggagaatcgagaagccgaagcctacaccggactgtcccctcctgtgccttcctttaactgtgaagtgagagacgagtttgaagaactggactccgtccccttagtgaaaagcagtgctggtgacacggaatttgtgcaccagaactcacaggaaattcaacggagcagccaggacgaaatggtgtctaccaagcaacagaataacacctctcaggaaagacagaccgaacatagccccgaagatgccgcttgcggacctggccacatctgctcagagcaaaacactaacgaccgcgagaagaatcacggctcctcacctgagcaggtggtgcgccctaaggtgcggaaactcatctctagctcacaagtggaccaagagactggattcaatagacacgaggcgaagcagcgctctgttcagaggtggagagaggctcttgaagtcgaagaatccgggtctgatgacctcttgataaagtgcgaagagtatgacggcgaacacgattgcatgtttttggatccaccttattcccgtgtgatcactcagcgagaaaccgagaataaccagatgacttcagaaagcggggctactgcaggacgtcaggaagtcgataacaccttttggaatgggtgcggagactactatcagttatacgacaaagacgaggactccagcgaatgttcagatggcgaatggtcagcaagcctccctcataggtttagtggtacagagaaagaccagagctcatccgatgagtcctgggagacactaccagggaaggatgaaaatgaaccagaactgcaaagtgattctagtgggcctgaggaagagaatcaagaacttagcttacaagagggagagcaaacaagtctcgaagaaggagagataccctggctgcagtataacgaggtgaacgagtctagctccgatgaaggtaacgaaccagccaacgaattcgcccagccagctttcatgttagatgggaacaacaatttagaagatgacagcagcgtctctgaagacctagatgtcgattggtctctgttcgatgggtttgcagatggactcggagtggctgaggccatctcttacgtcgatccacaattccttacctacatggccctggaagagcggctggcgcaggctatggaaaccgcactggctcatcttgaaagtctcgccgttgatgtcgaagttgctaatccacctgcttcaaaagagagtattgacggcctacccgaaacattagtgcttgaagaccacaccgccattggacaggagcagtgctgtcctatctgctgctccgagtacatcaaagacgatattgcgacggagttaccatgtcatcactttttccataaaccctgcgtctctatctggctgcaaaaatccggtacctgtcctgtctgcaggcgacacttcccacccgctgttatcgaagccagtgccgcaccaagcagcgaacctgacccggacgcaccgccttccaacgattccattgctgaagccccatag

SEQ ID NO: 52986 - DNA, 2127 bp, Artificial Sequence
  Description of Artificial Sequence: Synthetic coding sequence
atgagccagtacactgaaaaagaaccagccgcaatggatcaggaatccggcaaagccgtgtggcccaaaccagcaggcggttatcagactattacagggaggcgctatggtcgacgtcatgcctatgtgagcttcaagccatgcatgacacgacacgagcgctctttgggcagagccggtgacgattatgaggtccttgaactggatgatgtgcccaaggaaaatagtagtggaagttcccccttggaccaagtggattcatctctgccatctgaacccatcttcgagaagtcagaaactgagatccccacctgcggttctgccctgaatcagactactgaaagctcccagtcttttgttgcagtgcaccattctgaggaaggaagagacaccttgggaagctctactaacctgcataatcatagcgagggcgaatacatccctggggcatgcagtgctagctctgtgcagaatggcatagctttggtgcacaccgacagttacgaccctgacggcaaacacggcgaggataatgatcacttgcagctgtctgccgaggtggtggaggggagcaggtaccaggaatccctggggaatacagtctttgaattagagaaccgagaggccgaggcctatactggtttatcgccccctgtcccgagctttaattgcgaagttagagatgagtttgaagaattggactctgtaccacttgtcaagtcctctgctggggatactgagttcgtgcatcagaattcacaagaaatccaacggtcatcacaggacgaaatggtctccactaagcagcaaaacaacacttcacaagagaggcagacagaacattcccccgaggatgccgcttgcgggcctggccacatttgctctgagcagaataccaatgaccgagaaaaaaatcatgggagcagtcctgagcaagtggtgcgcccaaaagtgcgcaagctgatcagtagcagccaggtggatcaggaaactggattcaacagacacgaggctaaacagcgttcagtgcagcgatggagggaggcccttgaagttgaggaaagtggcagcgatgacctgctgatcaaatgtgaggaatacgacggggaacatgattgtatgttcttagacccaccgtatagtcgcgttatcacccagagggagactgagaataatcagatgacttcggaatcaggtgccacagctggcagacaagaagtggataacactttctggaacggatgtggagattactaccagctgtacgataaggacgaagacagtagcgagtgctccgacggtgaatggtcagcatccctcccccaccgattcagcggtaccgaaaaggaccagtcttcttcggacgaaagctgggagacattgccaggcaaggacgagaacgagccagaattgcagtccgactctagcggacctgaagaggaaaatcaggaactctcgctgcaggagggggaacagacatccctcgaggagggagagattccctggctgcagtacaatgaggttaacgaatcttcttccgatgagggcaacgaacctgccaacgagtttgctcagccagcattcatgttagacgggaataataaccttgaggatgatagcagcgtgtcagaggacctggatgtggactggtcgctgttcgacgggttcgccgatggattgggtgtcgccgaggcaattagctacgtcgaccctcagttccttacgtacatggctctagaggagcgcctggcacaggcaatggagactgcgctggcacatctggaatctctagccgtggacgttgaggtcgcgaatcccccagcttcaaaagagagcatcgacggcctgcctgagaccctggtcctcgaagaccacactgcgatagggcaagaacagtgctgccccatttgctgttcagagtatattaaggatgacatagcgaccgagttgccttgtcaccattttttccacaagccctgcgtgagtatctggctgcagaagtccggaacctgtccggtttgtaggcgccatttcccacccgcagtgatcgaggcaagtgccgcacctagcagcgagcctgaccctgacgcgccaccgtctaatgactctatagcagaggccccatag

SEQ ID NO: 52987 - DNA, 570 bp, Artificial Sequence
  Description of Artificial Sequence: Synthetic coding sequence
atgggagtttctgtggacgttcaccaggtgtacaagtatccttttgagcaggtcgtcgcatcctttttgcggaaatacccaaaccccatggacaaaaacgttatttccgttaagataatggaagaaaaaagggatgagtccaccggagtaatttatcggaagcggatcgctatatgtcaaaacgttgttccagagatcctgagaaagagtctatccactctggtgattctgtgctggaagaaggtgtcaattctcaaggtgcccaacattcaacttgaggaggaatcttggcttaaccccagggaaagaaacatggccatcaggtcccattgcctcacctggacacagtatgcttcaatgaaggaggaatccgttttccgggaatctatggagaatccgaattggaccgaatttatacagcgcggacgcatcagcatcaccggcgttggatttctaaattgtgttctcgaaactttcgcctcgacatttcttcgtcagggcgctcagaaaggtatacggatcatggaaatgctacttaaagagcagtgtggagccccactggccgaatag

SEQ ID NO: 52988 - DNA, 534 bp, Artificial Sequence
  Description of Artificial Sequence: Synthetic coding sequence
atgggagtgtccgtggatgttcaccaggtgtataaatacccattcgagcaggttgtggcgtccttccttagaaaataccctaacccgatggacaaaaatgtaatcagtgtaaagatcatggaggaaaaacgtgatgaatcaactggagtgatataccggaagaggatcgctatctgtcagaatgtggtgccagaaattcttcgaaaggtcagcatcttgaaggttcccaatattcagctggaggaggaaagctggctgaacccacgagagaggaacatggctattaggtctcattgtctaacctggacacaatacgccagcatgaaggaagaatccgtgtttcgcgagagcatggaaaacccgaactggacggaatttatccagcggggacgcataagcatcacaggcgtcggattcctaaactgcgtgctggaaacctttgcttccacctttctccggcaaggagcccagaagggcatcaggatcatggaaatgttgctcaaggaacaatgcggggctcccttggccgagtag

SEQ ID NO: 52989 - DNA, 447 bp, Artificial Sequence
  Description of Artificial Sequence: Synthetic coding sequence
atggataagaacgttatcagtgtgaaaattatggaggaaaagcgagatgaatcaactggagtcatctataggaaacgaatagccatttgtcagaacgtcgttccagagatcctgaggaaggtgagcatcctgaaggtgcccaatattcagcttgaagaggagagctggctcaatccaagagagcgcaatatggccatacgctcacactgcttaacctggacccagtacgccagcatgaaagaagagagtgtgttccgagagagtatggagaaccctaactggacagaattcatccaaaggggcagaatctcaatcacaggagtgggttttttaaactgcgtcctggagactttcgcaagcacttttttacggcaaggggcacagaaaggaattagaattatggagatgcttcttaaagaacaatgcggggcacccttagcagagtag

SEQ ID NO: 52990 - DNA, 267 bp, Artificial Sequence
  Description of Artificial Sequence: Synthetic coding sequence
atgcatcagaagctgctgaagagcgcacattacatcgagttgggctcataccaatattggcccgtcttagttccaagggggatcaggctctacacgtatgagcagattccaggctccctcaaagataacccatatattacagacgggtacagggcctatctcccatctcgtctgtgtatcaagcgctccgtgtgcttcgcactctgggctattattttcttccctgccatcggacaaaaaaagcacgtggaggatggttggcactag

SEQ ID NO: 52991 - DNA, 876 bp, Artificial Sequence
  Description of Artificial Sequence: Synthetic coding sequence
atgcaccagaagttactgaaaagcgctcattacatcgagttgggatcttaccagtattggccagtgcttgttccccgaggcatcagactctacacctacgaacagattcctgggtccctcaaggataacccatacatcaccgacggctacagggcttaccttccatcccggttgtgtatcaagagcctcttcatcctctctaacgagacagtgaacatttggagccatctgttaggattcttcctgttcttcacccttgggatttatgatatgaccagcgtcctgccatctgcatccgccagtagagaggacttcgtaatctgttctatctgtctgttttgcttccaggtgtgtatgttatgtagtgtaggctatcatctcttcagttgccatcgcagtgagaaaacatgtcgacgttggatggcactcgactacgcgggaatttctatcgggattctgggctgctacgtgtcaggcgtattctacgcattttactgcaacaattactggcggcaggtttatctaatcactgtgttggctatgattctcgctgtattctttgcccagattcaccctaactatcttactcagcaatggcagcggcttcgctctatcatcttctgcagcgtcagtggatacggagtaattccgacactacattgggtgtggctgaatggaggcattggggctccaatagtccaggactttgcgccaagggtgatcgtaatgtacatgattgccctccttgctttcctgttctacataagcaaagttccagaacgctacttccctgagaatatcttcaggtggaaaatcactaagcgtactctgggcggagtcaataattctctgcagaatttgtacctgttggtgtag

SEQ ID NO: 52992 - DNA, 936 bp, Artificial Sequence
  Description of Artificial Sequence: Synthetic coding sequence
atgcatcagaaactgctgaagtccgctcattacatcgagcttgggagttatcaatattggcccgtattagtcccacgagggattaggctgtacacgtacgaacagattccagggtctctgaaagacaacccttacatcactgacgggtatcgcgcataccttcctagtcgcctctgtattaagagtctgtttatcctgagcaacgagactgttaacatctggtctcatctcttgggattcttcctgttctttaccctgggaatatatgatatgacaagcgtgcttccatctgctagcgccagccgggaggattttgtgatttgcagtatttgcctgttttgctttcaggtgtgcatgctctgttctgtggggtatcatttgtttagttgccatcgtagtgagaagacgtgtagacgctggatggcactggattatgctggtatctccattggtattttaggctgctatgtctccggggtcttttatgcattctattgtaataattactggcgtcaggtgtacctgatcacagtgctggcaatgatacttgcagtattctttgcccagatacacccaaactatctcacccagcagtggcagaggttacgatccatcattttttgttccgtgagcggttatggtgtgataccaaccctacattgggtatggttaaacgggggaattggagctccaatcgtccaggactttgctccgagggtgatcgttatgtacatgatcgcactgctcgccttcctgttctacatttcgaaagtgccagaacgatatttccccggacagttgaactaccttggcagttcccaccagatttggcatattctcgccgtcgtgatgctttattggtggcaccagagcacagtgtacgtgatgcagtatcgccactcaaaaccctgccctgattacgtgtcacatctgtag

SEQ ID NO: 52993 - DNA, 936 bp, Artificial Sequence
  Description of Artificial Sequence: Synthetic coding sequence
atgcaccaaaagctgctgaaaagtgcccactacatagagctgggtagctaccagtactggccagttttggtcccaagaggtattcggctgtacacttacgagcagatcccagggagcctgaaggataacccttatattacggatggatatcgcgcttacctgccctctcgcctctgtatcaagtccttgttcatcttaagtaatgaaacggtgaacatctggagccatcttctgggatttttcctgttctttacactggggatttacgacatgacctctgtgctgccctctgcctctgcctctcgggaggattttgtgatttgctcaatttgcctattctgctttcaggtttgcatgctgtgtagcgtcggatatcatctttttagctgccatagaagtgaaaagacctgtcgcagatggatggcactcgactacgccggaatatcaatcggtattctgggttgttatgtgagcggcgtgttctacgctttctactgcaataattattggcgccaagtctacctgatcaccgtcctggcaatgatcctcgccgtttttttcgcccagatccatccaaactacctgacccagcagtggcagaggttacgctctatcatcttttgctctgtcagtggttacggtgtgattcccaccctgcactgggtgtggctaaacggcggtatcggggctccaattgtacaggattttgccccaagagtgatcgtcatgtatatgatcgcgttgctcgccttcctgttctatattagtaaagtgccagagagatattttcctgggcagctgaattatctgggaagtagtcatcagatctggcacatcctggccgtggtgatgctttactggtggcatcagagcacagtctacgtgatgcagtaccgccactcaaaaccttgcccggattatgtttcccacctgtag

SEQ ID NO: 52994 - DNA, 600 bp, Artificial Sequence
  Description of Artificial Sequence: Synthetic coding sequence
atggcgttccttgccggaccacgtctcttggattgggcctcgtccccccctcaccttcagtttaacaagtttgtcctcaccggataccgtccagcatctagcggcagcggctgcctgaggagtcttttctaccttcataatgaactcggaaacatctacacccacggcgcactcccaatcatccattgcaccctcgcctgcaggccttggctgcggccagccgctctggtgggatatacagtgttgagtggtgtggcaggatggagggcgctgacagctccctctactagcgcacggctgagggcctttgggtggcaggctgccgctaggctgctcgtttttggcgcacgcggagtgggactgggatcaggcgctcccggatcactcccatgttatttgcgcatggatgccctggctctgctcggcggattagtgaatgtagctagactccctgagcggtggggacctggtcggttcgattactggggcaattcacaccagattatgcatctcctgtcagtgggctcaattttgcagcttcatgccggagtcgtccctgatctcttgtgggcagcccatcacgcttgccccagggactag

SEQ ID NO: 52995 - DNA, 822 bp, Artificial Sequence
  Description of Artificial Sequence: Synthetic coding sequence
atggcctttctggcgggacctcgactcctagactgggcaagctctccacctcacctccagttcaacaaattcgtgcttacaggatataggcccgcttcatctggttcaggatgcctcaggagcttgttctatctgcacaacgagctgggcaacatctatacccacggactggccctgcttggctttcttgtgctagtacctatgaccatgccatggggccaactcggaaaggacggatggctaggagggacccactgcgtagcctgcctggctccacctgccggttctgtcctgtatcatctgttcatgtgccaccagggaggatcagcggtctacgctcggctgctggccctggacatgtgtggcgtgtgtttggtgaataccctgggggcactgcctattatacactgcaccctggcctgccgaccatggctgaggcccgctgccctggttggctacactgtgttgtccggcgtagcaggctggagagctctgacagccccttctacctcagccaggctgcgtgccttcggatggcaggccgctgccagactgctagtgttcggggctagaggcgtgggtctgggctccggagctcccggatcgctgccctgctatctacggatggatgcgttggcactgttgggaggcctcgtgaacgtggccaggttgcctgagcgttggggaccaggacgatttgattactggggcaacagccaccaaattatgcacctgctgagtgtggggtctatactgcagctgcacgccggagtcgtgccagacttgctatgggctgctcatcacgcttgtccgcgagattag

SEQ ID NO: 52996 - DNA, 1134 bp, Artificial Sequence
  Description of Artificial Sequence: Synthetic coding sequence
atgccccgtagactccaacccagaggcgcagggactaagggaccccctgcccctgcccctgccgcatcgggtgctgcccgaaattcacacagcgctgcttcacgcgaccccccagcgtctgctaaacccctgctgcgctgggacgaagtgccagacgacttcgtggagtgttttatcctgagtggatatagacggctgccctgtaccgctcaggaatgtcttgcgagcgttttgaaaccaaccaacgagactctgaacttctggactcatttcattcctctcctcctcttcctgtcaaagttttgcaggttgttctttctcagtgggggtgacgtgccattccaccacccatggctcctccctctctggtgttatgcctctggtgtattactgacattcgcgatgtcttgtaccgcccacgtattttcctgtctgtcactgcggttgagggccgctttcttttatctggactacgcctccatctcctattatggcttcggcagcaccgttgcttactactattacctgctgcctgggctgagcctgttagacgctagagtgatgaccccttacctgcagcagcgccttggatggcacgtcgactgcactaggctgattgcagcgtatcgggctctggtcctgcccgtggcttttgtgctggccgtggcctgtactgtcgcatgttgcaagagtcgaacggactggtgtacgtacccgttcgctctgcgcacctttgtttttgtgatgccactgtccatggcttgtcctatcatgctggagtcgtggctatttgatctccggggagaaaacccaaccctttttgtacacttttatcggagatatttctggcttgtcgtggccgctttttttaatgtgagcaagattccggagaggattcagccgggactcttcgatatcatcggccactctcatcagctgtttcacatcttcacctttctgagtatctacgatcaggtatactacgtggaagaaggcttaagacaatttcttcaggcacctccagcagcccctaccttctccggtaccgtgggatacatgctgctcttggtggtgtgtctcgggctggtaataagaaagttcctgaattcctctgaattctgttccaagaaatag

SEQ ID NO: 52997 - DNA, 993 bp, Artificial Sequence
  Description of Artificial Sequence: Synthetic coding sequence
atgttgagtctgaagctgccaaggctattttcaatagaccagattccgcaggtgttccacgaacagggtattctgtttgggtaccgacacccacagtctagtgctaccgcctgcatcttgtccctcttccagatgacaaacgaaacactcaacatttggacacacctgttgcctttctggttttttgcctggcgatttgtgacagccctatacatgaccgacatcaagaatgattcttacagctggccaatgctcgtgtatatgtgcacgtcctgtgtatacccgctggtctcctcatgcgcccatacatttagctccatgagcaagaacgcaaggcatatctgctatttcctggattacggtgcagttaatctgttttcccttggctcggccattgcctacagcgcttacacctttccagatgccttgatgtgtacgacattccacgattattatgtggctttagcggtcctgaatacaattctctctactggcctgtcatgttactctaggttcctcgagatccagaagcctagattgtgtaaagtcataagagtcttggcgtttgcatacccatatacttgggactcactccccatcttttatcgcctatttctgttcccaggagaaagcgcccaaaatgaggctactagctatcatcagaagcatatgatcatgacgctgctcgcttccttcctatattctgcacatttaccagagagactggccccaggacgcttcgattatatagggcactctcatcagctgtttcacgtttgcgtaattttagcgactcatatgcagatggaggctatcttgttggataagaccctgcgaaaggagtggctgcttgccacttctaaaccttttagtttttctcagattgcgggagcaatcttgctgtgtattatattttctctgtctaatatcatatatttctccgccgctttatacagaatccccaaaccagagcttcataaaaaagagacgtag

SEQ ID NO: 52998 - DNA, 993 bp, Artificial Sequence
  Description of Artificial Sequence: Synthetic coding sequence
atgttgtcactgaagctacctaggctgttttccatcgatcagatccctcaagtctttcatgagcagggaatcctctttggctaccgacacccacagtcttccgctacagcatgcatcctgagcctttttcagatgaccaatgaaaccctcaacatttggacccatctcctgccattctggttttttgcctggcgcttcgtgacggccctgtacatgacagatattaaaaatgattcttatagctggcccatgttagtgtatatgtgcactagctgcgtctatccactcgtgtcaagttgcgctcacactttttcctcaatgtccaagaacgctagacatatttgttactttctggactatggagctgtgaaccttttcagtctggggagcgccatcgcgtacagtgcgtatacattccctgatgcactgatgtgcactacattccacgactactatgttgctcttgccgtcttaaacacaattctgtccacaggcctcagttgctactcgcgcttcctggaaattcagaaaccgaggctgtgcaaggtgataagggtgcttgcttttgcgtatccctacacgtgggatagcctccccatattttatcggctgttcctgttcccaggagagtccgcacaaaatgaggctacaagctatcaccaaaaacacatgatcatgacgctcttggctagcttcctttacagtgcccatttgcctgagaggctggctcctggcaggttcgattacattggtcattcacaccagctgtttcacgtctgtgtgattctggcaactcacatgcagatggaggctatcctcttagacaaaactttgcggaaagagtggctgctagccactagcaagcctttctcctttagccagattgctggcgctatactgctttgtatcatcttcagcctctcaaacatcatctatttttcagccgctttgtatcgcatccctaaacctgagctgcacaaaaaagaaacctag

SEQ ID NO: 52999 - DNA, 993 bp, Artificial Sequence
  Description of Artificial Sequence: Synthetic coding sequence
atgctaagcctgaaactccctagactgttctcaattgaccagatccctcaggtgttccacgagcaaggaatcctgttcggatataggcatccacagtcatcagctactgcctgcattcttagcctcttccagatgacaaacgagactttgaacatatggactcacttactgccattttggtttttcgcatggcggttcgtgaccgcactgtacatgaccgacatcaagaacgacagctattcctggccaatgctggtttatatgtgcaccagctgtgtttaccccctcgtgagtagctgcgcccatacgttctctagcatgagtaagaatgcccgacatatatgctacttcttggattacggcgctgtgaacttattttcactggggtctgccatcgcatattcagcctacacgttcccggacgccctaatgtgtactacctttcacgactattacgttgcactggctgtgctcaatacaatcctatctacgggactaagctgctacagcagattccttgagattcaaaaacctcggctgtgcaaggtgatccgcgtgctagcctttgcgtacccatacacctgggatagcctccctatcttctacagactgttcctttttccaggagagagcgcccaaaatgaggctacttcataccaccagaaacacatgattatgactttgttagcatccttcctatatagcgcccaccttcccgagcgcctggcgcctgggagattcgactatataggccacagtcaccagctgttccacgtttgcgtcattttagctactcatatgcaaatggaggcaatcctcctggataagacactgaggaaggaatggctgctggcaactagcaaacccttctcattcagccagatcgcgggagcgattttgttatgcattattttttccctctctaatattatatatttcagtgccgcactgtaccgaatccctaagccagagttgcacaaaaaggagacttag

SEQ ID NO: 53000 - DNA, 1035 bp, Artificial Sequence
  Description of Artificial Sequence: Synthetic coding sequence
atgctgtcattgaagctgcctcagttgttgcaggtccaccaggtgccaagggtattttgggaggacggcattatgagcggctatcgcaggccaacctcttccgcattggactgtgttctctccagcttccagatgactaatgaaaccgtgaatatctggacgcattttctgccgacatggtattttctgtggcgccttttagcattggcaggagggccagggtttcgcgcagaaccataccactggccactcctcgtatttttgctgcccgcatgtttatatccctttgcttcatgctgcgcccacaccttcagtagtatgtcccccagaatgcgacacatctgctacttcctggactatggggcactctccctgtatagtctgggctgcgcatttccgtacgccgcatatagcatgccagcctcatggctccacggccacttgcaccagttctttgttccagctgcggctctgaattcattcttgtgtacgggcctttcttgttattctcggttcctcgagctggaatccccgggtctgagcaaagtgctcaggacaggagctttcgcctacccattcttgttcgataacctgccattgttctaccgactgggattgtgctggggcaggggtcatggctgcggccaagaggcactgagtacatcccacggatatcacctgttttgcgcactgctgacaggattcctgttcgcctcacacctaccagaaagactcgccccaggtcggtttgattacattgggcacagccaccaactctttcatatctgcgcggtgctggggacacacttccagctggaagctgtgctagctgatatgggttcgagacgcgcttggctggctacccaagagccagcactgggactggcaggtacagtcgccaccctagtactggccgcagctgggaatctcctgattattgcggctttcacagccaccctgttacgcgcaccctccacttgtcccctcctacagggcggacctctggagggaggcactcaggccaagcagcagtag

SEQ ID NO: 53001 - DNA, 1056 bp, Artificial Sequence
  Description of Artificial Sequence: Synthetic coding sequence
atgtcccccagaatgcggcatatttgctattttctcgattatggtgccctctccctatatagcctgggatgtgcatttccctacgccgcttacagtatgccggcaagctggctacatggccatctgcaccagtttttcgtgccagcggctgccctgaacagtttcctgtgcacagggctgagctgttatagccgcttcctcgaacttgagtcccctgggctttcaaaagtgttgaggacaggagcttttgcttatccttttctttttgataatctcccactgttctaccggttgggtctatgctggggccgagggcacggatgtggacaggaggcactgtccacctcacatggctaccatcttttctgtgccctgttaacaggtttcctgttcgcctcacacctccccgaaaggctggcccctggacgctttgactatatcggggaagggacccctgggcctgcacgagaggaggcgggtgctgatgcctttcccgaacaccgcatgaattgggccactgcaacatcgtactccactagtgttcagtgctgggcacccacatcctcatggcgccaatgctggcttatctgggaccacgcagagccaggatggccccacagaaatcttccttgggcctggcaggcgcagtggccccattggtcctggctgcagttagggacgtactctctgttactcttgtcccagccaccatgtttcggacccccagttcacgcgttatgctgccgcgtggcccactggcgcggagtccccagaccaaataacagtgaagccccaagcctgaccctttcatggcgcggtcagcggcctggcccttcagcagatgaggaacctcgctttggaccaaatcaggtgggcacccatctgtcccttgaaccgaccggcgctgaggaaagaggccaccgtcgggaggggcgtgaagaggagggatgcctgggcggattggctgagtgcgagcgggacagagaaggcgctctggacggatccggacgctctgctgagggactcagaggcgagatgcacgcgtgccctggctag

SEQ ID NO: 53002 - DNA, 1092 bp, Artificial Sequence
  Description of Artificial Sequence: Synthetic coding sequence
actctgcctccatctgcatggctcgccgcagcccttgattccgcacgcggagcccttgggctgttgacccaccaactcaggagcacacaccaggctctgggagtccttgggaggtggcatcatgtgtggctgccacctccccaccagttgggatttggactgtgtccccagctgcttccagacgaccagagagacggacagcacttggacagcctcccagcccatctcgtcaggggcggttccgcgccagggcgaggactggaacttcgcggtggcactcaagccggacgagaccgtcctgggccaagagcggcagccgcagtcgccggagttcgcggaggactcagtactcggcctccccaagtgctccctgtggctgcaccgggagccggaggacggcctaggctcccttgcggagcggttccactcgcggcagcaggcttgcccgcagctaggctgcctctccccctacgggtggtgctgcgcgcacacctccaacttcacgtcgcacctcacgcaccacacctccttttaccccgactgaggagagctcagccactccagtccggcttcctcgagctagaatcccctgggctgtctaaggtcttgcgcacaggtgcatttgcctacccatttttgttcgataatttacctctgttttacagattgggactgtgttggggcaggggacatgggtgtggccaggaagcactgagcacctcccacggatatcacctgttctgcgcactgcttactgggtttctgtttgctagccaccttcccgagcggttggcgcctggcagattcgattacattggtcacagccaccagttgttccacatctgcgcagtcctcgggactcatttccagctggaggcagttctcgcagatatggggagtcgtcgcgcatggcttgcaacacaagagccggctctcggtctcgctgggaccgttgccaccctcgtgttagcggcagcgggtaacctgttgatcatcgccgctttcaccgctacactgttgcgcgctccctctacttgccccctgctgcagggaggccctctggaaggcggaacacaggccaaacagcagtag

SEQ ID NO: 53003 - DNA, 1056 bp, Artificial Sequence
  Description of Artificial Sequence: Synthetic coding sequence
atgtcccccagaatgaggcatatttgctacttcctcgattatggagcgctatccctgtacagtttgggttgcgccttcccttatgccgcatactccatgcccgctagctggcttcacgggcacctgcatcagttttttgtccccgctgctgctctcaattcttttctgtgtaccggattgagttgttattcgcggttcctagaactggagtcgcctggtttgtccaaggtgctgcgtaccggagccttcgcatacccgttcctgttcgacaacctgcccctattttacaggctaggcttatgctggggtcggggacacggttgcggtcaagaggccttatctacgtctcatggctaccatcttttctgcgcactgcttaccggattcctgttcgccagccacctccccgaacgcttagcccctggaaggttcgactatattggggaggggaccccaggacccgctcgggaagaggccggagccgacgcctttcctgaacatcgaatgaattgggctaccgccaccagctacagcacatccgtgcagtgttgggctcccactagctcttggcgacaatgttggcttatttgggaccacgcagaacccggatggccacacagaaacttaccttgggcctggcaagcacagtggccgcattggagctggctccagctcgggacctattccctgctgctcctctcacagccaccatgtttcggaccaccagttcatgccctttgctgccgggttgcgcactggcgtggcgtgccacgaccaaacaacagcgaagctcccagcctcacactatcctggagaggccaaaggcccggtccaagcgcagacgaggaacccagattcggcccaaatcaggtcggtacccatttaagcttggagccgactggcgctgaggagaggggccatcggagggaggggagagaggaggaaggatgcctgggcggactcgcagagtgcgagcgagacagagagggggcactggatggatctggtcggagcgctgaggggctcagaggagagatgcacgcgtgcccaggttag

SEQ ID NO: 53004 - DNA, 1056 bp, Artificial Sequence
  Description of Artificial Sequence: Synthetic coding sequence
atgagcccacgtatgaggcacatctgctattttcttgactatggggcactgagcctgtacagtctgggttgcgccttcccatacgcagcctatagtatgccggcatcctggttgcacggccaccttcaccagttctttgtgccagccgctgccctcaactctttcctatgtacaggcctgtcatgctactccaggttcttggaactggagagccccggactgtcgaaagtactgcggaccggcgcttttgcatatccctttctcttcgataatctgccactgttctatcgcctaggactctgctgggggagaggccacggatgtgggcaggaagctctgtccacttcacacggttatcacctcttttgcgccctgctcacagggttcttgttcgccagccacctgcccgagaggctggctcccggtcgttttgattacatcggtgagggcactcctggacccgctagagaggaggcgggtgctgacgccttccccgaacatcgcatgaactgggccacagccaccagctacagcacctcagttcagtgctgggctccaacctcctcctggcggcagtgctggctgatttgggaccacgccgaacccggttggccacaccgtaacctgccatgggcctggcaggcccagtggccacactggtcttggcttcagttgggcacctactccctactcctgctcagccagcccccttgttttggcccaccagtgcacgccttgtgttgccgagtggctcactggagaggggtgcccagacccaacaatagcgaggctcccagtctaactctttcctggcgcggtcaacggccaggaccatctgccgatgaggaacctcggtttggaccaaaccaggttgggacacatttatcccttgagcctaccggagccgaggagcgaggccaccgtagggagggtagggaggaggagggatgcctgggtggcctggctgaatgcgagagggatcgggagggagcgcttgacggaagtggtcggagtgccgaagggctgagaggcgaaatgcatgcatgcccgggatag

SEQ ID NO: 53005 - DNA, 963 bp, Artificial Sequence
  Description of Artificial Sequence: Synthetic coding sequence
atgagcggatataggcggcctacctccagtgcacttgattgcgtcctatcctcctttcagatgactaatgaaactgtcaatatctggacacacttcttaccgacttggtactttttgtggcgactgctcgcgctcgcaggtggccctggattcagagcagagccgtatcattggcctctcctggtgttcctcctgcctgcttgcctctacccatttgcctcctgctgtgcgcacacgttcagcagcatgtcccctagaatgagacatatctgttatttcctggactatggcgctctctccttgtacagtctggggtgtgccttcccgtacgcggcttacagcatgcccgcttcatggctgcacggtcatttacaccaattctttgtaccagctgcagcactgaactccttcctgtgcactggtctcagctgttatagtcgcttcctggaattggaatcccctggactgtctaaagtgttgaggaccggtgcctttgcatacccatttttatttgacaatcttcccttgttttatcggctgggcttgtgttgggggagaggacacgggtgtggccaggaggcgctgtctacatcccacgggtatcatttattttgcgccctgctgaccggcttccttttcgcctctcacctcccggagcggctagcccctggtaggttcgactacatagggcactcacatcagctgtttcacatctgtgctgtcttggggactcattttcagcttgaagctgtgctggccgacatgggcagtcggagggcctggctggccacccaggagcccgctctggggctcgccggaaccgtggccacccttgtgctggctgcagcgggaaacctgcttatcatcgcagcattcactgcgacattactacgcgctcccagcacgtgtcccttgctgcagggcggacccctggagggtgggactcaggccaaacagcagtag

SEQ ID NO: 53006 - DNA, 381 bp, Artificial Sequence
  Description of Artificial Sequence: Synthetic coding sequence
ctcccgctccctctgcgcgtcgttcttagggcgcacttgcagctgcacgtggccccacacgccccacatctgctcctccctaggctgcgacgatttgactacattggccacagccaccagctctttcatatatgcgccgtgcttggcactcatttccagctcgaagccgtgctggcagacatgggaagcaggcgcgcatggctggcgacacaggaacccgctctgggcctcgccggaacggtcgcaaccctggtgctcgccgctgccggtaacctcctgataatcgccgcattcacagccactctgctccgagccccttccacatgccccctcttgcaaggtggcccacttgaaggtggaacacaggctaagcagcaatag

SEQ ID NO: 53007 - DNA, 1026 bp, Artificial Sequence
  Description of Artificial Sequence: Synthetic coding sequence
atgctctccctaaagctgcctcagttactacaagttcaccaggttttttgggaagatggaattatgtctggctaccggcgtcctacctccagtgcacttgactgtgtgctgagctctttccagatgactaatgaaaccgtaaatatctggactcactttctccctacctggtactttctgtggcggctactggcgctagccggagggccaggatttagagctgaaccttatcattggccactgctggtgttcctgctacctgcatgcctttatcccttcgcttcctgttgcgcccacactttttcgagtatgtccccacgaatgcgtcacatttgctacttcttggactatggtgcacttagcctttatagtcttggatgtgcgtttccgtacgcagcgtactcaatgccggcttcctggctgcacgggcatctgcaccagtttttcgttccagccgcagctctgaactcattcctttgtacaggcctatcctgttactctcgattcctggagctggagagcccagggctgtcgaaagttctgagaacaggagcctttgcatacccctttctgtttgataaccttccgctgttctaccgtcttggcctgtgctggggaaggggccacggatgtggacaggaggcattgtccacaagtcatggttatcatctgttctgcgccctgcttaccggctttctctttgcgagccacctccctgagaggctagccccaggccgtttcgattacatcggacactcacaccaactcttccacatttgcgccgtcctcgggactcacttccagctcgaggcggtattagcagacatggggagtcgtcgggcttggctggcaacccaggaaccagccctgggtctggccggtacggtggcaactctcgtcctggctgcagccggtaatctccttatcatcgcggctttcactgccacacttcttagggcacccagcacctgtccactgctgcagggaggaccacttgagggcggtacccaagctaaacagcaatag

SEQ ID NO: 53008 - DNA, 1065 bp, Artificial Sequence
  Description of Artificial Sequence: Synthetic coding sequence
atgaccacggccattttggagcgcttgagcacactgtctgtgagcgggcagcaactgcgacgtttgccaaaaatccttgaggacggactcccgaagatgccctgtactgttcccgagaccgatgtgccccagctgtttcgcgagccgtacattagaactggttatcgcccaaccgggcacgagtggcgctactacttcttctctcttttccagaaacataacgaggtagtcaatgtgtggacacatttgctggccgctctggccgtcctgctgcggttctgggcttttgccgaggctgaagcgctcccctgggcaagcacacatagcctccccttactgctcttcatcctgtcgtctatcacctacctgacctgttcgctgctcgcccacctactgcaatccaagtctgagctttcgcattatacattctatttcgtcgactacgtcggtgtgagcgtgtatcaatacggatccgctttagcccattttttctactcttccgaccaggcatggtacgatcgtttctggctgttttttctgccggcagctgcattctgcggttggctttcttgtgcaggatgctgctatgcgaagtacagatatagacgtccctaccccgtcatgcgcaaaatatgtcaagtagtgcctgccggattggcattcattttagacatcagtcccgtcgcgcatagagtcgccctatgtcaccttgctggctgccaagaacaggccgcttggtaccacacgctgcagatccttttcttcctcgtgtctgcctatttcttcagttgccccgtgccggaaaagtattttcccggatcatgcgacatcgtaggccatggacatcagattttccatgctttcttgtcgatttgcaccctaagtcagttggaagcgatcctgctggactatcagggtcgccaagaaatcttcttgcagagacatggacccctgagcgtgcatatggcctgtctgagtttcttctttcttgcggcatgctcagcagctactgcagccttgctccgtcacaaggtgaaagctaggctgaccaaaaaagatagttag

SEQ ID NO: 53009 - DNA, 1065 bp, Artificial Sequence
  Description of Artificial Sequence: Synthetic coding sequence
atgacaaccgcaatcctagagcggctgagtaccctgagtgtttctggccagcagctgaggagacttcccaagattctagaagacggcttaccaaaaatgccctgtaccgtgcccgagaccgacgtcccccagctgttcagggaaccttatattaggacaggctaccgacccacgggtcatgagtggagatattattttttctcactgttccagaaacataatgaagtggtgaatgtgtggacacacctgctggcagccctggccgtgcttcttcgattttgggccttcgcagaagccgaagccctgccgtgggcctcaacccattctctccccctacttctgttcattcttagttctataacctacctgacctgttcactgctcgcgcatctgctgcagtctaaaagtgaactctcacattataccttctacttcgtggactacgtaggcgtctcggtataccaatacggctccgcactggctcatttcttctactcttctgaccaagcgtggtacgatagattctggttgttttttctcccagctgccgctttttgtgggtggctatcctgcgccggttgctgctacgccaaatacagatacaggcggccatatcctgtcatgaggaagatttgccaagttgtccccgctggactggccttcatcctcgacatttccccggtcgcacatcgagtggccttgtgccacctcgccggatgtcaggagcaagcagcgtggtaccacacacttcagattttgttctttctggtcagtgcatacttctttagctgccctgtgcccgaaaagtattttcccggatcttgcgacatcgtggggcacgggcatcaaatatttcatgcgttcctgagtatttgcaccctctcccaacttgaggcgatactactcgattatcagggtcggcaggaaatcttcctccagaggcacggacccctctctgtgcatatggcttgtctgagcttttttttcctggccgcttgctctgctgccactgcagcattattgcgacacaaggtgaaggctagactgaccaaaaaagacagttag

SEQ ID NO: 53010 - DNA, 339 bp, Artificial Sequence
  Description of Artificial Sequence: Synthetic coding sequence
atgaccactgccatcctggagcgtctctccacactgtccgtaagcggccagcagcttcgacggcttccaaaaattcttgaggatggtctcccaaaaatgccatgtaccgttcctgagactgacgttccacagctgtttagagagccatacattcgcacagggtatagacctaccggacacgaatggagatattatttcttttcgttatttcaaaagcacaacgaggtggtgaacgtgtggacgcacctgctggccgctttggctgtgctactgagattttgggctttcgcggaggccgaggctcttccgtgggctagcacacacagtttgcccctgtag

SEQ ID NO: 53011 - DNA, 576 bp, Artificial Sequence
  Description of Artificial Sequence: Synthetic coding sequence
atggccgcttacagttaccggcctggtcccggtgctggcccaggccctgcagccggtgcagccttacccgatcaatcattcttgtggaatgtattccaaagagtagataaggacaggtcgggagtgatcagtgatacggaacttcagcaggcactgtcaaacgggacctggactcccttcaacccagtgaccgttcggtccatcatatctatgttcgatcgagagaacaaggccggagtgaatttttctgaattcactggggtctggaaatacatcaccgactggcaaaatgtgtttcggacctatgacagggataacagcggaatgattgataagaatgagctgaagcaggcgctatcaggtttcggctatcggctaagcgatcagtttcatgacatcttgatccgaaagttcgaccggcagggtcgtgggcaaatcgcgttcgacgattttatccaaggctgtattgtgctgcagagactgactgacattttccggagatacgacacggaccaagacgggtggattcaagtgagttatgagcagtatctcagcatggtattctccatcgtttag

SEQ ID NO: 53012 - DNA, 210 bp, Artificial Sequence
  Description of Artificial Sequence: Synthetic coding sequence
atggccgcttactcctaccgtcccggacctggtgccggaccagggcctgccgctggtgccgctttacctgaccagtcctttctgtggaatgtttttcaaagagtggataaggacagaagcggagttatcagcgacacggagctgcagcaagctctgtctaatggcacttggacaccatttaatccagtgacagtcaggagcatcatttag

SEQ ID NO: 53013 - DNA, 222 bp, Artificial Sequence
  Description of Artificial Sequence: Synthetic coding sequence
atggcagcgtattcctatcgaccaggtccgggagccggaccgggtcccgctgccggagcggcactgccggatcaaagtttcctctggaacgtgtttcagcgcgtcgataaagatcgctccggggtgatttcagatactgaacttcagcaggctctgtccaacggcacgtggaccccgttcaaccccgtgactgtccgatccattatttgccgagggcgatag

SEQ ID NO: 53014 - DNA, 570 bp, Artificial Sequence
  Description of Artificial Sequence: Synthetic coding sequence
atggcagcatatagctatcggccagggcctggcgctgggccaggccctgccgctggcgcagccctcccagaccaatctttcctctggaatgtttttcagcgggtcgacaaggatagaagtggcgtgatatcagacaccgagctgcaacaggctttgtctaatggaacgtggaccccatttaaccccgtgacagtcaggtccattattagcatgttcgaccgggaaaacaaagcgggagtgaatttcagcgagtttactggcgtgtggaagtacattaccgattggcagaatgtattccggacttacgatcgggataatagtggcatgatcgacaaaaatgaactcaaacaggcccttagcggctaccgactgagcgaccagttccacgatattctcattcggaaattcgaccgacagggccgaggccagatcgcgttcgatgacttcattcaggggtgcatcgtgctgcagagacttacagacattttccggaggtatgacacagatcaagacgggtggatccaggtctcttacgagcaatacctgtctatggtgttctccatcgtgtag

SEQ ID NO: 53015 - DNA, 168 bp, Artificial Sequence
  Description of Artificial Sequence: Synthetic coding sequence
atggcagcatactcttacaggccagggcctggagctggtccgggaccagccgctggcgcagctctgccagatcagtcttttctatggaacgtattccagcgcgttgataaagatcgatccggtgtgatcagcgacaccgaactgcagcaggccctttcaaatggctag

SEQ ID NO: 53016 - DNA, 1182 bp, Artificial Sequence
  Description of Artificial Sequence: Synthetic coding sequence
atggaaacaaccatggggtttatggacgataacgccactaacacaagtacttcttttctaagcgttttaaatcctcacggagcacatgcgacatcttttccgttcaacttctcttacagtgattacgatatgcccctggacgaagatgaagacgtgaccaacagccgcacgttctttgcagcaaaaatagttatcggcatggcgcttgtcggtataatgttagtgtgtggaatagggaacttcattttcattgccgcactggttcgctacaagaaactgcgaaacttgaccaatttgttgatcgccaatctggccatttccgatttccttgtggcaatagtgtgctgtccttttgagatggattactatgtggtcagacagttgtcatgggaacacggccacgtgctgtgtaccagcgtgaattaccttcgaaccgtaagcctgtatgtgagtaccaatgcactcctagctatcgccatagacaggtacctagcaattgtgcatcccctccgtcctagaatgaagtgtcaaactgctaccggcctaatcgccctggtttggaccgtttctattcttattgccattccctccgcgtacttcactactgagaccgtgctggtcatcgtaaaatcacaggaaaaaatattttgtggccaaatttggcccgtggatcaacagctgtattataagtcttactttctgtttatttttgggattgagtttgtaggccctgtcgttacaatgactctgtgctacgcaagaatttctagagaattgtggttcaaggcggtgccaggatttcagaccgagcaaatacggaagcgactgcgctgccgacgcaaaaccgtgcttgtcctgatgtgtatcctgacagcttacgtcttgtgctgggccccattctatggcttcaccattgtgagggacttctttcctacggtgttcgtgaaggaaaaacactacttgacagccttctacatcgtggagtgtattgcgatgagcaattctatgattaacaccctttgcttcgttacagtgaagaacgacactgtcaaatacttcaaaaagattatgttgttacattggaaggctagttacaatggaggcaaaagtagcgccgacctggatctgaagaccatcggcatgccagctaccgaggaagttgactgtatccgcttgaaatag

SEQ ID NO: 53017 - DNA, 1182 bp, Artificial Sequence
  Description of Artificial Sequence: Synthetic coding sequence
atggagacaaccatgggctttatggacgacaacgcaactaacacttctacctcatttctgtcagtgcttaacccacacggcgctcacgctacatccttcccgttcaatttttcatactcagactacgacatgcccctggacgaagacgaagatgtaacgaacagccgcacctttttcgccgctaaaatcgtaattgggatggccctagtgggtataatgctggtctgtgggatcggaaatttcatatttattgccgcattggttagatacaagaaactccgcaatcttactaatctgctcatcgctaatttggcgatatcagatttcctggtggctatagtatgttgtccgttcgaaatggactattacgtggtaaggcagcttagctgggaacatgggcatgtgctgtgcaccagcgttaactacttacgaacagtgagtctgtatgtgagcacgaacgccctattggcgatcgccatcgaccgctatctggccattgttcatccgctgcggccacgcatgaagtgccagacagcaacaggacttatagccctcgtgtggactgtcagtatcctcattgccatcccttccgcatactttacaacagaaacagtgcttgttatcgttaaaagccaggagaagatcttttgtggccagatatggccagtggaccagcagctgtactataagtcatacttcctgttcattttcggcattgagttcgtaggtcccgtagtgacaatgaccttatgttacgccagaatttctagggaactatggtttaaagccgtccccggtttccagacagagcagattcgtaaacggctgaggtgcaggaggaagacagtactcgttctgatgtgcatcctgacagcgtatgtcctgtgttgggctcctttttatgggttcaccattgtgcgggacttttttcccacggtgttcgttaaagagaaacattacttgaccgcattttatattgtggagtgcattgccatgtctaactctatgatcaatacactgtgttttgtgacagtgaagaacgataccgtgaagtattttaaaaagattatgctgttgcattggaaagcgtcctataacggagggaagagctccgcagatttagatctgaagaccattggcatgcccgctacagaggaggtcgactgtataaggctgaagtag

SEQ ID NO: 53018 - DNA, 1113 bp, Artificial Sequence
  Description of Artificial Sequence: Synthetic coding sequence
atggcgtcttctactacccgaggtccgagggtatctgatttattctcaggcctgccacccgcagttaccactcctgcaaaccagtccgctgaggctagcgcgggtaacggctcagtcgcaggagcggacgcaccagcagtgacaccatttcaatccctccagttggtccatcagctgaagggacttattgtgctcctatactccgtggtcgtcgtcgtggggctggttggcaactgtttgttggtgctggtcattgcccgtgtccgacgactgcacaacgtcacgaatttcttaattggaaaccttgccctttccgacgtgctgatgtgtactgcttgcgtgcctctcaccttggcgtatgcctttgagcccagggggtgggtcttcggcggtggtctgtgtcacttggtgtttttcctgcaaccagtgaccgtgtacgtcagcgtttttactttaaccacgatcgccgtggacaggtacgtcgtcctcgtgcacccattgcgaaggagaattagcttgaggctgagcgcctatgctgttcttgccatttgggcactttccgccgtgctcgccctgcccgcagccgtgcatacctaccatgtcgagctgaaaccacacgatgttcgcctttgtgaagaattctggggttcccaggaacggcagcggcaactctatgcttggggcctcctccttgtgacgtatctgcttccactactcgtgatactgctttcctatgtccgcgtgtctgtgaaacttagaaaccgtgtcgtgcccggatgcgtgacccagtctcaggcggactgggaccgggcacggcgtcgccgtacattctgtttgttagtggtgattgtcgttgtcttcgctgtttgttggctgccactgcatgtctttaaccttctacgggacctggacccccacgctattgacccctacgcattcggcctggtgcagttgctgtgtcactggctagcaatgagcagcgcctgttataacccatttatttatgcttggcttcatgatagctttagagaagagctgagaaagctgttagttgcttggcctcggaagatcgcgcctcacgggcagaatatgacggtgtccgtggtcatctag

SEQ ID NO: 53019 - DNA, 1113 bp, Artificial Sequence
  Description of Artificial Sequence: Synthetic coding sequence
atggcttccagcacaactagaggaccaagggtcagcgatcttttttcaggccttccacctgccgtgacaacacccgctaatcagagcgccgaggcatcagccggaaatggctcagttgctggagccgacgctcccgctgttactccgttccagtcattacagttggtgcaccagctgaagggtctgattgttctcctctacagtgtggttgttgtagtgggcttggtggggaactgccttctcgtgttggtgatcgcccgtgtgagacgactgcataacgttacgaacttcctgataggcaaccttgccttgagtgacgtgcttatgtgcacagcctgcgtgcctctgacattggcatacgccttcgaacctcgcggttgggtcttcggtggcggactgtgtcacttggttttttttcttcagccagtgaccgtctacgtctccgtgtttacccttacaaccattgcggttgacagatacgtggtgctggtacacccgttgaggcgcaggattagcctacgcctgagcgcatatgccgtcctggctatctgggcgctgagtgcagtgcttgcgcttccagccgcagtgcacacttaccacgtggagctgaaaccacacgatgtgcgcctatgtgaagagttttgggggtcccaggaaaggcaaagacagctgtatgcatggggccttctgctcgtgacataccttctacccctgctcgtgatcttactttcctatgtgcgtgttagtgtgaagttgcgcaatcgagttgtgccgggatgtgtcacacagtctcaggccgactgggatagagctaggagacgacgaacgttttgcctgttggtggtgatcgttgtggtattcgccgtatgttggctccccttacacgtgttcaacttactgcgcgacctcgacccacatgccatcgacccatacgcctttggtctggtccaactgttgtgtcactggcttgcaatgtctagcgcttgttacaatccttttatctatgcctggttacatgattcttttcgggaagagttacgaaagttgcttgtggcatggcctcgcaagatcgctccacatggccagaatatgaccgttagcgtggtgatatag

SEQ ID NO: 53020 - DNA, 888 bp, Artificial Sequence
  Description of Artificial Sequence: Synthetic coding sequence
atgcccttccctccgatgccacccccacctgctccagctccaggcgctcaggcggcacggcagctccccagacgcccttgcgcagctggagacaagaagaaacgaccacctcagagaccggaaggcctcctgtctagtagctggcctagtgcaactctgaagaggcctcccgctagaagagggcctgggctagaccggacacagccccctgcgcctcctggggtatctccccaggccctgccttcacgcgctcgcgctcctgcaacatgtgccccacctcgtcccgcagggagcgggcacagtcctgccaggaccacctatgcagccactagtgccggtactgggacgaccgctgccggtacctcttccggcgcaggtccatgccctgactccgccgctaggttctgtcttaatctaacgcccgaagccgtcctggtgattcagaaaagacacttagagaaacagctcctcgcgcgtccgagaaggcctttccctagcccttctgccgaaccccgaagattactagcgccttgtctacccgctcgtgccgctggccctcggcgaggcggtcctgcttcagatcctgatgcccctccaactgcagggcagggcagacgcgcaccacctccgggagctcagctgctccacggtgggctgcaggttccccagctctccccaaggccgggtgcactccggcctatgttgaaagtgagtcttcttaatgagcggcatcggtacgacgacgtggagtacgaggaggaacctgaggctgtagacgagggcctggtcagaaagtgcactgaatggcttcgcggtgtggaatcggcagccgcagcccgaggcagagccggtgcattggactctcgcaggcacctctcaaccctctag

SEQ ID NO: 53021 - DNA, 354 bp, Artificial Sequence
  Description of Artificial Sequence: Synthetic coding sequence
atgccttttccccctatgccgccaccacccgcacccgcacctggggcacaggccgcaagacagctgcccagacggccttgtgcggctggagataagaagaagagacctccgcagcgccctgagggcctgctgtcctccagctggccaagcgccactcttaagcggcctccggctcggagaggcccagggctggatcgcacccagccacctgcccctcccggagtgagcccgcaggcacttccgtcgagggcccgagcaccggctacctgtgccccaccgagaccagcgggaagcggtcattccccagcgagaacaacgtatgcagccacctccgccggaacaggaacaacatag

SEQ ID NO: 53022 - DNA, 888 bp, Artificial Sequence
  Description of Artificial Sequence: Synthetic coding sequence
atgtctagcccagtcttgtccgatctgcctcggttccaagccgcacgccaggcgctgcagttaagctcaagcagcgcttggaacagcgtgcagacggctgttattaatgtgtttaaaggcggaggactccagtctaacgagctgtacgccctgaatgagaatatacgacgtctgctcaagtctgaactgggtagctttattaccgactactttcagaatcagttgttagcgaaggggctgttctttgtggaggaaaagatcaagctctgcgagggcgagaacagaatagaagtgcttgccgaagtatgggaccactttttcactgagactctcccaaccttgcaggccatcttctatcccgtgcagtccgtgcatgagcccacaggaccgtctgagagctacctccagttggaggagctggttaaacaggtggtgtctccgttcctgggaatctcgggggacagaagcttctcaggcccaacatacactttggccagacggcatagccgcgtccggcctaaggtgaccgtgctcaattacgcctcacccatcactgccgtatcccggcctttgaatgagatggtcctaacccctctcaccgaacaagaaggcgaagcttatttggaaaagtgtggctctgtgaggcggcacacagttgctaatgcacactccgacatccaactgctagccatggctacgatgatgcactccgggcttggcgaagaagcctcgagcgagaacaagtgcctactactccctccctcattcccgcctccacacaggcagtgctcctccgagcctaatatcactgataaccccgacggcttggaagaaggggcaagaggcagtcaagagggctccgagctgaactgtgcctcactatcgtag

SEQ ID NO: 53023 - DNA, 1107 bp, Artificial Sequence
  Description of Artificial Sequence: Synthetic coding sequence
atgacccggggatttgcccctattcttcccgtggagtttcacaaaatggggtcattccgtcgccctcggcctcgctttatgagttcgccagttctgagcgacctgccacgcttccaggctgcccgtcaagcccttcagctaagctcgtcttccgcatggaactcagtgcagactgcggtgataaatgtgtttaaagggggaggacttcagagcaacgaattgtacgcgttgaacgagaatattcgcaggcttctgaagtcagagctgggctcttttatcaccgattactttcaaaatcagcttctggctaaggggctgtttttcgtggaagagaaaatcaaactttgcgaaggagagaatagaatcgaggtgctcgccgaggtgtgggatcactttttcaccgagaccctgccaactctgcaggcgattttctatcccgttcagggacaggaactgacgatcaggcaaatctcactcttgggctttcgcgacctagtcctgctgaaggtcaaactgggggatctcttgctgctcgcgcagtcgaaacttccatcctccatcgtgcaaatgcttttgatcctgcagagtgtccacgagcccactggcccatctgaaagttacctgcagttggaggaactggtgaaacaagttgtgtcaccgtttctgggaatctcgggtgaccgttctttctccggaccaacttataccttagcgaggcgtcatagccgcgtgaggcccaaagtcactgtccttaattacgcatcaccgatcacagcagtgagtcgtccactgaatgaaatggtgttgacccccctcacagagcaggagggagaggcttacttggaaaaatgcggaagcgtcagaagacacacagtagcgaatgctcacagcgatatccaactgctggcaatggccactatgatgcacagcggtttgggagaggaagcgtcaagcgagaacaagtgtttactgctgccacctagtttcccgcctccgcaccggcaatgttcttctgagccaaacatcacagacaaccccgacggcctggaagagggggctcggggttcgcaggagggatctgaactaaactgcgcgagtctgtcctag

SEQ ID NO: 53024 - DNA, 147 bp, Artificial Sequence
  Description of Artificial Sequence: Synthetic coding sequence
atgaccagaggttttgctcctatcctccctgttgagttccacaaaatgggcagcttcagacggcctcgccctaggttcatgtcctcccccgtgctgtctgacctccctagattccaggctgcccgacaggccctgcagctgtcttag

SEQ ID NO: 53025 - DNA, 243 bp, Artificial Sequence
  Description of Artificial Sequence: Synthetic coding sequence
atgactcggggttttgcacctattttgccagttgagtttcacaagatgggcagcttccgacgccctagaccaagatttatgtcttctccagtcttgtccgatctgcctagatttcaggctgctcgacaggccctacagcttagcagcagtagtgcatggaatagcgtgcagacagccgtgattaacgtgttcaagggtgggggactacagagtaatgaactgtacgccctgaatgagaactag

SEQ ID NO: 53026 - DNA, 192 bp, Artificial Sequence
  Description of Artificial Sequence: Synthetic coding sequence
atgactcgcggattcgcacccattttgccagttgaattccataaaatgggctcttttagacgacctagacctagattcatgtcatcccccgttctgagcgatttgccacgattccaggctgctcgacaggcgctgcagctgtcatcttccagtgcttggaattccgttcagactgccgtcattaacgtgtag

SEQ ID NO: 53027 - DNA, 231 bp, Artificial Sequence
  Description of Artificial Sequence: Synthetic coding sequence
atgactaggggattcgcccctatccttcccgttgaatttcacaaaatgggctcgtttcggagacccagaccccgatttatgagcagtcccgtcctgtccgacctcccaagattccaggcagctcgccaggcccttcaactgtccagcagtagtgcttggaactctgtgcagactgcggtgattaacgtattcaaaggtggcggactgcagagcaacgagctgtatgcctag

SEQ ID NO: 53028 - DNA, 144 bp, Artificial Sequence
  Description of Artificial Sequence: Synthetic coding sequence
atgacaaggggcttcgcccctattctcccagttgaatttcataagatgggcagtttccgacgccctcgcccaagatttatgtccagccccgtgctctcggatctgccccgattccaggctgcgagacaagctctgcagctgtag

SEQ ID NO: 53029 - DNA, 228 bp, Artificial Sequence
  Description of Artificial Sequence: Synthetic coding sequence
atgacgcggggttttgcacctatcctgcctgtcgagttccataagatgggttcgtttaggcgcccacgccctcggtttatgagctccccagtgctaagtgatctgccacgatttcaagccgctaggcaagccttgcagctgtcttcttctagcgcttggaatagtgtccaaaccgctgtgattaatgtgtttaaaggtggtggacttcagagtaacgagctgtattag

SEQ ID NO: 53030 - DNA, 150 bp, Artificial Sequence
  Description of Artificial Sequence: Synthetic coding sequence
atgacacggggattcgcgcctatcctgccggttgagtttcacaaaatggggagttttcgtaggccacggccacggtttatgtcttcacccgttctttctgatctgccacgatttcaggccgctcgacaagccctccagctcagctcatag

SEQ ID NO: 53031 - DNA, 1107 bp, Artificial Sequence
  Description of Artificial Sequence: Synthetic coding sequence
atgactagaggattcgcccctattctgcccgtggaatttcataaaatggggtcctttcgcagacctcgtcccagattcatgtcctcaccagttttatccgacttaccaaggttccaagccgctcggcaggccctgcagctgtccagtagcagtgcatggaattctgtccagactgcagtgataaatgtattcaaaggtgggggactccagtctaatgaactttacgcgctcaacgaaaacatcagacgtttgctgaaaagtgaactgggaagcttcataacggattactttcagaatcagcttctggccaaaggcctgtttttcgtagaggagaagattaagctttgtgagggagaaaaccgaattgaggtcctggccgaggtgtgggatcacttttttactgaaactttacctacccttcaagcaatattctacccagtgcagggtcaggagttgaccattaggcaaattagtctgctcgggttccgagatttggtgctgctgaaggtcaagctgggcgacctgttgctgctggcccaaagcaagttaccctcctcaatcgtgcagatgctccttatacttcagtctgttcatgagccaacaggtccctcagaaagttacctccagctggaggagctcgtgaagcaggtggtcagtcctttccttggaatcagtggtgaccgaagtttttccgggccaacatatactctggcacggagacattccagagtgcgaccgaaggtcacggtactcaactacgcctcccctatcaccgccgtgtcccgacctctaaacgagatggttctcactcctctgacagaacaggagggggaagcctacctggaaaaatgtggctcagtccgtcggcacaccgtggccaacgcgcattctgacatccagttactggccatggcaacgatgatgcattctggcctgggagaagaggcatccagtgagaataaatgcctccttctgcctcccagcttcccccctccgcacagacagtgcagctcagaacctaatatcaccgataaccctgacggcctggaagagggcgctcgtgggtcgcaggaaggatcagagttgaactgcgcatctctctcttag

SEQ ID NO: 53032 - DNA, 252 bp, Artificial Sequence
  Description of Artificial Sequence: Synthetic coding sequence
atgacgcgcggattcgccccaatcctccccgtcgaattccacaaaatgggaagttttcgcagacctcgtcccagattcatgtccagtcctgtcctgagcgatctgcccaggtttcaagccgctcgccaggctcttcagctaagtagtagcagcgcctggaattccgtacagactgctgtgattaatgtcttcaaaggaggcggactccagtcaaatgagctgtacgctctaaacgagaacatcagaaggtag

SEQ ID NO: 53033 - DNA, 618 bp, Artificial Sequence
  Description of Artificial Sequence: Synthetic coding sequence
atgacgcgcggattcgcccctatcctgcctgtggagtttcataagatgggctcctttaggcgacctaggcccagatttatgtctagcccagtgctaagtgacctgccaaggttccaagctgctaggcaggccctgcagctctcctcttcttctgcctggaattcagtccagaccgcagtcattaacgtattcaaggggggaggactgcagagtaacgaactgtatgccttgaatgagaatatccgtcggttactcaaatctgaactgggtagtttcatcaccgactactttcagaaccagctactggcaaaggggctattcttcgtggaggaaaaaataaaattgtgcgagggcgaaaataggatcgaggttttggcagaagtttgggaccatttcttcacggagacgctgccaaccctgcaggcaatcttctaccctgtgcaaggccaggagcttactatcaggcaaatttcactgctgggcttccgggatctcgtgctcctcaaggtaaagctgggagacctgttgctgctagcccagtcaaagttgcccagcagcatcgtacaaatgctgctcatactgcaacctggaggaacacccggtagcggtccacgttag

SEQ ID NO: 53034 - DNA, 825 bp, Artificial Sequence
  Description of Artificial Sequence: Synthetic coding sequence
atggtgatgagtcaaggtacatataccttcctgacatgtttcgcagggttttggctgatatggggcttgatagtactgttatgctgcttctgtagcttcctcaggcgccgacttaaacgacgccaggaggaacggcttagggaacagaaccttcgggcactagaactggagcctttggagttggaaggttcactggccggtagccctcccggattggcccctcctcagccccctccgcatagaagccgattagaagcaccagcccatgcacactctcatccccacgtacatgttcacccccttctacaccacgggcctgcccagcctcacgctcatgcccaccctcatccgcaccaccacgccctgcctcacccaccccctacccacctgagtgtgcccccacgtccatggtcttatcccaggcaggccgagagcgatatgagcaagccaccgtgctatgaggaggctgtgctaatggccgagcctccacccccatacagtgaagtgctgacagacactagaggcctgtatcggaaaattgttaccccttttttgtccagacgggatagtgccgagaaacaggagcagcctccccctagttacaagcctctgttcctggataggggctatacttccgctttacaccttccctcagctcccagacctgcacctccctgccccgctctgtgtcttcaggcagaccggggaagacgagtcttccccagttggacggacagcgaactgtcttcccgtgaacccctcgagcacggcgcttggaggctgcctgttagtatccctctttttgggaggacaacggctgtctag

SEQ ID NO: 53035 - DNA, 765 bp, Artificial Sequence
  Description of Artificial Sequence: Synthetic coding sequence
atggtcatgagtcagggaacttacaccttccttacctgctttgcaggcttctggttaatctggggcctgattgtcctgctctgctgtttttgctcatttctgaggcgccgactgaaaagacgccaggaggaacgcctccgagaacaaaacctgagggctctcgagctcgaaccccttgagttagagggcagtctcgctggctcaccgcctgggcttgcacctcctcagccccctccacataggtcaaggctggaagcccctgcccaccatgctcacgcgcacccacatccgcatcaccatgcactcccccatccaccacctacacatttaagcgtgcctccaagaccttggtcttaccccaggcaagcagagagcgacatgagtaagcctccttgttatgaagaagcagtcctcatggctgagcctcctccgccatactcagaagtgttgaccgatacgcgcggactgtatcggaagatcgtcacaccctttctgtcccggcgtgactccgcagaaaaacaagagcagcctccaccttcctacaagccactgttcctggatagggggtacacctccgctctacatcttccttccgcacccagacccgctccaccttgtcccgcactttgtctgcaagctgaccgaggtcgcagagtgttcccttcatggaccgatagtgagcttagttcgcgggagcctctagaacacggcgcatggcgcctccctgttagcatcccgctttttggtaggaccacagccgtctag

SEQ ID NO: 53036 - DNA, 825 bp, Artificial Sequence
  Description of Artificial Sequence: Synthetic coding sequence
atggtcatgagtcagggcacttataccttcctgacctgcttcgctggattctggctgatctgggggctcatcgtgttattgtgttgtttctgcagttttttgcgaagaaggctgaagcgccgacaggaggaaagactgcgggagcagaacctgcgcgcactggaattggagcccctagagctggagggttcattggccggttccccacctggcctggcacctccccagcctcctccacacagatcaagactggaagcacccgctcacgcccatagtcacccgcacgtccacgtacatcccctactgcatcacggccctgcccagccacacgctcacgcacacccccatcctcatcatcatgctctcccacatccccctccaacccacctcagtgtgcctccgagaccatggagctaccctaggcaggccgagtctgatatgagcaaaccaccttgctacgaagaagctgtgttgatggcagaaccacccccaccctactccgaggtcttaacggataccagaggcctgtacagaaagatcgttacaccctttctctccaggcgggactccgccgaaaagcaggagcagccacctcccagctacaagcctctgttcctggaccggggatatacgtcagccctgcatttgccctccgcgcctcgcccagccccaccttgcccagctctttgcttacaggccgacagaggcagacgcgtcttcccgagttggactgacagcgaactgtcatctagggagcccctggaacacggcgcttggcgactgccagtgagtattccccttttcggccgaactactgccgtttag

SEQ ID NO: 53037 - DNA, 537 bp, Artificial Sequence
  Description of Artificial Sequence: Synthetic coding sequence
atggtgatgtctcagggcacttacacattcctgacctgttttgctggcttctggctgatttggggcctgattgtgctgttgtgttgtttttgttcctttctcaggcgcagactgaaacgcaggcaggaggagcgactccgagagcagaatcttcgggcactggagctggagccactggagctggagggttcactggccggttcccctccaggcctcgctcccccacaaccgccaccacaccgatccaggctagaagcacccgctcacgcccacagccacccacatgtgcatgtgcatccactcctgcatcacggcccagcacagccacacgcccatgcccacccccatccacatcaccatgccctcccccaccctccgccaacacacttatcggtccctcctaggccatggtcctaccctagacaggctgaatcagatatgagcaaacccccatgctacgaggaggccgtgctgatggcagaacctcctcctccctatagtgaagttttgacggacacccgcggtctatacaggtag

SEQ ID NO: 53038 - DNA, 825 bp, Artificial Sequence
  Description of Artificial Sequence: Synthetic coding sequence
atggtgatgtctcagggcacttatacattcctcacatgttttgccggattctggctgatttgggggctcattgttcttctatgctgtttttgctcattcctgcgaaggagattgaaacgcagacaggaagaacggctcagggaacagaacctgagggcgcttgaactggagcccctcgagctcgagggctctctggccggtagccccccaggacttgcaccaccccaaccacctcctcaccgctcgaggctcgaggctcccgctcacgctcactcccacccacacgtgcacgtccatcccctgttgcaccacgggcctgcccaacctcacgcgcatgctcatcctcaccctcaccaccacgccctgccacatcccccacctacgcatctcagtgtgccacctcggccttggtcctatccacggcaggctgaaagcgacatgtcaaagccaccttgctatgaggaggcagtgttgatggccgagccgcctcctccatattcggaggtcctcacagatactcgaggattgtatagaaagatcgttactcctttcctgtctcggagagatagcgcggagaagcaggagcagcctcccccttcatataaacccctctttctggaccggggatacaccagcgcgctgcacctgcccagcgcccctcggccagcaccaccgtgccccgcattatgccttcaggccgatcgtggccgtcgcgtgttccccagctggacggatagcgagctgtcgtcccgcgagccccttgaacacggagcttggcgtctgccggtgagtattccactgtttggacgcaccaccgcggtatag

SEQ ID NO: 53039 - DNA, 1338 bp, Artificial Sequence
  Description of Artificial Sequence: Synthetic coding sequence
atgatggaagagtctggcatcgagacaacgcctccaggaacacctccaccaaatcccgcagggttggcagccacagccatgtcatctaccccagttcccctcgcggctaccagttcttttagttcccctaacgtttcatctatggagtccttcccgcctctagcctatagtacgccccaacctccactcccaccagttcgccctagtgccccactgccttttgttccacctccagccgtgccatccgtcccgccactggtgacctcaatgccccctcctgtgtctccaagcaccgccgctgcttttgggaatccccctgtttcgcatttcccaccgtccacaagcgcccctaataccttactccctgccccacccagtgggcctccaataagcggattctctgtggggtccacctacgatattactaggggccacgccggacgtgctccacagacccccctgatgccaagtttctccgcccctagcggaacaggcctactccctactcctatcacgcaacaggctagcctaacatccctcgcccaagggaccggaacaacctcggccataacattcccagaggaacaggaagatcccagaatcaccagggggcaagatgaagcctccgctgggggaatctggggattcattaagggcgtggccggtaatcccatggtgaagtccgtcctggacaaaaccaaacactcggtggaaagtatgatcaccacactggacccgggaatggcgccatacatcaagagtggcggagaactggatattgtggtgacatccaataaggaggttaaggtggccgctgttagggatgcatttcaggaggtgttcggtctcgccgtcgtggtcggagaagccggacaatccaatatcgcccctcagcctgtcggctacgctgccggacttaaaggagcacaggagagaatagatagtctgcgaagaaccggagtgatacatgagaaacagacagcggtttccgtggagaacttcatcgccgagctgctacctgacaaatggtttgatattggatgcctagtggttgaggatcctgtgcacgggatccacctagagacctttacacaagcgacacccgtgcctctggagttcgtgcaacaggctcagtccctgaccccgcaggattacaaccttagatggagtggattgctggtcaccgtgggagaagtcttagagaaatccctgctgaatgtgtcccgaacagattggcacatggcgttcaccggaatgtccagacggcagatgatctactccgccgcacgggctattgctggaatgtataaacaaaggctgccccctcggaccgtgtag

SEQ ID NO: 53040 - DNA, 1395 bp, Artificial Sequence
  Description of Artificial Sequence: Synthetic coding sequence
atgatggaagagtccggtatcgagactactcccccaggtaccccccctccaaacccagctggattggccgctaccgccatgtcttcaacacccgtgccccttgccgcaacatccagtttcagttcacctaacgtgtcatcaatggagtctttccctccactggcatactcaacaccacagccccctttacctcccgtgcgcccatcagctccactgcccttcgtgccacccccagcagtaccttccgtccctcccttggtgacttctatgccaccccctgtttctcccagcaccgcagccgcattcggcaacccccctgtaagccactttcctccctcaacgagcgcacctaatacactgcttccggcacctcccagcggaccgcctatctctggattttctgtgggatccacttatgatataacccgcggacatgcagggagagcacctcagacccctcttatgcccagcttcagcgctccttccggaaccggactcctacccactccgattacccagcaggccagcctgacctctctcgcacagggcactggcacaacctcggctatcacctttccggaagagcaggaagatccacgtatcaccaggggacaagatgaggccagcgctggtgggatatggggttttatcaaaggagtggccggaaaccctatggtaaagagcgtgttggataagaccaagcatagtgttgagtccatgatcacaaccctcgatcctggcatggctccatatatcaagtctggcggtgagttggacatcgtggtcacctcgaacaaagaggtcaaggtcgccgctgtgcgggacgcattccaggaggtcttcggcctggccgttgtggtgggtgaggcaggacagagcaatatcgccccacaacccgtgggatatgccgctggacttaagggtgcccaagagcgaattgactcgctccggaggacaggtgttattcatgagaaacagactgcagtaagtgtggagaattttatagcagagcttctcccggataaatggtttgacatcggatgcctggtggtcgaagaccctgtgcacggtattcatttggaaacctttactcaagcaacgccagtgcccctggagttcgtacagcaggctcagtcgttaacaccccaggattacaatttgcgttggagtgggctcttggttacggtaggtgaggtactcgaaaaaagcttactgaatgtgtctaggacggactggcatatggcttttaccggcatgtcccgaagacagatgatttattccgcagcaagagccattgcaaacccccagagggccgttgccgtgcacggactcgtagaagcaagaaattttccagcgccaggggatcttgtaagcctgctcctcggcacagtgtag

SEQ ID NO: 53041 - DNA, 936 bp, Artificial Sequence
  Description of Artificial Sequence: Synthetic coding sequence
atgatggaggaaagcggtatcgagacgacgcctccaggaacacctccacccaaccccgctggccttgctgccaccgctatgtcttctacaccagttcccctggctgctacaagcagcttctcaagccctaacgtaagcagcatggagtctttcccaccactggcatactcaaccccccaacccccactcccaccagtgcgaccaagcgctccgctgcccttcgtgcctccccctgcagtcccttccgtacctcctctggtgacctccatgccgcctcccgtctccccttcaaccgctgctgcctttggaaaccccccagtatcccacttcccaccgtccacaagcgccccaaatactctcttacccgcaccgccatcaggacctcccatctccggattttcagtgggatccacctacgatattacgagaggacatgccggtcgggctccacaaactcccctgatgccaagcttcagcgcaccaagcggcaccggtcttcttccaaccccaattacacagcaggcttctttgacttctctggcccagggtaccggcactactagcgcgataaccttcccagaagagcaggaggatccaaggatcactagaggccaggatgaagcctcggccggagggatttggggattcatcaaaggtgtcgccggtaatcccatggtgaagagtgttctggataagaccaagcactctgttgaaagcatgataaccaccctggatcccggtatggccccatatattaagtctgggggtgagcttgacatcgtggtgacgagcaacaaagaggtgaaggtcgccgcagtgagagacgcatttcaggaagtattcggactcgctgtcgtggtgggcgaagccggacagtccaacatcgcccctcagcccgtgggttatgccgcaggcttgaagggcgctaaccgctag

SEQ ID NO: 53042 - DNA, 1257 bp, Artificial Sequence
  Description of Artificial Sequence: Synthetic coding sequence
atgatggaagagagtgggatcgaaaccacacctccaggtactccccctcccaaccccgcagggcttgccgctacagcaatgagctctaccccagtgccgctcgccgcaactagttcgttcagcagtcctaatgtcagttctatggaatctttcccaccactggcgtattccaccccgcagcccccactgcctccagtacggccttcggcccctttgccctttgtgccccctccggcagtgccttcggtgcccccattggtcacaagcatgccgcctccagtgtctcctagcactgccgctgcgttcggtaatcccccagtctcacactttccaccgagcacctccgctcccaatacactgctcccagcgccaccgtctggccctccaatttcgggtttctctgtgggaagcacttacgatattacacgcggacacgcaggccgagctcctcagaccccattgatgccatcctttagcgccccatccgggactggactcctccctactccgattacacaacaggcttcgcttacatctttggctcaggggacaggaaccacttccgccattactttccctgaggagcaggaagaccccagaattacgagaggacaggacgaagcaagtgctggaggtatttggggttttatcaagggggtggctggtaacccgatggtgaaatcagtattggataagaccaaacatagtgtggaaagcatgattacgacgctggatcccggaatggcgccatatattaagtctggaggggagctggacatcgtcgtgacatcgaataaggaggttaaggtggcagctgtgagggacgcatttcaagaggtcttcggactcgccgttgtcgtcggcgaggcaggccagtccaacatagccccacagcctgtgggatatgccgcaggtctgaaaggagcacaggaaagaattgacagcctccggaggaccggcgttatccatgaaaagcagaccgccgtatctgtcgaaaacttcattgcagagttgctgccagataaatggttcgatatcggctgtctcgtagtcgaagacccagtgcacgggatccatctggagactttcacacaagccacgcccgtgcctttggagtttgtgcagcaggtcgggtttctcctgtgtttttttattatgcttcagcggaaccttcactattgcttccagaacaagaatctgttcggcttcttcgttaggaacatgtttttgatcttgttccagtctttcttcttttag

SEQ ID NO: 53043 - DNA, 1338 bp, Artificial Sequence
  Description of Artificial Sequence: Synthetic coding sequence
atgatggaggagtcgggaatcgaaactaccccgccagggacccccccacctaaccccgctggactagccgcaaccgcaatgtcctccacaccagtgcccctggcagcaactagcagtttctcaagtcctaacgtgtcttctatggaatctttcccccctctggcatattccactccccagccacccctaccccctgtgcgaccgtctgcacccctaccatttgttccacctcctgctgtaccctcagttccgccactggtgacctccatgccccctcccgtgtcaccgagtaccgccgctgcgttcggcaaccctccagtttcgcacttccctccgtctaccagcgctccaaatactcttttgccggcaccccctagcgggcctccaatctccggattttctgttggatccacatacgacatcactcggggtcacgccggtcgcgctccccagacccccctgatgcctagcttttctgcgccatccggcactggactgctgcctacaccaatcacacagcaagcaagtttaacatctctcgcacaggggaccggtaccacatccgctattacctttcctgaggaacaagaggaccctagaatcacccgtggccaggatgaagcttctgctggcggtatctgggggtttatcaagggcgttgccggaaacccaatggtgaagagcgttctcgacaaaacgaagcattctgtggaatctatgatcaccacgctggatccgggaatggccccatacattaagagtggaggggaattggatatcgtagtgacaagtaataaggaggtcaaagtggcagctgtcagggacgcatttcaagaggtcttcgggttggccgttgtggtcggcgaagccggtcagtccaacatagccccacaaccagtcggatacgcggcaggacttaagggcgctcaagagcgcattgatagtttgcgccgaacaggtgtcattcatgaaaaacaaaccgccgtcagcgtggagaatttcatcgcagagctgttgcccgacaagtggtttgatattggatgcctcgttgtcgaggatcccgtacacggcatccacctagagacattcacacaggctacccccgtacctcttgaattcgtgcagcaggcacagtccctcaccccacaggactacaacctgaggtggtccggactgcttgtaaccgtgggtgaggtactcgaaaagtccctcctgaacgtatcccggaccgactggcatatggcttttacaggaatgtctcgccgacagatgatttactcagcagccagagccattgccgaatccccaaaatcgtcaggatctccgtggttggggtag

SEQ ID NO: 53044 - DNA, 1389 bp, Artificial Sequence
  Description of Artificial Sequence: Synthetic coding sequence
atgatggaggagtctggcatcgaaactaccccccctggcacaccccctccaaaccctgctggcttggccgctaccgccatgagcagcacaccagttccactggctgccaccagctccttctcatccccaaatgtgagttctatggaatctttcccccctttagcctatagcacaccccaaccacctcttcctcccgtgcgccctagtgcccctctgccattcgtgccaccacctgcagtgccgtctgtgccccctctcgtcactagcatgccacctcctgtgtcccctagtacagcagcagccttcggaaatccccctgtgagccacttcccaccttctacctccgcgccaaacaccttgttgccggctcctccctccgggccacctatttccggattctctgttggaagtacctatgacatcacccggggacatgccggacgcgctccacagacaccattgatgccatcattttccgcacctagtgggacaggactgcttcccaccccaatcacacagcaagcatcgctcacgtccttggcacaaggcactggtacaacaagtgcaattaccttcccagaagaacaagaagacccacggatcacccgcggtcaggatgaggcctccgccggtggtatatggggatttatcaaaggagtcgctggcaaccccatggtgaaatcagttttggacaaaacaaaacacagcgtagaatccatgatcaccactcttgatcccggtatggcaccgtatataaagtccggtggcgaactggacattgttgttacttccaacaaagaggtcaaagtggcggctgttcgggacgcatttcaggaagtatttggcctggctgttgtagtcggggaagccggacagtcaaacattgctccccagcccgtggggtacgccgctggtttgaagggcgctcaagaaagaatcgacagcttaaggaggactggtgtcatccacgagaagcaaaccgccgtttccgtagaaaactttatcgccgagctccttcccgacaagtggttcgatatcgggtgcctggtcgtggaagacccggtccatggaattcacttggagactttcacacaggccacccctgtcccattggaattcgtacagcaggcgcagtctcttacaccccaggactataacctgcgctggagtggtctactcgtgacagtgggcgaagtccttgaaaagagtttattgaatgtcagcagaaccgactggcatatggcttttactggaatgtccaggagacagatgatttattccgcggctcgggctatcgccgatgactacttcccccgaattcccaaagaacagtggcagtcgatggcctggctgaagctcgagatcttcctccccctggtcacttggtag

SEQ ID NO: 53045 - DNA, 3795 bp, Artificial Sequence
  Description of Artificial Sequence: Synthetic coding sequence
atgagcacgctgtatgtctcacctcatccagatgccttcccgagcttaagggccctgatcgccgcaagatacggagaagccggagagggtcctggttggggtggagcccaccctaggatttgcctgcagcctcccccaacctctcgaacgcccttcccaccaccccgattacccgcactggagcaaggacctgggggactttgggtctggggcgctacagcagtggctcagctcttgtggcccgctggcctagggggtcctggcggatcccgggcagctgtgctggttcagcagtgggtgtcatacgccgacacagagctaattcctgccgcttgcggggcaacacttcctgcgttgggattgcggagctctgcgcaggatccccaggccgtcctcggggctcttggcagggctctgtcccccttagaagagtggctgagacttcacacgtacctagccggagaggcacctacactggcagatcttgcggctgtgacggcacttctgctgccattccggtacgtgcttgacccgccagccaggcgaatctggaacaatgttacaaggtggttcgtcacttgtgtaaggcagccggagttccgggctgtgctgggtgaggtcgttctctactcaggagccagaccactatcgcaccagcccggacccgaggctcccgcacttcctaaaacagcagcacagctcaagaaggaggcgaaaaagcgggagaaactggagaagttccaacaaaaacagaagattcagcagcagcagcccccaccaggagaaaaaaagcctaagcctgaaaagcgcgaaaaaagagatcctggcgtgattacgtacgatctacccaccccccctggcgagaagaaggacgtgagcggccctatgcctgacagttactccccaagatatgtcgaagcagcatggtatccctggtgggaacagcaaggcttctttaagcccgaatatggaagacctaacgtctccgctgccaacccacggggtgtgttcatgatgtgtatcccaccgcctaatgtaaccgggtccctccatttgggccacgccctgacaaatgctattcaagattctctcacccggtggcaccggatgcgcggtgaaactacgctctggaaccctggctgtgaccatgccggtattgcaacccaggtagtggtagaaaagaagctttggcgcgaacaaggcctgtcaagacaccagctgggccgagaagcgtttctgcaggaagtttggaaatggaaagaggaaaaaggcgacaggatttaccaccagttgaaaaagctcggcagcagtctggactgggatagagcctgttttactatggatcccaagctcagtgccgcagtgactgaagcgttcgtgcggctgcatgaggagggaatcatatatcgctctactcgtctggtgaactggtcttgtaccctgaactctgccattagcgatatcgaggttgacaaaaaagagttaactgggaggacgctgcttagcgttcccggttataaagaaaaagttgagttcggcgtcctggtttctttcgcttataaagtacagggatcggattcggatgaggaggtcgtggtggccaccacccgtatcgagaccatgctaggagacgtggcggtagccgtacatcccaaggacacacgataccagcacctcaagggcaagaacgtgatccacccttttctgtcgcggtctctgcccattgtgtttgatgaattcgtggatatggacttcggcactggcgcagtgaagattacaccagctcatgatcagaacgactatgaagttggtcagcggcacggattagaggccatctctatcatggacagtcggggagccttaataaacgttcctcccccttttttaggccttccgaggtttgaggcacggaaggcggtcctagtggctctgaaagagaggggactgtttagggggatagaggacaaccccatggttgtccccctgtgcaatcgttccaaagacgtagtggaacctctgttacggccacagtggtacgttcgatgtggagagatggcccaggcagcatctgccgctgttacgaggggcgacttgaggattttgcctgaagcacaccagagaacttggcacgcgtggatggataacattagggagtggtgtatctcacgccagctatggtgggggcatcgtattcccgcttactttgttacggtctccgaccctgctgtccccccaggagaggaccccgatggcagatactgggtttctggtcgaaacgaggccgaagcaagggagaaagcggcaaaagaatttggagtctcccctgataagatctccttgcaacaggacgaggatgtgcttgacacttggttttctagcggcctgttcccactttcaatcttagggtggccaaaccagtctgaggaccttagtgtgttctatcccggaaccctgttggaaacaggccatgatattctgtttttctgggtggctagaatggtgatgcttgggctgaaattgaccggtagattaccctttcgggaagtgtacctgcatgccatcgtgagggacgctcacggacggaagatgagcaaaagtctgggaaacgttatcgacccgctcgatgtgatttacggcatctctctccagggcctccataaccagctgttgaactccaatctggaccccagcgaagtggaaaaagcaaaagaaggtcagaaagccgacttcccagctgggatccctgaatgcggcacagatgctctccgtttcggcctgtgcgcttacatgagccagggacgggatatcaatcttgacgtaaatagaattctcggctatcgccacttctgcaacaagctgtggaatgccaccaagttcgctctgcgcggattgggaaagggctttgtcccttctccaacgagccagccgggaggccatgaaagcctggtggaccggtggatacgtagccggcttaccgaggccgtgcgactatccaatcagggattccaggcctatgacttcccagcagtaactactgctcaatatagtttctggctgtatgaactgtgtgacgtgtacctggaatgtttaaagcccgtcctcaacggcgtcgaccaggtcgctgccgagtgcgccaggcagacactttacacttgcctcgatgtcggcttgaggctgcttagtccttttatgcctttcgttacagaagagctgttccagaggttgccacggaggatgcctcaggccccaccctcactgtgcgtgacaccctaccccgaaccatctgagtgtagctggaaagacccagaggcagaggcggctttggagctggcattgtcaatcacccgtgcagttcgctctctgcgagccgattataacctgaccaggatacgacccgattgctttctggaggtggccgacgaggccactggtgctctggcatccgcggtttcggggtatgtgcaggcgctggcctccgcaggagtagtcgcagtgctggccctcggcgcacccgctcctcagggttgcgccgtggccttggctagcgacaggtgttcgattcatctgcagcttcagggactggtcgaccccgctcgggagctaggcaaattgcaggctaagagagtagaagcccagcggcaggcccaaagactgagagaacgacgggcagcctccgggtacccagtgaaggtgcccctggaggtgcaggaggcagatgaagcgaaattgcagcagaccgaggccgaactccggaaagtcgatgaagccattgctctctttcagaaaatgttatag

SEQ ID NO: 53046 - DNA, 678 bp, Artificial Sequence
  Description of Artificial Sequence: Synthetic coding sequence
atgccgggaacccaaactccggctccggcagaggacccccacagtgggtgcagggatcccgtgcctgcgaggccgcaggcgtgccatccaaagtcccaggagactagatttgagggaccgttaccgcctccccctcccgcagccgcagccccacctccccctgcgcctgctcagactgcccaggcgccaggttttgtcgtgccaacccatgcaggcacagtggggacattgccactgggcggatatgtagccccagggtaccctctacaattacagccctgtactgcatatgtcccggtctaccctgtcgggactccgtacgcgggtggaactccgggtgggaccggggtgacaagcacactgccccctcctcctcagggcccaggactggcgctgctagagcctcgaaggccacctcatgactacatgccgattgctgtgctcactacgatctgttgcttttggccaaccggcatcatcgctattttcaaggctgtccaagtgagaacagcactcgctcggggagatatggtgagcgccgagatcgcaagcagagaagcaaggaacttcagttttatttcgttggctgttggaattgccgcaatggttctctgcaccatattgacagtcgttattatcatcgctgctcagcaccatgagaattattgggatccatag

SEQ ID NO: 53047 - DNA, 678 bp, Artificial Sequence
  Description of Artificial Sequence: Synthetic coding sequence
atgccaggcacgcagacgcccgctcctgctgaggatccacactcagggtgccgggatcctgtgccagccagacctcaggcttgccatccgaagtctcaggaaacccgctttgaaggccctctgcctcctcccccacctgcagctgccgcaccgccacccccagcccctgcacagacagcacaggccccaggatttgtggtcccaactcacgccggaacagtgggaacactccccttgggaggatacgttgccccaggatacccactacagttacagccttgtaccgcatacgtgcccgtgtaccctgtggggacaccgtatgcgggtggtacccccggtggaacaggcgtgacgtccacacttccccctcccccacagggacctggcttggcacttttggagcccaggaggccgccacacgactatatgcccattgccgttctcaccacaatatgctgtttctggccaacagggatcattgctattttcaaagctgtgcaagtacgtaccgcgctggcccgtggagacatggtgtccgctgaaatcgccagtagagaagccaggaatttctcgttcatctctctggcagtgggaattgccgcaatggtcctgtgcacaatcctgacagtcgtgataatcatcgccgctcagcaccatgaaaactactgggatccctag

SEQ ID NO: 53048 - DNA, 678 bp, Artificial Sequence
  Description of Artificial Sequence: Synthetic coding sequence
atgcccggtacccagacacccgcacccgctgaggatccccattcgggatgtcgcgatccagtccccgctagacctcaggcctgccaccctaagagccaggagacccgctttgagggcccattaccccctcccccacctgctgcagcggcacccccaccccctgctcctgctcaaacggctcaggccccaggattcgtggtgccgactcatgccggaacagtgggcacgctccccctggggggatatgtggcccctggatatccacttcagctgcaaccgtgcactgcttacgttccggtgtaccccgtgggcactccctatgcaggaggtacacccggtggaacaggggtgacttcaacactacctccacctccccagggacccggtttggccctactggaacccagacgacctccccacgactatatgcctatagctgtgttgacaaccatatgctgtttctggcctaccggcattattgccattttcaaggccgtgcaggtacggacagctcttgccagaggggatatggtgtcagcagagatcgcttcccgagaagcccgaaatttttctttcattagccttgctgttgggattgcagctatggtgctctgtactattctcaccgtcgtcatcattatcgccgcacagcaccacgagaactattgggatccctag

SEQ ID NO: 53049 - DNA, 921 bp, Artificial Sequence
  Description of Artificial Sequence: Synthetic coding sequence
atgtcgtctgaaaagagtggattaccagacagcgttccccatacttcgcccccaccatacaatgccccacaacctcctgccgagccgcctgccccacctcctcaggccgctccatcatcccatcatcatcaccatcatcactaccatcaatcaggcaccgccacgctccctagactgggggctggcggattggcatcatccgctgccactgcccagaggggcccaagttcatcagccactcttccaaggcctcctcaccacgctcctcccggtcccgctgccggtgcccctcctcccggatgcgccacactgccacggatgccccctgatccttaccttcaggagacacgtttcgaagggcctctgccaccacccccacccgctgcagcagctccccctccccctgctccagcccaaacagctcaggccccaggctttgtggtgcctacccacgctggtacagtcggcactctccccctggggggttatgtagctccagggtacccccttcagctccaaccctgtaccgcttatgtccctgtgtatccagtaggaaccccatatgccggtgggactcctggagggacgggtgtgaccagtactctgcctccgccaccccagggccctggcctggccctcttagaaccgaggcgccctcctcacgactatatgcctatcgccgtcttgaccacaatatgttgcttttggcctacaggcatcattgctatcttcaaagcagttcaggtccgaacagccctggcaaggggagacatggtgagcgcagaaatcgcaagtagagaggcacgtaatttctcatttatcagcttggcggtcggcattgctgcaatggtgctgtgcactatcctgacagtggtgatcataattgctgcccagcaccacgaaaattactgggacccgtag

SEQ ID NO: 53050 - DNA, 678 bp, Artificial Sequence
  Description of Artificial Sequence: Synthetic coding sequence
atgccaggaacacagaccccggctcctgccgaggacccccatagcggatgcagagacccagtgcccgctagacctcaagcatgtcacccaaagtcccaggagactagatttgagggcccattaccaccgcctccgcctgcggctgccgcaccccctccgccagcacccgctcagaccgcccaggcccctggtttcgtggtccccacccatgccggaacagtcggcactttgcctctcggcggttatgtggcccctggttaccctctccagcttcagccctgtactgcgtacgtgcccgtatatcccgtggggaccccatatgccggtggtacgccaggaggtaccggagttacttcaacattaccccctcctcctcaaggccctggcctggcgttactggaaccacggaggccgcctcacgattacatgcccattgcagtattaactacaatctgttgcttttggccaaccggcataatcgctatttttaaggcggttcaggtccgcacagcactggctcgtggggatatggtcagtgcagaaatagcatcaagagaggccagaaactttagctttatttcgctggccgtgggaatcgccgctatggtgttatgcacaattctcacagtggtgatcattatcgcagcacagcaccacgagaactactgggatccttag

SEQ ID NO: 53051 - DNA, 921 bp, Artificial Sequence
  Description of Artificial Sequence: Synthetic coding sequence
atgtcatcagagaagtccgggttgccagactctgttccacataccagtccgccaccttataacgctccgcagccccctgccgagccacctgcacctcccccacaagctgccccttcaagccaccaccaccatcatcatcactaccaccagtctggcaccgccactcttcctcgcctgggagcagggggtcttgcatcatctgcggctactgcacagcgtggcccttccagtagcgctacgttgccacgaccccctcaccacgcacctccaggacccgctgctggtgcccctcctccgggttgcgctactcttccgaggatgcccccagatccctacctgcaggaaacacgattcgaggggccactgccgcctccacccccagcggcagctgcgccacccccaccggctcctgctcagaccgcgcaggcccctgggttcgttgtgccgacgcacgccggtacagtgggcaccctgcctttgggcggatatgtggccccaggataccctttgcagctgcaaccgtgcaccgcttacgtgcccgtctacccagtggggaccccttacgcaggagggacccccggaggtactggggtgacgtctactttgccgcctccccctcaggggcctgggttagccctactggaaccaagacgtcctccccacgattacatgcccatagccgttctgaccacaatatgttgcttctggccgacaggaatcatcgccatctttaaagcggtgcaagtgcgcacggcacttgcacgcggtgacatggtctcggccgaaatagccagccgcgaagccaggaatttcagtttcatcagccttgccgtgggcatcgccgctatggtactttgcacaatactaaccgtggtcatcatcattgccgctcaacatcacgaaaattactgggacccctag

SEQ ID NO: 53052 - DNA, 192 bp, Artificial Sequence
  Description of Artificial Sequence: Synthetic coding sequence
atgcccggtacccagacccccgctcctgccgaggacccacactccggatgccgtgatccggtcccagcgcgaccacaggcttgtcatcctaagtcccaggagacaagattcgagggcccattaccccctcctccacctgccgctgcagcacctcccccaccggcacctgctcagaccgcgcaggctccttag

SEQ ID NO: 53053 - DNA, 192 bp, Artificial Sequence
  Description of Artificial Sequence: Synthetic coding sequence
atgccgggtacgcagaccccagctcctgctgaagaccctcattcgggttgccgggacccagtaccagcacggccacaagcctgccaccccaagagccaggagacaagattcgaaggaccgcttcccccaccacccccagccgcagctgcaccacctccacctgcccctgcgcagactgctcaggcaccctag

SEQ ID NO: 53054 - DNA, 678 bp, Artificial Sequence
  Description of Artificial Sequence: Synthetic coding sequence
atgcccggaacccagacccctgctcctgccgaggacccacactcaggttgtcgcgaccctgtccccgcaagacctcaggcgtgtcatccgaagagccaagagactagatttgaaggcccactgccaccccctcccccagccgctgcagctccccctccgccagctcccgcacaaactgcacaggcacccggattcgtggtgcccacgcacgctgggacagtagggaccttgcccttaggcggttatgtggctccgggttaccctttgcagctacagccctgcacagcctatgtgcccgtataccctgtgggcacgccatacgccggtggcacaccaggaggcactggtgtaacatccaccctccctcctcctccgcaaggtcctggcctcgccctgctggagcctcgacgccctccccacgattacatgccgatagcggtgctgacaactatatgttgcttctggcccaccggcattatcgccatcttcaaggccgtgcaggttcgcactgcactcgcaaggggagacatggtcagtgcagaaattgcctctcgcgaagcccgaaactttagcttcataagtctcgccgtcgggatagccgctatggtgctatgcacaattctgactgttgtaattataatcgctgctcagcaccacgaaaattattgggacccctag

SEQ ID NO: 53055 - DNA, 192 bp, Artificial Sequence
  Description of Artificial Sequence: Synthetic coding sequence
atgccaggcacccagactcctgctcccgctgaggatccacattctggatgtagggacccagtgccagccagacctcaagcatgccatcctaagtctcaggagacacgctttgaaggacctctgccgcctccaccgccagccgcagcagcacctcccccacctgcacctgctcagactgctcaggcaccttag

SEQ ID NO: 53056 - DNA, 678 bp, Artificial Sequence
  Description of Artificial Sequence: Synthetic coding sequence
atgcctgggacccagacccctgcccctgctgaggaccctcactccggttgcagagacccggtaccggctaggccccaggcctgtcacccaaagtcccaggagacccgttttgaaggccctctcccacctccgccacccgcagcagcggcacctcccccaccagcccctgctcagaccgcacaggctccagggtttgttgtccccacacatgccggaactgttggcacccttccactgggagggtatgtggctcccggataccctcttcaactgcagccctgcacagcctacgtgcccgtgtatcccgtagggactccttatgccggtggaactcccggaggcactggagtcacaagtaccctccctccccctccgcaggggccaggtctggctttactggagccaaggcggccaccgcatgactacatgcccatcgccgttctaaccactatctgctgtttttggcccactggaatcatcgcaatttttaaggccgtgcaggttaggacagccctcgccagaggggacatggtctcagcagagatcgccagccgtgaagcgcgtaactttagcttcatctccttggctgtagggattgctgccatggtgctgtgtactattctcactgtcgtgattattatagcagctcagcatcacgaaaattactgggacccatag

SEQ ID NO: 53057 - DNA, 192 bp, Artificial Sequence
  Description of Artificial Sequence: Synthetic coding sequence
atgccgggaacccagactcctgcccctgccgaagacccgcactccggatgccgggatcccgtgccagcaaggccacaggcatgtcaccctaagtcgcaggagacgaggttcgaaggaccactgcccccacctcccccagcagctgccgctccccctcctcccgctccggcacagacagcacaggctccctag

SEQ ID NO: 53058 - DNA, 192 bp, Artificial Sequence
  Description of Artificial Sequence: Synthetic coding sequence
atgccaggtacccaaacaccagcccctgcagaggacccacatagcggttgccgagaccccgtcccagccagaccacaggcatgccacccaaagtcccaggaaacccggttcgagggcccactgcccccacccccacccgctgctgcagccccacccccacctgcgcctgcccagaccgcacaggccccttag

SEQ ID NO: 53059 - DNA, 192 bp, Artificial Sequence
  Description of Artificial Sequence: Synthetic coding sequence
atgccaggcacacaaacaccagccccagcggaagatccccactctggctgccgagatcctgtgcccgcacggcctcaggcttgtcacccaaaaagccaggagacacgcttcgaggggcctttacctccgccaccaccagctgcagctgcacctcctccacctgcgccagctcagaccgctcaagcgccttag

SEQ ID NO: 53060 - DNA, 678 bp, Artificial Sequence
  Description of Artificial Sequence: Synthetic coding sequence
atgccaggaactcagaccccagctcccgcagaggatccacatagcggctgtagggaccctgtgcccgcaaggccacaggcgtgccacccaaagtcccaggagacacgctttgaggggcctctccctccccctccacctgccgctgcagccccaccaccacccgcaccggcacaaacagcccaagcgccagggtttgtggtccctacccacgctggcaccgtgggaaccttgcctctcggcggttatgtggcccctggctacccattgcaactacagccatgtaccgcatatgtccctgtgtacccagtaggcactccatacgccggaggtactcccggtgggacaggggtgacctccactcttccccctccgcctcagggtcctgggctagccctgctggagccacggcgaccccctcacgattacatgccgatcgcagtgctgaccacgatttgctgtttctggcccaccgggattatcgcaatcttcaaggctgtacaagtgaggacagcgctggccaggggcgacatggtctccgccgagatagcgagtagggaggcgcgtaatttctcttttattagcctagctgttggcattgccgctatggtcctctgtaccattctcaccgtagttataatcatagccgcacaacatcacgaaaactactgggatccttag

SEQ ID NO: 53061 - DNA, 192 bp, Artificial Sequence
  Description of Artificial Sequence: Synthetic coding sequence
atgccgggaactcagaccccagcaccagcagaagatcctcacagcggctgtcgagacccagtccctgccagaccacaggcgtgccatcccaaatcacaggagacaagatttgagggccctttgccacctccgccaccagccgctgctgctccacccccacctgcccctgctcagaccgcccaggccccttag

SEQ ID NO: 53062 - DNA, 921 bp, Artificial Sequence
  Description of Artificial Sequence: Synthetic coding sequence
atgtcttctgagaagtctgggctacctgatagcgtccctcataccagccccccaccatataatgcgccacagccgccagcagaaccccctgctcccccacctcaagcggcacctagttcgcaccatcatcatcaccaccactaccatcagtcgggtactgccacacttcctcgcctgggggctggcggtctggcctcttctgcagccaccgcacagcgcggaccctcttcctcggccactttaccacggccaccgcatcatgctcccccaggaccagccgcaggggctcccccaccaggctgtgccacactgccacgcatgccacctgacccctacctgcaggagacacggtttgagggcccactgccaccgccacctcctgcagcagctgcacccccaccacccgctcctgctcagactgcacaggcacctggattcgtggtgcccacccacgccggaacggtcgggaccttgcccctggggggatatgtcgctccaggatatcctttacagctgcagccctgcactgcctacgtccctgtctaccctgtcgggactccctatgcaggagggacaccaggcggtaccggagtgacttcaacccttccaccccctccacaaggcccagggctggcactactagagcctcggagacctccacacgactacatgcccatagccgttcttacgacgatctgctgtttttggcccactggcatcattgcaatctttaaagccgtgcaggtgcgaacagccctggcacggggagatatggtgagtgcagagatcgctagccgggaggctagaaatttctcattcatctctctggctgtgggcatcgccgcaatggtgctgtgcaccattctaacggttgtaattatcatcgccgctcagcatcacgagaattattgggacccctag

SEQ ID NO: 53063 - DNA, 678 bp, Artificial Sequence
  Description of Artificial Sequence: Synthetic coding sequence
atgccgggaactcagacccccgctcccgctgaggacccacacagtggctgccgggacccggtcccggctagaccacaggcgtgtcatcctaagtcccaggaaactagattcgagggacctcttccaccgccacctcccgcagcggcagctcctcctcctcctgccccagcgcaaaccgcccaggctcctggctttgtcgtccccacccacgccggaaccgtggggacattgcccctgggaggttacgtggctcctggatacccactgcagctgcaaccatgcacagcctatgttccagtgtatcccgtcgggacaccttacgccggaggcacacccggaggcacaggcgttacctcaactctgccaccaccccctcagggtccgggtctagcgttgcttgagcccaggcgaccaccacacgactacatgcccatcgccgtgcttaccacaatctgctgtttttggcctactgggataatcgcgattttcaaggccgtacaagtcagaaccgcactagccagaggagatatggtgagcgcagagatcgcctcacgggaggcacgcaatttctcctttattagcctggcggtcggaatagccgctatggtgctttgtacaattttgactgtggtcattataatcgctgcccagcaccatgagaactactgggacccctag

SEQ ID NO: 53064 - DNA, 921 bp, Artificial Sequence
  Description of Artificial Sequence: Synthetic coding sequence
atgtcctctgagaagagcggcctaccggatagtgtgccccacactagtccccctccatataatgctccccaacctccagcagagccccctgcacctccccctcaggccgctccttcatcccatcaccatcaccaccaccactaccaccagtccggaacagctaccctccccaggctcggggctgggggactcgcatctagtgccgctacagcacagcggggaccttcttcgagtgcaacgttgccacgcccacctcaccacgcccctcccggacccgcagctggggctcctccccctgggtgtgcaaccttgccccgtatgccacctgatccatacctacaggaaacaaggtttgaaggaccactgcccccacctccgcctgccgcagccgcacctccacctcccgctcctgcacaaactgctcaagccccaggattcgtggttcctactcacgctggaactgttggtaccctgccgcttggaggttacgtggcaccaggttacccactccaactgcagccctgtactgcttacgtaccagtgtaccccgtgggaacgccgtatgccggaggaaccccaggcggaaccggtgtgacgagcacactgccaccacctccacagggtccaggcctggcccttctggaacctcgacgaccacctcacgactatatgcctatcgcagtgctgactaccatctgttgcttttggcctactggcatcattgccatttttaaggctgtccaggtgagaaccgcccttgcaagaggtgacatggtgagtgcggagatcgcctcccgggaggcaaggaacttcagctttatatctcttgccgttggcatagctgccatggttctgtgtactatcctcacagttgtgataataatcgctgcccagcaccatgagaactactgggacccttag

SEQ ID NO: 53065 - DNA, 678 bp, Artificial Sequence
  Description of Artificial Sequence: Synthetic coding sequence
atgccgggaactcaaacaccagccccagctgaggacccgcattcggggtgccgagatcccgtgccagctcgccctcaggcctgtcaccccaagtcccaggagacccggtttgagggtcctctgcctccaccaccgcctgccgcagccgctcctccgccacccgctcctgcgcagaccgcccaggctccaggctttgttgtcccgactcacgcaggaaccgtcgggaccctgcctctgggcggttacgttgctcccggttatcccttacagctgcaaccatgtaccgcatacgtccctgtgtatccagtcggtactccgtatgcaggcggaacgcctggtggcaccggagttacttcaacactccctccaccccctcagggtccaggcctggctctgctggaaccacgtaggccaccccatgattacatgccaatcgcagtcttaactacaatctgctgtttctggcctacgggcattattgccattttcaaagctgtgcaggttcgtactgcattagcccgaggcgacatggtgtctgcggagatcgccagtcgggaggcaagaaactttagcttcatatccctggctgtggggattgccgctatggtgctgtgtacgatactcactgtggtaatcattatcgctgctcagcaccacgagaactactgggatccttag

SEQ ID NO: 53066 - DNA, 921 bp, Artificial Sequence
  Description of Artificial Sequence: Synthetic coding sequence
atgagtagcgagaagtctggactgccagacagtgtgccgcacacctctcccccaccttataatgctccacagccacccgctgaacccccagcacctccaccacaggctgctccgtcttcacatcatcatcaccatcatcactaccaccaatcaggaaccgccacgctgcccagacttggcgcaggcggactggcatcgagcgctgccactgcccagcgaggaccctcaagctccgccacgctgcccaggccccctcaccatgcccctcccggtccggctgccggtgcgcctcctccgggatgcgccacactgccccgtatgcctcctgatccctacctgcaggaaacgcggttcgaaggacccctgcccccacctccgcctgcagccgctgctccacccccaccagccccagcacagacggcacaggctccgggattcgtggtgcccacgcatgcaggcacagttggcacactgcctctcggcggttacgtcgccccaggatatccgttgcagctacagccctgcacagcatatgtgccggtatacccggtgggcacaccctacgccggtggaactccaggtgggactggagttacatctaccctaccccctcccccacagggtcccggattagccttgcttgagccgaggcgaccccctcatgactatatgcccattgcagtgctgacaacaatatgctgcttctggcccactggtatcattgctatctttaaggccgttcaggtacgtacagcattagctcgcggagatatggttagtgcagaaatcgctagtagagaggcacgcaatttttctttcatctctctggctgtgggcatcgccgctatggtgctctgcacgatcctcactgtcgtcattatcatcgctgctcagcatcacgagaactattgggatccatag

SEQ ID NO: 53067 - DNA, 921 bp, Artificial Sequence
  Description of Artificial Sequence: Synthetic coding sequence
atgagctctgagaaatcggggttacctgatagtgtgcctcacacaagtccccctccctataatgcccctcagccccctgctgagcccccagccccaccgcctcaagcagcccctagctcacatcaccatcaccatcaccattatcatcagagcgggactgctacattgcctagattgggcgctggtggtctcgcttcgtccgcagccaccgctcaacggggaccgtcaagctctgccacgcttcctaggcccccacaccatgcaccccctggtccagcagctggcgcacccccacctggctgtgccacccttcctcgaatgccaccagacccctacctccaggaaacacgtttcgagggacccctgccaccacctcctccagctgccgctgctccccctcccccagcaccagctcagaccgcccaggccccaggcttcgtagttccgacccatgctggaacggtaggaactttacccctaggaggctacgtggcaccaggatacccactgcaattgcagccctgcacggcctatgtcccagtgtacccggtcggtacaccctacgcaggcggtacccccggtgggactggtgtgacctccactttgccacctccgccacagggacctggattggctctgctggagccaagaagaccaccgcacgattacatgcccattgctgtgctgactacaatttgttgcttctggccgacaggtattatcgccatatttaaagcggtgcaggtacggaccgctcttgctaggggagacatggtgtcagctgagattgcctctcgcgaagcgaggaatttttctttcatcagcctcgctgtgggcattgccgctatggtgctatgtacaattttgacggtggtgataatcatagcagcacaacaccatgaaaattattgggatccgtag

SEQ ID NO: 53068 - DNA, 192 bp, Artificial Sequence
  Description of Artificial Sequence: Synthetic coding sequence
atgcccggaacacagacacccgctccagcggaagatcctcatagtggctgtcgtgacccagtgcctgctcggccacaggcctgccacccaaaaagccaggagactcgctttgaggggccattgccccctccacccccagcagcggctgccccaccccctccagcgccagcgcagactgcccaggccccatag

SEQ ID NO: 53069 - DNA, 921 bp, Artificial Sequence
  Description of Artificial Sequence: Synthetic coding sequence
atgagctctgagaagagcggactgccggatagcgtcccacacacttctcccccaccgtataacgcaccccaaccacccgctgaacccccagcacccccaccacaagcggctccctcatcacaccaccaccaccaccaccactatcaccagtcaggcactgcaactcttcctagactgggtgcaggaggactggccagtagtgcggcaacagctcaaagaggcccttccagctctgctacactgcctagacctccacatcatgcccctccaggacctgcagcaggtgctcccccacccggttgtgcgacgctgccacgtatgcccccagacccctacctgcaagagactcgcttcgagggaccgctgcctccccctcctcccgctgccgcagctccacccccaccagcccctgcccagaccgcccaggccccaggatttgtggtccccactcacgctggcacagtcggcactctccccctggggggttacgtagctccaggataccccctccagctgcagccgtgtactgcttacgtgcccgtgtaccccgttggaacaccttatgcgggtgggactcctgggggaaccggggtgacctccaccctgccgcctccaccacagggacccggtttggccttgctggagccaaggaggccgccacatgactatatgcccatcgctgttctaactaccatctgctgtttttggccaactggaatcattgccatctttaaagccgtgcaagtgcgaacagccctggccaggggtgatatggtatctgccgagattgccagcagggaggccaggaacttctctttcatcagcctcgcagtcggaatagccgctatggttctatgcaccattttaaccgtcgtcatcatcattgccgcacagcaccacgagaactattgggacccatag

SEQ ID NO: 53070 - DNA, 678 bp, Artificial Sequence
  Description of Artificial Sequence: Synthetic coding sequence
atgcccggaactcagacccctgcgccagccgaggatccccacagcggatgtcgggatcctgtgcctgctagaccgcaggcatgtcacccaaaaagtcaggagacacgattcgagggaccattgccccctcctccccctgcagccgcagcacctcctcctcccgctcctgcacaaacggctcaggcgcctgggttcgtcgttcccactcacgccggaaccgtgggcacgctgcctttggggggatacgtggcgccaggttaccctctccagctccagccatgcacggcctatgtcccggtatatccagtagggaccccatacgctggagggacacctggtgggactggcgtgacctcaactctccccccacctccacagggacctggcttagcattgctggaaccaaggcgaccaccgcacgactatatgcctatcgcggtgctgacaacgatttgctgcttctggcccaccgggatcatcgccatcttcaaggctgtgcaggttcgtacggccttagctagaggcgacatggttagtgctgagatagcctcccgggaagctaggaacttctcttttatttcgctcgccgtcggcatagccgctatggtgctatgcacaattcttacagtggttataatcattgccgctcagcaccacgaaaactattgggatccttag

SEQ ID NO: 53071 - DNA, 678 bp, Artificial Sequence
  Description of Artificial Sequence: Synthetic coding sequence
atgcctggcactcagacaccagctcccgcagaagacccccactccggatgtcgggacccggttcctgctcggcctcaggcatgtcacccaaaaagccaggaaacgagatttgagggccctcttccacctcctccccctgctgcggctgctccacctcccccagcgcctgcacagaccgctcaggcccctggctttgtggtgcccacacacgcgggaaccgtcgggaccctgcccctcggagggtatgtggccccagggtacccactgcagttgcagccctgcacggcttacgtgcctgtgtatcccgtcggaaccccatatgccggtgggacgccaggcggaacaggcgtgacaagcacccttccacccccaccacaaggacccggtctggccctgctagagccacggcgacctccccacgactacatgcctatcgcagttctgacgaccatctgctgtttctggcctactggaattatagcaatattcaaagcggtgcaagtgcggacagcactggcacgtggagacatggtttcagcagagattgccagtcgcgaagctcgaaatttttcattcatctcgttggctgtggggatcgcagcgatggtcctgtgtactatcctcacggtggttattattatagcagcacagcatcatgaaaactactgggacccatag

SEQ ID NO: 53072 - DNA, 678 bp, Artificial Sequence
  Description of Artificial Sequence: Synthetic coding sequence
atgcctgggacacagacacccgctcctgcggaggatccccacagcggctgtcgggacccagtaccagctagaccccaggcctgtcaccctaaatcccaagagactcgcttcgagggacctctgccccctcctcctcccgctgccgcagcccctccaccccctgcaccagcccagacagcccaggctcccggtttcgtcgtgcctacgcatgccggaacggtcggcacgctgccactgggtggttacgtcgcccctggatacccactccagctgcaaccatgcacagcctacgtgcccgtatacccagtggggactccttatgccggtggaacacccggtgggacaggcgttaccagcacactgcctcccccacctcagggacccggtcttgcgctgctggaaccccgacggccacctcacgactatatgccaatcgcagttttgactacaatctgttgtttctggcctaccggcattattgctatattcaaggctgtgcaagtgcgcaccgccctggctcgcggtgacatggttagcgctgaaattgcctcacgcgaagccaggaactttagcttcatatcactggcagtgggcatagcggcaatggtcttgtgcaccattctgacagtcgtgatcataattgcagcccagcatcatgagaattactgggatccttag

SEQ ID NO: 53073 - DNA, 678 bp, Artificial Sequence
  Description of Artificial Sequence: Synthetic coding sequence
atgcccggaacccagactcccgctccagctgaggatccacactccggttgtcgggaccccgtaccagccagacctcaagcctgccaccccaaaagccaagagacccgttttgaaggacccctcccccctccaccaccagccgcagcggctccacctccgccagctcccgctcagacagcccaggcacccggttttgtagttcccacacacgcaggtaccgttggcaccctcccactaggcggatatgtggcgccaggctaccccctgcaattgcagccgtgtactgcttacgtcccagtctaccctgtgggaaccccatacgccggtggcactcctggaggtacaggagttacttccacgttacctcctcctccccagggtccagggctggccctattagaaccgaggcggcctccacatgattacatgccaattgcggtcctgacaactatttgctgtttctggcccacggggatcattgcaattttcaaggcggtgcaggtgcgcacagccctagctcggggagacatggtcagtgccgaaatcgcgtcccgggaggctaggaacttcagtttcattagcctggcggtggggatcgctgcaatggtcctgtgcacgatcctcacagtagtcataattatagcagctcagcaccacgaaaattactgggacccctag

SEQ ID NO: 53074 - DNA, 678 bp, Artificial Sequence
  Description of Artificial Sequence: Synthetic coding sequence
atgcctggcactcagacacccgctcccgcagaagatcctcactcaggctgtagagacccagtccctgcaaggcctcaggcctgtcatccaaaaagccaggaaacgcggttcgaaggccctttgccaccaccacccccagccgcagctgccccaccgcctcccgctcccgctcagaccgcgcaggcaccaggctttgtggtgcctactcacgccggaacagtgggcacactgcccctcggtggctacgtcgcccctgggtaccccctgcaacttcaaccgtgtaccgcttatgtgccggtgtaccccgtgggtacaccatacgccggtggcacccccggagggaccggcgtgacatcaaccctcccacctcctcctcaaggaccaggtcttgctctcttggaaccacggagaccccctcacgattatatgccaattgccgttctgacaacaatctgctgcttttggcctacaggtataatcgcgatcttcaaggccgtgcaggtcaggactgccctggctcgcggtgatatggtgtccgcagagatcgcctcccgtgaggcaagaaatttctccttcatctcattggctgtgggcattgccgctatggtgttgtgcacaattctcaccgtggtcattattatcgcagcccagcatcatgaaaattattgggacccctag

SEQ ID NO: 53075 - DNA, 678 bp, Artificial Sequence
  Description of Artificial Sequence: Synthetic coding sequence
atgcccggaacccagactcccgcaccggctgaagacccacacagcggctgccgagatcctgtgccggctcggccacaggcctgccatcccaaaagtcaagagactcgatttgagggccctctgcccccaccccctcctgccgctgctgccccaccgcctcctgcccctgcccagaccgctcaggctcccggtttcgtggtgcccacccacgccggaaccgtcggaacactaccactggggggatacgtagctccaggctacccacttcagctgcaaccgtgtactgcctacgtccctgtttatccagtcgggaccccctatgcgggaggcacaccgggaggaacaggcgtaacgagtaccttgccaccccctccccagggcccaggattggcattactggagccaaggaggccgccacacgattacatgccaattgccgtcttgactaccatctgctgcttctggcctaccgggattatcgcaatttttaaggccgtgcaagttcggaccgctttggctagaggcgacatggtttctgccgaaatcgcctcccgcgaagccagaaacttttcttttatctcactcgcagtgggcatcgctgcgatggtcctctgcacaatcttgacagttgttatcataatcgctgcacagcaccatgaaaattactgggacccgtag

SEQ ID NO: 53076 - DNA, 678 bp, Artificial Sequence
  Description of Artificial Sequence: Synthetic coding sequence
atgcctggtacacagacaccggctccagcagaggatccgcactcaggatgccgcgacccagtgcctgccagacctcaggcttgtcaccccaaatcacaagagacacgctttgaaggacccttacccccacctccccctgcggcagccgctccacccccaccagcacctgcacagacagcacaggctcctggatttgtggttcctacgcacgctggcaccgtgggcacattgccactggggggatacgtggcccctgggtaccctttgcaactacagccatgcactgcctatgtcccagtataccctgtcggaactccctatgctgggggtaccccaggaggcaccggcgttacttccactctgccacccccaccacagggacctgggctggccctgcttgagccaagaagacctcctcatgattatatgcccattgccgtgctgacaactatctgttgcttttggccaacggggataattgccatcttcaaggcagtccaagtcagaaccgcattggcacgcggtgatatggtttccgctgagatcgctagtcgtgaggcacggaatttctctttcatctcgttggctgtgggcattgccgctatggtgctttgtacgatcctcacagttgttattataatcgccgcacaacaccacgagaattattgggatccctag

SEQ ID NO: 53077 - DNA, 2946 bp, Artificial Sequence
  Description of Artificial Sequence: Synthetic coding sequence
atggccagctctccctgggggtgcgtctgcggactgctcttgctactactgccgttgttaggcacaggaccagctcttggcagggggtttccacgtccgctggagaactcagagatcccaatgatacctggagcacaccccaaagggtctgtaggatccgaaccccaagctttcgacgtctttcccgagaaccctcgtgctgactcccaccgcaatagcgatgtgcgccatgcccctgccgaggagatgccagagaagcccgtggcatccccattagggcctgcactgtatggccctaaggcagcacagggagcacagagagaacgacttcccgtgacggatgacctgcagatggcccaagggcctagtagccatgggtggactggcccactcgatagccaggagcttctgcagcaggaggcagtggcccctcatcccgtgggtcatccccatctcacatttattccaactaccccacgcagacagctgcgggttgccacggtacccccatcactgcagcacgaaggccaggagggccagtggccaccacgggatgaaggcctaaaggccaaaactaaatctcgggtgcccccaacctcccctagtgaccatcaaggccctccccacactttggtcagccattcaggcaccgtgaaaaggcctgtgctcgagggccagggcggatttgaggagcatctgcaggaggcagctcagggcccacatttcacccagcaggacccggcagctcccgatgtcggatctgttccccctgtggaggtcgtctactcccaggagcccggtgcacaaccagatctggccttggccaggtccctccctcccgctgaagaactacccgtggaaacccccaaaagagccggagcggaagtctcctgggaagtttccagtcccggacccccaccaaagcaggcagacctgccggatgccaaagactctccagggccacaacctaccgacccccctgcctcagaagcccctgaccgaccctccaagcctgagagggcagcaatgaacggagctgatccaataagccctcagcgtgtgcggggagctgttgaagccccagggactcctaagagtctcatccccggaccaagtgaccctggcccagccgtcaaccggacagagtctcctatgggggcattgcaacctgatgaggcggaagagtggccgggtcgtccccagtctcacccccctgcacctccagtgcaagcgccttccacctcacggagaggcctaatccgggtgaccactcagagggccctggggcagcctccccctccagagccaaccgcttccagcatggcgtcggcccctgcaagttcaccgccagctaacgcaacagccccacctttgcgctggggccctctgcgtagagttctttccttctcctgggagctccacgtctatggcgtaggagtactgttcctgctccccgcactgctagcgctcgcagccttggctgcagcccctgccggaccgaggctggccctcgttgctgccgttctcgtgttggtggcatctgcactccgtagcgcctacatgctgactgatccctacggaagccaggcccgtctcggggtccgcggtggcctcgtgctgtacaacctgcccttccccctgctgctgaccgcgctcgccgcactgacactgctggggctgggcgcaggattaccacccccacttcaaaaccccctgcttcttggcgctgtggctctcgtgcacggagtggggcttttggcaactgacctactgtcaacctggagtgtgctaaacctcctaacacagggactctcatgtgcatggggagctgcagttgcactcggcaccctctgtctctgcaggcgccgtttactggatggtcccaggggatgggatgcatcccccggacctcggctcttggccgtggccggtgcactcggactactcgcttctgggctacagctggccgctgctctgtggctctaccctggtccaggaagggtaggcaggtttagctgggcgtggtggggtgttcacttctggttgaggctgctcgagttaacttgggcccttgccttagctctcgcagcagtggccgcagcacggccaagacctccaacggaacatgcatgttgggctaaactgatgcggctggcatgccccgcaccctcgggaaagtcagaagtacctgagaggcccaacaactgctacgcagggcctagcaacgtgggcgcaggcagtctcgacatatctaaatcacttataagaaaccccgctgagtctggccagcttgccacacccagcagcggagcctggggctctgctgcttccttgggaagagggcctcagggcggtccaggactttcacgcaacggcgttgggccagctccatcactgtctgaactggatctgcgccctccaagcccaatcaatctgagcaggtcaatagatgccgctctgttcagagagcatctggtccgtgatagtgtgttccagcggtgcgggttgcggggtctcgcatctcctccaccaggaggtgccctgcggcctcggaggggaagtcatcctaaggctgagctcgatgatgccggatcttccctgctgcgcggtaggtgtagatcactgtccgatgtgagggtgagagggcctgtgccccaacacgtggtggaagctcctgatggggcagccgcagccgcttcaggcagctctctggactctttcagccggggttccctaaagatttcatggaatccatggaggcatggcctgtcatccgtcgattccctgcccctggatgaactgccaagcactgtgcagctgctgcctgctccgacccccgctcctgattccacggccgctcgacaaggggatggccagggcgaggttcagccacgcggaaaaccaggcgaatcccgaagtgctagctcagataccatcgaactctag

SEQ ID NO: 53078 - DNA, 2946 bp, Artificial Sequence
  Description of Artificial Sequence: Synthetic coding sequence
atggctagctctccatggggctgcgtttgcggcctgctgcttctgctcctgcctctcctggggaccggtcccgcactcggaagaggtttccccaggccacttgagaatagtgagattcccatgataccgggagcacaccccaagggaagcgttggatccgagccacaggccttcgacgtgttccctgaaaaccccagagccgattcccaccggaattccgatgttcgacatgccccagccgaagaaatgccagagaagcccgtggcctctccgcttggacccgcattatatggaccaaaagcggcacaaggggctcagcgcgaacggctgcccgtgactgatgatttacagatggctcagggaccctcctcccacgggtggaccggacctttggacagtcaagaactgcttcagcaggaggctgtagcaccccacccagtggggcatccccacttgaccttcattccgacaactccgaggcgacaactgcgagtcgccaccgtgcctccctctttgcagcacgaaggccaggaaggccaatggcccccaagggacgagggactcaaggcaaagactaagagtcgcgtgcctccaacaagcccctctgaccaccaagggcctccgcatacactggtgtctcatagcggcacggtcaaaaggccagtgctggaaggccagggagggtttgaagaacatctccaagaggcggctcagggtccccacttcacccagcaggacccggctgcaccagacgtgggctcggtgccacccgtggaggttgtgtacagccaggagccaggggctcagccagatttggcccttgctaggtctttgcctcccgcagaggagttacctgtggaaacacccaaacgggcaggcgctgaggtttcatgggaggtttcaagtcccggacccccaccaaagcaggcagacctccctgacgcaaaagactcacccggaccccagcctaccgacccgcctgcaagcgaggccccagacaggccctcaaagcctgagcgggctgctatgaatggagccgaccctatcagccctcagcgggttcggggagctgtagaggctcccggaacacctaagtcccttataccagggccatccgacccaggccctgctgtcaaccgaaccgaatcccccatgggcgctctgcagcccgacgaggccgaggagtggcctggtcgcccacaatctcacccccctgcgcctcccgtccaggcaccctccaccagtcgacgagggttaattcgagtgaccacacaaagagcattaggacagccgcctcctccggagccgaccgctagtagtatggcttccgcaccagcatccagtcctcccgcaaatgccacagcaccccctctgcgttggggccctctgcggagggtgctgtctttctcgtgggagctacacgtgtacggcgtgggcgtcctcttcctgctacctgctctgttagctttagcggcactcgcagcagcccctgccggacctcgactagccctcgtggctgccgtcctggttctggtagcctccgcacttcggtccgcatatatgctgacggacccatacggatcccaggcccgtctgggcgtgcgcggtggcctggtgctgtataaccttcccttcccgctgcttctgacagccctggcagccttgactctcctgggcctgggggctggactgccaccccctctgcagaatcctctgctactcggggctgttgctctggtgcatggcgttgggctcctcgcgaccgacctgctttcaacctggagcgtgctcaatctgctcacccagggtctgtcttgtgcatggggcgctgccgtggccctcgggacactttgcctttgcaggcgcaggctgctcgacggcccaagaggatgggatgcttccccaggaccccgtctgcttgccgtggccggtgctctgggtctcctggcctccgggctgcagctggccgcagccttgtggctgtacccaggaccaggaagggtgggacgtttctcctgggcctggtggggcgttcacttctggctgagactgctcgagctgacctgggccttggccctcgctctggcagctgtggcagccgctcgcccaaggcctccaactgaacacgcgtgttgggctaaacttatgcgactggcttgccccgcaccctctgggaagtccgaagtgccagagaggcctaacaactgctacgctgggccatcgaacgttggggctgggagcctcgacatctccaagtctttgatcagaaatcccgctgagtctgggcagttggctacaccctcatcaggcgcatggggttctgctgcctcgctcggtagggggcctcaaggcggacctggactgtcacgcaacggggtggggccagctccttctctgtctgagctggatctgcgacccccttcccccatcaacctgtcccgaagcattgacgcagccctcttcagggagcatctggtcagagattctgtttttcagcggtgtggtctgcgcggattggcaagtccacctcccggtggtgcccttaggcctagaagaggctctcaccccaaggctgaactcgatgatgccggatccagccttcttagggggaggtgtcggtccctgtcagatgttcgggtcaggggccctgttccccagcatgtggtcgaagctcccgacggagccgctgcagcagcatccggctcctccttagactctttttcccgaggctctttgaaaatcagttggaacccttggagacacgggctaagctccgttgatagtctgccactggatgagctgccttctaccgtccagctcctccctgcccctacacccgcacctgactccacagccgcaagacaaggagatgggcagggtgaggtgcagcctaggggtaagcctggagagtcccgttcagcctcttccgacaccattgagctttag

SEQ ID NO: 53079 - DNA, 2082 bp, Artificial Sequence
  Description of Artificial Sequence: Synthetic coding sequence
atggcccgacatggttgcctcgggctgggactattctgttgtgttctgttcgccgcaactgtcggaccccagcccaccccttcgatccccggagcacctgcgaccactctgacacctgtacctcaatctgaagcgtctatgctgtcattaaacctcggcctgaactttaagttccacctgagggggccagcggcagtttggggctcgcctgtgactgagacgcagccactcagtctcggtcccggacaggagccgggagaggaagtggcctctggactgaggactgacccactgtgggagttactggtgggatcttctgggaacagtctgactgagtggggctccacagaaggagggtcaaagcctcgtgcatcctcgctcctcccagagagcacgtcaaggcggagtggcccatcagatgggcctaccgcaccttaccagccaagacgctccacagtgacttgggatacagcactgatggtgactgctctcccaagctctgctccacggcctcatcaatccgagcttgagttgaaatttgatatggcccttagggccggtgccgcaccaacactggggcacagaaccctgcctcttctgccaagtctgcgggcatcccttgcagagattgctggtcgcctaggtcccttcggtttttttggaactacattaagtcccctcaggaacttctccggattgagtccccctggggagacaacgtccactagcagcgcaagtggggtatctggaagtctcgggtttctgggtaccacactgtccctgcctccgtacagtctcgaaaggaaactgtcctccccttctcctctggaccctgccgcatccctctctttcgctagcatcgccaccacgtccttagacccaacggttcccatatctgggccagatgacctctctccccctgcttcacttgggaatccaagcggtcagcctgagtgcggtcccggatcatgttcagtcggggagttgcccgagagagagggccagccccctgaggccccaagacccctcttttttctgacgttggaagccgactgggccgaggcacgcgcaagatggggcttagcctgggaagcccacgtgtacggtggatatgaagtattgcatgctctaggatatgggggtcagagtggacttgagggcccatggccctggtgggccttccagttggggttacgtttgggagaggtcggcgtcgccttacctctggccctgctgggcttgtacccggcactctgtagtccgagggtgcctccacggtgttgggccaagctgtttaggctctcgccgggacatgccgctccactgcttcccggtgggtgggtcacagggcctcctgataaggagcctttgggctcagctatcgctaggggagacgccgaacttttgcagttgtgtgcccttgcgggtccaggtccggatctgctgctgcaggggggaggttgccgtggcttcgagggcgcagcagccaaccccgcacctagcccagcaagctccccctgtagtgactacaccgtggactttaggccgccatcaccgattaacctcaggcgctctattgaagaggccctctgctctgaggctttgctcgcacctgggctgtttcaggggccagccttcgaagatgcactgccagggctcggcttgtacagaaccgcctccctcggtacaggaggacgcgctagcgaaaggagcggcgaagcgtccggccctgctgcccctccagagctgcccagtcccggtgcctggccagcaggatcttccgtgagcagcggctcattttgcgggctgagccgggatagcagctctatgttgctctgctcctctcccgatagacctcctcggtgcccccttgtttgcgtcttgagcccaccacgccctagcggatctagcccctccctcccagcatccggaagctaccaggctttgtctcccccaagccgtgacagtcccgaaccagcctccgagctccaagcagaggaggccctcctgcaggagcagtttctagatgcttgtcgacaaattgatgaactgtcagtgggttcggataccatcgacttgtag

SEQ ID NO: 53080 - DNA, 2700 bp, Artificial Sequence
  Description of Artificial Sequence: Synthetic coding sequence
atggcccgacacggttgtctaggtctggggctattctgttgcgttctgttcgccgcaaccgttggccctcaacccacccccagtatcccaggggcacctgctactactttgacgccagttccccagtcagaagcctcgatgctaagcctaaacctcggtctgaacttcaagttccacttgagggggcctgcagcggtctgggggtctccagtaactgagactcagcctctgtccctgggtccgggacaggaaccaggtgaggaagtcgcctctgggcttagaaccgatcctctctgggaactgctcgtgggctcttctggtaatagcctcactgagtggggttctaccgagggtggttcgaagccgcgagcttcttctctcctgccagaatcgacgagtcgacgcagcggaccgtcggatggccctacagcaccttatcagcctcgcagatcaacggtgacttgggacaccgctctgatggtcacagcactacccagctccgctcccagacctcaccagtcggagctcgaactaaagttcgacatggccttacgcgctggagccgctcccaccctcgggcacagaacgttaccattactaccctcattgagggcgagcctggccgaaattgctggcagactcgggcctttcggctttttcggcaccacgttgtcccccctgagaaatttctcaggcctgtccccaccgggtgaaactaccagtactagctcagctagcggtgtctcaggtagcctgggctttttgggcaccacactcagcctaccaccatattcacttgaacggaagctatcatctcctagtccactcgacccagcagcttctctctcctttgcgagcatcgctacaacatctctagatcccacggtcccaatctctggcccagatgatttgagtccaccagcttcactgggaaacccatcgggccagcctgagtgtggcccaggctcttgcagcgttggcgagttacccgagcgcgagggccagccgcctgaggcccctaggccattgtttttccttacgctcgaggctgattgggcggaggctcgagcacggtggggcctggcctgggaggcacacgtgtatggggtcggcgcactgttcggtctggtggccctcttggcgctgctcgcactggctcttttaccctggaggtgtcccccaggggctccgtgtttggcactcctcgatcttcttttgctgagcgctggcacaacccgagcatttcctctgttttacgatgcatacggccacagagacaggctgcccgcactcgcctggctgttactccaggaccttcctctcccctgcctggccgcaggccttggtctggcctgtctgttacttgccagacctcgcccacccaggtgccctacaggcctggccgcacttcttcttctcggccttggcctggctgccgctgctgcactcggctcagcagcacacaggccgctccggccattgcgcctcgcctcgagaggtctccacgccttcctggctgcattcttgagcgggctgcttctcgctcttagttgctggggaggacggaggcgcagagcaggggctcccctgggaggctccgggttcaagggcgcaacccccctaccgcaggggaggagcccgtttgccccacgggaatcatggcggagggccgctcggaccgcaccagtcgccggaactttcggtttgctgtccggggctctccagggatatgaagttctgcacgcgctgggctacggagggcagtcaggacttgagggcccttggccttggtgggcgttccagctgggactgcggctgggtgaagtgggagttgccctacctctggcactgctgggactttacccggcactttgcagccccagagtgccacccaggtgttgggcaaaattgtttaggctatcccctggccacgccgcacctttgctgccgggtggctgggtgaccggcccacctgacaaggaaccactaggctctgccattgccagaggtgacgccgagcttttgcagctctgtgctctggcagggcctggcccagacttactactgcagggaggaggatgtcggggatttgaaggagctgccgctaacccagctcctagcccagcatcttcgccttgctccgattataccgtggattttagaccaccatctccaatcaacctcaggcgcagtatcgaggaggcgctgtgtagtgaagcgctgttagctcctgggctctttcagggccctgcattcgaggatgctttgcctggtctcgggctatatagaactgctagtttgggaactggcggacgcgcatctgagagaagcggggaagcaagcgggccagcagctcctccagagttacccagcccaggtgcctggcctgctgggtccagtgtgtcatccggtagcttttgcggactctctcgcgattcgagtagcatgctcctctgctcttctcccgaccgcccaccacggtgtcctctcgtatgcgtcctgtccccaccaaggccgtccggctccagcccctctctgcccgcatcgggctcttatcaggcactttccccgccaagccgagactcaccagagcccgctagcgaacttcaggctgaagaagctctgcttcaggaacagttcttggacgcatgtaggcaaatagatgagctgagcgtcggttctgacaccatcgacctgtag

SEQ ID NO: 53081 - DNA, 2700 bp, Artificial Sequence
  Description of Artificial Sequence: Synthetic coding sequence
atggcccgtcacggatgtctggggttgggcctgttctgctgtgtacttttcgctgctactgtgggacctcagccaacccctagcattcccggtgcccctgccacaactttaacccccgttccccaatcggaggccagcatgttgtccctcaacctaggcctcaattttaagttccacctccggggaccagccgcagtttgggggtcccctgttacagagacccagcctctctctttgggaccgggacaggagcctggagaagaggttgctagcggcttgaggacggatcccttgtgggagctgctggtcggctcatccgggaactccctgaccgagtggggcagcaccgaggggggaagcaagcctagggcttcttctcttctgcctgagtccacaagcagacgctctggacctagcgacggtcccaccgcgccttaccagcctcgcaggtccaccgtaacttgggacaccgccctgatggtgactgctttaccgagctctgccccaaggccgcatcagtcggagcttgagctgaagttcgatatggctctgcgggctggggctgcacctaccttgggacacagaactcttcccttgctcccttctttgcgcgcttcgttggccgaaatagctgggaggctgggcccttttggcttctttggcaccactttgtcgcctcttcgcaacttctccggcctcagtccccctggggagacaactagtacctctagtgcttctggcgttagcggatctctcgggtttctcggaaccaccctgtcattgccaccatacagtttggaacgcaagctcagcagtccatcaccactggacccagcagcgtctctttcattcgccagcattgctactactagtctggaccccaccgtgcctatttccgggccagacgatttgagcccacctgccagtctgggaaaccccagtggccaaccagagtgcggccctgggagctgttctgtgggggaactcccagaacgggagggacaacccccagaggccccaaggcccctgtttttcttgaccctggaagccgactgggccgaagcccgagcacgctggggcctcgcgtgggaagcacacgtttacggcgtgggcgcattgtttgggcttgttgctctcctcgctctcctggcactggccctcctgccttggagatgtcccccaggagcaccttgcttggccttgctggatctgctcctcctgtcggccggtactaccagggcttttcccctgttctatgacgcttacggccatcgagaccggctcccagccctggcttggttactgttgcaggatctcccactgccttgtcttgccgctggtttgggtctggcatgtctgctgctggctcgccctaggcccccaagatgccccacaggcctcgctgcactgctcttgcttggattagggctcgcagccgctgcggctctggggtcagctgcgcatcgccctctgaggccattacggctggcgagccgcggattgcacgcattcctggctgcatttttgagtggactgcttctagccctgtcctgttggggcggacggagaaggcgcgcaggcgctcctctgggcggatcaggtttcaagggcgctaccccacttccacagggtcggagccctttcgctcctagagagtcatggcgtcgcgcagccagaacggctcctgtggccggaaccttcggactcctgagtggggcactgcagggctacgaagtgctgcatgcgttaggatacggcggacagtccggcttagaaggtccatggccgtggtgggccttccagctcggattgcggctcggcgaggtcggggtcgctttaccactggcactgctcgggctgtaccctgcgctatgcagccctagggtgcctccacggtgctgggcgaagctgttcaggttgtcccccggtcacgccgctccgttgctacccggaggctgggttacgggccctcctgacaaagagccgttaggatccgctattgcaaggggagatgcagagctactgcagttatgcgcactcgccggacccggacccgacctccttttgcagggaggaggatgtcggggtttcgagggcgcagcagctaaccccgctccttctcccgcttcctccccctgcagtgactacaccgtcgatttcagaccaccgagtcccatcaatctcaggcggtcaatcgaggaggccctttgctctgaagcgcttcttgcaccaggactgtttcagggccctgcatttgaggatgccctgcccggactcggtctgtaccggacagcgtccctgggcaccggtggtcgggcatcagagcgctccggggaggcttctggacccgctgctccacccgaactgcctagccccggagcgtggcctgcgggtagcagcgtttcatctggaagtttttgtggcctgtcccgcgactcgagtagcatgctactgtgctcctctcctgacagaccgcctcgatgtcccctcgtctgcgtcttgtcgcccccaagacctagcggcagttccccttctctcccagcaagcggctcttaccaggcactgtctccaccgagcagagacagtccagaacctgcgtctgagctccaggctgaagaggccctactccaggaacaattcctcgatgcttgcaggcaaatcgatgagctgtctgtcggatccgatacaattgacctgtag

SEQ ID NO: 53082 - DNA, 1290 bp, Artificial Sequence
  Description of Artificial Sequence: Synthetic coding sequence
atggctcggcacgggtgtctgggtctgggacttttttgctgcgtgctttttgcggcaaccgtagggccacaacctactccgagcattcctggcgcaccagctactaccctcactcccgtcccccagtctgaggcctctatgctttcattaaatctgggcttgaactttaaattccatctccggggacccgcagctgtgtggggcagtcccgttaccgagacccagccattgtcacttggcccaggccaggagcccggtgaagaagtcgcttctggtcttcggaccgacccactttgggaactcctggttggatcctcgggtaactccctcacggaatggggctctacagaggggggatccaaacccagagcatccagcttgctacctgaatctacttctcgcaggtctggtccgagcgacgggcctactgcaccctatcaaccaaggcgatctaccgttacctgggataccgccttaatggtaacagccctgcctagctctgcacctcgaccacatcagtcggagttagagcttaaattcgacatggctctacgtgctggtgccgctccgacactgggacaccgcaccttgccactgcttccttcccttagggccagcctcgctgagatcgccggaaggttggggccatttgggttctttggaaccacactgtctcccttgaggaacttcagtggtttgagccccccaggagagaccacaagtacatcatcagctagcggtgtgtccggaagcctgggctttctgggaaccacgctgtcacttcctccctatagtttggagagaaagctgtcatcccctagccctctggaccccgctgctagccttagctttgcctctatcgctacaactagcctcgacccgacggtcccaatttctggccctgatgatctctccccccctgcctcactaggaaatccttcaggccagcccgaatgtggcccaggtagctgtagtgttggtgagctacccgagcgggagggacagccccctgaggctccaagaccgctcttctttctgaccttggaagccgactgggctgaggccagagctcggtggggattagcatgggaagcgcatgtgtacgggaggttgcatagaggacttcctcctgccctgccaaatcagccagcgacgcagcaccgcggtggacccctccagaggggacctgcctgtgcctggccactgcctgggccttgtttaaggggcaggagcgcatgggcgaggaccctgccccaccggctggccggagaccgtggacagggacagtag

SEQ ID NO: 53083 - DNA, 1692 bp, Artificial Sequence
  Description of Artificial Sequence: Synthetic coding sequence
atggccgcagctgccgtgactgggcagaggccggagaccgccgcagcagaagaagcttcgagaccacagtgggctcctcctgaccactgtcaagcccaggccgctgctggactgggggacggggaagatgcgccagtgcgcccactctgcaagccgcgagggatctgctcaagggcgtacttcctcgtgctgatggtgtttgtgcatttgtatctgggaaatgttcttgctttgctgctctttgtccattactctaacggggacgagagctccgatcctggtcctcagcaccgggcacaagggccaggccctgaaccaaccttaggtcctctgacgcgcctggagggcatcaaagtggggcacgaaaggaaagtacagctcgtgacagaccgcgaccattttattaggacactgtcgcttaagccactactatttgagatccccggttttcttacagacgaagagtgcagactgattattcacctcgcacagatgaaagggctgcagagaagccagatcttgcccacggaggaatacgaggaggccatgtctacaatgcaggtgagccagctcgacctattcaggctgctggaccagaatagagatggtcatcttcagctaagggaagtgctggcccagactcggctggggaacgggtggtggatgacgccagaatcaatacaggagatgtatgccgctatcaaggccgatcccgacggtgatggcgttctgagcctgcaagagttttcaaacatggacctgcgcgactttcacaaatacatgcgctcacataaggcagagtcctctgagttggtccggaactctcaccatacgtggctgtatcagggagagggggctcaccatataatgagagcaattcgtcaacgggtactgcgcctgactcgcctcagccccgaaatcgtggagctgtctgagcccctgcaagtcgtgaggtacggcgagggaggacattaccacgcccacgtcgacagtggcccagtgtatccagaaacaatctgttcccatacaaaactggtcgctaatgagtcagtcccatttgaaacctcttgtagacaggtgtctcccaactggggtctcccttcaatcctcagaccgggaactcctatgactcaggcacagccttgtacggtaggtgtcccactgggtatgggcccaggcgatcactgggtaatccctgtgagcccttgggaacatcctcaactggggacctgcagcgtaccgcctctgccatactcctacatgactgtactgttctatctcaataatgtgacaggaggaggggagacagtgttccccgtagccgacaatcgaacctatgacgagatgtccctcattcaagacgacgtggacctgcgggacacccgcagacactgcgacaagggcaatctccgcgtgaagccacaacaaggcactgcagtcttttggtataactatctgcctgacgggcaaggatgggtcggggacgtcgacgattactcccttcatggtggctgcctggttacacgcggaacgaagtggatcgccaacaattggatcaacgttgaccctagcagagcaagacaagcattgttccagcaggaaatggcacgcctggctagagaaggcggaacagactcacaacctgagtgggctctagacagggcttatcgggacgctcgcgtggaactgtag

SEQ ID NO: 53084 - DNA, 1509 bp, Artificial Sequence
  Description of Artificial Sequence: Synthetic coding sequence
atggctgccgcagcagtgaccggccagagaccagaaacagctgccgctgaggaggcatcgcgaccccagtgggccccacccgaccactgccaggctcaggcagcggcaggcctcggcgacggcgaagacgcacctgttaggcccttgtgcaagccaagaggaatctgttctagggcatattttttggtccttatggtctttgtccatttatacctcgggaatgtgctcgccctgttactcttcgtccactactccaacggcgacgagagctccgacccaggcccacagcaccgtgcgcaaggacccggacccgaacccactctggggcctttaaccaggctcgaaggaattaaagtgggccatgaacgaaaggtgcaattggttaccgaccgggatcacttcatccgcacccttagcctgaagcccctgctgttcgagattcccggatttctgaccgacgaggaatgcaggcttattatccacctggcccagatgaagggcctccagagatctcagattttgcccacagaggagtatgaagaggccatgtccacaatgcaggtgtctcaactggacctctttcggctacttgatcagaatcgagacgggcacctgcagctgagggaggtactggcacagaccaggcttgggaatgggtggtggatgacccccgagagcattcaagaaatgtatgctgccattaaagccgatccggatggagacggagtgctgtccctccaggaattctcaaatatggatctgcgagatttccataaatacatgcgttcccataaggccgaatcgtccgaacttgttcgcaactcacaccatacttggctgtatcagggagaaggggctcaccacatcatgcgcgcaatcagacagagggttttgcgtctgactcggttatctccggaaattgtagagctgtcagagcctctgcaagtcgtacgttacggtgagggcggtcactatcatgcgcacgtagattcaggacccgtctaccccgaaacgatctgttcgcacaccaaattagtagccaacgagtcagtaccttttgagacctcctgccgatatatgactgtgctattttacttgaacaatgtaactggcggtggcgaaaccgttttccccgtggcggacaatcgtacttatgatgaaatgtcactaatacaagacgatgttgatcttagggacactcggagacattgcgacaaaggcaacttaagagtgaaacctcaacaaggcaccgcagttttttggtacaactacctgcctgatggtcaaggttgggtgggtgacgtagatgattattccctgcacggcggatgcctggtgacaaggggaaccaagtggattgctaataactggattaatgtcgatcctagccgcgctaggcaggcactgttccaacaggaaatggcgagattggcccgtgaagggggaaccgattctcagcctgagtgggcacttgatcgcgcttatcgggacgccagagttgaattatag

SEQ ID NO: 53085 - DNA, 2358 bp, Artificial Sequence
  Description of Artificial Sequence: Synthetic coding sequence
atgcctaaaggaaggcaaaaagtccctcacctggacgcccctcttgggctcccaacgtgtctatggctcgaactggccggactcttcctgctggtcccctgggttatgggactggctgggactggcggtccagatggacagggaaccggcggacctagctgggcagtgcacctggagagccttgaaggcgatggggaagaagaaaccctggagcagcaggccgatgctctcgcccaagcggcaggactggtcaacgcagggagaatcggcgagttgcagggacactacctctttgtccagcccgctggccaccgacccgctctagaagtggaggccattcgccaacaagtagaggctgtgctagcgggacatgaagcagtcagatggcattccgaacagagattgctcaggcgtgccaagcggtcagtacactttaacgaccccaaatatcctcagcagtggcatcttaacaacagacgcagcccagggcgagatatcaacgtgacgggggtgtgggaacgcaacgtgactggccgtggcgtgacagttgtagtcgtcgatgatggtgtagaacacacaatccaggatattgcgccaaactattcccctgagggcagctacgatctaaacagtaatgaccctgatcctatgcctcatcccgatgtggagaacggcaaccatcacggaactagatgcgcaggtgaaatagcagctgtcccgaataactccttttgcgcagttggcgtggcctacggttcccgaatagccggaataagagtgttggatggaccactgacagactcgatggaagctgtggcctttaacaaacattaccagatcaacgacatttatagctgtagttggggtcctgatgacgatgggaagaccgttgatggaccccaccaactgggaaaggccgcactgcagcacggagtgatcgccggtcggcagggctttggtagtatattcgtcgtggcatctggcaacggcggacagcacaatgacaattgcaactatgatggttacgccaatagtatttacaccgtaactataggcgcagtcgatgaggaaggccgaatgccattttacgctgaggagtgcgcatcgatgctggccgttacgttctccggaggtgacaagatgctacggagcattgtgaccacagactgggatcttcagaagggcactggttgtacagaaggacatacgggtacctctgctgcggctccattagctgctggcatgattgctctgatgctgcaggtgaggccgtgtctgacttggcgggatgttcagcacatcatcgtttttacagctaccagatacgaggatagacgggcagagtgggtgaccaatgaagcgggattttctcatagtcaccagcacggcttcggcctccttaacgcctggcgactagtcaacgccgctaagatctggaccagtgtcccctacttggctagctatgtttctcccgtgctgaaagagaataaggccatacctcaatctcccagatcgctggaggtcctgtggaatgtgtcaagaatggacctcgagatgagtggtttaaagaccctcgaacatgtcgcagtgactgtgagcattactcaccctagacgcggttctctggagttgaaacttttttgccccagtgggatgatgtcacttattggggcaccgaggtcaatggactcagaccccaatggcttcaacgactggaccttttcaaccgtccgttgttggggggaacgagctcggggtacctacaggctcgtaattcgggacgttggcgatgagagcttccaagttggcatccttcgacagtggcaattgaccttatatggaagcgtctggagtgccgtggatataagggatcgccagcgactactcgagtcggctatgtctggtaaatacctccatgatgatttcgctctgccttgcccacctgggctgaagattcccgaagaggatggctatactattacaccaaatacgttgaagaccctggtcctcgttgggtgcttcaccgtattctggaccgtatactacatgctcgaggtgtaccttagtcagcggaacgtggcatcgaaccaggtttgcagatcaggaccctgccactggcctcaccggtcacgcaaggccaaagaggagggaacagaactggaaagcgtgccactgtgcagctcaaaggaccccgacgaagtcgaaacagagtcccggggtcctcccactactagcgatttgttggcccctgacttgctggaacagggagattggtcactgagccaaaataagagcgctttagattgcccgcaccagcatcttgacgtgccgcatggtaaggaagagcagatctgttag

SEQ ID NO: 53086 - DNA, 342 bp, Artificial Sequence
  Description of Artificial Sequence: Synthetic coding sequence
atgcctaaagggcgacagaaagttccgcatctggacgcacctctgggattaccaacatgcctctggttggagctggcgggactgttcctgctggtaccatgggttatgggcctggccggaacaggaggccctgatgggcagggcaccgggggaccaagctgggcagtgcatcttgagagcctggaaggcgatggggaagaggaaacactggagcagcaagccgatgcattggcacaggctgccggactcgtgaatgctggaaggattggcgagctgcaagggcattacctgttcgtgcagcctgccggacaccgacctgccctggaggttgaggcaatttag

SEQ ID NO: 53087 - DNA, 279 bp, Artificial Sequence
  Description of Artificial Sequence: Synthetic coding sequence
atgcctaagggccgacagaaagtacctcatcttgacgcgccactgggactgccaacctgcctctggctcgagcttgccggtctcttcctgctcgtcccatgggtcatggggcttgctggtacgggcggacccgatggccagggcacgggtggtcctagctgggccgtccatctcgagagcctggagggcgacggagaagaggaaactctagaacagcaggcggacgctctcgctcaagcggctggcttggtcaacgccggaagaatcggagagctgtag

SEQ ID NO: 53088 - DNA, 279 bp, Artificial Sequence
  Description of Artificial Sequence: Synthetic coding sequence
atgccgaagggcagacagaaggttccccacctagacgcaccgcttggactccccacatgtctttggctggagctggccggactgtttctgctggtgccttgggttatgggcctagccggaactggcggacctgatggacagggcacaggcggacccagctgggcagtgcacctcgagagcctcgagggtgatggggaagaagaaacactcgagcagcaggccgacgctctggcacaggccgcaggcctggtgaatgcgggaagaattggagaactgtag

SEQ ID NO: 53089 - DNA, 714 bp, Artificial Sequence
  Description of Artificial Sequence: Synthetic coding sequence
atgcctttctatgcggaggagtgtgcgtccatgctggccgtgactttcagcggaggagacaagatgctgcgctcaatcgtgacaactgactgggatctacagaagggtaccggctgcaccgaagggcacaccggaacaagcgccgcagcgccactggctgctggtatgatagcactgatgttgcaggtacgcccatgcctaacatggcgggacgtccagcacataatcgtgtttaccgcgacccggtatgaggatcggcgagctgaatgggtcacaaacgaagctgggttcagtcacagccaccagcacgggtttggcctgctaaacgcttggcgactggtgaacgctgctaaaatttggacaagtgtgccgtacctggcgtcctacgttagccccgtgttgaaagagaataaggccattccgcagagcccgcgatccctggaggtcttatggaatgtatcaaggatggacctagagatgtctggtctaaagacactagagcatgtggcagtaactgtgagcatcacccaccctagacggggatccctcgagctgaaattgttctgtcccagtggcatgatgtctctgatcggcgctccccgtagcatggactcagacccaaacggcttcaacgactggaccttctcgaccgtaaggtgttggggcgagagagctcggggtacctatcggctggtcatcagagacgttgggtag

SEQ ID NO: 53090 - DNA, 1776 bp, Artificial Sequence
  Description of Artificial Sequence: Synthetic coding sequence
atgccaaagggaaggcagaaggtacctcaccttgatgcaccactcggcctgcctacctgcctctggctggagctggccggactttttttgctggtgccatgggttatgggtctcgcaggcacgggcggtcctgacggacagggaacagggggaccctcctgggctgtacatctagaaagcctcgagggagatggagaggaagagaccttagaacaacaggccgacgctcttgcacaggccgcaggactcgtcaacgccggacgaatcggcgaactccagggccattatctcttcgtgcagcctgccggacaccggcctgccctcgaagtggaggccatccggcagcaagtcgaggccgtcctggctggccatgaagccgtcagatggcactctgagcagcggctgctgagacgcgcaaagcgttccgtacacttcaatgatccaaagtatccccagcagtggcacctgaataatcggagatccccgggacgcgacatcaacgtgaccggagtctgggagcggaatgtgacgggtagaggggtaacagtcgtggtcgtagacgacggcgttgaacacaccatccaggacattgcccctaattatagtccggagggcagttacgatttgaatagcaatgatccagaccctatgcctcatcctgacgtggagaacggaaaccatcatgggactcgttgtgctggtgaaattgccgctgtccccaataactccttttgtgctgtgggggtggcatacggctccaggatagccggaatccgcgtcttggatgggccactcacagatagcatggaggccgtcgcttttaacaagcactatcagatcaatgacatttattcatgctcctggggaccagacgacgacggtaagaccgtggacgggcctcaccaactgggcaaggccgcactccaacacggcgtgatcgccggtagacaggggtttggtagtatttttgttgtggcatctggcaacgggggtcaacacaatgacaactgtaactacgacgggtatgccaacagtatctacaccgtgacgatcggcgcagtagacgaggaagggaggatgccattctatgccgaagaatgcgcttccatgctggccgtgacattctccgggggagataagatgctgcggagtatcgtcaccactgactgggacctccagaagggcacgggctgtacggaaggtcataccggtacaagcgcggcagctccgttagcagccggaatgatcgccctgatgcttcaggtgagaccctgcctgacctggagagacgtgcaacatatcatcgtgttcacggctacacgctatgaggaccgtcgggcagagtgggttacaaatgaagccggattttcgcatagtcatcaacacggttttggcctgctgaacgcttggaggctggtcaacgccgctaagatatggacatctgttccctatctcgctagctatgtctccccagtcctgaaggagaataaggctattccccagtccccaaggtccctggaagtgctgtggaatgtgagtcggatggacctggagatgagtggtcttaaaaccctggaacacgtggcagtcacagtcagtatcacacacccacggaggggtagtttagaattgaaactcttctgtccttccggcatgatgtctctcattggggctcctcgtagcatggacagctggttgtgtgtggagtgctcccggcaccaaggacaaaccaaggctgtcagagaatgccacgagtggaagatacctgctagatag

SEQ ID NO: 53091 - DNA, 2022 bp, Artificial Sequence
  Description of Artificial Sequence: Synthetic coding sequence
atggctaagctggagacattacccgtgcgcgcagatcctggaagagacccactgttggcattcgctcctcgcccttctgaattaggcccacccgacccgagattagctatgggtagcgtaggctccggcgtggctcatgctcaggagtttgcaatgaagagcgttggtacgcggacagggggaggtgggtcacagggtagcttccccggtcccagaggctcagggtcgggcgcttctcgggaaagaccgggacgctatccatccgaagacaaggggctcgccaacagcttgtatcttaatggggagttgcgtggttcagatcacacagatgtctgcggaaacgtggtcggaagttcaggcggttcatcttctagcggtgggtctgacaaggcacctccccagtacagagagcctagtcaccctcctaagctactggctacgtccggaaaattggaccagtgtagcgaacctttggtgaggccatcagcgtttaaaccagtggtccctaaaaacttccactccatgcaaaacttgtgtcctccccagaccaatggaacccctgagggacgacagggccctggcggacttaagggcggtttggacaaatcccgaactatgacccccgcaggcggaagcggcagcggattatcggattccggtaggaacagcctcacaagcctcccaacgtactcgtcttcctattcccagcatttagcgccactgagcgcttccacatcacatatcaaccgtattgggacggcatcatatggcagcggatctgggggttcctcaggcggagggtccggctaccaggacctcggcacttcagatagtggacgagcatcaagtaaatccggtagctctagttcaatggggagacccggtcacctaggcagtggggaaggcggaggcggagggctgcccttcgccgcatgctctcccccttcaccttctgccctgatccaggagcttgaggaacgcctgtgggagaaagagcaggaagtggcggctctgagaagatcactggagcagtcagaagcagcagtggcccaggtcctagaggagcgtcagaaggcctgggaaagagagctcgcggaactgcgacaggggtgttcaggaaaactgcagcaggtagcccgtcgcgcacagcgtgctcagcaagggcttcaactgcaagttttaaggctccagcaggataagaaacagctccaggaagaggctgctcggcttatgcgacagcgggaagagctggaagacaaggttgccgcttgtcagaaggagcaggctgacttcctgccaagaatagaagagactaaatgggaggtttgtcagaaagcaggggagatcagtctgttgaagcaacagttgaaggacagtcaggctgatgtcagccaaaagctttcagagatcgttggtttgaggtcccagctcagagaaggacgcgcttccctcagggagaaggaagagcagctgctgtccctcagagattcattttcttccaaacaagcgagcctggaacttggcgagggagagctgcctgccgcatgtctgaagccggcattaacacccgtcgatcctgccgagccccaggatgctctcgctacctgcgaaagtgatgaggccaaaatgcggaggcaagccggagtggctgctgctgctagccttgtctcggtagacggcgaggccgaggctggcggtgagtcaggaacgcgggctctgaggcgagaagtgggtaggctgcaagctgaactcgcggctgaaagaagagctagggaacgacagggcgcaagctttgccgaagagcggagagtatggctagaagaaaaagagaaggtaatagaatatcagaagcagctgcagctcagctatgtggaaatgtaccagcggaatcagcagcttgaaaggcggctgcgagagcgaggagctgctgggggagccagtactcctacgccgcagcatggggaagagaaaaaagcttggacgccaagcagactggagcgaatagagtcaacagaaatctag

SEQ ID NO: 53092 - DNA, 1884 bp, Artificial Sequence
  Description of Artificial Sequence: Synthetic coding sequence
atggctaagctcgagacactccccgtacgggctgacccagggcgtgaccccctacttgcatttgcccctaggccgtctgagctagggccaccagacccacgtcttgcgatgggcagcgtagggagcggagtggcacatgcccaagagtttgccatgaagtctgtcgggacaagaaccggcggtggcggtagccaaggatcctttcccggtccacggggaagcgggtccggggcaagccgggaaagacccggaaggtacccatccgaggataaagggctcgcgaattccctgtaccttaatggagagttgcggggttcagaccacacagacgtgtgcggtaatgttgtgggatcatccggcggatcctcttcaagcggcggtagcgacaaagctccaccacagtatagggagccctctcacccacctaagcttctagcaacaagcggaaaactggatcagtgtagcgagccactagtgaggcctagcgcatttaagccagtggtgccaaaaaattttcattccatgcaaaacctctgtccccctcagaccaatggcacccctgaagggcgacaaggtcccggagggctcaaaggaggactggataaatctagaaccatgacaccagcaggtggtagcggttcaggtttatccgattccggtaggaactcattgacttctttacctacgtacagctcatcttactcacagcacctcgcacccctcagcgcttcaacctcacacatcaacagaatcgggacagcttcctacggatcgggttctggcggttcttcaggaggcggttccggataccaggatttaggtacctctgatagcggccgagcatcctccaaatccggtagtagctcttccatgggccgaccgggacacctgggatcgggggagggcggaggcggtggtctaccgtttgcggcatgctcgccaccgtcaccaagcgctctgatccaggagttagaggaacggctttgggaaaaggaacaagaagttgccgcactccgcaggtctttagaacaatccgaagctgccgtggcacagcaggataagaaacagctgcaagaggaggcggctaggttaatgagacagcgggaagaattggaggacaaggtagccgcttgccagaaagagcaggccgacttcctgcctcgaattgaggagactaagtgggaagtctgccaaaaggctggggagatcagcctactgaagcagcagctgaaggactctcaagcggacgtgtcccaaaagctgtcggaaattgttggactgcgctcccagctaagggaaggccgagccagcctgagggagaaagaagaacaacttcttagcttaagggattcattctcgtccaagcaggctagtctggagctgggcgaaggtgagttgccagctgcatgtctcaaacccgcattgactccagtggatccagctgaaccacaggacgcattggcaacctgtgagtctgatgaggcgaagatgaggcggcaagcaggagtggctgcggcagccagcctcgtcagcgtcgacggtgaggccgaggcaggcggagagtcgggtacacgcgctctgaggcgggaggtcggacggctgcaggctgaactcgccgctgagcgccgagcccgagagagacaaggagcgtcatttgcagaagagagaagagtgtggctggaagagaaagagaaagtgatcgagtaccagaaacaactccagttatcttatgtagagatgtaccagcggaaccagcaactagaaagacgactgcgggagcgaggagccgctggtggtgcgtcaacgccaaccccccagcacggggaagagaagaaagcctggacaccctctcgtttggaacgtattgagtcgaccgaaatttag

SEQ ID NO: 53093 - DNA, 1884 bp, Artificial Sequence
  Description of Artificial Sequence: Synthetic coding sequence
atggccaaactggagactcttcccgttcgcgcagacccagggcgtgatccgcttctggccttcgcccctaggccctccgagctgggcccacccgatccaaggctggctatgggctctgtggggtctggggtggctcatgcccaggagttcgccatgaagtcagttggaactcggactggaggagggggatctcagggttcatttcccggaccaagaggctcaggatctggggcttctagggagcgccctggacgctacccatcagaggataagggcctcgcgaactctctctaccttaacggtgagttgcggggttcggatcataccgacgtgtgtgggaatgtcgtggggtcttcgggtgggtcaagctcatccggtggttctgacaaagctccgccacagtatagggaaccaagccacccccctaaactgctcgctacctcgggtaaacttgatcagtgtagcgagccccttgtgcgaccctccgccttcaaaccagtggttcctaagaatttccactctatgcaaaatctgtgtcctccacaaacaaacggcacacccgagggccgacaaggtccgggaggcctgaaggggggtttggacaaatctcgcactatgaccccagctggcggttctggctctggccttagcgattctgggaggaatagtctgacttctctgcctacatatagctcctcttactcccagcatctagccccactatccgcttctacctctcacattaaccggatcggcactgcatcatacggcagcggatccggcggatcttctggtggcggatccggctatcaggatctggggactagtgactcagggagagcctcaagcaagagcggctccagtagcagcatgggacggcctgggcaccttggaagcggggagggcggagggggaggactgcccttcgccgcatgctcccccccttccccaagtgctctgatacaggagctcgaggaaaggctgtgggagaaagagcaggaggtggctgctctgcgcaggagtctcgaacaatccgaggctgctgtggcacagcaggacaagaaacagctgcaggaggaagctgcgcgtctaatgcgccaacgggaggaattggaagacaaagtcgctgcctgccagaaagaacaggccgactttcttcctcgaatagaagagacaaaatgggaggtatgccaaaaagcaggcgaaatttccttgcttaagcagcagctgaaggacagccaggctgatgtcagtcagaaactcagtgagattgtgggactgcgctcgcagcttcgagaaggtagagcaagcctaagagaaaaggaggagcagctgctctccttgagagactccttctccagtaaacaagctagtctcgagctgggcgagggtgaactgcctgctgcatgtctcaagccagccctgacgcctgtagatcccgctgaaccgcaggatgcgctggccacctgtgaatcagatgaggccaagatgcggcgacaggcaggcgtggccgctgcggcatccctcgtatccgttgatggggaagcagaagccggaggcgagagtggcactcgcgctcttagacgagaagtcgggcgattacaggcggagctggcagcagaacggagagccagggagcgccaaggtgcctctttcgccgaagaaaggcgcgtgtggttagaggagaaagagaaagtcatagagtaccagaagcaactgcagctgagctacgtggagatgtaccagcgaaaccagcagctcgagcgaagattgcgagagagaggagccgcaggcggagcctctaccccaacaccccaacacggagaagagaaaaaggcatggacccctagcaggctggagcgaattgaatccacagagatttag

SEQ ID NO: 53094 - DNA, 1188 bp, Artificial Sequence
  Description of Artificial Sequence: Synthetic coding sequence
atgtcggccaatgccacactcaaaccgttatgcccaatattggaacagatgtcaagactgcagagccattccaatacttctattcgatacattgatcacgccgctgtactgctgcatggcctggcttcattactcggcctggtggaaaacggagtgatcctgttcgtagtgggatgtaggatgcgccagaccgtggtgactacctgggtactccacttggccctctctgacctgctggcttctgcctcacttcccttctttacatattttctggctgtgggtcattcctgggagctggggactacattctgtaagctgcactcatctatttttttcctgaacatgtttgcttcaggcttcctgctctcggcaattagcctggataggtgtctccaggtagtgcgtccagtctgggctcagaatcaccggaccgtggcagcagcccacaaggtgtgcttggtgttgtgggccttggccgtcctcaacaccgtgccatactttgttttcagggataccatcagtaggctcgatggcaggatcatgtgttactataacgtcctccttttaaacccaggccctgatcgagatgcaacttgcaactctcgacaggttgccttagcagtctctaagttcttgttggcattcctggtgcccttggccatcattgctagcagccacgcggcagtttcccttcggctgcagcacagagggcgaagaagacctggccgatttgtgagattagtggcggcagtcgtggctgcctttgcactgtgctggggcccatatcatgtgtttagcctcctcgaagccagagctcatgctaatccgggtctccgtcccctcgtctggcggggtctgccatttgttaccagcctggccttttttaactcagtcgctaatcccgtcctctatgttctaacttgtcccgacatgctccggaaactgagaagaagtctgcgtacggtgctggaaagcgtgctcgttgacgacagtgagttgggaggagccggttccagtaggagacgcaggacttcaagtactgccagatctgcatcccctctcgctttgtgttctaggcctgaagaacccagaggccctgccagactcctgggctggctgctggggagctgtgccgctagtccccagaccggaccgttaaacagggctttatctagtaccagctcttag

SEQ ID NO: 53095 - DNA, 933 bp, Artificial Sequence
  Description of Artificial Sequence: Synthetic coding sequence
atggtgtacaagaccttgtttgcactgtgcatcctgactgcagggtggagagttcagtccttaccgacaagcgcccctctctcagtaagcttgcctaccaatattgtgccaccaacaaccatctggacctcatcgccacagaacacagacgcagacacagctagcccttctaacggcactcacaacaactcggttctacccgtgaccgccagcgctcctacctcactgttgccaaagaatatctctattgagtcccgtgaagaggagatcaccagcccagggtccaactgggaagggaccaacactgaccctagcccgagtgggttctcctcaaccagcggaggagtgcacctgactaccactctcgaggagcattcatccggaacccccgaagcaggcgtcgcagcgactctctcccagtctgccgctgaacccccaacgctaatctctcctcaagctcctgccagctctccgtccagcttatccacttcgcctccagaagtcttctctgcgtcggtgactacaaatcattcttccacagtgacttccacccaacccactggggctccaacggcaccggaaagtccgactgaggaaagttcatctgatcatacccctactagccatgctaccgccgagccagtgccgcaagagaagactccgcctactaccgtgtccgggaaggtgatgtgcgagctcatcgatatggaaaccaccaccactttcccgagggtgataatgcaggaagttgaacacgccctgtccagcggatccatcgccgctatcactgtgacagttattgctgtcgtgctccttgtgttcggcgttgctgcttacctcaaaatccgtcattcttcctacgggaggctgcttgatgaccacgactatggatcctggggaaactacaacaatcctctctacgacgattcctag

SEQ ID NO: 53096 - DNA, 1191 bp, Artificial Sequence
  Description of Artificial Sequence: Synthetic coding sequence
atgggcgaaaggaagggcgtgaacaaatattacccacccgattttaacccagagaagcatggaagcttgaatcgctaccacaatagccaccccctccgtgagagggccagaaaacttagccaaggcatcctgattatccgcttcgagatgccctacaacatctggtgcgacggctgtaagaaccacatcggaatgggtgtacgctacaatgcggaaaagaagaaggtaggtaattactacaccacgccaatttatcgcttccgcatgaaatgtcatctttgtgtaaattacatcgaaatgcagactgacccagccaactgcgattacgtcatcgtgtctggcgctcagaggaaggaagaaagatgggatatggccgacaacgaacaggtgctgactacagaacatgaaaagaaacagaagctggaaaccgatgccatgttccggcttgagcacggggaggcagacagatctacattgaaaaaagccctgcccaccctgagtcacatacaggaagcccagtctgcatggaaggacgactttgcccttaactctatgctgcgtcggaggttcagagaaaagaagaaggccatacaggaggaagaggagcgcgaccaggccctccaggctaaggcctcactcacaattccacttgttcccgagacggaagatgaccgaaagctcgccgcactgcttaaatttcacactctggattcttatgaggataagcagaagttaaaacggacggagattatctcacgctcctggtttccttcagcaccgggtagcgctagctctagcaaagtgtcaggcgttctgaagaagttagcgcaatcacggagaacggccctggctacctcgccgattactgtaggggatttaggcattgtgcgccgacggtctcgcgatgtcccagaaagtcctcagcacgcggctgatactcccaaatccggtgaaccaagagtgcccgaggaagctgcccaggatcggccaatgtcccctggagactgccctccagagaccaccgaaaccccaaaatgctccagtccgagggggcaagaaggatcaagacaggacaagccactgtcccccgctggaagcagccaggaggctgcagatacccccgatacacgccacccgtgtagtctgggcagctccttggttgctgattacagtgactccgaatcggagtag

SEQ ID NO: 53097 - DNA, 1251 bp, Artificial Sequence
  Description of Artificial Sequence: Synthetic coding sequence
atggtcagacctaggagggcgccatacaggagcggggcaggcggtccacttggcggacggggacgtcctcccagaccgctcgtggtgcgcgcagttagaagcaggagttggcccgcttctcccaggggccctcaaccgccaaggatcagagcccgtagtgccccaccaatggagggcgctcgggtttttggcgcactggggccaattggccctagcagcccaggactgaccctgggaggactcgctgtatccgagcatcggctcagtaataagttattggcgtggagcggagtattagagtggcaagagaagcggaggccttatagcgacagtactgcaaaactgaaacggactctgccatgccaggcctatgtgaatcagggggagaacctggaaacagatcaatggccgcagaagctgataatgcagctgatccctcagcaactgcttaccacactggggcctctgtttcgtaactcccagttggcgcagtttcacttcacgaaccgtgactgcgacagcctgaagggcctgtgtaggatcatgggcaatggcttcgctggctgcatgctattccctcacatatcaccgtgcgaggtcagagtgctgatgctgttgtattcttcgaagaagaagatattcatgggcctcattccatacgatcaatccggattcgtttccgcgatccggcaagtcataactacacgcaagcaggcagtgggaccagggggtgtaaactccggccctgtgcagatagtaaacaacaaattcctggcttggtccggagtaatggagtggcaggagcccaggccagagcctaatagcaggagtaagcggtggctgccaagccatgtctatgtgaatcagggcgagatccttaggaccgagcagtggcccaggaaactctatatgcaactcattccccaacagctccttacgacgctagtcccactgttcagaaatagccggctggtgcaatttcacttcactaaggatctcgagacccttaaatcgctgtgtagaattatggataacggattcgccggatgcgtgcacttttcttataaggcatcttgtgagattcgggtcctcatgctcctctactctagcgaaaaaaagatcttcatcggcttgatccctcatgaccagggcaattttgtgaatggcattagacgggttattgccaatcagcagcaggtgttgcaaaggaacttggaacaggagcagcagcagcgtgggatggggggatag

SEQ ID NO: 53098 - DNA, 831 bp, Artificial Sequence
  Description of Artificial Sequence: Synthetic coding sequence
atgttattgttcagcgtcctgttactcctatctctggtgacaggcactcagctcgggccacgtacaccactgcccgaggctggggttgctattctgggtcgcgctaggggcgcacaccgaccgcagcctccacatccgccaagccccgtctcggagtgcggggacaggagcattttcgaaggaaggacacgatactcgagaatcacagggggaatggaagctgaggtcggggaatttccatggcaagtgagtatccaggcccgttctgaacccttttgcgggggaagcatcctgaataaatggtggatcctgactgccgcacactgcttgtacagcgaagaactgtttcccgaggagctatcagtggtgctggggacgaacgatctgacttcgccctcgatggaaataaaggaggtagcgagcatcatcctgcacaaggatttcaagagggccaatatggacaacgatatcgctctgttactcctggcctcaccgattaagctggatgatctcaaagttcctatttgcttgccaacgcaacccggacccgctacctggcgcgagtgctgggtggccggatgggggcagaccaacgccgcagacaagaacagtgtgaagaccgatctcatgaaagcccctatggttatcatggattgggaagagtgtagtaagatgtttccaaagctaacgaaaaatatgctctgtgcgggatataagaacgaatcttatgatgcttgcaagcagtcttactttcctacactgcaacgaatgaacacagggtccagccaaaccaagccgccaggtagtcatacattccatttgcagaattag

SEQ ID NO: 53099 - DNA, 1059 bp, Artificial Sequence
  Description of Artificial Sequence: Synthetic coding sequence
atgctactgtttagtgtgttactgctgctcagcttggtcaccgggacgcagctgggacccaggacccctctgccagaagcaggagtggcaattctcggacgcgcaaggggtgctcacaggcctcagccccctcaccccccatcaccagtgtccgagtgtggcgaccgctcaatcttcgagggacggactcggtatagcaggataactggaggcatggaagcggaagtgggggagttcccgtggcaggtttccatacaagccaggtcagaacccttctgtggaggctccattttaaacaagtggtggatattgactgccgcacattgtttatattccgaagagctgtttcccgaggaactgagtgtggtgctgggcacaaacgatttgaccagcccttctatggaaattaaagaggtggcctccattatactgcacaaggattttaagagagccaatatggacaatgacattgcgcttctgcttctcgccagccccattaagctcgatgacctgaaagtgccaatctgcctgccgacccagcccggacccgctacctggagggaatgctgggtcgccggatggggtcaaaccaacgccgctgataaaaactccgtaaaaaccgacctgatgaaggcacccatggtcattatggactgggaagagtgttctaagatgtttcccaaacttacaaagaacatgctgtgtgcgggatacaaaaacgagagttatgacgcctgcaaaggggactctggaggtccactggtgtgcactccagagcccggagagaagtggtaccaggtaggcatcatatcttggggaaaaagttgtggagagaagaacacacctgggatttacacgtccctcgtcaactacaacctgtggatcgagaaggtcacacaattggaaggtagaccgttcaatgcggagaaaaggcggacgtcggtcaaacaaaagccaatggggtccccggtctcgggagttccagaaccagggtctccacggtcgtggctgctgctctgccctctgagccatgtcttgtttagagctatcctatattag

SEQ ID NO: 53100 - DNA, 1185 bp, Artificial Sequence
  Description of Artificial Sequence: Synthetic coding sequence
atgggtatgaaacactcttcaaggtgtctgttgctacggaggaagatggccgaaaatgcagcggagtcaacagaagtaaattccccaccatctcagcctccccaaccggtggtcccggctaagccagtgcagtgcgttcatcatgttagtactcagccatcttgtcccggtcgcggaaagatgtcgaagctgctgaacccagaggaaatgactagccgggattactatttcgatagctacgctcacttcggcattcatgaagagatgcttaaagatgaagtgaggacacttacttatagaaatagcatgtaccataataaacatgtgtttaaggacaaggtggtgcttgatgtgggcagtggtaccggcattctatcaatgttcgcagcgaaggccggagcgaagaaagtgtttgggattgaatgcagtagcattagcgattattcagagaagataattaaagcaaatcacctggataatatcattaccatttttaaagggaaggtggaagaggtggagttgcccgtcgagaaggtggatatcatcatctcggagtggatgggatactgcttgttttacgaaagtatgctgaacacagtcatctttgcacgcgataaatggctgaaacctggaggcctgatgttccctgatagagcggctctctacgttgtggcgatcgaagaccgacaatacaaagatttcaagatccactggtgggagaatgtttatggattcgatatgacatgcattagggacgttgcgatgaaagagcccctggtcgacatcgtggaccccaagcaggttgtgactaatgcgtgtctgatcaaggaggtggacatctatacagtaaagaccgaagagctctctttcacctctgctttttgcttgcagatccaaaggaacgattacgtccatgcgctggtcacttatttcaacatagagttcaccaagtgtcacaagaaaatgggcttttctacagctcccgacgcgccttatacgcattggaagcaaactgtcttctatcttgaggattatctgaccgtcaggcgcggtgaagagatttacggtacaatctccatgaagcccaacgcaaaaaacgtgcgcgacctcgactttacagtggatctcgacttcaagggccagctgtgcgaaacttctgtatccaatgattacaagatgaggtag

SEQ ID NO: 53101 - DNA, 1158 bp, Artificial Sequence
  Description of Artificial Sequence: Synthetic coding sequence
atggaatcactcgcatcagatggtttcaagttgaaggaagtatcatccgtcaactcccctcccagtcagccacctcagcctgttgtaccagctaagcctgttcagtgcgtgcatcatgtgtcaacccagccctcttgccctggacggggaaagatgagcaagttattaaaccccgaagaaatgacctccagggattattacttcgacagctacgcgcattttggaattcatgaggagatgctcaaagatgaggtgaggaccctgacctaccgtaattccatgtaccacaacaaacatgtatttaaggataaagttgttcttgacgttggcagcggaacaggtatactgagcatgtttgccgctaaggccggagcgaagaaggtgtttgggatcgagtgcagcagcatctcagattacagcgagaagatcataaaagctaaccacctcgacaacataataactatttttaaagggaaggtggaagaggttgagctcccggtagaaaaggtagatatcataatcagcgaatggatgggctattgtctgttctatgagagcatgttaaatacagtcattttcgctagagacaaatggctgaaacctgggggtttaatgtttcccgatagggccgctctttatgttgtggctattgaggaccggcagtataaggacttcaagattcattggtgggaaaacgtctatggctttgatatgacctgtatcagggacgtggccatgaaggaacccttggtagacatcgtcgatccaaagcaagtcgtgactaacgcctgccttattaaagaggtcgacatttacacggtaaagacagaagagttaagctttacatccgctttttgtctgcagatccaaaggaacgattatgtgcatgccctggttacttatttcaatatcgagttcactaaatgccataaaaagatgggcttttccacagctcccgatgcaccatacacccactggaaacagaccgtgttctatctggaggactacctcaccgtccgcagaggtgaagagatctatgggactatctcaatgaaacccaacgcaaagaacgtccgtgaccttgactttacagtggacctggacttcaaaggtcaactgtgcgagacttcagtcagtaacgattacaagatgaggtag

SEQ ID NO: 53102 - DNA, 3498 bp, Artificial Sequence
  Description of Artificial Sequence: Synthetic coding sequence
atgtatttcctgagtggatggccaaaacgactcttgtgtcctctcggctcgccagccgaagccccttttcacgtccagagcgacccccagcgagccttctttgcagtgcttgctgcagccaggttgtctatttggtacagccggccatccgtcctgatcgtgacatacaaggaacccgcaaagtcctcaactcagttcggctcctataagcaggccgagtggcgaccagattctacgatgatcgcagttagcactgctaacggatacattctttttttccacatcactagcactaggggggacaagtacctttatgaacccgtctatcctaaagggtctccccagatgaagggaactccccatttcaaagaagaacaatgcgcgccagctttgaatctcgagatgcggaagattctcgacctccaggctcctatcatgtccctgcagtccgtactggaggatctgctcgtggcaacatctgacggactgctacacttgatccattgggagggtatgaccaacggtcgcaaagctattaacctttgcacagtccctttcagcgtggatctgcaatcatctcgtgtcggctccttccttggtttcactgatgttcacatacgcgacatggaatattgtgcaacgctggatggttttgccgtggtcttcaatgacggcaaggtcggcttcattacgcccgtgtcatcacgcttcaccgcagagcaactacatggggtatggccgcaagatgttgttgatggcacctgcgtagcagtgaataataaatacaggttgatggccttcggttgtgtaagtgggtctgtccaggtgtacacgattgacaattcaacaggggcaatgctgttgagccataagctggagttaacggcgaaacagtatccggatatctggaataaaacaggtgccgtaaaacttatgcgctggtcacctgacaacagcgtcgtgatcgtgacctgggaatatggtggtctgtcgctgtggagtgtgttcggtgcacagcttatctgcaccctcggcggtgattttgcttaccgatccgatggaacaaagaaggaccccctcaagattaactccatgagttggggggctgaaggctatcacctatgggtgatctctggattcggcagtcagaacacggagattgagagcgaccttaggtctgtggtgaagcagcctagcatcttgctatttcagtttatcaagtctgtgttgactgtgaacccctgcatgagcaaccaggaacaggtgctgctgcagggcgaagaccgcctctacctgaattgtggcgaggcctcgcaaactcagaacccacggtcgagctctacacatagcgaacacaagcctagtcgcgaaaagtctcctttcgccgatggaggtcttgaatcgcaagggctgagcactctcttaggacataggcattggcacgtggtacagatctcctccacctatctagagtccaactggcctatacgtttctccgcaatcgacaagctgggtcagaacatagctgtggttggcaaattcggttttgcccactactcattacttaccaagaagtggaagctgtttggtaacatcacccaggagcagaatatgatcgtcacaggtgggctcgcatggtggaatgattttatggtgctggcctgctacaacattaatgaccggcaggaggagcttagggtctatctgaggacgagcaacttagacaacgctttcgcacacgtgaccaaagcccaggcggaaactctgctgctgagtgtctttcaggacatggtgatagtgtttagggcagattgcagtatttgtctctattctatcgagcgaaagagtgatggacctaacaccacagcagggatacaggttcttcaggaggtgagcatgtcccgctatatccctcacccatttctcgtcgtctccgtgaccctcaccagtgtgagcactgagaatggtataaccctcaagatgccccagcaggcgcgaggggcagagtcaatcatgctgaatctggccggtcaactcattatgatgcaaagagaccggtcaggtcctcagattcgcgagaaagattcaaatcctaacaaccagaggaagcttttgcccttttgccccccagtcgtgctagcacagtccgtggaaaacgtctggacgacatgccgcgcaaacaaacagaagcgacacctgctggaggcactttggctaagctgcggcggagccggtatgaaagtgtggctgccactgtttcccagggatcaccggaagccacattccttcttatcccaacgcattatgctcccctttcatatcaatatttatccgctggccgtcctctttgaggacgccttggtgttaggcgcagtgaatgatactttactgtatgatagtctttacacacgtaataatgcaagagagcaactggaagtcctgttccccttttgcgtggtcgaaaggacctcccaaatctatctacatcatatccttagacagctcctggtgcgtaacctaggggaacaggccctcttgctcgcccagtcgtgtgccactctcccctatttccctcatgtcttggaacttatgctgcatgaggtacttgaggaagaagcgacctctcgtgagcctatacctgacccactactccccactgtggcaaagtttatcacagaatttcccctgttcctacagacagtcgtacactgtgccaggaagactgagtacgccctgtggaactatttatttgctgccgttggaaatccgaaggacttgttcgaagagtgcctaatggcgcaggatctggacaccgcagcgtcctatttgattattttgcagaatatggaggtccccgctgtttctaggcaacacgccacactgctgtttaataccgctttagaacaggggaagtgggacctgtgcagacatatgataagatttctgaaagccatcgggagcggagagagtgagaccccgcctagcacaccaactgcccaggagccatcatcaagcggaggcttcgaattctttcgaaatcgttctattagcttgtcacagagcgccgaaaatgtgcccgcttccaagttctcactgcagaaaacactttctatgccatctggaccgagtggcaaacgctggagcaaggattcagactgtgcggaaaacatgtatatcgatatgatgctgtggcggcatgctcgtcggctgttggaggatgtgcggcttaaagacctcggatgcttcgctgctcagttgggctttgagctcatctcttggctgtgcaaggagagaacacgggcagccagagtagataactttgtaattgcactgaagcggttacacaaagattttctatggcccctgcctatcatccccgctagtagcatctcaagcccatttaaaaatggcaaatataggaccggaaatgtggattttatgtcacttgtgcagggagaactgtactttacaccctgcatttatactttctgttactag

SEQ ID NO: 53103 - DNA, 2043 bp, Artificial Sequence
  Description of Artificial Sequence: Synthetic coding sequence
atgtatacgtttctccccgacaatttctctcccgcaaagccaaagccaagtaaagacctcaagcccctccttggctccgccgtactcggtctcctgctggttttggcagcagtggttgcttggtgctactactccgtgtcactcaggaaagctgagcgtcttcgcgctgaactgctggatctgaaagctggcggatttagcatccgcaatcaaaaaggcgagcaggtgtttcgcctggcgtttagaagtggcgcactcgacctagattcttgttcccgtgacggagccctgctcggctgtagtctgaccgcagatgggttgcccctccacttttttattcagacagtgcggcctaaggacaccgtcatgtgttacagagtcaggtgggaggaggctgcccctggccgagccgtggagcacgcaatgtttctcggggatgcagcagctcactggtatggtggagccgagatgaggacccagcactggccgattaggctggacgggcagcaggagcctcaaccattcgttacaagtgacgtgtactctagtgacgccgcttttgggggaattcttgaacggtactggctgagttctagggctgccgctattaaagttaatgactctgttccatttcatctaggctggaactcaacagagaggtccttgcggcttcaggcgagatatcatgatacgccgtacaaacccccagctggaagggccgctgctccagaattgagctatagggtatgcgtaggcagcgatgtgacgagcatccacaagtacatggttagacgttactttaataaaccgtcacgagtcccagcccctgaggcttttcgggatccaatctggtctacatgggccctgtacggacgggcagtggatcaggacaaggttcttagattcgctcagcagatcaggctgcaccacttcaactcgagccaccttgagattgacgatatgtatacgcccgcttatggggatttcgactttgatgaagtgaagttcccgaatgcgtctgacatgtttagacggctacgggacgccggatttagggtaactctctgggtccacccatttgtaaactacaacagcagcaggttcggagaaggagtggagcgtgaactttttgtgcgagagccaactggaaggttgcctgcactggtgaggtggtggaacggcattggggctgtgcttgactttacacatcctaaagccagagattggtttcagggccatctgcggagactaaggagccgctatagtgtggcctccttcaaattcgatgccggagaggtgagctatctgcctcgggatttctccacttatcggcctctgccagatccctcagtttggtcccgacgctacaccgagatggctctgccatttttttctctggccgaggtgagagtgggataccagtcccaaaacatttcttgctttttcagactcgtagatcgggacagcgtgtggggttacgaccttggccttcggtccctcatccctgccgtgctgacggtgtcaatgctgggctatccatttatcctgccagacatggtgggcggaaatgctgtgccacagaggaccgccggaggggacgtccctgagcgggagctatatatccgctggctggaagtcgccgcatttatgccagctatgcaattttccattccaccctggcgatacgacgcagaggtggtcgccatcgcccagaagttcgcagcactccgcgcttcactggtggcacccttgcttctcgagttggccggtgaggttaccgacacaggggaccccatagtgaggcctttgtggtggattgcacctggcgatgagactgcacaccggatcgattctcaattcttgatcggggacactctgttggtggccccagtactcgagcctggaaaacaggagcgcgatgtgtacctgcctgccggaaaatggcgatcttacaagggcgagctgttcgacaagactcctgttctgttaaccgactaccctgtggacctcgatgaaatcgcttatttcacctgggcctcatag

SEQ ID NO: 53104 - DNA, 228 bp, Artificial Sequence
  Description of Artificial Sequence: Synthetic coding sequence
atggccgctgaatgggccagtaggttctggctgtgggctacactcctcataccagcagcggcagtgtacgaagaccaggtgggcaaattcgactggcgacagcagtacgttggcaaggtgaagttcgcatctttagagtttagtcccggttctaaaaaactggttgtagctacagagaaaaacgtgatcgcggcactgaacagccgcaccggcgaaatatgcgagtag

SEQ ID NO: 53105 - DNA, 1665 bp, Artificial Sequence
  Description of Artificial Sequence: Synthetic coding sequence
gccccaactgggagagctgacctttctggaaaccagggtaacgcggcaggaagacttgccactgttcacgaaccggttgtgactcaatgggccgtgcatcctccggctccagcccatccctcactcctggacaaaatggagaaggctcccccacagcctcaacacgaagggttgaaaagcaaggagcatcttccgcagcagcccgcagaaggtaagaccgccagccgccgagttccacgtctgagagccgttgtggaatcccaggcattcaagaatatcttagtagatgagatggatatgatgcacgctagggccgctaccctgatccaagcaaactggcgcggatactggcttcggcaaaagctgatctcccagatgatggcggctaaggccattcaggaagcatggcgtcgtttcaataagcggcacatcttgcattctagtaaaagcttggtcaagaaaactagagccgaagaaggggacatcccgtaccatgcgcctcagcaggtccgattccagcatccagaggagaataggttattgtcaccccctattatggttaacaaagaaacccagtttcctagttgcgacaacctcgttctgtgtcgacctcaatcctcacccttgcttcaacccccagccgcacaaggcaccccagaaccatgcgttcaaggaccccatgcagctagagtaaggggcttggccttcctgccgcaccagaccgttaccattcgtttcccatgtcccgtgtcccttgatgctaagtgtcagccctgcttgcttacccgcactattcggagcacctgcttggtccatatcgaaggtgacagtgtcaagaccaaaagagtgagtgcccgaactaacaaggcacgggcaccagagaccccactgtcgcgacggtatgatcaggccgtcacaaggcctagtcgagctcagacccagggtcccgtgaaggccgagaccccaaaggcaccatttcagatttgccctggaccaatgatcacgaagacactcctgcagacttatccagtggtcagcgtcactctgcctcaaacttatcctgcatcgacaatgacgactaccccccctaaaaccagtcctgttcccaaagtaactattatcaagacccctgcacagatgtatcctggcccaaccgtgaccaagaccgctccacacacttgtccgatgcctactatgacaaaaattcaggtccaccccaccgcctctcgcacaggtactccacgccagacttgtcctgccacaatcactgccaagaaccgtccgcaagtgtcgctgctggcctcgatcatgaagagtcccccatctgtcgtaatgctcgtgggttctagccccaggacctgccacacatgcggtagaactcagcctacacgcgtagtccaggggatgggtcagggtacagaaggtcctggggcagtctcttgggcctctgcttatcagctggcagctctgtcgcccaggcagcctcacagacaggacaaagccgctaccgctattcaaagtgcgtggaggggttttaagatcagacagcaaatgcgtcagcaacagatggcagccaagattgtgcaagctacatggtggcacctcggtccttggcttcccgctgtcggcacgagctgggaagctcttatggccctctgggtctag

SEQ ID NO: 53106 - DNA, 657 bp, Artificial Sequence
  Description of Artificial Sequence: Synthetic coding sequence
caggtcaagaaagtcctttttgaggatgatgagaggagcactgatagctcccagcagtgtagcagtgaggatgaggatatttttgaggagacagctcaagtttccccccctagaggtaaggaaaagcgtcagtggcgtgccagaatgcctttactgtccgtgcagcctgttagcaatgccgattgggtttggctggttaagagactccataagctgtgcatggagctctgcaacaattatatccagatgcacctggacttggagaactgtatggaagagcccccaatctttaaaggagaccctttcttcattctcccgtcttttcagagtgaaagctccacgccgagtacaggcggattctccgggaaggagaccccatcagaggatgataggtctcaacccagatccggcagcaccgggtcaagcctgagcgtttccgtcagagacgcagaagcccagatacaggcgtggactaatatggtgttgactgttctgaaccagattcagatcctccctgatcagaccttcaccgccctgcagcctgctgtcttcccctgcataagtcaacttacttgtcacgtgacagatatccgagtgcgacaggccgtgagagagtggctgggcagggtcggccgtgtgtacgatattatcgtctag

SEQ ID NO: 53107 - DNA, 1035 bp, Artificial Sequence
  Description of Artificial Sequence: Synthetic coding sequence
atggaaaagcgtctgggagtcaagcctaacccagcatcatggatcctctcgggttattattggcagaccagtgctaaatggttgagaagtctgtacctgttttacacgtgtttctgtttctctgtcctctggctgtcaacagacgcttccgaaagcagatgtcagcaggggaagacccagtttggggttggcttgcgtagcgggggagaaaaccacctgtggctcctggaggggacacctagcttgcagtcatgttgggctgcctgttgccaggactcagcctgccatgtgttttggtggctggagggaatgtgtattcaagccgattgcagccgtccccagtcttgtcgtgccttcagaactcatagttcgaactcaatgctcgtgtttctcaagaagtttcaaaccgctgacgatctgggcttcctgccagaggatgatgtcccacaccttttggggctgggttggaattgggcaagttggaggcagagcccaccacgagctgcactgcgtcccgctgttagctcatccgatcagcagagtctgatccggaaacttcagaagcgaggcagcccctccgacgttgtgaccccaatcgtgacccagcacagcaaggtcaacgatagtaatgagctgggtggcctcaccaccagtgggtctgctgaggtccataaggccataactatcagttcacctctcactaccgacttgacagccgagctgtccggaggtccaaaaaatgtgagtgtgcagcccgaaatcagcgagggcctggccacgaccccaagtacccagcaggttaaatccagtgagaagacacagatagccgttcctcagcccgtagccccttcttattcctacgctaccccgaccccccaggcatcattccaatcaacctccgcaccctacccggttatcaaagagctggtggtttctgcgggagaatcagtacagatcacccttcccaagaatgaggttcaactgaatgcttatgtgttgcaggagccccctaaagcccattccaggcccgtttag

SEQ ID NO: 53108 - DNA, 2979 bp, Artificial Sequence
  Description of Artificial Sequence: Synthetic coding sequence
atggctgcggaatgggccagtcgcttttggctgtgggccactcttctgatacccgcagctgcggtgtacgaggaccaagtaggtaagttcgattggcgacagcagtacgttggcaaggtgaaattcgccagcctggagttctctccgggatccaaaaagctcgtggtggctacagaaaaaaacgttattgccgcattaaattcaaggacaggcgagatcttgtggcgtcacgtggacaaaggaaccgctgagggtgccgttgatgctatgttactgcacggccaagacgtaatcactgttagcaacggtggaaggatcatgcggagttgggagactaacattgggggtctgaattgggaaatcaccctggatagcgggagcttccaggccttagggctggtcggtctacaggagtccgtgcgctatattgccgttctcaaaaagacaactcttgccctgcaccatctttcctccggtcacctgaagtgggtcgagcatttgcctgagagcgacagtattcattatcagatggtttacagttacggctccggcgtggtttgggcactgggcgttgtgcctttctcacatgtgaatattgtaaaattcaacgtggaagacggcgagatcgtccagcaagtgcgggttagcacaccttggttgcagcacctgtcaggagcttgtggggttgtggacgaagccgtgctggtctgtcctgatccaagttctagaagtctacaaaccttggccctggagaccgagtgggagctgcgacagattccacttcagtcactggaccttgagtttggatccggctttcagcctcgagtgttaccaacccaacccaaccccgtcgacgcgtctagagcacagttcttcttacacctctctccgtcccattacgcacttttacagtaccactatggtacactctctttactcaagaactttccacagacggccttggtgtccttcgcaactacgggcgagaaaaccgtggcggcagtgatggcctgtaggaatgaggtcaaatcttcaagcagcgaggacgggtctatgggctcattttcggaaaaaagctccagtaaagattctttggcatgctttaatcagacatatactataaatctgtacttagtggaaaccggacgcagattgctggacactaccattactttttcgttggagcaatcagggacccggcctgagcgcctctatatccaggtgttcctcaaaaaagatgattccgttggatatcgggctctggttcaaacagaggatcatctactgctttttctgcagcaacttgcaggcaaggtcgtgctctggtccagggaggagagcttagccgaggtcgtttgcctcgaaatggtggacctcccattgaccggggcacaggccgaactggagggagagttcggcaaaaaagccgacgggctgttaggcatgttcctgaaaagactcagcagccagcttatcctcttacaagcgtggacatcacacctgtggaaaatgttctatgacgctcggaagccccgttcacagataaaaaatgagattaatattgacacgttggccagagatgagttcaacctgcagaagatgatggtcatggttacggccagtggtaaattgttcgggattgagagttcttctggtacaatcctgtggaagcagtatttgcccaatgttaaaccagactccagcttcaagttaatggtgcaacggacaacagctcatttcccccacccccctcagtgcaccctccttgtcaaggacaaagaatcaggtatgagttctctctacgtgttcaatcccattttcggtaaatggtcacaggtggctccacccgtgcttaagcgcccaatactccagagcctgctgctgccggtgatggatcaagactacgccaaggtactgctcctgatcgacgatgagtacaaagtcaccgccttcccagctactagaaacgtgcttaggcagttgcacgagctggctccgagcattttcttttatctcgtggatgctgagcaggggaggctctgcgggtatagacttagaaaggatttaaccaccgagctctcatgggaattgactatcccgcctgaagtgcagcgtattgtgaaggtgaaaggaaagcgctccagcgaacacgtgcattcgcaaggcagagtcatgggtgatagaagcgttctttataagtccctgaatcctaatttgctggcagttgttacagaatcaactgatgctcaccacgagcgaactttcatcggtatctttttgatagatggagtgacagggaggattatccattcctccgtgcaaaaaaaggccaaggggcctgtgcatattgtgcatagcgaaaactgggtcgtttaccagtactggaatacaaaggctagacgcaacgaattcactgtgctggaactctacgagggcaccgagcagtacaatgcaactgccttttcctctctagaccggccacaactcccccaggtgctccaacaaagctatatctttccttccagcatcagtgctatggaagcaactataactgaaaggggcatcacgagcaggcacttactcattggactgccatctggagcaatcctgtcgctcccgaaggcactcttagatccacggcgtccggagattccaacggaacagagtcgggaagaaaatctgattccctattcccctgacgtccaaatccacgccgaacgattcatcaattataatcaaaccgtgagcaggatgcggggtatctataccgctcccagtggcctggaaagtacttgcctagttgttgcatacggactggatatctatcagacaagagtttatccatcaaaacaatttgacgtcctgaaggatgactacgattatgtgctgatttcctccgtcctattcggactggtgttcgccaccatgatcactaaaagattggctcaggtgaagctcctgaaccgcgcatggaggtag

SEQ ID NO: 53109 - DNA, 2916 bp, Artificial Sequence
  Description of Artificial Sequence: Synthetic coding sequence
atggcggctgaatgggcgagcagattttggctgtgggccactctgttgattccagctgccgctgtgtacgaagatcaggtcggaaagtttgattggaggcagcagtatgttggcaaagtaaaattcgcatctctcgagttctctcccggttccaagaagttggtggtagccacggaaaaaaacgtcatcgcggcactgaactcccgcacgggtgaaatttacgttatcaccgtttcaaacgggggaaggataatgcgaagctgggagacaaacatcggcggtttaaattgggaaattaccctggacagcgggtcttttcaggctctgggcctcgtgggccttcaggaaagcgtccggtatatagcggtgttgaagaaaactacactcgctttgcaccacctgagctcagggcatctcaagtgggttgaacacctgcccgagagcgattccatccactaccaaatggtctactcatacggatccggagtggtgtgggctttaggagtcgtcccattttctcacgtcaatattgtcaaatttaacgtagaagacggggaaattgtgcagcaagtgcgcgtctccactccttggttgcagcatttgtctggggcttgcggggtggttgacgaagccgtgctggtttgccccgatccctcatcaagatctctgcagactctggctttggagacagagtgggagcttaggcagatacctttacagtcacttgacctggaatttggatctggtttccaaccgcgtgtcttaccaacacagcccaatcctgtcgacgctagtagagcacaattcttccttcatctgtcacccagccattacgccctgctgcagtaccactacggtaccttgtctctgctaaaaaattttccccaaacagctctggtgtctttcgccaccacaggcgagaagaccgtcgccgctgttatggcttgccgtaacgaagtccaaaagtcctcctctagcgaggatggatctatgggatcgttcagcgagaagtcaagctccaaagacagcctcgcctgctttaaccaaacctacactatcaacttgtacctggtcgagacagggcgacggctcctggacaccactattacattctcacttgaacagtctggaacccgcccagagcgcctgtacattcaggtatttctgaaaaaggatgattctgtgggttatcgcgctctggtgcaaacggaggatcatctgctcctcttcttgcagcagttggccggaaaggtggtgctgtggtcaagagaggagtctctcgccgaagtcgtttgccttgaaatggtagacctacccttgactggagcccaggcagagctggagggagagtttggcaagaaggccgatgggcttttgggtatgttcctgaagagactatctagtcagttgatactgctccaagcctggacctcacacctgtggaagatgttctacgacgccagaaaacctcgctcacagatcaaaaacgagattaacatcgacacgctcgcgcgtgacgaatttaaccttcaaaagatgatggtaatggtcacagcaagtggaaagctgtttggaattgaaagttcgtccggtaccatcctatggaaacagtatctgcccaatgtaaaaccggattctagctttaaactcatggtgcagaggacaactgctcactttcctcacccacctcaatgcactttgctcgtgaaagacaaagagagtggaatgtcttctctgtatgtgttcaaccctatatttggaaaatggtcccaggtagcgcctccagtgctaaagagaccgattcttcagagcttgctactgcccgtgatggaccaggactatgccaaagtgctcctgctgattgacgatgagtacaaggtgacagccttcccagcgactcgcaatgttctacggcagctgcacgagctcgctccaagcatcttcttctatctggtcgacgccgaacagggcaggctgtgtggctatcgcctaaggaaggaccttacaaccgaactgagttgggaactgactatacccccagaggtacagagaatcgtcaaagtgaaaggtaagcgcagctccgagcatgtgcatagccaaggccgagtaatgggcgacaggagtgtcctttacaaatctcttaatcccaacctgctcgccgtcgtgaccgagtccacggacgcacatcacgagcgtacttttattgggatcttcctcattgacggtgtgacaggtcgaatcattcattcctctgtccaaaaaaaggccaaaggtccagtgcacattgttcactccgaaaactgggtcgtgtatcagtactggaatacgaaagcgaggcgcaatgagttcacagtcctggagctttacgagggtacagaacagtacaatgcgacagcgttcagttctctggatcggcctcagctcccgcaagtcttgcagcagagctatatattcccgtcatcaatttccgcgatggaagccactatcaccgagcgcggaatcacttctcgtcacctgttgatagggctcccaagcggcgcaatcctgtcgctcccaaaggccctcctagatcctcggcgtccggaaatccctacagagcagtcacgtgaggaaaacctgattccctatagtccggatgtgcagattcatgccgaacggtttatcaattataaccaaaccgtgtctaggatgcgtgggatctacacggcgcctagcggactggagtccacctgtctggtcgtggcctacggactggacatttaccaaacacgagtgtatccctccaaacagtttgatgtactcaaggatgactatgattacgtgttgataagctctgttctgtttgggttggtattcgccacgatgattacgaaaaggctcgcccaggtcaaactcctcaatcgggcatggcgatag

SEQ ID NO: 53110 - DNA, 4101 bp, Artificial Sequence
  Description of Artificial Sequence: Synthetic coding sequence
atgctgtttaagcaggccgaactatggatgccacatcagggcaaaggaaacaagggggagcctccatccgccctgggactgtccaccagaaaagccctctcggtgctgaaagagcagttggaggcggttctcgagggacaccttagggagaggaagaaatgcctgacatggaaagaggtctggagatccagctttctccaccactcgaatcgttgtagctgttttcattggcctggcgctagcttaatgctgttggcagttcttctgctactcggttgttgtggagggcagcctgctggcagtcgtggcgtcggtctagtgaacgcctctgccttattcctgctccttctgctaaacctcgtcctgatcgggcgtcaagacagactgaagaggagagaggttgaaagacgactgcggggaataattgaccaaattcaggacgctcttcgggacggcagggagatccagtggccctccgcaatgtacccggacctccatatgccattcgcaccctcgtggagtttacactgggcttatcgggatggtcacctggtcaacctaccggtctcactgctggttgaaggtgatatcatcgcccttagacctggccaggaaagcttcgcttctctgagaggcattaaggatgatgagcacattgtcctcgagccaggcgacctgtttcctcccttctccccaccccctagtccacgcggagaagtggagcggggaccacagtcgccgcagcagcacagactcttcagagtgctagagacacccgtcatcgacaatatccgctggtgcctggatatggccctctcacgcccagtgaccgcattagataatgaaagatttaccgtccagtcggtgatgctccactatgccgtacctgtggtgctggcgggtttcctcatcacaaatgctttgcgctttatcttctcagccccaggggttacctcatggcaatacaccctcctgcagctgcaagtgaatggcgttttacctatacttccattactgttcccggttttgtgggtgctggcaacggcctgcggcgaggcccgagttcttgcccagatgagcaaagcgagtcccagctctctactggccaagttctcggaagacacactttcgtcatacacggaggccgtctcctcccaggaaatgctgaggtgcatatggggtcacttcttacgggtcctgggtggtaccagccccaccctgagccatagcagctctttgctacactctctcgggagcgttaccgtcctctgctgcgttgataaacaaggaatcctgagttggcccaatccctcgccagagaccgttttatttttctctgggaaagtggaacccccacattcctcacatgaggatctcacagacgggttgtcaacacgctcattctgtcacccagagccccatgaacgcgacgcactactggccggaagtcttaacaacaccctccacctttccaatgagcaggagaggggtgattggccaggcgaggcccctaagcctccagaaccctacagccaccataaagctcacggacgcagcaagcaccctagtggatccaatgtgtcgttctctagggacaccgaaggcggagaagaggagccctccaagacgcagcctggcatggagtccgacccgtacgaggccgaggatttcgtgtgcgactaccacttggaaatgctctctctcagccaagaccagcaaaacccctcctgcatacagttcgatgacagtaattggcaacttcatcttacctccctgaaaccactggggctgaacgttctgctgaacctgtgcgacgcgtcagtgactgagcgcctgtgtcggttctccgatcatctgtgtaacatagcactgcaagagagccactccgcagtgctgccggtgcatgtcccctggggtctgtgcgagcttgcccgtctgatcggattcacaccaggtgccaaggagctgtttaagcaggagaatcacctggccctttatcgcctgccctcagcagagacaatgaaagaaacctccttgggcaggctgtcttgcgttactaagcggaggcctcctctgtcccacatgatttcccttttcatcaaagatactactactagtactgagcagatgctgtcccacggcaccgcagatgtagttctggaagcctgcacagacttttgggatggcgctgacatttacccattgagcggttcagaccggaagaaagtgctggacttctatcagcgggcttgcctgagtggctattgttctgcgtttgcatacaaacccatgaattgcgccctttcctcgcagttgaacggcaaatgcattgaactggtacaagtgcctgggcagtcatcaatcttcactatgtgtgaactcccttcaacaattcctattaagcaaaatgctaggagatcatcttggtcctccgacgagggcatcggtgaggtgctggaaaaggaagactgcatgcaggccctgagcggccagatctttatgggcatggtgtcctctcaataccaggcgagacttgacattgtcaggttgatcgacgggttagtcaatgcatgtattagatttgtgtatttttccttggaggacgaactgaaaagcaaggtgtttgccgagaagatgggccttgaaaccggatggaattgccacataagcttgacccccaacggtgatatgccaggaagcgagattcctccgtcttcaccatcccacgcaggaagtcttcatgatgatctcaatcaggtgagcagagatgacgccgaaggattgcttctgatggaggaggaagggcactcagatctgatctcgtttcagcctaccgattctgacataccgagtttccttgaggattcgaatagggcaaaactccctcggggaatacatcaggttcgaccccacctgcagaacatagataatgtcccacttttggttcctctattcaccgattgtacccccgagactatgtgtgagatgatcaaaattatgcaagaatacggcgaggtaacctgctgcctaggctccagcgcaaatcttcggaatagctgcctgttccttcagagcgatatctcaatagcccttgatccactctatccctcccgctgctcctgggaaacattcggctacgcaacaagtataagcatggcgcaggcctcagatggcctcagccctttacagctgagcggccagctgaactccctcccatgtagcctcactttccgccaggaagagacaatctcgattatccgcctgatcgagcaggccagacacgctacttacgggattagaaagtgttttctcttcctgctgcagtgtcagctcaccttggttgtgatccagtttctctcgtgtctggtgcaacttcccccactgctgagcacaactgatattttgtggctcagttgtttctgctatcctttgcttagtatttcccttttgggaaaaccaccccattcttccattatgagcatggcaacagggaagaatctgcagagtatcccgaagaagactcaacactacttcctattatgtttcttgttgaaattctctctcactatttcttcctgtttgatatgttttgggtttactctccaatcattctgcgatagctcccgcgaccggaacctcacaaactgtagcagcgtgatgctaccaagcaatgacgacagggcgcctgcatggttcgaagatttcgcaaacggacttcttagcgctcagaaactgaccgctgccctgatcgtgcttcataccgtgtttatcagcattactcacgtgcaccgcactaagcctttgtggagaaaatctcccctgacaaacctctggtgggccgtgaccgtgcccgtcgtcttattaggccaggtggtccagaccgcggtcgatctacagctttggacacacagagattcacacgttcatttcggcttagaggatgtgcctctattaacctggttactaggatgcctaagtctggtactcgtggtggtcaccaacgaaattgttaagctgcacgagattcgggttcgtgtaaggtatcagaaacgccagaagctccagttcgaaaccaagctggggatgaactccccattttag

SEQ ID NO: 53111 - DNA, 2004 bp, Artificial Sequence
  Description of Artificial Sequence: Synthetic coding sequence
atgtggctgcagcagaggttgaagggactgccaggtcttttgtccagttcctgggctagacgcttactatgcttgttgggtctgctgctcctgcttttgtggtttgggggttcaggagcacgccgagccgcagggggtctccatcttctgccctggtcccgcggagagccaggcgcagccgagcccagtgcatgtctggaggcggctaccagggcctggcggggtctgcgcgaaagaggggaggtcgttccgctcggcccaggtgttccagcacttgtagccaacggatttctcgctctggacgtagcagccaaccgcctgtgggtgacacccggtgaacgggagcctgcagtcgcacctgactttgtgccattcgtgcagttgaggcctctgtcagcgctggcagaagctggtgaggctgtgctgctgttgcgggagggcctgctccgtcgggtgcgctgcttgcagctaggatctcccggtcctggcccagtggcagctggccctggtcccgcttcagtgtctgggctggccgcagggagcggtagagattgcgtgctccttcaggaggactttctcgcgcatcgcggacggccacacgtgtacctgcagcggattcaactcaataacccaaccgagcgcgttgcagcattgcagaccgtggggccaaccgcgggtcctgctccgaaagcttttaccagcacccttgagaaggtgggtgatcatcaattcctactctacagtggacgttcgccaccgacgccaacaggcctggtccacctggttgttgtggcagctaaaaagctggtcaacagactgcaggttgctcccaagacccagcttgacgagacagtgctgtgggtggtacacgtgagcggcccaatcaacccgcaggtgctgaagtctaaggcggcaaaggagctgaaggcgcttcaggacctggcaaggaaggaaatgctcgagttgctggatatgccagcagctgagttactgcaagaccatcaactgctatgggcacagctgttcagtcccggtgtcgagatgaagaagattaccgatactcacacgccatcagggcttacggtgaaccttaccttgtattatatgctatcttgttcaccggcacctttgctgagtccttcactgtcacatcgcgaacgagaccagatggaatcaacccttaattatgaggatcactgtttttctggccacgcaaccatgcatgctgagaatctttggcctggacgactgagctccgttcagcagattctgcagctcagcgacctgtggagacttacactccaaaaacgcggatgtaaaggactggtgaaagtgggcgctccaggcattttgcagggaatggtcctctcctttggcggtttgcagtttaccgagaaccacttgcaattccaggccgaccccgacgtcctacacaatagctatgccctgcatggcatacgatacaagaatgaccatattaacctcgcggtactggccgatgccgagggaaagccctacttgcacgtatcagtggagagtagaggacagcccgttaaaatctacgcatgcaaggccggttgtctcgacgagcctgtggagttgaccagcgcccctacgggtcacacattcagcgtcatggtgacacaacctatcacccccctcctctacattagcacagacttgacccatttgcaggacctgcgccatacattacacctaaaggctatactcgcccacgatgaacacatggcccagcaggaccctggcctgccttttttgttctggttttcagttgctagcctgatcacactgttccatctcttcctctttaagctcatctacaatgaatactgtggaccgggagctaaacccttattcaggagcaaagtggggagccgacacctggttgagaccagaggtcttgggctggctctctctccagtttccaggaagggcttagcgtggcgcggaggagtacggccaggccaggaatgggtctcatag

SEQ ID NO: 53112 - DNA, 483 bp, Artificial Sequence
  Description of Artificial Sequence: Synthetic coding sequence
tttctccctgacaacttctcaccagccaagcctaaaccatctaaggacctgaagcctctgctcggttccgcagtgctgggtctcttgctcgtgctggccgctgttgtagcctggtgttactattcggtatctctccgcaaagccgagcgactcagggcggaactgcttgatttaaaggctggtgggttcagtatccggaatcaaaagggagaacaggaaccacagccgtttgtcacatctgacgtgtattcaagcgacgcagccttcggaggaattcttgagcggtattggctcagcagtcgcgcagctgctatcaaggtcaacgactccgttcccttccatctgggctggaatagtactgaacgctctctgcgcctccaggcacgttatcacgacacaccctataaacctcccgctggacgtgcggctgctcctgaactttcttacagggtgtgtgtgggttccgacgttacctctatatag

SEQ ID NO: 53113 - DNA, 3261 bp, Artificial Sequence
  Description of Artificial Sequence: Synthetic coding sequence
atgattgcagtcagtacagccaatggctacattcttttctttcacatcaccagtactcgtggggacaagtacctatatgaacccgtctatcccaaagggagcccacaaatgaaaggtactccgcactttaaagaggagcagtgcgcccctgcgctgaacctcgagatgaggaagattcttgatcttcaagccccaatcatgagcctgcaaagcgtgttagaagatctgcttgtggcaacgtccgatggcctcctgcaccttattcattgggaaggaatgaccaacggaaggaaagcaatcaatttatgtaccgtacccttctctgtggacctgcagtcgagcagagttggatccttcctgggcttcacagatgtccatattcgggatatggaatattgtgccactctggacgggttcgccgtagtgttcaatgacgggaaagttggtttcattactccggtttcatcccggttcacagccgagcagcttcatggagtctggccgcaggatgttgtagacggaacctgtgtggccgtaaataataagtatcgcctgatggcctttggatgcgtgtcaggatccgtacaggtgtacactatcgacaacagcacaggcgcaatgctgttaagccataaattagagttgaccgccaaacagtaccctgatatctggaacaagactggggctgtgaaattaatgaggtggtctcccgataactcggtagtgatcgtgacttgggagtacgggggtctcagcctttggagcgtctttggcgcacagctgatctgcacattgggaggggatttcgcatacaggtctgacggcactaagaaggacccccttaagatcaactctatgagctggggggcagagggctatcacctgtgggtaatttccggtttcgggagccaaaacacggagattgagtctgacctacggtcagtagtgaagcagccgtccattctcctattccagttcataaaatctgtcctcaccgtgaacccatgcatgtcaaaccaagaacaggtgctgctgcagggcgaggatcggctgtatttgaattgcggtgaggcatcccaaacgcaaaaccccaggagcagttccacccatagtgaacacaaacccagccgcgagaaaagtccatttgccgacgggggtctagagtcccagggcctgtcaacactgctgggacacagacattggcacgttgtgcagatctccagcacttacttagagagcaactggccaattcggttctctgctatagacaagttaggccagaatatcgccgttgtcggtaagttcggttttgctcattattctctattaactaaaaaatggaagctgttcggaaacatcacccaagaacagaacatgatcgtgaccggaggtctggcttggtggaacgattttatggtattggcgtgctataacatcaacgaccgccaagaagaattacgggtgtacttgcgcacctccaatcttgataacgcctttgctcacgtcacaaaggcgcaggccgagacgttattgctgagcgttttccaggacatggtcattgtcttccgagccgactgcagtatctgcctctattctatcgagcgaaagagcgatggacctaatacgactgctggcatacaggttcttcaggaggtcagcatgtccaggtatatcccccacccattcctggtggtttctgtaaccttgacaagcgtcagtacagagaatggaataactctcaaaatgcctcaacaagccagaggcgctgagagtattatgttgaatctggccggacaactgataatgatgcagagggataggtctgggcctcagataagggaaaaggactcaaaccctaataaccagcgaaaactgttgccgttttgtccccctgtcgtcctggcacagtctgtggagaatgtgtggaccacatgccgcgcaaacaagcaaaaacgacacctcttggaagccctctggctgtcgtgcggcggagctgggatgaaagtctggctgcccctgttcccaagggatcatagaaagcctcacagctttttgtcccagagaatcatgctgccctttcacatcaacatttatccactcgccgtgctctttgaggacgcactcgtactcggtgctgtgaacgatacactgctctacgatagcttgtacactagaaacaatgcacgcgaacagctggaggttctgttcccattctgcgtggtggagcgaacgtcacagatttatctgcaccacatcctccgccaacttctggttagaaatctgggggagcaggccttgcttctagcccaatcttgtgccaccttgccttactttccacacgtgcttgaattgatgctgcacgaggttctggaagaagaggctacaagcagggaaccaatccccgatccactgctccccacagttgccaagttcattaccgaattcccactgtttctccagactgtcgtgcactgtgccagaaaaaccgagtacgcgttatggaactacctgtttgctgctgtgggcaaccccaaggatctgttcgaggagtgtctgatggcacaagatctggatacggccgcttcatacctcatcatcctgcagaatatggaagtcccagcagtttcaagacagcacgccactctactgttcaacactgccctggagcaaggaaagtgggacttatgccggcacatgatcagatttctcaaggccataggctctggcgaatcagaaacaccccctagtacacccacagctcaggaacctagtagctcagggggtttcgagttcttcagaaataggagcatctcgctgtcacagtcagcggagaacgtgccagcctctaagttcagccttcagaaaacattatcgatgccaagcggccctagcggtaagcggtggagtaaggactctgactgtgctgagaatatgtacatagacatgatgctgtggagacacgccagaaggctcctggaggatgtgcggttaaaggaccttggctgcttcgctgcccaactcggctttgaacttatttcatggctctgtaaagaacgcacgagagctgccagagtggataatttcgttatcgctctgaagcgcttgcacaaagatttcctctggcccttgcccattatccctgcttcgtcaatctcatcgccttttaaaaatggaaaataccgcacgggaaacgtagatttcatgagtctggtccaaggtgagctgtattttactccctgtatctacactttttgttattag

SEQ ID NO: 53114 - DNA, 1335 bp, Artificial Sequence
  Description of Artificial Sequence: Synthetic coding sequence
atggctccaagttccagatgggacgccatgggacctaagaactcctaccgatcagttcatggcagaattgtccccgaactcctcgagagtagtgtggccagagttaggcctctgcagtacgttcagagacagccatcacaggcttccgctagaagtggggctaatcctacacataggccaagcgcagaggtcaggcctgtaataaggacgggcgagatgacccactcctcagtgattcctcctttggctccaggcgtaaggagagtctcccttgggtatgaatcgtcaccgagtggctccttgccaccactctttaatcaggaatctccatggcgtaggcaagattcctatagcccccagaaccctgccgtatcccacaaggcctctttaaacagtaccatcctacaaggacccgcagatgctggggttgtcggcggacagagttggaatagagcctgggagccagcgagaggggcagctagttgggacacgtggaggaacaaggcagtggtacctccaaggagaagcggtgagccaatggtcagtatgcaagctgccgaagaaatccggattctggccgtgattacgatccaggccggagtcaggggctaccttgctaggagacgcatccgattatggcacagaggtgctatggttatccaggccacttggcgtggataccgagtccgcagaaatctagctcatctgtgtcgtgcaaccaccacgatacagtccgcctggagggggtactccacgagacgggaccaggctcggcactggcagatgctgcatcccgtgacttgggtggagcttggaagccgagcaggtgtaatgagcgataggagctggttccaggacggccgagctaggacagttagcgaccatcgctgcttccagtcatgtcaggcccacgcctgtagtgtttgtcatagcctgtctagccggatcggcagccccccttcagtggtcatgctggtcggtagctctcccaggacctgtcatacgtgtggcaggacacaacctacaagagtggtgcagggaatgggccagggcactgaggggccaggtgccgtgagttgggcttcagcatatcagcttgcagccctgtcacctaggcaaccacacagacaggataaggcagccactgccatacagtcggcatggcgcggttttaaaatccgtcagcagatgcgccagcagcaaatggcggcaaagatagtgcaagccacctggcgtggccaccacacccgatcctgtctcaaaaacacagaggccttgctcggtccggcagacccatctgctagttcacgccatatgcattggccgggtatttag

SEQ ID NO: 53115 - DNA, 4104 bp, Artificial Sequence
  Description of Artificial Sequence: Synthetic coding sequence
atgaccttacagggcagggctgacctttcagggaatcaaggaaatgctgcaggacgcttggcgacggtgcacgaacctgtggtcacccaatgggccgttcacccacccgctcccgctcatccctctctcctggataagatggaaaaagcacccccacagccccagcacgaggggctgaaatcaaaggaacatctcccacagcaacctgcagaaggcaagacagcttctaggagagtgcccaggctcagagccgtcgtggaatctcaggccttcaaaaacatattggtcgatgaaatggatatgatgcatgcgagagccgcaaccttgatacaggcaaattggcgaggctactggctgaggcaaaaacttatcagccagatgatggcagccaaagccatccaggaagcttggcgacgattcaataaacggcacatcttgcactcaagcaagtccttggtgaaaaagactagggccgaagaaggcgacatcccatatcacgcccctcaacaggtcagattccagcaccccgaagagaataggttgctgagcccccctataatggttaataaagaaacacaattcccgtcatgcgataatctcgtgctctgccgcccacagtcatcccctctactccaaccacccgctgcccagggaacacctgaaccctgcgttcagggcccacacgcagctcgggtccgcggtctggctttcttacctcaccagactgtcactataaggttcccatgcccggtatcattggatgccaagtgtcaaccctgtctgctcacgcggacaatccggtcaacatgcctggtccacatcgaaggcgatagtgtaaagacaaagagagtcagcgccagaaccaacaaagctagggcgcctgagacccccctgtcccgtcgatatgatcaagctgtcacaagaccatcccgagcccaaacccagggacctgtcaaagccgagactcccaaggccccattccaaatttgtcccggacccatgataacgaaaactcttctccagacctacccagtcgtgagcgtgacattgcctcagacatatcctgcttccactatgaccacaaccccccctaagaccagcccagttcccaaggtaactattatcaagacccctgctcagatgtatcctgggccaacagttaccaagaccgcacctcacacctgtccaatgcccaccatgacaaagatccaggttcatcctacagctagcagaactggtactccacgccagacttgtccggctactatcaccgctaagaataggccacaagtttccctcctcgcttcaatcatgaaaagtttgccacaggtgtgtcctgggccagccatggctaagacgccaccacagatgcaccctgtgactactcctgccaagaatcctcttcagacttgtctgagcgctactatgagcaaaacctcatcccaaaggtcccccgtgggagttacaaaaccctctccccagacaagactccctgccatgatcacaaagacccccgctcagttacgctctgtggccacgattcttaagacactgtgcctagcgagtccgaccgtggccaatgtgaaggccccacctcaggttgccgtggccgctggaacccctaatacaagcgggtcaatccacgaaaatccacccaaggcgaaggctaccgtaaacgtaaagcaggccgcaaaagtagtaaaagcatccagtccctcatatttggcagagggcaagatccgatgcctcgcccagccgcatcctgggacaggggttcctagggcggctgcggaattaccactggaggctgaaaagattaaaacaggcacacaaaaacaggcaaagaccgatatggcatttaaaacatctgtggccgttgagatggcgggagccccaagctggaccaaggtggccgaggagggtgacaagccccctcacgtttacgtcccagtagatatggctgtgactctgcctcgcggacagctggctgcccctctgaccaatgcctcctctcaacgccaccctccatgcctgtctcagagacccttggccgctcccctgacaaaggcctctagccagggtcacctacccactgagttgaccaaaaccccaagcttggcccacttggatacgtgtttgtctaagatgcatagccaaactcatctcgcgaccggtgctgtgaaggttcagtcacaggcccctctggctacatgtctgaccaaaactcagagcaggggtcaacctattacagatattaccacttgtctcattccagcacaccaagccgcagacctctcttccaatactcacagccaggttttgcttactggcagcaaagtgtctaatcacgcttgtcagcgtctaggcggattgtcagcacctccatgggctaagccagaagatcgccagactcaaccccagccccacggccacgtacctgggaaaaccacgcaaggaggaccttgtcctgccgcatgcgaggttcaggggatgctggtgccaccgatggcacccaccgggcactccacttgcaatgtagagtcgtggggcgacaatggtgctacccgagcccaacccagcatgccagggcaggccgtcccttgccaggaagatacagtcggttctctccttgcctccttgtgcgcagaggtggctggagtgcttgctagccaggaagacctccgcacattactggcaaaggccctttcccagggagaagtgtgggcagcactgaaccaggccctgtccaaagaggtgctcggcgctactgttaccaaagccctcccacagagcatgttatccatggcgctggtgaaggccctgagctggtccgaactgcggctgacactcagtcgggctttgtctaggggcgagctccgggctgagcttactaaggttatgcaaggcaaactcgccgaggtgctatccaaggctctgacagaggaagaatgggtggcactaagccaggccctttgccagggggagctgggggcattgctgagccagtcatggtgtagagtggcactccggacaggaactatcctccctaaggcggcaagtaagtcaaccggttctggcgttactaagaccccagccctcgttaaagttgcatgcaggcgttcaccaagtgccgcttggggcccttccctgggtccggtgagacctcagacctccaaaggacccgctgacgcaggcgtggtgggaggtcagagctggaaccgcgcttgggaaccagctagaggcgctgcatcgtgggacacgtggcggaacaaggctgtcgtcccaccacgaagaagcggcgaacccatggtctctatgcaagctgcggaagaaattcggatcttagctgtcatcactattcaggccggagtcaggggctacctggctagacggcgtatcagattgtggcaccgcggagcgatggtgatccaggccacctggcgcggatatcgagtgcggaggaatctcgcccacctgtgcagggccaccacgaccatccaatctgcttggcgaggctatagtactcgtcgtgaccaagccagacactggcagatgctccacccggtcacctgggtggagctcggctcgagggctggtgtcatgtcagatagaagctggtttcaggatggaagggctcggacagtgagtgatcatcggtgttttcaatcctgtcaggcccatgcctgcagcgtttgtcatagcttgtcttctaggatcgggtctccgccttctgtcgtgatgctcgtcggcagctcgccacgaacctgtcacacctgtgggcgtacacaacctactcgagtagttcagggcatggggcagggcaccgagggcccaggtgctgtttcttgggccagcgcctatcagctcgcagctctaagccctcgtcaaccccacaggcaggataaggctgcaacagccatccagagcgcctggcgcggtttcaagattcgccagcaaatgcgccaacagcagatggcggctaagattgtccaggctacctggagaggtcaccacacacggagttgcctcaaaaatactgaggcgctgctaggacctgctgatccatccgcttcatcacggcatatgcattggccaggaatatag

SEQ ID NO: 53116 - DNA, 4833 bp, Artificial Sequence
  Description of Artificial Sequence: Synthetic coding sequence
atggcaggtttgagaaggccccagccaggttgttactgccgtacggccgcagcagttaaccttctgttgggggtgtttcaagtgctgctgccatgttgtagaccaggcggagcccaggggcaggctattgagcccttaccaaatgtggtcgaattgtggcaggcagaggagggcgaactgctgctgcctacccagggcgatagcgaggagggcctggaggagccaagccaagagcagagcttctctgacaaattgttctcgggcaagggccttcactttcagccatcggtgctggacttcggcatccagttcctgggccatcccgtcgctaaaattctgcacgcttacaatcccagtagggacagcgaggtagttgtgaattctgtgttcgcagctgccggtcatttccacgtgccgccagtgccttgtcgcgtgattccagccatgggaaagacaagtttccggatcatcttcctgccaactgaagaggggtccatcgagagctccctgttcatcaatacctcatcgtatggggttctgtcctaccacgtgtcaggaatcggaacaagacgcatctccacagagggatcagcaaagcagttgcctaacgcctatttcttgttgccgaaagtgcagagcatacagctttctcagatgcaagccgagactactaacaccagcctccttcaagtgcaattggaatgttcactgcataacaaagtgtgtcaacagcttaaaggatgctatctcgagtctgatgacgttcttcgcctgcagatgagcatcatggtgaccatggagaacttttctaaagagtttgaagagaacactcagcatctgctggaccacctctcaatcgtgtacgtggccaccgatgagtctgagacttctgacgacagcgccgttaatatgtatatccttcactcaggaaacagcctgatctggatccaagacattcggcacttttcccagcgcgatgcccttagtctacagttcgaacccgtacttttacccacctctaccaccaactttacgaaaatagccagttttacttgtaaagcagcaacatcctgcgatagcggtatcatagaggacgttaagaaaaccacacatacacctaccctcaaggcctgtcttttttcatctgttgcccagggctactttcgcatggacagcagtgcgacccaattccacattgaaactcacgaaaacacctccgggttgtggtctatctggtacagaaatcactttgaccgaagtgtcgtgcttaacgatgtgtttcttagcaaagagactaagcatatgttgaaaatactaaatttcaccgggccattatttctcccgcctgggtgctggaatatcttttccctgaagctggccgtgaaggatatcgctattaatctctttactaatgtgtttttgactacgaatattggtgccatctttgccatacctctccagatctactctgcccctactaaagagggttcattaggatttgaggttattgcacactgtggtatgcactatttcatggggaagagcaaagcgggaaacccgaactggaatggcagcctgtcccttgatcaatccacatggaatgtggatagcgagttggctaacaaactatacgaaagatggaaaaaatacaagaacggggacgtgtgcaagagaaacgtcctgggtacaactcggtttgcacacctcaagaaatctaaagagagcgagtcgtttgttttcttcctgcccaggctcattgccgaaccaggcctcatgctcaatttctccgcgacggccttgagaagccgaatgattaaatatttcgtggtacagaacccttcctcttggcctgtttccttgcagttgctgccgctgtctctgtatccgaagcctgaggccctggtccatttactgcacagatggttcggcacagatatgcaaatgatcaacttcactacaggggaatttcagctcactgaggcctgtccgtacctgggaacccacagtgaagagagtagattcggaattctccatcttcacctccagcccctagaaatgaaacgggtgggcgttgtgtttacacccgcagactatggcaaggtcacttctctcatcctaataaggaacaacctgacagtaatcgacatgataggcgtggaggggttcggcgctagggaactcctcaaggtgggcggaaggctgccaggtgccggaggatcactacggtttaaagtgcccgagtctaccctgatggactgcagacgacagctgaaagactccaagcagatcctcagcatcacaaagaattttaaggtggaaaacattggcccactgcccattacggtaagcagtcttaagattaatggctacaactgtcaaggctatggctttgaggtgctcgactgccaccaattttccctcgacccaaatacatccagggatatcagtatcgtctttacaccagacttcaccagctcctgggtgattcgcgacctgtcgctagtgaccgcagctgatctggaattcagatttactctcaatgtcacccttccacatcacttgctgccactgtgcgcggacgtggtgccaggcccttcctgggaagagagtttctggcgcctgactgttttttttgtgtctctttcattactgggagtcattctcatcgccttccagcaagcccagtatatactgatggaattcatgaaaacccgccagcgtcagaatgccagctcaagctcccagcaaaataacgggccaatggacgtcatctcaccccactcgtacaagtcaaattgtaaaaacttcctcgacacatatggaccctccgataagggacgcggtaaaaattgcctcccggttaatactcctcagtcacggatccagaacgctgctaaacgcagcccggctacctacggccatagtcagaagaaacacaagtgctcagtgtattactctaaacataagaccagcacagccgcagcctcttccacatccaccacaactgaggagaaacagacgagccctctcggatctagcctgcccgctgctaaagaggacatctgtactgacgcgatgcgtgagaattggatcagcctccggtacgccagtgggataaatgttaacctgcagaagaacctgactcttcctaagaatctcctaaataaggaggagaacaccttgaagaacaccattgtgttctcaaacccgagctcagaatgttccatgaaggaaggcatacaaacatgtatgtttccgaaggagaccgacatcaagaccagcgagaataccgcagagtttaaggaacgggagttatgccctttaaagactagtaaaaagctaccagaaaaccatctccctagaaacagtccacagtaccatcaacctgacctgccagagatcagccgcaagaataatggcaataatcagcaggttcctgtaaaaaatgaagtggatcactgcgaaaatttgaagaaggttgacactaagccctcgtctgagaaaaaaatccataagacttcgcgcgaggacatgttctccgagaaacaggacatccccttcgtcgaacaggaagacccttataggaagaagaaactgcaggagaaacgggaaggaaacctccagaaccttaattggtctaaatcacggacgtgtcggaaaaataaaaaaaggggcgtggccccagtgagtcgacccccagagcagagtgatctgaaattggtgtgctctgatttcgagcgaagtgaattatcctccgatatcaatgtgcgcagctggtgcatacaggaatccacacgcgaggtctgtaaagctgatgccgagattgcctcctctttgccagccgcacagcgcgaggcggaagggtactatcagaaaccagagaaaaagtgtgtcgacaagttttgttccgattcctcaagcgattgtggatctagctctggatccgtaagagcaagcaggggaagctggggaagctggtcatccacttcttcctctgacggggataagaaaccaatggtcgacgcccagcatttcttgcccgcaggcgactctgtctctcaaaacgatttcccttccgaggcccctatctcactgaacctgtctcataacatctgcaatcccatgacagtgaattctctgccacagtatgccgagccttcatgtccgtccctccctgcaggccctacaggagttgaagaggacaaaggcctgtattctcccggagatctgtggccaactcctccagtctgcgtgacgagcagtctgaattgcacgctggagaacggcgtgccttgtgttatccaggagtcagcccctgtgcacaattccttcatagattggtccgctacctgcgaagggcaattttcaagcgcatactgtccactcgagcttaacgactacaacgcattccccgaggaaaatatgaattacgccaacgggttcccttgcccagcagacgtgcagaccgatttcatagatcacaattcacagtccacttggaacactcctcctaacatgccagccgcatggggccacgcatccttcatcagctctcccccttacctgacttccacaaggtcactttcccccatgtcaggcctgttcggcagcatatgggcccctcaatctgatgtgtacgaaaactgctgtccgatcaatcccacaacagagcattctacacatatggagaaccaagccgtggtttgcaaggaatactaccccggatttaatccgttccgcgcatacatgaatttggatatctggaccacgacggccaataggaatgctaatttcccactgagccgcgactcctcttattgtgggaacgtgtag

SEQ ID NO: 53117 - DNA, 2385 bp, Artificial Sequence
  Description of Artificial Sequence: Synthetic coding sequence
atgactctgcaaggaagggcggatctttcgggaaaccaaggaaatgcggctggcagactggctactgttcacgagccggtggtgacacagtgggccgtacaccctccggcacctgcgcacccaagcctcctggataagatggaaaaggcacccccacagccacaacatgagggactgaaaagcaaggaacacttgccacagcaacccgctgaaggcaaaactgcctctaggagggtccccagactgcgagcagtagtcgaaagccaggcttttaaaaacattctagtcgacgagatggacatgatgcacgcccgtgccgctacactgattcaggcaaattggcggggatactggctgcggcaaaaactgatttctcagatgatggccgctaaggctatccaggaggcctggaggcgctttaacaaaagacatatcttacattcatctaagagtctggtgaaaaagacacgggcagaagagggcgacatcccataccatgcccctcagcaggtacgcttccagcaccctgaggagaaccgacttctgtcacctcccataatggtaaacaaggagacccagttcccgtcttgtgacaatctggtgctttgtagaccccagtcaagtccacttctgcagccgcctgccgctcaaggcacccccgagccctgcgtgcaagggccacatgccgcacgtgtcaggggcttagcttttctgcctcatcagaccgtgaccattcggtttccctgtcccgtgtccctcgatgcaaaatgccagccatgtcttctgactcgaaccatcagatctacttgtctggtgcacatagagggggatagcgtgaagaccaatgccagttctcagcggcacccaccctgtctgtcacaaaggcccctggcagctccccttacaaaggcaagcagtcaaggccacctacccaccgaacttaccaagacaccatccctggcccacttggacacctgcctcagcaagatgcatagccagactcacctggctacgggggctgttaaggtgcagtcacaagctccccttgctacatgtctgaccaaaacccagtcccgaggccagcccatcacagacattacaacttgtttgatcccagcccaccaggctgcagatctgtcttcaaacactcactcccaggtactgctgacaggctccaaagtgtctaatcatgcctgccaacggctcggaggcctttccgcaccgccatgggcaaaaccagaggacaggcagacacaaccacagcctcatgggcatgttcccggaaagaccacacaggggggtccatgtccagcggcttgtgaggtccagggcatgctggtgcctcctatggcccctactggccattcaacttgtaacgtcgagtcctggggggacaatggcgctactagagcacagccttcaatgcctggccaggccgtcccatgccaggaagataccgggcctgccgatgccggtgtggtaggcggacaatcttggaatagagcatgggaacctgcgagaggggcagcctcatgggacacttggagaaacaaagcagtcgttcctcccagaaggtccggagagcctatggtgagtatgcaggccgcagaagagattcggattctggccgtgatcaccatccaggccggtgttcggggatacctcgcgagacgtagaatccgtctttggcataggggcgctatggtcattcaggctacttggaggggctatagagtgcgcaggaacttggcccatttgtgcagagctaccactacaatacagtctgcgtggagaggatactcaacgcggagggatcaagctcgtcactggcaaatgctccatcctgtgacatgggtggaactgggatcccgggctggcgttatgagcgatcggtcctggttccaggatggcagagctcggactgtttccgatcaccggtgctttcagagctgtcaagcacatgcttgcagcgtgtgccactctctatcatcaagaattgggtcgccaccgagcgtcgtgatgcttgtcggatcgtcccccaggacttgccacacttgcggccgtacccagccaacaagggtggtccagggtatgggtcagggcacggaggggccaggggctgtgagctgggcctctgcatatcaactggccgcactcagtccacggcagccacatcggcaggataaagctgccacagctattcaatccgcatggcgcggatttaaaatccgtcagcaaatgaggcagcaacaaatggccgctaaaatcgtgcaggccacttggcgcggacaccacaccagaagctgcctcaagaatactgaggccctcctggggccagctgatccgagcgcctcatcacggcacatgcattggcctggcatttag

SEQ ID NO: 53118 - DNA, 4272 bp, Artificial Sequence
  Description of Artificial Sequence: Synthetic coding sequence
atgtactttttatccggctggcccaagcgcttgctatgtccactcggctcacccgctgaggcacccttccacgtacagtctgaccctcagcgagccttctttgctgtgcttgccgcagctcgcctcagtatttggtactctcgaccctctgtgctgatagttacctataaggagccagccaagagcagtacgcagtttggcagttacaaacaagcagaatggagaccagatagcaccatgatagccgtatctacggccaatggatacatactcttttttcacatcactagcacgcgcggagacaagtacctttatgaaccagtctacccaaaagggagcccacaaatgaaaggcacgccccatttcaaggaagaacagtgtgctcctgccctcaacttggagatgcgaaaaatcctggacctgcaagcccctatcatgagtctgcagtctgtgttagaggacctactagtggcaacatctgatggcttgttacatctaatacactgggagggcatgaccaatggtagaaaagctatcaacctttgcactgtccccttctctgtggaccttcagtcctcccgggtgggctcctttctcgggtttacggatgtacatatccgagacatggagtactgtgccaccctagatggatttgccgtcgtgttcaacgacggcaaggttggtttcatcacgcctgtctcgagcagattcacggctgagcagctccatggcgtctggcctcaggatgtggtggacggtacctgcgtcgccgtgaacaataagtatcgtctgatggccttcggctgcgtctccgggtccgtgcaggtctacaccatcgacaattcgaccggagccatgcttctctcccacaaactagagctgaccgcaaagcagtaccccgatatttggaataaaaccggcgcagtgaagctgatgcggtggtcccctgacaacagcgtagtaatagtgacatgggagtacggaggactttctctctggagcgtgtttggcgctcagctgatctgtaccctgggcggagatttcgcctaccgttctgatggaactaaaaaggaccctctgaagattaacagtatgtcgtggggagctgagggttaccacctctgggtgatttctggctttggaagtcagaatacagagatagaatccgacctccgctcagttgtaaagcaacccagcattctgttgttccagtttattaagtctgtactaaccgtgaacccctgcatgtccaaccaagagcaggtgctgctgcagggggaagaccgactctacctgaactgcggcgaggcaagccagacacagaacccaaggtctagtagcacgcattccgagcacaagccaagtagagagaagagccccttcgcggacggcggattagaatctcagggcctgagtaccctgctcgggcatcgtcattggcatgtagttcagatctccagtacgtatctggaatctaactggcctatcaggttctccgcgatcgacaaattgggccagaatattgccgttgttggcaaatttggattcgcacattacagcctcttaactaaaaagtggaagctgttcggtaacattacccaggagcagaacatgattgtcaccggagggcttgcttggtggaatgatttcatggtgctcgcgtgctacaacatcaacgataggcaggaggaactccgcgtgtatctgaggacttcaaatctggataacgccttcgcccacgtaacaaaggctcaagctgagactcttctgctttctgtattccaggacatggtcattgttttcagagcagattgctcgatctgtctttactcaatcgaaagaaagtcggatggtcctaacaccaccgccggaattcaggttctccaggaggttagcatgtctcgctacatcccgcatccatttctagtagtatcggttacgctcacttccgtgagcacggagaacggcatcactctgaaaatgcctcagcaagctaggggcgctgagtccattatgctgaacttggccggtcagctgattatgatgcagcgcgatcgttccgggcctcagatcagggaaaaggattccaatccaaacaatcagcggaaattgctaccattttgtccaccagtggttttagctcagagtgtggagaacgtgtggaccacatgtagagcaaacaagcagaagcggcatctgctggaagcactttggttatcctgtgggggagccggtatgaaagtctggctgccgctgtttcctcgcgaccatcgtaagcctcactcttttttgagccagagaattatgcttccctttcacatcaacatctatccgcttgctgtcctgtttgaggatgccctcgtccttggcgcagtgaacgatacactgctgtacgatagtctgtataccaggaacaatgccagggagcagctggaagtgctgttccccttctgtgtcgtggaacgcacctctcagatctacctacatcatatcttgagacagctgctggtaagaaacctgggcgagcaggccctcctacttgcacaatcttgtgctacgcttccctatttcccccacgttctagagcttatgctgcatgaggtcctggaagaggaagccacttctagggaaccaatcccagacccgctgctgcccaccgtagcaaaattcatcaccgagtttcccctcttcctgcaaactgtggttcattgcgcccgaaagacagaatatgcgttatggaactatcttttcgcagcggttggcaatcctaaagacctgttcgaagagtgtctgatggcacaggacctggacacagcggcttcatacttgattatcctgcagaatatggaggtgccagccgtcagtcggcagcacgccactctcctcttcaatactgccctggagcaaggcaaatgggacctgtgccgccatatgatcaggtttctgaaggcgatcgggtccggggagtccgaaactcccccttccacccccaccgctcaggagccttcatctagcggcggatttgagtttttcagaaaccggtccatcagtctttcgcagtctgcagagaatgtccccgcaagcaaattctccctacagaagaccttgtctatgccatccgggccttctggcaagcgatggagtaaggatagtgattgcgcagagaatatgtacattgacatgatgctatggcgtcatgccagacgcctgctggaggacgtgcgactgaaggacctaggctgtttcgccgcacagctgggctttgagctaatttcctggctctgcaaagaacgcacgagagcagcacgggtcgataacttcgtcatagcgctcaagcggttgcacaaagacttcctctggcctttgcctatcattcctgcctcatccatcagttctccatttaagaatggcaaataccggaccgtgggcgagcagctgctgaagagccagtccgccgacccctttctgaatctcgagatggatgcaggcatttctaatatccagagatcacagagctggttgagcaatatcggacctacccaccacgaaattgacacagcatctagccatggccctcagatgcaggatgccttcctgtcgccactcagcaacaagggggacgaatgttctatcggtagtgcaactgacttgacagagtcctcatccatggtcgatggcgattggaccatggtggacgagaatttttctactctgagcctgactcaaagcgagttggaacacatttctatggagttagcttctaaaggaccccacaagtcccaagtgcaactgcgctacctgctgcacatatttatggaggcaggctgcctggactggtgtattgtcatcggcctaatcctgagggagtcttctatcatcaatcagatcctcgtgattacgcagtcctccgaggttgacggcgaaatgctacagaacataaaaacaggactgcatgccgttgacagatgggcttctactgattgtcctggctacaagccttttctcaatatcatcaagccgcagctgcagaaactgagtgaaatcaccgaggaacaagtgcagccagatgcatttcagccaatcaccatggggaaaactcctgaacaaacctcccctagagccgaagagtctaggggctcctcttcccacggtagtataccacagggtgaggtgggctcctcaaatatggtttctagaaaagaggaagacactgctcaggccgaggaagaagaaccttttcaagatgggacgtacgactgttccgtgagttag

SEQ ID NO: 53119 - DNA, 4035 bp, Artificial Sequence
  Description of Artificial Sequence: Synthetic coding sequence
atgattgctgtaagcaccgcaaatggttatatcctattctttcatatcacatcaacaagaggcgacaaatacctatacgaacccgtctaccccaaggggtctccccagatgaaagggactccccacttcaaagaggaacaatgtgcaccggctcttaaccttgagatgcgaaaaatcctggacctccaggcccctataatgtctctgcagtcagtgctggaggaccttctggtggccacctcagacggcctccttcatttaattcactgggagggtatgacaaatggccgtaaggcaatcaatctgtgtacggtcccattttcagttgatttgcagtcctcacgggtaggctcctttcttggatttacagacgtgcacataagggatatggagtactgcgccaccctagatggatttgccgttgttttcaacgacggtaaggtgggattcattactccagtctcatcccgctttacagcagagcagctccacggggtgtggccccaggatgtggtggacgggacatgcgtcgctgtgaacaacaaatatcgactgatggctttcggttgcgtgtctggttcagtgcaggtttacacaattgacaacagcacaggtgcaatgttgctgagccacaagttggagttaaccgccaagcagtacccagacatttggaacaagaccggcgcagtgaaacttatgaggtggtcaccagataacagtgtggtcattgtgacttgggaatacggtgggttatctctgtggtctgtattcggagcacagctgatttgtacattggggggagacttcgcgtaccgctcagatggaaccaaaaaggacccactaaagatcaactcaatgagctggggcgctgaaggttaccacctttgggttatctccgggtttggaagccagaatacagaaattgagtctgaccttcggtcagtcgtgaagcagccatccattctgctgttccagtttattaagagtgtgctgactgtaaacccatgtatgtccaaccaggagcaagtcctcctgcagggagaagaccgtctatacctgaactgtggcgaggccagccaaacccagaatcccagatccagcagcacccattctgagcataaaccttcccgggagaagtcccctttcgctgacggaggcctggagagccaggggttatcaaccctgctgggccacaggcattggcacgtggtgcaaatttccagcacttacctagagtccaactggccaatacgcttttcggccattgataaactgggacagaatatcgcggtggtggggaagtttggattcgcacactattccctactcacaaaaaagtggaagctctttgggaatattacccaggagcagaacatgatcgtgactggtggcctcgcctggtggaatgactttatggtgttggcttgctataacatcaatgaccgccaggaagagctgcgtgtgtacctgcgcacctccaacttggataacgcatttgcacacgtcaccaaagcccaggcagagactctccttttatctgtgttccaggacatggtgattgtgttccgagcagactgctctatctgcctgtactcaatcgaacgaaaatcagatggtccgaataccaccgctggcatccaagtcctgcaagaggtcagcatgtccagatacattccccaccccttcctggtagtgagcgttacccttacaagcgtcagcacagaaaacggcataacacttaagatgccgcaacaggcgagaggtgccgaatcaataatgttaaatctggcagggcagctaatcatgatgcagcgcgatcggtccggtccacaaattagggaaaaggatagtaaccctaacaatcaacgcaaactgctgcccttctgtccaccggtggtgctggcccaaagtgtcgaaaatgtgtggacaacctgccgggcaaataaacagaaacgccacctcctggaggccctttggttatcttgcggaggagcaggaatgaaggtgtggttgccgctcttcccgagggaccatcggaaacctcatagttttctgtcacaaagaatcatgctcccattccacatcaacatctatcccctcgctgtcttgtttgaggatgccctggtactaggagcagtaaacgacacattactgtatgatagcctgtacacaaggaacaacgccagagagcagttggaagtgctttttcccttctgcgttgtggagagaactagccagatatatctacatcatatcctgcggcagctgctggtgagaaacttaggtgaacaggctcttttgctagcacagtcctgtgccaccctcccctattttccccacgtgctagagctgatgttgcatgaggtactcgaggaagaagcaacctctcgggagcccatccctgatcccctgctgcccacagttgcaaagttcattaccgagttcccgttattcctgcagaccgtcgtccattgcgctcgaaagaccgagtacgccctgtggaattacttatttgcagccgtcggaaacccgaaagacctgtttgaggaatgtcttatggctcaggacctggataccgctgccagctacttgataatcttacagaatatggaagtgcctgcagtgagccggcaacacgcgaccttgcttttcaacacagccctcgagcagggaaagtgggacctctgcagacacatgattcgtttcttgaaagccatcggcagcggtgaaagcgagactcccccatcgaccccgacggctcaggagccaagctccagtggcggtttcgagtttttcaggaacaggagtatttctctgagtcagtccgccgaaaacgtgcccgctagcaaattttccctacagaaaacgctttcaatgccttccggcccttctggcaaaagatggagcaaggattctgactgcgcggaaaacatgtatatcgatatgatgttatggcggcacgccagacgcctgctggaagatgtccgcctgaaggatctgggctgttttgcggcacagctaggattcgagcttatatcttggctgtgtaaagagagaactagggctgcacgcgtagacaactttgttatagccctgaagcggttgcacaaggacttcctgtggccattacccattatccccgcaagcagtatttcaagtccctttaagaacggcaagtatcggacggtgggggagcagctgcttaagagccaatctgcggacccattcctgaacctggagatggacgcaggtatttccaatatccaaaggtctcagagctggctgtccaacattggcccaacgcaccacgaaatcgacacggcctcatcacacgggcctcaaatgcaggatgcattcctttcccctctcagtaataagggtgatgaatgctctattggcagtgccacggacctgactgagagcagctctatggtagacggggattggacaatggtggacgagaattttagcactctatcccttacccaatccgagctggaacacatttctatggagctggcttcaaaaggcccacataaatctcaagtgcaattgcgctacctgcttcatatattcatggaagcagggtgccttgactggtgcatcgtcattgggctgattctaagagaatccagcatcatcaaccagatccttgtgataacccagtcaagcgaagtagacggggaaatgctgcagaacatcaagaccggccttcatgccgtggatcgttgggcgagcaccgactgcccgggatataagccatttttgaacataattaagccccaactacagaagctgtccgagatcactgaggagcaggtccagcctgatgcattccagcccattacaatgggcaagacccccgagcaaacatcaccaagagcggaggagagccggggaagttcgtcccatgggtctattccgcagggagaagtcggatcatcgaacatggtgtcaagaaaggaggaggacaccgctcaggctgaggaagaagagccttttcaagacgggacctatgactgttcagtgagctag

SEQ ID NO: 53120 - DNA, 3081 bp, Artificial Sequence
  Description of Artificial Sequence: Synthetic coding sequence
atggagaagcgcctgggcgtcaagcctaatccagcttcttggatcttatcaggctactactggcaaaccagtgcaaaatggctgaggagtctgtatctgttttatacttgtttctgcttttcagtattgtggctcagcaccgatgcctcagagtcacggtgtcagcagggaaagacgcagtttggggtgggcctgcgttccggaggcgaaaaccacttatggctactggaggggacacccagtctgcagagctgctgggctgcatgttgtcaagactccgcctgccatgtgttttggtggctagagggaatgtgcatccaggcagactgttccaggccacagtcatgcagggcctttcgtacacactcctcaaattccatgcttgtctttttgaaaaaattccagaccgcagacgatctcggcttcttgccagaggatgatgtgcctcatctcctgggcctaggatggaattgggcctcttggaggcagtctccgcctcgcgcagccctgcgaccggcagttagctcctccgaccagcagagcttgatccggaaattgcagaaaagagggtccccatcagacgttgttaccccaattgtgacacagcattctaaagtaaatgattctaatgagctgggcggactaacgacatctggctccgctgaggtccacaaagctatcaccatcagctctcccctcactacagacctcaccgccgagctaagtgggggacctaagaatgtgagtgtgcagccagagatttctgaaggacttgcgaccaccccgtccactcagcaggtgaagtcatctgagaagacgcagatcgccgtgcctcaaccagtggcacccagttactcttacgctacacccaccccacaggcctcgttccagtctaccagtgcaccatatccagtcataaaggagcttgtcgtttctgccggtgagagtgtgcagattactctaccaaaaaacgaagttcagctcaacgcctacgtgcttcaagagccacctaaaggcgagacttacacttacgattggcaactcattacgcatccgagagactactccggggaaatggagggcaagcattctcagatcttaaagttgtctaaattgactcccggactgtacgaattcaaagtcattgtagagggccagaatgctcatggggagggctacgtgaatgtcacggtgaaaccagaaccaaggaaaaatcgacctccaatcgcaattgtgtcgcctcagttccaggaaatctcgctgcctaccacctcgaccgtcattgatggcagtcagagtaccgacgatgataagatcgtccaataccactgggaagaacttaaaggtccgctccgtgaggaaaaaatctctgaggacacagccattctgaagctatctaagttagtcccaggtaattacactttttcactcactgtagtcgactcagatggtgccactaattccacaaccgccaacctcacagtgaataaggctgtcgactacccacccgtggccaacgcaggacccaatcaggtgatcaccctccctcagaattccattaccttattcggcaaccagtctaccgacgaccacggcattacctcatacgaatggagtctctcccctagtagtaaaggtaaagttgtggagatgcagggggtccgtactccgaccttgcaactatcggccatgcaggaaggcgattatacctatcagctcacagtaaccgatactatcggtcaacaggcaaccgctcaagtgactgttatcgtgcaaccagagaacaacaagcctccccaggccgacgccggacctgacaaagagctcaccctcccagtagattctactacactggacggatctaaatctagcgacgatcaaaaaattatcagctatctttgggaaaagacccaaggccctgatggagtccagttagaaaatgcgaacagtagcgtggccaccgtgaccgggctgcaggtgggcacttatgtgttcacccttaccgtaaaggacgagagaaatctgcagagtcaatcaagcgttaatgttatcgtcaaagaggagatcaacaaacccccaatagctaagatcacagggaatgtagtgataacattgcctacttctactgccgaattggacgggtctaaaagctctgacgataaaggtattgtgagctatttgtggacaagggacgaaggctcacctgctgccggtgaagtgttgaatcattccgaccatcatccgattctgttcctgtctaatcttgtggaaggcacttacactttccacctcaaggttactgacgcgaagggggaatctgacacagatcgcacaacagtcgaggtgaaacccgacccccgtaagaacaacctcgtggagatcattcttgacattaatgtgagccaattgaccgagaggctgaagggcatgttcattcgccagataggggtcctgctgggtgttttggatagtgatatcatagtccagaagattcagccctacactgaacagtctaccaagatggtgttcttcgtacagaatgagccaccccaccaaatttttaaaggacatgaagtggccgctatgctcaagagtgagctgagaaagcagaaggctgacttcttgattttcagagcattagaggtaaatacagtcacctgccagctgaactgctctgatcatggacactgcgatagctttactaagagatgcatttgcgacccgttctggatggagaacttcatcaaagtgcagttgcgggatggcgacagcaattgtgaatggtccgtactgtacgtgatcatagcaacctttgttatagttgtggccctcggcattctgagttggactgtaatctgttgttgcaaacgccagaagggtaagccgaaacgaaagtccaaatacaaaatcctggatgccacagaccaggaatcactcgaactcaagccaacgagcagggccggaattaaacagaaaggactactgctaagctcgtcactgatgcactccgagtcagagttggatagcgatgacgctatcttcacctggcccgaccgcgaaaaaggcaagctattacattag

SEQ ID NO: 53121 - DNA, 3405 bp, Artificial Sequence
  Description of Artificial Sequence: Synthetic coding sequence
atggaaaaggccccacctcagccacagcacgagggcctgaagtctaaagaacacctgcctcagcagccagctgaaggcaagaccgcatcaagacgggttcctagactgagggcagttgttgagtcccaagctttcaagaatattttagtggacgagatggatatgatgcatgccagggcggcaactcttattcaagcaaactggcgcggatactggctccgccagaagctgatatcccagatgatggccgctaaggctattcaggaggcgtggagacggttcaacaagcgccacatactgcatagttctaagagcctcgtgaagaaaaccagagccgaggagggagacattccataccacgctccccagcaggtcaggttccagcatcccgaagagaaccgcttactgtctccaccgattatggttaacaaggaaacgcagtttccttcatgcgacaacctggtcttgtgtagaccacagagcagtcctctccttcagcctcccgcagcgcaaggtacaccggaaccatgcgtgcagggcccacacgccgcacgcgtgagaggcctggctttcctgccacaccagaccgtcaccatcaggtttccatgtcctgttagtctggacgccaagtgccagccttgccttctaacaaggacaatccgctccacctgcctggtgcacattgaaggagattccgttaaaaccaagcgagtgagtgcccgaactaataaggctcgggctccagaaacacctctaagtcggagatacgatcaggccgtaacacgacctagcagagcccaaactcagggacctgtgaaagccgaaacgcccaaggccccatttcaaatttgcccaggcccaatgatcacgaagactctgctccagacctacccagttgtatcggtgacactgccccagacttacccagcttccaccatgactacaacccccccaaaaacatcaccagtgcctaaagtgacaattatcaagacccctgctcagatgtatcctggtccaaccgttactaagactgcacctcatacatgtccgatgcctactatgactaagatccaggtccaccctactgcttccagaactggcacgcccaggcagacgtgccctgcaacaatcacagccaaaaaccggccacaagtgagcctgctcgcatccataatgaagagtttacctcaggtgtgtccaggtcccgcaatggcaaagaccccgcctcagatgcaccctgtcacaactcctgccaagaatcctttgcagacatgtctaagcgcgaccatgtctaagacctcaagtcagaggagtccggttggtgtgactaagccctctcctcagacccgacttccagccatgatcactaagactcctgcccagctgaggtccgtggctactattctcaaaacgctttgcctagcctctcccactgtcgctaacgtcaaggcgccacctcaggttgccgtcgccgctggaaccccaaacacaagcggatctatccatgagaatcccccaaaggccaaggctacagtgaacgttaagcaggccgcaaaggtggtcaaggctagttcaccctcctacctggcggaaggaaagatccggtgtctggcacagccacatcccggaaccggcgtgccacgcgcagctgccgaactgccactagaagcagagaagatcaaaactggtacacaaaaacaggctaagactgacatggcctttaaaacatccgtggcggtcgaaatggctggggctccatcatggactaaagtcgctgaggagggtgacaagccccctcacgtctacgtgcccgtcgatatggccgttacactacccagaggacagctggccgctcctctcaccaacgccagttctcagagacaccctccatgtctgtcacaacgaccccttgccgctccactgacaaaagccagctcacagggtcatttgccaactgaactcactaagacacctagcctagcacacctggatacctgtctcagcaagatgcacagtcagacacacctggctactggagctgtgaaggtgcaatcacaggcacccctagctacctgtcttacaaaaacgcagtctcgaggccagccaatcacagatattacgacctgtctgattcctgcgcatcaggcagccgacctatcaagtaacacacatagtcaagtgttgctcaccggctcaaaagttagcaaccacgcttgtcaacgccttggcggattatccgctccaccttgggcgaaaccagaagatcgacagacgcagccccagccacacggccatgtgcctgggaagaccactcaaggaggcccatgccctgccgcatgtgaggtccagggtatgctggtccctcccatggcacctaccggccacagtacgtgcaacgtagagtcatggggcgacaatggcgctacgagggcgcagccatcaatgccgggtcaggcggtcccctgccaggaggatacaggtcccgctgacgccggagtggtgggcggtcagtcatggaatagagcctgggagccggctcgcggtgcggcatcttgggacacctggaggaacaaagctgtggtgcctcctcgcagaagcggcgagccaatggttagcatgcaggctgctgaggagatccgcatcctcgccgttatcactatccaggcaggtgtacggggatacttggccaggaggagaataaggctgtggcaccggggtgccatggtgatccaggccacgtggaggggctatagagtgaggaggaacctggctcacctttgtcgcgcaacgaccactatccaatctgcttggaggggttactctacgcggcgagatcaggctagacattggcaaatgttacaccccgtcacctgggtggaactcggaagccgcgcaggtgtaatgtccgaccgcagttggtttcaggacggaagggcccgaaccgtgtcagaccatcggtgctttcagtcctgccaggcacacgcgtgctcagtatgtcacagcctgtctagccggattggttcccccccaagcgtcgtaatgcttgtcgggagctccccaaggacttgtcacacctgcggacgcacgcagcccaccagagtagtgcagggaatgggtcagggaactgaagggcctggggctgtgtcttgggcttccgcctatcagctggccgcactgtccccacgacagccacaccgacaggacaaagccgctactgctattcagtccgcgtggcgcggttttaaaatcaggcagcaaatgaggcagcagcaaatggccgctaagatcgtgcaggccacatggcgcggacatcatacccgatcctgtctgaagaacaccgaggcattgctggggcctgccgacccctctgctagttcccgccacatgcactggcccggaatttag

SEQ ID NO: 53122 - DNA, 2058 bp, Artificial Sequence
  Description of Artificial Sequence: Synthetic coding sequence
atggagaaacgattaggcgtgaaaccaaacccagccagctggattctctctgggtactattggcagacttccgcaaagtggctgcgctcattgtaccttttttatacctgtttctgttttagcgtgctgtggttatcaaccgatgcgagcgagagtaggtgtcaacaggggaaaacccaatttggcgtggggctccgcagcgggggtgagaatcacctgtggttgctggagggcacccccagcctgcagtcttgctgggcagcttgttgtcaggactcggcttgtcatgtcttctggtggctggagggcatgtgcatccaagcagattgcagtcgaccccagagttgtcgtgcattccgcacccacagctctaatagtatgctggtgttccttaaaaagtttcagacggccgacgacttaggatttctacccgaggatgatgtgccccacctgctgggcctcggatggaattgggcctcctggcggcagagcccacctagggccgcacttaggcctgccgtgtcgtcgtcggaccaacagagcttgattagaaagctgcagaaacgaggaagcccgtccgacgtggtcacccctattgtaacccagcacagtaaagtcaatgatagcaacgaactgggcggtttgaccacctcaggttctgcagaagtccataaagccattacaatttcgagtccgctgacgacagacctcacggcggagctttcaggagggccaaagaatgtgtctgtgcagccagagataagtgagggcctggcaaccactccctctacacagcaggtaaagtcatctgagaaaacccaaatcgccgttccccaaccggtggccccatcatattcctatgctaccccaacccctcaggcatcttttcagagtacttctgccccttaccccgtgatcaaggaactagtagtaagtgcaggagagtccgtacaaattactctgccaaagaatgaggtacaattgaacgcctatgtgctgcaggaaccccctaagggtgagacctacacatacgactggcagttaatcacacacccacgggactactccggagaaatggagggtaagcactcacagatcttgaagctatcaaagctaacacccggtctgtatgaattcaaggtgattgtggagggccagaacgcgcacggggaaggatatgtcaacgtcacagttaaacccgaaccgaggaaaaatagaccgccaattgccattgtaagtccacaatttcaggagatttcccttccaacaacaagcacagtgattgacgggtcccagtccaccgacgatgacaaaattgttcagtatcactgggaagagctgaagggaccgttacgggaggaaaaaatctccgaagataccgccatcctaaagctgtcaaagcttgtgcccggtaactatacattctccctgaccgtcgttgatagcgatggggcaacgaatagcactacagcgaatctcacagtgaataaggccgtggactaccctccagtggctaacgccggacctaaccaagtaatcacactcccacagaactcgatcaccctgtttggaaatcagtcaactgatgatcatggaatcactagttacgagtggtctctttctcctagttctaagggtaaagtcgttgaaatgcagggcgtgcggacacccactctacagctgtctgcgatgcaagagggtgattatacatatcagctcacggtgaccgatactattggccagcaggccactgcccaggtaactgttattgtacagccagagaataataagcctccgcaggccgacgccggtcctgataaagaactgacactcccagtggattccacgacactggatgggtcaaaaagcagtgacgaccagaaaatcatcagctacctgtgggagaagacccaagggccagatggagttcagctggaaaacgcaaattcctccgtcgccacggttaccggattgcaggtggggacttatgtgtttacattaactgtgaaagatgaaagaaatctgcagagccagtccagtgtgaatgtgatagtgtag

SEQ ID NO: 53123 - DNA, 4581 bp, Artificial Sequence
  Description of Artificial Sequence: Synthetic coding sequence
atggctggactgagacggcctcagcctggttgctattgtcgcaccgccgctgccgtgaatctgctgctgggggtcttccaggtgctgcttccttgttgcagaccgggaggcgctcaggggcaagcaatcgaacccctgccgaatgtcgtggagctgtggcaagccgaagaaggggagcttcttctgccgacgcagggtgactccgaagaaggactcgaagaaccatctcaggaacagagcttttctgacaagctgttcagcggcaagggcctccattttcagccatcagtgctggatttcgggatacagttcttagggcatcctgtggcaaagatcctccacgcgtacaatccctccagggattccgaggttgtggtaaactccgtgtttgctgccgctggacactttcacgtgcctcccgttccttgtagagtcatccccgcaatgggaaaaacttcctttcgcattatttttctcccaaccgaggaaggaagtatcgaaagctctctcttcattaatacaagcagttatggtgtgctttcttaccatgtatcaggcatcgggaccaggcgcataagcaccgagggctccgcaaagcagctgccaaatgcatattttttgcttcccaaagtgcaaagtatccagctctctcagatgcaggccgaaacaactaacacatcgcttctgcaggtgcaactcgagtgtagtctccacaataaagtctgtcaacagctgaaggggtgttatctggagtcagacgacgtcctgcggctgcaaatgtccataatggtgacaatggagaacttctctaaagagttcgaagagaatactcaacacttgctcgaccatctgagtatagtgtacgtggcaacagacgaatccgagactagcgatgattctgcagtgaacatgtacatccttcatagcggcaacagccttatctggatccaagacattaggcacttcagtcagagagacgcattgtcccttcagttcgaaccagtgctgctgcctacatcaacaaccaacttcacgaagatcgcttcctttacatgtaaggccgcaaccagctgtgacagcggcataatcgaggatgttaaaaaaaccacccacacgccaaccctcaaagcttgtctgttctcctccgtggcacagggctattttcgcatggactcaagtgccacccaattccacattgagacccacgagaatacaagtggcctatggagcatctggtataggaaccacttcgatcgctctgtggttttaaacgacgtgttcctgtccaaagagactaagcatatgctaaaaatcctgaatttcaccggtccactctttctcccacccggatgttggaacatcttctctctcaagctggcagtgaaggatattgccatcaatttattcacgaacgtgttcctcaccacaaacattggcgctatctttgccattccactgcagatttatagcgctcccaccaaagagggatcgcttgggttcgaagtcatcgcccactgcggcatgcactactttatgggaaagtccaaggctggaaaccctaattggaacggcagcctgtcactagatcagtccacttggaacgttgatagtgagctggctaacaaactttacgagagatggaagaagtataagaacggtgacgtttgcaagtttggcaccgacatgcagatgatcaacttcaccacgggggagtttcaactgaccgaggcctgcccataccttggcacacactccgaggagagcagatttggcattctacacctgcatctccagccattagaaatgaagagagtgggtgtcgtgttcacgcccgcagattacgggaaagtcacatccctcattctgattcgcaataatttaactgtgatagacatgatcggagtcgaagggtttggagcgagggaactgttgaaggttggcggtagactcccgggagccggaggtagtctcaggtttaaagtcccagagagtacgttgatggattgtcgcaggcagctgaaagatagcaaacagattctttcgataactaaaaactttaaggtcgagaacatcggacccctgcccatcacagtgagcagcctcaagatcaatggttataattgccagggatatggctttgaagttctggactgccatcagttctccttggacccaaatacaagccgtgacatctctatcgtgtttacgccagatttcacatcaagctgggtcattcgcgacctgtcactcgtgaccgccgcagatctggagtttaggtttactttaaacgtgacgctgcctcatcatctcttaccgctgtgtgcggacgtcgtgcctgggccatcttgggaggaatccttctggcgcttgaccgtgtttttcgtgtcgctgagcttgctgggcgtgatcctgatagcctttcagcaggcacagtacatactgatggagtttatgaaaacgagacagaggcagaacgcttccagctcctcccagcagaataatgggccaatggatgtgatcagccctcactcctataagtccaactgtaagaactttctggatacctacggccctagcgataaaggtcgagggaaaaactgcctaccagtgaataccccgcagtctagaattcagaacgcagccaaacggagtcccgcaacatacggacattcgcagaagaaacataaatgttccgtctactatagcaagcacaagacatctactgcagccgcatcctctactagcaccactacagaagaaaagcagaccagcccccttggaagctcactcccagccgcaaaggaggatatttgtaccgatgctatgagagagaattggatctcattaaggtacgcgtctggcatcaacgttaatctccagaagaatctcacactgcctaagaacctcctgaacaaggaggaaaatactttaaaaaatactattgtgttcagcaacccctcctcagaatgcagcatgaaagaagggatccaaacgtgcatgttccctaaagagacagatatcaagaccagcgagaataccgccgagtttaaggagcgcgagctttgccccctgaaaacatcgaaaaagctgccggagaaccacctgccgcgtaactcacctcagtaccatcaacccgatctgcctgagatcagcaggaaaaacaacgggaataatcagcaggttcccgtcaagaacgaggtggaccactgtgagaacctgaaaaaggtcgacaccaagccatcctctgagaaaaagatacataagacaagccgcgaagatatgttttccgagaaacaggatattccgtttgtcgagcaggaggatccctacagaaagaagaagctccaggaaaagagagaaggcaacctgcagaacctgaattggagcaaaagtcggacttgtagaaaaaacaagaagcggggagtcgctcctgtatccagacccccagaacagagcgatttgaaactcgtctgttccgattttgagcggtcagaattgtcatccgatatcaacgtgcgtagctggtgcatccaggagagtacgcgcgaggtatgcaaagctgacgccgagatagccagcagcctcccagccgctcagcgggaagccgaagggtattaccagaaaccggaaaagaaatgcgtagataagttttgtagtgattccagttccgattgtgggtccagttcaggttccgtacgggcttctagagggagttggggctcatggtccagtacctcttctagcgacggagataaaaagcccatggtagacgcccagcatttcctgcctgccggagattctgtttcccagaatgacttcccaagtgaagccccaatatctctgaatctgtcccacaacatatgtaatcctatgacagtaaatagcctcccgcaatacgcagaaccgagttgtccttctctccccgctggccctacaggtgtggaggaggataaggggctgtactctcctggcgatttgtggccaactccgccagtgtgtgtgacgtcgtcacttaactgtactcttgagaacggtgtcccatgcgtgatccaagagtcagctcctgtgcataactctttcatcgattggagcgccacttgtgaaggccaatttagctcagcgtattgccccctggagctcaatgactacaacgccttccccgaggaaaatatgaactatgcgaacgggttcccatgcccggctgatgtacagacggactttatagatcacaactcccagtcaacctggaacaccccccctaacatgcccgctgcatggggccacgctagctttatttcctctccgccatatctgaccagcacaaggtcactatcccctatgtctggtctcttcggctctatctgggccccacaaagcgatgtctacgagaattgttgtcctatcaacccgacaactgagcattctacccatatggaaaaccaagccgtcgtgtgcaaggagtattacccgggatttaacccctttagggcctatatgaatctggacatctggacaaccacggcaaacaggaatgccaatttccccctgtctcgggactcttcctactgcggaaatgtgtag

SEQ ID NO: 53124 - DNA, 3924 bp, Artificial Sequence
  Description of Artificial Sequence: Synthetic coding sequence
atgatcgccgtgagtacagcaaacggctacattcttttctttcacattacctccaccagaggggacaaatacctgtatgagcctgtctacccgaaaggatctccccagatgaaaggaacgcctcacttcaaagaggaacagtgtgccccagctctcaatctagagatgcgaaaaatcttggatctgcaggcccctataatgtcactgcagtcagtcctcgaggatctgttggtggcaacttccgacggtctcttgcatttaatccactgggaggggatgaccaatgggagaaaggctataaatctctgcactgttccttttagcgtcgacctgcagtccagcagagtcggaagtttcttgggattcacagacgtgcacatacgcgacatggaatattgcgcaaccctcgatggctttgccgtggtgtttaacgacgggaaggtcggatttatcactccagttagtagtaggtttactgcagaacagctacacggtgtctggcctcaagacgttgtggacgggacttgtgtcgccgttaacaacaagtacaggctgatggcgttcggctgcgtctccggcagcgtacaggtttatacaatcgacaatagtaccggcgcaatgctgctgtcccataagctggagctgaccgccaaacagtatccagacatttggaataagaccggagctgtgaagctgatgagatggtctccggacaacagcgttgtgatcgtgacttgggaatacggcggtctaagcctctggtcagtgtttggcgcacaactgatatgcacgttagggggagactttgcctatcgctccgatggaactaagaaagatccactcaaaatcaattccatgtcatggggcgctgaagggtaccacctgtgggtcatcagcggctttggcagtcagaatactgagatcgaaagcgacttaaggtctgtcgtgaaacagccctccatcctactcttccaattcattaagtcggtcctgacggtgaatccttgcatgtctaaccaagagcaggtgctgctgcaaggagaggataggttgtacctgaactgcggagaggcatcacagacacagaaccccagatctagcagtactcattcagagcataagcccagtcgagaaaaatcacctttcgccgacggcggactagagtcacagggcctctcaacgttattggggcatagacattggcatgttgtgcagattagttccacctacctcgagagcaattggcccatcagagaacagaacatgattgtcacaggcggactggcttggtggaatgacttcatggtgctggcctgctacaatattaacgatcgccaggaagagttgagggtctatctacgaacctctaatctggacaatgcatttgctcacgtgacaaaggctcaggccgaaacattgcttctctcggtgtttcaagacatggtgatcgtgtttcgggctgattgttcaatttgtctctactccatcgaacgcaagtctgatggaccgaacaccaccgccggtattcaggtcctgcaggaagtgagtatgagcaggtatatcccgcacccatttctggtcgtgtccgttacacttacttccgtgagtaccgagaacgggattactcttaagatgccccaacaagctaggggcgcagaatcaatcatgctgaatctagccggtcagctcatcatgatgcagagagatcggagcggtccacagatccgggaaaaagatagcaatcccaataatcaacgtaagctgctccctttttgccctcccgtggttttggcgcaatccgttgaaaacgtctggacaacctgtagggccaataagcaaaagcggcacctgctggaggctctgtggctatcctgcggcggagctggaatgaaggtgtggttgccactgtttccgcgtgatcataggaagccacactcctttctcagccagcgcattatgctgccgttccacataaacatctatcccctggctgttctgttcgaagacgctcttgtcctgggtgctgtcaacgatactctgctctacgactccctctacacgaggaacaatgcaagggaacaacttgaggtgctcttccccttttgtgtcgtggaaaggacatcccagatttatcttcatcacatcctgcgccagttgttagtccgaaacctcggggagcaggcactcctactggcccagtcctgtgccaccctgccttactttccccatgtgctggagctgatgctgcatgaggtcttggaagaagaagccacgtccagagaaccaatcccagaccctttgctccctaccgtggcaaaattcataactgagttccccctgtttctgcaaacagtggttcactgcgcccgtaagacagagtatgcactctggaattatctgtttgcagcagtaggcaaccctaaggacctttttgaggagtgtctgatggctcaggacttggacactgccgcttcctatctgatcattcttcaaaacatggaggttcccgcagtgtcacgccagcacgccactctcctgttcaatactgcattggagcagggcaagtgggatctgtgtcggcacatgatcagattcctgaaagcaatcggatcaggggagtcggaaacgccaccaagtacccctaccgcccaggaacccagctcctcaggtggatttgagttttttagaaaccgcagcataagcctgagtcagagcgctgagaatgtacctgcttctaaattctctttacagaagacactttctatgccttccgggccttccgggaagagatggagcaaagactccgactgcgccgaaaacatgtacatagatatgatgttatggcggcatgccagaagactgcttgaggatgtacggctcaaagatctcggctgctttgcagcgcaactgggctttgagctgatcagctggctgtgcaaagagcgcacgcgcgcagcacgggttgataacttcgtcatcgccctcaagcggcttcataaggactttctctggccattgccaataattccagctagctccattagctcgcctttcaagaatgggaagtaccggactgtaggcgagcagttgcttaagtctcagagcgcggacccctttctgaacttggagatggatgctggtatttccaacatccagagatctcaatcttggcttagcaatattggacctacccatcacgagatagacaccgcttctagtcacggaccccagatgcaggacgccttcctgtcacccctatccaataagggcgacgaatgctctattggctctgctacagacttgacagagtcctcctcaatggtagatggggactggacaatggtagatgagaatttcagcaccctgtccctgacacaatcagaactggaacatatctcgatggagctcgccagtaaaggaccgcacaagagccaagtacaacttcggtatcttctgcacatctttatggaagctggctgcctggattggtgtattgtgatcggcttgattctgagggagtcctcaattattaatcagatcttggtaattacccagtcaagcgaagtggacggagagatgttacagaatatcaaaaccggactgcacgctgtagatcgatgggctagtacagactgccctgggtacaaaccattcctaaacattatcaaaccgcaactccagaaactttctgaaattaccgaggagcaagtacagcccgatgcttttcagcccatcacaatgggaaaaacgcccgagcagactagtcctcgagcagaagagagtagaggttcatcaagtcatggctcaatcccccaaggtgaggtaggcagcagcaatatggtgtctcggaaggaggaggatactgctcaggcagaggaggaggaaccatttcaagacggcacctacgactgtagtgtcagctag

SEQ ID NO: 53125 - DNA, 822 bp, Artificial Sequence
  Description of Artificial Sequence: Synthetic coding sequence
atggaaaagagactcggtgtgaagcccaaccctgccagctggattctgtcaggatattattggcaaacctcagccaagtggctgcggtccttatacctgttttacacatgtttctgtttcagcgtgctttggttgtctactgacgcatcagagagcagatgccagcaaggcaaaactcaatttggagttggccttcgcagcgggggagagaaccacctatggctgctcgagggaaccccctctttgcagagctgttgggccgcatgctgccaggatagcgcttgccacgtattttggtggcttgaggggatgtgcatacaggcggactgttccaggcctcagtcctgcagagccttcagaacgcacagctccaatagcatgctggtgttccttaaaaaattccagactgccgacgacctggggtttctgcctgaggatgacgtccctcatcttctgggattgggttggaactgggccagctggcgacagtctccgccacgcgcagccctgaggcctgccgtgagctcctctgatcagcagtcgctcattagaaagttgcagaagcggggttctccctctgacgtagttactcccatcgtgactcaacacagcaaggttaatgactcaaatgaactcggaggcctcaccaccagcggaagcgctgaggtgcataaggcaatcacaatcagttcaccgctgacgacagatctaaccgccgaactgagcggcggtccaaaaaacgtgagtgtgcaacccgaaatctcagaggggttagcaactactcccagtacacaacaagtgaaatcttccgagaaaacatag

SEQ ID NO: 53126 - DNA, 540 bp, Artificial Sequence
  Description of Artificial Sequence: Synthetic coding sequence
atggagaaacgtcttggggtcaagccaaatcccgcttcttggatactctcgggctattattggcaaaccagcgctaaatggctgagatccctttatctgttctatacttgcttctgcttttcagtcctgtggcttagtactgatgccagtgagagtcgatgccagcaggggaagactcagttcggagtcggcctgcgctctggcggtgagaatcacctttggttgttggagggtacccccagcctgcagagttgctgggccgcttgctgtcaggacagcgcttgtcacgtgttttggtggctagaaggcatgtgtatacaggcagactgtagcaggccgcaatcctgccgggctttccggacacacagctctaattccatgctcgtcttcttgaaaaaattccagaccgcggatgacctgggcttcctccctgaggatgatgttccacatcttctggggcttggatggaactgggcctcttggcgtcagtccccacctcgcgctgccttgcgtccagcagtgtcttccagtgatcagtag

SEQ ID NO: 53127 - DNA, 471 bp, Artificial Sequence
  Description of Artificial Sequence: Synthetic coding sequence
atggccgaacccggacatagccatcacttgagtgctcgcgttagaggacggacggagcggaggatccctcgactgtggaggctactactctgggccggaactgccttccaggtgacccagggaaccggccctgagttgcatgcttgtaaggagtcagaataccactatgagtacaccgcctgtgattcgaccgggtcacggtggagagtagctgtgccacatacccccggtctgtgcactagccttccggatcccatcaagggaacagagtgctcattctcctgcaacgcgggagaatttcttgatatgaaggaccaaagctgcaagccctgtgcagaaggcaggtactcactgggaacagggatcaggttcgatgaatgggatgaactgcctcatggcttcgccagcctgtctgctaatatggagctcgacgatagtgccgcagagtcaaccggcaattgcacctcctag

SEQ ID NO: 53128 - DNA, 2781 bp, Artificial Sequence
  Description of Artificial Sequence: Synthetic coding sequence
atggccgagcccggtcattctcaccacttgagtgcgagggtgaggggaagaactgaacggcgaatacccaggctctggcgcttattgctgtgggccggaacagcctttcaggttacccaagggactggaccagagctccacgcctgtaaggaatccgaatatcactatgagtacacggcttgcgatagtacaggaagtcgatggcgcgtcgccgttccacacacgccagggctgtgtacatctctacccgaccccattaagggtactgagtgtagtttctcttgcaacgccggagaatttctggatatgaaagatcagtcttgtaagccttgtgctgaaggcaggtactctttgggaaccggaatcagatttgatgagtgggacgagctcccacatggcttcgctagtctaagcgctaatatggagctggacgacagcgccgcagagagcacaggaaattgcacaagtagtaaatgggtcccacggggtgattatatcgccagtaacactgatgagtgcactgctaccttaatgtacgccgtgaaccttaaacagtccggcaccgtgaattttgagtattactacccggattcgtcaattatttttgagttctttgtccagaacgaccagtgccagcccaacgctgacgactcacggtggatgaaaactactgagaagggatgggaattccactcagttgagcttaaccgaggcaacaacgtcctctactggcggacaactgccttcagcgtctggaccaaggttccaaagcccgtgctgacccagttgatgtataagtgggccaagccaaagatttgctccgaggacctggagggcgctgtcaagctgccagcatctggggtaaagacgcattgtcccccatgcaatcccggtttttttaagactaacaacagtacatgccagccttgtccgtatggaagttacagtaatggaagcgactgtacccgctgccctgctggaaccgaacctgccgtcggtttcgagtataaatggtggaacacgctgccaactaatatggagacaacagtgctgtccgggatcaattttgagtacaagggaatgacagggtgggaggtggccggtgaccacatttacaccgcagccggtgcatccgataacgacttcatgatcttaacactcgtggtgccagggtttaggcccccacagagtgtaatggctgataccgaaaataaggaggttgccagaatcacatttgtgtttgagactttatgtagcgtgaattgcgagctctattttatggtgggcgtaaactccagaactaatacacctgtggagacttggaaaggctctaagggaaagcagagttatacttatataatcgaggaaaatacaactacttcatttacgtgggcattccagagaaccacgttccacgaggccagtagaaagtatacgaacgacgttgccaagatctactctatcaatgtgacaaacgtgatgaatggcgtggcatcatattgtcggccatgcgccctcgaagcctctgatgtcggctcgtcttgtacgagttgcccggctggttactacatcgaccgggacagcggtacttgtcactcttgcccaactaatacaatcctcaaagctcaccagccttatggcgtccaggcatgtgtgccatgcggacccggaaccaagaacaataagattcattccttatgttacaacgactgcacttttagtcggaacactccaactcggacttttaactacaacttttctgcactcgccaacactgttaccttggcgggtgggccaagctttaccagcaaaggtctgaagtatttccatcacttcaccctgagtctatgcggtaaccaggggaggaaaatgtcggtttgtaccgacaatgtgacagatctgcgaatcccagagggcgagagtggtttttccaagagcatcacggcctacgtctgtcaggctgttattatcccaccagaggtgaccggatataaggccggagtttcgagtcaaccagtgtcgctagcagacaggcttatcggcgttaccactgacatgaccctcgatgggattacatctcctgcagaactgtttcacctggaaagcctcggaatccctgatgtcatttttttttatcggtccaacgatgttactcaaagctgttcctccggcagaagtactaccatccgcgtgcgatgttctcctcaaaaaactgtgcctggctctctgcttctgcctggaacatgtagcgatggaacctgcgacggctgcaatttccatttcctgtgggagtccgccgctgcatgccccctctgctctgttgccgactaccacgctatcgtttcctcatgtgtcgcaggcattcagaagaccacctatgtctggcgcgagcccaaactctgcagcggcggaatttctcttccggagcaaagagtcactatctgcaaaactatcgatttttggctaaaagtgggcattagcgccggaacatgcacggccatcttgttgactgtgctgacttgctacttttggaagaagaaccaaaaactggagtacaagtacagcaagcttgttatgaacgccacgctgaaagactgtgatttgcccgcagctgattcctgcgcaattatggaaggcgaggatgtcgaagatgatctgatctttacatcgaaaaaatccctctttgggaagattaaatcctttacttccaagagaaccccggatgggtttgattcggtcccgttgaaaacatcatcaggtggactggacatggacctgtag

SEQ ID NO: 53129 - DNA, 618 bp, Artificial Sequence
  Description of Artificial Sequence: Synthetic coding sequence
atggccgaacctggacactcgcatcatcttagtgccagagtgcggggacgaactgagagacgaatccctcgcttatggagattgttgctgtgggccggaactgcgtttcaggtcacccaaggtactgggcctgagctgcacgcttgtaaagagtctgaataccattatgagtacacggcatgcgactctacaggctcaagatggcgggtggcagtcccccacacccctgggctgtgtacgtccctgcccgacccaataaaagggacagaatgctcctttagctgcaacgcgggagagttccttgatatgaaagatcaatcatgcaagccatgcgccgagggcaggtattcactgggcacaggtattagatttgatgagtgggacgaactcccacatggctttgctagcctgagcgcaaacatggaactggatgactctgcagcagaaagcaccggtaattgtaccagttctaaatgggttcctagaggagactacatcgcctccaacaccgacgaatgcaccgccactctgatgtatgccgttaatctcaagcagagcggcactgtcaatttcgagtattactaccccgatagtagtatcatctttgaattcttctag

SEQ ID NO: 53130 - DNA, 276 bp, Artificial Sequence
  Description of Artificial Sequence: Synthetic coding sequence
atggctgaacccggtcattctcaccacctatcagcgagggttcggggacgaacagaacggagaatccctcgcctctggagattgctgctctgggcaggcaccgcttttcaggtcacacaaggtacaggccctgagctgcacgcctgcaaggagtcagagtatcactacgaatacactgcatgcgacagtacagggtccagatggagggtggccgtaccccatacccccggactgtgtaccagcctgcctgatccaatcaagggcactgagtgctag

SEQ ID NO: 53131 - DNA, 459 bp, Artificial Sequence
  Description of Artificial Sequence: Synthetic coding sequence
atggcggagcctgggcattcccaccacctgtcagcgagggtccgaggccgaaccgagaggagaatcccacggctgtggcgactgctgctctgggctggtaccgctttccaagtgacccagggtacgggccctgaactgcacgcttgtaaggagtccgagtatcattacgagtacaccgcatgtgattccaccggatctaggtggagagttgccgtgcctcatacccctggactgtgcactagcttgcccgatcccatcaaaggtacggagtgtagtttctcatgcaacgccggagaattccttgatatgaaagatcaaagttgtaaaccctgcgcagaaggtcgctactcactgggaaccggaatcaggtttgacgaatgggatgagctgcctcatggcttcgcaagtctgagtgctaacatggaactggatgattctgcagctgaatccacaggctag

SEQ ID NO: 53132 - DNA, 1923 bp, Artificial Sequence
  Description of Artificial Sequence: Synthetic coding sequence
atggtagtgccttccaagacgaagatcgtgtgtcacttctcaacgcttgtgctgacctgtgggcagcctcacacactacagatagtgcccagagacgaatacgacaatccaactaataacagtatgtcattgcgtgatgagcacaattataccctgagcatccacgaattaggccctcaggaggaggagagcacaggcgtttctttcgagaagagcgtgacttcaaatcgacagacgttccaagtcttcctgcgattgacactgcatagtcggggatgcttccacgcgtgtattagctatcagaatcaacccatcaacaacggcgaattcgatatcatcgtgctaagtgaggatgaaaagaacatcgtggaacgaaatgtgtcaactagtggagtctctatttacttcgaggcatacttgtacaacgcaacgaactgttcctccactccatggcacttaccccctatgcacatgacctcttcgcagcggaggccttccaccgccgttgatgaggaggacgaagattcgccttctgaatgccacaccccagagaaagtgaagaaacctaagaaggtatattgctacgtatctcctaaacagtttagtgtcaaagagttctatttaaagatcataccatggagactgtacacattccgcgtgtgccccggaacgaaatttagttacctgggccctgatcctgtgcacaaactgctgacccttgtagttgacgacggcattcagcccccagtggagctttcctgcaaggagaggaacattctcgcggctactttcattagatctctccataaaaacatcggagggtcggaaacattccaggacaaagtgaacttcttccaacgagaattacgccaagtacacatgaaaagaccccattctaaagtgaccctgaaagtgtcccggcatgccctattggagtctagcctgaaagccactaggaatttcagtatctccgactggagcaagaactttgaagtcgtcttccaggacgaggaggcgttggattgggggggacctcgtcgagagtggttcgagctcatctgcaaagcattattcgatacgactaaccagctgtttacgcgctttagcgacaacaatcaggccctagtgcacccaaaccctaacagaccagcgcacctccggctgaagatgtatgagtttgccggtagactggtgggcaagtgtctttatgagtcctcactaggtggcgcttataaacagcttgtgagggcacgctttacccggtccttccttgcgcagatcattggcctgaggatgcattacaagtatttcgagacagacgaccctgagttctacaaaagcaaagtctgctttattttgaacaatgatatgagcgagatggagcttgtgtttgccgaagagaagtataataagagtgggcagttggataaggtggtagaactgatgaccggcggagcacagacgcccgtcacaaacgctaataagattttttatttaaacctcttggcacagtataggttggcatcacaggtgaaagaggaggtcgagcacttcctgaagggattgaatgagctcgtacctgagaacttactggccatcttcgatgagaacgagcttgagctcttaatgtgtggcacaggcgatatatcagtgagtgacttcaaggcccacgccgtggtcgttggcggatcctggcattttcgggagaaagtcatgcgatggttctggactgtagtctcaagtctgactcaggaagagctcgctaggctgctccagtttactaccggtagttcacagctgcctcccggaggctttgcggcactgtgtccaagctttcagatcattgcagctcctacacactctactttgcccactgcccacacctgcttcaaccaggtgaaaggaccaggttcctgttcttag

SEQ ID NO: 53133 - DNA, 390 bp, Artificial Sequence
  Description of Artificial Sequence: Synthetic coding sequence
atgttttatgtgattggagggattactgtgtcagttgtggcgttcttctttaccatcaagtttctttttgagttagctgcacgggtggtctctttcctgcagaacgaagaccgagagagacggggtgacaggacgatttatgactatgtgcgcggaaattatcttgaccctcgctcctgtaaggtctcatgggattggaaagacccatatgaggtcgggcactctatggcttttagagttcatttgttttataaaaacggccagccctttcctgcacatcgcccagtagggctacgggtgcacatcagccatgttgagctggcagttgagatcccagtgacccaggaggttttgcaggagcctaattcgaacgtggtgaaagtggcttag

SEQ ID NO: 53134 - DNA, 1548 bp, Artificial Sequence
  Description of Artificial Sequence: Synthetic coding sequence
atgtggcgtctgcccggtctcctgggaagggccttgcccagaacgttgggcccatccctgtggcgcgtgactcctaagagcacgtctcctgacgggcctcaaactacctcatcaacccttctggtgcctgtgcccaatctggacaggagcggaccccatggcccaggtacgtccggcggaccaaggtcccacggctggaaagacgcctttcaatggatgagttccagggtctctcctaacaccctgtgggatgcgataagctggggcacattggccgtgctggctctgcagctggctagacagatccatttccaggcttcactccctgccggtccacagcgcgtggaacattgtagctggcactctccgcttgaccgattcttttcaagccccctctggcacccctgcagctccttaagacagcacattctcccctcgcctgatggtcctgccccaaggcatacaggtctgcgagaaccgagactaggccaggaagaagcctctgcacaaccaagaaacttcagccataactctctccgaggcgctaggccccaggacccctctgaggaaggccctggtgacttcggattccttcatgcaagttcaagtatcgagtccgaggccaagcctgcgcaacctcagccaacaggagagaaggaacaggataagtccaaaaccctgtcgctggaggaggctgttacaagtatccagcagctgttccagctcagcgtcagtatagctttcaacttcctgggtaccgaaaacatgaagagtggtgaccacacagccgcttttagctattttcagaaagccgcagccagagggtactcgaaagctcagtataatgcgggactctgtcacgagcacggcagaggaacaccaagggatatctcaaaggctgtcctgtactaccagctggctgcatctcaaggacactcactggcccaatatcgctatgctagatgtctgttgcgagaccccgcatcctcatggaatcctgagagacagagagccgtcagcctgctgaaacaggcagcagattctggacttcgagaggcacaggccttcttgggcgtgctcttcaccaaggaaccctatttagatgaacagcgggcagttaaatatttatggctcgccgctaataacggcgactctcagtccaggtaccacctgggaatatgctatgagaaaggactcggagtgcaacggaacctcggcgaggcgctgcgctgttaccagcagagcgcggctcttggaaacgaggcagcacaagagcgcctgagggctctgttcagcatgggtgcagcagctcccggtccatcagatttgactgtgacaggactcaaatcttttagttcgccgagcttgtgctcattgaacacattgttggctggtacgagtcgcctgccccacgcaagcagtaccgggaacttgggtctgttatgccggtccggtcacctgggggcatcactggaagcaagcagcagagccatccctccacatccctacccgctggagaggtctgtagtcagattgggctttggttag

SEQ ID NO: 53135 - DNA, 1548 bp, Artificial Sequence
  Description of Artificial Sequence: Synthetic coding sequence
atgtggcgactgcctggtctcctaggacgggctttacccaggacactgggacccagtctgtggcgggtgactcccaagtccacaagtcccgatggtcctcaaactacttctagcacattgctggtgccagttccaaacctggaccgctccggaccccatggtccaggtacatcaggcggaccccgatcccatgggtggaaggatgcattccaatggatgagcagtcgagtcagcccaaatacattatgggacgcaatctcctgggggaccctggcagtgttggctctacagttggccagacagattcatttccaggctagtttgcctgcaggaccccaaagagtcgagcactgtagttggcattcccctttagacagattcttctcttcacccctctggcatccgtgcagctcccttcgccagcacatcctgccatctcctgacgggcctgctccaagacacaccggcctccgcgaaccacgactcggccaagaagaagccagcgcacagccaaggaatttttctcataactccctgcgaggcgctcgtcctcaagatcctagtgaggagggtcccggtgattttgggttcctgcatgctagttcttcaatcgagtcagaagccaagcccgcacagccccaacctactggggagaaggagcaggataaatctaaaaccctgtccctggaggaggccgtcacatctatccagcagctgtttcaactcagcgtctcaatagctttcaactttttgggcacggaaaacatgaagtcaggagatcatacagcagcatttagctatttccagaaagctgccgcaagagggtatagcaaggcacaatacaacgccggactgtgtcatgaacacggtagagggacaccaagggacatttctaaggcagtgctgtactatcaactggccgcaagccaaggacattccctagcccaatatcgctatgcaagatgcctgcttagggaccctgcttcatcatggaaccctgaacgccagcgagcagtgagtctcctaaagcaggcggctgattcaggactgagggaagcccaggcgttcctaggcgtgctcttcacgaaggaaccttatttagatgagcagagagctgtgaaatacctgtggctggccgcaaacaatggagactcacaatcacgctatcatctcggaatatgttacgagaaaggcttaggggtgcagcgtaacctcggagaagccctgcggtgctatcagcaaagtgcagctctcgggaacgaggctgcgcaggagcgcctgcgtgcccttttttctatgggagctgcggctcctgggcctagcgatcttaccgtgaccggattgaagagcttttctagtcccagtctgtgcagtctcaatactctcttagcgggtaccagccggctgcctcatgcctcgagtaccggaaacctggggttgctgtgtcggtctgggcacctcggagcatccctcgaggctagcagtagggcaatcccgccacacccttatccattggaaaggagcgttgtgcggctgggttttggttag

SEQ ID NO: 53136 - DNA, 654 bp, Artificial Sequence
  Description of Artificial Sequence: Synthetic coding sequence
taggccgtgttgtattaccagcttgccgctagtcagggccattctctggcccaatataggtatgccagatgtctactgcgcgatcctgcgtcatcatggaaccctgaacggcagagggccgtttccctgctgaaacaggccgcagatagcggcttaagagaagcacaggcttttctcggcgtgttattcaccaaggaaccttacctcgacgagcagcgagccgtgaaatatctatggctcgctgccaacaatggagattcacaatcgagataccaccttggcatatgctacgagaagggcctgggggtacagcgcaatttgggagaagccttaagatgctatcaacaaagcgccgcattgggtaatgaggccgcacaggagcgcctgcgcgcactgttctccatgggtgccgcagctccagggccatctgatctcaccgtgacgggcttgaagtccttctcttccccaagtctctgttctcttaacacactgctggccggaacaagccggttgccacacgcttcctcgaccgggaatctaggcctcctgtgtcgttctggtcatcttggcgcttccctggaagcttccagtagagcgatacctccgcacccgtatcctctcgaacgctccgtggtgcgcttgggctttgggtag

SEQ ID NO: 53137 - DNA, 1560 bp, Artificial Sequence
  Description of Artificial Sequence: Synthetic coding sequence
atggcccgagcagggcctgcctggctcttactcgctatttgggtcgtcctgccctcctggcttagcagcgccaaggttagctcgctcatcgagaggatttctgaccctaaggatctgaagaagcttctgcggacgcgtaacaatgtgttagtcttgtactctaaaagcgaagtcgcagccgagaatcatttacggcttctgtcaacagttgcgcaggccgtgaaaggccaggggaccatttgttgggtggactgcggcgatgcggagtcgagaaaactctgtaagaagatgaaggttgatctgtcccccaaagacaagaaagtagagctcttccactaccaggacggtgcgttccatacagaatacaatcgagcagtaacttttaaatccatcgtagcttttcttaaggatcccaaaggacctcccctctgggaggaagacccaggtgctaaggacgtggttcacctggattccgagaaggacttccggcgattattaaagaaagaggaaaagcctctcctaatcatgttctatgcaccttggtgctctatgtgcaagaggatgatgccccacttccagaaagctgctacccagcttcgcggacacgcagtgctagcagggatgaacgtctactcttccgagttcgagaacatcaaagaggaatattccgtgaggggttttcctaccatttgttatttcgagaaggggagattccttttccagtatgataactatggaagcacagccgaggatatagttgagtggctcaaaaaccctcagccgccacaaccacaagtgcccgaaacaccgtgggccgatgaaggtggcagtgtttaccatttgactgatgaagactttgatcagttcgttaaggaacacagttccgtcctggtgatgtttcatgccccatggtgtggccactgtaagaagatgaaacctgagttcgagaaggctgccgaggctctccacggggaagcagattcgagcggagtgctggcggctgttgatgcaaccgtcaataaggcattagccgagcggtttcatatcagcgagttcccgacacttaagtatttcaaaaatggcgagaagtacgccgttccggttttacgcacaaagaagaaatttctggagtggatgcagaaccccgaggcaccgccaccaccagagccaacctgggaggagcagcagactagcgtgctacacctggttggggacaactttagggagaccctcaagaaaaaaaaacataccctggtcatgttttacgccccatggtgcccgcattgcaagaaagttattcctcacttcaccgctaccgccgatgcattcaaagacgatcggaaaatagcctgcgcagccgtggactgcgtgaaggataagaatcaggatttatgtcagcaggaggccgtcaaggggtatcctacctttcactactaccattacggtaagtttgcagagaaatacgactcagatagaacagagctgggttttacaaactatattcgagccctacgcgaaggagaccacgagcggttagggaagaaaaaggaagagctctag

SEQ ID NO: 53138 - DNA, 1755 bp, Artificial Sequence
  Description of Artificial Sequence: Synthetic coding sequence
atggatttgttgtggatgcctctcctgctggtcgccgcatgcgtctcagcagtccacagcagccccgaggtaaacgccggagtgtcatctatccacatcaccaaacctgtgcacattctggaagagagatccctccttgttctaactccagcagggctgactcagatgctcaaccaaacaagatttctcatggtccttttccacaacccaagctcaaaacagtcaagaaacttggctgaagagctgggtaaagccgtagagatcatgggcaaagggaagaacggcatcggcttcggcaaagtggatattacaatagaaaaggagctgcagcaggagtttgggatcacaaaagcccctgaactcaaactgttctttgagggaaacaggtccgagccaatctcttgcaaaggggtcgtggaaagcgcagccctggttgtttggctccgccgacagatttcccaaaaagcttttttgttcaacagcagcgagcaggtcgcagaattcgtaatctctcgtccgctggtgattgtaggtttcttccaggacctggaagaggaggtcgccgagttgttttatgatgtgattaaggactttcccgagcttaccttcggtgtgattactattgggaacgtcatcggtcgcttccacgtgacactcgactccgttttggtgttcaagaaaggaaagatcgtgaataggcagaaactgatcaatgactctacaaataagcaggaattgaaccgcgttatcaaacaacatttgactgacttcgttattgagtataataccgagaataaggacctcatctcggaactccatatcatgtcccatatgctgctttttgtctccaagtcctccgaatcgtatggaattattattcagcactataagcttgcttcgaaggagtttcagaacaagattctcttcatcctcgtagatgcggatgaacctcgcaacggtcgggtgttcaaatactttagggtgacggaagtcgacatcccttcagttcagatcctgaacctgtcgtctgacgcaaggtataaaatgccatcagacgacatcacatacgaaagtctcaagaagttcggcaggtctttcttgtcaaagaatgcaacgaaacatcagtcctctgaagagatccccaaatattgggatcagggactggtcaagcagctcgttggtaaaaatttcaacgtggtggtattcgacaaggagaaggatgtattcgtgatgttctacgcaccctggagcaagaagtgtaaaatgcttttccccctcctggaagagctgggcagaaaatatcaaaaccacagcacgattatcattgccaagattgatgtgactgctaatgatatccagctgatgtatctcgacaggtacccattcttcaggctttttccctctggcagccaacaggcggtgctttacaaaggggaacacacactgaaggggttttctgattttctggagagtcatataaagacaaagatcgaggatgaggacgaattactcagtgtggaacagaacgaggttattgaagaggaggtcttggcagaggaaaaagaggtaccaatgatgagaaaggggctgccagaacaacagagccccgaactggaaaacatgactaagtatgtcagcaagctggaagagcctgcagggaaaaagaaaacgagtgaggaagtggtcgtggtggtagccaaacctaagggacctccagtccagaagaaaaagccgaaagttaaggaggagctgtag

SEQ ID NO: 53139 - DNA, 819 bp, Artificial Sequence
  Description of Artificial Sequence: Synthetic coding sequence
atggggaatactacttccgacagagtatccggcgagcgtcatggcgcaaaagccgctaggtccgagggggcaggaggacacgctcccggaaaagagcacaaaatcatggtcggcagtacagatgatccatctgtgtttagcctccctgattcgaagctgcccggagataaagaatttgtatcatggcagcaggacctggaggattcagtgaagcctacccagcaggctcggccaacagttatacggtggtcagaggggggaaaagaagtcttcatcagcggctcctttaataactggtccaccaaaattcctcttatcaagtcccacaatgactttgtggccatcttggatttgcccgagggagagcatcagtacaaattctttgtggatggtcagtgggtgcacgacccgtccgaacccgtagtcactagccaactcgggactatcaacaatctcattcatgtgaaaaaaagcgactttgaggtctttgatgctcttaagctggactctatggagtcctctgagacttcttgccgggatctgtcaagtagtcctccaggcccttatggccaggagatgtacgccttcagatccgaggagagatttaagtcgcccccaatcctaccgccacacctgctccaggttattctaaacaaggacactaatattagctgtgaccctgcgctgttaccggaacccaatcacgtgatgctgaaccacctctacgccctcagcatcaaagatagcgttatggtgctctctgccacacaccggtataaaaaaaagtatgtcactacactcctgtataagccaatatag

SEQ ID NO: 53140 - DNA, 573 bp, Artificial Sequence
  Description of Artificial Sequence: Synthetic coding sequence
atgccacgtggaaggtccactcgctcctggtggggagtccgaacaaccccggcatgttccgcttccttgacaccctcacataatgactttgtcgccatcctggacctgcctgaaggtgaacatcagtataagttctttgtggatggtcagtgggtgcacgatccctctgaacccgtcgtcacatcacagctcggtactatcaataacctgattcacgtcaagaagtctgactttgaggtgttcgatgcgctgaagctggacagcatggagtcttcagagactagctgcagagacctgtctagctccccgcctggaccatatggccaagagatgtatgccttcaggagtgaagagagattcaaaagcccacccatcctgccacctcatctgttgcaggttatcttaaacaaggatactaacattagctgcgaccccgcactgcttccagaaccaaaccatgtgatgcttaatcatctgtatgcattgagcattaaagacagcgtcatggttctgagcgccacccatcgatacaaaaaaaagtatgtgaccacacttttatacaagccgatctag

SEQ ID NO: 53141 - DNA, 1053 bp, Artificial Sequence
  Description of Artificial Sequence: Synthetic coding sequence
atggaaaagcagccacagaattctcggcgtgggttagcccctagggaggttccgccagccgtcgggctccttttaattatggcgcttatgaatacactgctgtacctctgccttgatcactttttcattgcaccacgacagagcaccgtcgaccccacccattgtccctacggacatttccgcattggtcagatgaagaattgttccccttggctcagctgtgaagaactgcgcactgaagttaggcagctcaagcgggtgggtgaaggtgctgtaaagagggttttcctgagcgaatggaaagagcataaggtggcccttagccagctgactagccttgaaatgaaagacgattttctgcacggacttcaaatgctgaagagcttacagggaacacacgtagtgactcttctaggctactgcgaggatgataatactatgctcacagaatatcacccgctcggctctcttagcaacctggaagagactcttaatctgtccaagtaccagaatgttaatacatggcagcacaggctagagttggctatggactacgtgagcatcattaattatctgcaccactccccagtcgggaccagggtgatgtgtgactctaacgatttacccaagacactgtcgcagtacctgctaacttccaacttctcaattctggccaacgacttggatgcactgcccttagtgaatcatagcagcggcatgcttgtgaagtgcggccaccgggagctgcacggggacttcgttgcacctgaacaactctggccatatggtgaggacgttccgttccacgacgacttaatgccttcctacgatgagaagattgacatttggaaaataccagacatttcgagcttcctgctcgggcacattgagggttcagacatggtgagattccacctgttcgacatacataaagcatgtaaaagccagacccccagcgagcgcccaactgctcaagacgttctggaaacataccagaaggtcctcgacacactgagggacgccatgatgtctcaggcacgagagatgctctag

SEQ ID NO: 53142 - DNA, 585 bp, Artificial Sequence
  Description of Artificial Sequence: Synthetic coding sequence
atgggtgccgctgcctgggccagacccttaagcgtttcatttctccttctgttactccctctgcccggtatgccagccggatcctgggatccagcagggtaccttctttactgtccatgtatggggcgattcggaaatcaggccgatcactttctcggatctctggctttcgccaaactgcttaatagaaccctcgccgtgccaccatggatcgagtaccagcaccacaagccgccattcactaatctgcatgtcagctaccagaaatactttaagcttgagcccctccaggcataccaccgagtaatcagcctggaggactttatggagaaactagcccctactcattggcccccagagaagagagtcgcctattgcttcgaggttgccgctcagcgctcacctgataagaaaacatgcccgatgaaagagggaaatccattcggaccattctgggaccaatttcacgtgagtttcaacaagagtgagttgttcactggcatctcattctctgcctcttacagggaacagtggtcgcagcgtcgtgagaatcatagctgcgtcacgcttctgtttccacggtag

SEQ ID NO: 53143 - DNA, 1167 bp, Artificial Sequence
  Description of Artificial Sequence: Synthetic coding sequence
atgggagccgcagcgtgggccaggcctctgtctgtctcatttctgcttctgctgttgcctcttcccggaatgcccgctggatcttgggaccctgctgggtatctcctgtattgcccctgtatgggacggttcggcaatcaagccgatcatttcctcgggagcttggcgttcgccaaactcctcaataggacgctggccgtcccaccgtggatcgagtaccagcaccacaagcctcctttcactaatttgcatgtctcctatcaaaaatacttcaagcttgaacccctgcaagcgtaccatagggtaatatcgctggaggactttatggagaaattagcccctactcactggccgccagagaaacgcgtcgcatactgttttgaggttgcggctcagcgaagcccagataaaaagacatgtcctatgaaagaaggaaacccttttgggcctttctgggatcagtttcacgttagcttcaataagtccgaactatttacggggatttccttttcagcgtcttaccgggagcaatggtctcagcgatttagtccaaaggaacatccagtgttggcactgcccggtgctccagcccaatttcccgtgctggaggagcaccgcccactgcagaaatatatggtatggtcagatgaaatggtgaaaacaggcgaagctcagatacatgcgcatcttgtgcggccttacgtgggtatacatctcagaattggctccgattggaaaaacgcatgtgccatgttaaaagatgggactgctgggagccacttcatggccagcccacagtgcgtcggctattcccggagtaccgcggcaccattgacaatgacaatgtgcctgcccgacttaaaggagatacagcgggctgtcaagctttgggtaaggtccctagacgcacagtctgtttatgtagcaaccgactccgaaagctacgtgcctgagctgcagcagctttttaaaggcaaagtcaaggttgtttcgcttaagccagaagtggcacaggtggatttatacatcttgggtcaggcagaccattttattggtaattgtgtgtcatccttcacagcctttgtcaaacgagaacgggatctccaaggaagaccgtctagcttttttggtatggatcgacctcccaagcttagggacgaattttag

SEQ ID NO: 53144 - DNA, 534 bp, Artificial Sequence
  Description of Artificial Sequence: Synthetic coding sequence
atggtctggagcgacgagatggtgaaaactggagaggctcagatccacgcgcacttggtacgcccttatgtggggattcatctgcggatagggagtgactggaagaacgcctgcgcgatgctgaaggacggaactgcagggtcccatttcatggccagtccacagtgtgtgggttactctaggtccaccgccgcacctctgaccatgaccatgtgtcttcccgatttgaaagaaatccagcgcgctgtgaagttatgggtcaggtcactggacgcccagtccgtttatgtggccactgattccgagagctatgtgccagagcttcagcagctgttcaaggggaaggtgaaagtggtcagtctgaagcctgaggtggctcaggtagatttgtacatactcggtcaggccgatcattttatcggaaactgcgtgtcaagcttcacagcgtttgttaaaagagagagggatctccaagggagaccgagtagcttctttggaatggatcgcccacccaagctgcgagatgaattttag

SEQ ID NO: 53145 - DNA, 1275 bp, Artificial Sequence
  Description of Artificial Sequence: Synthetic coding sequence
atggcgaccttgagcttcgtttttctgctcctgggagccgtctcatggcctcccgctagcgcttccggccaggaattctggcccggtcagtccgccgcagatatactgagcggcgcagcctctcggagacgctatctgttgtacgacgtgaatcctcccgaaggctttaacctccgcagagacgtgtatatacgcatcgcctcgttgctcaaaacactcctgaaaaccgaggagtgggtgttggtgctacctccatggggcagactgtatcactggcagtctccagacatacaccaggtccggattccatggtctgagttttttgacctcccatcactcaacaaaaatatccctgtcatcgagtatgagcagtttatcgccgaaagtggcggtccctttattgatcaggtctatgtgctccagtcatacgctgaggggtggaaggaaggcacatgggaagaaaaagtggacgagcgaccttgcatagatcagctcctatatagtcaggacaaacatgagtactaccgcggatggttctggggctatgaggaaactaggggccttaacgtgtcttgccttagcgtccagggcagcgccagcatcgtcgccccacttcttttaaggaacacttcagcacgttccgtcatgctcgatagagctgaaaatctgctccacgatcactatggcggtaaggaatattgggatacccgccgatccatggtctttgctaggcatctccgagaagtgggcgatgagttccggagccgccacttgaattccacagacgacgccgatcgtataccgttccaagaagactggatgaaaatgaaagtgaaactcggtagcgctctgggtggcccatacctgggcgttcatttgagacggaaagactttatctggggccataggcaggacgtccctagcttggaaggggctgtgagaaaaatccggtccctgatgaagacacacagactggataaagtattcgtggcgactgatgctgtgagaaaagaatatgaggagctgaaaaagctcttgcccgaaatggttcgctttgagccaacgtgggaggaattggagctgtacaaagatggaggcgtggcaatcatcgaccagtggatctgcgcgcacgcaaggtgcttgcctacttctctctcagctgaaagtggttccggaggcttccaacgatttttttgtccaaaatacagtgtcagtgagcagatggttgcatgtgtgcattccgggcacttccacaccgtttgcctcctggtttag

SEQ ID NO: 53146 - DNA, 1290 bp, Artificial Sequence
  Description of Artificial Sequence: Synthetic coding sequence
atggccacactcagctttgtgtttttactgcttggcgcagtgagctggccccctgcgagcgcctctgggcaggagttctggccaggccagtcagccgctgatattctgagcggtgctgctagccggcgtcgctatctgctgtatgacgtgaaccccccagaaggattcaatctgcggcgagatgtttacatccgaatcgcctcactcctgaagacactcctaaagacagaagagtgggtgctcgtgctgcccccatgggggcgactctatcattggcaaagtcccgacatacaccaagtgcggattccttggtccgagttttttgacctgccctcattgaacaagaacatacctgttattgaatatgagcaatttattgccgaatccggcggtcctttcatagaccaggtgtacgtgctgcagagctacgccgaaggatggaaagaggggacttgggaggaaaaagtcgacgagaggccatgtattgaccagctgctctactcccaggataaacatgagtactaccggggttggttttggggctacgaagagaccagaggcttaaacgtctcatgcctctctgtgcaaggatctgcatctatcgttgcaccacttcttttgcgaaatactagtgcgaggagcgtgatgctcgacagagctgaaaacctcctgcatgatcactatggtgggaaggagtattgggacacgagacgttccatggtcttcgctagacacctgcgcgaggttggggatgagttccggtcgagacacctgaactccaccgacgatgctgacagaatcccttttcaagaggattggatgaagatgaaagtgaagttaggctccgctctaggaggaccgtatctgggtgtccacctcagacgtaaggactttatctggggtcacaggcaggatgtgcccagtcttgaaggcgctgttagaaaaattcgaagcttgatgaagactcatagactggacaaagtgtttgtcgcgacagatgcggtgagaaaagagtacgaagagctgaagaaactgctgccagagatggtgcgcttcgaacccacttgggaagagctagagctgtataaggatgggggtgtcgctatcattgaccaatggatttgtgcccacgccagattctttattgggacgtcagtgtctacgttcagcttcagaatccacgaggagcgggagatcctgggcctcgaccctaaaacaacatataacaggttctgcggcgatcaagagaaagcttgcgagcaacccactcattggaagatcacatactag

SEQ ID NO: 53147 - DNA, 1179 bp, Artificial Sequence
  Description of Artificial Sequence: Synthetic coding sequence
atggaatggtgggcgagctctccccttcgcctgtggctcctgttgttcctgctgccttcagcccaaggacggcaaaaagagtccggctctaaatggaaggtgtttattgatcagataaaccgcagtttagagaactacgaaccatgctcttctcagaattgtagctgttaccacggcgtgattgaagaagatctaacccctttccgcggaggcatctcgcggaagatgatggcagaagtggtgcgccgaaagctcgggacccactatcaaatcacgaaaaatcgcctgtacagagagaacgactgcatgttcccctctcgatgttccggggtagagcacttcattctggaggttataggacgtctaccagacatggaaatggtcatcaacgttcgcgattatccacaggtcccaaaatggatggagccagccattcctgtcttctcattctccaagaccagcgagtatcacgacatcatgtatcccgcatggacattttgggagggtggcccagcagtgtggccaatctatccgacagggttggggagatgggatctgttccgggaagatttggttagaagcgctgcccagtggccgtggaaaaaaaagaatagcaccgcctatttcagagggagtcgcacaagccccgagagagatccactgatcctcctgtccaggaaaaatcccaagttggtcgatgcagagtatacaaagaatcaagcctggaagagcatgaaggacaccctcggcaagcctgccgcaaaggacgtgcatttggtcgaccactgcaaatacaagtatctgtttaacttcaggggggtggcggcttcatttcgtttcaaacacctgttcctgtgcgggagcctggtttttcacgtgggagacgaatggctggagtttttttacccacagttgaagccttgggtgcactacattccagtcaagacggacctcagtaacgtgcaggagctgctgcagttcgttaaggctaacgacgatgtggcccaggaaattgcagagcggggttcccagttcatacgaaatcaccttcagatggatgatatcacttgttactgggagaacctcctgagtgagtattcaaagttcctgagttataacgtgacccgacggaaaggctatgatcaaataattcccaagatgctgaagactgagctctag

SEQ ID NO: 53148 - DNA, 3273 bp, Artificial Sequence
  Description of Artificial Sequence: Synthetic coding sequence
atgatgcctatgattctcacagtgttcctgtcgaacaacgagcagattctgactgaagtgcccattactcctgagacaacttgcagagacgtagtggagttttgtaaagaacccggagagggatcctgccatttggcagaagtgtggcggggaaacgagcgaccaataccattcgaccacatgatgtatgagcacttacagaaatggggacctagaagagaggaggtgaagttctttctgcgtcacgaagattcccctacggaaaatagtgaacagggcggacgccagacacaggagcaacgaacccagagaaatgtgattaacgttcccggtgagaaaagaactgagaatggggtcgggaacccaagggtggagctgacgctgtctgagcttcaggatatggctgctaggcagcagcagcagattgagaaccagcagcagatgctggtcgctaaggaacaaaggttacatttccttaagcagcaagagcgtagacagcaacagtcaatctcagaaaatgaaaagctgcagaaactgaaagaaagggtagaagcgcaggagaataagttgaagaagatacgcgctatgagaggccaggttgattatagcaaaatcatgaacggcaatctgagtgccgaaattgagcgtttctccgccatgttccaagagaaaaagcaggaggtgcagactgccatcttacgtgtcgatcagttaagtcagcagctcgaggatttaaagaagggcaaattaaacgggttccagagctataacggaaagcttacaggaccagcggctgtcgaattaaagcgcctgtaccaggaacttcagatacggaaccaactgaaccaggaacagaatagtaagctccagcagcaaaaagaactcctgaacaaacgcaatatggaggtggctatgatggacaagcgcatctccgaactgcgtgagcgcctgtacgggaaaaagatccagctgaaccgcgttaacggtacctccagccctcaatcacctctgagcacctccggaagagttgccgcagtgggcccatatatccaggtgccttcggcagggagcttccccgttctcggggacccaatcaaaccgcagtctctatctattgcgtcaaatgcagcccacgggcgatccaagagcgccaacgatgggaactggccaaccttaaagcaaaactcgtccagctccgtcaagcccgtacaggttgcaggagccgactggaaggatccaagtgtggagggttctgtcaagcagggaaccgtttcctcccagccagtgccttttagcgccctgggccctactgaaaaacccggaatcgaaatcggaaaggtcccgcctccgatacccggagtgggaaagcagcttccgccttcctatggaacgtaccctagccccaccccgctcggaccaggatcaacgtctagcctagaaaggaggaaagagggtagcctcccacgacccagtgcaggcttacctagtcgacagaggccgactctgctccctgccacaggctcaacaccacaaccaggatcttcgcagcagatacagcaaagaatcagtgtccccccttcacctacatacccccctgccggaccaccagcgttcccagccggtgattcaaagcccgaattgcccctaactgtcgccattaggccattcctcgctgacaagggctctcggcctcagagccccagaaagggacctcagaccgtgaacagctcaagcatctattcgatgtatctgcagcaggcaactccacctaaaaattaccaacctgctgcacactcagcactgaacaagtccgtgaaggcagtctatgggaagcctgttctccccagcggcagcactagcccttctcctctgccattcctgcatggatccctttccaccggcactccacaaccacagccacctagtgagtcgactgagaaggagcctgagcaggatggtccggcagcccctgccgatgggtctactgtcgaaagtttgcccaggcctctgtcacctacaaaactgaccccgatcgtgcactcccccctaaggtaccaaagcgatgcagacttggaggccctcagacgaaagctggctaacgcccctagacccctgaaaaagcggtcttcaatcacggagccggagggcccaggcggtcctaacattcagaaactgctctaccagagattcaataccctcgctgggggaatggaaggtacacctttttatcagccgtcccctagccaggatttcatggggacactggctgatgtggacaatgggaataccaatgcaaatggtaatctggaagaactccctcctgcacagccgacagctcctcttcctgccgagccggctccctcaagtgacgcgaacgacaacgaactgccctcccccgagccggaagagctgatctgccctcagaccacccatcagaccgcagagccggctgaagataacaacaataacgtggctaccgttcccaccactgaacagattcccagcccagtcgccgaggcgccttctcctggagaggagcaggtcccacccgcacctctcccgcctgcatcccacccaccggcaaccagcaccaacaaacgcaccaatctgaagaagcctaactcagaacgcacaggtcacggccttagggttcgattcaacccactggcgctccttctggacgcaagcttagaaggtgagttcgatctggtgcagagaatcatctatgaggtggaggatcccagcaaacctaacgatgagggaatcacaccacttcataatgccgtatgcgcagggcatcatcacatcgtgaagttcctgctggattttggagtgaacgtcaacgccgctgactccgatggctggactccactccattgcgccgcttcctgcaatagcgtgcacctgtgcaaacagctcgtggagtccggagccgcaattttcgcctccacgatttcggatatcgagaccgctgccgacaagtgcgaggagatggaagagggatatattcagtgttcacagtttctgtacggtgtgcaggagaaattgggagttatgaacaagggggttgcctacgccctttgggattatgaggcccagaactctgatgaattgtcattccatgaaggggatgccttgaccatactaaggcgaaaagatgagagtgagactgaatggtggtgggcaaggctgggcgacagagaaggctacgttccgaaaaacttgctgggcctgtaccctagaatcaaacctcggcaacggacccttgcatag

SEQ ID NO: 53149 - DNA, 1884 bp, Artificial Sequence
  Description of Artificial Sequence: Synthetic coding sequence
atggcggctcgccagcagcaacagattgagaatcagcagcagatgttggtggcaaaggaacagaggctccacttccttaaacagcaggagagaagacagcaacaaagcatatcggaaaacgaaaaacttcagaaattaaaagagcgcgtggaagcacaggagaataagcttaaaaaaatacgggctatgcgtggtcaggtggattattctaagatcatgaatggaaacctatcagccgagatcgagcggttctccgcgatgttccaggaaaaaaagcaggaagtgcagactgcaatattaagggtggatcagctgagtcagcagctagaggaccttaaaaaagggaaattgaatggatttcaatcgtacaatggtaagctgacaggaccagccgcagtagagctcaaaagactttaccaggaactgcaaatcaggaaccaactaaaccaagagcagaattccaagctgcagcaacaaaaagaattgttaaacaaaaggaacatggaggtcgcaatgatggacaagcgtatttctgagctacgagagaggctgtacggcaagaaaatccaattgaacagggttaacgggacatctagcccacagtctcccctgtccacttctgggcgtgtggccgcagtaggcccttacatacaggtaccatcagctggaagcttcccggtcctcggtgacccaatcaagcctcaaagcttatctattgcttccaacgctgcccatgggagatccaaaagtgcaaacgacgggaactggccaacactcaaacagaacagtagttcttccgtgaagcccgtgcaggtggcaggcgcagactggaaagaccccagtgtggagggcagcgtaaaacaagggacagtctcatctcaacctgtacctttctcagcactgggtcccaccgagaagccgggaattgagataggcaaggtgccccctcctatccccggtgtgggtaagcagctgccaccatcctacggtacctacccctcaccaacccctctcgggcctgggtctacttcctccctggaacgcaggaaggaaggctccctcccccgtccatctgcagggctgccatctaggcaaagaccaacactgctgcccgctactgggtccactcctcagccagggtcatcacagcaaatacaacagaggatcagtgttccgcctagtcccacttacccgcctgcgggaccgcctgctttccctgcaggagactcgaaacccgaattaccactgacagtagctatccgccctttcctcgccgacaagggatctcgcccacagagtccgcgtaagggtccgcagactgtgaattcaagctctatctattccatgtatttgcagcaagctaccccacctaagaactaccaaccagccgctcattctgcactaaacaaatctgttaaggccgtatatggaaagcctgtccttccctcaggctctactagtcccagccctctacccttcctccatggatctctctccactggtactccacagccacagcccccttcagaaagcacagagaaagagcccgaacaggacggtcccgcagctccagccgatgggtccacggtggaatctcttcctcgacccctaagccctaccaagttaaccccaatcgtacatagcccactgaggtatcagagtgacgcggatcttgaggcactacgacggaagctcgccaacgcccctaggccattaaagaagcgctcttccattaccgagccagagggcccacccttcctgcccgctcagcccctgccgggtctgcatggacaccttgggaggtgtggccagtggaagcaccagtgccagtggaagcctggaagagcgccaccctgccctgcacattctcccactcctagatag

SEQ ID NO: 53150 - DNA, 1197 bp, Artificial Sequence
  Description of Artificial Sequence: Synthetic coding sequence
atgtacctgcaacaggccacacctcctaaaaactaccagcccgctgcccattccgcgctcaacaagagtgtcaaagccgtgtacggaaagcccgtgcttccgtctggctctacttccccctcccccctgccatttctgcacgggtccctgagcactggaactccccagccccagccacccagtgagtcaaccgagaaggagcccgaacaggacgggccagctgcgcctgccgatggcagtaccgtggagtctttgccgagacctctctcacctacgaaattaacacccatagtgcattcaccgcttagataccagtcggacgcagatctggaagcgctccgcagaaaactcgcgaacgcccctcgccctttgaagaagcgatcctcaataactgagccagaaggcccaggcggaccaaatatccagaagcttctatatcagcggtttaataccttggcaggtggcatggagggaacaccattttaccagccatcacccagccaggatttcatgggaactctggcagacgttgataacggcaatacgaatgcaaacgggaatttagaagaactccctcctgcccagccgacagctcccctgccagccgaaccggctccctctagtgacgcaaacgacaacgagctcccctctccggagcctgaggagttgatctgtcctcaaactacccaccaaacagctgaaccagccgaagacaacaataataatgtcgctactgttccgacaactgagcagatcccctctccagtggcagaagccccaagccccggtgaagaacaggtgccccctgccccattacccccagcaagccatcccccagccactagcactaacaaacgcacaaacctgaaaaaaccaaactccgagagaacaggccatggattacgggtccgcttcaatcctctggccctgctcctcgacgcatcactggaaggcgagttcgacctcgtgcaaaggataatctatgaagttgaggacccttccaagcccaatgacgaggggatcaccccccttcataatgctgtgtgtgctggtcaccatcacattgtcaagtttttgctggatttcggggtcaacgtcaacgctgcagatagtgacggttggggggctggcaaagctgggtgtgatgagcagcggtgtggggtgtgctctgtgggcctccggggtccagaacagtag

SEQ ID NO: 53151 - DNA, 1908 bp, Artificial Sequence
  Description of Artificial Sequence: Synthetic coding sequence
tgagtggggccatacatacaagtcccatccgccggtagttttccagtcctgggagacccaatcaaacctcagagcctgagtatcgcatctaatgccgcacacgggcgttctaagtcagctaacgacgggaactggcctacacttaagcagaacagcagttcctcagtgaagccagtacaggtcgccggagccgattggaaagacccctctgttgaagggtctgtgaagcagggaacggttagcagccagccagtgcccttctcggccttagggccaactgaaaaacccggtatcgaaattggcaaggtcccgccacccatccccggtgttggtaagcagctgccaccaagctatggcacctatccatctccaaccccccttgggcctggctcaacctcctctcttgagagaagaaaggagggttccctgcccaggccgagcgccggtctaccttctcggcagcgtccaacgttactaccagctaccggatctaccccccaaccaggctcatctcagcagatccagcagaggataagtgtaccaccatccccgacctatcccccagccggtccacctgcctttccggctggggattccaagccagaattgcccctgacggtggccataaggccttttctggcggataaggggtctaggcctcagtccccaaggaaagggccacagacagtgaattctagctcgatttactccatgtacctacaacaggccacgccaccaaagaattatcaacctgccgctcattcagcactgaataaatctgtgaaagctgtttacgggaagcccgttttgccctctggctctacaagccctagcccactgccctttttacatggctcattatccaccggaacacctcagccccaaccccctagcgagtcaacagagaaagagcctgagcaggatggaccagccgctccagctgacggaagtacagtggagtcccttcccaggcccctgtccccaacaaaactaactcccatcgtgcactctccacttagatatcagagcgacgccgatctggaggccctcagaaggaagctggctaacgccccacgaccactgaagaaacgctcttccatcaccgagccggaagggcctggaggcccaaatatccagaagctgttgtaccagaggttcaacacccttgcgggagggatggagggcacgcccttctaccaaccaagtccatcccaagacttcatgggaactcttgctgacgttgacaatgggaataccaatgcgaacgggaatttagaggagctgccccctgcccagcctaccgcccctctgcccgcagaacccgcacccagtagtgatgcgaacgacaacgagcttccttcacccgagcctgaggaactgatctgtccacaaacaactcatcagacagcggaacccgctgaagacaacaacaacaatgtcgccacggtgcccacgactgaacagatcccctctcctgtcgccgaagcgccaagtcctggcgaagagcaggtacctcctgccccactgccccctgccagccatcctcccgctacctcaaccaataagagaactaatcttaagaagccaaatagcgaaaggactggacacgggctgagagtccgctttaacccgctggctctgctgctcgacgcatctctggagggggaatttgacctggtacagagaattatttatgaggtggaagacccgtctaaaccaaacgatgaaggaatcacgcccctgcacaatgcagtgtgtgcaggccaccatcacattgtgaagttcttgctagattttggcgtgaacgtaaacgccgcagactcggacgggtggggcgcaggcaaggctggctgtgatgaacagaggtgcggcgtatgctccgtaggattgaggggacctgaacagtag

SEQ ID NO: 53152 - DNA, 1587 bp, Artificial Sequence
  Description of Artificial Sequence: Synthetic coding sequence
atggctgagcacctcgagctgctggccgaaatgcccatggttggacgaatgtccactcaagagcgactgaagcacgcacagaaacgccgtgcgcagcaggttaaaatgtgggctcaggctgaaaaggaagcccagggcaagaagggccctggagagcggcctcggaaagaggcagcgtctcagggcctactgaaacaggttctcttccctccgagtgtggtgcttctggaggccgcagccagaaacgatctggaagaggtccggcaatttttggggtcgggagtctcccccgacctggccaatgaggatggtctaactgctttgcatcaatgctgcattgacgactttagagaaatggtacagcagctgctggaagctggcgctaacattaatgcgtgcgacagcgaatgctggacccccctccatgctgccgcaacttgtggccacctccatctggtcgagctgctgattgcaagcggcgctaacctgctcgctgtgaatactgacggcaacatgccctacgacctctgtgacgacgaacaaaccttagattgtctggaaacagccatggccgatcgcggaatcacacaggacagcatcgaggctgcgagagccgttccggagctgcgaatgttagacgatatcagatctcgtttacaggccggtgcagacctgcacgctccccttgatcatggagccaccctgctgcatgtagcagctgctaatggtttcagcgaggctgccgcacttctcctcgagcacagagcatctctgtccgccaaggaccaggatggctgggaaccgttgcacgccgcagcatactgggggcaggtaccgttagtggaactcctcgtggctcacggcgctgatttgaacgccaaatcactcatggacgagacgcccttagatgtgtgtggcgacgaagaggtacgcgctaagctcctggaactcaagcacaagcacgacgcattgttaagggcccagagtaggcaaaggtcgctgttgcgccgtcgcacttcttccgctgggtcacgtggaaaagtcgtcagacgcgtatccctcactcagaggaccgatctatatcgcaagcagcacgctcaggaggccattgtgtggcaacaaccccctccaacgagccccgagccccctgaggacaacgacgaccgccagactggagccgagctccggcctcctcctccggaagaagataaccctgaggtggtgaggcctcacaatggaagggtgggcggaagccccgtgaggcacttgtacagcaaaaggctcgatagatccgtgagttaccagctaagccccctcgattcaactaccccgcacaccctcgtccatgacaaggctcaccatactctcgccgatctaaaacgacagcgtgctgccgctaagcttcagcgaccgcctccagagggtccggagtcccctgagactgcagaacccggtctcccgggagatacagtgaccccgcagccagattgtggattccgcgcagggggtgaccctcccctcctcaagttgaccgcgcctgcggtggaggcgcctgtcgagcgacgcccatgctgtcttcttatgtag

SEQ ID NO: 53153 - DNA, 1587 bp, Artificial Sequence
  Description of Artificial Sequence: Synthetic coding sequence
atggccgagcatctggagctattggcagaaatgcccatggtgggcaggatgagtacccaggaacggctgaagcatgcacagaaacgacgagcacagcaagtgaaaatgtgggcccaggcagaaaaggaagcacagggaaaaaagggccctggagagcgacccagaaaagaggccgcaagccaaggcctgctcaaacaggtgctgttcccccctagtgtggttctcctagaagccgcagccaggaacgacctggaggaggtgagacagtttctggggtcaggagtgagtcctgatctggctaacgaggacggcctaactgctctgcatcagtgctgtattgatgatttccgcgagatggtacaacagctgctcgaggccggagcaaatatcaacgcctgtgactctgaatgttggactccactgcacgcagccgctacgtgcggtcacctgcacttagtggaattacttatagcatctggcgcaaatctgctggccgtaaataccgacgggaacatgccttacgatctttgcgatgatgagcagaccctcgattgtttggaaaccgccatggctgacagggggattacccaggattctatcgaggcagccagagcagtccctgaactgcggatgctagacgatataagatcccgcctccaggccggagccgatctgcatgctccactggaccacggcgctacactcctccatgtggctgccgcaaatggcttcagcgaagcggctgctctgctgctagagcatagagctagcctgtctgctaaagaccaggatggttgggagcccctgcacgctgctgcctactggggccaagtgccccttgtggaacttctggtagctcacggcgcagatctgaacgccaagagcctgatggatgagacccctctggacgtatgtggcgacgaagaagtccgggctaagctgctcgagctgaaacataagcatgacgcgttgctacgggctcagagcagacagaggtctctgctgcgcaggcgcacttcttcagctggttcaagagggaaggtcgttcgacgagtgtctctcacccaacggacagacctgtaccggaaacagcacgcccaagaggccatcgtatggcaacagcccccacccacaagccccgaaccacccgaggataacgacgacagacagaccggtgctgagttgagacctccgcctcctgaagaagacaatcctgaagtagttagaccccacaacggcagagtgggaggtagtcccgtgcgacacttgtacagtaagcggctggatcggagtgtttcctaccagctgtccccgcttgactcaactacacctcacacgctagtgcacgataaagcccatcatacactcgctgatctaaagcggcagagggcagccgctaagctccagaggcctccaccagaggggccagaaagtcccgaaaccgccgaacccggacttcccggagacaccgtgacacctcaaccagactgcgggttcagggccggaggggatcccccacttcttaaactgactgcccctgctgtagaagccccagttgaaaggcgcccttgttgcctcctgatgtag

SEQ ID NO: 53154 - DNA, 840 bp, Artificial Sequence
  Description of Artificial Sequence: Synthetic coding sequence
atgtcccgcgagagaccccctggcacagacattcctagaaacttgtcgtttattgctgcactcacagaacgagcttactatcgcagccaaagaccaagtttggaagaggaacccgaggaggagcccggagagggtggaacccgcttcggggctagatcgcgagcacacgccccaagcaggggaagaagggctcgtagcgcacccgcagggggtggcggtgcacgcgctccgagatcaagaagtcctgatacgagaaagcgtgtgcgcttcgccgacgctctgggattagaactagccgtggttcgacgattccggcctggggaattaccgagggtccctaggcatgtgcagattcagctgcaacgggacgccttacgccatttcgctccgtgtcagccaagggccagggggctgcaggaggcccgagccgcactcgagccagccagcgagcctggcttcgcagccagactattaacgcagcgaatttgtctggaaagggccgaagccggtcccctgggcgtcgccggttctgccagggtcgtggaccttgcttacgaaaagcgcgtgtctgtacggtggagcgctgatgggtggcgaagtcagagagaagcaccagccgcatatgcgggaccagcgccaccccctcctagggcagatcgtttcgcattccgtctcccggctccccctatcgggggagctctcctgttcgccctccggtacagggttactgggcacgagttttgggataataacggagggagagactacgctctgagggggcctgagcaccccggaagcggcggagcaccagaacctcaaggctggatccatttcatttag

SEQ ID NO: 53155 - DNA, 150 bp, Artificial Sequence
  Description of Artificial Sequence: Synthetic coding sequence
tgaggcgcactgctgttcgcactgcgctacagagtcactgggcacgagttctgggataacaacggtggaagggactatgctttgagaggacctgagcacccaggttccgggggtgctccagagccacaagggtggatccatttcatctag

SEQ ID NO: 53156 - DNA, 105 bp, Artificial Sequence
  Description of Artificial Sequence: Synthetic coding sequence
taattctgggacaataatgggggaagggattatgctttgcgtggaccagaacacccgggttccggcggtgcaccagaaccccagggctggatccattttatttag

SEQ ID NO: 53157 - DNA, 57 bp, Artificial Sequence
  Description of Artificial Sequence: Synthetic coding sequence
gagcaccccggaagcggcggagcgccagagcctcagggatggatccacttcatctag

SEQ ID NO: 53158 - DNA, 90 bp, Artificial Sequence
  Description of Artificial Sequence: Synthetic coding sequence
aatggaggacgcgattatgccctgaggggaccagagcatcccggatccggcggtgctcccgagcctcagggctggattcactttatttag

SEQ ID NO: 53159 - DNA, 42 bp, Artificial Sequence
  Description of Artificial Sequence: Synthetic coding sequence
tagggggcaccagaaccccaggggtggatacactttatctag

SEQ ID NO: 53160 - DNA, 2400 bp, Artificial Sequence
  Description of Artificial Sequence: Synthetic coding sequence
atggccagaacggcaccagtggagcctcctctgcgacactccgctccaccgtcccctgcggctggagaacctcggacctctgtggaggcagccgtcgcccctagacgtgtactgtttgccgacgaagccttaggactgcccctcgcccagctcaggagatatcgcccatggggtgggcctggagctggcaagatggcagctgcagctggccaggatggtggtggcggaggcggtgccgacgaggacgatgacggcgaagatggggatgagggagaagaagaggaagaagcttgtccagagccatctcccctgtgcccggtgccagcaggaggcggtttttacctggtcccaacattcagcttacctcccgcacccggacgattggaaagattaggacgggttatggtcgagctagaggctcttctcccacccccaggagccgtgcccggaggggctggagtgtgggtgcccggtggcagaccacccgtgctgagggggctggtgcgcgttctcaaccgttcattcgagaaggcagtacacgtacgtgcctctcacgatggatgggcatctttctgtgaccaccccgcaagatacgtaccgaggtcccccccttgggcaggagctggtggcaccggagctggcgaccccattcttgatccaggtctcggtctgggccctgggcaggcttccgccagctcccctgatgatggaggcagaactgacagatttgccttccagctaccattcgccgaaggagctggcgacggagcccgtctagactttgtggtgcgttacgagaccccagagggcacattctgggcgaacaatcacggtaggaattatactgtcctcttgagaatcgcaccagcacctacacccaccgatgccgaagggctcccccagcagcagcagctgccacaactggaaccacaaccagaatgtcagggtcccgtcgaggccgaggccaggcagttaaaatcttgcatgaagcctgtgcggcgaaggcccgctgaggaagagctgaagactaaaaacatggacgacaacacgtttgcgatggccgagcaccctgatgtgcaggaatctgtgggcccactggtggccccaacgccgctcaggccctggccccaaatgactttacaggtaagtgatgttcctatgactggcaaccccgcagaggaaggagacgtgccgagaagttctcctccagtggcttttaccgaagtgctgcaggctcccgctattcggattcctccctccagcccgctatgtggtctaggagggtctcccagggatcaggcaagcggcccagatgctagcgagggcgctacgggcccattccttgaacccagccagcagcaggcagaggccacctggggcgtctcttcggagaatggcggaggccttgaagctgtttctggatctgaagaactccttggtgaggacaccatagatcaagagctagaacaactgtatctgagccatctgtccagactgagagccgctgtcgccgctggcggtgcgggagggggaggagaaggcagcactgatggtggcatgtccccgagccacccactcggcatcttgaccgatcgggacctgatcctaaagtggccgggtccagagcgcgcattgaacagtgctctcgctgaagagatcacactgcactacgcgcgtttaggcagaggcgtcgagttgattaaagataccgaggaccctgatgacgagggagaaggcgaggaggggctctccgtgaccccttccagcccagagggcgacagtcctaaggaatcaccacctgagatcctctctggtgcgaggtccgtggtagcaactatgggtgatgtgtggttgccctgggctgaggggagcgggtgcgatgggcctgttgtgctcggtactgaggggcagttcattggcgatcctgaaaaggggatgggaaaggataccagtagtctccatatgaaccgggttattgctggcgtgacagagtcccttggcgaggccggaactgaagcccaaatcgaagtaaccagcgagtgggctgggtcgctggaccctatatctggaaaggaaccagcctctcccgtgttacttcagggccagaaccccaccttgctgagccccttgggagccgaggtctgtctgtcttccgttgcaagaccacacgtgtccagtcaggatgaaaaggacgcaggcccttccctggagccacctaaaaagtcccccaccctggcagtgcccgcagagtgcgtgtgtgcgctgccgcctcagctcaggggcccacttacccagactctcggagtgttggcaggactggtagtggtccccgtagctctgaatagcggggtatccctgctcgttctcgctctttgcttgagtctggcctggttttcgtag

SEQ ID NO: 53161 - DNA, 1413 bp, Artificial Sequence
  Description of Artificial Sequence: Synthetic coding sequence
atgaaacctgtgaggagacggcctgcagaagaagaattgaagacaaaaaacatggacgataacacttttgctatggaacatccagacgtgcaagaatctgtgggcccactcgttgcgccaacacccctccggccatggcctcagatgactctgcaggtgagcgacgttcctatgaccggcaacccagctgaagagggggatgtgcctcgctcttcaccaccagtcgcctttaccgaggtcctgcaagctccggcaatccgaatccctccgtcgtccccactttgtggcctggggggatcacccagggaccaggcttccggcccagatgcaagcgagggggctactggccctttcctcgaaccaagccagcagcaggccgaagccacatggggcgtgtcatccgagaatggaggtgggcttgaagcagtgtctggttcagaggaactgctgggtgaagataccattgatcaagagcttgagcagctgtatctctcgcacctctccaggttgcgagcagctgtggcggctgggggtgcaggtggcggaggggagggcagtaccgatggaggaatgtctccatcccatcccttagggatcttaacagaccgagaccttattttaaagtggcctggacccgaaagagcccttaactccgcactcgcagaggaaattacactgcattatgccagattgggcaggggcgtggagctaattaaggataccgaagacccagatgatgagggagaaggagaggagggcctgagtgttactcccagcagccccgagggggacagccctaaagagtcaccaccagaaattctgagcggggctcggagtgtggttgctactatgggcgacgtgtggcttccgtgggccgaagggagtgggtgtgatgggcctgtggtactagggaccgaaggtcagtttatcggggaccctgaaaaagggatgggaaaggatacctcttcactccacatgaatcgagtgatcgcaggggttactgaatccctcggagaagccggaacagaggctcagatcgaggtgaccagtgaatgggcagggtctctggatcctattagtggaaaagagcccgcatctccagtcctcttgcaaggacagaaccctaccctcctctcccctctgggcgctgaggtttgcctgagcagcgtagctagaccacacgtttcttcccaggacgagaaagacgcaggccctagtctggaaccaccgaaaaagtcccctacgctggccgttcccgctgaatgtgtctgtgctcttccgcctcagctcaggggccctctcacacagactcttggagtgttagccggattggtggtcgtccccgttgctctcaacagcggcgtatccctgctggtgctcgcactgtgtctatccctggcctggttcagctag

SEQ ID NO: 53162 - DNA, 1368 bp, Artificial Sequence
  Description of Artificial Sequence: Synthetic coding sequence
atgttttgctcaggccgtaaatgggtggccgaagccactatctgcactaaactcatgaagcgcgagaagagacgtatgggaaagcgtcgggcaaagaaggcaaagcgcgaggagaaaaagaaggggggagaacgacgccgaaatgagaagcgtgggaatcaaatgaaacgcatgtgcgaacggaagaagtacgagacggatctggaagaccaggacataatgggagcgttcctggataagcctaaaatggagaaacataatgcacagggccaaggcaacgggctaagatacggactcagctcaatgcaagggtggagagtggagatggaagacgcccatacagctgtaattgggctgccaagcggcctggaatcttggtcattttttgctgtctacgatggccacgccggatctcaggtggccaagtactgctgcgagcatctgctggaccatatcacgaacaaccaagattttaaaggtagcgcaggagcgccaagtgtcgagaatgttaagaacggaatccgaaccggctttttagagatcgatgagcacatgcgagttatgtccgagaaaaagcacggtgccgataggagcggcagcacagccgtgggcgtgctgattagtccgcagcatacttactttattaattgcggggatagtcggggtctgctgtgtcggaacaggaaggtgcatttcttcacccaagaccacaagcccagtaaccccttggagaaggaaaggattcaaaatgcagggggaagcgtgatgatccagcgcgtgaacggaagcctggctgtgtcaagagcccttggggacttcgactacaagtgtgtgcatggaaaaggcccaacggaacaactggtgagcccggagcctgaggtccatgacattgaacgctctgaagaggacgaccagtttataattctcgcctgcgacggtatatgggacgtcatgggcaacgaggaactctgcgactttgtccgctctaggctggaggtcacagatgatctggagaaagtttgtaacgaggtggtagatacatgcctttacaaaggttccagggataacatgagtgtcatattaatctgctttcccaatgccccaaaggtaagtcctgaagccgtgaagaaggaagctgagctcgacaaatacctggagtgtcgcgtcgaggagataattaagaaacagggtgaaggcgtgccagatctcgtacatgtcatgcgtaccctggcctctgaaaatatcccctccctgccacccggaggggaactagcatctaaacgcaacgtaattgaagccgtctacaaccgcctgaacccgtataagaacgacgatacagatagcacatcgacggacgatatgtggtag

SEQ ID NO: 53163 - DNA, 975 bp, Artificial Sequence
  Description of Artificial Sequence: Synthetic coding sequence
atgggggcttttctcgacaagccaaagatggagaagcacaatgcacagggacagggtaatggtctgcgttacgggttgtccagtatgcagggctggagagttgaaatggaggatgcccacactgccgttataggtctgcccagcgggctagagtcctggtccttctttgctgtgtatgatgggcacgccggaagccaggtggcaaagtactgttgcgagcacctgttggatcatataacaaacaatcaggactttaaggggtcagccggagcccctagcgtggagaatgtgaagaatggcatcaggaccgggtttttagaaatagatgaacatatgcgggtcatgagcgaaaaaaagcacggagccgaccgttccggctcaactgccgtgggagtcctgatttccccacaacacacttatttcattaactgcggcgacagcagaggactgctgtgtcgcaaccggaaagtccattttttcacccaggatcacaaacctagcaaccctctggaaaaagagcgtatccagaatgcgggaggtagcgtcatgatccaaagagtgaatgggagtctggctgtcagccgcgcactcggggattttgactacaagtgcgtgcacggcaaaggccctaccgaacaactggtgagccctgagccagaggtgcatgacattgagaggtccgaggaagatgaccagttcatcattctcgcctgtgatggcatctgggacgttatggggaacgaagagctctgtgactttgttcggagtcggctcgaggtgacagatgacttggagaaagtttgtaatgaagtggttgacacctgtctttataagggtagtagggacaacatgagcgtaatcttgatatgtttccctaatgcaccaaaagtttcaccagaagcagtgaaaaaagaagctgaactagataagtacttagagtgtcgagtcgaagggggttcattcaataaaaaatag

SEQ ID NO: 53164 - DNA, 1149 bp, Artificial Sequence
  Description of Artificial Sequence: Synthetic coding sequence
atgggagcattccttgacaaacccaagatggaaaagcataatgctcaggggcaggggaacgggctgcgatacgggctatctagtatgcaaggctggcgcgtcgaaatggaggatgcccacaccgccgtcatcggactcccctctggactggaatcctggagcttcttcgccgtgtacgatggccatgcaggctctcaggtcgccaagtactgctgcgaacacttgcttgaccatatcaccaacaatcaggattttaaagggtctgctggcgcaccgagcgtggagaatgtgaagaacggcattaggaccggttttttggagattgacgaacacatgcgtgtcatgtctgagaaaaaacacggcgctgaccggtctggtagcacggccgtgggggtgctgattagccctcaacacacctattttattaactgtggagactcacgaggcctgctgtgtcggaatcggaaggtgcattttttcacccaggaccataagccaagtaatcccttagaaaaagagcgcatccagaacgcaggaggtagcgtcatgattcagagagtgaacggatcactagcagtgagtagggctctgggtgactttgactataaatgcgtgcacggtaaaggccctaccgaacaattggtctcccctgagcccgaggtgcacgacatagagaggagtgaggaagatgaccagttcattatcctggcgtgcgatggcatctgggatgttatgggtaacgaggagctgtgtgacttcgtgagatcaagactggaggtcactgacgacctcgaaaaggtgtgtaacgaagtggttgacacctgtttgtacaagggtagcagagataacatgtcagtgattcttatctgctttccgaatgcgccaaaggtgagcccagaggctgtgaaaaaagaggctgaactggataagtacctagagtgccgcgtggaagaaatcatcaaaaagcaaggtgaaggggtccccgacctcgtccatgtcatgcgcacactagccagtgagaacatcccatctctgccgccaggaggagagctcgcctccaagcggaatgtgattgaggccgtgtataatcgtttaaacccctataaaaacgatgacactgacagcacctcaactgatgacatgtggtag

SEQ ID NO: 53165 - DNA, 564 bp, Artificial Sequence
  Description of Artificial Sequence: Synthetic coding sequence
atgggagctttcctggataaacctaagatggaaaagcataacgcccagggacaggggaacggactgcgttacgggctatcgtctatgcagggctggcgcgttgagatggaagacgcacatactgccgtgatcggactgccaagtgggctggaaagttggagtttttttgctgtctatgacggccatgctggctcgcaggtagccaagtattgttgtgagcatctactcgatcacattacgaataaccaggacttcaaaggttccgctggagcaccaagcgtagagaacgtaaaaaatggcatccgaacaggcttcctggagattgacgagcatatgcgagtcatgagtgagaaaaaacacggggcagatcgatccggatccaccgctgtcggcgtgctcatcagcccccagcacacttactttataaattgcggagactctcgcggtctgctttgtagaaacaggaaagtgcattttttcacacaggaccacaaacccagcaaccccctggaaaaggagcgcatccagaacgctggcggaagtgtgatgatccagcgagtgtag

SEQ ID NO: 53166 - DNA, 390 bp, Artificial Sequence
  Description of Artificial Sequence: Synthetic coding sequence
atgggggcttttctggataaacccaaaatggagaagcataatgctcaggggcaaggcaatggactccggtatggcctgtcgagcatgcaggggtggagggtcgagatggaggacgctcatacagcggtgatcggtctcccgagcggacttgagagttggtctttctttgctgtctatgatggccatgccggatcacaggtggccaagtactgctgtgagcacctgcttgaccatattactaataaccaagattttaaggggtcggcaggtgcgcctagcgttgaaaacgtgaaaaatggtattcggaccggctttcttgagatcgacgagcatatgcgtgtcatgagcgagaagaagcacggcgctgataggtccggttctactgcgtag

SEQ ID NO: 53167 - DNA, 1149 bp, Artificial Sequence
  Description of Artificial Sequence: Synthetic coding sequence
atgggggcattcctcgataaacctaaaatggagaaacataatgcccaaggccagggtaatgggctgagatatggacttagttcaatgcaaggctggagagtcgaaatggaagacgcccacactgctgtgattgggctgccatcagggcttgaaagctggagcttttttgcagtttatgacggtcacgcaggatctcaggtggcaaagtattgctgtgagcatctgcttgatcacattactaacaatcaggacttcaagggcagcgccggagcacctagcgttgagaatgttaagaatggcatcaggacagggttcctggagatagatgagcatatgcgggtgatgtcagagaaaaagcacggcgctgacaggagcggtagcactgccgttggggtccttatttccccacagcacacctatttcattaattgcggtgactctcggggacttctgtgcagaaacagaaaagtacacttctttacgcaggaccacaaacctagcaatcctctcgagaaggaacgcattcaaaatgcaggcggaagtgtgatgatccagagagtgaatggatcactggccgtatcccgcgcattaggggactttgattacaaatgtgtgcatgggaagggtcccacagagcagcttgtctcccctgaacctgaggtgcacgacatagaaaggagcgaagaagatgaccagttcatcatcctggcttgcgatgggatttgggacgttatggggaacgaggagctttgcgactttgtgaggagccggctggaagtgacggacgatctggagaaagtctgtaatgaagtcgtggatacctgcctgtacaaagggtcaagggataacatgagcgtaatccttatctgtttccccaacgcgcctaaagtctctccagaggcagtgaaaaaggaggccgagctggacaagtacctagagtgcagggttgaggaaataattaaaaagcaaggggaaggggtgcccgacctagtgcacgtcatgcggactctggcctcggaaaatatcccttcactgcctcctggcggagaactcgccagcaaaaggaatgtgatagaggcggtctataaccgtctgaatccttacaagaacgatgatactgatagcacctctactgacgacatgtggtag

SEQ ID NO: 53168 - DNA, 447 bp, Artificial Sequence
  Description of Artificial Sequence: Synthetic coding sequence
atgggggctttcctggataagccaaaaatggaaaaacacaacgctcaaggtcagggcaacggtctccgctacggactctcatctatgcagggctggcgcgtggaaatggaggatgcacacactgcggtcattggactgccatcggggttagagagctggagcttttttgccgtgtacgacggccacgcagggagccaggtagccaagtactgttgcgagcatcttttggaccacattactaataatcaagattttaaggggagcgcgggtgctccttccgtagagaacgtcaaaaacggcattagaaccggatttctggaaattgatgaacacatgagagttatgtctgaaaagaaacatggcgcagacagaagcggatcaaccgccgtcggggtactcatctctccccaacatacttacttcattaactgtggcgactcacggtag

SEQ ID NO: 53169 - DNA, 2367 bp, Artificial Sequence
  Description of Artificial Sequence: Synthetic coding sequence
acgcactacctgagtcctggcctgagcgacttctacctgaatcactcacctgccagcacttgtaccttgcgtagatcattaggttctgaaacaggcaagtgtttgccggcacactcgctgttgccaaagttttttccgtgtagagaggacgtgcataaggtggacatcatgactttttgccaacagaaagctgcccaaagttgcaaaagcgaaacactcggatcacgcgattccgccctcctgtggcaactgctggttttactttgcaggcagaacggttctatggtcggttcggatatagctgagctgctgatgcaggattgcaaaaagctcgagaagtataagcggcaaccccctgtcgccaatctcattaacttgacggacgaagattggccagtgctctcctctgggacaccaaacctgttgaccggagagatcccacccagtgtggagacccctgcccagatagtggagaagttcacacggcttctgtactacggacggaaaaaggaagcccttgagtgggccatgaaaaaccatctgtggggccatgccttgtttctgtcttccaagatggacccgcagacctacagctgggtaatgtccgggtttacttccactttagcattgaacgacccactccaaaccttgttccaactgatgtcaggcagaattccacaggctgctacgtgttgcggagaaaagcaatggggcgattggcggcctcatcttgcggtgatactatccaaccaagcaggggatcctgaactctaccaacgagcaatagtggccatcggcgatacccttgccggaaagggcttagtagaggcggcacatttctgttacctgatggctcacgtccctttcggtcactacaccgtcaagactgatcacctagtgctgctaggcagtagccacagtcaagaatttctcaagttcgccactactgaagcgatccagaggaccgagatcttcgaatattgccaaatgctcggcaggccaaagtcattcatccccagttttcaggtgtataagctgctctatgcttcacggctagctgactatggattggtgtcgcaggcccttcattactgtgaggcgataggagcagctgtcttatcccaaggggaaagctctcatccagtacttttggtagagttgataaaacttgctgaaaaattaaagctgagcgaccccttggtcctggagaggaggtcaggcgatcgagacctggagcctgattggctggctcagcttcggaggcaactggaacagaaggtggccggtgacatcggcgatccgcaccccaccagatctgacatctctggggcaggaggcacaaccactgagaacaccttctaccaggacttcagtggatgccagggttacagcgaggccccaggctaccgatcagctctgtggcttactcccgagcagacttgtctgctacagccatcacctcagcagccctttccccttcaaccagggtcctaccccgcaggcggtggcgcaggccagaccggtaccccaaggccattttactcagttccagaaactcatttgccaggcacaggatctagtgtcgccgtcactgaggccaccggtggcactgtctgggaggagatgctccagactcatctagggcctggagagaatacagttagccaggaaaccagccagcctcctgacggacaagaagtcatcagcaaaccacaaacccccctcgcagccagacctagatccattagcgaaagtagtgccagctccgcaaaagaggacgagaaagagtccagtgatgaggccgacaaaaattctcccagaaacactgcgcagcgcggtaaactgggagacggtaaggaacatactaaatcttcaggatttggatggttcagctggtttcggagtaagccgactaagaacgcctctccggctggagacgaggatagtagcgatagtcctgactctgaacaggagacccctcgcgcttcatcaccgcaccaggctgggctgggcctctcactgacaccctcccctgaatcaccacctctgccagatgttagcgcattctcccgcggaagaggaggcggagaaggaagggggagtgctagctccggaggagctgccgcaggggctggcgtcggaggtctttccggacccgagagcgtgagctttgaattatgctccaatcccggtgtactcctgccacctccggctctaaaaggcgcagtccccctctacaatccttcccaggtgccccagttgccaacagccaccagtctgaaccgccctaatcggctgagcgcatccctctcccacccggctatgctgcggatcaatactaggcctcgtctgatatcgcaggattag

SEQ ID NO: 53170 - DNA, 3183 bp, Artificial Sequence
  Description of Artificial Sequence: Synthetic coding sequence
atggaactttgggcaccgcaacgtcttccacagactcgaggcaaagccactgccccttcgaaagacccagacagggggttccggagggacggacaccacaggcctgttcctcattcatggcacaatggcgagcgtttccaccagtggcaggacaacagaggttctcctcaacctcagcaggagcccagagctgaccaccagcaacagccccactatgcctctaggcctggggactggcaccagcctgtgagtggtgtggactactatgagggcggatataggaaccagttgtactccagacctgggtatgaaaatagttatcagagttaccagagtccaaccatgcgggaagaatatgcctacggatcgtattactatcatgggcatccccagtggcttcaagaagagagagtgccccgacaacgttccccatacatctggcatgaggactatcgggagcagaaatacctcgacgagcatcactacgagaaccaacatagcccttttggcaccaatagtgagacgcactttcagagcaacagcagaaatccttgtaaggacagcccggcatctaacagtgggcaagaatggcccggagagctgttccccggaagcctcttagccgaggctcaaaaaaacaagccctcactcgcatctgaaagcaacctgcttcagcaacgggagagcggactgtcctctagtagctacgaactgagccagtacatccgcgatgcccctgaaagagacgatccacctgcatccgccgcttggagtcctgtccaggcagatgtttcaagtgccggacccaaagctcccatgaagttttatattcctcatgtgcctgtgtcttttggaccgggaggccaactcgtccacgtcgggcctagctccccaactgatggccaggccgcacttgtggagcttcacagtatggaagttatcctgaatgacagtgaggaacaggaggaaatgcgcagttttagcggccctctcataagagaagacgtgcacaaggttgacatcatgacattttgtcagcaaaaggctgcccagtcctgtaagagtgagacattagggtcccgtgactcagcgttactgtggcagctgctggtgctgctgtgcaggcaaaatggctccatggtcggaagcgacatagccgaattgttaatgcaagattgcaagaagctggagaaatacaagcgccagccaccagtagctaatctgatcaacttgacagacgaggactggcctgtcctctcctcaggaacccctaacctccttaccggagagatcccacccagcgtcgagactcctgcccaaatcgtggagaaatttacacgcctcttatactacggcaggaaaaaggaagccctcgaatgggccatgaagaatcacctgtggggccacgcactgttcctaagctctaaaatggatccacagacctattcctgggtcatgagcggcttcaccagcacacttgctttaaacgatcctcttcaaacactgttccagttaatgagcggtcgcatcccacaggcagcaacttgttgcggcgaaaaacaatggggcgattggaggccccatctggcggtgattctctccaaccaggctggagaccccgaattgtatcagcgtgcaatcgtagcgataggcgacactctagctggtaagggtctggtggaagcagcccatttttgttacctgatggcgcatgtcccgttcgggcactataccgtgaagacagatcacttagttctcttagggagttcccacagtcaagaattcttaaagttcgctacaacagaagcgatccagagaacagaaatcttcgagtactgtcagatgctggggaggcctaagagctttattcctagctttcaggtctataagctgctgtacgcttcccgtctggccgactatggactagtgtcacaggccctgcattattgcgaggcaatcggcgctgccgttctgtcccaaggggagtcaagtcacccggttctgctcgtggagctcatcaaactggcggagaagctaaagctaagcgacccccttgtgctcgagcgtaggtccggggaccgcgacttggagcctgattggctggctcagcttcgcaggcagctcgagcagaaggtggccggtgacattggggaccctcaccctacaaggagcgacattagtggagccggagggactacaaccgagaacactttctatcaagattttagtggatgtcagggatatagtgaagctcctgggtaccgaagcgctctgtggctaaccccagagcaaacatgtctgctgcagccttcccctcaacagccattccctcttcaacctggcagttaccctgccggaggtggagccggacaaacaggaacccctcgaccattctatagcgtgcccgagacacacttgccaggaacggggagttcggtagcagtcacagaagccactggaggaacggtgtgggaagagatgttacaaacccatctgggtcccggtgagaacaccgtgtcacaggagacctcccagccaccggacggccaggaggtaatctcaaaacctcagacacctctggcagctcgaccaagatctatcagtgagtcgtccgcctcgtccgccaaggaggacgagaaagagtcatctgacgaagccgataagaactcgccgcgtaataccgcccagagagggaagttgggagatgggaaggaacatactaagtcttctggtttcggctggttctcttggttccgaagcaaacctactaaaaacgcttctcctgctggcgatgaagattccagcgatagccccgactcagaggagaccccacgcgcatctagtccccaccaggcaggcctaggactttcactcacgcccagccctgagtcaccgcctcttccagatgtgtccgccttctcgagagggcgagggggaggcgaagggaggggctctgccagttcaggcggagccgctgcaggtgcgggtgtcggtggactgagtggtccagagagtgtcagttttgaattgtgctcgaatccgggagtcctattgcctcccccagcccttaaaggggcagtgcccctgtataacccctctcaggtcccccagctacccactgccactagtttgaacaggcccaataggctggctcagcgaagataccctacccagccatgctag

SEQ ID NO: 53171 - DNA, 2238 bp, Artificial Sequence
  Description of Artificial Sequence: Synthetic coding sequence
atggagctctgggctccgcagcgcctgcctcagacccggggaaaagcaaccgctccctcaaaagacccggataggggctttcgcagggatggacaccaccgtccggttccacacagctggcacaacggagagcggtttcaccagtggcaagataatagaggctcaccccagccgcagcaagagcctagggccgaccaccagcaacagcctcactacgcctctcgaccgggtgactggcaccagcccgtgtcaggagttgattactacgaagggggataccgcaaccagttatattctaggccagtattgtccagtggcacacctaaccttctcactggcgagattcctccttctgtggagacccctgcccagatcgtagagaagttcactaggttactctattacggccgtaagaaggaagctctggagtgggctatgaaaaatcacctatgggggcacgccctgttcttgagcagcaagatggatcctcagacgtattcttgggtaatgtcagggttcactagcacattagccctcaacgatcctctgcagacactgtttcagctcatgagcggcaggattcctcaggcagccacatgttgtggggaaaaacagtggggggactggcgcccacacttagcagtgatcttgtctaaccaagctggcgatccagagctgtatcagcgcgcaatcgtcgctatcggcgacaccctggcgggaaaggggctcgtcgaagcagcacatttttgctacctgatggctcacgtccctttcggtcattatacggtgaaaactgatcatctggtcttattgggatcttcacattctcaggagtttctgaagtttgcaaccactgaggcgatacaacgcaccgaaattttcgaatattgtcagatgctgggcagaccaaaatcgttcatcccatcttttcaggtttataagttgctgtatgcgagcaggctggccgactacggcctcgtttctcaggctctgcattactgtgaggctattggggcagcggtgctttctcagggcgagagtagccatcctgtgctcctcgtagagctgataaagctcgccgaaaagctcaagctgagtgatcccctggtcttggagcgtagatcaggggaccgcgatctagaaccagactggctggctcagctgcggaggcagctggagcagaaggtagcgggagatattggcgaccctcaccctactagatcagacattagcggcgcaggaggaactactactgaaaacaccttctaccaggatttctctgggtgtcagggctattccgaggccccaggttaccgctcagcactctggcttaccccagagcagacatgcctgttacagccatccccccagcagccttttccgctacagcctggatcctatccagcaggcggaggagcgggtcaaactggcacacctcggccattctattctgtccccgagacacacttgcctggcactggctctagcgtagccgtcactgaggccacggggggaacggtatgggaagaaatgcttcagactcacctgggccctggcgagaacactgtgagccaggaaacaagtcagcccccagacggacaggaggtgatttctaaaccacaaacccctctcgccgctcgccctcggtcaatctctgaatcctcagcctcctccgcaaaggaagacgagaaagaaagcagcgatgaggcagataagaactcaccaagaaacaccgcacagcgcggaaagctaggcgacggcaaagagcataccaagtctagcgggttcggatggtttagctggttcagatcaaaaccaaccaagaacgcatccccagctggggacgaggatagctctgacagtccagattccgagcaagaaacaccgagggcctcctcgcctcaccaggctggcctcggtctttctttaaccccctcccctgagtcaccacctttgcctgacgtaagcgccttctcgcggggaagaggcggtggcgagggaaggggttccgcttctagcggcggagctgccgcaggggctggcgtgggcggactgtctgggccagagtccgtgtctttcgagctctgctccaatcccggtgtgctgctgcctccaccagcattaaagggtgcagttccactgtacaacccatcccaggtgcctcagctgcccacagcaaccagcctgaaccgccctaacaggctggcccagcgcagataccccacccagccctgctag

SEQ ID NO: 53172 - DNA, 456 bp, Artificial Sequence
  Description of Artificial Sequence: Synthetic coding sequence
atggcggctactgcactgctcgaagccggactggctcgcgtcctgttctaccctactcttctgtatacactgtttagaggcaaggttccagggagagcccaccgtgactggtatcaccgcatcgacccaacagtgttgctcggagcgctacctctccgatccctaactagacaggtgtcaagggctggcgaacctggcccactgcccagacctcgcaggagtgtaccagtgggccctctcggctcccctccaagccttttgtctcatctttttgccagcgcggctggaacaggcagggagagagccagaggagatcatcacgaaaggggtgtaagggatgaagtcccagtccagttatttacaggtgctcagatggaatcacggggaggatgtaagtcccatcgacaggaccccgtgatccacccacaccaggcctggcccgcaggatgctcgtag

SEQ ID NO: 53173 - DNA, 3459 bp, Artificial Sequence
  Description of Artificial Sequence: Synthetic coding sequence
atgatcttcagcgatatgaacacagtctccggcagccccaaggtccacccaccaaacgggactagattctacaccttccaagagtttgccgctctgaccaaggaactcaatgcatgccgggaacaactcttggaaaaggaggaggagatctctgagctaaaagcagagcgcaacaacacccgtttgttactcgagcatctggagtgcctggtttctagacatgagcgaagtttgcgcatgaccgtggtgaaaagacaggcacagagccccagtggagttagtagcgaggttgaggtgttaaaagctctcaaaagcctctttgagcaccataaagccttagacgaaaagatagtcgccctaagagaacagaatgtccatattcagcgcaaaatggcttcatcggaaggttctacggaatctgagcacctggagggaatggagcccggacaaaaagtgcacgagaagaggctgtctaatggatcaatcgatagcactgatgagacttcccagatagtcgagctgcaggagctgcttgaaaagcaaaattacgaaatggcacagatgaaagagcgactggccgcactcagctcgagggtaggcgaggtggaacaggaagcggaaacagcccgaaaagacttgattaaaactgaggagatgaatacaaagtatcagcgcgacataagagaggccatggcccagaaggaggatatggaagagaggataactactctcgagaaaaggtacttatcagctcagcgtgagtccacctcgattcacgatatgaatgataaactggagaatgagctggccaacaaggaggccattctccggcagatggaggaaaagaaccggcaactccaagaaagattagaactggctgagcagaagctccagcaaaccatgaggaaggccgagaccttgccggaagtggaagccgaactagcccagaggatcgccgctctgacaaaagctgaagaaagacacgggaacattgaagagagaatgagacatctagagggacaattggaggaaaagaatcaggaactccaaagggctcgccagcgggagaaaatgaacgaggaacataataaacgccttagcgataccgtagacaggctactgactgaaagtaatgagagactgcagcttcatctgaaagaacggatggccgcacttgaggaaaaaaatgttttaatccaggagtctgaaacatttagaaagaatctagaggaatccctccacgacaaagagcgcctggcagaggagatagaaaagctgcggagtgagctggaccagcttaaaatgaggaccggttctttaatcgagccgactattccaagaacacacttggatacttccgcggagctccggtattctgtgggaagtctggtggatagtcaatccgactatcgaactaccaaagtgatcagacggcctagacgagggagaatgggcgtcagacgggatgaacccaaggtaaagtcgttgggcgatcacgagtggaacaggacacagcaaataggcgtactgagctctcacccgttcgagagcgatactgaaatgtccgacattgacgacgatgatcgggagactattttcagtagtatggatttactgtcaccgtccggtcacagcgacgcccagactttggcaatgatgctgcaggagcagctcgacgctatcaacaaagagatccgtctgatccaagaggagaaagaatccaccgagctcagagccgaagagatcgagaatcgggtcgctagcgtgtctctggaagggcttaatctcgctcgagtccacccgggtacctctattaccgcatccgtgactgcatcttctctggccagcagttccccaccatcagggcactctactccaaaactcactcctagatcccctgctcgagaaatggaccgaatgggtgtgatgactttgccatcggaccttcggaagcacaggaggaaaatcgcagtcgtggaggaggacggcagagaggataaggccaccataaagtgcgaaacgagtcccccaccaacaccaagagcattaagaatgacccacacccttccgagtagttaccataacgacgcaaggtcttccctgtcagtctcccttgagccggagagtctggggctggggagcgctaattctagtcaggactcactgcataaggctcctaaaaagaaaggaatcaagagctccatcggcagactttttggcaaaaaggagaaggcacggctaggtcaacttagagggtttatggaaacagaagcagcagcccaggagtccctgggcctggggaaacttggcacacaggccgagaaggaccgcaggttgaagaagaagcacgagctcctcgaggaagcgaggagaaagggacttccatttgcgcagtgggacgggccaacagttgtggcctggctggagctatggttggggatgcctgcctggtacgtggccgcttgtagagccaatgtcaaatccggcgcaatcatgtccgcactgtcagacactgagatacagagggagattggcattagtaatcctcttcacagactgaagctacggctagctattcaggagatggtgtcgctcacatctccttcagcgccacctacgtcgagaacgcctagcggaaatgtgtgggtgacacatgaggaaatggaaaaccttgcagcacccgctaagaccaaggaaagcgaagagggctcctgggcccagaccctggcctacggagatatgaaccatgagtggattggtaatgaatggttgccttctcttgggctgccacagtatcgctcttacttcatggaatgtttagttgacgctcgcatgctggaccatctaaccaagaaagatttaagagtacacctgaagatggtggattccttccacaggacttcgctccaatacggcatcatgtgcctgaaacgactgaactatgaccgtaaggagctggagcggaggcgcgaggcctcacagcatgagatcaaagacgtcctcgtttggagcaacgatcgggtcattcgttggatccaggcaattgggcttcgtgagtatgccaacaacatccttgaatccggcgtccacggcagcctgattgccctcgatgaaaattttgactactcctccctggcactgcttctgcagatcccaacgcaaaatacccaggccaggcagatcctagaacgtgaatataacaacttattggcccttggcaccgagcgcagattagacgaaagcgacgacaagaacttccggagagggtctacgtggaggcgacaattccccccaagagaagtgcacgggattagcatgatgccaggatcgtccgaaacacttcctgctggttttcggttgaccactacatcaggccagtcgcggaagatgactactgatgtggcctccagccggctgcagagactggataatagcacagtccgaacctactcctgttag

SEQ ID NO: 53174 - DNA, 2352 bp, Artificial Sequence
  Description of Artificial Sequence: Synthetic coding sequence
atgaggcatctagagggacagttggaagagaaaaatcaggagctgcagagggccaggcagcgggagaaaatgaacgaagaacacaacaagcgcctatccgatactgtggacaggctactgaccgaaagcaacgaacgactgcagcttcacttgaaggagcgaatggctgcactggaggagaaaaacgtgttgatacaagagtcggagacatttcggaaaaatctggaagaaagtctacatgacaaggaaaggttggccgaggaaatagagaagctgaggtcagaactggaccaactcaagatgcgcactggatccttaatcgagccaactattccgaggacccacctggacacttccgcagagctgcgctattctgtgggcagccttgtggattctcaaagtgactaccggacaactaaagtgatcagacgacctcgtagaggtaggatgggtgtgcgcagagatgagccgaaggttaagtccctcggcgatcatgagtggaacaggactcagcagattggggtgctcagctcccaccccttcgagtcagacaccgaaatgtctgacatcgatgatgacgacagagagactatctttagctccatggacttactctccccgtctggccactcagacgcacaaacgctggccatgatgctgcaagaacagctggacgctattaataaggagatccggctgatccaagaagaaaaagaatccaccgaactaagggctgaggaaatcgagaaccgagttgcctcggtctctctggagggactgaatctggccagggtgcatcctggcaccagcattactgcatccgtcactgcgtcaagcctcgcctctagctcgccaccctcagggcactccacacccaagttaacacccagatctcctgcacgcgaaatggaccgaatgggtgtaatgacactgccctctgatctgagaaagcacaggagaaaaatcgcagtggtcgaggaggacgggagggaagataaggccaccattaaatgtgagacatcaccgccaccaaccccacgagcccttaggatgacacacacgctaccttcttcctaccacaatgacgcacgaagtagccttagcgtgtcgctggaaccagaatcccttggacttggctctgcaaatagttctcaagatagtctgcataaagcaccgaagaagaagggcatcaagtcctctatcggcaggctcttcggcaaaaaagagaaggccagattgggccagcttagaggctttatggagactgaagccgcagcccaagaaagcctgggtctgggcaaacttggaacccaagccgaaaaggatagaaggctgaaaaaaaaacacgaactgttagaagaggcaagacggaaaggcttgccatttgctcagtgggatggcccaactgttgttgcttggttagaactctggctcgggatgcccgcttggtacgttgctgcttgcagagccaacgttaagtcaggcgctataatgagtgctctttctgacaccgagatccagagggagatagggataagtaaccccctgcacagactgaagctccggctagcaattcaagagatggtgtctctaacttccccctcagccccacctacctctaggacctgccctgtattccttcagacgctggcctatggggatatgaaccacgagtggattggcaatgagtggctcccaagtctcgggctgccccagtataggtcttatttcatggagtgtttggtggacgcgagaatgcttgaccatttgaccaagaaagatctgcgtgtgcacctcaaaatggtggattcttttcatagaacctctttacagtacgggattatgtgtctgaagcgtctcaactatgaccgaaaggaactcgagagaagaagagaagcctcccagcacgagattaaagatgtcctggtttggtcgaacgatcgagtgatccgatggattcaggcaatcggcctgagagagtacgctaacaatatcctcgagtctggcgtgcacggtagcctgatcgcactcgatgagaatttcgattattccagtctcgcactgctgctccagatccccacccaaaacacgcaggcccgacagattctggaaagagaatacaataaccttctggcattgggtacggagaggagattggatgagtccgatgacaagaacttccgtagggggtccacttggagaaggcagttccccccacgggaggtccacgggatctccatgatgccaggctcgtctgaaaccctgcccgctggctttcggctgactaccacctccgggcaaagtaggaagatgactaccgacgatggggtgttttccgtttattccacatag

SEQ ID NO: 53175 - DNA, 3756 bp, Artificial Sequence
  Description of Artificial Sequence: Synthetic coding sequence
atgatgtgcgaagttatgccaaccattaacgaagatactcccatgagccaacgtggcagtcagagctctgggagcgattctgacagccattttgagcagctgatggttaacatgttggacgaacgcgacagattactggacaccttacgggaaacccaggaatcgctgtctctcgcccagcaaagactgcaagatgttatctacgacagagacagcttgcagcgccaactaaacagcgccctgccccaggacattgagtccctgaccggaggcctagcgggtagcaaaggtgccgaccccccagagtttgcagcgctgacgaaagagctgaatgcctgccgggaacagctccttgagaaagaagaggagattagcgagctaaaggcagaaaggaacaatactaggctccttctggaacacctcgagtgcctggttagtaggcatgaacgctccttgagaatgactgtggttaagagacaagctcagagcccctccggcgtcagcagcgaggttgaagtcctgaaagccctcaaatccctgttcgagcaccacaaagcactcgacgagaaggttcgcgagagactgcgcgtttctctggagcgcgtttccgcgcttgaagaagagttggctgctgccaaccaggagatcgtggctctgcgagagcagaacgtgcacatccagcggaagatggcctcgtccgaggggagtactgaaagcgaacacttagaaggtatggagcccggtcaaaaagtccacgagaaaagattatcaaatggatccatcgattctacagacgaaacatctcaaatcgtggagctgcaggaattgctggagaagcaaaattatgaaatggcgcagatgaaggaaagactcgcagccctgagcagcagagtaggcgaggtggagcaggaggctgagaccgctcgaaaggatttgataaagacggaagaaatgaacactaagtaccaacgtgacatccgagaagccatggctcagaaagaggatatggaggagaggataactactctggaaaagagatatctcagtgcacagcgcgagtccaccagtatacacgatatgaacgacaagttagaaaatgaacttgccaacaaggaggctattcttagacagatggaggaaaaaaacaggcagttgcaggaacggctggaacttgccgagcagaagctgcagcagacaatgagaaaggcagagacgctgcctgaggtagaggcagaactagcccaacgcatcgcggctctgactaaggccgaagagcgacatggaaacatcgaagaaagaatgcgacatctagaggggcagctcgaggagaagaatcaggagctccagagagctcgccagcgcgaaaaaatgaacgaagaacacaacaaacgactgagtgacaccgtggatcgactgctcacagagtcaaatgaaagactgcagctgcacttgaaggagcgcatggccgctctggaggagaaaaatgtgctgatacaagaatctgaaacatttaggaagaacctcgaggagtcactccatgataaggagagactggccgaagagatcgagaagctgcgcagtgagttagatcaactgaaaatgcgaaccgggtctctcatcgaacccaccataccacgtacacacctcgacacatcagcggaactgcggtactcagtaggtagcctggtcgattctcagtccgattatagaacgactaaggtcattcgcagacctcggcgtggtcggatgggggtgaggcgtgatgaacccaaagtaaagtcattaggcgaccacgagtggaacaggacacagcagatcggggttctgtcatcccacccgtttgagtcagatacagaaatgtcagatatcgacgacgatgaccgagagacaatctttagttcaatggacttattgtctcctagtggacatagtgatgcacaaaccttggcgatgatgcttcaagaacaattggacgcgattaataaggagatccgacttatccaggaagagaaggaaagcacagagttacgagcggaggagatcgagaatagagtcgcaagtgtcagcctcgaaggtctcaacctcgcgagggtgcatcctggaacaagtattacagcatctgtcaccgccagctctcttgcctctagttctcctccttccggacacagcacccccaagctgacaccgagaagccctgcgcgagaaatggatagaatgggagtaatgacactgcccagcgacctgcgtaaacacaggcggaagatcgccgtggtggaggaagacggtcgcgaggataaggcaaccataaaatgcgagacaagtcccccacccacgccgagggccttacgtatgacccacaccttacctagttcatatcacaacgacgcccgaagttctctcagcgtaagcctagagccagagtcgttgggcctaggttccgcaaattcgtctcaggactccctgcacaaagcgcctaaaaagaaggggatcaagagcagcattggtcgattgtttggcaaaaaggaaaaggcccgtttaggccagttacgtggattcatggagaccgaggcagcagcacaggagtccctcgggttaggaaaactcggaacacaggccgagaaggataggaggttgaagaagaagcatgaactgctggaggaagcccgtaggaaaggattgccttttgcacagtgggacggccctacggtggtcgcctggctcgaactctggctcgggatgccagcctggtatgttgccgcttgccgagcgaatgtaaagagcggggctattatgagtgctctgtcggacactgaaattcagagggaaattggcatttctaatcccctgcaccgcctgaagctgcggttggccattcaagagatggtgagtctgacctccccttcagcacccccaacatcccggactcctagcgggaacgtgtgggttacacacgaagagatggagaacctggcggctccggctaaaacaaaggaatcagaggagggttcctgggcccagacgctggcctacggagacatgaatcacgaatggatcgggaacgagtggctcccaagcctcgggctccctcagtataggtcgtacttcatggaatgccttgtggacgccaggatgctagatcacctgaccaagaaggatctgagggttcacctgaagatggtcgactctttccaccgcactagccttcagtacggcatcatgtgtttgaaacgacttaactacgatcggaaagagctcgagcggagaagggaggcaagccagcatgaaattaaggacgtgctagtttggagtaatgatcgagttatcaggtggatccaggccatcggactgcgcgagtatgcaaataatattctggagtcaggagtacatggtagtctgatcgccctggacgagaatttcgactattcgtctctggcattgcttttacagatcccgacccagaacacacaggctcgtcagatacttgagcgagagtacaacaacctactcgcactaggtacagagaggcgcttggacgagagcgatgataagaacttccggagggggtcaacctggcgtcggcaattccctcccagggaagtgcacggaatctcgatgatgcccggtagttctgagaccctccctgctggctttcgcctgacaacaacctcggggcagtcgcgaaagatgaccacggatgtggcttcgtctcgactgcaacggctggacaactctactgtgaggacttattcctgctag

SEQ ID NO: 53176 - DNA, 3699 bp, Artificial Sequence
  Description of Artificial Sequence: Synthetic coding sequence
atgatgtgtgaggtcatgcccaccattaatgaggacacacccatgtcacagcgcggatcacagtccagcggctcagattccgactcccactttgagcagctcatggtgaatatgcttgacgaaagagacagactgctagacaccctccgagagacacaggagagcctgtctctggcccagcagagacttcaggacgtaatatatgatagggattcgttacaaaggcagctaaactctgctctcccccaggagtttgccgcattgaccaaggagctgaacgcatgccgggagcaactcctggagaaggaggaagagatcagtgaacttaaagccgaacgtaataacacccggctgttgttggagcacctcgagtgcctagtgagtaggcatgagcggagtctgcgtatgacggttgtaaaacgacaagcccagtctccctctggcgtcagctcggaggtcgaggtccttaaagcgctaaagagcctctttgagcatcataaggccctggatgaaaaggtaagggaaaggctacgcgtgtctttggagcgggtgagtgcccttgaggaggagctggccgctgcaaatcaggaaatagtggcattaagggagcagaacgtgcatatccagaggaagatggcttcctccgagggatcaaccgagagtgagcatttggagggcatggagcctggtcaaaaggtacatgaaaagcgtttgagcaatggcagcattgacagcacagacgagacttctcagatcgtggaattgcaggaactactggaaaagcagaattatgagatggcacagatgaaggagaggctcgccgcactgagctctcgtgttggggaggtggagcaggaggcagagaccgctagaaaagacctgattaagaccgaagagatgaataccaagtaccagagagacatccgcgaggccatggcccagaaggaggatatggaggagaggataactacactcgaaaaaagatacttgtctgctcagagagaaagtacttcaattcacgatatgaatgataagcttgagaatgaactggctaacaaggaagcgatcctccgccagatggaggaaaagaatcgccagttgcaggagaggctggaactggcagaacagaagctgcagcagacaatgagaaaggccgagacactgcccgaggtcgaagccgaattggcgcagaggatcgcagcgctgaccaaggccgaggaacgtcacggcaacattgaagagcggatgagacacctggaaggtcagctagaagagaaaaatcaggagctgcagagggcaagacagcgggaaaagatgaacgaggaacataacaaacgcctgtcggatacggtggatcggctgctcaccgaaagcaatgaaagactccagcttcatctaaaagaaagaatggccgctctcgaggagaaaaacgttctgatccaagagtccgaaacatttagaaagaatctcgaggaatcattgcatgataaagagcgccttgcagaggaaattgagaaattacggtccgaactcgaccagttgaaaatgagaacagggagtctcatcgaaccgacgattcctaggacacacctggatacgtccgctgaattgcggtactcggtggggagtctagttgacagccagagcgactaccgcacaactaaagtgatccgcaggcccaggagaggcagaatgggagtccgcagagatgagcccaaggtgaagagtctcggagaccacgagtggaataggactcaacagataggggtgctttcttcccacccatttgaatcagataccgagatgagcgatatcgacgacgatgaccgagagaccatattctccagcatggacttgctatctccttccggacactcagatgcgcagacgctggccatgatgctgcaagagcagctagatgccatcaacaaagagatccgactgattcaggaagaaaaagaatccacagagcttcgagctgaggagatcgagaaccgggttgcatctgtgagtctcgaagggttgaaccttgctagagtacacccaggcactagtataaccgcgtctgtaactgcttcgagtctggcttcttcatcccctccctcgggacactccactcccaaactgacaccaaggtctcccgcaagggagatggaccgtatgggggtgatgaccctgccttctgacctgcgcaaacatcgaagaaaaattgccgtggtggaagaggacggcagagaggacaaggcaacaataaaatgtgagacaagtccaccaccaacaccacgtgccctgaggatgacccacaccctacctagttcataccacaacgatgccaggagttcattaagtgtgagcctggagccagaatccttgggactagggtcggctaattcctcacaggattcgctgcacaaagctccaaagaagaaggggattaaatcatccattggcaggctgtttggtaagaaagaaaaagcccgactcgggcagctgaggggctttatggaaaccgaggctgcggctcaggagtccctggggttgggaaaactgggaacacaagctgagaaagataggcgcctgaaaaaaaatacgagcggtcacgagctgcttgaggaggcccgacggaaggggctgccattcgcacagtgggatgggccaaccgtggtcgcatggctggaactgtggttaggcatgcccgcatggtacgtcgcggcttgtagagccaacgttaagagcggcgcaatcatgagtgccctgagcgatactgaaattcagagggaaattgggatttctaacccgttgcataggctaaaattgcggcttgccatacaggagatggttagcctgacctcccccagcgcaccccctacatcccggactccatccggaaacgtgtgggtgacccacgaagaaatggagaatttggctgccccagccaaaacgaaggagtcggaggagggcagttgggcacaatgtcctgtttttctccagactctcgcatacggggatatgaaccacgagtggattggcaacgaatggctgccgagtcttggactgccccagtaccgcagttatttcatggagtgtctcgtggatgcccgaatgctggatcacttaacaaagaaagatcttagggttcacctcaagatggtcgactcttttcacagaacgtctctgcagtatgggataatgtgtttaaaacgactaaactacgataggaaagagctggaacgccgaagggaagcatctcaacatgaaatcaaggacgtgttggtgtggagcaatgaccgcgttatccggtggatccaagctataggactgcgcgagtatgcaaataacattctggaatccggcgtgcatgggagcttgattgctcttgacgaaaactttgactactcatcactggcactactgctacaaatccccacccagaatacccaggcaagacagatactggaaagagagtacaacaatctactggctttgggcacagagagacggctggacgagagcgatgataagaacttccggagaggctctacctggaggagacagttccctcccagagaagtgcacggaatttcaatgatgccaggcagcagtgaaacgctgcctgctggatttcggctgactaccactagcgggcagagtaggaagatgaccacggacgacggcgtattttccgtctactctacttag

SEQ ID NO: 53177 - DNA, 3633 bp, Artificial Sequence
  Description of Artificial Sequence: Synthetic coding sequence
atgatgtgcgaggtgatgccgacaatcaacgaggatacccccatgagccagagaggcagccaatcatcaggctctgacagtgatagtcattttgaacagttaatggttaacatgcttgacgagcgcgatcgactgctagacactctacgggagacccaggagtctctcagcttggcacagcagcgccttcaggacgtgatctatgacagagattctctgcagagacagttaaattccgcattgccccaagatattgaaagtctcaccggcggtctggctgggtccaaaggggctgacccacctgagttcgccgctctgactaaggagttgaatgcctgtagagagcagttactggagaaggaagaggagatttccgagcttaaggccgaaagaaataacactcgccttctgctggagcacctggaatgtctggtgtcccgccatgaacgttcccttcgaatgaccgtggtgaagagacaggcccagtcaccgagtggtgtgagttcggaggtggaagtactaaaggccctcaagtctctctttgaacatcacaaggctctggatgaaaaggtacgggagaggctgcgggtgagcttggagcgcgtaagtgccttggaggaggaactcgccgcagcaaaccaagagattgttgccttgcgggaacaaaacgtccacattcagcgcaaaatggccagctccgagggttccacggaatctgaacacttagaaggaatggaaccaggccaaaaagtccatgagaaaagattatctaacggttccatagatagtaccgacgaaacttcgcaaatcgtcgagcttcaagagctactcgaaaagcagaattatgaaatggcccagatgaaagagcgcttagctgccctgtcttctagggttggcgaggttgaacaggaggccgagacagctcgcaaggatctgatcaaaaccgaggaaatgaatacaaagtatcagcgtgacattcgggaggccatggcccagaaggaagacatggaggaaagaatcaccaccctggagaagcgttatctgtctgcacagcgcgaaagcactagcattcacgatatgaatgataagctcgagaacgaactagccaacaaagaggcaatactcagacagatggaagagaaaaatcgacagttacaagagagattggaattagcggagcaaaaactgcagcagactatgcggaaggcagaaacccttccagaagtggaagccgagctggctcagcgaatcgccgctcttaccaaagcagaagaacgccatggaaatattgaggagaggatgagacatttggagggtcagcttgaggagaagaaccaagaattacaacgggctcgccagagagaaaagatgaatgaagagcacaataaacgtttgtctgacaccgttgataggttgctcacagaatcaaacgagcggctccagctccatcttaaggagaggatggctgccctcgaggagaagaacgtgctgatacaggaaagtgaaactttcagaaagaacctcgaggagtcccttcacgataaagagaggctggccgaggagattgagaaactgaggtcggaactggatcagctgaagatgagaaccggcagcctaattgaaccaaccatccctcgcacacacctggataccagcgccgagttgcggtacagcgtgggaagcctggtggactctcagtcggattataggactactaaggtgattcgtaggccaagaaggggccgtatgggcgtgcgaagggacgagcccaaagtgaagagcttaggcgaccacgaatggaatcggacacagcagataggcgtactgtcctctcacccatttgagagtgacacagaaatgtcagatatcgatgacgatgaccgcgagactatcttctctagtatggatctgctctcaccttctggacactcagacgcccagactttggcaatgatgcttcaagaacaactggacgctatcaacaaagagattcggctcatacaggaggagaaggaatctacagagctgagggccgaagagatcgaaaatagggttgcctccgtgtcgctcgaaggcttaaatctagctcgtgtccatccaggcacaagtatcactgcatcggttactgcaagtagcctggcctcctccagccctccaagcggacactcgactcctaaactgacccccagatcacccgcacgggagatggatagaatgggcgtaatgacgctcccttccgatctcaggaagcataggcggaaaatcgccgtggttgaggaagatgggagggaggacaaagcaacaataaagtgtgagacatctccgcctccaacacccagggcgcttaggatgacccacacgctaccgagctcctaccacaacgatgccaggtccagcttgagtgtgtctttagaacctgagagccttggtttgggctctgccaactcgtcccaagatagcctccacaaggcaccaaaaaaaaagggtatcaaaagcagcattggtcggctgtttggaaagaaggaaaaagccaggctgggccagctcagaggattcatggaaacagaggccgctgcacaggagagcctaggcctcggaaagctgggaactcaggccgagaaagacaggaggttgaagaaaaaacatgagctcctggaggaggccagacgaaaaggccttccttttgcacagtgggatggcccaacagttgtggcatggttggaactctggctcgggatgccggcttggtacgtggcagcatgccgggctaatgtgaagtctggggctataatgagtgcgctcagcgatacggaaatccagcgggaaataggaatcagtaatcctctccaccgcctgaaactgaggctggctatccaggaaatggtttctctcacttctccatctgcccctcctacttcccgcaccccaagcggaaacgtgtgggtgacacacgaggagatggaaaatctagcagctcctgccaagactaaagaatccgaggagggttcctgggcccagtgtccagtcttccttcaaaccctggcgtacggcgatatgaatcacgagtggatcgggaatgagtggctgcccagccttggactaccccagtaccgatcctatttcatggagtgccttgtggacgcgagaatgctggatcatctcactaaaaaagacctgcgggtccatctcaaaatggtggattccttccatcgcacatcgctgcagtacggaattatgtgtctgaagagactgaactacgaccgcaaggagctggagaggcgcagggaagcctcccagcacgaaatcaaagatgttctggtctggtctaatgacagggtaatcaggtggattcaggcaatcgggctccgagaatatgcaaacaacatcctggaaagtggagtccacggatccctgatcgccttggatgaaaactttgattactcgtctttggccctcctcctccagatccctacgcagaatactcaagcgagtagatttctcaaggagaacactataacttcctggccatgggaactaaaaggcgactggatgaaagtgatgacgagaacttcagacgttgatcagccaggagagggctcgttcctcttggtgaagtatatggagagtgcttag

SEQ ID NO: 53178 - DNA, 3711 bp, Artificial Sequence
  Description of Artificial Sequence: Synthetic coding sequence
atgatgtgcgaggttatgcccactataaatgaggatactcctatgtcacaacgcggaagccagtccagcggctccgactcagactctcacttcgaacagttgatggtcaacatgcttgacgagagggatcgcctgctcgatacactgcgcgagactcaagagtccttgtcccttgcacagcagaggctgcaggacgttatctacgacagggacagcttgcagagacagttaaattctgccttaccacaggacattgaaagcctcaccggaggattagcaggcagcaaaggggcagatcctcccgagtttgccgctcttacgaaggaattaaacgcatgcagagagcagctgctggaaaaggaggaggagatctcagagctcaaggcggagagaaataacactcggcttttgctggaacacctagagtgtttagtttctcggcacgagcgctcactgcggatgaccgttgttaaaagacaggcacaaagtccttccggggtcagcagcgaggtggaggtcctgaaagccctgaagagtctattcgaacaccacaaagctcttgacgagaaagtgcgagaaagactgcgcgttagcctggaacgcgtgagcgccctggaggaagagctcgcagcggctaaccaagaaattgtcgccctgcgtgagcagaacgtccacattcagagaaagatggcgagcagtgaaggctccacagaaagcgaacatcttgaaggtatggaaccaggacagaaggtgcacgaaaaaagactcagtaacggcagcatagacagcacggacgaaacttcccagattgtcgagctgcaggagctcctggaaaagcaaaactatgaaatggcccagatgaaagaaagactggccgctctctctagcagggtgggagaggttgaacaggaggctgagaccgccagaaaggatctcatcaaaaccgaggagatgaacacaaagtatcagcgggacattagagaggctatggctcagaaagaggatatggaggagcgaataaccactttggaaaagaggtacctcagtgcccaacgcgagtctacctctatccatgacatgaacgataaactggaaaacgaactcgcgaacaaggaggccatcctgcgtcaaatggaggagaagaaccggcagctccaagaacgcctggaactggcggagcagaagctgcagcagacaatgcgaaaggccgaaactctgccggaagtcgaggcggaactcgcccagaggattgcagctctaacaaaggccgaagagagacacggtaatatcgaggagaggatgcgtcacctggaggggcaactggaggaaaagaaccaagagctgcagcgcgctcgccagcgggaaaaaatgaacgaagagcacaacaagcggctttctgatactgtggacagactactgacagagtctaatgagaggcttcagctgcacctcaaggagaggatggctgctcttgaggagaaaaacgtcctcattcaggagagtgagacatttagaaaaaacctggaggagtctttgcatgataaggaacgtcttgcggaagaaattgagaagctacggtccgaactagatcagcttaaaatgcgcaccggaagtttgattgagccaaccattcccagaacacacctcgataccagcgccgagctccgctactcagtgggatcattagttgacagtcagagcgactaccgtactaccaaagtgattcgcaggcctcggaggggcaggatgggagtcaggagagacgagcccaaagttaagtctctgggtgaccatgaatggaaccgcacccaacaaattggagtgctctctagtcatccattcgagagcgatacggaaatgagtgatatcgacgacgacgacagagaaactattttttcatctatggatttattaagccctagcggacactcagacgctcagacattagctatgatgcttcaggaacagttggacgcaatcaataaggagatcagattaatacaggaggagaaggagtcgacagagctgcgcgcagaggaaatcgagaacagggtggcaagtgtgtcattggaggggctgaatctggccagagtgcatccaggcaccagcattacagcctcagtgacggcaagctccctggccagctccagtccgccttctggtcactctaccccaaagctgacgcccagatcacctgccagagagatggatcgcatgggtgtaatgaccctcccttccgacttacgtaaacatcgtaggaaaatcgccgttgtggaggaagacggccgtgaagacaaagccaccatcaagtgtgaaacgtccccacctcctactcccagagcattgcgaatgacacatacgctgccaagttcttaccacaacgatgcacgatcaagcctgtcagtctcactcgaacccgagtctctgggcttagggagtgcaaatagttcgcaggattcacttcataaggctccaaagaagaaggggattaagagctcaattgggcgactcttcggaaagaaggaaaaagccaggctgggacagctgcgtggattcatggaaaccgaggccgcagcccaggagagtctggggctcgggaagctgggaacacaagctgaaaaggatagaagacttaagaaaaaacatgagctcctcgaggaagcccgtaggaagggtttaccgtttgcccagtgggacggaccgacagttgtggcctggctggagctgtggttgggaatgcccgcatggtacgtggctgcttgtagggccaatgtgaaaagcggcgctattatgagcgctctcagcgacacagagatccaacgcgagattggcataagcaacccactgcaccgcctgaagctaaggctggctatccaggagatggtttccttaacgagccctagcgcacctcccacctcacgcacaaaagagtccgaggaggggtcctgggcccagtgccccgtgtttctgcaaacactggcttatggtgacatgaatcacgagtggatagggaatgagtggctcccttcactgggcctaccccagtaccgctcttacttcatggagtgtctcgtggacgcacgcatgttggatcatctgaccaaaaaagatctcagagtccacctgaagatggtcgactcatttcatagaacctcattacagtatggtatcatgtgcctcaagcgattgaattacgatagaaaagaactcgagcggaggcgcgaggcaagccagcatgaaattaaagacgtcctggtgtggagcaatgaccgggtgataaggtggatacaagctattggtctcagagagtacgcaaacaatatcttagagtctggtgtccacggctctctcattgctctagatgaaaactttgactattcatccttggccctgctgctgcaaatccccacccaaaacacacaggccaggcagatcttggaacgcgagtacaataacctgttagccctcggcaccgagcgacgcctggacgagtctgatgacaaaaatttccggaggggttcaacttggcggagacagtttccgcctcgggaggtgcacgggataagcatgatgccaggctccagcgagacgctgcctgctggattccggctgacaaccacttccgggcagtcgaggaaaatgaccacagacgttgcaagctctagactgcagcgccttgataacagcactgtgcgtacctactcgtgctag

SEQ ID NO: 53179 - DNA, 1638 bp, Artificial Sequence
  Description of Artificial Sequence: Synthetic coding sequence
atgcagtccatttctaaacagaccttgcagatggatgtcaataaactgaacattaccctgctccgcatcttccgccagggagtagccgcagctctcggcttgctcccacagcaagtgcacataaaccggctcataggcaaaaaaaatagcattgaactgttcgtctcaccaattaaccgcaagacgggaatctcagatgctttgccgagcgaagaagtgttgagaagtttgaatatcaacgtcctgcaccagtctctcagccagtttgggattactgaagtgtcaccagaaaagaacgtgctgcaggggcagcatgaggcagacaaaatttggtccaaggaaggcttttacgctgtcgtgatatttctctccatcttcgtcatcattgtcacttgtctgatgatcctttacaggctcaaggagagatttcagctgtctctgcgccaggataaggagaagaatcaggaaatccacctctccccaatcaccttacagcccgctctctccgaggcgaaaaccgttcacagtatggtgcagcccgagcaagccccaaaggttcttaacgtagtggtcgatccacagggccgtggggctcctgaaatcaaggctaccacagctacgagcgtgtgcccttccccttttaaaatgaaacccattgggctgcaagagcggagggggtcaaacgtcagcctaacgcttgatatgagttcattgggtaacatagagccttttgtgtctatccccacaccaagagagaaagtagccatggaatacctgcagtctgcttcccgcattctcacaagatctcagctgagggacgtggtcgcatcatctcatctcctccaatcggaattcatggagattcccatgaattttgtggatccgaaggagattgacattcctagacacggaacgaagaacaggtacaagacaattcttcctaaccccctcagtcgggtatgcttaagacctaagaacgtgacggatagtctttctacatacattaacgccaactatatacggggatatagtggtaaggagaaggcttttattgcaactcaaggccctatgataaacaccgttgatgacttttggcaaatggtgtggcaggaagattcccccgtgatcgtcatgataacaaaactgaaagagaaaaatgaaaaatgtgtgttgtattggcccgagaagagaggcatttacggcaaagttgaagtattagtcatctcagtgaatgaatgtgataattatacaatccgcaatttagtgctcaaacagggctcccacacacaacacgtaaaacattattggtatacaagctggcccgatcataagacgcctgattccgcccagcccctgctgcagttaatgctcgacgtggaagaagataggttagcgtcacagggcagagggcctgtcgtagtgcactgttcagcagggattggcaggaccggatgctttatagcaactagcatcgggtgtcagcaactcaaggaagagggcgtggtcgacgccttgagtatcgtatgtcagctacgcatggatcggggagggatggtgcagacgagtgaacagtatgagtttgtccaccatgctctgtgcctctatgagtctaggctgtccgccgagacagtccaatag

SEQ ID NO: 53180 - DNA, 606 bp, Artificial Sequence
  Description of Artificial Sequence: Synthetic coding sequence
atggccgcaacagcattgcttgaggccggtctggcccgtgttctcttctaccctaccttgctctacaccctgttccgagggaaggtgcccggacgggctcacagggattggtaccataggatcgatcctacagtgctcctaggagccctgccactgagaagtttgacacgacagcttgtgcaggacgaaaatgtccgcggagtcattaccatgaacgaagagtacgaaacaagatttctgtgcaactcttcgcaggagtggaagcggctgggcgtggaacagctccgactttcaactgtagatatgactggcatcccaacacttgataatcttcagaagggggtccaattcgccctcaaatatcaatctcttggtcagtgtgtctacgtccactgcaaggcgggtcggtctagaagcgcgaccatggtggccgcatacctcatccaggtgcataaatggagcccggaggaggctgtacgggcaatcgctaaaatccgctcatatatccacatcagaccaggacagttagatgtgctgaaggagtttcacaaacaaattaccgcacgcgcaacaaaggacggcactttcgttatctcaaagacatag

SEQ ID NO: 53181 - DNA, 2280 bp, Artificial Sequence
  Description of Artificial Sequence: Synthetic coding sequence
atggccggtagcaagcagagccaccaggaggcagttaagaggcatctgtacttcctgcagctcaagatggatatctgtgagggccgactgacatgcccactcaatagcgccgttgtcctggcatcttacgcggttcagagtcactttggagattacaacagcagtattcatcatccgggatatctttcggattctcacttcataccggaccaaaacgaagatttcttaactaaggttgagagcttgcacgagcagcatagtggacttaaacagagcgaggcggagtcctgctacattaatatcgctaggacattagacttttatggggtcgagctccattcggggagagacttacataatctggacttaatgatcggaatcgcaagcgcaggagtcgcggtgtacaggaagtatatttgcacctcgttttacccttgggtgaacatcctcaagatctctttcaagcgtaaaaaatttttcatccaccagcgccagaagcaggctgagtctagggagcatattgtcgctttcaatatgctcaattatcgctcttgtaagaatctctggaaatcatgcgtggaacaccatacgttttttcaggccaagaagctcttgccccaagagaagaatgtcctttctcagtactggacaatgggctccaggaacacaaaaaagcgaagtccccgactcagacacgagattagaaaacctaggcattcctccgccgataatctggcgaacgaaatgacctacatcaccgagactgaagatgtcttttacacttataaaggatcattggccccacaagacagcgactccgaagtaagtcagaaccgatcaccgcatcaagagagcctttctgaaaataatcctgcacagagctacttaacccaaaaatcttcttcttccgtgagtcccagctctaacgccccaggatcatgtagtcccgatggcgttgatcaacagctgctcgatgactttcatcgcgtcactaaggggggtagcactgaggacgccagccaatattactgtgacaaaaatgataacggggactcataccttgtgctgatacggattactcccgatgaggacggaaaatttggtttcaacctaaagggtggagtggaccagaagatgccactggtcgtgagtcgcatcaaccctgagagcccagccgatacctgcataccaaagttgaatgagggagatcagatcgtccttattaacgggcgagatatatctgaacacacacacgaccaagtagtcatgttcattaaggcctccagagagtctcactcgagagagctagcattagtaatccgacgcagggcggttcgcagctttgccgacttcaagagcgaggatgagctcaaccaactctttccagaggccatttttcctatgtgtccggaagggggagacacactcgaaggcagtatggcccagcttaaaaaaggccttgagagcgggacagttctcattcagttcgaacagctctaccggaaaaaacccggattggctataactttcgcaaagctgccccaaaatctggataagaatcggtataaagacgtgcttccatacgataccacgcgtgtgctccttcaaggaaacgaggattacatcaatgcatcatacgtgaacatggagattcctgctgccaatctggtgaataagtacattgccactcagggacctcttccacacacctgcgcccagttctggcaggttgtgtgggaccagaaattatccttaattgttatgctcacaaccttaaccgagcggggtcgaacgaaatgccatcagtactggcccgatcccccagacgtaatgaatcatggaggattccacattcagtgtcagagtgaagactgcaccattgcttacgtgagtagggagatgcttgtgacaaatacccagaccggtgaggagcacacagtcacacatttacagtatgtggcatggcccgaccatggagtgcctgacgactcttccgattttctagagttcgttaattatgtacgctccctacgggtggactccgaacccgtgctcgtgcactgttccgcagggattggacgaaccggcgtcctggttactatggagaccgcaatgtgtctaactgagagaaatctgcccatctaccccctggacattgtcaggaaaatgcgggaccagcgcgctatgatggtccaaactagttcacaatacaagtttgtgtgtgaagcaatactgagagtctacgaagagggcctggtgcagatgctagatccctcttag

SEQ ID NO: 53182 - DNA, 2742 bp, Artificial Sequence
  Description of Artificial Sequence: Synthetic coding sequence
atgactagtcggctacgagcccttggagggagaatcaacaacattagaaccagtgagctgccaaaggagaaaactagaagcgaagtgatatgttctatccatttcttagatggagtggtccagacattcaaagtgacaaaacaggataccggtcaagtgctgcttgatatggtccataatcatttaggtgtgacagaaaaagagtactttggcctgcagcacgacgacgattccgtggattctcccaggtggctggaggccagtaaggccattagaaaacagctgaaaggcggattcccctgcacccttcacttccgcgtcaggttttttattccagacccgaacacattgcaacaggaacagacgcgccatctttattttctgcagctgaagatggatatctgtgaagggagactcacctgtccgctaaacagcgcagtggttctggcctcctacgccgtccagtcacactttggagactacaacagtagcattcaccaccccggttacttgtccgattcacactttatcccggatcagaacgaggatttcttaaccaaagtcgagtctctccatgaacagcactcaggcctgaaacagtctgaggctgaatcatgctacatcaacatcgccagaacccttgacttctacggtgtagagctgcacagcggtcgcgatcttcacaatctggatctgatgatcggtattgcttccgccggtgtcgccgtctacaggaaatacatctgcacctccttctacccatgggtgaatatcctcaagatctcttttaaaagaaagaagttttttatacaccagaggcagaaacaggcggagtcacgcgagcacatcgtggcttttaatatgctgaattaccgttcctgcaagaatctttggaagagctgcgttgaacatcacacttttttccaggccaaaaaattgctgcctcaggagaaaaatgtccttagccagtactggacgatgggctcccgaaataccaagaaatccgtcaacaaccaatactgcaaaaaagttatagggggaatggtctggaatcccgcaatgaggcggtccctcagcgtggagcacttagaaaccaagagcctgccatcacggagtcccccaatcacgcccaactggcgcagcccgagattaagacacgaaatcaggaaaccccgacactcctcagctgataacctcgcaaatgaaatgacttacattaccgagaccgaagatgtgttctacacttataaaggatccctggccccacaggattcggattctgaggtgtctcaaaaccggtcaccacatcaagaaagtttgagcgagaataatccagcccagtcttacctgactcagaagagcagttcatctgtttcccctagcagcaacgcacctggatcatgtagccccgatggcgtggaccagcagctgctcgatgacttccaccgggttaccaagggagggtcaacagaggatgcaagtcagtactattgtgataagaacgataacggcgattcatacctggtgctcattaggatcacccctgacgaagatgggaaatttgggttcaacctgaaaggaggagtggaccagaaaatgccactcgttgtgagtcggataaaccctgaatcacccgcagatacttgcatccctaagttgaatgaaggcgaccagatagtgctcatcaatggaagagatatctccgagcatacgcatgaccaagtggtcatgtttatcaaagcgtcccgggagtcacactcccgggagctggcgctagtgattaggagaagggccgtgcgcagtttcgccgacttcaagtctgaagacgaactcaaccagctgtttccagaagcgatttttccaatgtgccctgaaggcggagacaccctggaaggctccatggcacagctgaagaaaggccttgaatccggtaccgtgctcatccagtttgaacagctgtaccggaagaaacccggtttggctataacattcgcaaaactgcctcaaaacctcgataagaatagatacaaggatgtgttgccatacgacactaccagagtcctgctgcagggcaacgaggattacattaatgctagctacgtgaacatggagatcccagcagccaatctggtaaacaagtacattgccacacaaggtccactgccccatacatgcgcccagttctggcaagtggtgtgggatcagaaactctcactgatagtgatgctcactactctgaccgaacggggacggacaaaatgtcaccagtactggcccgacccacctgatgtgatgaatcacggcggtttccatatccagtgccaaagcgaggactgtaccatcgcctatgtcagcagggaaatgctagtaacaaatactcagactggagaggaacacaccgtgacacacctccagtatgtggcctggcccgatcatggcgtaccagacgatagcagcgatttcttagaatttgttaattacgtacggagtctcagggtggactctgagccagtgctggtccattgctcagccggaataggtagaacaggggtactcgtgacaatggaaaccgccatgtgcctcacggaacggaacctccctatctacccgcttgatatagtccgtaagatgagagatcagagggccatgatggtccagacgagtagccagtataagtttgtatgtgaagccattctgagagtgtatgaggaggggctggtgcaaatgctcgatccgtcttag

SEQ ID NO: 53183 - DNA, 1146 bp, Artificial Sequence
  Description of Artificial Sequence: Synthetic coding sequence
atgccattagtcgtgtcacgaattaacccagaatccccagcagacacgtgtatcccaaagctgaacgagggcgaccagatcgtgctaataaatggtagagacatttctgagcacacacatgatcaagtggtaatgtttatcaaagccagccgggaatcccactcccgtgaactggcgctggtgatccgccgtcgtgcagtcaggagctttgcagattttaagtcagaggatgaactcaatcagttattccccgaagccatattcccaatgtgccccgaggggggagatactttggaaggttcgatggcacagctgaaaaaaggactagagtccggtactgtgctgattcagtttgagcagctctaccggaagaaacccggtttggccatcactttcgctaagcttccccagaacttggacaagaatcggtacaaggatgtcctgccctatgatacgacaagggttctgctccagggcaatgaagattacataaacgccagttatgtgaatatggagatcccagccgcaaacctggtaaataaatacatcgccacccaagggccactgccccatacatgcgcacagttctggcaggtggtctgggatcagaaactttcactcatcgtgatgctcactacgctgaccgagcgcggaaggaccaaatgccaccagtactggcctgacccaccggatgttatgaatcatggcggttttcacatccagtgccagtcggaggattgcactattgcctacgtcagtcgcgaaatgctggttaccaacacacagacgggtgaggaacacaccgtgacccacttgcaatatgtggcttggcctgatcatggtgtccccgacgactccagcgacttcctcgaatttgtgaactatgtgaggagtttacgggtggacagcgagccagtgctggtgcattgttccgcaggcattggaaggaccggtgttctggtcaccatggaaacagcaatgtgcctcaccgagcggaatttgccaatctacccactggatatcgtaagaaaaatgcgcgatcagcgggcaatgatggtacagacttcctctcagtacaagttcgtgtgtgaggcaatacttagggtgtacgaggagggcttggtgcaaatgctagatccgtcgtag

SEQ ID NO: 53184 - DNA, 2742 bp, Artificial Sequence
  Description of Artificial Sequence: Synthetic coding sequence
atgactagtcggttgagggcccttggcggacgcattaataacatccgcacaagcgagctcccaaaggaaaaaacccggtctgaggtaatttgctcaatccacttcttagacggcgtggtccagacatttaaggtgaccaaacaggatactggacaggttttactggatatggtgcacaatcacctgggcgtgactgaaaaggaatactttggcttgcagcacgacgatgacagtgttgattctcctaggtggctggaagcctcaaaggctattcggaagcagctcaagggcggtttcccttgcacactgcatttccgcgtaagattcttcattcccgaccccaacactctacaacaagaacaaacacggcacctctatttcctgcagttgaaaatggatatctgcgagggacgtctcacctgccccctcaactccgccgtcgtgttagcctcctacgccgtgcagagtcattttggagattacaactcctctattcaccaccctggctatttgagcgacagccacttcattccagatcagaacgaagatttcctcacaaaggttgaaagtctccatgagcagcattccggcctgaaacaaagcgaggctgagagctgctatatcaatatcgccagaacattggatttctacggtgttgaattgcacagtggcagagacctccacaacctggacttgatgatcggaatcgctagcgctggtgttgctgtctaccgtaagtacatttgtacctccttctatccctgggtgaacattctgaagatttcctttaaacggaagaaattcttcatccaccaacggcagaaacaagccgagtccagggagcatattgtagccttcaacatgctgaattaccgatcttgtaagaacctttggaagagttgcgtagaacaccacacattctttcaggctaagaagctgctgccacaggagaaaaacgttctgagccagtactggacaatgggctcccgcaataccaagaaatctgtgaataaccagtattgcaagaaagtgattggcggaatggtgtggaatccggctatgcggaggtctctgtcagtagaacacctcgagacaaaaagcctgcccagcaggagcccaccgatcaccccgaactggcggtccccacggttgagacatgagattcgaaagcctaggcactcttccgccgacaatctggcaaatgagatgacatacatcacagagaccgaggatgtgttctacacatataaagggtccttggcccctcaggattctgatagcgaggtgtctcagaatagatccccccatcaggagtccctcagcgagaacaaccccgctcagtcataccttacccagaaaagttccagtagtgtctcacccagtagcaacgctcccggatcctgtagccctgacggagtcgaccagcaactcctggatgattttcacagggtgacaaaaggcggatcaacggaagacgcttcacaatattattgcgacaaaaatgacaatggggatagttatctggtgttaatacgcataacccccgatgaagatggcaaatttgggttcaatctgaagggtggtgtcgatcagaagatgcctctggttgtcagtaggataaatcctgagtctccagccgacacctgcattcccaagctcaatgaaggcgatcagattgtgctgataaatggcagagacatctccgagcacacacacgaccaggttgtcatgttcattaaggcatctagagagtcacatagcagagaactggcgctagtgatcaggaggagggccgtgcgaagtttcgcagattttaagagtgaagacgagctgaatcagttgttcccggaggccatattccccatgtgtccagagggtggagataccctggagggttctatggctcagctgaaaaagggtctcgaatccggcacagttttgattcaatttgaacaactgtataggaaaaagccagggcttgcaattacgttcgctaaactgccccagaacctggacaaaaatcggtataaagatgtgctgccctacgacacaactcgagttttgttgcagggtaacgaggattatattaacgctagctatgttaatatggagatcccagctgctaatcttgttaacaagtatatcgccacccaggggcctctgccccatacctgtgcccagttctggcaagttgtgtgggatcagaagctctccttgattgtgatgctgaccaccctcacagagcgaggccgtacaaagtgccaccagtattggcccgatcctccagacgtgatgaaccatgggggatttcacatccaatgccagtcggaagactgcactattgcgtacgtgtcacgcgaaatgctggtgacgaacacacagacaggtgaagagcatacagtcacacatttgcagtacgtggcctggccagatcacggagtccccgatgatagcagcgatttcctggagttcgtcaactatgtcaggagtctccgcgttgattcagaacccgtcctggtgcactgctctgccggaataggccgaacgggggtgctggtaaccatggagaccgccatgtgtttaactgagcgcaatctgcccatatatcccctggatatagtgagaaagatgagggatcagcgtgctatgatggtgcagacaagctcgcagtacaagtttgtttgtgaggcgatcttgagagtctatgaggaaggcctggttcagatgctggacccaagctag

SEQ ID NO: 53185 - DNA, 2349 bp, Artificial Sequence
  Description of Artificial Sequence: Synthetic coding sequence
atggacatctgcgaaggtcgactaacatgcccacttaacagcgccgttgtccttgcctcatatgcggtgcaaagtcacttcggggactacaacagctccatccaccatcctgggtatctctcggattcacacttcatacccgatcaaaacgaagatttcctgacaaaagtagagagcttacacgagcaacactccggtctgaaacaatcagaggctgaatcatgctacattaatattgctaggaccctggacttttacggtgttgaattacattctggtcgtgatctgcacaatttagatcttatgattggcatcgccagcgccggagtagctgtatacaggaaatacatctgtacctcattttacccatgggtaaatatattaaagatttcttttaaaagaaaaaagtttttcatacaccaacgacagaagcaagcagaaagcagggaacacatcgtggcttttaatatgctgaattatcgtagctgtaagaatctgtggaagtcctgcgtggaacaccatacgtttttccaggctaaaaaactcctgccccaagagaagaacgtgctgtctcagtactggaccatgggaagcaggaatacaaagaagtctgtgaataatcagtactgtaagaaggtcattgggggtatggtgtggaacccggctatgagaaggagtctcagcgtggaacatctggagacaaaatcactcccctctagatcccctccgattactccgaactggcgctcaccgagactccgccatgagatccggaaacctcgtcattcctccgcagacaatctggcaaacgagatgacttatatcacagagacggaggacgtgttctatacttacaagggttctctggctccccaggactctgacagtgaagtatcccaaaatcgaagccctcaccaggaaagtttgtctgagaacaaccctgcacagtcttacttgactcaaaagtccagctcttccgtctccccctcatcaaacgcacctggctcttgcagcccggatggagtggaccaacaactccttgacgattttcaccgagtcaccaagggcggtagtaccgaggatgcctcccagtattattgtgacaagaatgataacggagactcttacctagtccttattcgaatcacccctgatgaggacggcaaattcggattcaacctcaagggaggcgttgatcaaaaaatgcccctggtagtctcacggatcaatccagagtcccccgctgatacatgcatccccaaactgaacgaaggtgatcagattgtactgattaacggaagggatataagtgagcacacccatgatcaggtcgtgatgttcatcaaggcatcgcgcgaatcacactctcgcgaactggccttagtgatccgacgacgcgctgtacggtcgtttgccgacttcaagagcgaggatgagctgaaccaactgtttcctgaagcaattttccccatgtgccctgagggtggggataccttagaaggatccatggcccagctgaaaaaaggcctggagtccggcacagtcctgatccagtttgaacaattatatagaaaaaagcccggactggccatcaccttcgcaaagctgccacagaacttggataagaataggtacaaggatgtgctcccttacgacaccactcgagtgctgttacaagggaacgaagactacattaacgcatcctacgtcaatatggaaatccctgccgctaacctggtcaataagtatatcgctactcaagggccactccctcatacttgtgcacagttttggcaggtggtctgggatcaaaaactgagcctcatcgtcatgttaactactttaaccgaaagaggccgaaccaagtgtcaccagtattggccagatccccctgacgtgatgaatcatgggggttttcacatccagtgccagagcgaagactgcacaattgcctacgtatcacgggagatgcttgtgaccaacacccaaaccggtgaagaacataccgtcacacacctccaatacgtggcctggccggaccatggggtccctgacgatagttctgactttctcgagtttgttaattacgtgagatcactcagggtggactcagagccagtcctagttcactgtagcgcagggatcggtaggaccggagtgctggtcactatggagaccgctatgtgtcttaccgagcgaaaccttcctatataccctctagatatagtgaggaagatgcgcgaccagcgagctatgatggtccaaactagttctcagtacaaatttgtgtgtgaggctatactgcgtgtatacgaagagggcttggtgcagatgttggacccttcctag

SEQ ID NO: 53186 - DNA, 2214 bp, Artificial Sequence
  Description of Artificial Sequence: Synthetic coding sequence
atggacatatgcgaaggtagactgacatgtcctctgaacagcgccgtcgtactcgcatcttatgccgtgcaatcccatttcggagactacaactctagcatccaccatccaggttaccttagcgactcccacttcatacctgaccagaacgaagactttctcacgaaggttgaaagcctgcacgagcagcacagcgggcttaagcagtccgaggctgagtcttgctacattaacatagctcggaccttagacttttacggggttgaactgcacagtgggagagacctgcacaacctggacctaatgatcggtatcgctagcgccggagtggccgtctataggaagtatatttgtactagcttctacccatgggtcaatatactcaagatcagttttaagaggaaaaagttcttcatccaccaacgacagaagcaggccgaatccagggaacatatcgtcgcattcaatatgctgaattatagatcctgcaaaaatctgtggaagtcatgtgtggaacatcacacttttttccaagctaaaaagctgttgccccaggagaagaatgtgctgtcccagtactggactatgggttctaggaacactaaaaaacggtctcctcgcctgcgacatgagattcggaaaccgaggcattcatccgcggataaccttgcaaacgagatgacatacatcacagagaccgaggatgttttctatacatataaaggatccttggctccccaggactccgacagcgaagtgtctcagaatcgctcacctcaccaggaatctctgtctgaaaataatccagcccagtcatatctgacccagaagagctctagcagtgtgtccccttccagcaatgcccctggatcctgcagcccggatggcgtggatcaacaactgttggatgactttcatagggtgactaaaggaggaagtacagaggacgcttcgcagtattattgtgacaagaacgacaatggagatagttacctggtgttgataaggatcactcccgacgaggatggaaaatttggctttaatctcaaggggggagttgaccagaaaatgcctttagtcgtatcccgtataaacccggagagccctgcagacacatgcataccaaagctcaacgagggggatcagatcgttctgatcaacggtagagatatcagtgaacacacacatgatcaggtggtgatgttcattaaagcttcccgggagagccacagtcgcgagctggccctcgtgatccgacggagggccgtaaggtccttcgccgatttcaaatctgaagatgaactaaatcaactttttcctgaggcgatcttcccgatgtgccccgagggaggcgacacacttgaaggcagcatggcacagctgaaaaagggtctcgagagcggcacggtgcttattcagtttgagcagctctaccggaagaaacccggtctcgccattacattcgcaaagctcccacagaatttggataaaaaccgatacaaggacgtgttaccctatgacacaacccgcgtactcctccagggtaacgaggattacatcaacgcctcctacgtgaacatggagataccagctgccaatttggtcaataagtacattgcaacccagggtcccctgccacacacctgtgcacagttctggcaggtcgtgtgggatcagaagctcagcctcatagttatgttgaccacattaactgaaaggggtagaaccaagtgccatcagtattggccagatcccccagatgtcatgaatcacggaggcttccatatacagtgtcagtctgaagactgcacaattgcttatgtgtcccgcgagatgctcgtcacgaacacccagacaggggaggaacacactgtaactcatcttcaatacgtggcctggcccgaccacggagtaccggacgactccagtgatttcttggagttcgtaaactatgtgcggtcgctacgggtggatagcgagccggtgctcgtgcactgtagtgccggaattggaaggacgggcgtgctagtgacaatggaaacagccatgtgtctgacagaaaggaatctccccatctacccattagacatcgtccgtaagatgcgggatcagcgagctatgatggtgcagaccagcagccagtataagtttgtatgcgaagccatcctccgagtctacgaggaaggactggtgcagatgttggatccttcctag

SEQ ID NO: 53187 - DNA, 2781 bp, Artificial Sequence
  Description of Artificial Sequence: Synthetic coding sequence
atgaccagccgattccgtttgcccgcaggcaggacctacaatgtgcgcgcttccgagctggccagggacaggcaacataccgaagttgtctgcaatatcctgctgctggacaacaccgttcaggcgtttaaggtgaataagcatgatcaagggcaggttctgctggacgtagtgttcaagcacttggacctgacggaacaggattattttgggctgcaactcgccgacgattccacggacaatcccaggtggcttgatccaaataagcccatcaggaagcaactcaagagggggagcccctactctttaaactttcgggtgaaattttttgtttccgacccaaataagctccaggaagagtacacaagatatcagtatttcctccagatcaagcaggatatactgaccggcaggttgccctgtcctagcaacaccgcagcgctgctcgccagttttgccgtccagtcagagcttggcgattacgaccagtctgagaatctatcaggctacttgagtgattattcatttatccctaatcagccacaggacttcgaaaaagaaattgcaaaactgcaccaacagcacataggcctcagccccgcagaagcagagttcaactatctcaatactgcgaggacgctggagctttacggggttgagtttcattacgctcgagaccagtcaaacaatgagatcatgataggagtcatgagtggcggaatattaatctacaagaatcgcgttcgtatgaataccttcccttggttgaaaatcgtcaaaatctcttttaagtgtaagcagtttttcattcagctacgaaaggagttgcacgagagccgagaaaccctcctgggctttaacatggtcaattatcgggcttgcaagaatctgtggaaggcctgcgtggaacatcacactttctttcgactggacaggcccttgccaccacagaagaactttttcgcgcactacttcacattgggatcgaagttccgttactgcggccgaaccgaggtccagagtgtccagtacggcaaggagaaggctaataaggatagggtgttcgcccgatctccctccaaacctctagcaagaaagcttatggactgggaagtggtctcccgaaactcaatcagtgatgaccgattagaaacccagtccctcccgtcccgcagccctcctggtaccccaaaccaccggaattctacattcacccaagagggcaccagactgagaccgtccagcgtagggcatctcgtagatcacatggtacacacgtctccatccgaggttttcgtcaatcaaaggtccccttcatcgacacaggcgaatagcatcgtgctcgagtcctccccttcccaggagacacctggcgacggcaaacccccagctctgccccctaaacagtcaaagaaaaactcatggaaccagattcactactcacacagccagcaggatctggaatcacatatcaacgagactttcgacatccccagtagtcccgagaaaccgacccctaatggaggcattccacacgacaatctggtgcttattcgcatgaagcccgacgagaacgggaggttcgggttcaacgtgaaaggcggttatgatcagaagatgcctgtgatcgtctcccgcgtcgcacctgggacgccggcagacctatgtgttcctcggctaaatgagggcgaccaggtggttctcatcaacgggagagacatcgctgagcacacgcacgatcaagtagttttattcatcaaagcaagctgcgaacggcattcgggcgaactgatgcttctggtgaggccgaacgcagtttatgacgtcgtcgaagagaaattagaaaacgagccagacttccagtatatcccagaaaaagcccctcttgacagcgtgcatcaggacgatcattccctgagagagtccatgattcagctcgcagaaggcctgatcaccggcacagtgctaacacagtttgatcagttgtaccggaagaagccgggaatgaccatgtcctgcgccaagctcccccagaatataagtaaaaaccgctaccgggacatctccccctatgacgcaactagagttatactgaaagggaacgaagattatattaacgctaactacattaatatggagattcccagcagtagcatcatcaatcaatatatcgcatgtcaggggcctcttccacacacctgtacagatttttggcaaatgacgtgggagcaaggaagctctatggtagttatgctcactacacaggtggaacggggacgagtcaaatgtcaccagtactggccggagcccacaggatcctcctcgtacggatgttaccaggttacttgccatagcgaagaagggaacacagcatatatttttcggaagatgactttattcaaccaagaaaaaaatgagtctcggccactgacccaaattcagtacattgcttggccggaccatggggtccctgatgacagcagtgacttcctggatttcgtgtgccacgtgaggaacaaacgtgccggaaaggaagaacccgttgtggttcattgtagcgcgggaatcgggaggaccggagtgttaattacaatggagacagctatgtgcttgatcgagtgcaatcagcctgtctatcccttggacatcgtgcgcacaatgagagaccagagagctatgatgatccaaacaccatcacaatatcgcttcgtttgcgaagcaattctcaaggtgtatgaagagggattcgtgaaaccattaaccacctcaacaaacaagtag

SEQ ID NO: 53188 - DNA, 228 bp, Artificial Sequence
  Description of Artificial Sequence: Synthetic coding sequence
atgacaagtcggttccggctgcccgctgggagaacttacaacgtccgtgccagtgaactcgctcgcgaccgccaacataccgaggtggtctgtaacattctgcttctcgacaacaccgtgcaggcatttaaagtgaacaaacacgaccagggacaggtcctgctggacgtggtttttaagcacctcgacctaactgagcaagactattttggtctgcagttggcctag

SEQ ID NO: 53189 - DNA, 486 bp, Artificial Sequence
  Description of Artificial Sequence: Synthetic coding sequence
atgaccagccgcttccgtctgcctgccggaaggacgtacaatgtcagggcaagcgaactggctcgcgatcgacagcataccgaagtcgtgtgcaatatcctgcttctggataataccgttcaggcgttcaaggttaacaagcacgaccagggacaagtgctgctcgacgtcgttttcaagcatctggatctcactgagcaggattacttcggactgcagctggccgatgacagcacggataacccccgttggctcgaccctaataagcctatccgtaagcagctgaaaaaattgttactgctcattctaggtggctccccttacagccttaattttagggtcaaattcttcgtcagcgaccccaacaaacttcaggaagaatacacccggtaccagtattttctccaaatcaagcaagacatcctcaccgggagactgccatgcccttctaacactgctgcgctcctcgctagcttcgccgtatag

SEQ ID NO: 53190 - DNA, 1680 bp, Artificial Sequence
  Description of Artificial Sequence: Synthetic coding sequence
atggattgggaggttgtaagtaggaacagcatctccgatgacagactggagactcaatcgcttccaagccggagcccacctgggactcctaatcaccgaaattccacctttacacaggagggcacgcggttgaggccatcctctgtcggacatctggttgatcatatggtacatacttcaccatccgaggtgtttgttaatcaacggagccccagttccactcaggcaaattcaattgtcctggagtccagcccttcccaggaaacacccggtgacgggaaacccccagctctccccccaaagcaatccaagaagaactcttggaatcagatccattactctcatagccagcaggacttagaatcccacatcaatgagaccttcgacatacctagcagtcctgagaaacctacacccaatggcggaatcccccatgataatctcgtgttaattagaatgaagcctgacgaaaacggaagattcggcttcaatgtaaaaggcggttacgatcagaagatgcctgtgatcgtaagtagagttgccccaggcacccccgcagatctgtgtgttccaaggctaaacgaaggggaccaggttgtgctcatcaatggtagggacattgccgaacacacccacgaccaggttgtgctctttattaaagcttcttgtgagaggcatagcggcgagctgatgctcttggtccggccaaatgcagtttacgacgttgtggaggaaaagttggagaacgagcccgacttccagtacatccctgaaaaagctcctttagattccgtgcaccaagatgatcactctctccgagaatcaatgatccagctcgccgaaggactgatcacaggaaccgtgctgacccaattcgatcagctgtatagaaaaaagccgggaatgactatgtcgtgtgctaaacttcctcagaatattagcaagaaccgttatagagacattagtccctatgacgctaccagggtcattctcaagggcaatgaggactacatcaatgccaactacatcaatatggagatacccagcagttcaatcatcaatcagtatattgcgtgccagggccctctccctcacacgtgcaccgatttctggcagatgacctgggagcaggggtcaagtatggtagtgatgctaaccacacaggtggagaggggcagggtgaagtgccatcagtattggcccgagcccactgggtcaagctcgtatggatgctaccaggtaacttgccacagcgaggaagggaatacagcttatatattccgcaagatgacactcttcaatcaagagaaaaacgagtcccgaccgttgacccagatccagtatatcgcctggccggaccacggggtgcctgacgatagcagtgatttcttggacttcgtttgccacgtgagaaacaaaagagccggtaaagaggagccagtagtagtccattgtagcgcaggcatcgggagaaccggtgtgctcattaccatggaaaccgccatgtgcctgatcgaatgtaaccagcctgtgtatcctcttgatatcgtgcgcacaatgagggatcagcgtgcaatgatgatccaaaccccatcccagtatcggtttgtttgcgaggccattctgaaggtgtatgaggaagggtttgtcaagccgctcaccacaagcacaaacaaatag

SEQ ID NO: 53191 - DNA, 3708 bp, Artificial Sequence
  Description of Artificial Sequence: Synthetic coding sequence
atgatgtgcgaagtaatgccgaccataaatgaagatacccccatgagccagcggggttctcagtcaagcggcagtgatagcgattcccactttgagcagctgatggtgaatatgttagacgagcgggatagactcttagacactcttcgtgagacccaagaatctctgagcctagcgcaacagaggctccaggatgttatttatgacagggattctcttcagagacagctcaatagcgcattgcctcaggagtttgccgcactgacaaaagagttaaatgcttgcagagaacagctactcgaaaaggaggaggaaatatctgagttgaaggctgaacggaataacactcgcctgttgctcgaacaccttgaatgccttgtcagtcgtcatgaaaggtccttgaggatgactgtggtgaaacggcaggcacaaagtccatccggagtttccagtgaggtagaggtgcttaaagccttgaaaagcctgtttgagcaccacaaagccctagatgaaaaggtaagagaaagactgcgtgtgtctctggaaagggtgagtgctttggaggaagagctggccgcagctaaccaggagatcgtggcactgagggaacagaatgtgcatatccagcggaaaatggcttcgtctgaaggtagcacggagagcgaacatcttgagggaatggagccaggacagaaagtgcacgagaaaagactttcgaacggaagcattgacagcacagacgaaacaagccaaattgtggaacttcaggaactcctcgagaagcagaactatgagatggcccagatgaaggaaaggctggcagctctctcctcgcgcgtgggtgaggttgagcaggaagcagagacggctcgcaaagatctgatcaaaacggaagagatgaatacaaagtatcagagggatatccgggaggctatggcacagaaggaggatatggaagaacgtatcacaaccctggaaaagcggtatctttccgcccagagggagtccaccagtatccacgatatgaacgacaaactagagaacgagttggcgaacaaggaggcgattctccggcaaatggaggaaaaaaaccgccagctgcaagagcggttggagctggccgaacagaagctgcagcagaccatgcgcaaggccgaaacactcccagaggtcgaagccgaattagctcagaggattgccgctctcactaaggcagaggagcgccacggcaatatagaggagcgaatgaggcatctcgaaggccagctggaagagaaaaatcaagagttgcagcgggctaggcagcgtgagaagatgaacgaggaacataataagagactcagtgatactgttgacagactcctaactgagagcaacgagagattgcagttacacctgaaggaacggatggcggcattggaagagaagaatgtgctgatccaggagtctgagactttcagaaaaaatcttgaagagtccttacacgataaggagcgacttgccgaggaaattgagaaactgcggtccgaactggaccagctcaaaatgaggactggcagcctgatcgagcccacgatccccaggacccaccttgatacttccgcagagcttcgatacagcgtgggctccctggtcgacagtcagtccgactatcggaccactaaggtgattagaaggccacgccgaggcaggatgggtgttcgcagggacgaacccaaggtcaagagccttggtgatcacgaatggaaccggactcagcagatcggagtcctgtcttcccacccatttgagtctgacaccgaaatgagtgatattgacgacgacgatcgggaaaccattttcagctccatggacctgctttctccaagcggtcactccgacgcccagaccttggctatgatgctccaggagcagctcgatgccataaataaagaaattagactgatccaggaggagaaagagtccaccgaactgagagcagaagaaatcgagaacagggtggcatccgtcagtttggagggtctcaatcttgctcgggtgcacccaggcacttccatcaccgcaagcgttaccgcgtcaagtttagccagtagtagccccccttccggacactctactccaaagctgacacctaggtcgccggcaagggagatggacagaatgggcgttatgaccctcccgagcgatctccgcaaacaccgccgaaagattgcagtcgtcgaggaggatggcagggaggataaagcaaccatcaagtgcgagactagcccgccacctacgccacgagcgttgagaatgacccatacacttcccagtagctaccacaacgatgcgagaagcagcctgtctgtaagcctggagccagagagtcttggtttgggctcagctaactcgagccaggattcgctccacaaagctcccaaaaaaaaagggatcaaaagctcaatcgggaggctgttcggaaaaaaagaaaaagccagactcgggcagttacgcggttttatggagacagaggcagccgctcaggagtctcttggcctcggaaagcttgggacccaggctgaaaaggaccgacgcctgaaaaagaaggtaattcggcatgagctcctcgaggaggccaggaggaaagggctgccctttgcgcagtgggatggccctaccgtcgtcgcttggctggagttgtggctcggcatgcctgcttggtacgtggccgcttgtagggcaaatgttaaatcaggggctattatgtcagcactgtcagatacggagatccagcgggagatcgggatctctaaccctctgcataggctgaaactgaggctagctattcaggaaatggtgagccttacgtctccctcagcaccccctaccagtagaacaccttcgggaaacgtctgggtgacccatgaggaaatggagaacctggctgctccagcaaaaactaaggagtctgaagagggcagttgggctcagtgtccggtctttcttcagactctagcttacggcgatatgaatcatgaatggatcggaaacgaatggctcccctccttggggctgccccagtatcgatcatattttatggagtgtctcgtcgatgccagaatgctagatcatctgaccaagaaggaccttcgggtccacctcaagatggttgactcctttcataggaagaagaggacgagcctccagtatggcatcatgtgtttgaagcgcctgaattatgaccggaaggaactggaaaggcgtagagaagcaagccaacacgaaatcaaagacgtcctggtgtggtccaatgatcgggttatcaggtggattcaggccattggtctccgcgaatatgccaataatattcttgagtccggtgttcatgggtctttgattgctctcgacgagaattttgattactccagtcttgcacttctgctccagattcccacccagaacacgcaggcccgtcagattctggagcgggagtataacaacctgctcgcactcggaactgagcgcagactcgacgagtccgatgataaaaactttcgaagagggtcaacctggcgaagacagttcccacctcgtgaagtgcacgggatttctatgatgcccggttcctctgagacactcccagcaggattccgacttacaaccacaagtggccaatcccgaaaaatgactaccgacgacggggtgttctctgtgtactccacctag

SEQ ID NO: 53192 - DNA, 3471 bp, Artificial Sequence
  Description of Artificial Sequence: Synthetic coding sequence
atgatcttctcggacatgaacactgtcagtggaagtcctaaagtacatcctcccaacggcaccaggttttatacgtttcaggaatttgctgctctgaccaaggagctcaacgcctgccgtgagcaactgttggaaaaagaggaggaaatatcagagcttaaggcagagagaaacaatactcggctgttactggaacatctggagtgcttggtatcccggcacgaacgcagcctgagaatgactgtcgtgaagcggcaggcacagtcccctagtggggtgagtagcgaggtggaggtcctgaaggccctcaaatccctcttcgaacaccacaaggcactggacgagaaggtgagggagagattgagagtgagtctcgaacgggtctccgctcttgaggaggagctggccgctgctaaccaagagatcgtggcccttcgggagcaaaacgtgcatattcaaaggaagatggcctcatccgaagggtccacagaatcagaacatctggaaggtatggaacctggccagaaggtccacgaaaaaagactgagcaatggatccattgatagtaccgatgaaactagtcagattgtcgagcttcaggaattgctggagaagcaaaactatgaaatggcccagatgaaggagcggctcgctgctctcagtagccgtgtaggtgaggtcgaacaggaggcagagactgcccgaaaagacttgatcaagaccgaagagatgaacactaaatatcagcgcgatattcgcgaagcaatggcccagaaggaagacatggaggaacggatcacaacactggagaaacgttatttgtccgcccaacgcgagtcgacaagcatccatgatatgaatgacaaactggaaaatgagcttgccaacaaagaggcgattttgcgtcagatggaggagaagaacaggcaactccaggagagactggagctggccgagcagaaattgcagcagaccatgaggaaggcagaaactctgcctgaagtggaagccgagttggcccaaaggattgctgcgcttactaaggctgaggaaaggcacggcaatattgaggaacgaatgcggcatttagagggccagctggaggaaaaaaaccaggaactgcaacgagctcgccagcgcgaaaaaatgaatgaggaacacaataaaaggctgtcagacaccgtggaccgcctgcttaccgaaagcaatgagcgcttgcagctccatttgaaagaaaggatggcggctttggaggaaaagaatgttctgatccaggagtctgaaactttccgcaagaacttagaggagtcacttcatgacaaagagcggcttgccgaagagatcgaaaaactgcggtccgaacttgatcaactgaagatgagaactggtagcctgatcgagcctaccatccccaggactcacctggacacctcggctgagctcagatactctgtgggctctttagtagatagtcagagcgactatagaactactaaagtaataagacggcctagaaggggtagaatgggtgttcgtcgcgatgaacccaaggtgaagagcctgggcgatcacgagtggaacaggacgcaacagattggagtcttatcttcccaccctttcgaatccgacaccgaaatgtctgatatagacgatgatgatcgcgagactatcttctctagcatggacttgctgtctccgtctggccactccgacgcacaaacgctggccatgatgctccaagaacagttggatgccattaacaaggaaatccgcctgatccaggaagagaaagaaagtaccgaactgagggccgaagagattgaaaacagagtggcctcagttagcctggaagggttgaacctcgccagagtacatcccggaacatctatcacggcctcagtcaccgctagcagcttagccagttcaagcccacccagtggtcacagcacccctaagctgacgcctcgctctccagccagggagatggaccggatgggagtgatgacactgccgtccgatttgcgcaaacacagacggaagattgctgtcgttgaggaagatgggagagaggataaggctaccatcaagtgcgaaacaagtcccccaccaacccctagggcacttcggatgacccatactcttcccagttcctaccacaacgatgctagaagttctctatccgtgtcactcgaacctgagtctcttggcctgggttccgccaactcttctcaggacagtctccataaggctccgaagaaaaaaggaataaaaagctctatcgggagactatttggtaagaaggaaaaagctcgcctggggcagttgcggggatttatggagactgaagctgcagcccaggagtctctcggtctcgggaaactgggcacgcaagcagaaaaggacagacgactgaagaagaagcacgaattgctggaagaggcacggagaaagggactgcccttcgcacaatgggacgggccaacggttgtcgcctggctggaactctggctgggtatgcccgcatggtacgttgccgcatgtagggccaatgtcaagagtggagcaattatgtcagccctttcagatacagaaatacagcgcgagatcggcatcagcaatcctttgcaccgcctgaaactgcggctggccatacaggagatggtctccctgacttcccctagcgctccccctaccagccggaccaaagagtctgaggaggggtcctgggcccagaccttagcatacggggatatgaaccacgaatggataggaaatgagtggctgccgtccctcgggctgccccagtatcgttcatactttatggagtgtctagtggacgcacggatgctggatcacttaaccaagaaggatctgagagtgcatctaaaaatggtggacagcttccacagaacctcccttcagtacggcataatgtgtttaaagaggcttaactatgataggaaggaactcgagaggcggcgagaggcttcacaacatgaaatcaaggacgtcctagtgtggtctaacgacagggtcatccgttggattcaggctatcgggctgcgtgaatatgctaacaatatactggagagtggtgtgcacggaagtctgatcgcactggacgagaactttgattattccagcctcgctttgcttctgcagatccccacccaaaacactcaggcaagacaaatactggagcgggaatataataatctgctagctctcggaacagagcgccgactcgacgaaagcgatgacaagaacttccgaaggggatctacttggagacggcaattcccacctagggaagtgcacgggattagtatgatgccaggatccagcgagacattgcctgcaggtttcagactgacgacaacctccggccagtcccgtaaaatgacaactgatgttgccagttcaagactccaaaggctagataactctacggtgcggacctacagctgttag

SEQ ID NO: 53193 - DNA, 1332 bp, Artificial Sequence
  Description of Artificial Sequence: Synthetic coding sequence
atgactcataccctgccaagttcatatcataatgacgccagatcctccctgagcgtttctctggaacctgagtccttaggcctaggtagcgccaactcttcacaggattccctgcacaaggctccaaaaaagaaaggcattaaatcctcaattggaaggctgtttggaaagaaggagaaggcaagactgggacagctcagggggttcatggaaactgaggccgcagcacaggagtctctgggtcttggaaagttgggaacccaagcagagaaggaccggaggttgaagaaaaagcacgaactgttggaggaggctaggagaaaggggttgccatttgctcagtgggacgggcctacagtggtagcttggctggaactgtggctagggatgcccgcatggtatgtggcagcgtgtagggcaaatgttaagtctggcgcaataatgtctgccctgagcgataccgaaatccagagagagatcgggatctcgaaccctctccaccggctaaagctgcgacttgccatccaagaaatggtatctctgacatccccatccgccccacctaccagtcgcacttgcccagtcttcctccaaactctcgcatatggggacatgaatcacgaatggattggcaacgagtggctcccgagcctaggactgccacagtacaggtcttactttatggaatgtctggtcgatgctcgcatgcttgaccacctgacgaagaaggatttgcgcgtccatttaaaaatggtggacagcttccacagaaccagcctccaatatggcatcatgtgcctgaagcggttgaattatgacaggaaggaattagagagaaggagggaagcaagccagcatgaaatcaaagatgttctcgtatggagcaacgatagggtgatcaggtggattcaggctattggattgcgtgagtacgctaataacattctggaatctggagttcacggttccctaatagccctggacgaaaatttcgactactcttctcttgcattgttgctgcaaataccgacccagaacactcaggcacgacagatcctcgaaagggaatacaacaatttgttggccctcggcactgaaagaagactagacgaaagcgatgacaagaatttccgaaggggcagcacttggcgccgtcagttcccaccccgagaagtgcacggcatttcgatgatgccagggtccagcgagaccctccctgcaggcttccgcctcaccaccacgagtggccaatctcgcaagatgacgactgatgtcgccagtagcaggctacagaggctggacaactcaacggtccgaacatattcatgttag

SEQ ID NO: 53194 - DNA, 3783 bp, Artificial Sequence
  Description of Artificial Sequence: Synthetic coding sequence
cggagtaaggaccctaaaagccagactctggccatgatgtgcgaagtgatgcccacaataaacgaggacacacccatgtcccagaggggatctcagtcctccggaagcgactccgactctcacttcgagcagctgatggtcaatatgctggatgagagagataggctgctcgataccctgcgagagactcaggagagcctcagtctagcccagcagcgcctgcaggatgtgatctatgatcgagactctcttcaaagacagctgaacagtgcgctcccccaagacatcgagtccctaaccgggggtctcgcaggtagcaaaggagccgatcctcccgaatttgccgctctgacaaaggaactgaacgcctgtagggagcagctgttagaaaaggaggaagagataagcgagctgaaagctgagcgtaacaacactcgcctgttactggaacacctggagtgtttggtgtcgcgccacgagcggtccctgaggatgacagtggttaagcgacaagcacaaagtccatccggcgtgtcatctgaagtcgaagtgcttaaagcactcaagagtttgtttgagcaccacaaggccctggacgagaaggtgagagagcgacttcgggtgtcgttggaacgcgtctctgcgcttgaagaggaactagctgccgctaatcaggagattgtagctttaagggaacaaaacgtccatatacagagaaagatggcctcgtctgaagggagcaccgagtctgagcatcttgaggggatggaaccgggtcagaaggtacacgaaaagagattgagtaacggcagcatcgattctacggacgagacatcacaaatagtggaactacaggagttgctagagaaacagaattacgaaatggcgcagatgaaagagcgactggctgccctgtcctcgcgcgtgggggaagtggagcaggaagctgaaacagccaggaaggatcttattaagactgaggaaatgaacacgaaataccagagggacatacgcgaagctatggcacagaaagaggatatggaagaaagaatcactacgcttgagaagcggtacttgagcgctcagcgagaatcaacatccatacatgatatgaacgataagttagaaaacgagctggccaacaaggaagcgatcctgagacagatggaggagaaaaatagacagctccaggagcgtctggaactggccgagcagaagttgcagcagaccatgagaaaggccgagactctgcccgaggtcgaagcggaactcgcccagagaatcgcggctctaactaaggccgaagagagacatggaaatatcgaggagcggatgcgccatctcgaggggcagcttgaagaaaagaatcaggaactacagcgggctcgccaaagagaaaagatgaacgaagagcataacaagaggctctcagacactgtggaccgattgctgacagaatctaacgaacgccttcagttgcacctgaaggagaggatggctgctttggaagagaaaaacgtgctgatccaggaatcagagacgttccgcaagaacctagaggagtcactgcacgacaaagaacggctcgctgaggagatcgaaaagctgcgtagtgagctcgaccagctcaagatgaggactggatcccttattgaacccacaatcccacggacccacctggatacttctgccgagctccggtatagtgttggaagcctggtcgactcacaaagcgactaccggaccacaaaggttattaggaggccccgacgaggcagaatgggtgtgaggcgtgatgaacctaaagtgaagagcctgggcgatcatgagtggaaccgcacacagcagataggggtgttatcctctcatcctttcgaaagcgataccgagatgtccgacattgatgatgacgaccgggaaacaatcttctcctctatggatctactcagccccagtggccattctgatgctcagacactagccatgatgttgcaggagcagctcgacgccatcaataaagaaattcggctcatccaggaggagaaagagtcgactgaactccgcgcagaggagatcgagaacagagtcgccagtgtatcgcttgaggggctgaaccttgcccgagtccacccaggtacaagcataacagccagtgtgactgcctcctccctcgcgagtagtagcccaccatccggccactccacacccaagctcaccccacggagtccagctagagagatggatcgtatgggagtgatgacactcccttcagaccttcggaagcatagacgaaaaatcgctgtggtcgaagaagatgggcgagaagacaaggctacaatcaaatgtgagacatcacctcctcccacaccccgtgccctgcggatgactcatactctgcccagctcttaccataacgatgccaggtcatccctgtcagtgtcgctggagcctgaatctctcggcctcggcagcgcaaactccagtcaagactctttgcataaagccccaaaaaagaaaggcataaagtcctccatcggacggctgtttggtaagaaggaaaaagcgaggctgggacagctgcgtgggttcatggaaactgaggccgctgcacaagaatctctgggactcggcaagttgggcacacaagccgagaaagacagaaggctgaagaaaaaacacgagctgctggaagaagctaggcgtaaaggactcccttttgctcaatgggacggtcccactgtggttgcttggctggaactctggctcggcatgccggcatggtacgtcgccgcatgcagagctaacgtaaagtccggcgcaattatgtcggctctgagcgatacggagatccagagggaaatcggaatttccaatcccctgcatcgtctgaaactgcgtctggcaattcaagagatggtcagtctaacatcccccagtgcacccccaaccagtagaactccctctggcaatgtgtgggtcacccatgaagaaatggaaaatctcgccgctccagctaagactaaggaaagcgaagagggcagttgggcccagtgccctgtgtttctgcaaacgcttgcctatggagacatgaaccacgagtggatcggcaatgagtggctgccgagcttaggtctccctcaatatagaagctattttatggagtgccttgtcgacgcaaggatgctggaccacctgactaaaaaggacctgagggtccatctgaaaatggtggacagtttccatcgtacgagcctccagtacggtataatgtgtctgaaacggttgaactacgatcggaaggagctggaacgcaggcgagaagcatcccagcacgaaataaaggatgtcctggtctggtctaacgatagagtcattcgctggattcaagctattggcttgagagagtacgcaaacaacatattggagagcggagtgcatggtagcctcatcgctctcgatgagaactttgactactcctctctagccctgctgttgcagattccaacacagaatacacaggccaacgcccgtcaaatcctggagcgggagtataacaacctgttagcactgggcactgaacgccgtctggacgagtccgacgataaaaattttaggcgcggttctacgtggaggcggcagttccctccgagagaagtccatggtatatctatgatgcctggttcatcagaaaccctgcctgcaggttttcggctgacgacgacatcaggccaatcccgaaaaatgaccaccgatgatggggtgttctccgtttactccacatag

SEQ ID NO: 53195 - DNA, 366 bp, Artificial Sequence
  Description of Artificial Sequence: Synthetic coding sequence
atgatgtgcgaggtcatgcctacaatcaatgaggacacccctatgagtcagcggggttcccagtcttccgggagcgactcagattctcattttgagcagctgatggtgaacatgctggacgagcgcgatcgacttctcgacacgctccgggaaacccaagaatctctgtcactggcacaacaaaggctccaagacgtgatttatgaccgagattcccttcaaaggcagctgaacagtgccctgccacaggatattgagtccctaactggcggtctggccggttcaaagggagcggatccgcctgaatttgctgccctcactaaggagcttaacgcatgcagagagcaacttttggagaaagagtag

SEQ ID NO: 53196 - DNA, 3774 bp, Artificial Sequence
  Description of Artificial Sequence: Synthetic coding sequence
atgatgtgtgaggtaatgcctaccattaatgaggatactcctatgtcccagcggggatcccagtccagcgggagcgattctgacagtcattttgagcaactgatggttaatatgctcgacgaaagggatcggctgcttgatacgcttcgcgaaacccaggagagcctgagcctggctcagcagcggcttcaggatgtgatctacgacagggactctctgcagagacagctgaactctgcgttaccacaggacattgaatccctgaccggcggtctcgccggtagtaaaggcgctgatcctccagagttcgcggctttgacaaaggaactgaatgcttgccgtgaacagctgctcgagaaagaggaggagattagcgaactgaaagccgaacgtaataatacccgcctgctgctagagcacctcgagtgtctcgtatctaggcatgagcggtccctgaggatgactgttgtgaagaggcaggcacagagccctagtggcgtttcatctgaggttgaagtgctgaaagccctgaagtctctgtttgagcatcacaaagcattagacgaaaaggtgcgggagagactgcgcgtcagccttgaaagggtgtccgctctcgaagaagagctagctgcggcaaaccaagagatcgtagcactgcgcgaacagaacgtgcacattcagcgcaaaatggcttcaagcgaaggtagtaccgagtcggaacacctggaaggtatggaacccggtcagaaggtccatgagaaacggctaagtaacggatctatcgattcaactgatgagacatcccagattgttgaactacaggagctgctagaaaaacagaactacgaaatggcccagatgaaagagaggctagcagctttatcatcccgtgtcggcgaagtggagcaagaagccgagactgctcgtaaagacctgatcaagaccgaagaaatgaacaccaagtatcaaagggacattcgcgaagcgatggcccaaaaggaggatatggaggagcgaatcacaaccctcgaaaagcggtatcttagcgcacagcgggagagtacttcaatccacgacatgaacgacaaactggaaaatgaactggccaataaggaagccattctgcgccagatggaagaaaagaaccgtcagttacaggagcgcttagaacttgccgaacagaagcttcagcagacaatgcgcaaagcagagacgttaccagaagttgaggccgagctggctcagagaattgctgctctcactaaggccgaggagaggcacggtaacatcgaggaaagaatgcggcacctggagggccagctggaagagaaaaaccaggagctccagagggcacgccagagggagaagatgaacgaagaacataataaacgacttagtgacacggtagaccggctgctgaccgagagcaatgagcgactgcagctgcacctgaaggaaaggatggccgcactggaagaaaagaacgtattgattcaggagagtgaaacctttaggaagaacctagaggagagcctgcacgataaggagaggctggccgaggagattgaaaagctgaggagcgaactagatcagctcaagatgcggactggttccctgatcgagcccaccatcccgcgaacccatctcgacacaagtgctgaattgagatatagcgttgggtccttggtggattcccagagcgactaccgaaccaccaaagtgattcgtcggccacgacggggacgtatgggcgtaagaagagatgagcccaaagtaaaaagcctgggagaccacgagtggaatagaactcagcaaattggggtgctgtccagccaccctttcgagtccgataccgaaatgtccgacattgatgatgacgatcgcgaaacgatttttagttctatggatctgctgagtccatctggacactccgacgcccagactttggcaatgatgttgcaggaacagctcgacgcaattaataaggaaatcaggttgatccaggaagagaaagaaagtactgagctgcgggcagaagaaatcgagaatagggtggcatccgtgtcccttgaaggtttgaacttggcgagggttcacccaggaaccagcattaccgcttctgtaactgcgtctagcctcgcgagctctagtcctcctagtgggcatagtacacccaaactgactcctcgctcccctgcacgcgaaatggacagaatgggggttatgactctgccttccgatctgagaaagcaccggagaaaaatcgccgttgtggaagaggacggacgagaggataaagctaccataaaatgcgagacgtcccctcccccaacacccagagcgctaagaatgacgcatacacttccctcctcctatcacaacgacgcacgcagcagcctgtccgtcagtcttgagcctgaatccttgggcttgggcagcgctaattccagtcaggattctctgcacaaagccccaaagaaaaaggggatcaaatcttcgattggcaggctcttcggcaagaaagaaaaggcccgacttggccagctccgtggatttatggagaccgaggccgcagcccaggaatcccttgggttgggcaaactgggaactcaagctgaaaaagacaggcgcctgaagaagaaacacgaattgttggaagaggcccgacggaaaggcctcccattcgcgcagtgggacggccctactgtggtggcctggttggaactctggctcggtatgcccgcatggtacgtagcagcttgccgggcaaatgttaaaagtggcgctatcatgtctgcattatcggatacagaaattcagcgtgaaattggtatttctaatccactgcaccgattgaagttgagactggcaatacaagaaatggtctctctcacaagtccctccgccccaccaacatccaggacacctagcggaaacgtgtgggtgacgcacgaggaaatggaaaacctggctgctcctgccaaaaccaaggagtctgaggaaggtagctgggctcagtgccccgttttcctgcaaacgctggcctatggcgacatgaatcacgagtggatcggcaatgaatggctcccatcattagggctgccccaataccgaagttacttcatggagtgcctggtcgatgcacgaatgctggaccatctgaccaaaaaagatctcagggtgcacctgaaaatggtagacagtttccaccgcacatcactccagtacggcatcatgtgccttaagcgtctcaactatgatcggaaagaactcgagagaagaagagaggcatctcaacatgaaatcaaggatgtactcgtctggagcaatgacagagtgatcagatggattcaggccataggcctgagggaatacgctaataatattctggaatcaggagttcatgggtccctgatagcccttgatgaaaattttgactacagttctctggcgctgctgttgcagatccccacgcagaatacgcaggccagacaaatcctcgaaagggaatacaacaatttattggcccttggaacagaacgcagattggacgaaagtgacgacaagaacttccgcagaggttcaacttggcgcagacagttccctccaagggaagtacacgggatctctatgatgccagggtcgtcagagaccctgcctgccggatttcgacttaccacaaccagcggtcagtcacgaaaaatgaccacagatgtcgcctctagtcgcctgcagcgcttggacaactctactgttaggacctacagctgttag

SEQ ID NO: 53197 - DNA, 1974 bp, Artificial Sequence
  Description of Artificial Sequence: Synthetic coding sequence
atgagacgagcggtgtgtttcccggcattgtgccttctgttgaatttacacgccgctggatgcttctccgggaacaacgatcattttctcgcaatcaaccagaagaaatctgggaaacctgtcttcatctacaagcactcacaagacattgagaaaagtcttgacatcgcaccgcagaaaatataccgtcactcctatcacagctcgtcagaagcacaggtgagtaagagacatcagatcgttaattcagcttttcctcgaccagcgtacgatccctctctgaacctgctcgccatggacggacaggacctcgaggtggagaatctgcctattcccgctgcaaacgtcattgtggtgaccctgcagatggatgtgaataagctcaatattacacttttgcgtatcttccgccagggcgtggccgcagctttaggtctccttccacaacaggtgcatatcaatcggctgataggtaaaaagaattctatcgagctgttcgtaagccccataaatcggaaaacaggaatatctgatgccctaccttccgaggaagtccttcgttcactgaatatcaacgtcttacatcaaagcctcagccagttcggaatcacagaagtatctcctgagaaaaacgtgctgcagggccagcacgaagctgacaagatctggtccaaggaaggtttttacgccgtagtaatctttctgtcaatttttgttattatcgtaacatgtcttatgatcctgtaccgcctgaaagaacgcttccaactgtccctacggcaagataaggagaagaatcaggaaattcacctgagccctattactttacagcccgctttatccgaagcaaagaccgtccactcaatggttcagcccgaacaggcgccaaaggtgctcaacgtcgtggtagacccgcaagggaggggagcaccggaaattaaagccaccaccgctacatcagtctgtccaagtcctttcaagatgaagcccatcggcctgcaagaaagacggggatcaaatgtttctctgacgttggatatgtcttctttgggcaatattgaaccatttgtctctattcccacacccagggagaaggtggccatggaatatctacagagcgccagtagaattctgacaaggtcccagctgcgcgacgtagtggccagtagccaccttctgcagagtgagtttatggaaatacctatgaattttgtggaccccaaggagattgacatccctaggcacggaactaaaaacagatataagacgatactgccgaatccgctctctagagtttgcttaagacctaagaatgtgacagattccctatctacatacatcaacgcaaattacatacgaggctacagcgggaaggagaaggcgtttattgccacccagggcccaatgatcaacacagttgatgacttctggcagatggtttggcaggaagatagccccgtgatcgttatgatcaccaaacttaaggaaaagaatgaaaaatgcgtactgtattggcctgagaagcgcggaatttatgggaaggttgaggtgcttgtgatcagcgtgaacgagtgcgacaattacaccataagaaacctggttctgaaacagggctctcacactcagcacgtgaaacattactggtatacctcttggccggatcataagaccccggatagcgcccagcccttactgcagttaatgcttgacgtcgaggaagacagacttgcaagccagggaaggggcccagttgtcgtgcactgcagtgccggaatcggcaggactgggtgcttcatcgccacctcaataggctgtcaacaactgaaggaggagggcgttgtagatgcactgtcaattgtgtgccagctgcgaatggatcggggaggcatggtccaaactagtgaacagtacgagtttgttcaccatgctctgtgtctttatgaaagtaggttaagtgcagagactgtccagtag

SEQ ID NO: 53198 - DNA, 1356 bp, Artificial Sequence
  Description of Artificial Sequence: Synthetic coding sequence
atgaaccaaaaaaatgtgttgcagggacaacacgaggccgacaagatctggagcaaggagggcttctatgcggtggttatattcctgtccatctttgtgatcattgtaacctgtttgatgatcctgtaccgactgaaggaaagattccaactgtctctccgacaggataaggagaagaatcaagagatacacctctctcctattacgctgcaacccgcactcagcgaggcaaagactgtgcactccatggtgcagcctgagcaggcgccaaaggtcctcaacgtagttgtggatccgcagggtcgcggagctcctgagatcaaggctacaaccgctacatccgtctgcccatctccgtttaagatgaagcctattgggctgcaggagcgaagagggtctaatgttagtcttaccctcgatatgtcgagtctgggcaatatagagcctttcgtgagcatcccaacgcctagggagaaggtggccatggaataccttcaatcagccagccggattttgaccagaagtcagcttcgggatgtagtcgcctcgagccacctgctacagtctgagttcatggagattccgatgaactttgtggatccaaaggagatcgacatcccccgacacggcacgaaaaaccgttacaaaaccatcctcccgaatcctctttccagagtttgtctgagacccaaaaatgttacggactcccttagcacctatatcaatgccaactacatccgagggtacagcggaaaggagaaggccttcatcgcgactcaagggccaatgattaatacagtggatgatttctggcagatggtttggcaagaagactcaccagtgattgtgatgattacaaagctgaaggagaaaaacgagaagtgcgttctgtattggcccgaaaaaaggggaatctatgggaaggtggaagtactggtaatatctgtcaacgagtgcgacaattatactatccgaaacttagtgttgaagcaggggtcacacacacagcatgttaaacactactggtacaccagttggcccgaccacaaaactcctgattccgcgcagcctctgttgcagctcatgctcgatgtcgaggaagacaggctcgcatcccaagggcgaggccctgtggttgtacactgtagcgcaggaataggaagaactggctgcttcatagccacaagcatcggatgccagcaactgaaggaggagggcgtggtggacgcactaagtattgtgtgtcaactgagaatggaccggggtggcatggtacagacctctgagcaatacgaattcgttcaccacgcattgtgcctctatgagtcacgtctgtctgcagaaaccgtgcagtag

SEQ ID NO: 53199 - DNA, 1239 bp, Artificial Sequence
  Description of Artificial Sequence: Synthetic coding sequence
atgattctgtatcgacttaaggagcgcttccagctgagcctgcggcaagataaagagaaaaatcaggaaatccacctcagcccaattacgctgcagcccgcattgagcgaagcaaaaactgttcatagcatggttcagcccgagcaggctccaaaagtccttaatgtcgtggtggacccacagggtcgaggcgctccggagattaaggccaccacagccacttccgtgtgtccatcaccatttaagatgaagcccattggactgcaagagcgcaggggctccaacgtatccttaacactggacatgagctccctagggaatattgagccatttgtaagcatcccaacccccagagagaaagtggcaatggagtacctgcagagtgcgtcccgtatccttacaagatcccagttgagagatgtggtcgctagctctcatctgttgcagtctgaatttatggaaatacctatgaactttgtggatccgaaggaaatcgacatacctcgccacggcactaagaacagatacaagaccatcctgcctaatccgctaagtcgcgtgtgcctgcgacctaagaacgtaactgacagcctttcaacttacataaacgccaactacattaggggctattccggcaaggagaaagccttcattgccacacaggggccaatgatcaacactgtggacgatttttggcagatggtttggcaggaggactcccctgtcatcgtgatgatcaccaaacttaaagagaaaaatgagaagtgtgttttatactggcctgagaagaggggtatttatggtaaagtggaagtgctggtcatctctgtcaacgagtgtgacaattacacgatccgaaatctcgttcttaagcagggtagtcacactcagcatgtcaagcattactggtacacatcgtggcccgaccacaaaactccagatagcgcacaacccctgctgcagctgatgctggacgttgaagaagacagactggcatctcagggccgtggtcccgttgtcgttcactgcagcgcgggaatagggaggacaggttgtttcatcgccacaagcattggttgtcagcaactaaaggaagagggcgtagtcgacgcattatctatcgtatgccagcttcgcatggatagaggagggatggtgcagacctccgaacagtatgaattcgtacatcacgccctttgtctgtatgagtccaggctctcggctgaaacagtccagtag

SEQ ID NO: 53200 - DNA, 1239 bp, Artificial Sequence
  Description of Artificial Sequence: Synthetic coding sequence
atgatcttatataggctaaaagagagatttcagctgagcctccgtcaggataaggaaaaaaatcaagagatccacctgtcaccaatcacgcttcagccagcgctatccgaggccaaaactgtgcacagtatggtacagcccgaacaggccccaaaggtgctgaatgtagtcgtcgatccccaggggaggggggcacctgaaatcaaggctaccactgccacatccgtgtgcccgagcccattcaagatgaaaccaattggcctgcaggagagacggggttctaacgtatcgcttactcttgacatgtccagcctgggcaacattgagccatttgtatccatacctaccccaagggaaaaggttgcaatggagtatttgcagtccgcctctcggattctcaccaggtcccagctgagggatgtggtggctagctcccacctgcttcagtccgaatttatggagatccctatgaactttgtggatccaaaggagattgatatccctcgccacggaactaagaatcgttacaagaccattctgcctaacccactgtcacgggtgtgcctcaggccaaaaaatgtcaccgactctctatccacttacattaacgccaactacataaggggatactcaggaaaggagaaagccttcatcgccacacaggggcctatgattaatacggtcgatgatttttggcagatggtctggcaggaggattcaccggttattgtgatgattactaaactgaaggaaaagaacgagaagtgtgtcctgtactggcctgagaagagggggatctatgggaaagtagaagtgttggtgattagcgtgaatgagtgtgataactacacaatcaggaacctggtgctgaagcaagggtcacacacccaacatgtcaagcactattggtacacttcctggcctgatcataaaacaccagactccgcccagccactgttgcaacttatgctggacgtggaagaggatagactagcatcccaagggcgtggtcccgtggttgtgcactgctctgcaggcatcggacgtacaggctgctttatagccaccagcattggctgccaacaactcaaggaagagggggtcgtcgatgcgctgagcattgtgtgccagctaagaatggacaggggcggaatggtacagaccagcgaacagtacgaatttgtgcaccacgctttatgtctttatgagagccgcctttccgcggaaacggtgcagtag

SEQ ID NO: 53201 - DNA, 597 bp, Artificial Sequence
  Description of Artificial Sequence: Synthetic coding sequence
atgatcctgtatcgattaaaagaacggtttcagctgagcctgcggcaggataaagagaagaatcaggagattcacctgagcccaatcactctgcagcctgcgctttccgaggctaagaccgtgcattccatggtgcagcctgaacaggcccctaaagtactgaacgtagttgtggaccctcaaggacggggtgctcctgagattaaagctaccaccgccacttccgtctgccccagtccgttcaagatgaaaccaattggtctccaagaaagaagaggaagcaatgtctctttgactctggatatgtccagcctcgggaatatcgagcccttcgtgagtattcccacccctagggagaaggtagccatggagtatctgcagagtgcatcccgcattctcaccagatcccagctccgggacgtggtggctagtagtcacctactacagtctgagttcatggaaatccccatgaattttgtcgaccctaaagagatagatatccctagacacggaactaagaaccgatataagacgattctcccaaatcccttatcacgggtatgcctgcgccctaagaatgtgacagattccctctag

SEQ ID NO: 53202 - DNA, 4352 bp, Artificial Sequence
  Description of Artificial Sequence: Synthetic coding sequence
atggcatcgctggctgctctggctctctcactgctcctcaggctacagcttcccccactgccaggggctagggctcagtcggctgccggtggctgcagctttgatgagcactacagcaattgcgggtatagcgtggccctcggaacgaatggtttcacatgggaacagattaatacctgggagaagccaatgcttgaccaagcggtgccaaccggctccttcatgatggtgaactcctcagggagggcttccggacagaaagcacaccttctgttgccaactttgaaggaaaatgatactcactgtatagattttcattactatttcagttcccgggatcggtcatcgccgggagctttaaatgtttatgtgaaagtcaacggcggtccacaaggcaatcccgtctggaatgtgtcaggggtagttaccgaaggctgggtcaaggccgagctggccattagcacattctggcctcacttctatcaggtcatcttcgaatcagtaagcctgaaagggcatcctggctatatcgccgtggacgaggtgagagttcttgcccatccctgtaggaaggctcctcatttcctccgcctacagaacgtggaggttaatgtaggacagaacgccacatttcagtgcattgcaggcggaaaatggagtcagcatgataagttgtggttacagcagtggaatggacgggacaccgccctcatggtgacacgcgtagtgaatcatagaagattttctgctaccgtatcagtggctgacaccgcgcagcggtccgtgtctaagtatcggtgtgtcatccgaagtgacgggggatccggggtaagcaattacgcggaactgatcgtaaaggagcctcctactccaatcgctcccccagagctgctagctgtgggcgcaacctatctgtggataaagcccaatgccaacagcattattggagatgggcctatcatcctgaaggaagtagaatatagaacaacaacgggtacttgggctgagacacatatcgttgacagccctaactacaaactgtggcacctggaccctgatgtagaatacgaaatcagggtgctcctgacgagaccaggagagggagggaccgggccaccgggacccccattgaccacccgcacaaagtgcgccgacccagtgcacggccctcagaacgttgagattgtagacattcgcgcacggcagttgacgctgcaatgggagccattcggctacgccgtgacaaggtgtcacagctataaccttacagtgcagtatcagtacgtgtttaaccaacagcagtatgaggctgaggaggtgattcagacctctagtcactatacattaaggggtctcagaccctttatgacgatccggctccgccttctccttagcaatccagagggcaggatggaatcagaggaactcgtggtgcagaccgaagaggatgtgcctggggcagtgccccttgaatcgatacaggggggaccattcgaggagaaaatttacattcaatggaagcctccgaatgagacgaatggcgtgatcacgctttacgagatcaattacaaggctgtgggtagtttggatccctcagccgatctgtcctcccagaggggaaaagtctttaagctccgcaatgagacccaccatctctttgtcgggctgtatccaggtactacatactcattcactattaaagcttctactgcaaaaggcttcggaccgcctgtgaccacacgcatcgctacaaaaatcagcgctccatccatgcctgaatacgacactgacactccactgaatgagactgacacaactattacggtaatgctcaagccagctcagtcgagaggagcacccgttagcgtttaccagcttgtagtcaaggaggagaggctccaaaagtctaggagagcagccgacattatcgaatgctttagcgtgcccgtgtcctatcgcaatgcttcttctttagattcacttcactactttgccgcagagctgaagccggcaaatctccctgttacgcagccctttacagtaggtgataacaagacctataacggttattggaatccacctctatcaccccttaaatcatactctatttacttccaggcactgtcaaaggccaacggggagactaagattaactgcgtgcggctcgcgaccaaggcccctatgggctctgcacaggttacacccggaacccccctgtgcttgctgaccactggggcttctacacagaatagcaacacggttgagccagaaaagcaggttgacaacaccgtgaagatggccggtgtcatcgctggcctcttaatgttcatcattatactgctgggtgtcatgctgactataaaacgacggaagctggcgaaaaaacagaaggaaacccagtcgggagctcagcgagagatgggccctgtagcctcagccgataaacctacaaccaagctgtcagcgagccggaatgatgaggggttttcctcttcttcccaggatgtgaacggatttacagacggcagccggggagaactctcccagcccactctgaccattcagacacacccatataggacttgcgatcctgtagagatgagctatcccagggatcagtttcagcctgcgatccgcgtggccgacctgctccagcacataacacaaatgaagagaggccagggctacggcttcaaagaggaatacgaagccttgcctgaagggcagacagcctcttgggacactgctaaagaagacgagaatcggaataagaaccgatacggcaatatcattagctacgaccactcaagggtccggctacttgtcctcgacggtgacccacactcagactatataaacgccaattacattgacgggtaccataggccgaggcactatatcgcgacccaagggccaatgcaagaaacagttaaagacttttggaggatgatatggcaggaaaactcagcctcaatcgtgatggtgactaatctggtggaagtcgggagagtcaaatgcgtaagatattggcccgacgataccgaagtgtacggcgacatcaaagtcaccctgattgagaccgaaccactcgctgagtatgttatccgcacatttactgttcagaaaaaagggtaccatgaaattcgggaattacgactgtttcacttcacaagctggcctgatcacggagtcccatgctatgctaccggcctgctagggtttgtcaggcaggttaaattcctgaacccaccggaagcaggaccaatcgtagtccattgtagcgcaggcgctgggagaaccggatgcttcatcgccatcgatactatgttagatatggccgagaacgagggagtggttgatatcttcaactgtgtcagggaattaagggcgcaacgcgtgaatctggtccaaactgaggagcagtacgtctttgtgcatgacgctatcctagaagcttgtctgtgcggcaatacagccattcccgtgtgcgagtttcgcagcctctattacaacatcagccgcctggacccacagaccaacagtagccagatcaaggatgaatttcagaccctcaatatagttaccccgagggtacgacctgaagattgctcaatagggctcctgccacggaatcacgataagaacagatccatggatgtacttcctctggatagatgcctgccctttttgatctccgtcgacggtgagtcttccaattacattaacgccgctctcatggatagccataaacagcctgccgcatttgttgtgacacagcaccccttgcccaatacagtcgctgatttttggagacttgtctttgattataattgtagcagtgtcgttatgctgaatgaaatggatactgctcagttctgtatgcagtactggccagaaaagacctccggctgttacggcccaatccaggttgagttcgtctctgcagatattgacgaagacatcatccatagaatatttagaatttgcaatatggccaggcctcaggacggatatcgtattgtgcaacacttacagtacatcggatggccagcttacagggacactcccccaagtaaaagatccctgttgaaggtggtgcgcagactcgagaaatggcaggagcagtacgacggccgagagggccgaactgtcgtccattgtcttaatggtggtggaagaagtggcactttttgcgccatttgcagtgtgtgcgagatgatccaacagcagaacatcatcgacgtgtttcatatcgttaaaacccttcggaacaacaaatccaacatggtcgagacactcgagcagtacaagtttgtctatgaagtggcgctggaatatctgagctcttttta

SEQ ID NO: 53203 - DNA, 4355 bp, Artificial Sequence
  Description of Artificial Sequence: Synthetic coding sequence
atggccagcctggccgcattggcgctgtccctgctactcaggctccagcttcctcctcttcctggggctagagcacagtcagccgctggtgggtgttcttttgatgaacactatagcaactgcggctacagtgtggcactcgggaccaatggtttcacgtgggagcaaatcaatacttgggagaagccaatgctggaccaagccgtgcctaccggaagctttatgatggtgaactctagcggcagggcgtcaggccagaaagcccaccttctgctgcccactctcaaagaaaacgacacccactgcatagactttcactactactttagtagtagagacagatcctctccgggagccctcaacgtttacgtgaaagtgaatggcggaccgcagggcaacccggtttggaatgtgtcaggggtcgttaccgaaggctgggtcaaagcagagctggctattagtacgttctggccccacttttaccaggttatttttgaatctgtttcactgaaggggcaccctgggtatattgctgtagatgaggttcgcgtcctggctcacccctgcagaaaagcaccacatttcttgcggctgcagaatgtggaagtgaatgtcggacaaaacgcgaccttccagtgtatcgcagggggaaagtggtctcagcacgataagctatggcttcaacagtggaatggacgcgacacagccttaatggtgaccagggtcgtgaaccatagacggttcagcgcaactgtctccgtggccgatactgcgcagcggtccgtgtcaaaatatcgatgtgtaatccgctctgacggcggtagtggagtgtccaattatgctgagctgatagtgaaagaacctccaacaccaatagccccaccagaactgttggcagtgggggcaacatatctgtggatcaaaccaaatgccaatagcatcatcggcgatgggcctattatactgaaagaggttgagtatcgcactacgacgggaacatgggccgagacacacatcgtagactctccgaattacaaactatggcacttggaccctgatgtggagtatgaaatcagggtccttttgaccagaccaggtgaaggaggtacaggcccacctggccctcctctgactactcggaccaaatgcgctgatcccgtccatggaccacagaatgtcgaaatcgttgatatacgagcaagacagctcactctccagtgggaacctttcgggtatgccgtgacacggtgtcattcctacaatctgacagtccagtatcagtatgtgtttaaccagcaacagtatgaggccgaagaggtgatccagacaagtagccattatactctgcggggacttagaccgttcatgacaatcaggttgcggttactgctttccaatccagaaggccgtatggagtcagaggaactggtagtccagacggaagaggacgtgccaggggctgtgcctcttgaatccattcagggcggaccttttgaggagaaaatctacattcaatggaaaccccctaatgagactaacggtgtcatcacattgtacgaaataaactacaaagctgtgggttcccttgatccaagcgccgatcttagctcgcaacgagggaaggtctttaagctgcgcaatgagactcaccacctgttcgtaggactgtatcctggtacgacgtattcatttactattaaggcgtcgacagcgaaggggttcggaccacccgtgaccactagaattgccaccaaaatttcagctccgtcaatgccggagtatgacaccgatacaccgctgaatgaaacagacacaacgatcacagtcatgctgaaaccggcacaatctcggggagcgcctgtctctgtgtaccaacttgttgtgaaagaggaacggttacagaaatctagacgggctgctgatattatcgaatgctttagcgtcccagtgtcatataggaacgctagctctctcgatagtctgcactacttcgccgcagagctaaagcctgcaaacctgcctgtgacacagccgtttacagtcggggataacaaaacatacaatggctattggaatcccccactgagtccactaaagtcttactcgatttattttcaagctctctccaaggccaacggcgagacaaagatcaattgcgtaagactcgcaactaagggagcctcgacgcaaaactcgaacaccgtcgagcctgagaagcaagtggacaacacagtgaaaatggctggtgttattgcaggcctgctaatgtttatcatcatactgcttggcgttatgctgactataaagaggaggaaactggcaaagaaacaaaaagagactcagtcaggtgcacagagagagatggggccagttgcctctgccgacaagccaacgaccaagttgagtgcctccaggaacgatgagggattttcctcatcttcccaagacgtaaacgggttcacggacggatcacgtggtgagctgtcacagccgacccttaccattcagacacacccatatcgcacatgcgacccagtcgaaatgtcctacccccgagaccagttccagcccgctatccgagttgcggaccttttgcagcatattacccaaatgaaacgaggccaggggtatggtttcaaggaagagtatgaagcactgccagagggacagacagcttcctgggatactgcaaaggaggatgagaataggaacaaaaacagatacgggaatatcatctcatacgaccactctagggttcggcttcttgtactggatggcgacccacacagtgactacattaacgccaactacattgacgggtaccaccgccctcggcactatatagctacccagggacctatgcaggaaaccgtgaaagatttttggcgaatgatttggcaggaaaatagtgcatccatagtgatggtgaccaatctcgtcgaagtgggtagacatcccgcagagcataccgtaggcaacgccactctggggagggccgctagcccgggaatggtaaaatgcgtccggtactggcctgatgacaccgaggtctatggggacattaaagtgacgctaatcgagaccgaacccctcgctgagtatgtcattcgtactttcacggtccagaagaagggataccacgaaatccgagaacttcgcttattccatttcacatcatggcctgatcatggcgttccctgctacgccacaggcctgctgggatttgtgcgtcaggttaagtttctgaatccaccagaggcgggacctattgtggttcactgctctgcgggagctggcaggacaggctgtttcatagcgatcgatacaatgctcgatatggctgagaacgaaggagttgtggacatcttcaattgcgtacgcgagctaagagctcagcgtgtaaacctcgtccagacagaagagcaatacgtgtttgtacacgacgcgatccttgaggcttgcctgtgtggtaacactgcaattcccgtttgcgagttcagaagcctctactacaacatatcccggctggatccacagacaaactcatcacagatcaaggacgaatttcagaccctcaacatagtaactcccagggtgcgacccgaggactgctctattgggttgttacctagaaatcatgataaaaacaggtctatggatgtcttgccgttagaccggtgcctacccttcctgattagcgtcgacggcgaatcctccaattatattaatgcagctctgatggattctcacaaacagccagcggcatttgttgtgacccagcacccgctccccaataccgtagcagatttttggcgcctggtcttcgactataactgctcatcagtcgtaatgttaaacgagatggacactgcccagttctgtatgcagtattggcccgagaagactagcggatgttacggccctatacaggtggagttcgtctccgccgacattgacgaggacatcatccaccgtatctttcgaatttgcaatatggccaggccacaagacgggtatcggattgtccagcaccttcaatacatcgggtggccggcttatagggacactccaccatctaagagatctctcctaaaggttgttagacggctggaaaaatggcaggaacagtacgatgggcgagaaggcagaaccgtggttcactgtcttaacggaggaggaaggagtggcactttttgtgccatctgtagtgtgtgcgagatgatccagcagcagaatatcatcgacgtgttccatattgttaaaacacttcgaaataacaagtccaacatggtggagacactagagcagtataaatttgtttacgaggtcgccctggaatacctcagcagtttcta

SEQ ID NO: 53204 - DNA, 4325 bp, Artificial Sequence
  Description of Artificial Sequence: Synthetic coding sequence
atggcctccttagccgcactggcactgagcctgctgctgagactccagttacctcctctgcctggagcccgagctcagtccgctgcgggaggttgcagcttcgatgaacattactccaactgcggctactccgttgccttggggactaatggcttcacatgggaacagattaacacatgggagaaaccaatgctggaccaggcagtgccaaccggcagcttcatgatggtgaattcatctggacgagcaagtggacagaaggctcatctgttactgccaacgttaaaggagaatgacactcactgtatagactttcactattatttttcctccagagacaggagtagcccaggagccctgaacgtctacgtcaaagttaatggaggtccccaagggaacccagtgtggaatgtgagtggcgtagtcaccgagggctgggtaaaagccgagctcgccattagcacattctggcctcacttctatcaagtcatctttgaatcagtgagcctcaaagggcaccccggttacattgccgtcgacgaggtgcgggtgctggcacatccatgccgaaaagcaccacattttctccgacttcaaaacgtggaggtgaatgtgggtcagaatgctacttttcaatgcattgctgggggaaagtggtcccaacatgacaagttatggctgcagcagtggaacggtagggatacggccctcatggtaactcgtgtggttaatcatcgcaggttctcagcaacagtttccgtagccgacaccgcacagcgctctgtgtccaagtatagatgtgtgattcggagcgatggaggaagcggagtttcaaattacgccgaattgattgtaaaggaacctcctacaccaattgcgccacccgagctccttgccgttggcgctacatatctttggattaagcccaatgcaaactctataatcggcgatggccctatcattctcaaggaggtcgagtaccgcaccacaaccggtacctgggccgagacccacatcgtggattcccctaactacaaactgtggcatcttgatccggatgtggaatacgaaatccgcgttctgcttacaagacctggcgagggaggcactggtcctccgggtccacccttaaccacccggacaaaatgtgctgatcccgtgcatggtccacaaaatgttgagatcgtggacatcagggcgaggcagctgaccttacagtgggagccgtttggctacgctgtaacgcgctgccacagttataacctgactgtgcagtatcagtacgtattcaaccagcagcagtacgaagcagaggaggtgatacagacctcttctcactacacattgagaggcctccgcccatttatgactatacgcctgagactactattgagcaaccccgaaggacggatggaaagtgaggagctcgtcgtccaaacagaggaggatgtgccaggcgctgtacccctcgaatccatacagggaggtccattcgaggaaaagatctacattcagtggaagcctcctaacgagaccaacggggtaattacattgtatgagattaattacaaagcagtaggttcccttgatccatccgcagacctgagctcccagcgcggaaaggtttttaaactgaggaacgagactcatcacctgtttgttgggctctaccctggtactacctactcctttactatcaaagcatccacagctaaaggctttggtcctccagttactacccggatcgccacaaagatctcagctccatctatgcctgagtacgacactgacaccccattgaacgagacagacacaaccataaccgttatgttaaagcctgcgcagagccggggagcaccagttagcgtgtatcagctcgtggtgaaggaagagagattgcagaagagcaggagagcagctgacatcatcgagtgtttctccgttcctgttagttataggaatgccagcagcctggactcacttcattactttgctgccgaactgaaacctgccaacttacctgtcacacaacccttcacagtgggtgataacaagacctacaacggctactggaacccgcctttgtcaccgttgaaaagttattctatctatttccaggcactgagtaaggccaatggcgagactaagatcaattgcgtgagactcgccactaagggagcaagcacccagaactccaatactgtcgagccagaaaagcaggtcgacaacacagtcaagatggcaggagtgatagccggacttctaatgttcataattattctcctgggggtgatgctgacaatcaagcggagacgtaatgcttatagctattcttactacctgaagttggccaagaagcaaaaggaaacccaatctggggctcagagagaaatgggtcccgttgctagcgctgataagcccactactaagctatctgcaagtcggaatgacgaaggattctcatcctcttcccaggatgtgaatggttttactgatggcagcaggggagaattgtcccagccaacactcacaattcagacccatccttacaggacatgcgatcctgtcgaaatgtcctatccgagagaccagttccagcccgctatcagagtggccgacctgctgcagcatatcacacagatgaaacgcggacagggctacggttttaaggaggagtatgaggccctgccggaaggacagactgccagctgggataccgctaaggaggacgagaaccggaataaaaacagatatggtaatataattagttacgatcacagccgtgtacgtcttttggttcttgacggagaccctcactctgactatatcaatgccaattatattgatggataccatcgcccacgacactacattgcaacacaaggcccaatgcaggagaccgttaaggacttctggcgcatgatctggcaagaaaattcagcttctattgtcatggtgactaatctggtggaggtgggccgagtcaaatgtgtgagatattggcctgatgataccgaggtttacggcgacatcaaggtcacattgatagagactgagccattggctgaatacgtgattcgcacatttaccgtgcaaaagaagggataccacgaaatccgggagctccgtctgtttcattttacatcatggcctgaccacggggttccctgttacgccaccggacttctgggtttcgtcagacaagtcaaatttctgaatcctccagaggcaggccctattgttgtacattgctccgcaggcgctgggagaacagggtgtttcattgccatcgataccatgctggacatggctgagaatgaaggagtggtggacatattcaactgcgtgcgcgagctgcgcgctcagcgcgtgaacctggtacaaaccgaagagcaatatgtgttcgtgcacgatgctatcctggaggcatgtctgtgcggtaacaccgcaataccggtttgcgaatttcggtcattgtattataacatcagccgtttggatcctcagaccaactcatcacagatcaaagatgagtttcagaccctgaacattgtgacccccagggttcggccagaagattgcagcatcgggctactgccaaggaatcacgataagaacagatcaatggacgtgctgcctctggaccgttgcctcccattcttgatatcagtcgacggcgagagctctaactatattaatgcggcattgatggactcccacaagcagcctgctgctttcgtagtgactcagcaccccctcccgaacaccgtggccgacttctggagactcgtgttcgattacaattgctctagcgtcgtgatgctgaacgagatggacactgcccaattctgcatgcaatactggcctgaaaagacaagcggatgctacggccctatccaggtggagtttgtgagcgcagacatcgatgaagacatcatccaccggatttttaggatctgcaacatggcgaggccgcaggatgggtacaggattgtgcaacacctgcagtatatcggttggcccgcttatagggacacaccacctagtaaacgatcccttctgaaggtggtccggagactagagaagtggcaggagcagtatgatgggcgtgagggtcgcacagtcgtgcactgtcttaatggcggtgggagatctggcaccttctgcgccatctgctctgtgtgtgagatgatccaacagcagaacatcatagatgtattccacattgtgaagacattgcgaaacaacaaatcaaatatggtggagacactcgagcagtataaattcgtgtatgaagtagctctggaatatctgagctctttcta

SEQ ID NO: 53205 - DNA, 4322 bp, Artificial Sequence
  Description of Artificial Sequence: Synthetic coding sequence
atggcttcccttgctgccctcgcacttagcctgctgctccggttacagttgccgccactcccaggcgcaagggcacagagcgccgcaggtggatgctcgtttgatgaacactatagtaactgcgggtattcagttgccctgggtacaaatggatttacgtgggaacagatcaacacttgggagaagcctatgcttgaccaggccgtcccaactggtagctttatgatggttaactcgtcgggtcgagcgtctggccagaaagcccatctcttactgccaacacttaaggagaatgatacccactgcatcgactttcactactactttagctcacgcgacagatccagtcctggggcactgaacgtgtacgtgaaggttaatggcggaccacagggaaaccctgtgtggaatgtgtccggcgtcgttactgagggctgggtcaaagcagaactggctatctccacattttggccccacttctaccaggttattttcgagtctgttagcctgaagggtcatccaggctatattgctgtggacgaagtgcgagtcctggcccacccttgccggaaggcccctcatttccttagactgcagaatgtggaagttaacgtaggacagaatgccaccttccagtgtatagccggaggtaagtggagccaacacgataaactatggcttcaacagtggaatggtagagatactgccctgatggtaacacgggtcgtgaaccacaggagattcagtgccacggtgagtgtggctgacacagcccagagaagtgtcagcaagtatcgctgcgttattaggtcagatggtggatcgggtgtttcaaattacgctgagctgatcgtgaaggaacctcccacacccatagcacctcccgaacttctggcagtaggcgctacatacctgtggataaagcccaacgcaaactctatcatcggggacggcccaatcattctcaaggaggttgaatacagaaccacaactggcacttgggctgagacccacattgtggactctccaaattataaactgtggcacctcgacccagatgttgaatacgagatacgagtactgcttaccagacctggagagggtggcaccggaccacctggaccacctttgactaccagaaccaagtgtgctgatcctgttcacggaccccagaacgtggagattgtcgatataagggcccgtcagctgacacttcagtgggaaccattcgggtatgccgtcactcgctgtcacagctacaatctgaccgttcagtaccagtacgtgtttaatcagcagcaatatgaagcagaggaggtgatccaaacctcaagccattacacattaaggggcctccgaccttttatgactatcaggttgcgcttactactgagcaatcctgagggtagaatggaatcagaagaactggtagttcagactgaggaagacgtgcctggggcagtgcccctagagagcatccagggtggaccctttgaggagaagatctatattcagtggaagcctccaaacgagactaatggtgttattacactttatgaaataaattacaaagccgtggggtccctcgacccgtctgccgacctgtctagtcagcgcggaaaggtattcaagcttagaaatgagacacaccatttgtttgtggggctgtatcctggaacgacctacagctttactatcaaagcaagcacggcgaaagggtttggacccccagtgacaactcggatcgccaccaagatctccgcaccatccatgccggaatatgatactgacacccctctaaacgagaccgatacgaccattacggtaatgctgaaaccagctcaatcgagaggcgcacccgtttctgtgtaccagctcgtcgtcaaggaggagaggctgcagaaatcacgacgtgccgctgatataattgagtgtttctccgttcctgtgtcttatagaaatgcgtcctcattggactccttgcactattttgcggcagagctaaaacctgcgaacctgccggttacacagccgttcactgtcggggataacaagacatacaatggctattggaacccgcctctgtcccctctgaagtcttattccatctacttccaggccctctcaaaggccaatggcgaaacaaaaatcaattgcgtcaggctggcgaccaagggggcttcaactcaaaacagtaacacagtggaacccgagaaacaggtggataacacagtcaaaatggccggtgtaattgcgggactgctcatgttcatcatcatactgttgggcgttatgctgactattaaaagaaggcgaaacgcctactcctacagctactatcttaagctggctaaaaaacaaaaagagacgcaatctggggcacagagggaaatgggcccagtcgcgtccgccgacaagccgactacaaaactctccgccagcaggaacgacgagggctttagcagctctagtcaggacgtgaacggctttaacggatcccgcggtgagctttcccagcccaccctgacaatccaaacccacccttaccgaacttgtgatcccgtggagatgtcgtaccctcgagaccagtttcaaccggcaatcagggtggcggacttgctccagcatattacacaaatgaagaggggacaggggtatggctttaaggaggagtacgaggccttaccggaggggcaaacggcctcatgggataccgcaaaagaggatgagaatcgcaacaaaaatcgttacgggaatattatctcgtatgatcattcacgagtgagactgctggtacttgacggagatcctcacagcgactacatcaacgctaactatatcgatgggtatcatcgaccacgtcattatattgccacccagggacccatgcaggagaccgtaaaggatttttggaggatgatctggcaggagaacagcgcttcaattgtgatggtgaccaatctagtggaagtgggacgggttaagtgcgtgcgctattggcccgatgataccgaggtgtatggcgacattaaggtgaccctgatcgagacagagcccctagccgagtatgtgatcagaacattcaccgttcagaagaaaggatatcatgagatccgtgaactccgcctatttcatttcacaagctggcctgaccatggggtaccttgctatgctactggactactgggcttcgtgaggcaggtaaaattcttgaaccctcccgaagccggtccaattgtcgtgcactgttccgccggtgccggacgcaccggctgtttcatcgctatcgacaccatgctggacatggcggaaaacgaaggcgtggtggacattttcaactgtgtaagggaacttcgagcacaaagagtgaacttagttcaaaccgaagaacaatatgtgtttgttcatgacgcgatccttgaagcctgtctgtgcggcaacacagctatccccgtctgtgagttccggtcactgtactataacatctctcgactcgatccccagacaaactcttcccagatcaaagatgagttccagaccctgaacatcgtcacgcctcgggtaaggccagaggattgttcgattggattgttgccacgcaatcatgataagaatcggagcatggacgttctcccactcgacaggtgcctgccttttcttatctctgttgatggggagagcagcaattacatcaacgccgctctgatggactcacataaacagcccgctgcctttgtcgtaacccagcacccgctgcctaatacagtggccgacttttggagactggtcttcgactacaattgctcgagcgtcgttatgctcaacgagatggacacagctcagttctgtatgcagtactggcccgagaagactagtggctgttacggacctattcaggtggaattcgtgtccgccgacatagacgaggatatcatacaccgaattttccggatatgtaacatggcccgacctcaggatgggtaccgaattgtacagcatctgcagtatattggctggcccgcatacagagacacacctccatctaaacggtcactgctgaaggtggtgaggcgacttgaaaagtggcaggaacagtacgacggcagggagggcagaacggttgtgcactgccttaacggcggtggtcgctccgggacgttttgtgctatctgctctgtatgtgagatgattcagcagcaaaacatcatcgacgttttccacattgtgaagactctgcgaaataacaagagcaacatggttgagacattggaacaatacaaattcgtgtatgaggtcgctcttgagtatctgtcaagctttta

SEQ ID NO: 53206 - DNA, 4334 bp, Artificial Sequence
  Description of Artificial Sequence: Synthetic coding sequence
atggcctctctggctgctctggcgctgtctcttcttctgcgcctccaactcccacccctccccggagcccgagcccaaagcgccgctggaggctgcagcttcgatgaacactattctaactgtggctacagtgtggcacttggcacgaacggcttcacttgggaacagattaatacatgggagaagccaatgttggaccaggctgtgcccacaggctcatttatgatggttaactctagcggacgagcatcggggcagaaagcgcacttactgttaccaactctgaaggagaacgacacacattgcatagactttcactattatttcagctctcgcgatcggagcagtcccggagctctgaatgtctacgtgaaagttaatgggggtccccagggaaacccagtgtggaacgtgagcggagtcgtcacggaaggctgggtcaaagcagaactggcaataagcactttctggccccatttctaccaggtgatattcgaaagtgtgtcgctgaaaggccatcctgggtacattgcggtggacgaagtccgggtgctagctcacccgtgtcgcaaagcgcctcactttctccgtctgcagaacgtcgaagtgaacgtgggccagaatgcgacctttcagtgtattgctggaggtaagtggtctcagcatgacaaactgtggctgcagcagtggaatggaagagacaccgccctcatggtcacccgtgtggtcaatcacaggaggttctctgctaccgtgtccgtagcagacactgcccagcgatccgtttctaaataccgatgcgttattcgcagtgatgggggtagtggcgtgtccaactacgcagagttgatcgtgaaggaaccaccaaccccaatcgcaccccctgagctgttggctgtcggtgctacttacttatggattaagcccaacgcaaacagtattattggcgacgggccaattatactcaaggaggttgagtatcgcactaccactggcacctgggcagagacgcatattgtcgattccccaaattataaactgtggcatctcgatcctgatgtagaatatgaaattagggttctgctgactagacctggagagggcggaaccggaccaccagggcctccacttacaaccagaaccaagtgtgccgatcctgtgcacggtccacaaaacgtcgaaatcgtcgacatccgcgctcggcaattgactttacagtgggagcccttcggatatgctgtcacccgctgccattcctacaatctcaccgtccaatatcagtacgtcttcaaccaacaacagtatgaagcagaggaggtaattcaaacaagcagccactatactttacggggtctgaggccgttcatgaccatacgccttcgactgttgctcagtaatcccgaggggagaatggaatctgaagaactggtcgtgcaaaccgaagaagacgtccccggagccgtcccactggaatcgattcagggcggtccgttcgaggagaagatctacatacagtggaagccacctaatgagactaacggcgtgataaccctgtatgaaattaattacaaggcagttggttcgttagatccttcagcggacctctcaagtcaacgagggaaggtattcaaactgcgcaatgagacccaccatctttttgtgggactgtatcccggaacgacatactccttcacaatcaaagcttctaccgcaaagggattcggccctccggtgacaacccgcattgcaactaaaatctccgcaccaagtatgccagagtacgatacagacacacccctcaacgaaacggatactaccattactgtgatgctgaagcctgcacaatctcgcggtgctccggtctcagtgtaccaactggtagttaaggaggagcggctgcagaaaagcagacgcgctgcagatattatagagtgcttttccgttcctgtttcctatcgcaacgcatccagcctggacagccttcactacttcgcagccgagctgaagcccgctaacctgcccgtgacccagcctttcaccgtcggcgataacaaaacatataacggttattggaacccccctctgagccccctgaaatcctactccatatattttcaagcactctctaaggcaaacggcgaaaccaagattaactgtgtgagactggcaacgaagggcgcttctacccagaactctaacactgtggagcccgagaaacaggtagacaacactgtaaaaatggcaggagtgatagcaggactactcatgttcatcataatcctgctgggggtgatgttgaccattaagagaaggagaaatgcctactcctattcatattacctgtcgcagagaaagctggccaaaaagcagaaggagactcaaagcggagctcaaagggagatgggacctgtggcaagtgccgacaaacccaccaccaagctcagcgcaagtagaaatgatgaaggattcagtagcagctcacaggacgtcaacgggttcactgacggttcacggggtgagcttagccagcctaccctgaccattcagactcacccttatagaacctgcgatcctgtggaaatgagttaccccagagatcagttccagcccgcaattcgcgtcgcagacttactgcagcatatcacccagatgaagcgtggccagggctatggctttaaggaagagtacgaggcactccccgagggccagacagcaagttgggacactgcgaaggaggatgaaaatcgaaataaaaataggtacggcaacatcatctcttacgaccacagccgggtgagactgctcgttttggacggggacccccacagcgactatataaacgccaattatatagacggctatcatagacctcgacactatattgctactcaggggcctatgcaggagacggtgaaagacttctggcgaatgatctggcaggagaatagtgccagcattgttatggtgaccaatcttgtagaagttggacgcgtcaaatgtgtccggtattggcccgatgatacagaagtgtatggggatataaaagtcactttgattgaaactgagccacttgcggaatacgtgatccgtacttttaccgtgcaaaaaaaaggttatcacgagatccgggagctacgcctgttccacttcacctcatggccagaccacggagtgccatgctacgccaccggcctactggggtttgtccggcaagttaagtttctaaaccctccggaagccggacccattgtggtgcactgcagcgccggagctggcaggaccggttgctttatcgccatcgatacgatgctggatatggcagagaatgagggagttgtggatatctttaactgcgtccgggagctgagagcccaacgagtcaatcttgtacagaccgaggaacagtatgtgtttgttcatgatgccatacttgaagcatgcctttgcggaaatactgccatacctgtgtgcgagttcagatcactatactataacatttctcgactcgatcctcagacaaatagctctcagataaaagacgagtttcaaactctgaacattgtaactccacgagtgcggccagaggactgctccatcggcctcctgcctaggaaccacgataagaaccggtctatggacgtgctaccactggacaggtgcctgccattcctgatctccgtggatggcgaaagcagtaattacataaatgctgcgttgatggactcacacaaacaaccggctgcatttgtggtgactcagcaccccctgcctaacaccgtcgccgatttctggcgtctggtgtttgattacaattgcagcagcgttgtcatgctgaacgagatggacacagctcagttctgcatgcagtactggcctgagaagacatcaggttgctacgggcctatccaggtcgaattcgtgtccgccgacattgatgaggatataatccaccgaatttttcggatctgtaacatggcaagaccacaggacggatacagaatcgttcagcacctgcagtacattggatggccggcttaccgggacacccccccttctaagagaagtctcctgaaggtcgtccggcgtctggagaagtggcaggagcagtatgatggaagggagggcaggacggtggtacactgcctgaatggcggtggaagaagcggtaccttttgtgcgatttgtagtgtttgcgagatgatccagcaacagaatattatcgatgtgtttcacattgtgaagacattacgcaataacaagtccaacatggtggaaacattggagcagtataagtttgtctacgaggttgccttagagtacctgtcaagcttcta

SEQ ID NO: 53207 - DNA, 4391 bp, Artificial Sequence
  Description of Artificial Sequence: Synthetic coding sequence
atggcctctctggcggcactggccctctcgctcttacttagacttcagttgcctcccctaccaggggctagagcccagtccgcggctggaggatgctcatttgacgagcattactcaaactgtggttatagtgtggccttaggaaccaacggatttacttgggaacagatcaacacatgggagaagcccatgctggatcaagcagtccccactggctccttcatgatggttaatagctctgggagggcttccggacaaaaagcacacctgctgctgcctactctgaaggaaaatgacacccactgcatagattttcattattactttagttccagggaccggagctctccgggagccctgaatgtctatgtaaaagtaaacggcggacctcaaggaaatcctgtgtggaacgtaagtggagttgtgactgagggctgggtcaaagccgagctcgcaatctccacattttggccccacttttaccaggtgatcttcgagagcgttagcttgaagggtcatcctggttacattgccgtcgacgaggtacgcgtcttagctcatccctgcagaaaggctccccactttctgaggttgcagaacgtcgaggtcaatgtagggcaaaatgcgacttttcagtgcatcgcgggaggcaagtggtcacagcatgataagctttggctccagcagtggaacggtcgggatactgcactgatggtgaccagagtggtgaaccataggcggttctctgccaccgtgagcgtggccgacacggcccagaggagcgttagtaagtaccgttgtgttattcggagcgatggcggaagcggtgtgtccaactacgcagaactgatagtgaaggaacctccaacaccgattgccccaccagagctcctcgccgtaggtgccacgtacttgtggattaagcctaatgccaatagcattataggcgatgggccaatcattttgaaagaagttgaataccgcaccaccacaggaacgtgggctgaaacccatatcgtggactctcctaactacaagttgtggcacctggatccagatgtggagtacgaaatccgggtgctgcttactcggcctggtgaaggcggtactggaccacccggtccaccactgaccaccaggaccaaatgcgcggatcctgtccatgggccacaaaacgtggaaattgtggatatcagagccagacagcttaccttgcaatgggagccttttggatacgccgttacacgctgccattcctataacctaacagtacagtaccagtacgtgttcaaccagcagcagtatgaggccgaggaagtcatccagaccagctcacattacaccttgcgcggtctgcggccttttatgaccatccgcttaaggcttctgttatcaaaccctgaagggaggatggaaagcgaggagcttgtggtgcagactgaggaggatgttcccggtgcagtgccccttgaaagtattcaaggcggaccttttgaggaaaaaatctacatccagtggaaacccccaaacgagaccaacggtgttattaccctctatgagattaactacaaagccgtgggtagcctggatccatccgctgatctctcatctcaaagaggcaaggtcttcaagctcagaaacgagacgcaccacctgttcgtcggactgtacccagggacgacatactccttcaccattaaggcatccactgctaagggctttggtcctccagttaccacacggatagctactaagatctcggctccttcaatgccggagtacgataccgacactcctctcaacgagacggacactaccataacagtgatgctgaaacccgctcagagtcgcggagccccagttagcgtgtatcagctagttgtgaaggaggaaaggctgcagaagtcgagaagagctgcagatataattgaatgctttagcgtcccagtgagctaccgcaacgccagctcactggatagccttcattactttgctgctgagctcaagcccgcaaacctaccggttacccagccctttactgtgggagacaacaaaacttataacggctactggaatccccctctgtctccccttaagtcatacagtatatacttccaagccctatcaaaagcaaatggcgagacaaagatcaattgcgtgcgacttgccaccaaagcacccatgggttcagctcaggtgacacctggcacgcctctctgtctcctgaccaccggtgccagtacgcagaattcaaataccgtggaaccggaaaagcaggtggacaacaccgtcaagatggctggagtcatcgccggactcctaatgttcattatcattctgctgggggtgatgcttacaatcaaaagacgtagaaacgcctatagctatagctactacctgagccagaggaaacttgctaagaagcaaaaggaaacacagagtggtgcacagcgggagatgggaccagttgctagcgccgataaaccgacgacaaaactttccgcctccaggaacgatgaaggattctcttcctcctcccaagatgtcaatggcttcacggacggatcacgcggagagctgtcccagcccacgctcacgatccagacgcacccctacaggacgtgtgaccctgtggaaatgtcctatccaagagaccaatttcagcccgctatccgcgtggctgatctgcttcagcacatcacccaaatgaagagagggcaggggtatggttttaaagaggaatatgaggcgctgcccgaaggccaaaccgcctcatgggacacggccaaggaagatgagaacaggaacaagaatcggtatggaaatatcatttcttatgaccacagcagggtgaggctcttggtcttagacggcgatccacactccgactacattaacgccaactacattgatggctatcaccgaccgagacactacatcgcgacccaaggcccaatgcaggagacagtgaaagacttttggaggatgatctggcaggagaattccgcttctatcgtgatggtgaccaacttggtggaggttggacgagttaaatgcgtgcgctattggcccgacgatacggaggtctacggcgacattaaggtgacactgatagagaccgaacccctggccgaatacgtgattcgaacattcacggtgcagaagaaggggtaccacgaaatcagagagctccgactcttccatttcacttcttggcctgaccacggcgtgccctgttatgcaacaggccttctggggtttgtgagacaggttaaatttcttaatccaccagaggccggaccaattgtagtgcactgtagtgctggcgctggccgaaccggatgtttcatcgccattgacaccatgcttgatatggctgaaaatgagggggttgtggatatttttaactgtgtgcgggaactccgggctcagcgggttaacctggtgcagacagaagaacagtatgtgttcgtacacgacgccatcctcgaggcatgcctgtgcgggaatacagccatccctgtgtgtgagtttcggagcctgtactataatatttcccgactggatcctcagacaaattccagccagattaaagatgaattccagaccctgaacattgttacaccaagggtgagacctgaggactgctccatagggctgttgccacgaaatcacgacaagaataggagtatggacgtgctccctctcgaccggtgtctgcccttcctcatatccgtagatggggaatcgtctaattatatcaatgccgcactgatggactcacacaaacagcccgctgcattcgttgtcacccaacatcccttgccaaacacagtcgctgacttttggcggctggtgtttgattacaactgctcttccgtggttatgttgaacgagatggacaccgcccagttctgtatgcagtactggcccgagaagacttccggctgctacggaccaattcaggttgagtttgtgagcgcagatatagacgaagacatcatacatagaatttttcggatctgtaacatggctaggcctcaggatgggtatcggatcgtgcagcacctgcagtacatcggctggcctgcttatagggacacccccccttctaagaggtctctcctcaaagttgtgagaaggctggagaagtggcaagagcagtacgatggccgagaagggcgtacagtggtgcactgtcttaacggtggcggacgcagcgggacattctgtgctatctgcagcgtttgcgagatgattcagcagcagaatataatcgacgtgtttcatattgtcaagaccctaaggaataacaaatcaaatatggtcgagacactggaacagtacaaatttgtgtatgaggttgccctggagtacctgtccagctttta

SEQ ID NO: 53208 - DNA, 4296 bp, Artificial Sequence
  Description of Artificial Sequence: Synthetic coding sequence
atggccagtctggcagccctggctctgtcactgcttcttcgtcttcaattgcccccactgccaggcgcacgagcgcagtctgccgcagggggatgctcttttgatgagcactacagtaattgtggctacagtgtggctttgggcaccaatggtttcacttgggagcaaattaacacatgggaaaagcccatgctggatcaggcagtccctaccggcagcttcatgatggtgaactcctcggggcgagccagcgggcaaaaggcccacctcctcctgccgacattaaaggagaatgatacacactgcatcgattttcactactatttttcatccagagaccgcagtagccccggagctttaaacgtgtacgtgaaagtcaacggtggcccacagggaaaccctgtgtggaacgtatctggtgtcgtgactgagggatgggtgaaggcagagctcgcaatctccactttctggccccatttttatcaggtgatctttgagagcgtatctctgaaaggccatcccggttatatcgcagtcgacgaagttcgggtacttgcgcatccatgcaggaaagctccccacttcttgcgcttgcagaacgtggaggtgaatgtcggccagaatgcgacgtttcaatgcatcgcaggcggtaagtggtcccaacatgacaaactttggttacaacagtggaatggacgcgacactgccctgatggtaacacgagtggtgaatcatcgccgtttctcagcaaccgtaagcgtagcggataccgctcagaggagtgtaagcaaataccggtgcgtcattcgctccgatggtggcagtggcgtcagcaactatgctgagctcattgttaaggagcccccaactcctatcgccccacctgaattgttggcagtgggtgcaacatacctatggatcaaacccaatgccaactctatcatcggtgacggcccaatcatactcaaggaggttgaatatagaacgacgacgggcacttgggccgaaacgcacattgtcgattccccaaactataaactgtggcacctggaccctgacgtggagtacgaaattagggtgctgttgacccgcccaggtgaggggggtacagggcctcctggtcccccactgaccacccgaactaaatgtgcagatccggtccacggccctcagaatgttgaaatcgtcgacattcgggcacggcagttaactctgcaatgggagccatttgggtacgcagtgacgagatgtcactcctataacttgaccgtacaatatcagtatgtcttcaatcaacagcagtacgaagccgaggaggtgatacagacatcgtcacattacaccctaaggggactgcggccattcatgacgatccgtctaaggctgttgttgagcaatccggaaggaagaatggaatcggaagagctcgtcgtgcaaacggaggaagacgtcccaggggcagtgccgctagaatccatccaaggtggtccattcgaggaaaagatctacatccagtggaagccgccaaacgaaaccaacggtgtcattactctatacgagatcaattacaaagctgtggggtcattagatccgtctgccgatctgagctcccagaggggcaaagtcttcaaattacgtaacgagactcaccacctttttgtaggattgtaccctggcacgacatatagctttacaatcaaggccagtaccgccaagggctttggccctcccgtgacaacacggattgccacgaaaatcagtgcgccaagcatgccggaatatgatacggacacccccctaaatgagacagatactaccataaccgtgatgctgaagcccgcacagagtcgtggggctccagtatctgtatatcaattggtggtgaaggaagaacgcctgcagaagtcccgaagagccgctgatatcatcgagtgttttagtgtgcccgtgagctaccgtaacgcttcttcattggattcattacactactttgctgcagagcttaagccggctaaccttccagtcacccagccttttacggtgggcgataacaaaacctacaacgggtactggaaccccccactcagtccactcaagtcttattcaatttacttccaggctctttcaaaggccaatggagaaaccaagattaattgtgttagattggccaccaagggagcctccacgcagaactccaacacggtggagcccgagaagcaggtggacaacaccgttaagatggctggagtgatcgcagggctgcttatgttcattataattctgcttggcgtcatgctgaccatcaagcggcgaaagttagctaagaaacagaaagaaacacaaagcggcgctcagcgcgagatgggcccagtggctagcgctgacaaacccaccaccaaactgagtgccagcaggaatgacgaaggatttagcagctcctcccaggacgtaaatgggttcacagatggatctcgcggtgaactctcccagccaactttaaccattcagacacatccgtacaggacttgcgaccccgtcgagatgtcttatccaagggatcaattccagcctgctatccgcgtcgccgacttgctgcaacacatcacacagatgaagcgcggacagggatacggctttaaggaagagtacgaggcattgcccgagggacagacagccagttgggacaccgctaaggaagatgagaacaggaataaaaaccggtatggaaacatcatttcatatgaccattcaagagtgcgactcttggtgctggatggggatccgcactctgactatattaatgcaaattacattgacggataccaccggccacggcactatatcgctactcaggggccaatgcaggagaccgtcaaagacttctggagaatgatatggcaggaaaacagcgcctcgattgtcatggtgacgaatctggttgaagtcgggagagtaaaatgtgtcagatattggcccgacgataccgaagtctacggagatattaaagtaaccctgattgaaaccgaaccactcgcggagtacgtcattcgcacattcactgttcagaaaaaagggtaccacgagatcagagaactgcggttatttcatttcacatcctggcccgaccacggagtgccgtgctacgctaccgggcttttgggctttgtgaggcaagtgaaattcttgaacccccctgaggctggccctatcgtcgtgcactgtagcgctggagccggtcggaccggatgtttcattgcgatagacactatgctggacatggcagagaacgaaggagttgttgatatattcaattgtgtgcgagaacttcgggctcagagggtgaaccttgttcagacagaggaacagtatgtcttcgtgcatgatgcaattcttgaggcatgcctgtgcggtaacaccgctatcccagtgtgcgagtttcgtagcttatactataacatttcacgcctcgatccccagacgaacagtagccagatcaaggacgaatttcagacgctgaatattgtgactccgagggtgagacctgaagattgctccatcggcctactgccaaggaatcacgataaaaatcggtccatggacgtgctacccctggacagatgtttaccatttctaattagcgtcgatggtgaatctagcaattacatcaacgcggcacttatggattctcacaaacagcccgcagcctttgtggtaacgcagcacccactgcccaacaccgtggccgacttctggagattagtcttcgattataactgctcttccgtggtcatgctgaacgagatggacaccgcacagttttgcatgcaatattggccagagaaaacttctggatgctatgggcctattcaagtggagtttgtaagtgcggatatagacgaagacataattcatagaatattccggatatgtaatatggccaggccccaagacggatataggatagtccagcatctgcaatatattggctggccagcatacagagatacacctccttccaaaaggagcttgctcaaggtcgtcagacggctagagaaatggcaggagcagtatgatggacgggaggggaggactgtggtgcattgccttaacggcggtggcagatcagggactttctgtgctatatgttccgtctgcgaaatgatccaacagcaaaatattatagacgtgttccatatcgtgaagacactgcgcaataacaagtcaaatatggtggagacccttgagcagtacaagttcgtttacgaagtcgctctggaatacctctcctcgttctaa

SEQ ID NO: 53209 - DNA, 765 bp, Artificial Sequence
  Description of Artificial Sequence: Synthetic coding sequence
atggcggcagttgcggcaaccgctgccgctaaggggaatgggggagggggaggcagggccggagccggtgacgccagcggcacacggaagaagaaaggccctggtccccttgcgacagcttatctcgtcatttacaacgtggtgatgacggccggatggctagtcattgccgtcggactcgtgcgtgcataccttgctaaaggcagttaccactcactctattatagcattgagaaacctctaaaattcttccagactggagcactcctggagatcctgcattgtgcgatcggtatagtacccagctctgtggtactgactagctttcaggtgatgagtcgggtgttccttatatgggccgtgactcattctgtgaaagaagtgcagtctgaggattctgtgttactattcgtcatagcctggaccataactgagatcattcgatacagcttctacactttttcccttctgaaccacctcccctatctcatcaagtgggctcgctacacgctgttcatcgtactatatccaatgggcgtaagtggagagttgcttacgatctatgcagcactgccttttgtgaggcaggccggactatacagcatctctctccctaataagtacaatttcagcttcgactattatgccttccttatcttgatcatgatcagttatatccccattttccctcagctttacttccacatgattcatcagcgcagaaaaatcctgtctcataccgaggagcacaagaagttcgagtag

SEQ ID NO: 53210 - DNA, 1089 bp, Artificial Sequence
  Description of Artificial Sequence: Synthetic coding sequence
atggaaaaccaggtgctcaccccacacgtttattgggctcagcgacaccgagagctttatctgcgggtagagttgtcagacgtccagaaccccgctatatctattaccgagaatgttttgcattttaaagcccagggtcacggtgctaaaggcgataacgtctatgaattccacttagagttcctagacttggttaaacccgagccagtttataagttgacccaacgacaagttaatattacagtgcagaagaaagtctcccaatggtgggaaagactgacaaaacaggaaaagagacccctgttccttgccccagactttgacagatggctcgacgaaagcgatgcggagatggaactgcgggctaaggaagaggagcggctgaataaactgagacttgaatctgagggatcccccgagacactcacgaatctgaggaaaggttacctgtttatgtacaatctcgttcagttccttgggttttcatggatatttgttaacctgactgtccgattctgtattcttggaaaagagtcgttctatgatactttccacaccgtggcagatatgatgtacttctgccagatgctcgccgtagtggagacaattaacgctgcaatcggtgtgacaacttccccagtgttgcccagcctaatccagctgctgggacgtaatttcatcttgtttattatcttcggcaccatggaagagatgcaaaacaaagccgtggtattttttgtgttttatctgtggtctgccattgagatcttcagatattccttttacatgcttacctgcatagacatggactggaaggtgttgacctggctcagatacacgttgtggatccccctctaccctctgggctgcctggcagaggccgtcagcgtaatacagtctattcctatttttaatgagactggaagatttagcttcaccttaccttatccagtgaagataaaagtgaggttctccttcttcctccagatatacctgatcatgatcttcttaggactttacataaatttccggcacctctacaagcaacgccgtagacggtatggacagaaaaaaaagaaaattcactag

SEQ ID NO: 53211 - DNA, 699 bp, Artificial Sequence
  Description of Artificial Sequence: Synthetic coding sequence
atgggaccattggcccttccagcttggctgcagccacgataccgcaagaacgcctatctgtttatctattacctgattcaattctgcggtcactcctggatatttactaacatgacagtcaggtttttctcattcggcaaggactcaatggttgacacattttatgcgataggtctggtcatgcgactgtgccagtctgttagccttctggagttgctacacatctatgtggggatcgaaagtaatcacctgctcccacgcttcctgcagctgaccgagagaatcataatcttgtttgtggtgatcacaagccaggaagaggtccaggagaaatacgttgtctgcgtactcttcgtgttctggaatctccttgacatggtgcgctacacgtattcaatgctgagtgtaattggcataagctatgccgtgctgacatggttgtctcagacgctctggatgccaatttaccccctctgcgtgctggcggaggcctttgccatctatcagtctctgccctactttgagtccttcggaacctatagcaccaagctgccttttgacctgagcatctatttcccttacgtactgaagatttatctgatgatgctgttcatcggaatgtattttacctactcccatctgtactcagaacggcgagacatccttgggatttttcctattaagaaaaagaagatgtag

SEQ ID NO: 53212 - DNA, 699 bp, Artificial Sequence
  Description of Artificial Sequence: Synthetic coding sequence
atgggacccctcgccctgcccgcatggttgcagcctagatacagaaagaatgcatatctgttcatctactatctgattcagttttgcgggcatagctggatctttactaacatgaccgtgcgcttcttctcttttggcaaagactccatggtcgatactttctatgccattggtttagtgatgaggttatgccaatccgtttctttgctagagctgcttcacatctacgtgggcattgagtcaaaccacctgctgcccaggttcctgcagcttaccgagcggatcatcattctgttcgtcgtgatcacctcacaggaggaagtccaggagaagtatgttgtctgtgtactgttcgttttttggaatctcctggatatggtccgatacacctactcgatgctttcagtcatcgggatatcatacgccgtgctgacctggttatctcagacattgtggatgcccatctatccactgtgtgtgctagccgaagcgtttgcaatctaccagagccttccatatttcgagtctttcggcacctactcaactaagcttccctttgatctaagtatatacttcccatatgtgctcaagatttatctcatgatgctgtttattgggatgtactttacgtatagccatttgtatagtgagagacgtgacatcctgggaattttccccataaagaaaaaaaagatgtag

SEQ ID NO: 53213 - DNA, 2397 bp, Artificial Sequence
  Description of Artificial Sequence: Synthetic coding sequence
atggagttctcttggggttcagggcaggagtcccgacgactcctgcttctgcttttattactagccgcatgggaggccggaaacggacagctccactactccgtgtccgaagaagccaaacatggtacattcgtaggacggatcgctcaggacttaggtttggagctcgcggagctagtaccccgactttttcgtgtagcttcaaaggggagagggggacttctggaggtcaatttgcagaacgggatcctcttcgtaaattccagaatcgaccgagaagaactctgtagaaggagcgctgagtgtagtattcacttggaggtcatagtagaccgcccacttcaagtgttccacgttgacgtggaggtccgcgacatcaacgataatcccccagtgttccctgcaacgcagaaaaacctgagcatcgctgagtcacggccactcgactcacgatttcccctggaaggcgcatctgacgccgatattggggaaaatgctcttctgacctaccgtctcagccctaacgaatacttctcgctcgaaaaacctccggacgacgagctggtgaaaggtcttggactgatccttaggaaatccctggaccgagaagaagcacctgagatatttctggtgttgactgccactgacggtggcaagcccgagttgaccggcacagtgcagctgttaataaccgttcttgatgctaacgataatgcgcctgccttcgatagaacgatatacaaagttcgactgttggagaacgtcccaaatggaactttggtcattaagttgaatgcctccgacctggacgaaggtttaaacggcgatatagtgtatagcttcagcaacgatatttcacccaatgtgaagtctaaattccacattgatccaattaccggccagattatcgtcaaagggtacatcgattttgaggaatcaaagagttatgaaattattgtcgagggcattgataaaggccagcttccactcagtggccactgccgtgtgatagtggaggtggaggataacaacgacaacgtccccgacctggagttcaagtctctctcacttcccattagagaagatgctcctctgggaacagtaatagcccttatcagtgtgagcgataaggatatgggagtaaatggactcgtgacatgctccctgacttcacacgttccttttaaactcgttagtaccttcaaaaactactactctttggttctggatagcgctctggaccgtgagtccgtgagcgcctacgagctggtcgtcaccgcacgcgatggaggttcccccagcctttgggctaccgcctctgtgagcgtagaagtcgcagacgttaatgacaatgcaccagcctttgcgcaaccggagtacactgtgtttgtaaaagaaaataatccccctgggtgccatatctttaccgttagcgcctgggacgctgatgcacaggaaaatgcactcgtatcttatagtctagtcgagcgccgtgtgggagagcgtgctctttcctcatatgtgagtgtccatgccgaaagtggtaaggtttatgctctgcagcctctggaccacgaggaactggaactgttgcagttccaggttaccgcgagggacgcgggagtgccacctcttgggagtaatgttactctgcaagtctttgtactcgacgaaaatgataacgcccctgcactgttggctcctcgggctggaggaaccgggggagcagtgagcgagcttgtcccctggagcgtcggtgtcggccatgtcgtggctaaagttcgggctgttgacgcagattccggctataacgcatggttgagttatgagctgcagcccggtacaggcggagccagaataccttttagagtcggcctgtacaccggcgagatctccactaccagagccctggatgaaaccgacgcgcctagacacagactgcttgtgctcgtgaaggatcacggtgaaccagctctcaccgcgaccgccactgtgctggtttcactcgtcgaaagcggccaggcacccaaggccagctctcgagccctggtaggagccgtcggaccagacgctgccctggtcgacgtgaacgtgtatttgatcattgccatctgtgctgtgtccagtctgctagttttaacgttacttttgtatacggccctgagatgttccgcactgccaacagagggggcatgcgccccagggaagcctacactcgtgtgctcttcagctgtcgggagctggtcttacagtcaacaaaggcggcctcgggtctgttctggcgaggggccacctaagaccgatcttatggccttttcaccatcattaccggactctagggatagagaagaccaacttcagacaacagaagaaagtttcgctaaagtctcggtctag

SEQ ID NO: 53214 - DNA, 2706 bp, Artificial Sequence
  Description of Artificial Sequence: Synthetic coding sequence
atggagttctcctggggctcaggccaggaatcacgaaggttgttactgctgttgctgcttctggcggcatgggaggccggaaacggacagcttcattactctgtttctgaagaggccaagcatgggacttttgttggaaggatcgcacaggacttaggcctggaactagccgaactcgttcctcgtctgtttagggttgcgagtaaagggaggggcggacttctcgaagttaacctgcaaaatgggatcctcttcgtgaattcccgcatagatcgagaagagctgtgtagacgctcagccgagtgcagcattcatctcgaggtaatcgtagatagaccacttcaagtattccacgtggacgtggaggtgcgcgatatcaacgataatccccctgtctttcccgcaacacagaagaacttgtctattgcagagtcaaggcccctagactcccggttccctttagagggtgcgtccgacgccgatatcggcgagaacgctttgcttacctatcgtctctcccccaatgagtatttcagcttggagaaaccccctgacgacgagcttgtgaaaggtctgggcctgatcttaagaaaatctctcgatcgcgaggaggcacccgagatcttcctcgtgctgaccgcaactgacgggggaaaacccgaactcaccggcactgttcagctgcttataacggtcctcgacgcaaatgacaacgccccagcatttgaccgaaccatttacaaagtaaggctgttggagaatgtgcccaatggcaccttggtgatcaagctgaatgcatctgacctagatgagggtctgaatggagacattgtttatagttttagcaatgatatctctcccaatgtgaagagtaagttccatattgaccccatcacaggacagatcatagtaaaaggctatatagacttcgaggagtcaaagagctatgagatcatagtggagggtattgataagggccagcttccattgagcggccactgtagggttattgtagaggtggaggataacaacgacaatgtgccagacctagagtttaagtcattgagtctacctattcgggaagacgctcctttaggcaccgtgatcgctctcatctccgtgtctgacaaggatatgggcgtgaatggcctggtgacatgcagcctcacctcacatgtgcctttcaagttggttagcacttttaagaactattactcattggtcctcgacagtgctctcgaccgcgagagtgtgtccgcatacgagttggttgtgaccgctagagacggtggttccccaagcctctgggccacagcctctgtatcagttgaagtggctgatgtcaatgacaatgcgcctgccttcgcccagcctgagtacacggtctttgttaaggaaaacaatccccctggctgccatattttcaccgtatcggcttgggatgccgacgcccaagaaaacgctctcgtttcttatagtcttgtggagcgacgggtgggggagcgcgcactgagctcatatgtatccgttcacgctgagtccggtaaggtgtacgccttacagcctctggatcatgaagagctggaactgcttcagtttcaggtgacggccagggatgcaggagtcccgcctctggggagtaatgtgaccctgcaggtcttcgtcctcgacgagaacgacaatgctcctgccctgcttgcccctcgtgcgggaggcactggcggtgctgttagtgaactagttccatggtcggtgggagtgggacacgtcgtggccaaggtccgagcagtcgacgcggatagtggatataatgcttggcttagctacgaactgcaaccaggcactggcggagcaaggatcccctttagagtgggactgtacaccggagagattagtaccacaagagccttagatgagacagacgcacctcggcaccgactcttggtcctggtgaaggaccatggagaacccgctctcactgcaacagccaccgtccttgttagcctggtggaatccgggcaggctcccaaagcaagtagtagggctttagtgggcgctgtgggtccagatgcagccttagtggacgttaacgtatatctgattatcgccatttgtgcggtgtcttctctgttggtgctcacccttttactctataccgcactccgctgctctgcactcccgacagagggggcatgtgctcccggaaagccaaccctggtctgctccagcgccgttgggtcctggtcttatagtcaacagcgcaggcctagggtgtgtagcggggaagggccacccaaaacagatctaatggccttttccccgtctctgcccgactcccgcgatagggaagatcagcttcagacaaccgaggaaagttttgcgaaacccaggcaaccaaaccccgactggcgctacagcgcttcactccgcgcagggatgcactccagcgtacacttagaggaggctgggattctgagagcgggtcccggtggacccgatcagcaatggcctaccgtttcaagcgcgacaccagagccggaggccggagaggtgagtcccccagtgggcgcaggcgttaactccaactcctggacatttaaatatggccctgggaatccgaaacagagcggcccagagccaaagaagcaaacccaggtgagcttcctgcttaggcgaaagggtgaagcttctcagccccgtcaatag

SEQ ID NO: 53215 - DNA, 2844 bp, Artificial Sequence
  Description of Artificial Sequence: Synthetic coding sequence
atggaatttagctggggctccggtcaggagtccaggaggttactcctattgttgcttctcctggccgcttgggaagccggaaacgggcagcttcactattctgtctccgaggaagccaaacacggtaccttcgtggggcgaatcgcacaagacctgggcctggaactggccgagttagtgccacggcttttccgcgtggcatcgaaagggcgtggaggtctgctcgaagtaaatctgcaaaacggtattctatttgtgaactcacgcatcgatcgcgaagagctgtgtagacgatctgccgaatgcagtatacacctggaggtgatcgtggaccgtccactgcaggttttccacgtggatgtggaagtgcgcgatatcaatgacaatccacccgtttttccagccacccagaagaatctctccatcgctgaatcaaggcctctggactctcgctttcccctggagggggcatcagatgccgacattggggaaaacgcgcttctaacctacagactgtccccaaatgaatattttagcttggaaaagcctccagacgacgaattggtgaaaggtctggggctcattctgcgaaaaagcctcgaccgggaggaggcccctgaaattttcctggtcctgaccgcaacagacggagggaagccggaacttactggcacagtgcaactcttgatcaccgtcctggacgcaaatgacaacgcgccagctttcgatcgaacaatctataaagttaggttgctcgagaatgtgccaaacgggacgctcgtcatcaaactcaatgccagcgacttagatgagggcctgaatggggacatcgtgtactcattcagtaatgacatcagtcccaatgtgaaatccaagtttcatatcgatccaataacaggccagatcattgtgaaggggtatatcgactttgaagagagtaaaagctacgagataatcgtagaaggtattgataagggccagcttcccctttccgggcactgtcgcgtgattgtggaggtggaggataataacgataatgtgcccgatctggagttcaagtcgctgagcctccccatccgcgaggatgcacctcttggcactgtcatcgctctgatttctgtgtcagataaggacatgggggtgaatggccttgttacttgtagccttacttcacatgttcccttcaagttagtctcaacctttaagaattattattctctcgtgctggactctgcactggatagagagtcagtgtcagcatacgagctcgtggtcacagccagagatggtgggagcccttccctttgggcaaccgccagcgtcagcgtggaagtagccgatgtgaatgataatgcccctgcttttgcacagccagaatacaccgttttcgtaaaggaaaacaacccaccaggctgccatatcttcacagtgagtgcctgggacgccgacgcacaggaaaatgcgctggttagctactccctcgtggagcgcagggtgggggagcgcgcactgagttcctatgtcagtgtgcatgccgagagcgggaaggtgtacgctctccaacccctcgatcacgaggagctggagctgctgcagtttcaggtcacagcaagagacgcaggcgtgccacctcttgggagtaatgttacattacaggtcttcgtcctcgatgagaacgacaatgctccagcgctgcttgcccctcgtgctggtggaaccggaggggcagttagcgagctcgttccttggtctgtcggcgttgggcacgtggtcgcaaaagttcgggcagtggacgccgacagtggatacaatgcctggctcagctacgagctgcaacctggaacaggaggcgcaagaatccccttccgcgttgggctctacaccggggagataagcaccacaagagccttggatgaaaccgatgcgccacgtcatcgcttgctggtattagttaaagaccatggagaacctgccctcaccgccaccgccacagtgttggtttccttggtagagtccggacaggcccctaaggcttccagcagggccttggtgggggctgtcggtcccgatgccgcattagttgacgttaatgtgtacctaatcatcgccatttgcgccgtgtcaagcctgctggtgctgacgttgttgctctacacagcactgaggtgtagtgctttacccaccgagggagcgtgcgcgcctgggaaaccaactctggtgtgttcctctgctgtcgggagctggagttacagtcagcagcgtcggcctcgcgtctgttctggagaaggaccacctaaaacagatttgatggccttctcgccatctcttcccgatagcagggatcgggaggaccaactgcagactacagaggaatcgttcgccaagccaaggcagcctaaccccgattggaggtactccgcttcactcagggcagggatgcatagttctgttcatcttgaggaggctggaattctccgggctggccctggcggacctgaccaacagtggcctactgtatcttctgctacgcccgaacccgaagctggtgaggtctctcctcccgtgggtgccggagttaattcgaattcttggacatttaaatacggcccaggaaatccgaaacagtccggccctggcgaactacctgataagttcatcatccccggttctcctgccattatatccatcagacaggaaccgaccaacagccagatcgacaagtctgatttcatcacatttggcaaaaaggaagaaacaaagaagaagaaaaaaaagaaaaaaggcaataaaacccaagaaaaaaaggaaaaagggaactccaccacggacaactcggaccagtag

SEQ ID NO: 53216 - DNA, 2403 bp, Artificial Sequence
  Description of Artificial Sequence: Synthetic coding sequence
atggccgtgcgtgagctctgtttcccccgacagcggcaggttctgttcctgttcttgttttggggcgtctccctcgccggatctggattcgggcgttactccgtgacagaggagaccgagaagggtagtttcgtggttaacctcgccaaggaccttgggctcgcggagggtgaactggcagccaggggtacacgcgtggtcagcgacgacaacaaacagtacctgctcctcgactcccacacgggcaacctactcaccaacgagaaactggacagggagaagctctgtggccctaaggagccatgtatgttgtattttcagatactgatggacgatccctttcagatctaccgcgcagagctaagggttagggacatcaacgaccatgctcctgtgtttcaagataaagaaaccgtactcaaaatcagcgagaacactgcggagggaaccgctttccggcttgagcgagctcaggaccccgatggtgggttgaatgggattcaaaattacaccatttctcccaattcgttcttccatattaacatatcaggaggggatgaaggtatgatctatcccgagctagtactggacaaggcccttgatcgggaagagcagggtgaactgtctttgacattaacggcacttgacgggggtagccctagccgctccgggaccagtactgtgagaatcgtggtacttgatgtgaatgacaacgcaccacagtttgcccaagcgttatatgagacacaggccccagagaacagtcccattgggtttctgatcgtcaaggtctgggccgaagatgtcgatagtggtgtaaacgctgaggtaagctacagttttttcgacgcctcagagaatattcgcaccacttttcagatcaatccctttagcggggagatctttttacgggaattactggactatgagctcgtgaactcctataaaatcaacattcaggccatggatggaggcggactgagtgccaggtgcagggtgttagtagaggtgctggatacgaatgataaccccccagaactgatcgtgtcctcgttcagtaattctgtggccgagaactctccagagactccgctcgccgtgtttaagataaatgaccgcgactcaggtgagaacggcaagatggtctgttatattcaggagaatctcccgttcctattgaaaccttccgtggagaatttctatattctcatcactgagggagctctggatagggaaatccgcgcagagtataatatcactattaccgttacggacctgggtacccccaggttaaagacggagcacaatattaccgtgctggtcagtgacgtgaatgataatgcgcctgcttttactcagacttcgtacaccctgttcgtgcgtgaaaacaactcccccgcactgcacattggatcagtctcagctaccgatcgcgactccggcaccaacgcacaagtcacctattctttgttaccgccacaggatcctcatctccccctggcctccctcgtgagcattaacgccgataacggacacttgttcgccctgcggagcctagactacgaagcactgcaggcctttgagtttcgggtcggggctaccgacagaggtagccccgctttatctcgggaggcactggtgagagtattagtgctggacgctaatgacaactcccctttcgttctctatccactgcagaatggctccgccccttgtacagaactggtaccacgagccgcagaacctggctaccttgtgaccaaagtggtggccgtagacggagactcagggcagaacgcgtggctttcttaccagttactaaaagcgactgagccaggattgttcggagtctgggcccataatggcgaagtgcggaccgccaggctcctgtcggaaagagacgccgctaaacacaggctggtggtcctggtcaaagataacggcgaacccccacggagtgcaacagccactctgcatctcctgctagttgatggctttagtcagccgtacctgcccctcccagaggcggcaccagctcaagcacaggccgaagcagatctcctgacagtgtacctcgtggttgctttggcctcagtcagttctctcttcctattgagcgtgctgctgtttgtggctgtaaggctctgtcggagaagcagggccgcttccgtgggcaggtgctctgtgccagaggggccattcccgggacatttagtggacgtaagaggagcagagacgctgagccagtcttaccagtatgaagtctgcctcaccggcggacctggaacatccgagttcaagttcctcaaacctgtcatttctgatatccaggctcaagggcctggcaggaagggcgaagaaaatagcactttcagaaatagttttggctttaacattcagtag

SEQ ID NO: 53217 - DNA, 1764 bp, Artificial Sequence
  Description of Artificial Sequence: Synthetic coding sequence
atgatggaaaccccactcccaaaggctccagaaaaaaggcaggtcacggcaataatcttccttctgcttctgtgggaggctggatcagcaaccattaaatactctgtcctcgaggaacgagatagcgggtcttttgttgcaaatctggctaaggatcttgggctgggcgtcggagaactggccgctcggggagctcggatactcagcaaagggaacaagcagtatctgcagctcgagcgcaaaagtgggaacctcctcctcaaggaaaagttggatcgagaggaattgtgcggagatatagatccttgcatacttcacttccagatgctactcaagaacccagtgcagttcattcaaggcgagttgcagctccaggacgtaaatgaccacgcgcctgaatttctggaaaatgagattctactgaaaatctctgaaggttcccatccaggcacgtcttttcctctcaaaatcgcccaggatctcgatgtgggctccaacacagtgcaaaattactccatcagcaccaacagttattttcatctttttacgcggaatcactctgacggaaaaaagtatcccgagctggtgctggaccaggcactcgacagggaggaacagccgcaactaagactcacacttaccgctctcgatgggggtagtccgccaagaacaggtacctcacaagtgctgatcgtcattgtggacataaatgacaatgtgcctgagttcgcacagaggagatacgaggttcaagtgcctgagaacacccccatcggcagcttagtcatcacagtatccgcgagagatctcgacgcgggaactcatggagagctgagttatagtttttttcaatattcaaaccaaatcatccaagccttcgaaataaatagcatcacaggggagatacgttttaagaaggctctcgattttgaggagattcaatcttatcacatggaagtggaggccagcgatggcggtggcttgtctgggaagtgcaccgtagccatcgaagtaatggacatcaatgacaatgcccctgagttgaccatgtccctgctgatatctgacatcctcgaaaatagccccgagacagttgtggctgtattcgggatcagtgatcctgactcaggaaataacggtaaaatgatgtgcagtatccaagaccacctgccttttctgctcaagcctacacttgagaatttttatactctgctgaccgagggcgctctcgaccgggagtcaagggcagagtataatatcaccattacagtaacggatttgggcactcccaggttgaagacagaatacaatatcacgctgcgcgtcagcgatgttaatgataatgcgcctgccttcactcagacgtcctacacactgtttgtgcgtgagaataactcacctgcactgcacatcggatccgtttccgccacggaccgtgatagcggaaccaacgcacaggtaacttactcgctgcttcctccacaaaacccacacctcccactggcttccttagtctccattaacaccgacaatgggcatctctttgcccttcgcagtcttgactacgaagcactacaggaattcgaattccgcgttggcgcatccgacaggggcagcccggctttgtcctccgaggcccttgtgcgagtcctggtctgttggaccccaactacaacacgcccatcctgttgtacacgttgccgcaccgcccctcgaccggcaccgtcttggtgccctgggaggccttccagggctacgtggtag

SEQ ID NO: 53218 - DNA, 726 bp, Artificial Sequence
  Description of Artificial Sequence: Synthetic coding sequence
atggaggattacttgcagggctgcagggccgcacttcaagagcgcacgatcattctggactgtgtcaacatggacctgaagattgggaaggccaccccaaaagacagcaagtacgtcgagaagctggaagcactctttcctgacctaccaaaacgcaacgatatttttgattccctccagaaggcgaagttcgatgtgtccggactcacaacagaacagatgctccgcaaggaccagaagacgatttatcgacagggcgtgaaagtggcaatttcagctatttacatggatttagagatttgcgaagtgctggagcgatcccattcacctcccctaaagctcaccccagcatctagcactcatccaaacctccacgcctatctgcaggggaatacacaagtttcacggaaaaaactgttacctctcctccaggaagccctttctgcatactttgacagtatgaaaatcccctccggtcagccggaaactgccgatgtgagccgcgagcaggtggataaagagttggatagggcgtctaatagtctgatttcaggactgtctcaggacgaggaagatcccccactgcctcccacccctatgaactcacttgtcgacgagtgccctctggaccagggactgcctaagctgtcggccgaagctgtgttcgagaagtgttctcagatatctctgtcccagtccaccacagcatccttaagtaagaagtag

SEQ ID NO: 53219 - DNA, 1362 bp, Artificial Sequence
  Description of Artificial Sequence: Synthetic coding sequence
atggaggattacctgcagggatgtcgagccgctttgcaggaatcgaggccactccacgttgttctgggtaatgaagcctgcgacttggattctactgtctcagcattagccctcgcgttttacttggccaagacgactgaggccgaggaagtcttcgttcctgtgctgaacatcaaacgctccgagctacccctgaggggcgatattgtgtttttccttcaaaaggtacacatccctgagtctatcctgatttttagggacgagattgacttgcacgcactgtaccaggccggtcaactcaccctcatattagtcgatcatcacatcttgtctaagtctgacacagcccttgaggaggccgtcgctgaagtacttgaccacaggccaatcgagccaaaacactgtccaccttgccacgtaagcgtggaacttgtcggtagttgtgccacgctagtcaccgaaagaattctccagggtgcccctgaaattctggatcgccagactgcagcactgttgcacggaactatcattctggactgtgtgaatatggacctgaagatcggaaaggcaactcccaaggacagcaaatacgtggagaaactggaagccctgtttcccgatctccccaaacggaatgacatatttgattcactgcagaaggcgaaattcgacgtatctggccttaccacagaacagatgctccggaaggaccagaagaccatttaccgacagggggtgaaagtagcaatctccgcaatctatatggaccttgaggcattccttcagcgttcaaatctcttagctgatctgcatgccttttgccaggctcattcctacgacgtgctggttgccatgaccattttcttcaacacccacaacgagcccgttagacagctagctatcttttgcccccacgtcgccctccagacaaccatatgcgaggtgctcgagaggagccattccccccctctgaagctgaccccggctagctcgactcatccaaacctacatgcttatctgcagggaaatactcaggttagtcgaaagaagctgcttcctcttttgcaggaggccctgagtgcttatttcgactccatgaagatacccagcggtcaacccgagacggctgatgttagtagggagcaggtggacaaagaacttgaccgcgcaagcaactcgctcatctctggattgtctcaggatgaggaagatccacccttacctcctacccccatgaatagcctcgtggatgaatgtcccttggatcagggactgccgaagctgtctgctgaggctgtgttcgaaaagtgtagccagatctcgctaagtcagtcaacgacagcctcactcagcaagaaatag

SEQ ID NO: 53220 - DNA, 1161 bp, Artificial Sequence
  Description of Artificial Sequence: Synthetic coding sequence
atggaggactaccttcaaggatgtagagcagctttgcaagagagccgccctctgcatgtggtgctaggaaacgaggcctgcgacctggactcaaccgtgagcgctttagccctggctttttatctcgccaagcgctccgatactgccctggaggaggccgtggctgaggtgctggaccatcggcctattgaaccaaaacactgtcccccatgtcacgtgagcgtagagctcgtaggctcctgcgctaccctcgtaaccgagcggattctgcagggtgcgcctgagatcttggacagacaaaccgcagcactcctgcacggaactattattctggattgtgtaaatatggatttgaagattggcaaggcaacccccaaggacagcaagtatgtcgaaaagctggaagccctcttcccagaccttcccaagaggaacgatattttcgactccctccagaaagccaagttcgatgtgagcggtctaactaccgagcagatgctgcggaaagatcagaaaaccatatatcgccagggggtaaaagtcgcaatctctgcaatatatatggacctcgaagccttcctgcaacgatcaaatctccttgccgatctgcacgctttttgccaagctcatagctacgatgtgctggtggccatgacaatcttttttaatactcataacgagccagtccggcagctcgccatcttttgcccacacgtagctttgcagaccacaatctgcgaagtgttagagcgtagtcatagcccaccgctaaagctgactccggcatcttccacgcacccgaatctgcatgcctacctacagggcaacactcaggtgagcaggaaaaaactgttgcctctcctccaggaagcgttaagcgcttatttcgatagcatgaaaatcccttcgggacaacccgagaccgcagacgtgtctcgtgagcaagtggataaggagctcgaccgggctagcaatagcctgataagtggcctgtcccaagacgaggaggaccctcccctgcctccgactcctatgaactccctcgttgacgagtgccctctcgaccaggggctgcctaagttgtcagctgaagctgtgtttgagaagtgcagccaaatctccctttcccagtccactacagcatcattgtccaagaagtag

SEQ ID NO: 53221 - DNA, 657 bp, Artificial Sequence
  Description of Artificial Sequence: Synthetic coding sequence
atggaccttaagattggaaaggctacaccaaaggacagtaaatacgtggaaaagttagaggcgttgttcccagatttacctaagaggaatgacatttttgatagcctgcagaaagccaagttcgacgtgtccggcctgacaaccgagcaaatgctgaggaaggaccagaagactatctaccggcagggtgtaaaggtggcaatcagcgctatatacatggatctggaaatttgcgaagtgttggagcggtcccactccccacccctgaaactgactccagcatcatccactcatcctaacctccatgcttacttacagggaaatacccaagtttcacgaaaaaagttattgccgctgctccaggaggccctttccgcttacttcgattctatgaagattccttcagggcaaccagaaaccgcagatgtatctcgcgaacaagtggataaagaattagatagagcgagtaactcactgatcagtggactcagtcaagacgaggaggatcccccattaccaccaaccccaatgaactcactggtagacgaatgtcctttagatcagggcttacccaagttatcggccgaagccgtgttcgagaagtgcagccagataagcctaagtcagtcgactaccgccagcttatcaaaaaagtag

SEQ ID NO: 53222 - DNA, 507 bp, Artificial Sequence
  Description of Artificial Sequence: Synthetic coding sequence
atgctccggaaggatcaaaagacaatataccggcagggggtaaaagtggctatctcggctatttatatggacttggagatatgcgaggtcttagaacggtcccactcaccccctctcaaacttacccccgcaagttccacacatcctaatctccacgcttatctccagggcaacacgcaggtctcacgtaaaaagttgttacctctgctgcaggaggccctgtctgcttacttcgactccatgaagatcccttcaggccagcccgaaacagctgacgtgagtagggagcaagttgataaagaattagaccgcgcttcaaattcactgatctcaggcctatctcaggacgaggaagatcccccactccccccaactcctatgaattcactggttgacgagtgtcccctggaccagggcctacccaagttaagtgctgaagccgtctttgaaaaatgctctcagatcagtctgtcacagagcacaaccgcctccctgagcaagaaatag

SEQ ID NO: 53223 - DNA, 816 bp, Artificial Sequence
  Description of Artificial Sequence: Synthetic coding sequence
atggacctaaaaattggaaaagccacacctaaggacagtaaatatgtggaaaagctggaggcattgttcccggacttgccaaaaagaaatgatatcttcgacagcctgcagaaggccaagttcgacgtgagcgggttaacgacagaacagatgctgcgaaaggatcagaagacaatatatagacagggggttaaggttgccatttcagccatctacatggatttggaggccttcctgcagcgtagtaatctcctcgcagatttgcacgccttttgccaggcccatagttatgacgtactcgtcgccatgacgatcttttttaacactcacaatgagccagtccgtcaattggccattttctgtccgcacgtggcattgcagaccacaatttgcgaagtcctggagcgctcccactctcctccactgaagctgacccctgccagctctacgcatccaaacttacacgcctacttacaaggcaacacacaggtatcaagaaaaaaactgttgccgctcctccaagaggctctgagtgcctattttgattccatgaagatccctagcggacagcccgaaacagccgacgtttccagagaacaagtcgacaaagagctcgacagagcctctaattccctgatttccggccttagtcaggacgaggaggatcctccgctgccaccaaccccaatgaattctcttgtggacgaatgtcccttagaccagggcctgccaaaattatccgctgaggccgtgtttgaaaagtgtagtcaaatttctctaagtcagtctacaactgcttccctgtctaagaagtag

SEQ ID NO: 53224 - DNA, 657 bp, Artificial Sequence
  Description of Artificial Sequence: Synthetic coding sequence
atggatttgaagattggcaaggcaacccctaaggattctaaatacgtcgagaaactcgaggccctgttccccgacctgcctaagcggaacgacatttttgacagtctccaaaaagcgaagttcgatgtttctggccttactacggaacagatgcttagaaaggatcagaagacaatctatcggcagggcgttaaagtggccattagcgcaatttatatggatttggaaatatgtgaggtcttagaacgctctcattcccctcccttgaagttgactccggctagttccacacatcccaacctgcatgcctatttacagggtaatactcaggtttctagaaaaaagttgctgcccctcttgcaagaggccctgagtgcctatttcgactcgatgaaaatcccctcgggacaaccagagacagcggacgtgtcaagagagcaagtggacaaggagcttgatcgagcaagcaattctctgatctctggattgtcacaggatgaagaggatcccccactgcctcctactcctatgaactcattggtcgatgagtgcccactggaccaggggctgcccaaactctcagcagaggccgttttcgaaaaatgttcccaaatctctctttcccagtctacaacggcctcgctgagcaaaaaatag

SEQ ID NO: 53225 - DNA, 537 bp, Artificial Sequence
  Description of Artificial Sequence: Synthetic coding sequence
atggacctgaagatcggtaaggctaccccaaaggattccaagtatgtggaaaagcttgaagccctctttcctgatctgccgaaaagaaacgatatattcgactcactgcagaaagctaaatttgacgtgagcgggttgactacagagcagatgctaagaaaggaccagaagaccatctaccggcagggagtaaaggttgccatttcggccatatatatggacctggaaatatgtgaagtgcttgagagatcccatagtccccctttgaagttgacccctgcctcctcaacccatccaaacctgcatgcttacctgcaggggaatacacaggtctcccgcaaaaagctgttgccgctgcttcaggaggccttgagtgcctacttcgactccatgaagataccctcagggcagccggaaactgccgatgtcagccgagagcaggtggacaaagagctggaccgggcttctaacagtctcataagtggactgagtcaggatgaggaagatccgcctctgccacccactcccatgaactag

SEQ ID NO: 53226 - DNA, 423 bp, Artificial Sequence
  Description of Artificial Sequence: Synthetic coding sequence
atggatttgaagattggcaaggccacgcccaaagactctaagtatgtcgaaaaattggaagcgctcttccctgacctccctaaacgaaatgacatctttgattctcttcaaaaggccaagtttgatgtgtcaggcctgaccaccgagcagatgttgcggaaggatcagaaaactatttatcgacagggcgtaaaagtggcaatctcagctatatatatggatctggaagcattccttcagaggtccaacttgctcgccgaccttcacgcattctgtcaggcacactcttatgacgtccttgtcgctatgactatctttttcaacacccataacgaacccgtgcggcagctcgctattttctgcccgcatgtcgcccttcagactactatttgtgaagtgctggaaagatctcatagtccttag

SEQ ID NO: 53227 - DNA, 5241 bp, Artificial Sequence
  Description of Artificial Sequence: Synthetic coding sequence
atgagtgcctgtaacaccttcactgagcatgtgtggaagcccggtgagtgcaagaattgttttaagcctaaaagcctgcaccaattacctcctgatcccgaaaaagcccctattacccacgggaacgtcaagacaaacgccaaccactccaataatcacaggatccggaacaccggaaactttaggccacccgtagcaaaaaagcccacgatagctgtgaaaccaaccatgatcgtagcagacggtcagtccatttgcggcgagctatccattcaggaacactgtgagaataagccagtgatcattggttggaatagaaatcgggctgctctctctcaaaagcccttgaacaacaacaatgaagacgacgaaggcatctctcacgtccccaagccctacggaaacaacgatagcgcaaaaaagatgtcagataacaataacgggctgacagaggtgctgaaagaaattgccggactggatactgcacctcaaattagagggaacgagacaaattctcgcgagacctttctgggcagaatcaacgactgttataagcgctctcttgaacggaagttgcccccttcttgtatgattggcggaattaaggaaacacaagggaagcatgtgatactttctgggagcacagaagtaatcagcaatgagggaggcaggttctgctatcccgaattctcatccggggaggagtcagaggaggacgtgctgttttccaacatggaagaagaacatgagagctgggacgagagtgatgaggagttgttggccatggagataaggatgaggggacaacccaggtttgcaaactttcgcgctaataccctctcacctgtgagattcttcgtagataaaaaatggaataccatacccctgcggaacaaaagcctgcaacgtatctgtgcggttgattacgatgacagctacgatgaaatccttaacggctacgaggaaaatagcgtggtgagctatggacaggggagtatccaaagtatggtgtccagtgactcgactagccccgattcatcccttactgaggagagccgtagtgagaccgcctcatctctgagtcagaagatctgtaatggcggattatccccaggtaaccccggagactctaaggacatgaaggagatagaacccaattatgagtctccttctagtaacaaccaggataaagatagcagtcaggcctctaaatcttccatcaaagtccctgagacacacaaggctgtcctggctctgcggttggaagagaaagatggtaaaatcgccgtccagactgagaaagaggagtccaaggccagcaccgacgtcgccggacaggctgtaactatcaatttggtgccgacggaagaacaggcaaagccatatcgggtcgtgaatctggagcagccattgtgtaaaccttacacagtggttgatgtgtctgcggcaatggcttctgagcacctggagggaccagtgaactcgccaaagacgaaaagctccagtagcactccgaacagtcccgtaacatcctcaagtttgacgccaggccaaatatcggcacacttccaaaaatcaagtgctataagatatcaggaggtgtggacgtcctccacaagccccagacagaagattccaaaagtggagctcatcacctcaggcacaggccctaatgtgccaccaaggaagaactgccataaaagcgccccaacctctccaacggcgacaaacatttccagcaaaacgatccctgtcaagtctccaaatctaagcgagattaagtttaatagctataacaacgctggcatgccacccttccctatcattattcacgacgagccaacttatgcacgtagttctaaaaacgctatcaaagtgcccatagtcattaacccaaacgcatatgataatctcgctatctataagtctttccttgggacgagcggtgagctgtcggtgaaggagaagactacatcagtcattagtcatacttatgaggaaatcgaaacggaatctaaagtccctgacaatacaacttcaaagaccacagattgtctgcaaaccaaaggatttagcaactctacagagcacaagcgcggatccgtggcacagaaagtgcaagaatttaataattgtctgaaccgaggtcagtcaagcccccagcgaagctattcttctagtcatagctcccccgctaaaatacagcgggctacacaagagcccgtggccaaaatcgaagggacacaagaaagccagatggttggatcctcctctacacgcgagaaggcctccaccgtgctctctcaaattgtagccagcatccagccaccacagagccctcccgagacaccacagtccggccctaaagcctgtagtgtcgaggagttgtacgcaattcccccagacgcagacgtggccaaaagcaccccaaaatctaccccagtccgacctaagtccctttttacatcccagcctagtggtgaagcggaagcacctcaaacaactgatagtcccaccactaaggttcagaaggatcccagcatcaaaccggttaccccctctcccagcaaacttgtgacatcaccacaaagtgaaccacccgctccgttcccacctcctcggtcaacatcctctccctaccacgctgggaatctcctgcagagacacttcactaattggactaagcccacctctcccactcgcagtactgaagcggagagtgtgctgcattccgaggggtctagacgagcagcggatgctaagccaaagagatggatctcttttaagagcttcttccgcaggagaaaaacggatgaagaggacgacaaggagaaggagcgggagaaggggaaactcgtgggactggatggtacggtgatccacatgttaccaccgccaccggtacaaagacaccattggtttactgaagctaagggggagagcagtgagaagcccgcaatagtgttcatgtaccggtgcgatcccgctcaggggcaactgtctgtagaccagagtaaggccagaactgaccaggctgctgtaatggagaaagggagagccgaaaatgctctgcttcaggacagtgagaagaagcgatcccatagttctccgagccagatccccaagaaaattctctctcacatgacgcacgaggtgaccgaggacttcagccccagagatccacgcactgtggtggggaagcaggacgggagaggatgtacatcagttaccactgcattaagccttcctgagctcgagcgggaggacggcaaggaggacatctccgatcctatggatcccaacccctgctcagccacttactctaatttaggccaaagccgtgcagccatgattccaccgaagcaaccgcgtcaaccgaaaggcgcagtcgacgacgctatcgcatttgggggaaaaacagaccaggaagcccctaacgcttctcagcctacaccccctcccttacccaagaaaatgattatcagagctaataccgagccaatttcaaaagacctccagaagtcaatggaatctagtctgtgcgtgatggcgaatcccacctacgatattgacccgaattgggatgcatcaagcgcaggaagtagcatcagctacgaactcaagggactcgatatcgagtcttatgacagcctggaacggcctcttcggaaagagcgcccagtcccgtccgcagctaactccatcagctcgctgacaacactgtctataaaagaccgtttcagtaactccatggaatcgctgagctcccggagaggaccatcatgccgtcagggccgaggaattcaaaaaccgcagcgtcaagccctttatagaggtcttgagaaccgagaagaggtcgtgggtaaaattagaagtctgcacacagacgccctgaagaagttagccgtgaaatgtgaagatttatttatggctggccagaaggaccagctacgcttcggcgttgacagttggagcgacttcagacttaccagcgataagccttgctgtgaggcgggagatgcagtgtattatacagcttcatacgccaaagaccccctgaacaactatgccgtcaagatatgcaagagtaaagccaaagagagccaacaatattatcattccctcgcggtgagacagagtcttgccgtgcactttaacatccagcaggattgtggccattttctggcggaagtgcctaatcgcttgttaccctgggaagatcccgacgatcctgaaaaagatgaagatgatatggaggagactgaggaagacgccaagggcgaaaccgacgggaagaatcctaaaccctgcagcgaggccgcttcgtcccaaaaggagaatcagggcgtcatgtcaaagaaacagcgcagccacgtggtggttataacaagggaggtcccatgcctgaccgttgctgatttcgtccgtgattccctggcacaacatggcaagtccccggacttatatgagaggcaggtctgcctgctcctgctgcagctgtgctcaggcctggaacatctaaagccttaccacgtcactcactgtgacctgaggctggagaaccttttattggtccattaccagcctggcggtactgcgcagggcttcggcccagcggagccatcacccacctcaagttacccaactagattgattgtgagtaatttctctcaggccaagcagaagagccacctagtcgaccctgagatactccgggaccagtcgcgcctggctcccgagatcattacagcaacacagtacaagaagtgtgatgagtttcagactgggattctgatctatgaaatgcttcatctgcctaatccttttgacgagaatcctgagctcaaggaacgggaatacactcgcgctgatctgcccagaatcccttttagaagtccctattcccggggtcttcagcagctggcatcatgtctgctgaaccctaaccctagcgagcgcatcttgatttctgacgccaagggcatcctgcagtgtctgttatggggccctcgtgaagacctgttccagacctttacggcgtgtcccagtttagtgcagcgaaatacactcctccagaattggctggacatcaagagaacacttttgatgattaagtttgccgaaaaatccctagacagagagggaggaatttccctcgaagattggctttgtgctcagtatttggccttcgcaacgaccgatagcctatcctgcatcgtgaaaatccttcagcatagatag

SEQ ID NO: 53228 - DNA, 5240 bp, Artificial Sequence
  Description of Artificial Sequence: Synthetic coding sequence
atgagcgcttgtaacacctttaccgagcatgtgtggaagcctggcgaatgtaaaaattgcttcaagcccaagtcactacaccagctccctccagatccagagaaagccccaattacacacggaaacgttaagaccaacgctaatcatagtaataatcatcgaataagaaataccggcaacttccggcctcctgtggcaaaaaaacctaccatcgccgttaaacctacaatgatcgtagctgacgggcagagcatatgcggcgagctgtcaattcaagaacactgtgaaaataagcctgtgattatcggatggaatcggaacagagccgctctcagtcagaaaccgcttaataataataacgaggatgatgagggaatctcgcatgtgccaaaaccctacggcaacaacgattcagctaagaagatgtctgacaacaataatgggcttaccgaggtcctcaaggaaatagcgggacttgacacagctcctcaaatccgagggaatgaaacaaatagcagagaaacttttctgggacgaatcaacgactgctacaaacgctccctggaacgcaagctgcctccaagctgcatgatagggggaattaaggaaacacagggtaagcacgttatattatcaggctcaacagaagtgatctcaaacgaaggcggacgcttttgctacccggaattttcaagtggtgaagaaagtgaagaggacgtgctcttcagcaacatggaggaagaacatgagagttgggatgaaagcgatgaggagctcttggcaatggagatacggatgcggggacaacccagattcgctaactttcgggcaaacactcttagccctgtgagattcttcgttgacaagaaatggaacactatccctctgagaaacaagtccctacagcgcatttgtgctgtcgattatgacgatagctatgacgaaatccttaacggatatgaagagaactcagttgtgtcctacggccagggctccattcagtccatggtatcaagtgacagtacttctccggattcatcactgaccgaggaatctagaagtgagacagcctcctcacttagtcagaagatctgtaatggtggactgtcccccggaaatcccggtgactccaaggacatgaaagaaatcgaacctaattatgagtcacccagctccaacaaccaggacaaggatagcagccaagcttccaagagtagtatcaaggtgcctgagactcacaaggcagtcctcgccctcaggttggaggaaaaggatggtaaaattgctgttcagactgaaaaggaagagtctaaagcaagtaccgacgtggccggtcaggccgtgactattaatctggtacccaccgaggaacaagccaagccctatcgtgtggtgaacttagagcagccgctctgcaagccctataccgtggttgacgttagcgcagccatggccagtgagcatcttgaagggccagttaactccccgaaaaccaagagtagtagcagtactccgaacagcccggtgacaagctcatccctgacaccgggacagatctccgcacatttccagaagtcttcggccattagatatcaggaagtatggaccagctcaacttccccacgccagaaaatacctaaagtcgagctgataacttccgggacagggccaaacgtccctccacgaaagaactgtcataagtcggcacctacaagtcccaccgccaccaatatcagttctaagaccattccggtgaagtctcctaaccttagtgaaatcaagttcaattcctacaataacgctggcatgccgccattccctattataattcacgacgaaccaacctacgctaggagctccaagaacgccataaaagtacctattgttattaacccaaacgcctacgataacctggctatctacaagagttttttgggaacatccggagagttatccgtaaaggagaagaccacttccgtcatttctcatacgtacgaagaaatcgagaccgaaagcaaggttccagataacacaacatctaagaccacagattgcctccaaactaaagggttttctaacagcactgagcataagcggggtagcgtggctcagaaggtgcaggaatttaacaattgtctgaaccgcggacaaagcagcccacagagaagctatagtagcagccattcctctccagctaaaatccagagggccacacaggagccggtggctaaaatcgaaggaactcaagagtcacaaatggttgggtcatccagtacccgagagaaggcgagtaccgtgctatctcagattgtcgcaagtatccagcccccacagtccccacctgagacaccccaaagtggacccaaggcctgctccgtcgaagagctctatgcaatcccccctgacgccgacgtggccaagtcgacacctaagagtaccccagtcaggccaaagtcgcttttcacatctcagcctagtggtgaagcagaagcaccgcagaccaccgattcccctaccaccaaagtgcaaaaagacccttcgatcaagcctgtgacaccctcaccctcaaaactggtaacctctccacaatcagagccacccgctccgtttcctccaccaagatcaacctcatccccttatcacgctggaaacttgctccagaggcattttacgaactggacaaaacccacatcccccacaaggagcactgaagctgagtccgttctccacagtgagggcagtaggcgggcagccgacgccaagcctaaaaggtggatttctttcaagtcgttcttccggcgtaggaaaactgatgaggaagacgacaaggaaaaggagcgagagaagggcaagttggtgggactcgatgggaccgtgatccacatgctgccgccacccccagtgcaaaggcaccactggttcaccgaggccaagggagagtcctcagagaaacccgctatagtcttcatgtaccgctgtgaccctgctcaggggcagttgagcgtcgaccagagcaaggccaggacggatcaagctgctgtgatggagaaagggagggctgagaacgcactcctgcaggattccgagaagaaacgaagtcattccagcccgtcccagatccccaagaagatactgagtcacatgactcatgaggtgactgaggatttttctccgcgagatccaaggacagtcgttgggaaacaggacggcaggggctgcactagtgtcacaacggccttgtccttacccgagcttgagagggaggatggaaaggaagacatctcagaccccatggatcctaacccatgtagcgcaacctattcaaacctcggtcagagcagagcagcgatgatccctccaaaacaacctcgccaaccgaaaggggcagtggatgatgccattgcttttggcggaaaaaccgaccaggaggcccctaacgcctctcagcctactccccctcctctcccaaaaaagatgatcatccgcgctaatactgaacccatttccaaagatctacagaaaagcatggagagtagcctgtgcgtgatggccaaccccacgtatgacattgaccccaactgggacgcctcttccgccggatcaagcatcagttacgagcttaaggggctggatatagagtcatacgacagcctcgagcgtccgctcaggaaagaacgtcctgtgccctccgcggctaattccatcagctctctgacaacactcagtataaaggaccgcttcagcaactcaatggagtcactgtcatcgaggcgtgggccaagctgtcggcaggggagaggaatccagaagccacaaagacaggcattgtatcgtggtcttgaaaatagagaagaggtcgtaggaaagatccgcagcttacacactgatgctctaaagaagctcgcagtcaaatgtgaggacttgttcatggccggtcagaaagaccaactgaggtttggcgtcgatagctggtcagatttccggctgacatcggacaaaccatgctgtgaggccggagatgccgtctattacaccgcctcatatgcgaaggaccccctgaacaactatgcggttaaaatatgtaagagtaaagcgaaagaaagccagcaatactaccattcattggcagtacggcagtccttagctgtccattttaacattcaacaggactgtggtcatttcttagcggaggtcccaaacagattgttgccgtgggaggacccagacgaccccgagaaagacgaggatgatatggaagaaacagaggaggacgctaaaggagagactgatggaaagaaccccaagccttgtagtgaagccgcttcctctcagaaggaaaaccagggagtgatgtctaaaaagcagcgatcccacgttgttgttatcaccagggaagtgccttgtctgacagtcgccgacttcgtccgagattctctggcccagcacggcaaatcacccgatttgtatgaacgacaggtttgcctgctactgctgcaattgtgttctggactggaacatctgaagccctaccatgttactcactgtgaccttaggctcgagaacctactgctggttcactatcagcctgggggaaccgcccaggggtttggaccagccgaaccgtcccccacgtcttcatatcctacccggttgattgtgtccaatttctcacaggctaaacagaaatctcatcttgtggatccggaaattctgcgggatcagtcccgcttagcacccgagatcatcactgcaacacagtacaaaaaatgtgatgaatttcaaacaggcatacttatctacgagatgttgcatctgcctaatccctttgatgaaaatcctgaactgaaagaaagggaatatacacgagctgatctgcctaggatacctttcagatcaccatacagtcgcggattgcagcaacttgcatcctgtctgctgaacccaaatccttcagagcggatcctcatcagcgatgccaagggcatccttcagtgtctgctctggggtcctcgcgaggacctgtttcagacatttacagcatgcccatccctcgtacagcgcaatacactgctgcagaactggttggacattaaacgtacgctcctgatgataaagttcgcagaaaagagcctggacagagaggggggtattagcttggaggattggctttgtgcgcagtacctggcattcgctactacagattcgttatcttgcatcgtgaaaatacttcaacataggta

SEQ ID NO: 53229 - DNA, 3402 bp, Artificial Sequence
  Description of Artificial Sequence: Synthetic coding sequence
atggacgttctggccgaggaatttggtaatctgacacccgagcagttggctgcccctattccaaccgtggaggaaaaatggaggctcctacccgcttttcttaaagtcaaaggactcgtcaagcaacacattgacagtttcaattatttcataaacgtggaaatcaagaaaatcatgaaggctaacgaaaaggttacaagcgatgccgatcccatgtggtatttaaaatacctgaacatttatgtcggtttgccagacgtggaagagtcattcaacgtaacccggcctgtatcgcctcacgaatgcagactgcgggacatgacttactcagcccctatcacggtggacattgaatacaccagggggagccagcgcattatcaggaacgcgcttcccataggtagaatgccgataatgttgaggagctcaaattgcgttttgacagggaagactccagccgaatttgctaaactgaacgagtgccccctggatcccggtgggtacttcatagttaagggagttgagaaagtcatcttaatccaggaacagctgtccaagaaccgcatcatcgtggaagctgatcgaaagggcgcagtgggagcgtctgtaacaagttcaactcatgagaagaagtctcggacaaatatggcagtgaagcagggcaggttctatctccgtcacaatactctgagcgaagacatccccatcgtgattatcttcaaagctatgggagtggaatctgaccaggagattgtgcagatgattggaactgaagagcacgtgatggccgcattcggtccctctctcgaggagtgtcagaaagcacagatcttcacccagatgcaggccttaaagtacatcggcaacaaggtacggagacagaggatgtgggggggaggcccaaaaaaaacaaaaattgaagaagcaagagagcttcttgcatctacgatactgacccacgtaccggtgaaagagttcaatttcagggccaaatgcatctatactgccgtgatggtgcgcagggttatcctcgcccagggcgacaataaagtggacgacagggactattatggcaacaagaggctggagctcgccggacagttattgtctctgctgtttgaggacctgttcaaaaaattcaattccgagatgaagaagattgctgaccaggtgatacccaaacagcgcgcagcgcagttcgacgtagtgaagcatatgcgtcaggatcagattactaacggcatggttaatgcaatctcaactgggaactggtctttgaaacggttcaagatggatcgccaaggcgtcacacaggtgctttcacgcctcagctatatcagcgctcttggcatgatgacccgcattagctcccagtttgagaaaacacggaaggtctccggtccaagatctctgcaaccctcacagtggggaatgctgtgtccctcagacacccctgagggggaagcgtgcgggctggtaaaaaacctggcgctgatgacccacattaccacagatatggaggacggacctatagtgaagcttgctagcaatctgggcgtggaggatgttaaccttctgtgtggggaggaactctcgtaccccaacgtgttcctggtgtttctgaatggcaacattctgggcgttatcagagaccacaagaagctcgtgaacacttttaggctcatgcgtagggctggatacatcaacgaattcgtctctatatcaacgaacctgacggacagatgcgtctacattagctctgatggcggacgcctgtgcaggccttacattattgtgaagaagcagaagccagcggttaccaataaacacatggaggagctcgctcagggctatcggaacttcgaagattttctccacgaaagcctggtggaatacttggacgtgaacgaagaaaatgactgcaacatcgctctgtacgaacacaccatcaacaaggatactacgcacctggagatcgaaccttttacattgctgggcgtgtgcgcaggtcttataccttacccccatcataatcagtcaccacggaacacttaccagtgtgcaatgggcaagcaagctatggggaccattggttacaaccagcgaaatagaatcgacactctcatgtacctgctcgcctacccacagaaacccatggttaaaacaaagacaatagaactgattgagtttgagaagttacctgcaggccaaaatgccactgtcgcggttatgagttattctgggtatgacatcgaagacgccctagttttgaacaaagcaagccttgatcgcggattcggcagatgcctcgtgtacaaaaacgccaaatgtacactcaagcgttataccaaccagacttttgataaagtcatggggccaatgctcgatgccgcaacacgcaagccaatctggagacacgagattctggacgcagatggcatatgttctcccggagagaaagttgaaaacaaacaggtgctcgtaaacaaatcaatgccaactgtcacacaaatccccctggaaggctcaaacgttcctcagcagcctcagtacaaagacgtccccatcacttataaaggtgctactgactcttacattgagaaagtgatgatcagcagcaacgccgaggacgcgttcctcattaaaatgttactgagacaaacgcgacgcccagaaattggtgacaagttttcatccagacacggacagaaaggcgtctgcggcctgatcgtcccgcaggaggacatgccattttgcgacagcgggatctgccctgacataattatgaacccgcacggcttcccgagcaggatgactgttggcaaactgatcgaactgttggccggtaaggcaggggtattggacgggaggttccattatggaaccgcctttggtggatctaaggttaaagacgtgtgcgaagatcttgtgcggcacgggtacaattacctaggcaaggactacgtcacatccggaatcactggggagcccctcgaagcttacatctatttcgggccagtgtactatcagaagctcaagcacatggtgttggacaagatgcacgctagggccaggggtccaagagctgtgctcacacgccaacccacagagggaaggtcccgagatggtggactgaggttaggcgaaatggaaagagattgcctgatcgggtacggggctagcatgctgctgctcgagaggttaatgatctcctctgacgcctttgaggtggacgtttgcgggcagtgtggcctgctcggctactcgggctggtgtcactactgcaaaagtagttgtcacgtttcttccttaagaattccatacgcttgtaagctactcttccaggaactacaatcgatgaacataatccccaggcttaaacttagcaagtataatgagtag

SEQ ID NO: 53230 - DNA, 3036 bp, Artificial Sequence
  Description of Artificial Sequence: Synthetic coding sequence
atgatgagtgacgcgtccgacatgcttgccgctgccttggagcagatggacggcataatcgcaggaagtaaggctctggaatactccaatggtattttcgactgtcaatcgccgacttcgccatttatgggtagccttcgagcattgcacctggtggaagatctgcgtggcctgctggagatgatggagaccgatgagaaggaagggctgcgatgtcaaattccagacagtacagctgaaacactggttgaatggcttcaaagtcagatgaccaatggacacttacctgggaacggggatgtgtaccaggagcgtctggcacgcctggaaaatgataaggaaagtctagtgcttcaggtctccgtcttgaccgatcaggtcgaggcccagggggagaagatcagggatctggagttctgcttagaggaacatagggaaaaggttaatgccaccgaggaaatgctgcagcaagagttgctgagtagaacctctttagagactcaaaaactggatctgatggccgaaatcagtaacctgaagctgaaactcactgcggtggagaaagatagattggattacgaagataagttccgagacacagaagggttaatccaggagatcaacgatctacgtttgaaggtgagcgagatggacagtgagcgtttgcagtatgagaagaagttgaaaagcacgaaatccctgatggctaagctgtccagcatgaagattaaggtgggccagatgcagtatgagaaacagagaatggagcagaaatgggaaagtctgaaggacgagctcgcatcgctcaaagagcaacttgaagaaaaagaatctgaggtaaaaaggcttcaggagaagttggtttgtaagatgaagggcgagggagtggagatcgtcgatagagatattgaagtgcagaaaatgaagaaggctgtagagtcgctgatggccgcaaacgaggagaaagatcgcaagatcgaagacttacgccagtgtctgaacaggtacaagaaaatgcaagatactgtggtgctcgcacaggggaaggatggagagtatgaggaactcctgaatagcagcagcatctcttcactactggatgcccaaggtttcagcgacctggaaaagagcccgagccccacaccagtgatggggtccccatcttgtgacccattcaatacgtctgttccggaagaattccacacaactattcttcaagtgagcatcccgagcttactgcccgctacggtgtctatggagacgtcagaaaaaagcaaactgacgcccaagcctgagacttcttttgaagagaatgacggcaacattatattaggcgcaaccgtggacacccagctgtgtgataaacttcttacttcctccctccagaaaagctcatccctcggcaatttgaaaaaagagacaagtgatggagagaaggaaacaatccagaaaacctcagaagaccgcgctcccgctgaatcaagaccattcggtaccctgccaccaagaccccctggtcaggacacctcaatggatgacaacccttttggtacgcggaaggtaaggtctagctttgggaggggcttctttaagatcaaaagcaacaagcgcaccgcaagtgccccaaacttagctgaaacagagaaggaaaccgctgagcacttagatctcgcaggagcttctagccgtcccaaagattcccagcgcaactctcctttccaaattcctcctccgtctcctgacagcaaaaaaaagagtcggggtattatgaagctgtttgggaagctgagacgctctcaaagcacaacatttaatccggatgacatgtccgagcccgagttcaagaggggtggaacacgagccactgctggccctcgcctcggctggtccagggatttggggcaatccaactccgaccttgacatgccatttgctaaatggacgaaagagcaagtctgtaactggctcatggaacagggcctggggagctaccttaactccggtaagcactggatcgccagcggtcagaccctgctgcaggctagccagcaagacctggaaaaagagctcggaatcaaacactctttacaccggaagaagctgcagctggccctgcaggccctgggcagcgaggaagagacaaaccatgggaaattggactttaactgggtcacgcggtggctcgacgacataggattacctcagtacaagacacagtttgatgagggccgtgtggatgggagaatgcttcattatatgacggtggacgatttactgtcactgaaggtagttagcgtgctgcatcacctgtctataaagagagctatacaggtgctgcggattaataacttcgaacccaactgtctgcgacggaggcccagcgacgagaatacaatcgccccttcagaagttcagaagtggacaaaccaccgtgtgatggagtggctaaggagcgtcgatctggccgaatatgcccctaatctgcgtgggtccggcgttcacggaggcctgatggtccttgagcctaggttcaatgtcgagacgatggcccagcttctgaatatcccccctaataaaacactcctgcgcaggcatcttgccacccattttaacctgctgatcggggctgaggcgcaacaccagaaaagggatgccatggaacttcccgattacgtgttgctgaccgccacagcgaaagttaagcctaagaaattagcttttagcaacttcggcaatctacggaagaaaaaacaagaggatggagaggagtatgtgtgtccaatggagctcggtcaagcaagtggatccgcctcgaagaagggctttaaacccggtctcgacatgcgactctacgaggaggatgatttggacaggctcgagcaaatggaggattccgaagggacagtgcgacaaatcggcgcattctcggaggggattaataatctgacgcacatgcttaaggaggacgatatgtttaaagacttcgcagccaggagccccagtgctagcatcaccgatgaggactccaacgtctag

SEQ ID NO: 53231 - DNA, 513 bp, Artificial Sequence
  Description of Artificial Sequence: Synthetic coding sequence
atgatgagtgatgccagtgacatgctcgccgctgcactggagcagatggatgggattatcgcgggatccaaggcactagagtatagcaacggaatctttgactgtcagtcacccacatcaccattcatgggcagcctaagagcattgcacctggtcgaggatctccgtggactcctcgaaatgatggagaccgatgagaaggagggcctgagatgccaaatacccgacagcaccgcagagactcttgtggagtggttgcagagccagatgaccaacgggcacctgccagggaatggagatgtctatcaggaaagactggcgcgtcttgaaaatgacaaggagtccctggtgctgcaggtcagcgttctcacggaccaagtggaagctcagggcgaaaagatcagggacttggagttctgtctcgaggagcaccgcgagaaggtgaatgctacagaggagatgctgcaacaagtgtgcgctgaagctcggacaaagatggggttcccatgttag

SEQ ID NO: 53232 - DNA, 261 bp, Artificial Sequence
  Description of Artificial Sequence: Synthetic coding sequence
atgatgtcggacgcctccgatatgctcgccgctgcactggagcagatggatggtataatcgccggatcaaaggccctagaatactccaatggcattttcgattgccaatcccccacaagccccttcatgggatcgctcagagcacttcatttggtggaagacctgcgcggactgctggagatgatggagacagatgagaaagagggcttgaggtgccagattccagattccactgccgaaacactcgtggaatggttgtag

SEQ ID NO: 53233 - DNA, 2577 bp, Artificial Sequence
  Description of Artificial Sequence: Synthetic coding sequence
atgttgcaacaggagcttctgagcaggacgagcctggaaacccagaagttggatctgatggcggaaatttcgaatctaaagcttaagctgactgctgtggaaaaggataggctggactatgaagacaagttccgcgatacagagggacttattcaggaaatcaacgacctccggttaaaagtgtctgagatggactctgaaagactgcagtatgagaaaaagcttaaatccacgaaaagtttaatggcaaagctctctagcatgaaaatcaaagtagggcagatgcagtacgaaaagcagcgcatggaacagaagtgggaaagcctcaaggatgagctggcgtctctgaaggagcaactcgaagagaaggagagtgaggtaaagagactgcaggaaaagcttgtatgcaaaatgaagggcgagggagtcgagatagtggatagagacatcgaggtgcaaaagatgaagaaagctgtggaatctctgatggctgccaacgaagaaaaagaccgaaagatagaggatctgcgccagtgtcttaatcgatacaagaagatgcaggatacagttgtgctggcacaaggaaaggatggcgaatacgaagaactactgaacagcagctccatcagttctctgcttgacgcccaggggtttagcgatcttgaaaagtcaccctcgccgacccccgtgatgggtagccctagttgcgacccgtttaacacaagtgtgccagaagaatttcatactaccatcctgcaggtgagcattccgtctcttctgccagcaacagtgtctatggaaacctcggagaaatccaagctcacacccaaaccggaaaccagcttcgaggagaatgatggaaacatcattcttggcgctaccgtagacacccaactgtgcgataagctattaacatctagcttacagaaatcgagctccctgggaaatctgaagaaagagactagcgacggggagaaagaaacgatacagaaaaccagcgaggacagagcaccagccgagagcaggccttttggcactctgccacctaggccaccaggccaggacacatcaatggacgacaatcctttcgggacacgtaaagtccggagcagttttggacggggattttttaaaataaagagcaacaaacggacagctagtgccccaaaccttgccgaaacggagaaagaaacagcagagcatctggacctcgcgggtgcaagtagtcgcccaaaggacagtcagagaaattctccttttcagatcccaccacctagcccggactcaaagaaaaagtctcggggtatcatgaagctgtttggaaaattgaggaggagtcaatcaaccacgttcaacccggatgacatgtccgagcccgaattcaaaagaggtggcacaagagccaccgccggacccaggcttggctggtctcgggatcttgggcaatcgaactcggatcttgatatgcctttcgctaagtggacaaaggagcaggtttgcaactggctgatggaacagggcctgggaagttatctcaattctggcaaacattggatagcatccggacaaacgctgctccaagcctcccaacaggatttagaaaaggaactcggcatcaaacactcactgcatcgcaaaaagcttcaactcgcactgcaagccctaggtagtgaggaggagaccaaccacggaaagctggactttaattgggtcactaggtggctcgacgatattggactgcctcagtacaagactcagttcgatgaaggccgagttgacgggcgaatgctccattacatgacagtcgatgacctgctgagtctcaaggtcgtatcagtgctgcaccacctctcaatcaagcgagcaattcaggtgcttaggatcaataacttcgaacccaactgcctgagacggaggccatccgatgaaaatactatagcccctagcgaagttcaaaagtggactaatcatcgcgtcatggagtggctgcgctctgtcgatctcgctgagtacgcacctaacttgcgaggttcaggagtgcacggcggactcatggtactggaacccaggtttaacgtcgagacaatggctcagcttctcaacatcccccctaacaaaacactgctgagaagacatcttgcaacccactttaatctgttgatcggggctgaggctcagcatcagaagcgagacgcaatggaacttccggactacgtcctgctcactgccacggctaaagtcaagcctaagaagctggcgttcagcaattttggcaatctcaggaagaagaaacaggaagacggtgaggaatatgtttgccccatggagttaggccaggcctcaggctccgctagcaagaaaggcttcaaacctggcctggatatgagattgtacgaagaagatgatctcgatcgcctagaacaaatggaggacagtgaagggacagtgcgacagataggtgccttctctgaaggcataaacaatttgactcatatgttgaaagaggatgatatgttcaaggactttgcagccaggtctccttcagcatctatcaccgacgaggattccaacgtttag

SEQ ID NO: 53234 - DNA, 57 bp, Artificial Sequence
  Description of Artificial Sequence: Synthetic coding sequence
atgctacagcaggagctactatctaggacatcactcgaaacacagaagctagattag

SEQ ID NO: 53235 - DNA, 2943 bp, Artificial Sequence
  Description of Artificial Sequence: Synthetic coding sequence
atgatgtccgacgccagcgacatgctggctgccgcactcgaacagatggatgggattatcgcaggcagtaaagccctggagtattcaaacggaatctttgactgccaatctccaacctcacccttcatggggagtctaagagccctgcatcttgttgaagatctccggggtctgttggagatgatggaaaccgacgagaaagagggccttaggtgtcagatccccgacagcactgccgagactctagtcgagtggctacagagccagatgaccaatggccatttgccaggaaatggcgacgtctaccaggagagactggctcgcttggagaatgacaaagagtccctggtgcttcaggtgagcgtcctgacagaccaagttgaggcacagggcgaaaaaatcagggacctggagttctgcctggaggagcatagggaaaaagtcaatgctactgaagagatgctgcaacaggagttgcttagcagaacaagcctggagacccagaagttggacctcatggctgaaatatccaacctgaagcttaaacttaccgccgttgaaaaagaccgactggattacgaagataaatttcgagatactgagggccttatccaggaaatcaatgacctgcggctgaaagtttctgagatggattcagaacgcctccaatatgagaagaagctgaagagcacaaaggacgagttagcctctctcaaggagcagctggaagagaaggagagtgaggtcaaacggctgcaggaaaagctggtatgcaagatgaaaggtgagggagtggaaattgttgacagagacatcgaggttcaaaagatgaaaaaggcagttgagtccttaatggcggcaaacgaggaaaaggaccgcaagatagaagacctacgccagtgtcttaaccgctacaagaaaatgcaggatactgttgttcttgctcagggaaaggatggcgagtatgaagagctgctgaattcctcttctatatctagtcttcttgacgcccaaggattttcagacttagagaagagtccatccccaaccccggtgatgggtagtccgtcgtgcgacccctttaatacttccgttcctgaggaattccatacgacgatccttcaggtctctataccttcccttttacctgcaaccgtctctatggagacgagcgagaagagcaaactgactcccaaacctgaaacctcattcgaggaaaacgacggcaacatcattttgggtgcaactgtcgatacccagttgtgtgataagcttctaacaagttctctacagaaatcatctagcctgggaaatctcaagaaagagactagcgatggtgagaaagaaacaattcagaagacttctgaagacagagcgccagctgaaagtcggccattcggaacattgccgccacgaccacctggccaggatacttccatggatgataacccatttggcaccagaaaagtccgatcatcattcggcaggggattcttcaaaattaagagcaataaacgcacagcgtccgcacccaatctcgccgagaccgaaaaggagaccgccgaacatttggaccttgccggtgcgagttccagaccaaaggatagccagaggaattccccttttcagattcccccaccgtcacccgattctaagaaaaagagtagaggcattatgaaactcttcggcaagctccggagaagccagagcacaacatttaatccagatgacatgtccgagcctgagttcaagagagggggaactcgtgccacagctggacctagattgggttggtctcgcgatttaggccagtccaacagcgatctcgacatgcccttcgccaagtggacaaaagaacaagtctgcaattggctcatggagcagggcttggggtcatatcttaacagtggtaagcactggatcgcttccgggcagaccctcctgcaggccagccagcaggatctggaaaaggaacttgggatcaagcacagccttcaccgcaaaaaactgcaactagccctgcaggctctcgggtctgaagaggaaacgaatcacggaaagttagatttcaactgggtgactcgctggttagacgatatcgggttaccccagtacaagactcagttcgatgagggcagagtcgacggaaggatgctccattatatgacagtggatgacctgctttctctcaaggttgtgtcagttctgcaccatcttagcataaagagagctatccaggtccttcggattaacaactttgagcccaactgcttgagacgcagacctagtgacgaaaatacaattgcacctagcgaggttcaaaaatggaccaatcaccgagtgatggagtggcttcgttccgtggatctggctgaatacgctcccaacctccgcggaagcggtgtccatggaggcctgatggtgctggaaccaagattcaacgtagagaccatggcacaacttctcaatataccaccgaacaaaaccctgttgaggcgtcacctggctacccatttcaacctgctaattggggctgaggcccagcaccaaaaaagggatgcaatggagcttcctgattacgtactcctcacagcaactgccaaagtaaagcccaagaaactggctttttcaaactttgggaacctccgcaagaaaaagcaggaggacggggaagagtacgtctgtcccatggagctgggtcaggctagcggatccgcctctaaaaagggatttaagccagggctcgatatgcggctttatgaggaagatgaccttgaccgcctggaacaaatggaagacagcgaaggcacagtgcgacagattggggctttttccgagggcatcaataacctgacacacatgcttaaagaagacgacatgttcaaggacttcgcagccagaagcccatccgcttctatcaccgacgaggactccaacgtatag

SEQ ID NO: 53236 - DNA, 852 bp, Artificial Sequence
  Description of Artificial Sequence: Synthetic coding sequence
atgatgagtgatgcctctgatatgttggctgccgctctcgagcaaatggacggaatcattgcgggatcgaaggccctggagtactcgaatggcatatttgactgccagagccctacttccccatttatgggctctctgcgcgctctacatttggttgaggacctgagagggctgctagagatgatggagaccgacgaaaaagagggactgagatgtcagatacccgactccacagccgaaacgttagtagagtggctccaatcccagatgaccaatggtcatcttcccggaaatggagacgtctatcaggagcgattggcccgactcgaaaatgataaagaaagtttagtgctgcaggccatggtttctgtacttactgatcaggttgaggcacaaggagaaaagatccgggacctagagttttgcttggaggaacaccgggagaaggtcaatgccactgaggagatgctacaacaggagcttctcagccgaactagcttagaaacgcagaaactggacctcatggccgagatatctaatctgaagcttaagttgacggccgtcgaaaaggaccggcttgactacgaggacaagtttcgcgacaccgaggggttaatccaggagatcaacgatctgcggctcaaagtgagcgaaatggatagcgaacgtctccagtatgagaagaaacttaagagtactaaggatgaacttgcctcattgaaggaacagctcgaggaaaaagagtcagaagtgaagcgactgcaggagaagctagtgtgcaaaatgaagggcgagggcgtggaaatcgtagaccgggacgaaaattttaagaaaaaacttaaggagaaatag

SEQ ID NO: 53237 - DNA, 846 bp, Artificial Sequence
  Description of Artificial Sequence: Synthetic coding sequence
atgatgagcgacgcgagcgacatgctcgcagctgccctcgagcaaatggacggcatcatcgccggtagcaaagctttggagtattccaacggcatcttcgattgccagtccccaactagcccattcatgggaagccttagggccttacacctggtagaggacctcagaggcctcctagagatgatggagactgacgagaaggaggggttacggtgccagattccggactctacagctgaaaccctggttgagtggctacagagtcagatgacaaacgggcatctgccgggtaacggcgacgtctaccaggagaggctggctcgcctggaaaatgacaaggagtccctcgtccttcaggtgtctgttttgacagatcaggtagaggcacagggggagaagattagagaccttgaattttgtttggaagaacatagggagaaggtgaatgctaccgaggaaatgctgcaacaggaactgttatcccgaactagtttagagactcagaagctcgacctgatggcagagatttccaatttaaagctcaagctcacagctgtcgaaaaggaccgtctggattacgaagacaaatttcgggatactgaagggctgattcaggaaatcaatgacctgcgacttaaggtctccgagatggatagtgaacgccttcagtacgaaaagaaactgaagtccactaaagatgagttggcttcattaaaggaacaattggaggagaaggagtcagaggttaagcggttgcaggagaagctggtctgtaaaatgaaaggcgaaggggtcgagatcgttgacagggatgaaaactttaagaagaagcttaaggagaaatag

SEQ ID NO: 53238 - DNA, 1197 bp, Artificial Sequence
  Description of Artificial Sequence: Synthetic coding sequence
atggggcaggccggatgcaaaggcctttgtctgtccttgtttgattacaagaccgagaaatatgtaattgcaaaaaataagaaggttggcctcctttaccgccttctacaagcctctatacttgcctacctggttgtgtgggttttcttaattaagaaaggttatcaagacgtcgatacatcgctgcagtctgctgtaattactaaagtcaaaggcgttgctttcaccaacacgagcgacctgggccagcgcatctgggacgtcgctgattatgtgatccccgctcagaacgaaggcatccctgacggtgcctgcagcaaagattccgactgccatgctggggaagccgtgactgccggtaacggtgtcaagaccggtcgttgcctacgccgtgagaacctggctagagggacgtgcgaaatctttgcctggtgccctcttgagaccagttcacggcctgaggagccgtttctgaaagaagcggaggacttcactatctttattaagaatcacattcggttccctaaattcaatttcagtaaaagcaacgtgatggacgtgaaggatcgatcctttctcaagagctgccacttcggccctaagaatcattactgccctatcttcagacttggaagtgtgattcggtgggccggttcagactttcaggacatagccctagaaggcggagtgattggtataaacatcgaatggaactgcgatcttgacaaggccgcttcagaatgtcatcctcactattctttttcgaggctggacaacaagctctctaagtctgtgtccagcggatacaactttagattcgcgcgatactatcgggacgctgccggagtcgaattccgcacattgatgaaagcttacggtatcagattcgacgtcatggttaatgggaaaggcgctttcttctgcgacctagtactgatttacctgattaagaagcgcgaattttaccgcgacaagaagtacgaggaggtgcgaggattagaagactcatctcaagaggctgaagacgaggcaagcggactgggcctgtcggagcagctcacgtccggtccaggattgctcggaatgccagagcaacaggagcttcaggagccccctgaggccaaaaggggctcaagttctcaaaagggcaacggctctgtttgtcctcaattactggagccacatcgctccacatag

SEQ ID NO: 53239 - DNA, 1248 bp, Artificial Sequence
  Description of Artificial Sequence: Synthetic coding sequence
atgtgtccccaattggccggtgctggttccatgggtagcccaggagccacaactggctggggcctcttggactacaagacagagaaatgggctctgctggctaaaaaaggatatcaggagcgggacttagaacctcagtttagcatcattactaagttaaagggcgtgagcgttactcaaattaaagagctaggtaatagactgtgggacgtggccgacttcgtcaagcctccacaaggggaaaatgtattctttctggttaccaattttctggtaacaccggcacaggttcaagggcgatgccccgagcatcccagcgtgccgttagctaactgctgggtggatgaagattgtccagaaggggaaggaggcacacacagtcatggcgttaagacagggcagtgcgtggtctttaatgggacacatagaacgtgcgagatttggagctggtgccctgtggagagcggggtggtcccctccagaccactcctcgctcaagctcagaattttaccttatttattaaaaacactgtcactttttcaaagtttaattttagcaagtcaaacgctttggagacttgggaccctacatactttaagcactgtcgctatgaaccacagtttagcccgtattgcccagtgttcagaattggagacctcgtggcaaaagccggagggaccttcgaagacttggctctgctgggtgggtctgtaggtatcagagtccactgggattgcgatctggatacgggggacagcggctgttggccacattattcctttcagctgcaggaaaaatcttacaacttccggacagcaacccattggtgggaacagccaggtgtggaagcaaggaccctgttaaagctatatggcatcagatttgatattctagtgactgggcaagcaggaaaatttggattgattccgacagcagttacgcttgggaccggagccgcttggctcggggtcgtgactttcttttgtgatttgttgctgttgtatgtggaccgggaagcgcacttctactggcggactaaatatgaagaagctaaagcacccaaggccaccgcaaatagcgtgtggcgtgaactggcattagctagtcaggcgcgactagcagagtgcctgcgcaggtcctccgcacccgctcccactgccacagctgcgggatctcaaacgcagacccctggatggccatgccccagcagcgatactcaccttcccactcactctggcagcctgtag

SEQ ID NO: 53240 - DNA, 1494 bp, Artificial Sequence
  Description of Artificial Sequence: Synthetic coding sequence
atggccgctgcccaacctaaatatcccgcaggcgcaacagcacgacggcttgccagggggtgttggtccgccctctgggactacgagacccccaaagttatcgtggtgcgcaaccggagattaggagtcctgtatcgggctgtacagctgctaatcctgttgtattttgtgtggtacgtgttcattgttcagaagtcttaccaggagtcagagactgggcctgaaagttccatcatcacaaaagttaaaggaataacaaccagcgaacacaaggtctgggatgtcgaagaatatgtgaaaccccctgaaggagggtcagtgttttccattataacaagagtcgaggctacacatagccagactcaagggacatgtcccgagtctataagggttcataatgcaacatgcctctccgacgccgactgcgttgctggggagttggacatgctgggcaatggtctgcgtacaggacggtgcgtcccgtactaccaagggccttctaagacttgcgaggtgtttggctggtgccccgtcgaggacggtgcatcagtgtctcagttcttgggaaccatggcaccgaattttaccattctcataaaaaattccatccactatccaaaatttcactttagcaagggcaacatcgccgaccgcaccgatggatatttgaagagatgtacctttcatgaggcctcagacctttactgtcccatctttaagttagggtttatagttgagaaggcaggagagagcttcacggagcttgcgcacaaaggtggagtcatcggggtaattatcaattgggattgtgatctggatctgccagcctccgagtgcaacccgaaatattcatttcgcagactagaccccaagcacgtccccgcatcatctggatataatttcaggttcgctaagtattacaagattaacggtactactacccggacactgattaaggcttacggaatccggatagacgttatcgtccacggccaggccggaaagttttcactcattccaacaatcattaatcttgcaactgcactgaccagcgtcggcgttgtgcggaacccactgtggggaccttccggatgcggaggtagcactaggcctcttcacactggattatgctggccgcagggctctttcctgtgtgattggatcctcctgacttttatgaataaaaacaaagtgtattctcacaagaaattcgacaaggtgtgtacaccgagccaccccagcggcagttggcctgtgaccctggctagggtcctgggccaggcgccaccggaacctggtcatagaagcgaagatcagcacccatccccaccaagcgggcaggagggacagcaaggggctgagtgtggtcctgctttcccccctctgcgaccctgtccaatcagcgcccctagtgagcagatggtggatacacctgcatcagaaccagcacaggcatctacgcccactgacccaaagggcctggcccagttgtag

SEQ ID NO: 53241 - DNA, 1215 bp, Artificial Sequence
  Description of Artificial Sequence: Synthetic coding sequence
atggcggctgcacagcccaagtaccccgcaggcgctactgcccgtcgacttgctaggggatgttggtcagcactgtgggactacgagactccaaaagtaatcgttgttcgcaaccgaagactcggtgtcctgtaccgagcggtccagctcctgattttattatactttgtctggtatgtgtttatcgtgcagaaaagctaccaggagagtgagacgggtcctgagagcagcatcattactaaggtgaaaggcatcaccactagtgagcataaggtctgggatgttgaggagtatgtgaagccgcctgagggaggttccgtttttagtattattacccgtgtcgaggccacccatagccagacccaaggaacctgccccgagagtatccgcgtgcacaacgccacttgcctgtccgatgctgattgcgttgccggtgagctcgacatgctgggaaatggactacggaccggcaggtgtgttccttactatcagggaccctctaaaacctgtgaggtctttggctggtgccctgtggaggacggggctagcgtgtcccaattcctgggaaccatggcccctaactttactatcctcatcaagaattctatacactacccaaaattccattttagcaagggaaatatagctgaccgaaccgacgggtatctgaaacggtgtactttccacgaggcgagtgatctgtactgtcctattttcaaactgggtttcatcgtagagaaagccggagagtcattcacggagctagctcacaaaggcggtgtgataggtgtcattatcaattgggattgcgatctcgacctgcccgctagtgaatgcaatcctaagtacagcttccgacgcctggatcccaagcacgttcctgccagttctggctacaattttcgattcgcgaagtactataagattaacggaaccacgactcgcaccctcatcaaagcctatggcatcaggattgacgtgattgttcacggccaggcaggtaaatttagcctcattccgacaatcatcaatctcgcgacagcactcacttccgtcggggtagggagttttctttgtgattggatattactgactttcatgaacaagaataaggtgtacagtcataagaagttcgataaaatggttgacactcccgcttccgagcccgcacaggccagcaccccaactgaccccaaggggttggctcagttatag

SEQ ID NO: 53242 - DNA, 1344 bp, Artificial Sequence
  Description of Artificial Sequence: Synthetic coding sequence
atggcagccgcacagcccaagtacccggcaggggctactgcccgtcggttggcaaggggatgctggtcagccctttgggattatgaaactcctaaggtgatcgtcgtacggaacagaagactcggtgttctctatcgtgctgtgcaactcctaattctgctatattttgtttggtatgttttcatcgtacaaaagagttaccaggaatccgaaaccgggcctgaatcctctattatcaccaaggttaagggaatcaccacttcggagcataaggtgtgggacgtcgaggaatacgttaaacccccagagtccatccgcgttcacaatgccacgtgtctgtccgatgccgattgcgtggctggggagctggatatgctggggaatgggctgcgcacaggtcggtgcgttccctactatcagggtccatcaaagacttgtgaggtcttcggttggtgtccggtcgaggatggcgcaagtgtctcccaattcttagggactatggccccaaatttcacgatcctcatcaaaaatagcatccactaccctaagtttcatttcagcaagggaaatatagctgatcgaacggatggttatctcaagaggtgcacctttcacgaggcaagcgacctctattgtcccatcttcaaactcggctttattgtagagaaggcgggagagagttttactgagttggctcacaaaggcggagtgattggagtgataatcaactgggactgtgacttggaccttccggctagcgaatgcaatcccaagtactccttccgtcggcttgatccaaaacacgtccctgcttcttccggttataactttcgatttgcgaagtattacaaaatcaatggtacaaccacaagaacgctgatcaaagcctacggcatccgaatcgacgtaattgtgcatgggcaggccggaaaattttccctcattcctacgataattaatctcgccactgcgctgacctcagttggtgtgggatcattcctgtgcgattggatcttgttgacattcatgaacaaaaataaagtgtattcccataagaagttcgataaagtctgcacccccagtcatccttccggttcatggcctgtcactcttgcacgagtgctgggacaggcccctcccgaaccaggccaccgatccgaggatcagcacccctctccgccatctggtcaggagggtcagcaaggggcagaatgtgggccagctttcccaccactcagaccctgtcccatttctgcacctagtgaacagatggtagacacgccggcaagtgagcctgcccaagcgagcacgccaaccgatcctaaaggtctcgcccagttatag

SEQ ID NO: 53243 - DNA, 1140 bp, Artificial Sequence
  Description of Artificial Sequence: Synthetic coding sequence
atggctgcagctcagcctaaatatcctgcaggtgctaccgctagaagacttgccaggggctgctggtctgccctatgggattatgagacaccaaaggtaatagtgagtatccgggttcataatgccacctgcctcagcgacgccgattgcgtggccggagaactcgacatgcttgggaacgggctgcgtacagggaggtgtgtaccttattaccaagggccaagtaagacctgcgaagtgttcggctggtgccctgtggaagatggggcatcagtgtcccaatttctgggcacaatggctcccaactttacaatcctaataaagaatagcatccactatcctaagttccactttagcaagggaaatattgccgaccgcaccgacggatacttgaaaaggtgcactttccacgaagctagcgacctttattgtcctatatttaaattgggcttcatcgtagagaaagctggggagtcgtttaccgagctggcccataaaggcggagtcattggtgtgatcattaattgggattgcgatttggatttgcctgcctcggagtgcaatccgaagtactcatttcggagactggaccctaaacacgtgcccgcaagctccggctataacttccgatttgctaagtactacaagatcaatggaaccaccaccaggaccctcattaaagcatatgggatacggatagatgtgattgttcacgggcaggctgggaaatttagtttgattccaacaattattaacctcgctaccgccctcacaagcgtcggggtggggtcctttctgtgcgactggattctcttaaccttcatgaataagaataaagtatacagccacaagaaattcgataaagtctgtacaccatcccatcctagcggatcctggcccgtcaccctcgctcgggttctgggtcaagcaccacctgaacctgggcatcgatccgaggatcaacaccctagcccaccatccgggcaagaaggccaacagggcgctgagtgcggaccagcttttccaccgctcaggccctgtcctatttcggccccttccgaacaaatggttgacactcctgcaagtgagcccgcacaagcttcaaccccgaccgatcccaagggcctcgctcaactgtag

SEQ ID NO: 53244 - DNA, 1200 bp, Artificial Sequence
  Description of Artificial Sequence: Synthetic coding sequence
atggcagccgcacaaccaaagtatcccgctggcgctacagctcgtcgacttgccagaggttgttggagtgccctatgggattatgaaacgcccaaggtgatcgtggtacggattcacagagccgagaaactgcctggggaacgagatgggccacgagagctgcatcaccaccaaggtcaaggcgatcaccacgtgagggcccagtcagtggggagaggtggagttcgggaagcaccacgtgggctacgcacaggcaggtgcgtcccatattaccaaggcccttccaagacctgcgaagtattcggttggtgccctgtggaggacggcgcatcagtcagtcaattcctcggcaccatggctcccaattttactatcctcatcaagaactctatccactaccctaaattccatttctctaaggggaatattgcagatagaaccgatggttacctcaagcggtgtacatttcacgaggcatccgacctgtattgtcctatctttaagttagggtttattgttgaaaaggctggagaatcattcaccgaactcgcccacaagggaggcgtgattggcgtgataatcaattgggattgcgatctggacctgcctgcctcggaatgtaaccccaaatacagtttcagaaggcttgatcccaagcatgtgcccgcatcatctgggtacaacttcagattcgccaaatactataagatcaatggtacgaccacccgcaccttaatcaaagcctatggcatccgaattgacgtgattgtgcatggccaggccggaaagttctctttgatccccaccatcatcaacctcgccactgctcttacaagtgtgggtgtcggttccttcctttgtgactggatcttactcactttcatgaacaaaaataaggtgtatagtcataaaaagtttgataaggtgtgtacaccgagtcacccctccgggagttggccagtcaccttggctagagttctggggcaggccccacccgaaccagggcatagaagcgaggatcagcatcctagcccgccttcaggccaggagggtcagcagggagccgaatgcggtcctgcttttccacctctgaggccatgccccatcagcgcaccttccgagcagatggtagatacgcctgctagcgaacctgctcaagcttcgacgccgaccgacccaaagggcctggcccaactttag

SEQ ID NO: 53245 - DNA, 1416 bp, Artificial Sequence
  Description of Artificial Sequence: Synthetic coding sequence
atggccgcagctcagccaaagtacccagctggagctacagccaggcggctagctcgtggatgttggagcgccctgtgggactacgaaacacccaaggtgattgtggttcgcaaccggaggctgggcgttctgtatagagcagtacaactgcttatcttactgtatttcgtgtggtatgtgtttatagtgcagaagagttaccaggagtccgaaaccggtcccgaaagtagcattattacaaaagtgaaaggaatcactacgagcgaacacaaggtgtgggatgtcgaagagtatgtcaaacccccagagggaggatctgtgttttctattattactcgggtcgaagctacccacagccagacccaggggacctgtcctgaatcaattcgggtgcataatgcgacctgcctgagcgacgccgactgcgttgcaggagagttagacatgttaggaaacgggttaaggacagggaggtgtgttccctattaccagggaccttcaaagacgtgtgaggttttcgggtggtgtcccgtagaggatggtgcaagcgtcagccagtttttgggaacaatggcacctaactttacaatactgatcaagaattccattcactaccctaaattccatttctccaaaggcaacattgcggaccggaccgacggatatctcaaacgttgcacattccatgaagccagcgacttgtactgccccattttcaaattgggcttcatcgtggaaaaggccggagagtcattcaccgagctcgcccacaaggggggagtcattggcgtcataattaactgggattgtgacctggacttgcccgcttctgagtgtaaccctaagtattccttcaggcgcctggaccctaaacacgtgcccgcttcgtccggatacaacttccgtttcgccaaatactacaaaatcaatggcaccacaacacgcaccctaattaaggcttacggtatcaggatcgatgtgatagtgcatggccaggccggaaaattcagcctcatccccacgatcataaatctggcgacggccctgacctctgtgggggtgggttccttcctgtgcgactggatcctcctgacattcatgaacaaaaacaaggtttatagccacaaaaagttcgataaggtgtgtacccctagtcatccatctgggtcatggcccgtgaccctggcgcgagtcctgggtcaggcacctcctgagcctggccatcgtagcgaggaccagcatccttccccgccaagtggacaggagggccaacaaggtgcagaatgcggacccgcattccctcccttgcggccttgccccatctctgccccatctgagcaaatggtggatacgccggcatctgaaccggcacaggctagcactccaacagatccgaaaggactggcacagctgtag

SEQ ID NO: 53246 - DNA, 1113 bp, Artificial Sequence
  Description of Artificial Sequence: Synthetic coding sequence
atggccgctgcacaacccaagtatcctgccggagccaccgcccgaagactcgccaggggatgctggtccgcgctttgggactacgaaacacccaaagtgatcgtggtgaggaatcgaaggctcggggtactctatagggccgtgcagctgcttattctgctctatttcgtgtggtatgtatttatcgtgcagaagtcttaccaggaatcagagacggggccagagtcaagtattattaccaaggttaagggaatcactacatccgagcataaagtttgggacgtcgaggagtatgttaagccccctgagagtatcagagtacacaatgccacctgtctgtctgatgctgattgcgtggctggagagctggatatgctggggaacggggctttgcaggatctgcgaggcgtgagactcgtcccagggggtcgatgggggctctgccaacctatcagcggctacgatggaccaaaatttcatcacccccaccaggagcagcatcccctcccccagattccactgctgcaaggtcagcaccggagaccccaccgtagggtcccggaagcgttacatgtgcctcgtggtctaagacccctcctgccgcacctgcaagcaggtttgtatcggggtgagggctggggcgagcttcaccgtgcaaggactcagggcagggggggtgtaatcggcgttattatcaattgggactgtgacctcgacctacccgctagtgaatgtaacccgaaatacagctttagaagattggaccctaaacatgtgccggcttcttccggatacaatttcagattcgcaaaatactacaaaatcaacggaacaaccactagaactcttatcaaggcttacggcatccggattgacgtgatcgttcacggacaagctggaaaattttctttaattccaacgataataaacctggccacagcactgactagcgtgggagtggggtcctttttatgtgattggatcttgctgacttttatgaacaaaaacaaggtgtactctcataagaagttcgacaagatggtcgacactcccgcatctgaacccgcacaggctagcacacctacagatcctaaagggttggcacaactgtag

SEQ ID NO: 53247 - DNA, 1056 bp, Artificial Sequence
  Description of Artificial Sequence: Synthetic coding sequence
atggccgatcaggatcccgcaggcatttcccctttgcagcaaatggttgccagcgggaccggggctgttgtaacatcactatttatgacaccactagatgtcgtcaaggtaagattgcagtcccagcggccatccatggcgagcgaactcatgccctccagtcggctgtggtccttatcctataccaagtggaagtgtctcttatactgcaacggagtattggagccactctacttgtgtccaaatggcgctcggtgtgctacctggtttcaggatccaacaaggtttacaggtacaatggacgctttcgtcaagatcgttagacacgagggcacaaggaccttgtggtccgggctgcctgccacactggtgatgaccgtgccggctactgctatttattttacggcttatgatcagctgaaagcgttcctgtgcggtagggcattgacctctgatctatacgccccaatggtggcaggggcattggcacggctgggaaccgtaactgttatatcaccactggaactcatgagaactaaactccaagcccagcatgtcagctatagggagctcggtgcctgcgtccgcaccgccgtggcgcagggcggatggaggtctctatggcttggctgggggcctacagctttgagggacgtcccattctctgcgctgtattggttcaattacgagctggtaaagtcttggctcaacggctttagacctaaggatcagactagtgtgggaatgtcctttgtcgctggcggtatcagtggaactgtggccgctgtcttgacgctacctttcgacgtggttaaaacccaacgccaggtggccctgggagccatggaggctgtgcgggtaaatcccctgcacgtggattccacctggctgttgttgaggagaattagagcagaaagcggaaccaagggcctctttgccggttttctacctcgaatcattaaagccgctcctagttgcgctatcatgatttctacttatgagttcggcaagtctttttttcagagactcaaccaggatcgcctgcttgggggttag

SEQ ID NO: 53248 - DNA, 1299 bp, Artificial Sequence
  Description of Artificial Sequence: Synthetic coding sequence
atggggcaagccggatgcaaggggctttgtctgagccttttcgattataaaaccgagaaatatgtgattgctaagaacaaaaaagtaggattgctatacaggctgctccaggcctctatcctcgcctacctcgtcgtgtgggtgtttttgattaagaaggggtaccaagatgtggatacttctttgcagtccgcagtgataactaaggtgaagggggtagctttcaccaacacttcagacctcggacagcgcatttgggacgtagcagattatgtcattcctgcccaaggcgagaacgttttttttgtggtgacaaacctgatcgtgactccgaatcaaaggcagaatgtgtgcgccgaaaatgaaggcatcccagacggagcatgcagtaaagatagtgattgtcatgcaggggaagcggtgacggccggaaacggagtgaaaacgggcaggtgtctgcggcgagagaatcttgctcgaggaacttgcgagattttcgcttggtgcccactggaaaccagctcccgtcctgaagaaccgtttctcaaggaggctgaggactttacaattttcataaagaatcatattcgatttcccaagttcaacttttccaaatctaacgtgatggacgtgaaggaccggagcttcctgaagtcatgtcactttggaccaaagaatcactactgcccaatcttcagactggggtcagtgatacgctgggccggtagtgattttcaggatatcgcactggagggaggagtgattggtatcaacatagagtggaattgcgaccttgacaaggctgcgagtgaatgccatcctcactattccttttcaaggctggacaacaaactttcaaagagtgtctctagcggctataactttagattcgccaggtactacagggatgctgcaggcgttgagttccggacattaatgaaagcctacggtattaggtttgacgtcatggttaatggcaagggtgccttcttctgtgatctagtgttgatttacctcatcaagaaaagggaattctaccgcgacaagaaatacgaggaggtgcgtggcctcgaagattcttctcaggaagctgaggatgaggcctctggattgggcctcagtgaacagttaacgagtggtcccggtctattagggatgccagagcaacaggagctgcaagagccaccagaggccaagcgtggcagcagctctcagaagggcaacgggtccgtctgtcctcagctgctcgaaccacaccggttacgaacaccctccgcctcacctttgcaccaggagtag

SEQ ID NO: 53249 - DNA, 1266 bp, Artificial Sequence
  Description of Artificial Sequence: Synthetic coding sequence
atgggtcaggctggctgcaagggcctttgcctctccctgtttgactacaaaaccgagaagtatgtgatcgccaagaacaagaaagttggtctgctgtaccgtttactacaggctagtattctggcctacctggttgtgtgggtgtttctaatcaagaagggctaccaggatgttgacacttctttgcaatccgcggtaattactaaagtaaaaggtgtggcctttactaacacaagcgatttaggacagcgaatctgggatgtcgccgactacgtcattcctgctcaaggggaaaacgttttctttgtggttacaaatctgattgtgacccccaatcagcgccagaatgtatgtgccgagaatgaaggaattcctgatggtgcgtgtagcaaagactcggactgccacgccggagaagcagtgacagcaggcaacggtgtcaagactgggaggtgcctgaggcgcgaaaatctcgccaggggcacctgtgagattttcgcatggtgcccgctagaaacttcgtctcggcctgaggagccgttccttaaggaggccgaagacttcactatttttatcaagaaccatatacgcttccccaagtttaatttttcaaacaatgtcatggacgtgaaggacaggagcttcctcaaaagttgccacttcggacctaaaaaccattactgcccaatcttccgactgggcagcgttattaggtgggccggttccgatttccaagacatagcgctggaagggggtgtgatcgggattaacatcgagtggaactgtgatctggataaggcagcctctgagtgccatccacactatagtttcagccgacttgacaacaagctcagcaagagcgtcagtagcgggtacaattttaggtttgccaggtactacagagacgcagcaggcgtggagtttcggacgttgatgaaagcctatggcattcgctttgatgtcatggtgaacgggaagggcgcattcttctgtgatctcgtcttaatatatttaattaaaaaacgcgagttctatcgcgataaaaaatacgaggaggtgcggggtcttgaggacagttcccaggaagcagaagatgaggcatctggactgggactgtctgagcaactcactagcggaccaggactcctaggcatgccagagcaacaagagcttcaagagcctccggaggccaaacgcggttcgagctcgcagaaggggaacggaagcgtttgtcctcagcttctagagccccacagatctacctag

SEQ ID NO: 53250 - DNA, 1194 bp, Artificial Sequence
  Description of Artificial Sequence: Synthetic coding sequence
atgggacaggccggttgtaagggtctttgtctgtcactttttgattacaagaccgaaaagtatgtgatcgccaaaaacaagaaggtggggctactgtacaggcttctccaggcatccatccttgcctatctcgtcgtgtgggtgtttttaattaagaaggggtaccaagatgttgatacatccttgcagagcgctgtgataacaaaggtgaagggcgtggcattcacaaacacgtctgatttaggacagcgcatttgggatgtcgcagactatgtgatcccagctcagaacgagggcattcccgatggtgcgtgtagcaaggattccgattgccacgcaggagaggccgttacggccggaaacggcgtgaaaaccggccgatgccttagaagggagaacctcgcacgtggcacgtgcgagattttcgcatggtgtcccctggaaacaagtagccgcccagaagaaccctttctgaaggaggcagaggattttacgatctttatcaagaaccatatacgattccccaaattcaattttagcaacaatgtgatggacgttaaagaccggtcattcttgaaatcatgccattttggtcctaagaaccattactgcccaatattccggctggggtccgtcattcgatgggcagggtccgactttcaggacatcgccctggagggtggagttataggaataaacatcgagtggaactgcgacctcgacaaggctgcgtcagagtgccaccctcattattccttcagtcgcctcgacaacaaacttagtaaatctgtctcatccggatacaatttcaggttcgctaggtactacagagacgcagccggtgtcgagttccgcaccctgatgaaggcttatggaattagattcgacgttatggtaaacggcaaaggcgcttttttctgcgatctcgttctgatatacctgattaagaagcgcgagttttacagggataagaagtatgaagaggtacggggtctcgaagattcaagtcaggaggcagaagacgaagcctcaggtttgggactatccgaacagctgacctctggcccaggccttctcgggatgccagagcagcaggaactacaggagccacccgaggccaagcgcggaagcagcagtcaaaagggaaatggatcggtttgcccacaacttctggagccccaccgaagcacatag

SEQ ID NO: 53251 - DNA, 1089 bp, Artificial Sequence
  Description of Artificial Sequence: Synthetic coding sequence
atgcctacatatcgccctccaagtcacagatgggtgttcctcattaaaaaaggctatcaggatgtcgacacgagtctgcagtctgccgtaattaccaaggttaagggagtcgcttttactaatacttccgacctggggcagcgcatctgggatgttgcggactatgtaataccagcccaaaacgaggggatacctgatggagcgtgtagtaaggattccgattgccacgccggagaggccgtcacagccggtaatggcgtgaagacaggccgatgtcttcggcgagagaatttggctcgcggtacctgcgagatcttcgcttggtgcccgcttgaaacctcctccagacccgaagaaccgttccttaaggaggccgaagacttcactatcttcataaagaatcatatcagattccctaagttcaacttctcaaagagtaacgtaatggacgttaaagatcgctccttcctgaaatcatgccactttggcccaaagaatcactattgcccaatttttagattaggctccgtgatcagatgggctggaagcgacttccaggacatagccttggagggcggtgtgatcgggatcaacatcgagtggaattgcgacctagataaggccgcttccgaatgccaccctcactacagctttagtcgcctcgacaataaactgtccaaaagcgtgtcatctggctataacttcagatttgcgaggtattatagagatgccgcaggggtggaattcagaaccctgatgaaggcctacggcatccggttcgacgtgatggtgaatggaaaaggggcattcttttgcgacctggtactgatctatctcattaagaagcgggagttttatagagacaagaagtacgaggaggttcgaggcctcgaagattcttctcaagaagcagaagatgaggcttcagggctcggcttaagcgaacagttgaccagcgggcctggactgctgggcatgccagaacaacaggaactccaggaacctcccgaggccaagaggggcagcagctcccagaaaggaaatggctccgtgtgtccccagctcttagaacctcataggtctacctag

SEQ ID NO: 53252 - DNA, 1296 bp, Artificial Sequence
  Description of Artificial Sequence: Synthetic coding sequence
atgggttcccccggtgcaactaccggctggggtcttctggattataaaactgagaaatatgtaatgacacgcaactggagagtgggagccttgcagcggctgcttcagtttggcattgtggtctacgtggttggctgggcccttctggcaaagaagggctatcaggagcgcgatcttgaaccacagttcagcattattactaagctgaagggcgtgtctgttactcagataaaggagctgggaaaccgtctgtgggatgtggccgatttcgtgaaacctcctcagggcgagaacgtgttttttctcgtgacaaatttcctggtgacccctgcgcaggtccaaggaaggtgccccgagcatccaagcgtcccccttgctaattgttgggtggatgaggattgcccggagggggaggggggaacccatagtcacggagtgaaaaccggacagtgtgttgtgtttaacggcacccacagaacctgcgaaatatggtcttggtgcccagtggaaagcggggtggtgccctctaggccgctgctggcccaggcacagaacttcactctcttcataaagaacactgttacattttccaaatttaatttcagcaaatccaatgcactggagacttgggatccaacttatttcaagcattgtcgctacgagcctcagttttcaccctattgccctgtctttcggattggagacctcgtggcgaaagcagggggaacattcgaagacctggccctgctcggaggtagcgtaggtatcagggtgcactgggactgcgacttagataccggcgacagcgggtgctggccccactactcctttcagcttcaggagaaatcatataacttcaggacagctacccattggtgggagcagcccggagtcgaggctcgaaccctcctgaaactatacggcattagattcgacatcttggtcacaggccaggccggaaaatttgggctgatccctacagctgtgaccctcgggactggagctgcatggttgggcgtggtcacattcttctgtgatctgctgttgctgtacgtggatagagaagcccacttctattggaggaccaagtatgaagaggctaaagctccaaaggcaaccgctaacagcgtctggcgagaactggccctcgctagccaggcacggctggctgagtgcctgcgcaggtcatctgcgccagctccaaccgctaccgccgcagggtcacaaactcagaccccaggatggccttgtccgtcttcagatacccacctgccaacacattctggctctctctag

SEQ ID NO: 53253 - DNA, 213 bp, Artificial Sequence
  Description of Artificial Sequence: Synthetic coding sequence
atgggatcccccggtgcaactacaggctgggggctcctggactataagaccgaaaagtgggctttgctggcgaagaaaggttatcaggagagggacctggagccacaattcagcattataacaaagctcaagggggtcagcgttactcagatcaaagaactgggtaacaggctatgggacgttgctgactttgtgaagccccctcaagtctag

SEQ ID NO: 53254 - DNA, 1326 bp, Artificial Sequence
  Description of Artificial Sequence: Synthetic coding sequence
atgtgtccacaactggcaggagctggctctatgggatctccgggtgctacaacaggatggggcttactggactataagaccgaaaaatacgttatgaccaggaattggagggtgggggctcttcagcgcctcctgcagtttgggatagttgtgtatgtcgtcgggtgggccctgttggcaaaaaaaggttaccaggaacgggacctggaacctcagtttagtatcatcaccaagttgaaaggcgtctccgtgacacagattaaagaactggggaacagactctgggatgtcgccgattttgtcaagccaccacagggggagaacgtgttcttcctggtcacaaactttctagtcacacctgcccaagtgcagggcagatgtcccgagcacccatccgtgccactggcaaactgttgggtggacgaggattgtcctgaaggggaaggcggaacgcactcccacggggtcaagactggtcagtgtgtcgtgttcaatggaacgcacaggacgtgtgaaatctggagttggtgcccagtcgagagtggggtagtcccaagtcgccctttacttgcacaagcacaaaacttcaccttatttatcaagaacaccgtgacatttagtaagtttaacttcagtaagagtaatgccctcgaaacatgggatcctacctacttcaaacactgtagatacgagccacagttcagcccttattgccccgtgttcagaataggggaccttgtggctaaggccggtggcaccttcgaggacctggcccttcttgggggaagcgttggtataagggtccattgggattgcgacctggacaccggtgactccggatgctggcctcattactcattccagttgcaggagaaatcctacaattttcggactgcgactcattggtgggaacagccaggcgtggaggctagaacgctgctgaaactctacggaatccgattcgacatcctcgtcacaggtcaggccggaaagtttggactgatcccaacagcagtgaccctgggcactggcgcagcctggctgggcgtggtcacgtttttctgcgacctcctgctgctctatgtggaccgtgaggcccatttttattggcgcaccaagtacgaggaggctaaagctccaaaggccacagctaactccgtatggagagagttggccctggcaagtcaggccaggctggccgagtgcctccgccgttcttccgccccagcccctacagctactgctgcaggctcacagacacagacccctggatggccttgccctagcagtgatactcacctgccaacccattctgggtccctatag

SEQ ID NO: 53255 - DNA, 243 bp, Artificial Sequence
  Description of Artificial Sequence: Synthetic coding sequence
atgtgcccgcaactagccggagccggatccatggggtccccaggagccaccactgggtggggcctactggattataaaacagagaaatgggccctcctagcaaagaaaggttaccaggaaagggacctcgaaccccagtttagtatcattaccaagctgaagggagtatctgtgacccagatcaaggagctgggcaatcgtctgtgggatgttgccgacttcgtgaagccccctcaagtgtag

SEQ ID NO: 53256 - DNA, 1167 bp, Artificial Sequence
  Description of Artificial Sequence: Synthetic coding sequence
atgtggtgggccctgctggcgaaaaaagggtaccaggagcgggacctcgaaccgcagttcagcatcattacaaagctgaagggggtttccgtgacacaaatcaaggaactgggaaaccggctttgggacgtggctgatttcgtcaaaccccctcagggcgagaacgtcttcttcttggttacaaactttttagtgacgcccgctcaggtacagggccgatgcccagagcatccctccgttccacttgccaattgctgggtcgacgaggattgccctgagggcgaagggggaacacacagtcacggtgtgaagactggtcagtgtgttgtcttcaatgggactcaccggacatgcgaaatctggagctggtgtccagtcgagagcggagttgtacctagtaggcccctgctcgctcaggcccagaattttaccctcttcatcaaaaataccgtgactttttccaaatttaacttcagtaaaagtaacgcgctggaaacctgggatccaacttacttcaaacattgtagatatgagccccaattttctccttactgccctgtgtttaggattggtgatctcgtggcaaaggccggaggtactttcgaggatttggccctgctaggtggttccgttggaatccgcgtgcactgggactgcgatctagatactggcgatagcgggtgttggcctcactactctttccaactgcaggagaagtcttacaacttccggaccgcgacacactggtgggagcagcctggtgtggaggcccgaaccttgctgaaactgtatggaatcagatttgacattctagtgacgggccaggctgggaagttcggcctcatacccacagccgtgactctggggaccggggctgcctggctaggagtcgtcactttcttctgcgacctgctgctactgtacgttgacagagaggctcacttctactggcgaaccaagtatgaggaagccaaggcccctaaagctactgccaacagtgtatggcgagaactcgccctggccagtcaggcacgtctggccgaatgtttaagacggagcagtgcccctgctcctacagcaaccgccgcagggagccagacacagacgcccggatggccatgcccatcatcagatactcacttaccaacccatagtggctccctgtag

SEQ ID NO: 53257 - DNA, 1020 bp, Artificial Sequence
  Description of Artificial Sequence: Synthetic coding sequence
atggcaaatctggacaagtatactgagacttttaaaatggggagtaactctacctctacagcagaaatctactgcaacgtcaccaacgtgaaatttcagtattcactttacgctactacatatatcctgatattcatacccggattactggctaactctgcggctctgtgggtactatgccgttttatcagtaagaaaaataaagctatcatctttatgattaatcttagcgtggcagatctcgctcacgtgcttagcctaccactgcggatctactattatatcagccatcactggccttttcagcgcgctctgtgtctattgtgtttttacctgaagtacttgaacatgtacgcatctatctgcttcttgacctgtatatccctgcagaggtgtttcttcctcctgaaacctttccgagccagagattggaagcgcagatacgacgtgggcatctcagccgctatctggatcgttgtgggcactgcttgcttgccgttccctatcttgagaagtaccgacctcaacaacaacaagtcttgtttcgcagacctgggctataagcaaatgaatgccgtagcattggtgggcatgattacagtggcagaattagcgggattcgttatccctgtgatcattatagcatggtgcacgtggaagaccacaattagccttcggcagcctcccatggcatttcagggaatttccgagaggcagaaagccttgcgaatggtgtttatgtgcgccgctgtgttttttatctgttttaccccttatcacatcaactttatattctacaccatggtcaaagagacaattatatcaagctgcccagtggttaggatcgccttatattttcatcccttttgcctgtgcttagcctccctttgttgcctgcttgaccctatactttactattttatggcgagcgagttccgcgaccaactctctcggcacggaagcagtgtcaccagatcaagattaatgtctaaggaatccggcagttccatgatcgggtag

SEQ ID NO: 53258 - DNA, 1020 bp, Artificial Sequence
  Description of Artificial Sequence: Synthetic coding sequence
atggccaatctggacaaatacacagaaacctttaaaatggggagtaattccacgtctaccgctgagatttattgtaatgttacaaacgtgaaatttcagtacagtttgtacgccacaacctatattctcatttttataccgggactgctggccaactccgcagcgttatgggtcctgtgcagattcatttctaaaaagaataaggccatcattttcatgatcaatctgagtgtggctgacctggcccatgtcctgtcacttcccttacgcatctattactacatttcacaccactggcccttccagagagctctgtgcctgctttgtttttatctgaaatatttgaacatgtatgcctcaatctgtttcttgacgtgcatttcattacagaggtgcttcttcctgctgaagcccttccgggctcgggactggaaacggagatatgacgttggaattagcgccgctatttggatcgtggtggggaccgcctgtctgccctttcctattctgcggtctaccgacctgaataacaataagtcctgcttcgcagatctcggctataagcaaatgaacgccgtggcgctggtagggatgatcacggttgctgagctcgcaggcttcgttatccccgtgatcatcatagcttggtgcacttggaagaccacaatcagtctcaggcagcctccgatggcgttccaggggatctccgagcggcaaaaggccctccgcatggtcttcatgtgtgccgctgtcttcttcatttgcttcaccccttatcatatcaattttattttctacacaatggtgaaagagactataattagctcatgtcccgtggtaagaatagcactgtactttcatcccttctgcttgtgccttgcttcactatgctgcctcctggatcccatattgtactacttcatggctagtgagtttcgggatcagctgagccgtcatggaagttcagtcacacgctctcggctaatgtctaaggaatccggttccagtatgatagggtag

SEQ ID NO: 53259 - DNA, 1065 bp, Artificial Sequence
  Description of Artificial Sequence: Synthetic coding sequence
atgacagcagccatccggcgtcaacgtgaattgagcattttaccgaaggtcaccctggaggcaatgaatacaacagtcatgcagggctttaatagatctgagagatgtccacgagacactaggatagtgcagcttgtttttcctgccctgtacaccgtggtttttctgacgggcatcttgctcaatactctggcactttgggtattcgttcatattcccagctcaagcacattcataatttacctgaagaacaccctggtggctgacctgatcatgacactgatgctcccgttcaaaatcctctcggatagtcacctggctccctggcagcttagagcattcgtgtgtagattctccagcgttatcttttacgagactatgtacgtaggcatcgtgctgctcggactgattgcatttgataggttcctgaagatcattcggcctctgagaaacatctttttgaagaaacctgtctttgccaaaacggtgtcaattttcatttggttcttcctgttcttcatttctctgccaaatactatactgtctaacaaagaagctaccccgtcaagtgtcaagaagtgcgcgtcactcaaggggccactggggctgaaatggcatcaaatggtgaataatatttgtcagtttattttttggacagttttcatacttatgctggttttctacgttgtgattgctaaaaaagtgtacgatagctaccggaaatctaaatccaaagaccgcaagaacaacaagaagctggaaggcaaggtgtttgtagttgtggctgtgttttttgtttgctttgccccatttcattttgccagagtgccttatactcattcgcaaacgaacaacaagactgactgtcgccttcaaaatcaactgttcatcgctaaggaaaccactctgttcctagcggcaaccaatatatgtatggacccacttatctatatatttctgtgcaaaaagttcacagaaaagctcccctgcatgcagggccgaaagactactgcaagttcgcaggagaaccactcaagccaaactgacaacatcaccctgggttag

SEQ ID NO: 53260 - DNA, 1017 bp, Artificial Sequence
  Description of Artificial Sequence: Synthetic coding sequence
atgatcaatagtaccagtacacagcctccagatgaatcgtgtagtcagaacctcctcatcactcagcagatcatccctgtgttgtactgtatggtattcatcgctggtattctcctgaatggcgtgagcggctggatttttttttacgtgccctcaagcaagagttttatcatctatctcaagaacatagtgatcgccgacttcgtcatgtcactgaccttcccattcaaaatcttgggcgactctggcctgggcccttggcagctgaatgtgtttgtatgcagagtatctgccgtcttattttacgttaatatgtacgtatcgattgtgtttttcgggctcatatcctttgacaggtattacaagatagtaaagcctctctggaccagctttatccagtctgtgtcctacagcaagcttctcagtgtgatagtgtggatgctgatgttgttacttgccgtgccaaatatcattttgacgaatcagtccgtgagagaggttacacaaattaagtgtattgagttaaagagtgagctgggaagaaagtggcataaagcttccaattacatctttgtggcgattttctggatcgttttccttttactaatcgttttttacacagctattacgaaaaagatctttaaaagccatttaaagagcagccgtaattctacttcggtcaagaaaaaatcctctcgaaacatattctctatagtgttcgtgttcttcgtatgttttgtgccctaccacattgcaaggataccttatactaagtctcaaaccgaggcacactacagctgccagagtaaagaaatactccgttacatgaaggagtttaccctcctcctgagcgccgctaacgtgtgcctggacccaattatttacttctttctttgtcaacctttccgggaaattctatgtaagaaacttcacatccctttaaaggcccagaatgatctcgacatttcccggatcaaacgtggcaacaccaccctcgaatcaaccgacaccttatag

SEQ ID NO: 53261 - DNA, 1017 bp, Artificial Sequence
  Description of Artificial Sequence: Synthetic coding sequence
atgattaatagtacttctacccagccaccggacgagagctgctcccagaatttgttgattactcaacagattattccagtactctattgcatggtgttcattgctggtatactgctgaatggggtttccggatggatatttttttacgttccttcctcaaaaagctttattatctacctgaaaaatattgtgatcgcagacttcgtgatgagcctgacattcccgttcaagattctgggtgacagcggtcttggtccatggcagctcaatgtctttgtttgtagagtgagcgcggtgttattttatgtcaatatgtatgtttctatcgtgttttttggcttgatctcctttgatcgctactacaagatcgtaaaacccctttggacaagcttcattcagtccgtgagttattcaaagttgctgtctgtgatcgtctggatgcttatgctcctgttagccgttccaaatatcatcctgacaaatcagagtgtgcgggaggtgactcaaattaaatgcatcgaactgaaatccgaactggggaggaaatggcacaaggccagtaactacattttcgttgccatattctggattgtatttctgctgctcatcgtgttctatactgccatcacaaagaaaatcttcaagtcgcacctcaagtctagtcggaatagtacgagcgtgaaaaaaaagtcaagcaggaatattttttccattgtatttgttttcttcgtgtgcttcgtaccttaccacatcgcacgaataccatacactaaatctcagacggaggctcactattcttgccagagcaaagaaattctcagatacatgaaagaattcactctcttgctgtcagctgcgaatgtctgcttggaccccattatatatttctttctgtgtcaacctttcagagaaatcttgtgtaagaaactgcatatcccccttaaggcacagaatgatctcgacatatcacggatcaaaaggggtaataccacccttgagagcaccgataccctgtag

SEQ ID NO: 53262 - DNA, 291 bp, Artificial Sequence
  Description of Artificial Sequence: Synthetic coding sequence
atgattaactcgacctctacccagcctcctgatgaatcatgttctcagaacctgttgattacacagcagattataccggtgctgtactgtatggtttttatcgctggcattctgctcaacggagtttctggttggattttcttctatgtaccatcctccaaaagctttattatctacctcaagaatatcgttattgcagactttgttatgtccctcaccttcccttttaagatcctaggagattcagggttgggaccatggcagctgaatgttttcgtgtgtcgagtgtag

SEQ ID NO: 53263 - DNA, 2358 bp, Artificial Sequence
  Description of Artificial Sequence: Synthetic coding sequence
atggccagtaaagtgaccgatgcaatagtgtggtaccagaagaaggagttcctctctgttgccaccactgcgcctggtcctcagcaggtattgcctgggtactgtcagtgcagcctcaaagaccagggtttgttcatccaatgtttgattggtgcttatgaccagcagatttgggagaagtcagtggagcagagagagatcaaatttatcaagttgggcctccgtaacaaacctaagaagaccgcccatgttaaaccagacctgatagatgttgatttagtgcgtgggtcagcctttgccaaggccaagccagaaagcccgtggacaagcctcacccgtaaaggaatagtgcgagtcgtgttttttcctttctttttccggtggtggttacaggtgacctccaaggttatcttcttttggctgcttgtgctttacctcctacaggtggcagcgattgtacttttctgctccacctcgtcaccccattctattccgttgacggaggtgatcggacctatttggctgatgttgttattggggactgtccactgtcagatagttagcactagaacacccaagcccccactgtctaccggaggcaaaaggcggagaaaactgcggaaggccgctcatctggaggtgcaccgggagggtgatggtagttccaccacggacaatacacaagagggggcagtccagaaccacggtaccagtacctcacatagcgtgggcacagtgtttagggacttgtggcacgctgccttttttctgtctgggagcaaaaaggcaaaaaacagcattgataagagcacagaaacagataacgggtatgtctctttagacggcaaaaaaaccgtgaaatctggcgaagacggcatccagaatcatgagcctcagtgcgagaccattaggcccgaagaaacggcctggaacacagggacattacgcaacgggccaagtaaggacacgcagcgaactatcactaatgtttctgatgaggtgagctccgaggagggcccagagactggctatagcctcagaagacacgtcgatcgtacaagcgagggggtacttcgaaacagaaaatctcaccactataaaaaacattacccaaacgaagacgcaccgaaaagcggtacttcctgttcctccaggtgtagttcatccagacaggactccgagagcgcacgcccagagtcagagaccgaagatgttctctgggaagatctgctgcactgcgcggaatgccacagctcttgcaccagcgagaccgacgtagaaaaccaccagatcaacccctgcgtgaaaaaagagtaccgggacgacccgttccaccagtctcacctaccttggctccattcctcccacccaggactggagaagatcagcgccattgtgtgggagggaaacgattgcaaaaaagccgatatgagtgtgttggaaatctccggaatgatcatgaaccgtgtgaatagccacattcccggtatcggataccaaatattcggaaatgctgtaagcctgattttggggctgacccccttcgttttccgcctctcccaagctacagatctcgagcagcttactgctcactctgcttctgagctgtacgtgattgccttcgggtcaaacgaagacgtcatcgtgctgtctatggtgatcatctccttcgtggtgcgtgtatccctggtctggatctttttctttctcttgtgcgttgctgagcgtacttacaaacagcgcctcctcttcgctaagttgttcggacacctgacctccgcaagacgagcgagaaagtctgaggttcctcattttcgcctgaaaaaggttcagaatattaagatgtggctgagcctcaggtcttacctcaagcgacggggacctcagcggagcgtggacgtaatcgtgtcatctgctttcttactcacgattagtgtggtgttcatctgctgcgctcaattgctccacgtgcacgagatctttctggactgccactataattgggagttggtcatctggtgtatctctctcacactgttcctgcttagatttgtaacattggggtccgaaacgagcaagaagtattccaacacttctatactgctcactgaacagatcaacctgtatctgaagatggaaaagaagcccaataaaaaagaagaactgacgttggtcaacaatgtgttaaagctggctacaaagctgttgaaagagctggactccccctttaggctgtacgggttgaccatgaatcccctcttgtacaacatcacacaggtggtaatactgtctgccgtgagcggcgttatatccgacctgctgggctttaacctcaagctgtggaagattaaatcctag

SEQ ID NO: 53264 - DNA, 2088 bp, Artificial Sequence
  Description of Artificial Sequence: Synthetic coding sequence
atggcctctaaggtgacagacgcaatcgtctggtatcaaaaaaagatcggggcatatgaccagcaaatttgggaaaagagcgtggaacaaagagagatcaaaggcctgcggaataagcctaagaagaccgctcatgtaaaaccagacctaatagatgtggacctggtccggggaagcgcattcgccaaagctaagcccgagtctccttggacgagtctaacccggaagggaattgtgcgtgttgtgtttttcccctttttcttccgctggtggctacaggtgacttccaaagtgatttttttctggctgcttgtgctctaccttctgcaggtcgctgccattgtgctgttctgcagcacaagctccccacactccattcccctcacagaagttattggacccatttggctaatgttactccttgggacagtgcattgccagatcgtcagtaccaggacccctaaaccgcctctttctactggagggaaacgtcggagaaaactaaggaaagcagcgcatctggaggtgcaccgcgaaggtgacggcagttctacgaccgataatacccaggagggggcagttcaaaaccacggcacaagcacttcccactccgttggtacggtctttagagacttgtggcacgccgcattttttctgagcggaagtaagaaggcaaagaacagcatcgacaagtctacggagaccgataacggatatgtgagtctggacggcaaaaagaccgtcaagtccggggaggatggtattcaaaaccacgagccacaatgtgagacaatcagacctgaagagaccgcctggaatacagggacgctgcgtaacgggcctagtaaggacactcagaggactattacaaatgtctctgacgaggtatcaagcgaggagggtcctgagaccggctattctttaaggagacacgtagaccgtacctccgagggagttctgcgcaataggaagtctcatcactacaaaaagcactatcccaatgaagacgcccctaagtccggaacctcctgctcgagccgttgcagtagctcgcgtcaagattcagaatccgcccgaccagagtctgaaactgaggatgtgctatgggaagatctactgcactgcgcagaatgccatagctcctgcaccagtgaaacggatgttgagaaccaccaaattaatccttgcgtgaagaaggagtaccgcgacgacccctttcatcagtcacatttgccttggctccatagctcccaccccggtctggaaaagatctccgcaatcgtatgggaaggaaacgactgcaaaaaggctgacatgagcgtgctggagatctccggaatgattatgaaccgggtcaactctcacattccagggattggttatcagatatttggaaatgcggtcagcctcatcctggggcttaccccttttgtgttcaggctttctcaagctacagatttagaacaactgactgcgcactctgcgtcggagctatacgttattgcctttgggagcaatgaagatgtgatcgtcctcagtatggtgatcatctccttcgtggtacgcgtcagtctagtatggatcttttttttcctgctatgcgttgccgagcgtacatataaacagcgcctgttgttcgccaaactgtttggccatctgactagcgctcgtcgggcaaggaaaagtgaagtgccccactttaggttaaagaaggttcagaacatcaagatgtggttgtctctacgaagttacctgaaaagaagagggcctcagcgatccgtggatgtgattgtttcatcggcctttctcttaaccatctccgtcgtctttatttgttgcgcgcaaattaacctttacttgaaaatggagaagaagcctaacaaaaaggaggagttgactttggtgaataatgttctcaagcttgccacaaaactcttaaaggagctcgacagtccgtttcggctgtacgggctgacaatgaatcccctgctttacaatattactcaagtggttatattaagcgccgtttcaggcgttatatccgacctccttggcttcaacctcaagctgtggaaaatcaagtcatag

SEQ ID NO: 53265 - DNA, 2244 bp, Artificial Sequence
  Description of Artificial Sequence: Synthetic coding sequence
atggcttcgaaggtcaccgacgcgatcgtgtggtatcagaaaaaaataggcgcatacgaccagcaaatttgggagaagagcgtagaacagcgggagatcaaaggtttacgtaataagcccaagaagactgcccacgtgaagccagacctgatagacgtcgaccttgttcgcggtagtgccttcgccaaggccaagccggaatccccgtggaccagtctcactcggaagggcattgtgagggtcgtctttttccccttcttctttaggtggtggcttcaggtgacatccaaggtaatttttttctggctccttgtcctgtatttgttgcaggttgctgccatcgtattattctgcagcacaagtagccctcactccattcctctgacagaagtgattggcccaatctggctgatgttactgctgggtaccgtgcattgtcaaatcgttagcacacgaacccctaaacctcctctgtctaccgggggaaaacggcgaaggaaactaaggaaggcggcacacttggaggtccatagggaaggcgacggttcttcgactactgataatactcaggaaggtgctgtgcagaaccacggaacgtctacgagtcacagcgtggggacagtgtttcgggatctgtggcatgctgcctttttcctttcaggttctaagaaggccaaaaacagcatcgataaatccactgaaactgacaatggatatgtgtccctggacggtaaaaaaaccgtgaagtcaggtgaggacgggatccagaatcatgagccacaatgcgagaccatccggcctgaggagacagcctggaataccggtacactgcgaaacggtcccagtaaggacacacagcgcactattacaaacgtctcagatgaggtctcctcggaagaaggccctgaaacagggtatagcctccgaagacatgtcgatcgcaccagcgagggggtgctgcgcaaccgcaagagccatcattacaagaagcattaccccaacgaagacgcccctaaatcaggcacttcttgcagcagccgctgcagctccagccgccaggacagtgagtccgctagacctgagtctgaaaccgaggacgtgctgtgggaggatctcctccactgtgccgagtgccattcctcctgcacatctgaaactgacgtagagaaccaccagatcaatccatgtgtcaaaaaggagtaccgtgatgacccatttcatcagagccatttaccatggttgcactccagccatcccggactggagaaaataagcgctattgtgtgggagggaaatgactgcaaaaaagctgacatgtccgttttggagatttcagggatgatcatgaacagagtgaacagccatattcctggcatcggctaccagatctttgggaatgctgtgtctctgatcctggggttgacaccgttcgttttccgcttaagccaagctaccgacctggagcagctgactgcccatagtgcctcagaactgtatgtgatagcattcggttcgaatgaagatgttattgttctgtcaatggttatcatttcatttgttgtaagggtgtcccttgtctggatattcttctttttactgtgcgtggcagagcgaacctacaagcagaggctgctgtttgcaaaacttttcggccacctcacatctgcccgacgagcccgaaaatcagaagtcccccattttagactgaagaaggtccagaacattaaaatgtggctctcgttgcggagttacctgaagcgaaggggacctcagaggagcgtggatgtgatcgtatctagcgctttcctgctaactatttctgttgtttttatctgttgcgcgcagctgcttcatgttcatgagatctttctggactgtcactacaactgggagcttgtgatatggtgcatctccctcaccctcttcctcctgaggtttgtaacgctcggctctgagacaagtaagaaatactccaacaccagcatactgctcactgaacagataaatctttacctaaagatggagaaaaagccgaacaagaaggaggaactgaccttggtgaataacgtattgaagctggccacaaaattactcaaagaattagacagtccatttcgtttgtacggcctcactatgaacccactcctgtataacattacccaggtggtaatcctgtcagccgtgagcggcgtcatcagtgacctgttaggtttcaacctaaagctgtggaagattaagtcatag

SEQ ID NO: 53266 - DNA, 2256 bp, Artificial Sequence
  Description of Artificial Sequence: Synthetic coding sequence
atggcctccaaggttaccgatgcaatcgtgtggtaccagaaaaaaatcggagcctacgaccagcagatctgggagaaatcggtcgagcagagggagattaagtttatcaaacttggattaagaaataaacccaagaagaccgcacacgttaagccggacctgatcgacgtggacctcgtacgcggatccgcatttgccaaggctaagcctgaaagtccgtggactagcttgactagaaagggtatagtccgcgtggtttttttccccttttttttccgatggtggttacaggtcacctcaaaagtgattttcttctggctgctcgtactgtacctgttacaagtggctgccattgtgctgttctgttccacgagctccccccattctattcctctgactgaggtgatcgggccaatctggcttatgctcctgctggggaccgtgcactgccagattgtgtccacccgcactccaaagcctcctctgtccacagggggtaaaaggaggaggaagctgcgcaaggccgcacatctcgaggtgcacagagaaggtgatggatcttctactacagacaatactcaagaaggtgccgtgcagaaccacggcacctcaacctcccacagtgtcggaaccgtttttcgcgatctttggcatgctgcgttttttttaagcggcagcaagaaagccaaaaacagcatcgataagtccaccgagaccgataacggatatgtgtccctcgatggaaagaagaccgtcaagtcaggcgaggatggaatccagaaccacgaaccacaatgcgaaaccattcgccctgaagagactgcatggaataccggaaccctgcggaacggccctagcaaggatacccagaggactatcactaacgtttccgatgaggtctccagcgaagaggggccagagactgggtattcactacggcgacatgtcgatcgcacaagcgaaggagtattgcgaaaccgcaagtcacaccactacaagaaacattaccccaatgaagatgcgcctaagtccgggacctcttgcagctccaggtgctcctcgtcaaggcaggattccgagtccgccagaccagagtcagagaccgaggatgtcttgtgggaggatctgctacactgtgccgagtgccacagttcttgtacatcagagacggacgtcgagaaccatcagatcaatccctgcgtgaagaaagaataccgggatgatcccttccaccaatcccatctgccatggctgcactcctctcaccctgggcttgagaagatcagtgccatagtgtgggagggaaatgactgcaagaaggcggatatgtccgtgctcgagatttcgggaatgattatgaaccgtgtaaacagtcacatccctggcatcggctatcagattttcgggaacgcggtcagcttaatactgggtctgactcccttcgtctttaggttgagtcaggccacggatctggagcagttgacggcccacagcgcatctgagctctacgtaattgcctttgggagcaacgaggatgttatcgtgctctcaatggtgatcattagttttgtggtgcgagtgtcgttggtatggattttcttctttcttctctgcgttgccgaacggacatacaagcaacgcttactatttgccaagctcttcggacatctgacttcagctaggagagcgagaaaatctgaggttccccatttccgattgaaaaaagtgcagaacattaagatgtggctgagcttgagatcatatctgaagaggagggggccacagcgatccgtggatgtgattgtgtcaagtgctttccttctcaccataagcgtcgtgtttatctgctgcgcgcagttacttcacgttcatgaaatcttcctggactgccactacaattgggagctcgtgatctggtgcatatccctgactctgtttctgctgcgctttgtaactctcggatccgagacctctaaaaaatactctaacacgagcattctgctgacagagcagatcaatctgtacctcaaaatggagaagaagccaaataagaaggaagaactaacgttagttaataacgtgctcaagctcgctaccaaactgttgaaggaactggactcaccgttcaggctctatggattaacaatgaaccccctcctctataacatcactcaggtcgttatcctgtcagccgtttccggagtgatctcagatctgctcgggttcaacttgaaactgtggaaaatcaaaagttag

SEQ ID NO: 53267 - DNA, 2256 bp, Artificial Sequence
  Description of Artificial Sequence: Synthetic coding sequence
atggctagcaaggtcacagatgccattgtctggtaccagaagaagattggcgcttacgaccagcaaatatgggagaagtccgtcgaacaaagggaaatcaaattcatcaaactcggacttcgcaacaaacctaaaaagaccgcccacgtgaaacccgatttgatcgacgtggacctggtcaggggcagcgcatttgccaaggcgaaacccgagagcccctggacgtccctgaccaggaaagggattgtgcgggtggtattttttcctttcttctttcgctggtggctacaggtcactagtaaagtgatctttttctggttgcttgtgctctatctgcttcaggtggctgctatagtactcttttgcagtacttccagcccacacagtattccccttaccgaagtaattggacccatttggctgatgctcctgttgggtaccgttcactgccagatagtgagtactaggacaccgaagccacctttgagcaccggcggaaagcggagaagaaagctgaggaaagccgctcacctggaagttcatcgggagggagatggcagttccaccaccgataatacccaggaaggagctgtacaaaatcacggcacctccaccagtcattcagtcggcaccgttttccgggacctgtggcacgctgcattcttcttgtctgggagcaagaaagccaagaacagtatcgataaatctactgagaccgacaatggctacgtttcgctggacggtaagaagacagttaaatccggcgaggacgggattcagaatcacgagccacaatgtgagacaataaggcctgaggagaccgcatggaataccgggacccttcgcaacggtccaagcaaagatacacagagaaccattacgaacgtatccgatgaggtaagcagcgaagaaggtcctgagacaggatactcacttcgtcgccatgtggaccgcacctcggaaggggtgctccgaaatcgaaaaagccaccactataagaagcattatcctaacgaggacgcgcctaaatcaggcacttcctgctcgtcccggtgttcgtctagcaggcaggatagcgagtcggcaagacccgaatctgaaactgaggatgtattatgggaagacctattgcactgtgcagaatgccattcgtcgtgcacaagtgagactgatgtggaaaatcatcagattaacccatgcgttaagaaggaatatcgcgatgatccctttcatcaaagtcacttgccatggttgcacagcagccaccccggactggaaaagatttccgctatcgtttgggaagggaacgattgcaagaaagccgatatgtccgtcctagaaataagtggaatgattatgaaccgtgtgaactcacacattcccggaattggataccaaatttttggcaatgcagtgagcctcatactggggctgactccatttgtcttccggctgtcccaggcaactgatctggagcagctgaccgcccacagcgcctctgaactctatgtgatcgcgtttggctccaatgaagacgtgattgtcctctctatggttattatcagttttgtggtgagagtttccctggtctggatttttttctttctgttatgcgtggccgaaagaacatacaagcaaagactgctgttcgcaaaacttttcggtcatctgacatctgctcgccgagccaggaagtccgaggtcccacatttccgcctcaagaaagtccagaacataaagatgtggttgtcactgcgatcataccttaagaggcgcggaccccagcgatccgttgatgtgatcgtttcttccgccttcctgctcaccatctcagtggtctttatatgctgcgcccagctgctgcacgtgcacgagattttcctggactgtcactataactgggagctagtgatctggtgtatcagcctcaccctgtttttgctccggtttgtgacgcttggaagcgagactagcaagaagtactctaacacatctattctcctcactgagcaaatcaacctctatctgaagatggagaaaaagccaaataaaaaggaggagctgactctggtcaataacgtgcttaagctggcaacaaagctgctgaaagaactcgattcgccttttagactgtacggcctgacaatgaatcctcttctgtacaacatcacacaggtggtcatcctcagcgcagtgtccggcgtgatctccgatttgctggggttcaatctgaaactgtggaagatcaagtcctag

SEQ ID NO: 53268 - DNA, 2256 bp, Artificial Sequence
  Description of Artificial Sequence: Synthetic coding sequence
atggcgagcaaggtcacagatgctatagtgtggtaccaaaagaaaatcggtgcctatgaccagcagatctgggagaagtccgtggagcagcgagagattaagtttataaaatatggcctcagaaacaaaccgaagaaaacggcacatgtgaagcctgatcttattgacgtggacttggttcgtggcagcgctttcgccaaggctaaaccagagtcaccctggacctcattgactagaaagggaatcgtgcgtgtcgtgttcttcccgttcttttttcggtggtggctgcaagtgacgtccaaagtgatcttcttctggttattggttctgtatctgctgcaggtggcagcaattgtgctgttctgctctacgagctccccacattccatcccgttaacggaggtgatagggccaatctggctaatgttactcctggggactgtacactgccagattgttagcacaagaacacccaagccccctttatccaccggtggcaaaagaaggcgaaagctgcggaaagccgcacatctggaagtacacagggagggcgatggcagctctacaaccgacaatacccaggagggagctgtccagaatcacggaacttctactagtcatagcgtcgggaccgtgttcagagacctgtggcatgcagccttcttcctttcgggatccaaaaaggctaaaaattctatcgataagtcaacagaaactgacaacggatacgtttcacttgatgggaaaaagaccgttaaatctggagaggacggtattcagaaccacgagcctcagtgtgaaacaatcagaccagaagagacagcttggaacacgggcacacttcgaaatggaccgtcaaaggatacacagaggaccattactaacgttagcgatgaggtctctagtgaagaaggaccggagaccggatattccctgaggaggcacgtggacaggacctcagaaggagtgctgcggaataggaagagccaccattataaaaagcattacccgaatgaggatgcccctaagtccggcacctcgtgcagctcacggtgctctagtagtcgccaggactctgaatctgcccgtcctgagtccgaaacagaagacgtgctctgggaggatctcttacactgtgccgagtgccacagttcttgcacatctgagactgatgtggaaaatcatcagattaatccatgtgtgaagaaggagtacagagacgatccctttcaccagtcacaccttccttggttacactcctcccatcctggattggagaaaatttcggctattgtatgggaaggaaacgactgcaagaaagccgacatgtccgtgctagagattagcggaatgataatgaaccgagtcaactcccacatccccggaataggataccaaatctttggtaatgctgtttcgttaatactgggtttaactccatttgtgttccgactgtctcaagccactgaccttgaacagctcactgcccacagcgcatctgagctctatgtgatcgcttttggctccaatgaggatgtgatcgttcttagcatggtcataatatcctttgttgtccgtgtgtccctcgtatggattttcttcttcctgctgtgcgtggcagaaaggacatataaacagcgcctgctcttcgcgaagctgttcggacatctgacttccgccagacgtgcccgaaagtctgaggtgccccacttcagactcaagaaagtgcagaatataaaaatgtggctctcgctcaggtcttacctgaagagacgcggtcctcaacgttcggtagacgtcattgtgtcgtccgctttccttcttacaatctcagtggtgtttatatgttgtgcgcagctgttacacgtgcacgagatctttctcgactgtcattataactgggagctggttatctggtgcatcagtcttactctcttcttgctgaggttcgtgacactgggttcagaaaccagcaaaaagtacagtaatacaagcatcctactcactgaacagattaatctgtatctcaagatggagaaaaagcctaacaaaaaagaagaactcacacttgtgaataatgtgctcaagttggcaactaagttactgaaggagctcgactcgccgttcagactctacggattaacaatgaaccctttactatataacatcacccaggtggttattttatctgccgtgtccggcgtgatctctgatctcctcggcttcaatctgaagctgtggaagatcaagtcgtag

SEQ ID NO: 53269 - DNA, 1059 bp, Artificial Sequence
  Description of Artificial Sequence: Synthetic coding sequence
atggctagcaaggtgactgacgctatcgtgtggtatcaaaaaaaaattggggcttacgatcagcagatctgggagaagtccgtggaacagcgcgaaattaaaggattgagaaataaacccaagaagaccgcccatgtgaagcccgacttgatcgatgttgacttggtgcgcggatctgctttcgcgaaggcaaaacctgagtcgccgtggacatctctcacacgcaagggaatcgtgcgggtcgtgtttttccccttcttttttcgatggtggctgcaggtgacatcgaaagtcatcttcttttggctgttggtgttgtacctgctccaggtagcagcaatcgtgcttttttgctcgacatcttctccgcactccattcccctaacggaggttatcggtcctatttggctcatgcttttactgggcactgttcactgtcagatcgtgtccaccagaacccctaaacccccactgtctacaggcggtaagcggcgtaggaaactgagaaaagccgcacacttagaggtgcatcgggagggtgacggcagctccaccaccgacaatactcaggagggtgccgtccagaaccatggaactagcaccagtcatagtgtgggcactgtctttcgtgatctgtggcacgcagctttttttctctccgggagtaaaaaggccaagaacagtatcgataagtcgactgagaccgataatggctacgtctcactggatgggaagaaaaccgtgaagtccggcgaagacggtatacaaaatcacgagcctcagtgtgaaacaattagacctgaggagacagcttggaacaccggtaccctccgaaatgggcctagcaaagatacgcaaagaactatcacaaacgtgtccgatgaggtctcttccgaagaaggccctgagactgggtattccctgcggcgtcatgtcgatcgcacttccgagggcgtgcttaggaacagaaaatcacatcactacaagaagcactaccctaatgaggtgtacactctcagcctctccgtttatatcagaatctatttcatttgttattag

SEQ ID NO: 53270 - DNA, 1071 bp, Artificial Sequence
  Description of Artificial Sequence: Synthetic coding sequence
atggcctcaaaggtgactgacgcgatcgtgtggtaccagaagaaaataggtgcctatgatcaacagatctgggagaagtcagtagaacagagggaaattaaattcattaaactcggactacgtaacaagcccaaaaaaactgcgcacgtgaagccagacctcatcgatgtcgatttggtgagaggatccgcattcgctaaggctaaacctgaatctccctggactagccttacacggaaaggcattgtacgcgtcgtgttcttccctttcttttttcggtggtggctgcaagtgacttcaaaagtgatcttcttttggctcttggtgctgtacttactccaggtggccgcaattgtgttgttctgcagtactagctccccacatagcatccctctcaccgaagtaattgggccaatttggcttatgctcctcctgggtaccgtgcattgtcaaattgtctccacaagaacaccaaaaccacccctctccactgggggaaaacggcgtcgaaagctcaggaaagcagcgcacttagaggtccatagggagggggatggctctagtaccacagacaacacgcaggagggcgctgtgcagaatcacgggaccagtacatcacacagcgtcggaaccgtcttccgagacctatggcacgccgcttttttcttgtctggcagcaagaaggccaaaaatagcatcgacaagagcacggagaccgacaacggctacgtgtccctggatggaaaaaagaccgtgaagagcggggaagatggtatccagaatcacgaaccccagtgcgagacgatccgccctgaagaaacagcgtggaataccgggactttaaggaacggcccatcaaaagacacgcagagaactatcacaaacgtatccgacgaagtgagttcagaggaggggcctgagactgggtattcactacggaggcatgtcgatcgcacatctgagggggtgttgcgtaaccgcaaatctcaccactacaagaagcactaccccaacgaagtatacaccctgagcttgtccgtctacattcggatctatttcatctgttattag

SEQ ID NO: 53271 - DNA, 1449 bp, Artificial Sequence
  Description of Artificial Sequence: Synthetic coding sequence
atggccaggaagctgtcagtgcttgaggtgttgcttatcatcttttgtttgatcgtggtcacaatcgacatattgcttctgctattagtgctggaggagacgtcagacaccagttttaccccagagtgcccggagatcccacagtcagaacgcatagattgcacacctgaccaagaagtaacagaggatatctgtcggtggcagtataagtgctgttggtcaccggtggcggacgccaatgtaccaaggtgcttttttccttggaattgggggtacgaagcatccaacggtcatacaaacacgtccacaggcttcaccgcccaactgaagagactaccctctccatctttgttcggaaacgacgttgctacaacactgttcacggcagagtatcagacaagcaataggtttcacttcaagatcactgatttcaacaatatacgttacgaagtaagccacgagaacatcaatctcgtggatggcatcgctgacgcatcgaacctcagctactacgtagaggtgactgacaagccttttagtattaaaatcatgcggacttctaatagacgggtcttgctggataccagcataggccctttgcaatttgcccagcaatatctgcaactgagcttcagattgcccagtgccaatgtatacggattgggagagcacgtccatcaacagtatcgacataatatgacatggaagacctggcctatctttacccgggacgcaacccccacagaaggaatgattaacctgtacggcgcacacacttttttcctctgtctggaggacgccagggggagcagcttcggcgttttccttatgaattcgaacgctatggaagtgacattgcagccagccccagccatcacttatcgtacgattgggggaatcctggacttttacgtattccttggaaatacaccagaacaggttgtgcaggaatatctcgaattggtggggcgacctttcttcccaccatactggtcattaggctttcagctgtctcgtcgcgattacggcggaatcaataagctgaaagaagtcgtatctcgcaaccggctggctgagatcccgtatgatgtacagtatagcgacatcgactacatggacggcaaaaaggactttacggttgacgaggtcgcatacagcggcttgccggattttgtgaaagagctacacgacaatggacaaaagtatctcatcataatgaatccgggtataagcaagaactccaactacgagccttataacaatggaagcctgaagagagtatggatactcgggagcaatggttttgccgttggggaggggtacccgggacctactgtcttccccgactacacaaatccagtatgcactgagtggtggacggatcaagtggcaaaatttcatgatcatctggagttcgacggggtttggattgttagctactatagttag

SEQ ID NO: 53272 - DNA, 1941 bp, Artificial Sequence
  Description of Artificial Sequence: Synthetic coding sequence
atgtttctatcgatttccacgcgtttacctagccaatacatttatggattcggtgagacagaacatacaacttttagacgtaacatgaattggaatacttggggcatgttcgcccatgatgaacccccagcatacaaaaaaaattcttatggtgtgcacccctactacatggccctggaggaggacgggtcagcccacggggttttgctccttaatagcaacgccatggatgttacccttcagcccacacctgccctgacttatagaactactgggggaattttggatttttatattgtattggggcctacacctgaacttgtgactcagcaatatactgaactgatcgggcgacctgcaatgattccttattgggcccttgggttccatctttcgagatacggttatcagaacgatgccgagatctccagcctgtacgatgcaatggtcgccgcacagataccctacgacgttcaacacgtggacatcgactatatgaatagaaagctggattttacgttaagcgccaacttccagaatctgagtctccttatagagcaaatgaagaagaacggaatgcggttcatcctcatccttgatccagccattagcggaaacgaaacccagtacctgccttttattagaggccaggaaaacaatgtttttattaaatggcccgatactaacgatatcgtgtggggaaaggtgtggcctgatctcccaaacgtgatcgttgatggaagccttgatcacgaaacgcaggtgaagctttaccgcgcatatgttgccttccccgacttcttcagaaacagtaccgcggcttggtggaagaaagaaattgaagagctgtatgccaacccccgtgagcctgagaagagcctcaagttcgacggcttatggatagatatgaatgaaccaagcaattttgtagacgggtcagtgaggggttgctcaaatgagatgctgaacaatcccccttatatgccctatttggagtctcgcgacaagggattgagttccaaaaccctgtgcatggaaagccagcagattctgccggattcttcccccgtcgagcattataatgtgcataatctgtacgggtggtcccaaactagaccaacctatgaggccgtacaggaagtgacagggcagaggggtgttataatcacccggtcaacattcccctcttccggacgctggggtggacaccggttaggaaataatactgccgcttgggaccagttgggcaaatctatcattggcatgatggagttctctctattcggaataccctatactggagccgacatttgcggttttttcggggacgcagagtacgaaatgtgtgttcgatggatgcagttgggggctttctatccctttagtaggaatcataacaacattggcacccgcagacaagaccccgtcgcctggaattcaactttcgaaatgcttagccggaaagtgctggaaacccgatacactctcctcccatatctgtataccttaatgcacaaagcacacgttgagggctcaaccgttgtccgacccctattgcatgagtttactgatgataggactacatgggacatagatcgtcagttcatgttgggacccgcaattctgatttcccccgtcttagagacatctacatttgagatctccgcctattttccccgagcccgttggtatgattatagcacagggacaagttcaactagcaccgggcagcgcaaaattctgaaggccccattagatcacatcaatcttcacgttaggggtggatacattcttccgtggcaggagcccgctatgaacacacactctagccggcaaaatttcatggggctgatcgtcgctctggatgacaatgggacagccgagggccaggtattctgggatgatgggcaatcgattgtgtttaataccaccgcaatgtag

SEQ ID NO: 53273 - DNA, 3381 bp, Artificial Sequence
  Description of Artificial Sequence: Synthetic coding sequence
atggtgaaactttccattgtgcttactccccaatttttgtcccacgatcaagggcagctgacgaaagagcttcaacaacacgtcaagtccgtcacatgcccttgcgaatacctgagaaaagttattaacaccttggcggatcaccaccacaggggaacagactttggaggaagcccctggctccatgtgatcattgcattcccaacctcatacaaagtggttattactctttggatcgtctatctgtgggtgagcttgctgaagacaattttctggtctcgcaatgggcatgatggcagtactgacgtgcagcagcgggcttggagatctaaccgtaggagacaggaaggcctgcggtcaatatgtatgcatactaagaagcgggtctcttctttcaggggtaacaagatagggctcaaggacgtaattacacttagacgacacgtcgagacaaaagtgcgggctaaaattcgaaaaagaaaagtgaccacaaagataaaccaccatgacaaaatcaatggaaagagaaagaccgccagaaagcagaaaatgtttcaaagagctcaggagttacggcgacgggcagaggactaccacaagtgtaaaataccccctagcgccaggaaagcattatgtaactgggtcagaatggcagcagccgagcacaggcactcttcaggtctgccttattggccttacctcacggcggagacgttaaaaaacagaatgggtcatcagcctccccctcccacgcagcagcattcgattaccgataactccttatctttaaaaaccccacccgaatgcctgctcacccctctccctcccagtgccgacgataatctcaagaccccacccgagtgtgtactcaccccgttgccaccctccgcggacgacaatctgaaaaccccccctgagtgcgttttgacaccccttccacccagtgccgacgacaatctaaagactccgcctgagtgtctgctgacacccctgccacctagtgcagatgataatctcaagacaccgcctgagtgtctgctgactcctctcccgccatccgcactcccctccgcaccccctagcgcagacgacaatctcaaaacacgagctgagtgtctgctacatccactgcctccaagtgcggatgacaatcttaaaacccctagcgagaggcagctgactcctcttccaccgagcgccccaccctctgccgatgataatatcaagaccccggctgagagactgcgtggaccgttacccccatccgccgatgacaaccttaagactccttcggaaagacaattaacgcctctcccaccatctgctccaccaagcgcggacgacaatataaagacacctgccgagcgacttaggggccctctgcccccttctgccgatgacaatctgaagacaccttctgagcgccagctgacccctttgcccccatccgcccctccttctgccgatgacaatatcaaaaccccagcagagaggctgagagggcctctgcctccatccgccgacgataatctgaagaccccatcagaacgccagctgacggctctacctccttccgcggatgacaacattaagaccccagccgagagattgcggggaccactgcctcctagcgcagacgataacctgaaaacacccagtgagcggcaactcacccctctgcctccgtcagcccctccgtctgctgacgataacataaagaccccactacccccttctgcggacgatttaaaaacgcctagcgagcggcagcttactcccctgcctccaagtgcgccaccgagcgcggatgataatataaagattccaggctttcatcaccagcctatgattatttctagacacctgccttctgtcagctccttgcctttccatccgcaactgcatcctcagcaaatgattatctcccggcaccttccctctgtctgcggaggacgttttcatcctgagcgcatgatcatcagccgtcatctgccatcagtatcttctttacccttccatccccaactgcacccccaacaaatgatcatctcgcgacacctgccatcagtatgcggcggaaggtttcacccccagcagatgataatctcaagacacctcccatccgtgagttctctgcccttccaccctcagctccacccacagcagatgatcataagtaggcacctaccttctgtgtgtggcggtcgcttccaccctcaaagaatgataatatctcgacatttgccaagcgtttcgagcctccccttccatccgcagctacacccgcaacagatgatcatctccaggcacctcccttccgtgtgcgggggaagattccacccccagcaaatgattatttctcgccacctgccctccgtctctagtctcccttttcacccacaactgcacccccagcaaatgatcatatcacgccacctccccagtgtctgcggcggacgctttcacccacaaaggatgatcatcagccggcatctgccctctgtcagtagcctcccgtttcatccacagctgcacccccagcaaatgatcatctcaagacaccttccttctgtgtgtggggaacgcctgcggggaccccttcccccttctgcagatgacaacctgaaaacaccctctgaacgacagctcactccgctcccgccaagcgctcctccttctgcagacgataatatcaagactcccgctgagagactgcgcggaccactgccgccatcagccgacgacaacctgaagacccctagcgagaggcaactcacccctctgcccccttctgcacctcctagtgccgacgataatattaagacccccgcagagcgtctgcgcggaccgttacccccttccgcagatgacaacctgaagacgccatccgaacgccagttaacgcccctgccgccatcagcccctccaagcgccgacgataatatcaaaacccctgctgaaaggctgagagggcctctcccaccgagcgccgacgataaccttaagactcctcccctggctacacaggaagctgaggctgaaaaaccccgtaaaccgaagagacagcgagctgctgagatggaacctccgcctgaaccgaaacggagaagggtcggcgatgtcgaaccctccagaaagcctaagcggaggagagccgctgacgtggaaccatcaagtcccgagcccaaaaggcgccgagtgggcgacgtggaaccatcccgaaaacctaagaggcggcgagccgcagacgtcgaaccatctagcccagaacccaagcgccgacgagtgggggacgtggaaccgtcccggaagcctaagaggaggcgcgctgcggacgtggaaccaagcctgcccgagccaaaacgccgaagacttagctag

SEQ ID NO: 53274 - DNA, 2220 bp, Artificial Sequence
  Description of Artificial Sequence: Synthetic coding sequence
atgttctgttgtctcggctacgagtggttgtcaggaggatgcaagacatggcacagcgcatgggtgataaatactctcgcagaccatcaccacagaggtactgatttcggcggaagtccctggctgcacgtaattatcgccttcccgacctcatacaaggtggtaatcacactttggattgtgtatttatgggtcagtctgttgaaaaccattttttggagtcgaaatgggcacgatggaagtaccgatgttcagcagcgagcttggagatctaataggaggaggcaagagggacttcgctctatctgtatgcacaccaaaaagcgggtgagcagctttcggggtaacaaaatcggactgaaagacgtgataaccctacggaggcacgtggaaacaaaagtgcgcgcaaaaattcggaaaagaaaggtaaccacaaagatcaaccaccacgataaaatcaacggaaaacgaaaaaccgcacgcaagcaaaagatgttccagcgtgcccaagagctgaggcgaagagccgaggattaccacaaatgcaagattccaccatcggcacgcaaagctctttgcaattgggtccgaatggcggctgccgaacataggcactccagcgggctaccctactggccatatctgacggccgagacactgaagaacaggatgggacaccagcctcccccacccacacagcaacattccatcactgacaacagcttatctctgaaaacgccccctgaatgcctcctcacacctctacctcctagcgcagacgacaacctgaagaccccaccagagtgtgtgctgacgccacttcctccttcggcggacgataacctgaaaacacccccagagtgcgtgctgacccccttgccacccagcgctgatgacaacctgaaaactccacctgaatgcctactaactcccctccctccaagtgctgatgacaatctcaagacaccccctgagtgtctgctgacccccctccccccttcggcgctgccttccgctcctccctcagccgacgataatctgaaaacccgggctgagtgcttgctgcatcccctacccccaagtgcagatgacaacttaaaaacgccctcagagcggcagttgacccctctgcctccttctgcgccaccatctgcagatgataacatcaaaacacctgctgagaggcttcgagggcctctgcctccgagtgcagacgacaatttaaaaaccccttcagagcgccaactgactccgctgcccccatctgcaccacccagtgccgatgacaacatcaaaacccccgctgagagactgcggggaccactccctccatctgccgatgataatctaaagactccctccgaaagacagctcacgcctctccccccaagcgcccctccctctgccgatgacaatattaaaactccagccgagcgcctgagaggccctctgccccctagcgcagatgacaatctgaagactccctcagagcgacagcttaccgctctaccaccaagcgctgatgataatattaagacgccagccgagcgcttaagaggtcccctgccaccgagtgccgacgataacctgaaaacgccaagcgaacggcagttgacccctctccctcctagtgctcccccatctgcagacgataacataaagactccggcagaaagattgcggggtccattgcccccatctgccgatgacaacctaaaaacaccttcagaacgacagctcacccctctccccccaagtgcacctccctccgccgatgacaacatcaagacgcccgctgagagactcaggggacccttgccccctagtgcggacgacaatttgaaaactcccccactcgcgacccaagaggccgaagccgagaagcccagaaagccaaaacgacagagggccgctgaaatggagcccccaccggaacctaaacgtagaagggtgggagacgttgagccttctcgaaagccaaaaaggaggagggccgcagacgtggaaccaagttcccccgagcccaaacggcgacgcgttggggatgttgaaccgagccggaaaccaaagcgcagaagggcagctgacgtagaaccctcgagtcctgagccaaagcggcgtagggtgggagacgtagagccatccaggaagcccaaaaggagaagagctgcagacgtggaaccttcccttccggagcccaaacgtcggaggctgagttag

SEQ ID NO: 53275 - DNA, 3402 bp, Artificial Sequence
  Description of Artificial Sequence: Synthetic coding sequence
atggtcaagctcagtatcgtcctgaccccccagtttcttagccatgaccaagggcagctaaccaaggaattgcagcagcatgttaaaagtgtcacatgtccctgtgaatatctgcgtaaagtgatcaacacccttgcagatcaccatcataggggaaccgatttcggcggtagcccatggcttcacgttattattgcattccccacctcatacaaggtggtgatcaccctgtggatcgtctatctttgggtgagcctcctgaaaacaatcttttggtcacgaaatggtcatgatggctccaccgacgtgcagcagcgagcctggagatctaatcgtcggcgacaggaaggtcttcggagcatttgcatgcatacgaaaaagcgcgtaagctcattccgcggtaataaaatcgggctcaaggatgtaatcactctgcgcaggcatgtcgagactaaagttagagccaagattagaaaacgaaaggttacaacaaagataaatcaccacgacaaaattaacggcaaaagaaagactgccagaaagcaaaaaatgttccaaagagcccaggagctgcgtagaagggcagaggattatcacaagtgcaagataccgcctagcgcgagaaaggccctctgtaattgggtccgcatggctgccgcagaacatagacactctagcggactcccttattggccatacctaacggctgaaactctcaagaaccgcatgggacatcagcctcctcctcccacccagcagcactctattaccgacaatagtctgtcactgaagactcctccagaatgtcttctgacacctctccctccgtcagccgacgacaatttaaaaactcccccagagtgcgtccttactccactgcccccttctgcagatgataatctcaaaacccccccagagtgtgttctgactcctctgcccccttccgccgacgacaatctgaaaacaccgcctgagtgcttgttgacacccctccccccatccgctgacgacaatctcaaaactcccccagaatgcttgctaacccccttaccacccagcgccctaccaagtgcaccccctagtgccgatgataacttgaaaaccagggccgaatgcttgctgcaccccctgccacccagtgcagatgataatttgaagactccaagcgaacgacagcttacacccttacccccttctgctccgccaagcgcagacgataacataaaaactcctgcagagcggctaaggggccctctcccgccatcggccgatgataacctcaagactccgtctgaaagacagctcactcccttgccaccctccgctcccccatccgccgacgacaacatcaagacgccagccgaaagactgcggggtcctttacccccttccgctgatgacaatcttaaaactccaagtgagagacagctgacccctctgccaccgagcgctcccccttctgccgacgacaacataaagacccctgccgaaaggcttcgtgggcctctccccccaagcgctgacgataaccttaaaacaccttccgaaagacagctgactgccctgccccctagtgcggacgacaacataaagactccagctgagcgactgaggggcccactgccccctagtgctgacgacaatctcaagaccccaagcgaaagacaactaacaccccttcctccttcagcaccaccctctgctgatgataatattaagaccccagcgtttcacccacagcggatgattagcaggcacctaccttccgtcagttcattgcccttccacccccagctccatccccaacaaatgataataagccgctacctgctctctgtctgtggttttagattccaccaccagccgatgatcatctcgagacacctgccatccgtgtccagccttccgttccaccctcagctccaccctcagcagatgatcatttcaaggcatctgccttctgtttgcgggggacgcttccaccccgaacgcatgatcatttctagacatctccctagcgttagtagtctcccgtttcatcctcagttgcacccacagcagatgattatctctagacacctgcctagcgtctgcggcggaagattccacccacaacagatgattatctcacgccatttgccaagcgtgtcctctttgcctttccatccccagctccatccgcaacagatgatcatctcccggcatctcccttctgtttgcggtgggcgtttccatccacagaggatgattattagccgccatctgccctctgtgtccagcctccccttccatccgcagctccatccacagcaaatgatcatttcaagacacctaccatcagtttgcggcggacggtttcaccctcagcagatgatcatctctaggcatcttcctagcgtgtccagcctcccattccatcctcagcttcacccacagcagatgatcatctcacgccacctcccctcggtttgtggagggaggtttcatccacagagaatgattatcagtcggcatttgccgagtgttagttcattgcctttccatccacaattacacccccagcaaatgatcataagtagacacctgccctccgtctgtggtgagcgccttcggggaccactcccccctagtgcagacgataatctcaaaacaccgtctgaaagacagctcacaccgcttccaccctctgcacccccttcagccgatgataacataaaaactcccgctgagcgcctgcgcggacctctgcctcctagtgcagatgataatttgaagaccccttctgagcgccaactgacaccccttcctccctccgcgccaccgtcagctgacgacaatatcaagacccctgccgagagactgcggggtccactgcctcccagtgccgacgataatttgaaaacaccctcagaacgtcagctgactcccctaccaccctcagcaccacccagcgccgacgacaatattaagacaccagcagagcggctccgcggaccactccctcctagcgcagatgataatctcaagacgcccccactagcaacgcaggaggccgaggctgagaaacctagaaaaccaaagaggcagagagccgctgagatggagccccctcctgaacccaaaagaaggagggtgggagatgtcgagccttctcggaaacctaaacgacggagggcagccgacgtggaaccatctagtccggagccgaagaggcgcagggttggcgacgtggagccctcccgaaagccaaagcgtaggcgcgcagcagatgtggaaccatccagccccgagcccaagcgaaggcgtgttggggacgtggagccctcacgcaagccaaaacggaggcgagcagctgacgtcgaaccgtctctgcccgagccaaaaaggagacgcctgagttag

SEQ ID NO: 53276 - DNA, 2037 bp, Artificial Sequence
  Description of Artificial Sequence: Synthetic coding sequence
atggtgaagctgtcaattgtactgacaccccagttcctgtctcacgaccagggccagctaactaaagaactccagcagcatgtgaagagcgtcacgtgcccctgtgagtacttgaggaaggtaatcaatacactggctgaccatcaccaccggggaactgatttcggagggagtccatggctgcatgtgataatagcattccccaccagctacaaagtagtgattacgctgtggatcgtctatctgtgggtcagcttgcttaaaaccatcttctggagccgaaatggccatgacggctccacagatgtacagcagagggcttggagatcaaaccgacgaaggcaggaggggctgaggtcgatctgcatgcacaccaaaaagagggtgagtagttttcgaggtaacaagattggacttaaggatgtgataacgctcagacgccacgtggagactaaggtgagggccaaaatccgcaaaaggaaggtaactaccaagattaatcatcatgacaagataaatggcaaacgcaagaccgcgcgaaagcagaagatgtttcagcgggctcaggaattaagacgtagagcagaggactatcacaagtgcaagataccacccagtgcgcgaaaggcactatgcaactgggtcagaatggccgcagcagagcacaggcactcttccggactcccctattggccctatctcaccgcggaaacattgaaaaatcgcatgggacatcagcctccacctcccactcagcagcacagcattaccgacaattccctttccttgaagacaccccctgagtgtttattgacaccattgccgccttctgcggatgataatcttaaaaccccgcctgagtgcgtactgacccccctgcccccatctgccgatgacaacctgaaaacaccaccagagtgtgtgttgaccccactgccccctagtgccgatgataacctgaagaccccccctgaatgtctcctcaccccgctcccacccagcgctgacgataacctcaaaaccccacccgagtgcctgctcactccactgccacctagcgcactcccttcggcaccacctagcgccgatgacaatcttaagacaagagctgagtgcttgttacaccctctgcccccatctgccgacgataatttaaaaacccccagcgagaggcagcttacccctctacccccttccgcgcctccgagtgctgacgataacatcaaaactcccgctgaacggcttcgaggtcctctccctcccagcgccgatgataatcttaaaactccaagcgagcgccagctcactcccctccccccatcagccccaccatcagccgatgacaatatcaaaactcctgcagagagacttagagggcctctgcccccttcagctgacgacaatctgaagacccctagcgaacgacagctcacgcccctgcccccttcggcacccccttctgcagacgataacataaaaaccccagcggaacggcttagaggtccgctgccccctagcgccgacgataaccttaagacaccgtcagaacgccaacttaccccacttccacccagtgccccaccatccgcagacgataatataaagacacccgctgaaaggttgcggggaccactgccaccatcagctgacgacaacttgaaaacgcccccactcgccactcaagaagctgaggcggaaaaaccgagaaaaccgaagcggcagagggccgctgagatggaaccacctcccgagcccaagcgacgcagagtcggggacgtagagccatctagaaagccgaagcgccgacgagccgctgacgtagagccttcttctccagagccaaaacggaggagggtgggcgatgtagaaccttcacgaaaacctaagaggcggagagccgctgatgttgaaccttcttcacccgagccaaagcgccgaagggttggagatgtagagccgagtaggaagcctaaacggaggagagctgcagatgtcgagccatccctcccagaaccaaaacgcaggcgtctcagttag

SEQ ID NO: 53277 - DNA, 2547 bp, Artificial Sequence
  Description of Artificial Sequence: Synthetic coding sequence
atggtgaaactgagtatagtactgacccctcagttcctgtcccacgaccagggccagctcacaaaggagctgcagcaacacgtgaagtctgtgacatgcccgtgcgagtatttacggaaggttatcaacacactagctgatcatcatcaccgtggcacagattttggcggatctccttggttacatgtgatcattgctttcccaacttcgtacaaagtcgttattactctttggatcgtctatctctgggtgtcccttctcaaaactattttctggtcaaggaacgggcacgacggcagcactgacgtacagcagcgtgcatggagatccaaccgacggagacaggaaggattgcgctcaatctgcatgcacactaaaaaacgcgtgtcaagctttaggggaaataagattggtctcaaggacgtgatcacactgcggaggcatgtggagaccaaagtacgggcaaagatccgtaaaagaaaagtaaccaccaaaattaaccatcacgacaagattaacggaaagcggaaaacggccagaaaacagaaaatgttccagagagcccaggaactgcgtcgcagagcagaggactatcacaagtgcaagattccaccctcagcccgaaaggcactttgcaattgggtcagaatggctgccgctgagcaccggcacagcagcggcctgccgtactggccatatctaactgctgagaccttaaaaaaccgtatgggacatcaacccccaccccctactcagcagcactcaatcaccgacaactctctctccctgaagactcctccagagtgtcttctgactccactgccccctagtgccgacgacaacctcaaaaccccccctgagtgtgttctcacccctttaccacccagcgctgacgataacctcaaaacccccccagaatgcctgctgacgcctctgccaccatcagctcttccttctgctccaccctcagcagacgacaacttaaagactagagccgagtgtctgctgcatccgctaccgccaagcgccgacgataacttaaaaacgccctccgagcgacagttaacccccctgccgccttcagccccaccctccgccgacgacaatatcaaaactccagcctttcacccacagcgcatgattatctccaggcacctgcctagtgtgagctctctcccctttcacccccagctgcacccacagcagatgatcattagccggcatttgcccagcgtatgcggaggaagattccatcctgaacgcatgataatttccaggcacctgccaagtgtgtccagcctgccatttcatccacaactgcatccgcagcaaatgattatttcccgccacctgccaagcgtgtgtggcggaaggtttcatccccagcaaatgattatttcccgccacctgcctagcgtttccagcctaccctttcaccctcagttacatccccagcaaatgattattagccggcatctgccgagtgtctgcggaggcagatttcaccctcaacggatgatcatcagccggcatctacctagcgtctcctccctgccctttcacccccagctccacccacagcaaatgattatctcacggcacctgccgagcgtctgtggcggtcgcttccacccccagcagatgatcatttccaggcacctgccctcggtctcctccctccccttccatccccaacttcaccctcagcagatgatcatctcacggcatctaccatcagtctgcggaggtagattccaccctcagcgaatgataatatctcgacacctgccatcggtgtctagcctaccattccatccccagctgcatcctcagcagatgataattagccgacatttgccatccgtgtgtggagagaggctgaggggcccattaccacctagtgccgacgataacttgaaaactccttctgagaggcagctgacccccctgcctccatccgccccaccgagcgcagatgacaacatcaaaacccctgccgagcgcttgcggggtcccctccccccttccgcagatgataacctgaaaacccctagcgaaaggcagcttacaccattgcctcccagtgcgcctccatctgcggatgacaacattaagacccccgctgagagactgcgcggacccttgccccctagtgccgatgataatcttaaaacaccacccctggccactcaggaggccgaagcagagaagccacgaaagcccaaacgtcagcgtgcagctgaaatggagcccccaccggagccaaagagaagacgtgtcggcgatgtggaaccaagccggaagccaaaacgcaggcgtgctgctgacgtggagccatcatcccccgaaccaaagcgcaggcgcgtgggggacgtcgaaccttccagaaagcctaagcggaggcgggctgcggatgtggagccaagcagcccagagccaaagcgcagacgcgtcggagatgtggaaccctctagaaaaccaaaacggaggcgtgccgcagacgtggagccctcactcccagagccaaagaggaggcgcttgtcctag

SEQ ID NO: 53278 - DNA, 3033 bp, Artificial Sequence
  Description of Artificial Sequence: Synthetic coding sequence
atgcacacaaagaagagggtgagctctttcaggggcaataaaatcggcctgaaggacgtgatcactctcagaaggcatgtggagacaaaagtccgggctaaaatccgcaaaaggaaggtcacgactaagatcaatcaccacgataaaatcaatggaaagcgcaaaaccgccagaaaacagaagatgttccagcgagcgcaggagctgaggcgcagggcggaggactatcacaaatgtaagattcctccgtctgccagaaaggcactgtgtaactgggtgcgcatggccgctgcggaacacaggcacagttctggactaccatactggccttatctgaccgccgaaaccctgaagaaccgaatgggccaccagccccctcctcccactcagcaacactccatcacggacaacagcctgtcactgaagaccccgccagagtgtctgctgaccccactccccccatcagcagacgacaacctgaaaaccccccctgagtgcgtgttaaccccactccccccatctgcggacgacaacctgaaaactccccctgagtgcgtgctgactccacttccgccttccgccgacgataacctgaaaacaccacctgaatgcctgctgacccctcttcccccaagcgctgatgataaccttaagacaccaccagagtgtttacttacgcctttgccaccctctgcactgccttcagctcccccatctgcggatgataacctcaaaacacgtgcagaatgcctcctccacccactcccgcctagcgctgatgataatttgaagactccttcagagagacagcttacccctcttcctcccagtgcacccccatcagcggacgataacatcaaaactcctgcggagcgccttcggggacctttgccccctagtgccgacgataatctgaagacgccctccgaacggcagctcacacctctgccaccctccgcgccaccgtcagcggacgataatatcaagacaccggcagaacggttgcggggtccactgcccccaagtgcagatgacaatcttaaaacccctagtgagcggcaattgacgccactccctccatccgcccctccaagcgctgatgataatatcaagacaccagccgaaaggctcagaggtcccctgcccccatctgctgacgacaatctcaagacaccctcggaaagacagctgacggctctgcccccttcagcggatgacaacatcaaaaccccagcggagcggttaagagggcctctgccacctagtgcggacgataacctgaaaacaccaagcgagcgccagttaacacccctacctccttccgctccaccctccgcagatgataatataaagacccctgctttccaccctcagaggatgatatccaggcacctcccctcggtctcctccctgcccttccatcctcagctccaccctcagcagatgataatcagtcgttatctcctgagtgtttgcggtttccggtttcaccaccaaccaatgattattagtcgccatttgccttccgtgtcttccctcccttttcacccacaattacaccctcagcagatgatcatcagccgccacctcccctccgtgtgcggaggacggttccacccggagaggatgattatctcgagacatcttccctctgtgtcttccctcccattccacccccagctgcatccacagcagatgatcatctcgaggcatctgccctcagtgtgcggaggacgcttccacccacagcagatgattatcagcaggcaccttccatccgtgtccagtctccctttccatccccagttgcacccccagcagatgattatttctaggcaccttcccagcgtttgcgggggacgattccacccccagaggatgatcatttcacgccatctcccttcggtgtcctccctgcctttccatccgcagttgcatccacagcagatgatcatttccagacacctgccctccgtgtgtggaggcaggtttcaccctcaacagatgatcattagccggcatttgccttccgtgtccagcctccctttccaccctcagttacatcctcaacaaatgatcattagtaggcatctccccagtgtgtgcggaccactccccccttcagcagatgataatctcaagacgccgagtgaaagacaattgactccatttccaccctccgcaccgccaagtgcagacgataatattaagacccctgccgagcgcttgcgagagcgcttgcgcggaccacttcctccaagcgcagacgataatctgaagactccctctgagaggcagcttacaccgctccccccaagcgctcccccttccgcggatgacaacataaagactccagccgaaagactgagagggccattaccaccctcggcagatgacaatcttaagactccgtccgaacggcaactgaccccactgcctccctcagccccacccagtgccgacgacaacattaagaccccggctgaacgtttacggggtcctctgcccccaagcgccgatgataatcttaagaccccctccgagcgccagctcacccctctgccgcctagtgctccaccttcagccgacgataacatcaaaacacccgcagagcggctacgcggtcccttacctccctccgccgacgataatctgaagacacctccccttgccacacaggaagccgaagctgagaaacccagaaagccaaagagacagcgagcagccgaaatggagcctcctccagagccaaagcgcaggcgggtgggggacgtggagccctcccggaaacccaaacggaggcgcgctgctgatgtggaaccttccagtccagagccaaagagaagacgggtaggcgatgtggagccctcgcggaaacccaagcgtagacgggcagctgacgttgaacctagtagccctgaaccgaagagacgtcgagtgggcgacgtggaacccagtagaaagcccaaacgacgcagggccgctgacgtggaaccaagcctgcctgaacccaaaagacggaggttatcttag

SEQ ID NO: 53279 - DNA, 3402 bp, Artificial Sequence
  Description of Artificial Sequence: Synthetic coding sequence
atggtgaaactgtctatagtgctgaccccgcaattcttgtcccacgaccaggggcagctaacaaaggagttacaacagcatgttaagtcagtaacgtgcccatgcgaatacttgcgcaaggtcattaacaccctggccgatcaccaccaccggggtaccgactttggtgggtcaccatggttgcatgttatcatagctttcccaacgagctataaggtagtcataaccctgtggattgtatacctctgggtttcactcctgaagactattttttggtcgcgcaacggccacgatgggagtactgacgtgcagcagagggcctggaggtccaatcggaggaggcaggaaggactgcgttctatttgcatgcatactaagaagcgtgtaagctctttcagaggtaacaagatcggacttaaagacgtgattacactacgcagacatgtcgaaaccaaggttcgagcaaaaattcgtaaaagaaaggttaccactaaaatcaatcaccacgacaaaatcaacgggaaaagaaagaccgcacgcaagcagaaaatgttccaacgcgctcaagagttgcgtcgacgggctgaggactaccacaagtgtaaaataccccctagcgcacgaaaagcactctgtaattgggtgagaatggccgctgctgagcaccgacacagcagtggactcccttattggccatacctcacagccgaaacactgaagaacagaatggggcaccagccacctcccccaactcagcagcattccattacggataatagcctgtctctaaagaccccacccgagtgtctcctgaccccattacccccttcagccgatgataacctcaagacaccccctgaatgtgtcctgactcctctgccacccagcgccgatgacaacctcaagactccccctgagtgcgtgcttacgccccttcccccaagcgctgatgataacttgaaaaccccccctgagtgcctgctgaccccgctcccaccctcagctgacgacaatctaaaaacaccacccgaatgtttgctcacccccctgccaccatccgccctgcctagtgcgccaccgtccgcggatgataacctgaaaactcgagcagagtgtctgctgcaccctctgccccctagcgccgacgataatcttaaaaccccttctgagagacagttgactccactgccacccagtgctcctcccagcgcagatgataatattaagactcccgcagaaagacttcgtggaccattgcctccgtctgccgatgacaatttaaagaccccatctgaacggcagctgaccccccttccaccttctgcacccccatccgccgatgacaacatcaaaacccctgccgaaaggttgaggggcccactcccaccctcagctgatgacaatctaaaaactccatccgagaggcagctgaccccgctaccccctagtgccccacccagtgctgatgacaacatcaagacccctgcagagcgtttaaggggccctctccctccatcagctgatgataacctgaaaaccccgtcggaaaggcaactaacagccctgcctccctccgccgacgataacatcaagacccctgcagagcggcttcgaggccctctgccaccatccgctgatgacaatttgaaaactccctcggagcggcagctcacccctctgccaccatccgccccaccgagcgcggacgataatattaagacccccgctttccatccccagcggatgattagccggcatctcccttccgtgtcatctcttcccttccatccacagttgcatccccaacaaatgatcatctctagatacctcctgagcgtgtgcggctttcgcttccaccaccagccgatgataatttcacgccatctcccgtcagtatcatccctgccattccatcctcaactgcatccgcaacagatgattatttccaggcacttgccgagtgtgtgtggtggcagattccaccccgaaaggatgatcattagcaggcacctgccatctgtgtctagtctgccctttcatccacagctgcacccacagcagatgattattagccggcatctcccttccgtgtgcggcggtcggtttcatccccaacagatgattatttcccggcatttgccttctgtctcaagtttacccttccacccacaactgcacccacaacagatgattattagccgccacctgcccagcgtctgtgggggacggttccacccccaaaggatgatcatcagcagacaccttccttcagtgtcttccctccccttccacccccagttgcaccctcagcagatgatcattagcagacatctgcccagcgtttgcggcggtcggtttcacccccagcagatgatcatcagcagacatttgcctagcgtgagttctctgccttttcaccctcagctccacccccagcagatgatcataagcaggcacctacctagcgtgtgtgggggtagattccatccccagcggatgataattagtaggcacctgcccagcgtgtctagcctgccgttccatcctcaactccacccacaacagatgatcattagccgacaccttccgtcggtgtgcggtgagagactacgtggccctttgccgcctagcgcagatgataacttgaagacacctagcgaacgtcagctgacccccctgccgccttccgctcctccatctgccgatgataatatcaagacccccgcagaaaggttgcggggtccgctgcctcccagtgcagatgacaacctgaagactccttcagagaggcaactaacccccctgccaccctcagcacctccctctgctgacgacaacatcaagacgcctgctgaacggctgcggggaccactgcccccttccgccgatgacaatttgaaaaccccttctgagagacagctgactccgctgcctcctagcgcccctccatctgctgatgacaacatcaaaactcccgcagaaagactacgcggaccgctgcctccgtccgccgacgataacctgaagaccccaccattagccacccaggaagccgaagctgaaaagcctagaaagcctaagaggcagcgggctgcagaaatggagccccctcccgagcctaagaggagaagagtgggggatgtggaaccaagtaggaagccaaaaagacgaagagcggctgacgttgagcctagctcaccagaacccaaaagaagacgtgtgggcgacgtggagcccagccgcaaacccaaaaggaggcgtgctgccgatgtggagccaagctccccagaacctaagagacggagggtgggtgatgtagagccaagccggaagcctaagagacggcgtgcagcggatgtggagccctctctgccggaacctaagaggaggcgcttgagttag

SEQ ID NO: 53280 - DNA, 708 bp, Artificial Sequence
  Description of Artificial Sequence: Synthetic coding sequence
atgcccaaaggcagggccggaagtctgccaaccaccagtatcggctggagatttcagctctggttcctgggcctcacatgccccgagcgtcatcttgctagacgactgaaaaataactcgttttaccccttcgttcagcaggagccgaatgtgtttgtcctcgagtactatctggatacgctttggaaaggtatgttactcttcattatcagcgtggtgcttgtgtccttcagcagcctccgcgaagtgcagaaacaggagacttgggtttttcttgtgtacggcgtcggcgttggcctgtggctcgtgatatcttctctgcccagaaggaggctcgtgttaaaccacactcgaggcgtgtatcacttttccattcaaggacgaacggtctgccaggggcctctccacctcgtatatgtcaggctcgccctgtcttcggatgcccatggcaggtgcttctttcacttggtcctcgggggtcaccggctggaaccgctggtactagtgcagctctcagagcactatgagcagatggaatatcttggccgatacattgcacgtaagttaaacattaactactttgattacctggccacctcttacaggcacgtggttcgacattggcctcctcccggagccggtacagttatgggtaaaagccccatgggccacaagccctccagctcacagtcttccctggaagtgtag

SEQ ID NO: 53281 - DNA, 708 bp, Artificial Sequence
  Description of Artificial Sequence: Synthetic coding sequence
atgcctaagggtcgtgctgggtcactgcccacgacctccattggctggagatttcagctctggttcctgggactgacttgtcctgaacgccatctcgcaaggcgcctgaagaataatagcttctaccccttcgtacagcaagagcccaatgtgttcgtgctggagtattacctggacaccctgtggaagggaatgctactgttcatcatttctgtggtcctggtgtcattttcttcactacgtgaagttcaaaagcaggaaacttgggtgtttctggtatatggggtgggtgtgggcctatggttagtaatctcctctcttccgcgtcgcaggttagtactgaatcacactcggggagtctaccacttttctatccaaggtcgaaccgtttgccaaggccctctgcatttggtttacgtgaggctggcgctgtcctctgacgcccacggtcgctgtttcttccatcttgtgctgggcggtcatagactggagcccctagttttggtacagctgtctgagcactatgagcagatggagtatctgggtcgctacatcgcccgaaaactgaatatcaattattttgattacttagcaacgtcctatcgccacgtcgtgcggcactggcctccgccaggagccggaaccgttatggggaagagtcccatgggccataagcctagcagctctcagagttcattagaggtatag

SEQ ID NO: 53282 - DNA, 180 bp, Artificial Sequence
  Description of Artificial Sequence: Synthetic coding sequence
atgacatccgttagcacgcagctttctctggtgctaatgtctctcctcctggtcctccccgttgtggaggccgtcgaggctggggacgccattgctctgctgctcggtgtcgtcttgtccatcaccggaatctgcgcttgtctcggagtttatgcaaggaaacggaatggacagatgtag

SEQ ID NO: 53283 - DNA, 180 bp, Artificial Sequence
  Description of Artificial Sequence: Synthetic coding sequence
atgactagtgtgtccacacaactgagtctggtcctgatgtcactgcttctggtactgcctgtggtggaagctgtggaggccggagatgcaatcgccctactgctcggcgtagtgctctcaatcacgggaatctgcgcatgcctgggggtctacgctcgaaagcgcaacggacagatgtag

SEQ ID NO: 53284 - DNA, 180 bp, Artificial Sequence
  Description of Artificial Sequence: Synthetic coding sequence
atgaccagcgtcagcacacaactgagcctcgtgctcatgagtctgttgcttgtactccctgttgttgaggccgtggaggccggagacgccatagcccttctgctgggagtggttctgagtatcactggaatctgtgcttgcctgggcgtgtatgctcgaaaaaggaacgggcagatgtag

SEQ ID NO: 53285 - DNA, 399 bp, Artificial Sequence
  Description of Artificial Sequence: Synthetic coding sequence
atgaccggggaactggaggtcaaaaatatggacatgaagcccggtagcaccttgaaaatcacgggatcaattgctgatggcacggatggattcgtgattaatctagggcagggaaccgataagttaaatctgcacttcaacccgaggttttctgaatctacaatcgtgtgcaatagcctggacggatctaactggggccaagagcagagggaagatcatctgtgtttcagcccgggttcggaagtaaagtttactgtgacgttcgagagcgataagtttaaggttaagttaccagatgggcacgaactgactttccctaacaggctggggcacagtcatctgagctatttgtcagtgcgcggaggcttcaatatgtcatccttcaagctcaaggagtag

SEQ ID NO: 53286 - DNA, 240 bp, Artificial Sequence
  Description of Artificial Sequence: Synthetic coding sequence
atgtttgagtgtataaccgagaactttagtatcgaccctgcccgtaccttgatggtgggcgatcgcttggaaaccgatattctatttggacatcggtgcggtatgactacagtactcacgctgaccggcgtgtctcgcctcgaggaagcccaggcttacctagctgccggacagcacgatcttgtaccacattactacgtcgagagtatcgcggacctcactgaggggctcgaggactag

SEQ ID NO: 53287 - DNA, 1296 bp, Artificial Sequence
  Description of Artificial Sequence: Synthetic coding sequence
atgcaggctctgaacatcacgcctgaacaatttagtcgccttctgagagatcacaatctcacccgcgagcagtttatcgcgctgtacaggcttcggccactggtgtacactcccgagctgcctggtcgggctaaactcgccctcgtcctgacgggcgtactgatttttgcactggccctcttcgggaatgccctggtgttttacgtagtcactaggtctaaggccatgcggacagtgactaatatttttatttgctcattagccttaagcgacctgcttatcacttttttttgcatccctgtcaccatgctacaaaatattagcgacaactggctgggaggtgccttcatctgcaagatggtacctttcgtgcagtccaccgcagtcgtcactgagatcttaaccatgacgtgcattgccgtggagcgccaccaaggattagtgcatccgttcaagatgaaatggcaatacaccaaccgcagagcttttaccatgctgggagtcgtatggctagtcgccgtgatcgtcggctctcctatgtggcatgtgcaacagctagagattaagtacgatttcctgtacgaaaaagagcacatctgttgtttggaggagtggacctctccggtccaccaaaagatttacacgactttcatcctggtgattctgttccttctgccgcttatggtgatgctgattctttacagtaaaattggctatgaactgtggattaagaagcgggtcggagatggcagcgttctgaggactatccatggtaaagaaatgagcaagatagccagaaaaaaaaagagggcagtcatcatgatggtgacggtggtcgccttgtttgcggtttgctgggccccttttcacgtggtgcacatgatgattgaatattccaatttcgaaaaagaatacgatgacgtgactatcaaaatgatctttgcaatcgtgcaaatcatcggctttagcaacagtatctgtaatcctattgtgtacgccttcatgaacgaaaattttaagaagaatgtgctgagcgctgtctgttattgtattgtcaacaagacattcagcccagcgcagaggcacggtaactccggaattaccatgatgcgtaagaaggccaagttctctcttagagaaaatcccgtggaggagactaagggtgaggcttttagcgatggcaacatcgaagtcaagctgtgcgagcagaccgaggagaaaaagaagctgaaaaggcatttagcactgttcagatcagagctggcagagaactctccccttgattcgggccactag

SEQ ID NO: 53288 - DNA, 825 bp, Artificial Sequence
  Description of Artificial Sequence: Synthetic coding sequence
atggcggcttcctggcgcttagggtgtgacccacgcctactgcggtatctagttggtttcccgggacgacgtagtgtgggcctagtgaagggtgccttgggctggagcgtgtcaaggggcgctaactggagatggttccatagtacacagtggctgagaggagatccgattaagatcttaatgccgagcctgtctcctacgatggaggagggcaacatcgtgaagtggctgaagaaagagggggaagcggtctcagccggagatgccttatgcgagattgagacggacaaggccgttgttactttagatgcctccgacgatggtatacttgcgaagatcgttcagatgccagatgttaacgtctcttgggatggggagggtcccaagcagcttccttttatagacatatcagttgcagtcgccaccgataaggggctcctgacccctatcatcaaggacgctgcagcgaaaggaatccaggagatagccgatagcgtgaaggccttgtctaaaaaagccagggatgggaagctcctgcctgaggagtatcagggagggagtttcagcatttctaatttagggatgttcggcatagatgagttcaccgcagtgattaatcctccccaggcctgcattctggccgtgggacgattcaggcccgttctgaagctcaccgaagacgaagagggaaatgcgaaacttcaacaaaggcagttgattactgtgacaatgagctccgactctcgtgttgtggacgacgagctggcaacacggttcctgaagtctttcaaagccaacctcgagaaccccatcagattggcctag
